United States Patent 7,745,391 (HUMAN THROMBOSPONDIN POLYPEPTIDE) - sequence listing, part 14

SEQ ID NO: 33669 - DNA, 1716 bp, Homo sapiens
ctccataatctgtgcccatttgagtattttgttttcaattagggagatagttggtattaggattaggattgttgtgaagtatagtacggatgctacttgtccaatgatggtaaaagggcagagttatttttgatgttccccaattccccaccagccaatccaagcattttctcctgggacccgctccatgttcagggtctaagacccagaatgagtttctccagccaggtggccactttatggaaaggatgcagggtcccccagacccctcctctagcccagcagcggctggggtctggctcctttcagagacactacacttcccgtgcagactcagatgccaactcaaagtgccttagcccaggttcctgggcttctgctgccccctcaggaccccagctaacctcagaacaactaactcatgtggactcggaaggacgggcagctatggtagatgtgggcaggaagccagacacagagcgggtggctgtggcttcagccgtggtcctcctgggaccggtagccttcaagcttgtccagcagaaccagctcaagaaaggagatgccctagtggtggcccagctggctggagtccaggcagccaaggtgaccagccagctgatccctctgtgccaccacgtggccctgagccacatccaggtgcagctggagctggacagcacacgccatgccgtgaagatccaggcatcttgccgggctcggggccccaccggggtggagatggaggccctgacctctgctgcagtggccgccctcaccctgtatgacatgtgcaaggctgtcagcagggacatcgtgttggaggagatcaagctcattagcaagactggtggtcagcggggggacttccatcgggcttagcacctgcccttctcacccatggcccacccaggcctggagctgggatgcaatgtaggctgagggaaagacgtcaggttcctttaatcacagtcactgtttgtttaccttgagcagtaaacccgaagtcagcctgctctactactaacaaacaggcctgctgctagatgatctctaatgaccaatggggcttcctttctatagggaggataccagcaggcccttaagccttccaggacactaaggtcgtgggagcgggactgcaacaagcaatgccagataactgagaaatcatgttctttgtggactatttcagacaaccaggttccgacagtccagcccagaacttttccttctcattttgggttttctcttctcctgctttcctggggagagattaagcgctcattaagcagaggagcccactttgaggagagcaaagcacaagcttgcctgaagaatggatcccaacttctccccggcagctctgcctccctaagtctgtgaagccgcagccctgccctgtcctgtcctgtcctgacttcatctctccttctgcccaagtctgtgtcccatcagacttgcagcctttcagcttaacagttgcccggtcctgctggccccttttcctctggcccccctcttctgaaacaggatgtgcacacatgggccatagccctaaggactcctgccagaccacacagcccacacctggccctgttcacggctgttccacccacccctctttattctggagcatatcagggaaagaaaagttgatgatagattgccttcaccctcacagcgcacaaataaagctacgatgccaactttgca

SEQ ID NO: 33670 - DNA, 2043 bp, Homo sapiens
ctgcccctccccgcccttgctgggatgaccccgggggcgagtgcccggccagtgtgctcccgaagcgggctgcggttccgctcgtatcaggcttcatggcggcgcggccactgtcccggatgctgcggcggcttctgaggtccagcgcccggagctgcagctcaggggctccggtgacccagccctgccccggggagtccgcgcgagctgcctcggaggaggtgtccaggcggaggcagttcctgcgggagcatgcggcccccttctccgccttcctcacagacagcttcggccggcagcacagctacctgcggatctccctcacagagaagtgcaacctcagatgtcagtactgcatgcccgaggagggggtcccgctgacccccaaagccaacctgctgaccacagaggagatcctgaccctcgcccggctctttgtgaaggaaggcatcgacaagatccggctcacaggtggagagccgcttatccggccggacgtggtggacattgtggcccagctccagcggctggaagggctgagaaccataggtgttaccaccaatggcatcaacctggcccggctactgccccagcttcagaaggctggtctcagtgccatcaacatcagcctggacaccctggtgcctgccaagtttgagttcattgtccgcaggaaaggcttccacaaggtcatggagggcatccacaaggccatcgagctgggctacaaccctgtgaaggtgaactgtgtggtgatgcgaggccttaacgaggatgaactcctggactttgcggccttgactgagggcctccccctggatgtgcgcttcatagagtatatgccctttgatggcaacaagtggaacttcaagaagatggtcagctataaggagatgctagacactgtccggcagcagtggccagagctggagaaggtgccagaggaggaatccagcacagccaaggcctttaaaatccctggcttccaaggccagatcagcttcatcacatccatgtctgagcatttctgtgggacctgcaaccgcctgcgaatcacagctgatgggaacctcaaggtctgcctctttggaaactctgaggtatccctgcgggatcacctgcgagctggggcctctgagcaggagctgctgacttcatctctccttctgcccaagtctgtgtcccatcagacttgcagcctttcagcttaacagttgcccggtcctgctggccccttttcctctggcccccctcttctgaaacaggatgtgcacacatgggccatagccctaaggactcctgccagaccacacagcccacacctggccctgttcacggctgttccacccacccctctttattctggagcatatcagggaaagaaaagttgatgatagattgccttcaccctcacagcgcacaaataaagctacgatgccaactttgcagatgcaagaatgaagacactgtgtgggtagggcactgagctgctgcagtttcacagggaaggctgcacctatcaatcaatcaatcaatcctatcccaagacacagttccctgagggaagaagaggagggacctggaaaggcctaagggtgtactctctgtatagccccgctatgggaaaataaagtggagtagggggcatagaaatgcaccatctaagggaaatcttttgtcaggtggtggccaggggtgttcaaagctcattgcttgcattaccagctattagagagatcagagagggcaattaattagaggctcctggttctcacatcccaaacacacacagttctggcctgctgggctctctaacttggatgtctttgagtcctcagtggtgccccctgcctgcctcccctttgccctatgccaaggtgtgctggcaaatattaaacaaccagctctctggaaaagacaatttgtgatataaatactcccatgttgaataatttcaagctaccagtatgtcaaatggcttgcaaaatttctgaaaatgtaaacaattggttctcacagagctggtacaagctggctccagca

SEQ ID NO: 33671 - DNA, 1257 bp, Homo sapiens
ctgcccctccccgcccttgctgggatgaccccgggggcgagtgcccggccagtgtgctcccgaagcgggctgcggttccgctcgtatcaggcttcatggcggcgcggccactgtcccggatgctgcggcggcttctgaggtccagcgcccggagctgcagctcaggggctccggtgacccagccctgccccggggagtccgcgcgagctgcctcggaggaggtgtccaggcggaggcagttcctgcgggagcatgcggcccccttctccgccttcctcacagacagcttcggccggcagcacagctacctgcggatctccctcacagagaagtgcaacctcagatgtcagtactgcatgcccgaggagggggtcccgctgacccccaaagccaacctgctgaccacagaggagatcctgaccctcgcccggctctttgtgaaggaaggcatcgacaagatccggctcacaggtggagagccgcttatccggccggacgtggtggacattgtggcccagctccagcggctggaagggctgagaaccataggtgttaccaccaatggcatcaacctggcccggctactgccccagcttcagaaggctggtctcagtgccatcaacatcagcctggacaccctggtgcctgccaagtttgagttcattgtccgcaggaaaggcttccacaaggtcatggagggcatccacaaggccatcgagctgggctacaaccctgtgaaggtgaactgtgtggtgatgcgaggccttaacgaggatgaactcctggactttgcggccttgactgagggcctccccctggatgtgcgcttcatagagtatatgccctttgatggcaacaagtggaacttcaagaagatggtcagctataaggagatgctagacactgtccggcagcagtggccagagctggagaaggtgccagaggaggaatccagcacagccaaggcctttaaaatccctggcttccaaggccagatcaacttgcagcctttcagcttaacagttgcccggtcctgctggccccttttcctctggcccccctcttctgaaacaggatgtgcacacatgggccatagccctaaggactcctgccagaccacacagcccacacctggccctgttcacggctgttccacccacccctctttattctggagcatatcagggaaagaaaagttgatgatagattgccttcaccctcacagcgcacaaataaagctacgatgccaactttgca

SEQ ID NO: 33672 - DNA, 301 bp, Homo sapiens
aatctgggtgacagagcaagatttcatctagaaaaaataaaccataaataaattaattaattaaaaaaagaaaataacactcctgtttcatctggaccaataccttcttttaccttctttttctttttccttttaagttccagggtacatgtgcaggatgtgcaggatgtgcaggtttgtaacacaggtaaacgtgtgccatggtggtttgctgcacctatcaccaatacttttcttgatgggtttccacatgagaatcagtccttaagcatggaaaatgtgtctgattttcttatttggt

SEQ ID NO: 33673 - DNA, 490 bp, Homo sapiens
atttaaaatgtattcctggctttaggaaacaaaagaaaaattttaaaccctggcagttaaattattactggtctctacagggttaatttaatgtaaataatctactctcctgagggaaaaggtggaggcctggcattctggaagggccagtcaggtggtgacaaaactgtgtgccttggggttttgaggggtgtgttgggtggctctgaacctggctttgggtttgttacatctctcgctctcttaaaacagtaactcaagatgtaagtaaaagtgttttcattttttattgatcctgctaacatctttcattatccagcatgtagccacagcaaattattgctcatttgatactgagaattctattgaccatcgctttcgttggagagagaattctaactactcggctgctctgtcatcagtcagagctaaggctgaggactttccaccactaaaaccaaaataaattgagccttctgcctccagaaat

SEQ ID NO: 33674 - DNA, 408 bp, Homo sapiens
ttcccatcgtggcctgaacgagtttttcaggttaactttggaatgcccttggctgagaggaggggttcattccccacagctggggggcttagaattttatttttggtttacagtatcagttcttcttcttcttcgtatcagttcttcttcttcttcttcttcttcttctccttcttcttcttcttcttcttcttcttcttctttgtgtccagtagaatttgattatatagatagagtgcagtttgttactccattcatcagctgaaggatatttgggttgtttctattttgaagcaattagaagtaaagcagctataaatattcacatgcaggtatttgtgtgtacttatgacttcacttcccttgactaaatatttaggggcaagatgggaggtcatatgatgagtg

SEQ ID NO: 33675 - DNA, 357 bp, Homo sapiens
gactcaatgcatgaagacaattccaacactcctatgatttcatcccccatccagtttgcagcatcccttccctagccacctgcccaccaaaaaaccctagcctccaagctcctggggaggtgaatttgagaactatctcccatcatgcttctgggctgccttgtgataattaaatcttttctctgctgcaacacgcctgctgtctcagtgtattggctttatctgtgcagcaggcaagaagaacccactgtactatggcaaccatgaagtgagggtgtggggggccctgtagcaccaagcttgaatcctgtagtctttctggattgtgaggaggcacagagactcccaggggaggag

SEQ ID NO: 33676 - DNA, 287 bp, Homo sapiens
ggagttaatttggctgaagtagaaaacccagttgtctttcctatgatggatttcagttgaaagctctgttcacatattttagctttaggtgaattgcttgaaaactgtctaatggaaatctatttcaggggtcaggtgaagagaagggagagactataaacagaatccctctctgtgaatctgtcattttcctactcactttctagctgtgggggttagcccaaatcctgccctctgtatgttcaggttagtaagtctgttaatattctatttaagttacagctgtc

SEQ ID NO: 33677 - DNA, 294 bp, Homo sapiens
cattacagcacttttcacgacagcaaagacatagaatcaatcaaggtgcccatcaatggtggattggacaaggcatgtaaaatggtttcatttgtctaattagactctgaaggatacaatggatgcatttaaaacattagtcacacttctatgatagtaaatatatttcaattatttggtctatagaatacctagaaaaaatgtaatttatgataaatacactttcatcacatctttttttcctgcaaggtatttttctccataatatgacaagtatgaatcatttcacaacac

SEQ ID NO: 33678 - DNA, 197 bp, Homo sapiens
cctcctgtaggatggaagcactttgctctttggccttttgaggtcacccagctatttgaaggtcaggggcaactcgattctaatgagatcaaggtcacagggtcatgttgcccccaggaaagtgggagatggagttctgtggtccaggctgtggccctgctgcagggctgggaggtggagaggtgtggacagagaag

SEQ ID NO: 33679 - DNA, 410 bp, Homo sapiens
gctgggcagagctcggaaactgtgtctccattgctctcagctcagactgtctccattacgttaagctgcaggcccccaggcagggcccccgctgctttgtccctggctgctcctctgagccaagaacgacagtgatgccagtgtctccactgctgcaaaggttctcattttgttctgaaggacagtacccccaacgactggctgtgcgctctgtcacctatcggatgtcttccgctcagtccacactgccaggtcaagggagcaggagctgctgtgtccttggtttacaagacttgagagctcttcagtaggagggagtgtatgaaaaatacatagtaaggatgcctaaggagagtgcagaagcccagcactgagcgtcctggaaagacttcaaataaatctgcacattc

SEQ ID NO: 33680 - DNA, 704 bp, Homo sapiens
atattatatatatatgtctataacatttagacagagaagataataatatattcattttatagtttaggaaacagacttggaagggcaaataacttgtctaagatgactaagcagctgagtgagaaccacagcctatctgtggcattcagtttcagccatctttcccttgcttcataaggatagttactctggtatcagttgctggattgggattttgggcatttataaatgtttttattttggatattactgaatcacagacaatttcatcttagttaattaaaaattcatcttacgtgacacttgtctaaatcttaaaatattaaaattttaatgtataaggatgttaataatctttatattttaagagactatgaagtcaagtctagctaacttagatctgtaagtttttagctatggaaagcaattctattgtgtacaagtttcagcctgtgaagggaattcattgaaaatgtatagagatcagaagaactaacacctttcttgcatggatttttcttgattattggcagttaacaataaaatgttattagatcactggtgcttctgtgtggggttgagttttatgatatcttctgttagacccataagggaggctgtgagttgtttctacatcctggaatatttaagatcctcttttaaattatattttatataagccatgaaaatggcattgaataatg

SEQ ID NO: 33681 - DNA, 315 bp, Homo sapiens
taaattacagaacaataaaatcaggagtggagaaaatttgaaaacaaaaagggtgaatgctccatgtcagtctggattcagacagggaaaatagaaggcactgtatgtattccagtaatgaagagttttaatggaaggaattagaggtgctgccaccacccagagtcacaacctcagcactgaaccagtgattctcaggagcttgctggaaagtttctgtggatcacaggaacatctgggtgtctcccactgactttctctatctgaagcaccagtgaggggattctcacgttcacctggagactgtttcagtca

SEQ ID NO: 33682 - DNA, 1791 bp, Homo sapiens
attaggaatggccagagcaaacagttgagatctgtaagttcatatttaggaccaagtttccatgctctgtgtagagactgagaagcgttctgagcctccatcagcagctgttgcgtccactgaataattcattcaggaaacaaggactgagtacctttcatgtgccagattatctcgaaggctctggtgaccttaggatgaacaaaaaattatgctttcacaagtagaaggaaacgagtatgaatttgggaattgtctgcctttacattatagattgcctctattttctggtgggagtttagcctcatgatattggtgagagccacagatcctgaagggcatgaatttaaggctcagctatgctacttcccatctgggaactgctgttaaagtcggtaaatgctcaagaaatcaatcagaggcccttctcctcgttcttctttattttccatcatcaccaccatcgtcacctataatcaccatgatgatattagatattggtgcaagtagaatcagagatgtgtattgtttgatccaaatattgtatgttgcaaattgaaagtctgccatcctataaatatgaaggagcagttagggagtttcagtaataagcaaaaatgaaggtaagtaacttggactagtcagccatttatgatggtaataataataataataataataataataataataataatcagaaataacaaagtaactgtgaagttgagatatttgaagactagtcccagtactaaggtgctttggggcaatgcgcagttttctaaaagtaatcattttcttgggttggacacagaataaatttttagtactttattttcctggttcttcagttcaattttgctacccaaacttactaccaattatggtttctttacttcaaaattccaaagctccccagcaatttgcagggtgagattttgtgtgactgctggaaggcacattccaaaacataaagaaactttgccattggcagaaatggccttttgggattacaggtgtgagacactgcacccggccttggggtttttcaaagattgtttgggggaagtgatgggagtggctagacaatggttgtttgttgctgattggttgggggtgaagtcatagggttatgggaaatgttcctcctgtgtgctgaatagtttctggtggggccacaagagcagttggtgagtccaggtgaagccaggtgtcagacatgcaaagaacccgaaaagacatttcaaaaggccaatcttaggttcaataatagtgatgctgtccacaggggtaatcggggaagttagcataccttttgatctcttgaataatgactggcaatcctttatgtctacaccttagcagaattcagccccctctatctgcctagcctggtggtctctcattagctttacaaaagtggttgagttttggggaaaggctgttatcatttaacctataaattaaatgcctcccaaggctagcttggcttaagcagccaaggaataattaaaagcagtttgaaggctcaaggcaagaggggagttggctagatcagatctcccccactgccataattttctcactgttataatttttgcaaaggcagtttcagttctagtactctatctgggatgtaccttacttcacttacaaataagcacagatcatattttgtatctacataactaggcaagaaccatcctgaaagggtaacaaattctatgaatccatccaaatataaaaatattcacacgatgtttctgtaattccacacagttagaaaaaaaa

SEQ ID NO: 33683 - DNA, 341 bp, Homo sapiens
taatagaaatacagttgccaaagagaaagcagcaggcagagctaaggaaaggaggagtgttcgaatgattaatcacactcacaccactctccccaacagggagctctcatgtgaagagtttaacggacttgccaattagttacttgtgaatcatcctccacttgcctaattttctttcaaagtttgtactcagcaatttgtactgacttcaatatcaacttacgtagttttctttgtagggcgaaaaaaagggaaggaaaaccagttcatgtctttgcatttcagcaactaaattggtcatttgaggaaattttaaaaactacttttctctgctgcagtgc

SEQ ID NO: 33684 - DNA, 1082 bp, Homo sapiens
atttttttataaaaagtactacattatttgatttttatgcctttaagttttacttctgagtttttaaatttttgaattttattttgataagatcagttatcacaaaatatttttgcacttaagcagtactctttttgagtattatgaatttctggccaccactgtcacaaatgtgtacagcctatgccactgagatgcttacagttattgctgacattgaataaagatgaagaatcttcatgaagactataccactgcacccaattggaaacagagtcaccaccaccttttcaaccagcaaactaaaacccaactgcagatgaaagtccttatctatggaagccactctagaaagttaggaagaggtaggctggacgcggtggctcaagcctgtaatcccagcactttgggaggccaagatgggtggattacttgaggtcaggagttcaagaccagcctggccaatatgacgaaatcccatctctacaaaaataccaaaaaaattagccaggtgtggtgacatacacgtgttaattccagcttctcatgaagctgaggcaagagaatcgcttgaacttgggagacagaggttgcagtgagccaagatcatgccactgtactccagcacaggtgacagatggagacttcatctcaaaaaaaaggaagagatgatttgttccaccaggtgcacagacatcaacacagggacaccagaaatatgaaagagcatggaaataggttgccacccaaaggaaccgtcactttctagtggcagacctgcatgaaaaggaaatcaactaattgccagaaaaggaattcaaaattatgattttttaagaaattgaatgatatacaaggaaatacagatagttcagtcaatcagaaaaggatttatgatgtgaatgacaaattcaacagagatagaaatcataaaaaaaagaaccaaccagaaatcctgcaactgaagaattcagtgaattaaattaaaaaatacaacagagagattcaacaaaagaaagaatccagcaaaagaatccctgaacttgaagataggtcattcgaaattacctagtcagaggaaa

SEQ ID NO: 33685 - DNA, 483 bp, Homo sapiens
aaatgaagatcacagagccagttgatcagtggggaagctgcatctgaaatccaggacttctagatcctgggtcaactggtaatcacaagcgtacagataacaggcaggcaggaatgtgaaaatcagagagaagagagatgtgcaccagaagctggagtaatgtgctttgaagatggaggaagggaccataaatcaaggaatgcagacagcctgtagaagctgggaaaggcaaggatgtggattcactcgagtctctagaagaaacgcaaccccgccaacaccttgatttgaggacgtctgaccttcagaatgagaaaatgatacatttgtgttgtaagccacccagtttgtgaaatatgtatcaacaattgaaaactagtacatagtcaaatactcaatctctgttttttttagcttatcattttcaatctctgtctccaacccacaaaccacatgcatcataaataaattaaaataccaaaa

SEQ ID NO: 33686 - DNA, 473 bp, Homo sapiens
agaggacactgtttcaagattcctgcgccagctccttcgttgttatagaagttggactaaataaaagggtaatcacaagcgtacagataacaggcaggcaggaatgtgaaaatcagagagaagagagatgtgcaccagaagctggagtaatgtgctttgaagatggaggaagggaccataaatcaaggaatgcagacagcctgtagaagctgggaaaggcaaggatgtggattcactcgagtctctagaagaaacgcaaccccgccaacaccttgatttgaggacgtctgaccttcagaatgagaaaatgatacatttgtgttgtaagccacccagtttgtgaaatatgtatcaacaattgaaaactagtacatagtcaaatactcaatctctgttttttttagcttatcattttcaatctctgtctccaacccacaaaccacatgcatcataaataaattaaaataccaaaa

SEQ ID NO: 33687 - DNA, 891 bp, Homo sapiens
aaatgaagatcacagagccagttgatcagtggggaagctgcatctgaaatccaggacttctagatcctgggtcaactggtaatcacaagcgtacagataacaggcaggcaggaatgtgaaaatcagagagaagagagatgtgcaccagaagctggagtaatgtgctttgaagatggaggaagggaccataaatcaaggaatgcagacagcctgtagaagctgggaaaggcaaggatgtggattcactcgagtctctagaagaaacgcaaccccgccaacaccttgatttgaggacgtctgaccttcagaatgagaaaatgatacatttgtgttgtaagccacccagtttgtgaaatatgtatcaacaattgaaaactagtacatagtcaaatactcaatctctgttttttttagcttatcattttcaatctctgtctccaacccacaaaccacatgcatcataaataaattaaaataccaaaaaaaaaaaaaaaaaaaaaaaaaaactgtgtggggcgccgcgctctggcgcccttgagagaaagcgttttcatagagacacttcgcggttgggcgcgcgcgcggggcgccccagagtcggcgacaatggtggaacatgggggcacaatagcggtggtcccatagggaaacccgggggcaggaacaagagggcgccgggggatattctctccaccgaccaataaaagaaaaagcgccgcggggggggaacaaacggcgacgaggcgttctctggaaaacacaatgtcccgagagagggagattgcacgaggggggccacatcacagggggggctcctataaccaaccaggggggagagttcccaggaggagaagcgcccgaatattccaacattgagccccggtcgcgggg

SEQ ID NO: 33688 - DNA, 676 bp, Homo sapiens
gaccaccccgttgttcccactttctgtggttaaggggcgcatcgagtggcgaaggagagagcccagtgaactaaacagccctttaaaagttcgctttgcttcctgctggcgctctttctagcactaactttggtatgcatttaatctgtaaaattagtactatcaccttacgttggagtagcactttacagtttgactctagatgctcttttcattccatcctgctacctactcacatcaagtgcttttccccttgaccaacggtatgccaatctgctgataattacttcggtattcactgaatttctaaatctcaaggctcagtgagcagggtagtctgtagggagggattagttagggaatgccttccaaagggggttttgagctggaatttgaaggtgatcggcagccaagggaacactttcagcaagcgtttcttgagttgaagagttaaaaggagcttagataatctagcccaattctctgagaagactgaggcttagaaaggttatgacttcctcaagctgtttttttgcaaagccttcatgcctttttaataacttctagacattgcagaatacaaaacaggacactggctgggccctgagaacatttaaaatagaattgagaaggccaaaacacagaaaaggagaaaattgaaagtatatcaatttca

SEQ ID NO: 33689 - DNA, 435 bp, Homo sapiens
gaagtgttgatttcttaaaatgttattttccccagccagagtgtgtttggttttcttctggagtacacccactccagataaagttaggactgtgtcttaagattttagatcagcttaaaaaaattttttttgttttggtgacaatagaacatagatatttacatgtatatttgaatacaatagtcccctcttatcctgtcttgctttctgtggttttaattactcatggtgaactgtggtctaaaaatactaaagtggaaaattgcagaaataaaccattcatgagttttattttatttatttattttgggacagagtctcactttgccacctagtctggagtgcagtggtgcgatcatagctcaccacagcctcagcctcaaactcctagactcaagggaccctcctgccttggcctcccagatagctaattaa

SEQ ID NO: 33690 - DNA, 393 bp, Homo sapiens
ttacatgtctctctattacttggcaataatgggaatttttatttctacagttgtattgttttggtctgctccataccctgtaaacatttccattgttctacaaagctgtgtactcttttctgttagggtcagtgttttaggtgggaaaacaggctggttttctccactttattttctaaaatggtgttacatccctctgcttaggattattaatattaacaaaccatgtccacaactggtagaattgtctaatttgaatagtgaactgaaaaacactgaacatagccaaaataaaacatttaactagcttccatcaattcaatgacaatgacaaaaaaaaaagtactaaatacccacaaagtacaaagaactgtgatcagtattgcaggagag

SEQ ID NO: 33691 - DNA, 3060 bp, Homo sapiens
  misc_feature (3052)..(3052): n is a, c, g, or t
  misc_feature (3054)..(3059): n is a, c, g, or t
cagcatcgccttttcctcccgtttctccttccactcccagctccacatcctcctcctattctcccctctcccctcttcaaacccccaccttccagttccctcacctcccctttcggctggtcccctggggcttgcagcaagagggagagagagctcctgacaggattgatggtccttccccaccctgtcctctcatccgctccctccccagcaggcacagacatccccctacaaaaggcaggagcccaggctgtgtggaaacagctgctctcagacgcctttccatttgctctctgctggctaggctgggctgtgcctctgctccctcttcctctagctgagagtgggcacctggggtaccgggcccccccacctcattccccatgaatgctgtgggaagtcctgaggggcaggagctgcacaagctggggagtggagcctgggacaaccccgcctacagtggtcccccttccccacacgggacgctgagagtctgcaccatctccagcacggggcctctccagccccaacccaagaagcctgaagatgaaccccaggagacggcatacaggacccaggtgtccagctgctgcctccatatctgtcaaggcatcagaggactttggggaacaaccctgactgagaacacagctgagaaccgggaactttatatcaagaccaccctgagggagctgttggtatatattgtgttcctggtggacatctgtctactgacctatggaatgacaagctccagtgcttattactacaccaaagtgatgtctgagctcttcttacatactccatcagacactggagtctcctttcaggccatcagcagcatggcggacttctgggattttgcccagggcccactactggacagtttgtattggaccaaatggtacaacaaccagagcctgggccatggctcccactccttcatctactatgagaacatgctgctgggggttccgaggctgcggcagctaaaggtccgcaatgactcctgtgtggtgcatgaagacttccgggaggacattctgagctgctatgatgtctactctccagacaaagaagaacaactcccctttgggcccttcaatggcacagcgtggacataccactcgcaggatgagttggggggcttctcccactggggcaggctcacaagctacagcggaggtggctactacctggaccttccaggatcccgacagggtagtgcagaggctctccgggcccttcaggaggggctgtggctggacaggggcactcgagtggtgttcatcgacttctcagtctacaatgccaatatcaatcttttctgtgtcctgaggctggtggtggagtttccagctacaggaggtgccatcccatcctggcaaatccgcacagtcaagctgatccgctatgtcagcaactgggacttctttatcgttggctgtgaggtcatcttctgcgtcttcatcttctactatgtggtggaagagatcctggagctccacattcaccggcttcgctacctcagcagcatctggaacatactggacctggtggtcatcttgctctccattgtggctgtgggcttccacatattccgaaccctcgaggtgaatcggctcatggggaagctcctgcagcagccaaacacgtatgcagactttgagttcctcgccttctggcagacacagtacaacaacatgaatgctgtcaacctcttcttcgcctggatcaagatattcaagtacatcagcttcaacaaaaccatgacccagctctcctccacgctggcccgctgtgccaaggacatcctgggcttcgccgtcatgttcttcattgttttcttcgcctatgcccaactcggctacctgcttttcgggacccaagtggaaaactttagcactttcatcaagtgcattttcactcagttccggataatcctcggggactttgactacaatgctatcgacaatgccaaccgcatcctgggccctgcctactttgtcacctatgtcttcttcgtcttcttcgtgctcctgaacatgttcctggccatcatcaatgacacatattcagaggtcaaggaggagctggctggacagaaggatgagctgcaactttctgacctcctgaaacagggctacaacaagaccctactaagactgcgtctgaggaaggagagggtttcggatgtgcagaaggtcctgcagggtggggagcaggagatccagtttgaggatttcaccaacaccttaagggaactgggacacgcagagcatgaaatcactgagctcacggccaccttcaccaagtttgacagagatgggaatcgtattctggatgagaaggaacaggaaaaaatgcgacaggacctggaggaagagagggtggccctcaacactgagattgagaaactaggccgatctattgtgagcagcccacaaggcaaatcgggtccagaggctgccagagcaggaggctgggtttcaggagaagaattctacatgctcacaaggagagttctgcagctggagactgtcctggaaggagtagtgtcccagattgatgctgtaggctcaaagctgaaaatgctggagaggaaggggtggctggctccctccccaggcgtgaaggaacaagctatttggaagcacccgcagccagccccagctgtgaccccagacccctggggagtccagggtgggcaggagagtgaggttccctataaaagagaagaggaagccttagaggagaggagactctcccgtggtgagattccaacgttgcagaggagttaagtgtgaggcactcccggagcaaagtctatgaaggatcttctgcaagaggctgcctcctggtccactgaacctggaaactgagtgggctttaaccaggagataaaaatggagcctgaagggaatcaggcaaggaaatgaactcaggattcagagatctttgaattaatatgtggtgggttctgacattattcttccataagaccatgtgggtttccatggtggctatcaataaaactccttaggaaaacttnannnnnna

SEQ ID NO: 33692 - DNA, 960 bp, Homo sapiens
  misc_feature (952)..(952): n is a, c, g, or t
  misc_feature (954)..(959): n is a, c, g, or t
cagcatcgccttttcctcccgtttctccttccactcccagctccacatcctcctcctattctcccctctcccctcttcaaacccccaccttccagttccctcacctcccctttcggctggtcccctggggcttgcagcaagagggagagagagctcctgacaggattgatggtccttccccaccctgtcctctcatccgctccctccccagcaggcacagacatccccctacaaaaggcaggagcccaggctgtgtggaaacagctgctctcagacgcctttccatttgctctctgctggctaggctgggctgtgcctctgctccctcttcctctagctgagagtgggcacctggggtaccgggcccccccacctcattccccatgaatgctgtgggaagtcctgaggggcaggagctgcacaagctggggagtggagcctgggacaaccccgcctacagtggtcccccttccccacacgggacgctgagagtctgcaccatctccagcacggggcctctccagccccaacccaagaagcctgaagatgaaccccaggagacggcatacaggacccaggtgtccagctgctgcctccatatctgtcaaggcatcagagaggttccctataaaagagaagaggaagccttagaggagaggagactctcccgtggtgagattccaacgttgcagaggagttaagtgtgaggcactcccggagcaaagtctatgaaggatcttctgcaagaggctgcctcctggtccactgaacctggaaactgagtgggctttaaccaggagataaaaatggagcctgaagggaatcaggcaaggaaatgaactcaggattcagagatctttgaattaatatgtggtgggttctgacattattcttccataagaccatgtgggtttccatggtggctatcaataaaactccttaggaaaacttnannnnnna

SEQ ID NO: 33693 - DNA, 1862 bp, Homo sapiens
  misc_feature (1854)..(1854): n is a, c, g, or t
  misc_feature (1856)..(1861): n is a, c, g, or t
tgagacaaagtcctgctctgttgcccaggctggagtgcagttgcacaatctcggctcactgcaacctcagcttccccggggtcaagcaattctcatgcctcagcctcctgagtagctgggactacagtcatgtgccaccacgcccggctaatttttgtatttttggtagagatgggattttgccatgttggccaggctggtctcaaactcctggcctcaagtgatccacccacctcagcctcccaaagtgctgggattaggagacaacgtaattaaatgggacaaagtctttgttttctaagagctcatagacttgcaaataaactgaatcacagaataagttcaacagaagtgactaggagtagagggtgatcaattctatctctgagcttaagggaaggcttcctggaagaggtaatgtctaaataggatattggaggatgaatagctcacaagtggacaagcagaggaaggctcttccaagaagagatgaaagcacatacaaaagcatagaggtctgaaaccaagcaacatacacaggaggaataagtagttgagcattgctaagtattaaataaaggggcggggacaggtgggggtcatagcaggagatgagaccagagaaacaggcaaggacccactgagaaaggccacactaccactctgccaaaagaatagggtgccagaagggatttcaaaaaggcacatttttagatctgcatattagaaaggttaattactctagttgtattatggaggatggatttcaggggtagggagtaaaggggaagctgggggatagcaggttatttagaggcaaacagattttgcaataatccctgtaggaggtcatgaggccctgaacctggtgagcaggagtcaggagaggaagaagaaactgaactgaactgagtgttttcctgggggtaagattgctagactttggagaaccttctttaccagaagcaaaacttttgccagagtcaagcaaaagagtgaggaagtccataactgagaggtcacagccacagctgggcagaaatcatttcatcatcctcttctcagactgggacacgcagagcatgaaatcactgagctcacggccaccttcaccaagtttgacagagatgggaatcgtattctggatgagaaggaacaggaaaaaatgcgacaggacctggaggaagagagggtggccctcaacactgagattgagaaactaggccgatctattgtgagcagcccacaaggcaaatcgggtccagaggctgccagagcaggaggctgggtttcaggagaagaattctacatgctcacaaggagagttctgcagctggagactgtcctggaaggagtagtgtcccagattgatgctgtaggctcaaagctgaaaatgctggagaggaaggggtggctggctccctccccaggcgtgaaggaacaagctatttggaagcacccgcagccagccccagctgtgaccccagacccctggggagtccagggtgggcaggagagtgaggttccctataaaagagaagaggaagccttagaggagaggagactctcccgtggtgagattccaacgttgcagaggagttaagtgtgaggcactcccggagcaaagtctatgaaggatcttctgcaagaggctgcctcctggtccactgaacctggaaactgagtgggctttaaccaggagataaaaatggagcctgaagggaatcaggcaaggaaatgaactcaggattcagagatctttgaattaatatgtggtgggttctgacattattcttccataagaccatgtgggtttccatggtggctatcaataaaactccttaggaaaacttnannnnnna

SEQ ID NO: 33694 - DNA, 418 bp, Homo sapiens
ccaagagagtaggcggtatctagatgtcttcctacttcccagtgaatcctattcttatcctttgtgcatcccaagatttgttgctagcacccatgggtttctcgttttcccccacagaggttccctataaaagagaagaggaagccttagaggagaggagactctcccgtggtgagattccaacgttgcagaggagttaagtgtgaggcactcccggagcaaagtctatgaaggatcttctgcaagaggctgcctcctggtccactgaacctggaaactgagtgggctttaaccaggagataaaaatggagcctgaagggaatcaggcaaggaaatgaactcaggattcagagatctttgaattaatatgtggtgggttctgacattattcttccataagaccatgtgggtttccatg

SEQ ID NO: 33695 - DNA, 377 bp, Homo sapiens
catgcctttgggaaatgtagtcactccagggaggctgctggggagtgttggccacaggggacagataggaaaggccttgagagctctggggagtaaactccatttcaagatataaaattcccagaaattttgaaatcacaggcattttcattttgaacactgtttataaatcttaaaatcatgttgtgagtttaaaagtcatttataccttgatttggtcattgcattaccataaactgtatttgttctatttagagctgtaaaggcctagggggtgaggtagggtgcctatagtaagggaactttctggattctgtttttttttgtttgtttgtttgtttgtttgtttttgagacgagtcctgctctgtcacccag

SEQ ID NO: 33696 - DNA, 128 bp, Homo sapiens
ccccctcagactccatcttcacgtgagtcttatccttcttcgaggagctgctggtctgctcctcttcagacttagcattctttacctctactccttgcttgcaatgttccttttcaattttttccagg

SEQ ID NO: 33697 - DNA, 347 bp, Homo sapiens
tcaattcttttctactcatctcattgagagatagagttgaattcatcttcccttgtatctaggctgcacttattcgtttgcttgaccaatggaatgtggctgagtggccgtgtaaaatgcctgactaccctgagactgccatgttgaaggaagcccagctagccatgtggagaggccttgtggagcgggaaatggccaacctccatccattggaagtcatcccatttgaggccctagatactgaaaatcagaaagaagttacttcccattccccacctcaaggccctgtccaaactgaagattcatgggcagaataaacaattgctattttttaaaggtgtatgttt

SEQ ID NO: 33698 - DNA, 488 bp, Homo sapiens
gcccaaagtgggatgcttgctttgctcacattgattgcgtctcccagtgcctccccgcgcctcatctctgtcgtcatcctttttctactgcaggctcatcagagaacacaagtagctcacagcaccctggagagggaaggaggtttgtgcagctaaaatatctgactcctaaaatggagtttcctgaaattattccttactcatagtgtaatgaggtgtatgtgttggatctattataactttctttcgctccgtctctcagaatagatgatcatcctcatctttgcatcatattccaattagaaagggatgatacaacaagaaagctctcgtaagatgtcagctgcttgattttggacttcgcaaactctagaacttttctcttgcttgctcctgccatgtaagaagtacctttcgtttccggccatgattctgaggcctccccagctgtgtggaactaatatggcagatataacagcacgtaattt

SEQ ID NO: 33699 - DNA, 222 bp, Homo sapiens
ttttgggtaaatttgcctggcttcagggcgaaggccctccagcaccaagagctgcctagtactgcagattcttacgaccactcaaatctttctttcctttataagaaacaagcaactctaccctatggttgagccaatgtgtcagtttcttcctatccaaatggatggcatcctgacatctgcagtgagaggccaatgcaatttggtgggggtaggggcaag

SEQ ID NO: 33700 - DNA, 1179 bp, Homo sapiens
  misc_feature (308)..(308): n is a, c, g, or t
atggtcctcctcagtattcttagaattctttttctttgtgaactcgtgcttttcatggaacacagggcccaaatggcagaaggagggcagtcctctattgcccttctggctgaggcccctactttgcccctgattgaggagctgctagaagaatcccctggcgaacagccaaggaagccccggctcctagggcattcactgcggtacatgctggagttgtaccggcgttcagctgactcgcatgggcaccctagagagaaccgcaccattggggccaccatggtgaggctggtgaagcccttgaccantgtggcaaggcctcacagaggtacctggcatatacagatcctgggctttcctctcagaccaaaccgaggactataccaactagttagagccactgtggtttaccgccatcatctccaactaactcgcttcaatctctcctgccatgtggagccctgggtgcagaaaaacccaaccaaccacttcccttcctcagaaggagattcctcaaaaccttccctgatgtctaacgcttggaaagagatggatatcacacaacttgttcagcaaaggttctggaataacaagggacacaggatcctacgactccgttttatgtgtcagcagcaaaaagatagtggtggtcttgagctctggcatggcacttcatccttggacattgccttcttgttactctatttcaatgatactcataaaagcattcggaaggctaaatttcttcccaggggcatggaggagttcatggaaagggaatctcttctccggagaacccgacaagcagatggtatctcagctgaggttactgcctcttcctcaaaacatagcgggcctgaaaataaccagtgttccctccaccctttccaaatcagcttccgccagctgggttgggatcactggatcattgctccccctttctacaccccaaactactgtaaaggaacttgtctccgagtactacgcgatggtctcaattcccccaatcacgccattattcagaaccttatcaatcagttggtggaccagagtgtcccccggccctcctgtgtcccgtataagtatgttccaattagtgtccttatgattgaggcaaatgggagtattttgtacaaggagtatgagggtatgattgctgagtcttgtacatgcagatga

SEQ ID NO: 33701 - DNA, 749 bp, Homo sapiens
agctatggaacctgagcgacaccttgatttgtgttgtcacctgaccaagcctaaagacctccagctcagtcccccaccttcatcccaccccacagatgataaaattcagacctctctcctgaaaggcagaggttcaacattcaggactgtttctggccgaggacttcttccaattaaaacccccaccgtgggctgtctcccctcatttcatttttctaaaggggcagaggcctcttttagaaaataataaaatgcaatgtgtgtgatttacttttctgatctctttgagaaatagagaaatataaaagtgtgttcttaactccagaaccactctttttgcataaatacctcatcgggcagctttctaagtgtgattttcctgagtctcccttcgttggatctgccggaagacttgtcggggaacctttagtgagggtacttcttcctatttttcttctgtttttggaggcatacacattatgcataaccaaaacaatggctcaattgtgtttaactttgtattttgattgttgagaacaaaaacaaaaagtatcaatgtgtatgtggctgtttgtagtgaatttattggagaatgaggttgtccgtgtccttaacaagccaaggggcaggaggcaccctctcttatcccctcctccaagagcagtagagaatttaagcacaagcctatttgtgaaagaatattttgcttaagtgtcattcactttagtcttggaattccttcccaaacg

SEQ ID NO: 33702 - DNA, 509 bp, Homo sapiens
aagtgtagcaaatggaacggccaggtgagaggccagagagatctaagaatgtcctgaaggaggtgagatttgcccttgaccttgatggagtggtcagacttgggaaagaagatgaataaagcctatataaactgagagttaagagtgaagactggagacagatggctttggcttaaatcgcagttctgctgcttgctatctgtgtgaccttgggtaagttacttaacctcagtttcccagttatgacatgggaatgataacaatggtgtcggtctcttgggttgctttgaggttatttgaaataatacctgtaaagcacacagctaaaaaggaggaatgatggtggtgatgcagggagaccaaagagtgaaacagtctagagtgaagcgaatgtgttaaaatccagaggcgatcaagtgaagccagcctttggaggcccgtagaagtcatttggaggaatttggacttcgtgcagtaggaaagagggaaaactgtttttagaaaaaaaa

SEQ ID NO: 33703 - DNA, 352 bp, Homo sapiens
gactctgcaacatgtgttcttaaccatcagactttatttctctggtgggcaacacaggtagatgtgacaggttagaagtattagatataaatataagttatcgagatgatatgactaccgaattcactactgcactttttttacttttttaaaaacatgtatttcagcacactgctaaaccacagcaagaatctttttaaaaagaccttacaagaagcatgattacaggtcacaaaatcaagggaaaatattgtcatcattattttttaataagtgataagtgaggctgatgagtgtagacctgttgctttattaatagaaatatgtgcatctggtgaggacttgtatttgc

SEQ ID NO: 33704 - DNA, 1095 bp, Homo sapiens
  misc_feature (204)..(204): n is a, c, g, or t
atggcccagcagtggagcctccaaaggctcgcaggccgccatccgcaggacagctatgaggacagcacccagtccagcatcttcacctacaccaacagcaactccaccagaggccccttcgaaggcccgaattaccacatcgctcccagatgggtgtaccacctcaccagtgtctggatgatctttgtggtcattgcatccgtnttcacaaatgggcttgtgctggcggccaccatgaagttcaagaagctgcgccacccgctgaactggatcctggtgaacctggcggtcgctgacctggcagagaccgtcatcgccagcactatcagcgttgtgaaccaggtctatggctacttcgtgctgggccaccctatgtgtgtcctggagggctacaccgtctccctgtgtgggatcacaggtctctggtctctggccatcatttcctgggagagatggatggtggtctgcaagccctttggcaatgtgagatttgatgccaagctggccatcgtgggcattgccttctcctggatctgggctgctgtgtggacagccccgcccatctttggttggagcaggtactggccccacggcctgaagacttcatgcggcccagacgtgttcagcggcagctcgtaccccggggtgcagtcttacatgattgtcctcatggtcacctgctgcatcaccccactcagcatcatcgtgctctgctacctccaagtgtggctggccatccgagcggtggcaaagcagcagaaagagtctgaatccacccagaaggcagagaaggaagtgacgcgcatggtggtggtgatggtcctggcattctgcttctgctggggaccatacgccttcttcgcatgctttgctgctgccaaccctggctaccccttccaccctttgatggctgccctgccggccttctttgccaaaagtgccactatctacaaccccgttatctatgtctttatgaaccggcagtttcgaaactgcatcttgcagcttttcgggaagaaggttgacgatggctctgaactctccagcgcctccaaaacggaggtctcatctgtgtcctcggtatcgcctgcatga

SEQ ID NO: 33705 - DNA, 383 bp, Homo sapiens
atcggcttctggggaggcctcaggaagctttcaatcatgacagaaagtgaaaggggagcaggtggatagtgggagcaggagcaagagagagggagatgctacacacttttaaacagccagatctcatgagaagtcacttgttattgcaaaaacagtaccaagaagatggtgctgaggcatttgtgagaaatccatcaccgtgatccaataacctcccaccaggccccacctctaatcctgggattacaattcaacatgagatttggggaggacacgcatccaaactatatcagcccctcagattatttatgtagaaaatgcaggtgatcactacctaccttgttgtgttgttatgatgattatagataatggcattattttta

SEQ ID NO: 33706 - DNA, 321 bp, Homo sapiens
aaaattaagggggaagtggtgagataattaggtaggaacacacgcttataagttctatccccaaaatacagagtgtgaataattatataaggagatgaaatatgagtaaatatggatattacaaccttctttgaaattaggccttatactgtttaatgtcattttaataatcttgtggtttattctataatgtattttccaaattgctgtagaaagcctgaaggcacatgtacaatgaaatcattcagcaaagttttttaaacaattgataatagtaataaaatgaaaactggctgtgcttaactgtaattcacagtgaga

SEQ ID NO: 33707 - DNA, 569 bp, Homo sapiens
ggtctgcatttacttgccttttctaagtgtaactttatgaataattgatggaactgggaagttattggctgattgaaaagccatctcttcatgtctgtaagtctgacctatgggtaaagccaactgttcaggcttttagggtctttaatgaaaggtctttataaaaagcctttcactctttataaggaaaaaaaaatcagattttgaaaatgggattttttttctgacaatagtacattagaaaccaatccagccaggtttttggttaataaatgaatcaagctgactgcatgactaattcagattaatggtgcagaaatcagtcactaaagaagccccaaaaaagtttgctttaatagtcttaacagaatgatcataaattcggatctcccctcctattactgctctctgtgtttaaaacgcttgaaagccctagtaaacatctcctccgcctaagtagatgcagtgtatatgctataaaacaaggcaaagtctccagcaggatgcagatctgttagctgtattatgttttattactaccattggcttacttgaagccaggcttttat

SEQ ID NO: 33708 - DNA, 353 bp, Homo sapiens
aatgtggcatgacaaaagatgccattaaaaatgtaaaaggcaaatgacggagtaagaaggaatattttcagtgcatataatagatgaagacttaatatctttgctcttcagggagctgtcatgaaactgataaggatcagtgacccacccaaaaagcaggtgaagagtgtttagtcagttcacagaagaacgtatctaaatggccagtaaacaacacttcaaggaaataaaaataacaagttagtacttcttattgctggccaattcaaagaaagaggtgcattccttcattactggtagaaaaagaaattgttacagcctgggcaacaagagtgaaactctgtctcaaaaaa

SEQ ID NO: 33709 - DNA, 520 bp, Homo sapiens
tgccagggctacatttcttaatgacaggagaaagcatgaggacttagaaccaacttctttgatgtcggtctgcacccctccttcagaaggacaatgagctcctgggaggctttggtcgttgggtgtgatgtggttgtctgatcctagaaaagaggccgctcaggatgggaagaagatttcaacccctgcgtgtccgacgcagctcccaacgtcgctgaggccttcagaaacccaaagtggcatcgctaggaaaacgactgacaaccggtcacacgacccaggcagagacccagaaagaggctcaccaaagacaggctgacatacaagaaaccaccctccagcgcacagggcacattagtcccaaacacgcacacgaacacacacaaagaaagagacagagaaacaggagagaaagagagacatacacacacagagacatacagcagtggcacagaaacacccacctccaggcagccccagaggctgccgggttctgctctcggcaagaatgaccctcggg

SEQ ID NO: 33710 - DNA, 2087 bp, Homo sapiens
  misc_feature (1038)..(1038): n is a, c, g, or t
  misc_feature (1162)..(1162): n is a, c, g, or t
  misc_feature (1171)..(1171): n is a, c, g, or t
agaaaagatgtgttcatctaattcactattctccaaatacagaatagtttctctatgataaagcactggcatcttatcatgacggagagggtagtagccttgaatgatgttttaactggtaattgcttttatatcaaacacttttcagctgattatgaacaagattcagcctaattttaaagctaaaattaaaaatacgtggggcctcagttttacctataaacatgtaatgaaaaggtgtttttatttttttcctgtggcctctcaaggaagaaatgattctatctttaacacgtttttatttattttatgaatgggcaaatatcctaacaaaaagaaacacacgtcttaccattcatcttgggagagaaggctattgcttgataactaaggaatactatttttgaagcacctttacagtacttgacatgtcagttatgttttcaatgttcagccctatgtcagcctgcaggaatttctcatctgcccatgtctgtctattcatattggtaagtttcagcacagccctctttaaaacttcattgtgttactaatatttaatttttaagttttaaaatctagcacttctgtgctagatcctcgaatcaatttttacattcttttgaaatttatagtaatatttttgcctcatccctatactcaataattggcagtgagctatattatcacttaagtaactttattaccaattgtgctatattctaccatcacaaagtattcttttaaggcattcttcagatactgtcattttcattggtgtcttccagaacgattctataaaaactctgtaagattagcccttttactgttatgtgaaagaaacagggtaacatgatgggcaaaaaacttgagactgaaattttacgtgtaacactgtcatgtgttcattcaaaaaaaaataatttaacttctgtgtgttgctatctctgcctttaaaatacagtagtggtgccgtatctcatgtagacaggttgtgaaatccaaaaaatgtattttacatgttctcggtttttaagncttacaaggttcttttccagctagaatcttctttgaagaacaggaaacaaagaagacttttcctggcctcctcttagactctggagtagggtaactaaaagataaatcagctacttcttaaaanttccaactnccaatcatatcaagaataacatttcaaacaaagcataccaatgaaaattcaaggtatcttgtaacttcccccccaccttttcgggagctgggaggggttaccaagctgttcccaaagctgaaggaaaagaaggcatagtgtgcctcagcaactttcctgagctccgtatttccttgactgcagtttgtgttacctataaagggagatttatcatatcttggtgccaaagctcaaaaattactgggtaaaatatatacatccccatgtatgctgcttaaatacacacatgaacatataattcaaattttcactgtgctatatttaagtaggtaagacaagaaagacaaaatctctgaattgaagcagatatgaagcatataaatgatagtacttcctttttatttagtgcctttactttttgaaatttttgcacgtaattttatttcatcctgacaactttaaatagttcataagacaagtatacactttataaatgtctaagacacagagaggcaaaggtaaatgcttaaaggttgttggactataatggcaattagctaacttcctgaattatctcctttacaggaattcccttttaaaatattatatacagatatatacagacacacacaagaagtatatattcataaatattcttaaaaattaaggttatcaatatgaagtgtgtcagtcccttggaggaattagtttaacttcgttgtagatggaccagatttgaaatgagcaaaaagtctatgcctaaatttttcaaataaaaagagcattgaaaaacatcttgatttccctctccttgccccctaccaatcctagtaggattgtgctttcaatcagagactctgccttcaatctgagtgacatcagactcagagcccacactttaaggcaaaaaaaaaaa

SEQ ID NO: 33711 - DNA, 371 bp, Homo sapiens
tgtaaaacagtacataaatggaccagaaaagggtctttatcctggtgaatattttagaatctatactaactcatggaggtaaaggcaaacattactattcttcattcaatcaatacttgctgatcacataccacatgtcaagcattaaatacagaggatacagcagtgaacaagttcctgccttcttggagcttatgttctaagttaggaagacaaggaaacaagtaaacataatatgtaacgcataaacatataatatggtgattcagtgctatcaataaagtaggtggaatgggatacccaattttgaaaaaaatatagaaaaaaagttttaataaaaaataaagctgggaagcaaaatgagatgggtg

SEQ ID NO: 33712 - DNA, 380 bp, Homo sapiens
gaattccaggagatacagttgaagttgagatttgaatggggacacagccaagccatatcacacagtttgggtgaaggatacttaataagggagggcgcaacatacaaaaactgcaacatctggctgccatcagctcctccaccagcgcccccgcgtgggaattagtggagcgccagacagtcctaaggtcaagtcagtcctaaacttgcagttgtttgtgagacttacatcacttaatttcacaaacctcactgttcaaatggggacaatcaggcttatgagtagttgtgggtgtcaaatgaatgttcgtatgaggtctggcatcacaatgagtattttaatggatcttatccagatgcctccagatgctattggataaa

SEQ ID NO: 33713 - DNA, 415 bp, Homo sapiens
ttttttgaagatgacatgattgtctatgtaggaaacctttggaatctacaaaaaattttaaaaattactagaatcaataagtgagtttaacaaggttgcacgatgcaagatctctgtataaaatcaattatatttctatcttctagcaatgaataaccagaaattgaatttcaaaacaataccatcagtgatgcaggaaactctgtgagtttgcaagaggcagaataatgacccccaaatacgcccatgtcctaatccccagaacttgagcatatgttaccctacgtggcaaatggaactttgcagatgtgattaaggacctgcagtgaaggagatttatccaagtggacctaatctaatcacatggatagcagataatttttttctgctctgtcagaggtgtgactactgaaga

SEQ ID NO: 33714 - DNA, 273 bp, Homo sapiens
gcccctttctacacagtttttctcagccagattgggctccaggtgcctgcaatagtaacttgctcatttacatgtgctgtgtatttaactcttacccttgtaacttcacttcctcattgcccagttaatgctttctcagacctcctcccacatggactactttactcagattcttatctcagtgtagatttctgggtaaacctaaattaagacagttgctaacaaaaatgagtatagagagcagacttcagggtgagattctgggaatcgagg

SEQ ID NO: 33715 - DNA, 494 bp, Homo sapiens
gatctccaaggattttcatattgccaagcagtcacataatataaactaaatgagttcccaaatgagttgtgtcaagtgtccatgttgttttttagagtcaagatatatttagtttaaatgtgaaaagaaatttcaagtagtctttctgtttcagtcaacagtctgtgaaatgccaaatactcactattgttacattggcttcttaggaaaactgcccctaggtactatggcttgtgttgattttcagtgaagccagccttgtttatcctgggtctacaaatgtttggacactataaagactagacatgaaggaggctgacctcctgtcagctaggagtgggcataaaattcaagccaattttgggcactccattttgaatgggtggatttttgggtcctaataaccttctctctgtcttggaaagtaagacgcattgtgaattaagagaattcaggtcattagagtttaggcatgattccagttttccataagg

SEQ ID NO: 33716 - DNA, 292 bp, Homo sapiens
gtctcaagggaaaaaaaaaaggaaaactgattattccacaaaaatgttacaattcatcaatcaattcggcaaagtaacaggatgcaacatcaacatataaatttagttgtatttctatacattaaaagtgaactttctgaaagaaaattaggaaaacattccaatttgcaatagcataagaaagaataaaatacttgggaataaacttaagaggtgttattagtccgtttccactgctgtaaagaaatatctgagaccgagtaatttataaagtaaagaggtttaatgttta

SEQ ID NO: 33717 - DNA, 580 bp, Homo sapiens
ttttttgagagggactctcgctctgttgcccaggctggagtgcagtggcgcgatctcggctcactggaacctctgcctcccaggtttcaagtgattctcccgccttagcctcctgagtagctgggattacaggtgcctaccaccacgcccagctaatttctgtattttagtagagatgggatttcatcatgttggccagggtggtctcgaactcctgacttcaagtgatccacccacctcggcctcctgacgtgctgagattacaggcgtgagccatggtgcatggccatgtgaataaattttattgattttttttcttttatgaaggaattatctttgaacctatagtctaacttatatagaatactttttttttcctttttcttttcttttcttttcttttttttgagacacagtcttgctctgttgccaaggctagagtacagtggcacaatcttggctctctgcaacctccacctcccgggttcaaacgattctcctgccttagcctcccgagtagctgggactacaggcacccgccaccacgtccggctaatttttgtatttttagtagagatag

SEQ ID NO: 33718 - DNA, 3093 bp, Homo sapiens
gatttcagttgaaagatgtgtttttgtgagtagagcaccgcagaagaactgaagactgttgtgtgctccccgcagaaggggctaccatgatcctttcctcctataacaccatccagtcggttttctgttgctgctgttgctgttcagtgcagaagcgacaaatgagaacacagataagcctgagcacagatgaagagcttccagaaaaatacacccagcatcgcaggccgtggctcagccaattgtcaaataagaagcaatccaacacgggccgtgtgcagccgtcaaaacgaaagccactgcctcccctcccaccctctgaggttgctgaagagaagatccaagtcaaggcactttatgattttctgcccagagaaccctgtaatttagccttaaggagagcagaagaatacctgatactggagaaatacaatcctcactggtggaaggcaagagaccgtttggggaatgaaggcttaatcccaagcaactatgtgactgaaaacaaaataactaatttagaaatatatgagtggtaccatagaaacattaccagaaatcaggcagaacatctattgagacaagagtctaaagaaggtgcatttattgtcagagattcaagacatttaggatcctacacaatttccgtatttatgggagctagaagaagtacggaggctgccataaaacattatcagataaaaaagaatgactcaggacagtggtatgtggctgaaagacacgcctttcaatcaatccctgagttaatctggtatcaccagcacaatgcagccggtctcatgactcgtctccgatatccagttgggctgatgggcagttgtttaccagccacagctgggtttagctacgaaaagtgggagatagatccatctgagttggcttttataaaggagattggaagcggtcagtttggagtggtccatttaggtgaatggcggtcacatatccaggtagctatcaaggccatcaatgaaggctccatgtctgaagaggatttcattgaagaggccaaagtgatgatgaaattatctcattcaaagctagtgcaactttatggagtctgtatacagcggaagcccctttacattgtgacagagttcatggaaaatggctgcctgcttaactatctcagggagaataaaggaaagcttaggaaggaaatgctactgagtgtatgccaggatatatgtgaaggaatggaatatctggagaggaatggctatattcatagggatttggcggcaaggaattgtttggtcagttcaacatgcatagtaaaaatttcagactttggaatgacaaggtacgttttggatgatgagtatgtcagttcttttggagccaagttcccaatcaagtggtcccctcctgaagtttttcttttcaataagtacagcagtaaatctgatgtctggtcatttggagttttaatgtgggaagtttttacagaaggaaaaatgccttttgaaaataagtcaaatttgcaagtcgtggaagctatttctgaaggcttcaggctatatcgccctcacctggcaccaatgtccatatatgaagtcatgtacagctgctggcatgagaaacctgaaggccgccctacatttgcggagctgctgcgggctgtcacagagattgcggaaacctggtgaccggaaacagaatgccaacccaaagagtcatcttgcaaaactgtcatttattgtgaatatcttcaccatatggggtcacttatggtgaatatctttcttcagagttgctgactcttgaaaacagtgcaaagatcacagtttttaaaagttttaaaaatttaagaatattcacacaatcgtttttctatgtgtgagagggatttgcacactcttatttttctgtaaaatatttcacatcccaaatgtgaagaagtgaaaaagacttcgcagcagtcttcattgtggtgctcttcatgatcatagccccaggaacccttgaggttcttcttcacaaggctgagagtgcttccttcttgaagacgagtgtcattcatcacttcagtgatccatgcatagaatatgaaaataaattcttccaactcatgggataaaggggactcccttgaagaatttcatgtttttgggctgtatagctctttacagaaaatgcacctttataaatcacatgaatgttagtattctggaaatgtcttttgttaatataatcttcccatgttatttaacaaattgtttttgcacatatctgattatattgaaagcagtttttttgcattcgagttttaaacactgttataaaatgtagccaaagctcacctttgaacagatcccggtgacattctatttccaggaaaatccggaacctgattttagttctgtgattttacactttttacatgtgagattggacagtttcagaggccttattttgtcatactaagtgtctcctgtaattttcaggaagatgatttgttctttccagaagaggagacaaaagcaagatagccaaatgtgacatcaagctccattgtttcggaaatccaggattttgaattcgagatgaaacaaccagcaatcacagttaaatcttaactttgcctgcactctttgtaggaatgatcagaaatttatctttatcattctgagtgcttcaggagtacaataggaagaaagatactggagaaagcactagtgtaatcaccatgaagtctgacaacaggagcccattatttgcgtactgtcccaccctgtatcatggttctctgggaacaagcttttatgattctcattagagtttatttgttgattgtcagtagtttgcgacttttaaattatatttcccccactcaaagaatggtatctttatatatcaatgacattcaataaatgtgtattatttctaatgagaatcagttacaagaggagacttgatagttcaagtagtggtctcagaaatgtttgggctgaatgtggtggctcatgcctataatcccagcactttgggaggccaaggtgggaagataacttgagcccagtttgagaccagcctgggcaacaaagtgagatcctatctctattacaagaa

SEQ ID NO: 33719 - DNA, 2113 bp, Homo sapiens
agttcaaacatttaaaaatgcaaacacaattctgctcactggtgtatgtttttcttcaccaggaaattatctcattcaaagctagtgcaactttatggagtctgtatacagcggaagcccctttacattgtgacagagttcatggaaaatggctgcctgcttaactatctcagggagaataaaggaaagcttaggaaggaaatgctactgagtgtatgccaggatatatgtgaaggaatggaatatctggagaggaatggctatattcatagggatttggcggcaaggaattgtttggtcagttcaacatgcatagtaaaaatttcagactttggaatgacaaggtacgttttggatgatgagtatgtcagttcttttggagccaagttcccaatcaagtggtcccctcctgaagtttttcttttcaataagtacagcagtaaatctgatgtctggtcatttggagttttaatgtgggaagtttttacagaaggaaaaatgccttttgaaaataagtcaaatttgcaagtcgtggaagctatttctgaaggcttcaggctatatcgccctcacctggcaccaatgtccatatatgaagtcatgtacagctgctggcatgagaaacctgaaggccgccctacatttgcggagctgctgcgggctgtcacagagattgcggaaacctggtgaccggaaacagaatgccaacccaaagagtcatcttgcaaaactgtcatttattgtgaatatcttcaccatatggggtcacttatggtgaatatctttcttcagagttgctgactcttgaaaacagtgcaaagatcacagtttttaaaagttttaaaaatttaagaatattcacacaatcgtttttctatgtgtgagagggatttgcacactcttatttttctgtaaaatatttcacatcccaaatgtgaagaagtgaaaaagacttcgcagcagtcttcattgtggtgctcttcatgatcatagccccaggaacccttgaggttcttcttcacaaggctgagagtgcttccttcttgaagacgagtgtcattcatcacttcagtgatccatgcatagaatatgaaaataaattcttccaactcatgggataaaggggactcccttgaagaatttcatgtttttgggctgtatagctctttacagaaaatgcacctttataaatcacatgaatgttagtattctggaaatgtcttttgttaatataatcttcccatgttatttaacaaattgtttttgcacatatctgattatattgaaagcagtttttttgcattcgagttttaaacactgttataaaatgtagccaaagctcacctttgaacagatcccggtgacattctatttccaggaaaatccggaacctgattttagttctgtgattttacactttttacatgtgagattggacagtttcagaggccttattttgtcatactaagtgtctcctgtaattttcaggaagatgatttgttctttccagaagaggagacaaaagcaagatagccaaatgtgacatcaagctccattgtttcggaaatccaggattttgaattcgagatgaaacaaccagcaatcacagttaaatcttaactttgcctgcactctttgtaggaatgatcagaaatttatctttatcattctgagtgcttcaggagtacaataggaagaaagatactggagaaagcactagtgtaatcaccatgaagtctgacaacaggagcccattatttgcgtactgtcccaccctgtatcatggttctctgggaacaagcttttatgattctcattagagtttatttgttgattgtcagtagtttgcgacttttaaattatatttcccccactcaaagaatggtatctttatatatcaatgacattcaataaatgtgtattatttctaatgagaatcagttacaagaggagacttgatagttcaagtagtggtctcagaaatgtttgggctgaatgtggtggctcatgcctataatcccagcactttgggaggccaaggtgggaagataacttgagcccagtttgagaccagcctgggcaacaaagtgagatcctatctctattacaagaa

SEQ ID NO: 33720 - DNA, 251 bp, Homo sapiens
tacctgatactggagaaatacaatcctcactggtggaaggcaagagaccgtttggggtaagacacttacatgacttagtcagtatccaattcttccaacacaaagaagactacttagtgactcaggcttataactcttccctctgcatgaaatggaatctgtcccctctcccccaggatgtgtgagagaatgagagaacagtgatttcaggcagagtctcagaaccagatacacctggcttcacatcctga

SEQ ID NO: 33721 - DNA, 613 bp, Homo sapiens
cacactggtgaaggtgcagaaacttatttttcgctttagttacagttatttgtcttccactagtgaaggaaggcacgatcgagactttcatacgctttataataattcgtctcacccttcccttagagactccctcaatatcacgtactcatggctttctaacagctgagaaatgatctgcttttcagataacaccatccagtcggttttctgttgctgctgttgctgttcagtgcagaagcggtaagtctacttccgagggcaatttcttgaaaattaattaattccgtttctttattacctgtggagtcaccatgtctctttgcacccgctgttctctctacctgggaaccttctcccattttctccctgtggaatgcctatttgtttacaggtctaggtcaaatttcaggtcatctgggatcctttcctgatcctttagatttcattgttcattccattgcactcccatcgtgtgcggcattgttctccacttaatttttatttcatgtatgttgtttataggtctgtgctccaatacgtattttttccctttaagggcaagaatcctatcttagttatctatctccccaaaactaccagtgtggagaga

SEQ ID NO: 33722 - DNA, 290 bp, Homo sapiens
ataatagcacatctatttgtagcatggtttactgaagatttatacccatttttgagatttactgctcagaaaaaaagatttcctcaaaatattactgctcattgacaatgcacctagttacacaagagccctacaaagagatcaatgttgtttgcatacataacacagcatccattctgcagcacatggatcaaggagcaattttgacttacaagtgttattagttaagaaatgtacttcataaacctatagctgctataaatagtgattcctctgatggacctgtgcta

SEQ ID NO: 33723 - DNA, 512 bp, Homo sapiens
cactcagggccctgctcagtgattggccctgtgatcacccaccccggccccttgttagcggcccctgctccatagtgggcagcccgtggattccctaatgaattctgtcagcccagcgtgcaggagatggacagatagagaggccaaatcccaaagtggatttataagtggaaatccagggataaatgcggggttggcgtaggtgaggggagttgaccacatccactgctaaatctcagattccaagaggagcttaattcgtaaggctatgtgctagaaaagtctgcattagccactttggcgtgagtatatctctaaaaccactaatgaaattgtgctttggtcaatcaacatttctggggccagtggcatgggtaatcactgggcttgcgttgtgcttttagacagggaagccaatgtggtccctggtacacgcagttttcttcaacaccgaacgtttgtttttccatcttgtgggtagtgagcctttcttgagccaaaatatatgtagc

SEQ ID NO: 33724 - DNA, 2567 bp, Homo sapiens
taaacattcagtttattgtatgtcttatacatggcagtcaagctgtaataaaataccggttgaataagcagcaggttctcagtaaatgcataatttatcaagctgtacattttaaacgttcagtttattgtatgtcttatacatggcagtcaagctgtaataaaataccggttgaataagcagcaggttctcagtaaatgcataatttatcaagctgtacattttaaacgttcagtttattgtatgtcttatacatggcagtcaagctgtaataaaataccggttgaataagcagcaggttctcagtaaatgcatatccaatggtgcagagaagtgttcaatgttggctgcagggatgcaaagcaggtgccaataagtgttggtggaattaatgtgcagaataaataagtattcacttattaggtgttcaataactttagagtgaatgaataaatttgacagatatttattgctgatcgtgtgctaggcactatcctaggctctgggaataggttaaggaaccaaacaaaaatccttgtgctcacagagctttaattttagaaggatagcagacaataaaagcataagtaaaatacatatagtgtgctagataggtgctaaggagaaataaggttgagaatggggatagggaaagtcaaggaaggaggttgacatgttagagactgtgtccaccgtcattgaaagggtaatgcttgagaaaggcctgaaggatatgggcggacagagtgtgtgtctagggcaataaaaagtaactgctccagatgttgaagaaaataatgtgcaggagttgaactgtttggaaggagggtgagccccatagaaggagccaccctcgccccctgctgagtcccggctcgctcggcccgcgcgtacctgcgttgtccaccaggaggcgctcccgcacccgccccgcaggcgtcttccgccgccggccggtgcgtgggcacgcgcagaaaccgctaggtggcgacggtttcccttcccacgcgcggacgccggcgtgggccgacgcggccggagcgcccgcgcgtgcgcagagccgaggccaggctgccctcgaagcggggcggggcgaagcggggcggggccgagcagggcggggcgggggcttgaggtgattcccaagccgcggggcggctccggtggtgcggggaaaccgaaagtgggcggcggccgcggcggggcccctggcggagacggcggcaggagctgggcccagagacgcggggacgggccgtgggcccccggaacgaggcaaagatgctggaaggagatctggtttcaaagatgctacgagctgttctgcagtctcataagaatggagtagcattaccccggctccaaggagagtacagatccttgactggagactggatccccttcaaacagctaggtttccctacactagaagcctatctgagaagtgtgccagcagtggtcaggatagagactagtagatctggagagattacctgctatgccatggcctgcacagaaactgcaagaattgctcagcttgtggctcgtcaaaggagttctaaaaggaaaaccgggcgtcaagttaattgtcagatgagagtgaagaaaaccatgccattttttctagaaggaaaaccaaaagcaaccctcagacaaccaggatttgcttcaaatttttctgttggcaaaaaacctaatccagcaccgttaagagacaaaggaaactctgttggagttaagcctgatgctgaaatgtctccttatatgctacacacaactcttggaaatgaagcattcaaagacattccagtgcaaaggcatgtgaccatgtccaccaacaacaggtttagcccaaaggcgtcccttcaaccacctttgcagatgcatctctcaagaacctctactaaggaaatgagtgataatttaaatcagactgttgaaaaacccaatgtcaagcctcctgcctcttacacttataaaatggatgaggttcaaaatcgcataaaggaaatactaaacaagcataacaatggcatttggatatctaagcttccacatttttacaaagagttatataaagaagaccttaatcaaggaattttacaacagtttgaacactggcctcatatttgcacggtggagaaaccttgcagtggtggccaagatttacttctttatccagctaagagaaagcagcttttgagaagtgaactggatactgagaaagtacctctatccccactacctggtcccaaacaaacaccaccgttgaaagggtgtccaacagttatggcaggagactttaaagaaaaagtggcagacctgctggtgaaatacacaagtggcctttgggccagtgcacttccgaaagcatttgaggaaatgtacaaagtgaaattccctgaggatgccttaaaaaatcttgcctcactttctgatgtatgcagcatagactacatttctggaaatccccagaaggccattctctatgctaaacttccattgcccactgacaaaatccaaaaggatgcagggcaagcacatggtgataatgatatcaaggctat

SEQ ID NO: 33725 - DNA, 389 bp, Homo sapiens
gaggttcaaaatcgcataaaggaaatactaaacaagcataacaatggcatttggatatctaagcttccacatttttacaaagagttatataaagaagaccttaatcaaggaattttacaacagtttgaacactggcctcatatttgcacggtatgtttttccttattcctcccttctgatacctcctccctgcccaactttgagatcttgagttattagtcatatcaccttttatccccagaagacaaagcactttacatatgttacctcattaatctttatctcttaagattaacatatgtcagttcttatttatagaagtatgtcaaagttgaaggttctcctgtgttgtaattgctatttttatatattttgttttatgtcatttt

SEQ ID NO: 33726 - DNA, 292 bp, Homo sapiens
agctttttaatttttaaaaaactctataaaggacaaaaacacaagcacttttttttttggcccacgttagtgtaacgtgagttgccatctcagacggaactgtagtaataacaagtcaaagcatatcaagctgcttttcccaaaatgatgaaaccagagccatgtattttctgaagtatctttcacatctataacagatactcagaagagagactaattctctcaaagtctcttcttactctgatggagatttggagagaacacaagaggaatcagagctaaatgcttttgt

SEQ ID NO: 33727 - DNA, 728 bp, Homo sapiens
gacccttttcacaagatggtgccgaaagtgaagaaggaagctcctgcccctcctaaagctgaagccaaagcgaaggctttaaaggccaagaaggcagtgttgaaaggtgtccacagccacaaaaagaagaagatccgcacgtcacccaccttccggcggccgaagacactgcgactccggagacagcccaaatatcctcggaagagcgctcccaggagaaacaagcttgaccactatgctatcatcaagtttccgctgaccactgagtctgccatgaagaagatagaagacaacaacacacttgtgttcattgtggatgttaaagccaacaagcaccagattaaacaggctgtgaagaagctgtatgacattgatgtggccaaggtcaacaccctgattcggcctgatggagagaagaaggcatatgttcgactggctcctgattacgatgctttggatgttgccaacaaaattgggatcatctaaactgagtccagctgcctaattctgaatatatatatatatatcttttcaccatatacatgcctctctgtcaatttctggttgggctgggaggccacacacagacactgacatgacagggcttgggcaagactcctgttctacttatccttttgaaatattcaccctgccactccaccatgtgtgatcactccagagatctttgtgactagagttagtgtcctaggaaaaccagaactcagaac

SEQ ID NO: 33728 - DNA, 1010 bp, Homo sapiens
ttgttccatgaatgaatgaatccttgtacacaaacggtgttagggaatgcaaaaaaccaatgaagattctgccgatcagcagagcgttcaaacactgaactggaattgtggtgctctccaatttttgcttaaaaagactcccttggcaaattgtaatcttatagaacccttattttatacaaaaggtttttttcttcctttgaaccagtggctgggattaagactgaagaggtctataaataagcagggaatttacataaccagagattggtctcagtaggcctcagatcccattacagaaaaagcaaacgagtttttggcattttagttctaccaaactctgttgttattgcaattacaaagtttatatctattttaaccatgtatccatgtctgcacttgcacatatacatacagacatagaggacctcagttcatgctaaatcacttgttgagttctaagtatttatatataaaaatggcaggttcagttgcctcttggaatcctaagggaatggaagaaataaaaaattaacctctcatcttggaaaaaccttttaaaataatatttcaccaatttagcaaacctgtatactcatgttaactctataatgatttgttttgtttcaatattttcaaaatggcctctctacattcttgctggttaacagtcctggctgaggctcagatctatcctttcctgtacacagatataggcatttgctcacttccagatattccacaaagtaaccacacttcaaagatggacaactttgcagctgggctaccatttccttctcctgtcatttacatcaggcaatatttcataaaaggattacctcctgtagctggaaggatagttagagattatgtagccatctactcattttgcagatgaggaaacaaggattccagagactgatacaggatttctatgactttttcccctttatgcagatttgattgcctcactataaatttaatccttatatttcatgattactgctata

SEQ ID NO: 33729 - DNA, 424 bp, Homo sapiens
gcacgagcttaactatagtggaattcttttgctgtgagactttgcatggttgtgtgaaagccacttattattccaccaaaactgtctgtttctagaacctataaaatgtaaggctccaggaaatccggaaaatggccactcctcaggtgagatttatacagtaggtgccgaagtcacattttcgtgtcaggaaggataccagttgatgggagtaaccaaaatcacatgtttggagtctggagaatggaatcatctaataccatattgtaaaggtatgtttagtaaatttaccacgtttcttatgtttggcaatcctagaaaggtaaggcgtagacatatgaagtgttatgttgtatcaatgttctttgtatttgaactgaggtattaggctcatgtttaaacatgaccccacacacacacacca

SEQ ID NO: 33730 - DNA, 249 bp, Homo sapiens
atttaaaattccttaaattgcattcaggaaataaaattccttaaattgcattcaggaaaataaaaaaatttaggcttggaggctgagcgtggtggctcatgcctgtaatcccagcactttgggaggtggaggtgggcagatcactttaggtcaggagttcgaaaccagcctggcaaacatggtgaaacccatttctactaaaaatccaaaaaatagccaggcatggtagctcacacctgtagtcacagc

SEQ ID NO: 33731 - DNA, 125 bp, Homo sapiens
gattagagggggacaagactggagccaggaatccatataattggctattgtttaattgaggcaagggaagatgatagtatggtcttagaagtgcctacatgaatggagggttgaattgacaggat

SEQ ID NO: 33732 - DNA, 300 bp, Homo sapiens
tgaaaaaaggtattatcaatagctaaagttattatttcaaactgccacaggcagttgtagaggaaataaaaggtactctaaataaataaaaggtaatatatacataataataatatatatatgtctcatacacacacacacacaaacaaaacctaagtaatgcatatcaccaacattgcaataatatctcagaattagaatcctagatctagactgaaagcatggtgtaaatgtatgaaggcaacaaaaacagaggtataggtggcagggagacatacagaaaagaacaccaaaataaag

SEQ ID NO: 33733 - DNA, 344 bp, Homo sapiens
tgtcacctctaaccaaagggcctccccagatgcctagcctggtccaagcgttccatcaagagtcagtaccagcgtttattgctgtccagtctgtgcaagctccatgctggctgctgggtaagagccaagggcagccaggcctaatggctcatgcctgtaattccagcactttgggaggctgaggctggtggatcacctgaggctgggagtttgagaccagcctggccaacatgttgaaaccccatctctactaaaaatactaaaattagccaggcatggtggtgggtgcctgtaatcccagctactccagaggctgaggcaggagaattgcttgaaccggggag

SEQ ID NO: 33734 - DNA, 485 bp, Homo sapiens
caagacattgtgattttgaccttgttggatgctgcacctaaaggtggatggaagaggaagagtcttgggggctaccatcctggctggagaagctggcacgaggctccctcttgtggatgcagcaagtctgagggccaagggaagagaagagtgacatagaatctcctttccttgagatcttagaatcacgcctgcctccttacctccatccaggactgttaaaaatctcccaaggcagagacttttaggcctacatgtacttagcctcctcttcccacctcctgttcatctctgtttccaatgttccactgccatcactgccaggaagttctgcagagaagaatgaagaagaaccgtatgatcctaaacatgttctttgaagatattatcaacccaccattggccttatttactggaatgtttttataacctttatttgacacctcttcccatcatttaaaataaatctggtgcttccctgaaaa

SEQ ID NO: 33735 - DNA, 939 bp, Homo sapiens
aatttactctacctcagtcctaattagtggtagtatgataagagatttctgctccaggaataggacgtcttcctttctttactccaatagagcagcggtgatgtcatttctgtatttcaggaagactggcagacagttgctttgattcttcctcaaagtatttaccatcagctacagtccaaaattgctttttcttcaaggagatttatggaaaagactctgacaaggactctggaatacaagctcctgataacttcaagatcataccactggactaagaactttcaaaattttaatgaacaggctgataccttcatgaaattcaagacaaagaagaaaaaaaactcaattttattggaataaataatcaaaaggataatgttttcataattttctatttgaaaatgtgctgagtctttgaatgttttattctccagatttatgaacttttttccttgaacaattggtaaagtatacttttgtaaacaaaaattgaaacatttgcttttgctgagtgccccagaattgggaaactattcatgagtattcatatgtttatggtaataaagttatttgcacaacttcagtaaggatctgctctctttataacaggacacatttgaaaacatcggttatattaccaaggctttgactgggatgttatatttgagaatatacatagaataaacccatagggaatgcaggcaaagtctgaagttgcccttggtttggcttcctagtctcaagaggtttttggaagtttaatctgagattcttattaaaaacttctagcaaagcgaagtttaaaaagagcctctatggtccattgctactcttgccgcacttaggtaaaaagtctgggcaagttcggtgagactcaacctattttgcaaacaaattcatcctactggaattatctttggtaaaaatagagactcc

SEQ ID NO: 33736 - DNA, 945 bp, Homo sapiens
tgcggggatcagtgcgcctctccctctctcccctcccccaccaccttactgctaacactccaggaataggacgtcttcctttctttactccaatagagcagcggtgatgtcatttctgtatttcaggaagactggcagacagttgctttgattcttcctcaaagtatttaccatcagctacagtccaaaattgctttttcttcaaggagatttatggaaaagactctgacaaggactctggaatacaagctcctgataacttcaagatcataccactggactaagaactttcaaaattttaatgaacaggctgataccttcatgaaattcaagacaaagaagaaaaaaaactcaattttattggaataaataatcaaaaggataatgttttcataattttctatttgaaaatgtgctgagtctttgaatgttttattctccagatttatgaacttttttccttgaacaattggtaaagtatacttttgtaaacaaaaattgaaacatttgcttttgctgagtgccccagaattgggaaactattcatgagtattcatatgtttatggtaataaagttatttgcacaacttcagtaaggatctgctctctttataacaggacacatttgaaaacatcggttatattaccaaggctttgactgggatgttatatttgagaatatacatagaataaacccatagggaatgcaggcaaagtctgaagttgcccttggtttggcttcctagtctcaagaggtttttggaagtttaatctgagattcttattaaaaacttctagcaaagcgaagtttaaaaagagcctctatggtccattgctactcttgccgcacttaggtaaaaagtctgggcaagttcggtgagactcaacctattttgcaaacaaattcatcctactggaattatctttggtaaaaatagagactcc

SEQ ID NO: 33737 - DNA, 1038 bp, Homo sapiens
ttaatggcgatgttgcagcgatcatagacaaaagcattttatccctcagattactctcagacagcataatgggctctatgcgttgctcagctcgttactcagccactggcgaggaaagctccacatccttgacaatcagagtcatagctcctccccgattaagaacttttgctttcaataatccaacgtagcagccgtgatgtcatttttgtatttcaggaagactggcagacagttgctttgattcttcctcaaagtatttaccatcagctacagtccaaaattgctttttcttcaaggagatttatggaaaagactctgacaaggactctggaatacaagctcctgataacttcaagatcataccactggactaagaactttcaaaattttaatgaacaggctgataccttcatgaaattcaagacaaagaagaaaaaaaactcaattttattggaataaataatcaaaaggataatgttttcataattttctatttgaaaatgtgctgagtctttgaatgttttattctccagatttatgaacttttttccttgaacaattggtaaagtatacttttgtaaacaaaaattgaaacatttgcttttgctgagtgccccagaattgggaaactattcatgagtattcatatgtttatggtaataaagttatttgcacaacttcagtaaggatctgctctctttataacaggacacatttgaaaacatcggttatattaccaaggctttgactgggatgttatatttgagaatatacatagaataaacccatagggaatgcaggcaaagtctgaagttgcccttggtttggcttcctagtctcaagaggtttttggaagtttaatctgagattcttattaaaaacttctagcaaagcgaagtttaaaaagagcctctatggtccattgctactcttgccgcacttaggtaaaaagtctgggcaagttcggtgagactcaacctattttgcaaacaaattcatcctactggaattatctttggtaaaaatagagactcc

SEQ ID NO: 33738 - DNA, 397 bp, Homo sapiens
agagagcagaaaagaggaagagggaaaagagtgccactcccttcccttctgctttcatgaggcagcccccgccttgccatttcacccccacatatacatttcatcttgcacagcctttgccagagctcagatggccacacccagccagagagagggtggtaaatgtagtctttccagtggaacatccgtaacattgaataacatatgccatgttctagggaggcagagggactggctatttgaagatattttgcaggatatgtcataatacgtaacctattcctagcaatagtacatgctttaaaacaagcaattatgatagctttaatgaaaccacagataaataattcccatattttatagagtgctcaggtattttgaattgagaaaatgattt

SEQ ID NO: 33739 - DNA, 431 bp, Homo sapiens
tttctggcagaacaacctttcccaaacatagaactagtcatgttactcctatgattaaagtctttcaataactaactcccagcacctacaaaataaagttcaaatcccagatgtgtgacatacaatacccttcacaacgtgggcctccagcctcagctcaggccatgacaccaactgaaatcacaacctgccttgagctgaatgcagcagaggctgctggttgcccatctggacatcattctctctttctccttagtagcagaaaactttactcaggaggccatgaatcccaccgcaacaccacatttctcaccttccctggtagttatgtatgaccttgtgcctaagttctgacaaatgggactttcaaggtgaaggatgctctttttctcccaacaccctctctttcctcctgctgactacaattcaga

SEQ ID NO: 33740 - DNA, 359 bp, Homo sapiens
gtacaactcctaacagaataataccagtacagcactttaagatgatagcaaaagactacagaacagacaaaatcgaacttaataatgaactccaggtagacttagcctgaaaactactcccttcaaatttcccttgttgctccaaatatgcctaaaaggattttgacactgactcttaggtgccaattaccccctgcctcaatgtgggatgagaacaaaaaccaaaataggtccatcctagcaccaagggccatcaaaaccaaacttaaagatgattgatcagtgatgcttttggaaaaagatctggagcacaaaagggaaacgtgaaagttgtctgaatcaaaatggagtcactagta

SEQ ID NO: 33741 - DNA, 191 bp, Homo sapiens
  misc_feature (51)..(51): n is a, c, g, or t
tctttctagccctttctagccctttctagccctttctagccctttctagcnctttctagctctttctagcccacaccttggaaactgaatccctttccttcatcgagagtttccaaagactttacactttggatatattatgcctgatctaacaataaaacaatgcatagatatctccccaaaaaaaaaaa

SEQ ID NO: 33742 - DNA, 949 bp, Homo sapiens
tgagagcctccaacaaggtaattttaaaatagaggctgtcatttccttccagtgtgggttgatcttagatatatacttataacgaatcggcaaagtgacactgtgatttctgagttagaaaaaggtaatattccttcagcctagggttctgtctttctctcctgggacatgtgtctttgacaccctgagccaccatgtaagaagtccagctaccatgaagccgtcatgcagaagagaccatgtagagacatcacacagagatagagggaggcacccaggagccccagctgtttcagactccagatatttggatcatcctgcgcgggtaccagacatgtgaatgaagaagctcgtgagatgactgcagttccagctaccatcggactgcaacatcacgggacaccccaacccagaaccaccccactgaatacttcccaaacaccaacccacatgaaccatgagagataataatgactgttgctgtttcaagccactaaaaaaataaaaatatttttttaaaaagtagaggctactgatggttgaattgaaatgatgtgtctttatggtaggagctcaataaaaatcttagatctcttgttgacagtgcataaaagttaccagtagaggtcatacttgattaatattttcatatcctcttttctgtaagtatatagcttaataattattattcagtatatgaatataagctcagtaaaactgtatcttggattgttacaagtggtctgtttgctaccttctgtgaattaccaactactgtgtaaaaaataagtactggcttagtgaaatatttaccattaaaaccatactgagctgggctgggtcgcatgcacctgtagtcccagctactcgggaggatgaggtgggagaactgcttgagcccaggagtttgaggctagcctaggcaacacagcaagaactcgtctctaag

SEQ ID NO: 33743 - DNA, 374 bp, Homo sapiens
aaactgggtccactcaacatggtgattcccaccgtcttctccttgttaccacctgtgcaaagtgtgaaggccacctccaagtaacaccatgtgttcaaaccatcatggcaacccacatttgcatattaaaaggctatggcgggagggcctggtttctcccaggctacatgaataacacacctggtcaagccaatcctttgggccctatgcaaaccagatactgcctcctccagcctccagatataagggactgtctttctgttgcgcacagggtctatctctgttcctttcccatgtctcagtacgggggagctgttctcttctttcttccttcttacttgctattaaacttttcactccttaaaactactcca

SEQ ID NO: 33744 - DNA, 108 bp, Homo sapiens
gatattgcaggtttggttccagaccaccactatactaaagcaataaagcaatcatggattttgtttcccagtgtatgcaaaagttatgtttccactatactgtagtct

SEQ ID NO: 33745 - DNA, 310 bp, Homo sapiens
ggtggaatattttcctcctgctaagctctactttacttctctgtagaatgggggataataattatacttatttcttagggtagaagtgaggactcaaagcagctatccatataaagagcttagcccagggctggcatatattaagtattcaatacatgttacctatgacttgaatttaattattattaggagtattggtgtatacatcagtaattgccacagtttttacttttgcattaaaattcagattctggccactgcactccagcatgcgtaacagagagtgacctctctctctcaaaaaaaaaaa

SEQ ID NO: 33746 - DNA, 412 bp, Homo sapiens
cttaatgtgtagttcaagaatcataatagttacttccatttcttcttttccatatttcgtgcttttgttgtcatgcattttgagttgaagtgttctttctgctttgtcaggcagttaccttttcaagcaattaaaagtgacaaaaatactgtaatcccagcactttgggaggctgaggtgggtggattgcttgaacccaggagttcaagaccagcctgagcaacatagtaggacacagtatctataaaaaaataacaaaaattagccagacatggtggctcgtgcctgtaattccagctactctggaagcttaggtgggaggtattgcttgagcctgggctgtcgaggctgcagtgagcctagatcatgccactgtgcttgagcctgggtgacagagagtaacaccctgtca

SEQ ID NO: 33747 - DNA, 326 bp, Homo sapiens
ctcgctggcttgatgcgactaacagaaaagccactttcagaatgcctcgcctcacccggggcccagatatttacatagtggcctttcattctgcgaacagtgtgtgcctctgcaaatattttaggcctccctgcatgcttgcgggcccctacgtcccattcaccagcttttaagtttgttttgcaggcagggagccactgagagggaggcctgactcagagcacagggggccctgctgtctctgccgccgcctcctgccactgcagacttggcggggaaggaagcagtgggttttacagctggtgtttttggtttagcaaaaaaaa

SEQ ID NO: 33748 - DNA, 971 bp, Homo sapiens
cggccgcccccaaccccccggggtctcctctcctgcggggggactggagaagctgggccatcgctggtcttagggaggcagataatttagtccctgggtcgttgtgtttatagctcggggaattgaaaattgttctgtaacgcatcgtaaattaatctttccgacgttgtaaattccaaaaagcatttggtttgttagaaaaaacctgttttctccgctttataaaaacatttgaagccatgctttatattgaactcttaaggagagtattaggaactcgtccgttcaggttctaacttgttggtgttaagtgtctggattaaagactctctttttcgtgtgccgaagccatgatttctcaaattcattcagttgtgtcatacaggaaaaggaagcaaaaatttcagctttatttttgttttccggcttaggcttggttgggaagatttgatggtggttagacacgtctgcccttatttgcctgtttagaaaaacctattctaatgacaaaaacagttacattgctcccactattgtcatggttacctgaaggcaaaagtttactcaaagcttctgagattttatgttcgtttatttgcttctctttttaaaaaaatgtcagctgagtttcaggaatgagtagtctgtcaaacaagagatgaaattagaagcctggatctaagggctttggggaagtttcggttgagttcccctttcacttgtgtcggtgctgtaggactcggggtggctccagctggcgtctggcccagcagagagctgtaggggcccgctctggttgctggctgtgtggactctgagggacacccctggcgagggtgttaatgagcctgcagcgtctgagtccacccaccctcagactggcccctgactcactctgcacctgccatatcagcctccttgctagttctgaacagagccacatgctctgtccttggatcttcctggaatgc

SEQ ID NO: 33749 - DNA, 382 bp, Homo sapiens
gtatcatcttctcccttttactgatggaaaagttgtagaggagcagaacttgaactagggtttatctcaatatgttttgatttgtgggtcactacccattgttggattaatgggtgctaaatgtatttagtgggtcataactaacatttattttaatggattggtttgggatggaaggaccagagtacatagcatgtaatagaagtattatttgctgaaacttttgtttcatttacatacagacatatagagagttgcaatatatttcttactgtgagtcatgtcagaaaacatatgaaagccactggtttgttcaaatcccaatctgttcttctattttctatactgtctcctcaaaaaaataaatttcccaaattatttc

SEQ ID NO: 33750 - DNA, 416 bp, Homo sapiens
acagggtaaaaatcctattgtgttttgtgaccttcaaaccgttaagttcccaatttagaagatggctttgatcctaacttagggatatcttgcctaggcggaaagtgccaggctaagcctccagtaaataaatcaataagcatcatgagatctacaatctggaatcagacagtttgcttgattgctgagatagggtctatggcagatcctatgttttgtgttcttcagcccccatagagccttgagaagactgcagctctagccaactgcttgactgcaaccttgtgagagaccctgagctgagctaagatgctccttcctgcctggctcccagaaattgtatgagataataaatgtttgttgttactcagcaatagataactcgtgcaataacatgcaagacattttttaaaagg

SEQ ID NO: 33751 - DNA, 1602 bp, Homo sapiens
gtagaaagaacagattcgtcatgaactgagttttctaccatggcttcttacccagcagagaaccaccgtgatggtttactcttaaaaagggaaggaaaaaaaaaaaggatttcaacagtacattacaatccaagatattaacataggaagcagtggtctgtgtttttctcaattttatttttaaaaggagatgtattaatgtgaaaggtttcttctacttttcctctatctcttcacctcctctactttaagtggagatgggaaaaattgtgtaggatgcagccccacgccagcagagcccagcaataactttagatctaccagtcaaatcttgtcggctattgctctgtgcctctgttacagaagcattaatgttaattgccttccccagggatacaaagaagtagaagtaccaaaggaaagggtagatatttaacagatgcctcagtgataagaaagatgcctccttgtgtctcactgttttctagcactgaaacatgatacactttgtatccacctgcagaataaagcaatccagacaggcgctctgtaacttagacatcacttgattaaaattatagtctccaaatatagtgttttagaaaaggcactgcacatttttagaggcacgtgaatgtcattcccacctctaacccatctaacatcggtgagatgttaagaaaatgtgccgatgttactgtgaaataaagatgcctgtaattaattgtaggcatcacacacatgcgtgaacatccagagttaggtctcaaggctcttctggttctaagtcctaacaaacaatgatcttttcagtgaactgtagaattctggaaagaataagcgtacctccaggctgcttacatcaatagcttacacgtgcttcctgatgcctgccttaacaacaaaaaattcgtgtccatagcaaatatttattgcatgcccactctgggctaggcactgttttagaggacaccgcagctatcaaggcagatgtggtccctgttcccatgaggctcctacatttgagtggaggaagatgtacttgtctacgttgggtgatgattagtgccatgaagaacaaaacggatacagtgagtaatgtggacagggctatcttagctatcactctaataaggtgatatctgaggagagatctgaatgaagtgaggatacaatggatatccaaggaaaagagcattccagcaaaggaaaaaacacatgcagagaccctgaaggagaagcagggtcactttgtcaaagggacagcaaggaagccaatgaccgggtgaaatgagtgaagagagcgttcagagaggacagccaaaagctctgtgggccacggcaggactttgtcccttgctgagcaagatgggaagccactgaatgtttgcgggcagggtagtgacatgctgtgacttatgtttaaaaggattactccttcatagcgatgaagaaaagctctataacaaaagttccgttgtggtggttatacagcattgtgaatgtacttaatgccaatgaattgtgtactttaaaatggtaaattttatgttatatatgttttaccacaataaaaataatttttttaaaggaaaaaaaaag

SEQ ID NO: 33752 - DNA, 845 bp, Homo sapiens
ctccaggctgcttacatcaatagcttacacgtgcttcctgatgcctgccttaacaacaaaaaattcgtgtccataggtgagtattagggtatgttcattgtatctcaatgaaactagtttttaaagttttcaatgcatttgtttgagatcaattaatatttggatacctatcatgacccaggatatttctttgttcagcaaatatttattgcatgcccactctgggctaggcactgttttagaggacaccgcagctatcaaggcagatgtggtccctgttcccatgaggctcctacatttgagtggaggaagatgtacttgtctacgttgggtgatgattagtgccatgaagaacaaaacggatacagtgagtaatgtggacagggctatcttagctatcactctaataaggtgatatctgaggagagatctgaatgaagtgaggatacaatggatatccaaggaaaagagcattccagcaaaggaaaaaacacatgcagagaccctgaaggagaagcagggtcactttgtcaaagggacagcaaggaagccaatgaccgggtgaaatgagtgaagagagcgttcagagaggacagccaaaagctctgtgggccacggcaggactttgtcccttgctgagcaagatgggaagccactgaatgtttgcgggcagggtagtgacatgctgtgacttatgtttaaaaggattactccttcatagcgatgaagaaaagctctataacaaaagttccgttgtggtggttatacagcattgtgaatgtacttaatgccaatgaattgtgtactttaaaatggtaaattttatgttatatatgttttaccac

SEQ ID NO: 33753 - DNA, 509 bp, Homo sapiens
ttgcatctggatatccagtctgcccaacaccatttattgaagaaactttccttacattgtgtgtttttggcgcactagaaaaatattagttgaccatatagattttcttgaataaatatgtcttcatttcctgtatgcccttaggaaatttacagagactttaaataggtgctagtttttaaaaataattttcaccagttaaagctgttttgtatgggagcagctttgagctcctcacactgtcattccagaagttgtatctctccaattatctgtagaagaaatttaactgattagggtaaaataaacaaattaatgtaaatgcaaagagaacaaacctgaagtctaactaatttggtcattaccagtaattattatttacagatagatttatttgtagttcattaactgcaaacttgcttcatttgtgtgctgtaactcattaatcagaaagctgcattgagtgatgggactctaatgtggtttgactttttaaataaatttcaaga

SEQ ID NO: 33754 - DNA, 1536 bp, Homo sapiens
  misc_feature (348)..(348): n is a, c, g, or t
  misc_feature (741)..(741): n is a, c, g, or t
  misc_feature (1110)..(1110): n is a, c, g, or t
atggatgtgtgtggctggaaagaaatggaggttgcgctggtcaattttgataattcagatgaaatccaagaagagccaggctatgccacagacttcgactcaaccagcccaaaaggccggcctgggggcagctccttctccaacgggaagatcctcatcagcgaaagcaccaaccatgagacggccttctccaagcttccgggagactatgctgaccccccagggcctgagccagtggtcctaaatgaaggaaaccagcgggtgatcatcaacattgctgggctgagatttgagacccagctcagaacccttagtcagttcccagagactctcctgggagaccggganaaaaggatgcagttctttgactccatgagaaatgagtatttctttgatcggaaccggcccagttttgatggaatcctatattattaccaatctggtgggaaaattcggcgcccagccaatgttcccattgatatctttgctgatgaaatctccttctatgagctgggtagtgaggccatggaccagttccgggaggatgaaggcttcatcaaagaccctgaaacactgctacccaccaatgacatccaccgtcagttctggctcctctttgagtaccctgaaagttccagcgctgcccgtgctgtggccgtggtctcggtgttggttgtggtcatctccatcaccatcttctgcctggagacactgccagagttccgggaggatagggagctnaaggtggtcagagaccccaatctcaacatgagcaagacagtcctctcccagaccatgttcaccgaccctttcttcatggtggagtctacctgcatcgtgtggttcaccttcgagctggtgctccggttcgtggtctgccccagcaagactgacttcttcaggaacatcatgaacatcattgacatcatctccattatcccctactttgcaactctcatcacagagctagtccaggagacagagccgagtgcccaacagaacatgtccctggccatcctgaggatcatccgcctggtgagggtcttccgcatcttcaagctctcgcgccactccaaggggctgcagatcctcgggcaaacactgaaggcntccatgcgggagttggggttgctcatcttctttctcttcattggagtcatcctcttctccagtgcagtctactttgctgaggtggatgagccagagtcccatttctctagcattcctgatggcttctggtgggcagtggtcaccatgacaactgtaggctatggggacatgtgcccgaccaccccaggggggaagattgtgggcactctgtgtgccattgcaggggtcctcaccattgccctccctgtgcctgtcattgtctccaacttcaattacttctaccaccgggagactgagaatgaagaaaagcagaacatcccaggagaaattgaaagaatcctcaacagtgtaggctcaagaatgggcagcacagactctcttaataagaccaatggtggctgttccacagagaagtctaggaaatga

SEQ ID NO: 33755 - DNA, 334 bp, Homo sapiens
aaaaaaaaacaacaaacaaacaaaaaaaccagaaaatatggtggatgtggtggctcacgcctgtaatcccagcatttgggaggccaagtcaggaggatcacttgagccctgaagtattgagaccaacctgggtagcatagcaagacccctgcctatatccatccccctcctcgcaaaaaaaaaggccaggtatggtgggcaggagcctctggtcccagctactcagaaggctgaagcaggaggatcctttcagctcaggaagttgagcctgcagtgagccatgattgcaccacggcattccagcttgggcaacagagtgagaccctctttcaaa

SEQ ID NO: 33756 - DNA, 386 bp, Homo sapiens
cctgagtagctgggactacaggtgcacaccaccacacctggctcccaattcctggtgttttgttttgttttttcaagacaagagtctcactctgtcacccaggctgcagtgcagtggtgcaatcacagcttactgccttgaccttctgggcttaagcaattctcccgcctcagcctcccaaagtgctgggattacctgcatgtgccactgcacctggccccaattccaaatttctgatgtatctatccaacacagactttcccctcctgagacagtctgagtgcatcccacatactgaatactcgatactcaattaaggggtaaaatttccccaaagcagagttaaattactgcaaaacggcacagaagctgccagccagaaacca

SEQ ID NO: 33757 - DNA, 474 bp, Homo sapiens
gcttgaaaatattattgtattctgcttagtaattttatattctagtaaaggcattgtaagtccaaagatgtatgaagatgtatgctaaagcagatagaattaggcacttgtcctgtccaaatgaggaatttttaaatttttaaatggtttttttttctatttttagacatctaatgctatagattcaaactttttctactcttgtctagatatgccaaatgctggcaaaaaattgcttttgttgttgttgttgttctttttttttgagacagagtcttgttttattggccaggctggagtgcagtggcaccatctcggctcactgcaacctctgcctcctggggttcaagccactgtgcccagcctaagaattgctatttggatgttgccgaatttgtaaaaacacagcaataagcaaaatccttttgaacaaagaagtcctgagttcatctcattggtggactgaagcaattc

SEQ ID NO: 33758 - DNA, 436 bp, Homo sapiens
agaatgttctcacaaatgtgtgtctgccaacaaattaatactccacaaagagaaactctgccccacatggcagcttccaataaatgctctgattcaaatcacaactctttcattttttttttatccccttcccccttgagggagcacatttagacaatatttgaggatgtcatctttctgctttttaaaactctctagagttttcatttaagactcttaatggttgatgactaaaactacagatctggatagtggaaaaactaataatcttaaaaaacacttctgaaatgtggtaaagtgcattcattctcttccctcctctttgtccttttcaaagaaagaaagttcaatatgaaaccaatgcaaattatgactttactcagtgagatattttaccttctttcagactgtttcatactgaagtttataaaaaaaa

SEQ ID NO: 33759 - DNA, 404 bp, Homo sapiens
ctattaattcgcggccgcgtggacatccaattagttcagtcagttgcctcccctcttcagtggaagattttgtttttagttcagtttaggaaggaagatttcctttcaggaggccaggtgtggtggctcacacctgtaatcaatcacagcactttgggaggccaaggcgggagcccagaatttccagaccagtctaggcgacatagtgagacaccctgtctttacaaaaaaaattaaaacaatatagctgagtgtggtggagaatgcatacctgtagtcccagctactcgggaggctgaggtgagaggatcacttgagcctgtgaggtcaaggctgcagtgagctgtgatcacgccactgcactatagcctgggcaatagagcaaagccttgtctccaaaaaaa

SEQ ID NO: 33760 - DNA, 383 bp, Homo sapiens
gtcgtagaatttactagggaagctatctaggcctagagtttccttagtggaaggttttgttttgttgtttgtttgtttattttgagacggagtctcgctctgttgcccaggctggagaggctggagtgcagcggcgggatcacggctcattgcagcctctgcctcctaggttcaagcaattaccgtgcctcagccacatgagtagctgggattacaggtgaacgtcaccatgcccggctaatttttgtacttttagtagaaatgaagtttcaccatgttgcccaggctggtctcaaactcctgacctcaagtgatctgccctcctcagcctcccaaagtgctaggattacaggcgtgagtcagcacgcctggcctagaagttt

SEQ ID NO: 33761 - DNA, 389 bp, Homo sapiens
tttttttttgagacagtcttgctctgttgcccaggctggagtgcagtggtgtgatctcagctcactgcaacctctgcctcctgtgttaaagtgattctcctgcctcagcctcctgagtagctgggattacaggcatgcaccaccacaccaggctaattttgtatctttagtagagacggggtttctccatgttggtcagactggtcttgaactcccgacctcaggtgatccgcccgcctcagtctcccaaaagtgctgggattacaggtgtgagccactgcgcctggctgaaaccacgtgttctaatgcagttttttttctacaggacttaaaaaagacaatgtcctcatttactactcatatgaagtaaatgttaaaaatcatctcta

SEQ ID NO: 33762 - DNA, 345 bp, Homo sapiens
ttccaaacctggggtggggagattagataaccacggtcaacccactggtcccagagcttccccatttgcaaactggggctgtaatttgaaaaagcaaaagaaggggatggtgtgagtaatgatgaaaaccagggtttctgagaccaccacttagtaattaaacttggaagcagtgggtgggaaaagaagcaaactagtggcttctcaaaactagcctgagttaactactatggatatggccctggatggacctgggagggatcttgccccagtatccgctgcataacctcaacctgtctccttgggatggtggtgagaacaggcctgactcgggagcagtgccct

SEQ ID NO: 33763 - DNA, 438 bp, Homo sapiens
gagtagtggtctaggagttgagagatcgggttctactcctgggagccactagctgtgtgttgctagagaagtcacctaaccattctggcctcgccgttgataaaatgagggtgttagacccacagacagacctagtcaaaacagcaagctaatgtgtaatggcagaatatcctgtaagtcaagtatttcttgcagtaagttcattcagaacatcatttagtgaagccagtgctccacatttaacccttccaacctcatctcatttaacaagagtttgtggaactagccaggcctgatggcacgcacctctgtattcccagctactcaggaggctgagataggaggattgtttgagcctgggaggtcgaggctgcagaaagctgtgttcatgccactacacttcagcctgggtgacagagtgagaccctgtctccaaga

SEQ ID NO: 33764 - DNA, 453 bp, Homo sapiens
ttcttgaaagaaagaaaacaaagttcagatggtcagcaacttcatattgacagtgtccagccaacagtagaaaaggtactcagtttatgaagaaagtcagtcaatagaaacagacctagagatgactttaaaaaatttcttcgtttctttaaaagataattgactgtttagatatgtttaaagatttaaaataagtcagtagagaaatggaactaaaggaaaattctagatgaaaattacaacatctgatgaaaaatttgctagatgagtttaatagtagatcagatgctgtaaaaaaaaataaagactagtgaacatgcagtcagggcaatagaaagtattcaagtgaggctgggtacagtggctcacacctgtaaccccaacactttggaagactgaggttggaggatcccttgaactcaggagttcaagaccagcctgggcaacatggtg

SEQ ID NO: 33765 - DNA, 450 bp, Homo sapiens
gtcatcccctttagagtataagctccaggaactttgattattcaccatcattttggcaacttgcatagcctctggcacatagagaggtgccaatatttgttaaatatttgtgaactaaataaatgcgctaattaagcctcttaccaagggcctggcagaccccatgctaagcactccagaaaacatgatcgtgttaattcctgggcaacatcctctgacggtagatattagtggttctgttttccagaccaagacacaggctcagagtatttaaatgacttggccaaggtcctgtggcttagaggcactaggacccatatttgcaccaggtctgctgggatgggcagaggccagtcttctgaaccacgggcatcactgctttgtggccctgtgccctgtgccagtcacagaggggacatacaatatctgcaggagggcagggtgtttgct

SEQ ID NO: 33766 - DNA, 736 bp, Homo sapiens
tgtcttagggttggagaagggaccaagcctcccctgaaagctgaggggtttatggtcaagaagaaagagtaactatggccacctttaggtcaccagccaataatactgcttctctatcctgttctgctgtgacatttgtcccagcaggtgttccagtctgtcctacagtagtgagaccacctgatatggtgaggaaggcaggtaattgatcttactccatcatatcatcacatctatttccaccccccgcccttggagacaaggtctcactccatcatttaggccggaatgcagtggtgcaatcatagctcattgtagtctcaaacacctgggcccaagtgatcctcactgtagtctcccaagtagctaggactacaggcacatgccaccacacctggctaattaaaaaaaattttttttgcacagagatgggggtcttgatatgttgcccaggctggtctggaactcctggccacaagtgatcctcccacctcagcctcccaaagcactgggattactgttgtgagccaccatgaccagccccatcacttcttttgtaggtttgtatttgtttttatttttgacaaagacttttatttcacggtgacttcttcacaagtttcctcagatgctagtctgaacaaaggagagcagggaactagaaatgtagactttctgttttttccagctatggcatcactgatctcatccatcttactaaagtttgtgcagtctc

SEQ ID NO: 33767 - DNA, 1324 bp, Homo sapiens
aggcgtgagtcaccgcccctggcctccaagtgatcttaattgcatactaatgtgttaaggactttaatgtgttaactctttaagatagagttaaacacactgtttcctaagggtttgtttttacatcttctgtaaaaacaaaggtatatgttttactaaaccagcattttagttgtggaccctaagtctaccttgaaaaaaaaaatgatatgatttttaacattctaatgagtacaagatgacagtgaacaacagtaatgtaccaagtcagggaaagtaggtggtgggggtggctacaggctgggaacatggtgagttgcttggtattgttttaaaattctctacagccaatacactccccttattgtctgtatcttgcctctgccctgatcttagccatccattgcattattatgaattggtaatcaacaactctgatagaaattgacttgctattttctctaattgggctggttatatattgccctattgtccttagcgccttttcgattctcaagaaggttgcataattccagcagccttccatgtaaatggcagtagtatagagtagctgagataaagaatagtctccaggggactgactatataatataggaagttgaagcagtagggtagttcctaaatgttaataaatttcccccagtaagccctgtaaaggcagggaattggagcggggggtggggggtagggggcaggtgttctcccaagggcaaggagaaaggaccttacaaaattattgtattaaagtctgaaatgctttataggatttagagcctaagtaggagcatggtgttcttgtaatagcaatccaaatctgttattttagttgttaagggagaaattctttaaaagtcttcaaagaaattagagataggcattaatttattaaacagtgataatagaggttattggaatctattttgggaaactttaagtcatttggtattgggaagagagtacttcaaggttaatttgtataaatttaattttgttataagaggctgtactctgtttgcactctagaattaggaaggttactttcctgacttttgtatttctcaggaaaaaaagaattggaagaaacttaagaggtctgttaatgccagtacctaaacgtgacatttaacatggcatggaagctatgctttgaataaacacttgagaaaaggaattacataatttcttttttgttgtatggatggctttggattatacagagcttaacatttatataaaacaccagtctgagactgatgaagtgaaaacctttttattataaaataaaaattggaagaatggcatt

SEQ ID NO: 33768 - DNA, 1448 bp, Homo sapiens
ctttatgtgactgataaaaaacatcttaaagctcccatgttaaaatataaaaatggtttgacaatttttgattaccatgactgtcagttatatactatattatgaatatgcagtgtggttcttgttggttgatctgtttaccctgcatagattttaatctgtactttaaaacatctatgataaaaatagtgacagacagaaattaccccaaaaagagacctaggccaggaagggggtgggagctttcataggaatacagcctagaactctccattgtagccacgtatggaatcagccttacttacatgtaggacctttgtgctttaagagctctgggacatattggccaaatagaaaagaagaggacagtatttcaactcagtcatactcaatatttccaattaagatataatcctgacaccattgttcaattaactttgacgccagaagtcaaagccagaactgggaccccacagctcttaagtactggtccctatcctgcctatgcctatagccagccacactggtttccaagttctgtgatcattttgctacaatcatgttagggtgaaaatctgtacgtcagaactgttaaatgctaattatttttaagtgcatgagacctggggccttctctttctacttgcactctgcttatactagtttctatttgtagatctcaggccttcatcataaagacctctatcaactcacaaaagtatttgtctctattagagtggcatgtggtcatttgagtaaaaaaaaaaaaattacatgggtatcggattcataggcatcctgtccatctaagacaagtgttaattttattggcccatcagctggagcccctttcctcttagccataccattgttttctaccaaattaccactcaatatcttaatgaaagcactcaacattaagtgacataaacagtggcatttgggtaagcaacactcagtggggtgctgacatacagtttgggtaagattaaaaaacaccaaaggctgaaatctgtgagtaccaagaactgtgcatataggtttagaaattgactgtgtaccctagaatgtgcagtgtaatattttcaataggtgtttttttaaagaacactagatttttggaataatatatttctaattaggactatactgtttttcaatggtctgttaaaacatcatacagaatatttatttagtttattgtcatgtattggctaactttcaggggcctcagattccatatgtcttcagtggattgatgaatatcaggttaatttgtgcctgccccagccatctctactttattctgaggtattccacaatcctcttgttgcaggtgctgctaaaaaaaactcaaaattgtgtatcaaatattttctttcaactgtaaaaaatcatctgtgttaaagtgaataaaaagtgcattttgaataaccagcaaaaaaagt

SEQ ID NO: 33769 - DNA, 427 bp, Homo sapiens
acttgagaaaggaatatcaatttcataaatcctttcaaagaaccaacttttgacattgctttttctctgtggtttatctgttttctgtttcatgatttgagctctttaattccttcccttctccttactttgggtttaatttgctcttttttccctagttttaagtgaaagcttagatcattgattttcgaaactccttttaaaaaacaattattaacatttaaagctataagtttccctgtaagcattctttagctgcatcccacagatattgatatgatttaattattattccattcaaaatatttttaaattcctcttggaatttatttgacccatgggttgtttgaaagaatgtttccaaataattttcaaatatttggtatttttcaggtatccttttgttactgtgttttcatttaatgcc

SEQ ID NO: 33770 - DNA, 1210 bp, Homo sapiens
ccatcactggatatgattgattctaaaactatctatacctttttataggatgcaatttatctgaacctatggtgatcacataaaattaactattttctacttaaaaatgaaataattaacttgtatctccttggggttgtaaggccttcataatatagccaaatcctttaaaattcatgtgttggggggacatctgacatgtcctttcacgtgggattgaaggaaaggagccactggccacagatattgtacatatggatctttttatgaacataagactttattttgctgtttccctaatacatagtcatgcagttcatatttgaacatttttggtaatctggtaagcctatttaaaagtttttcttatagtgacctaaaatatacttttctctgatttccgttccttccttttcttctgctgtttataactctgggaagtctggtgctgacacaagctggagcaccaagagcagagtcttaaagaaaagacaaataggaaagggaataactgtccttactatagacacaaaggtgaataaataggactacacaaacctcaagacctagatcatatgctccatactcaatacgtttaaattttgttggtgaaacacaagagacaaatgtggagaacgaattgtattcaaagccaactgcaacatctcaaacataactagtctattagaaggtggtgcatggtagacagggttcaacccccagaggaggaagtctttaaaagggagatggttggtaaggcacccttgagagggttcagagcaggggcccagtgccagtgggagaatgaagtcaaaatcggagctcaaatgcatgatgcctacacggtgaacaattagaaaggctatagcttagatgactagtagagtttgttaactcattaactcatcaaaaatgtttatggagtatctgatatgctttaggcagcaccctgataagtggtagagacacaatagagaagaagacagatcagatctttagccttcagattcactgactatcaagcctatggcattgaggctcaagattcaattgtcaggattatattaatctaccctatttttatacgtatgttatgttgcagcatcatagctctcaaaaatatactgaaataaggcaaaacaaatacattaacatgcccattttgtcttactcattatgatgtgaacaaggtgttcccatgtcattgtaa

SEQ ID NO: 33771 - DNA, 563 bp, Homo sapiens
gtatttaccatgcttggtgtcctctgagcttcctggatttggtgtttgtcattaattctgggaaatcctcaagttattattacttcaaatatttcttctgttcctttctttcttccacttctgatattcccattatgcttatgttacaccttttgtaattaaactatggaattgaactatggaattatgtaattgaactatgtaaatgaactatggaactatgttccatctttttcattcaactgaagcagcaaaccaagcatcagaaccagactcagatatgacagattttggaattatcagactgggaacttaaaaaaactatgattaagacactaagtgctctaaagaaaaaagaagataatgatgactaaacactatgtgtttaatttttttcatcagttcatttaatacacaattactgacactaaagattttagtttagaggaaaagtgtatacttacaatactttaaacttttaaaatgaggctgtaggattatattcaaaaacattaaaattatggaattatgaattccaccttggaggacttaagaatgattga

SEQ ID NO: 33772 - DNA, 397 bp, Homo sapiens
ctgcagttcctgatactggtttttctacatgcttcagccaaagacatatactctttgatccctgagaacactatttcctcagtgtctttgcacatggagttcacttctctgcttgtgaagtctatgaatattgcatggctgatttgtcacaattttaagtcttcaacatctggagtgttctggcaagaatttgtaggaaaaatttttgaatcatcagattaccatagcacaaccttggagaataaaactcttttgctctgaagctcatctaataacctgatatctctcaaatgaatctatccaatgacagggaataccccatgttaaacagctgattcttgttctgaatacgtttattatcttgtagttagtaaataaatcaattggacccttaaga

SEQ ID NO: 33773 - DNA, 325 bp, Homo sapiens
tgtttccctgaatttaagtaaatttttggaaacctaccaagagaaaactaagtaaaagcttagtgtaaaaaaaaaattgcataaataagttctgattatacttcagatttagaagcagaatatatttatcaatgaaaaatttcttgtaagctgagcatggtggcacatgtctttagttccagctacttgggaggctgaggcaggaggattgcttgaagccaggagtttaaggctgcaatgtgctaggctcatgcctgtgaatagccactacaccctagcctgggcaacaaagtgagaccctgtctctggggggggaaaaaaaaaa

SEQ ID NO: 33774 - DNA, 315 bp, Homo sapiens
tacccaatttggagtacatatgtaaatttgttacatagatatattgctgatgctgaggtgtggggtacaaatgatccaatcaccttggtagtaaacctagtactcaataagtagttgggtactactaaagattaggttcaactacaaggttcaactacttattgagtactatgttcactacaaggacccaacttgtagtgaacacagaggagaacaagtcattccttgtttccctgtctttctccctcctctagtgtttattgtttccatctttatgtccacatgtacccaatgattagctcctacttatatgtg

SEQ ID NO: 33775 - DNA, 743 bp, Homo sapiens
ttcccttgtcatatttctgaaactccattataacatatgtaactcctttgtaaccaaaatttaggtaagcaggcttcctttgctctgaaggttttgagtacctggctgtatttgttgagtatttttaaaattttggatagtctcttaggcaacaataatcacaatatattcatcccttcagttctggagaaagcctgataccaggcacagcctactgaccccaaggagcctggcactgattggcatcacattgatctagaactggtccagccgacgaagagtaggaaaagagaagggctgctcagggaaacattggctgggggcacggaataagcacatagtaaaaagggaacatcagggtcaaatggaaatcacctgagacaggaaacagggagttcatttggccacactggaagaaaggcaagaaagaggaagacaagtcttggagtaccctggctgttctccacactcacaagacatcagctatatactctgcttggtgcataagaaagagaaaagagatgccttttgtgttttgagtaagaataattaaaccataaggaagaccatgtataaaactgatggaaataatagtcaccaaagtacagcacataccattttgtgtctaataacaatgtagcacagtaatgactgtacatgtcattgtatgtataccaaacaagattgttgtaaatcatattttttattacaacactaagttctgcttctgcattcctaggttt

SEQ ID NO: 33776 - DNA, 714 bp, Homo sapiens
ctaggcagtgctgcagagcagggagagacccatgttctatcttttaagcctttctgtcctcccagattcaagtctcagtcatctccttcctccagtgtcgctactgatagatccaaagcaaagaatgggcctcacaggggcccagaaacgctcatgaactgggaggcaaccttctgtacatacgcgaatgtttgggagagggtccacataggcgaatgttcgggagagggtccacataggcgaatgttcgggagagggtccacataggcgaatgttcgggagagggtccacataggcgaatgtttgggagaggacccacagctttcattaggtactcaaagggggtcctccctttccaaagggaatggccactgatctggtctgtattttgtaacttaagtactgaacaggaaggccaggaatttactaaagagatcagtgaagcagaaatctgggtttaagtcccaaacaaacctacagggcaaatcccagttctacagtttttagttgtatacctttaagtaagttactaaaatttctgagcctttataaaaaggaatttttttaaaaatcaaattttttaagatcgttaattggactgagaatgtcaagcccttagcaagtactcccaaaccatagctattaatattaccaatattattcttagctctcggaagagagggatctttcggtgccttaagtaaaatctacaaa

SEQ ID NO: 33777 - DNA, 262 bp, Homo sapiens
ggctctgatgccagggctactcctccctctaggccatcattagcaaagcctttcctactgatggtgtgggccctgcccatgggggcgtgggacctgttgcatggatgatctggtttgtaggagagccagagaggtggcaggtagcaggtgaggtagcttgtaatctgaatttgcatcttccaacttgagtcttctgcaaaggtcagcatacagggtggaataatactgaggaaaagtagtaactgaaattcaagtactcaat

SEQ ID NO: 33778 - DNA, 938 bp, Homo sapiens
ttcctagtctgatttttctcagtctcggcccttctcacatccctaacccacccccaattctcagataaaaattttcaggtttcctgctatgtcatgtgttgatatatgccagagatttggtcatacagttttaccttagtgctgaaagagaccagacttcatctggttaattattaggaggcagctgctggcacatactctagccattccagactttcatggagagagcttgatctcagtgttttggaaaaacaaaaagtaactccttcctatgaaaaggggtggggtgctcagcctcatcagtaatcggaggaatgcaaattaaaactgcagtgatatattggttttatgttcatcagattggtaaaaattaaagtctgacaaaaaatgttgggaaggatgtgaagcaactagaactctgcaagcagaagtgtaaatgagcacaaccattttggaaaaacaatttggtattgtctcataattaaagatgtacatgccctgtgacccagaaattccactcctgggtatttaccctaaagaactttacatatgtggaccaggagacatgtacaaaaacatccatagcaacactgttgacaatagcaaaacaaactaacagaaaattcaaactggagaaaaaatcccaatgtcgatcaacttgagattggataagttaatcatgatatgttcctacaatagaatactatatagcagtgaaaaagtaaatcgcagctatagcaacataaactaatctcaagaacaaaaagttgcagaagggtatatacgttaatattagaaataaaaaaatcaggtcaagaccaacctgggcaatatagtgagacactgtctctacaaaaaaattttaaaagtggctgggcgcagtagttcatgcctgtaatcccagccttttgggaggccaaggcgggaggatcccttga

SEQ ID NO: 33779 - DNA, 410 bp, Homo sapiens
agacaaatacccaaattgttttccccaaagtggttgtgctcatttacacttctgcttgcagagttctagttgcttcacatccttcccaacattttttgtcagactttaatttttaccaatgtcgatcaacttgagattggataagttaatcatgatatgttcctacaatagaatactatatagcagtgaaaaagtaaatcgcagctatagcaacataaactaatctcaagaacaaaaagttgcagaagggtatatacgttaatattagaaataaaaaaatcaggtcaagaccaacctgggcaatatagtgagacactgtctctacaaaaaaattttaaaagtggctgggcgcagtagttcatgcctgtaatcccagccttttgggaggccaaggcgggaggatcccttga

SEQ ID NO: 33780 - DNA, 593 bp, Homo sapiens
agtttactccctgccatgtttgactattagatgtttggagaacaatgagatacccattttggtggggaggcgtgagttttaaggaaggaagtcgtgggaaaggaaggcaggcaggggaggccatttgaggatggactcttagtgcctggctgagggggttatctctaacttggggagccagggaaaggtaaaatgtacataacatcagatttaccattttaaccattttcagtgtatggttccctgggcattaattacactcacaatgttttacaaccatcaccactatccatctccagagccttttttaaaaatcatcccatacagaaactctgtacccgttacacaatcattccccatttccactcccaccagcctctggtaacctctgtactactttctgtcttgatgaatttgcctattctagttacctcatagaagcagaatcagacaatccttgtccttttgcatctggcttatttcacttagcatgatgttttccagccttatccgggctgtagaatgtgtcagaattttattccctttttttaagttaaaaaatatttatccttatgacctggcagtcacatgag

SEQ ID NO: 33781 - DNA, 410 bp, Homo sapiens
tttcaaatcaaatcaacaaacgtttgcactccagcaaggctctataggagataaaacgacatggtttacataaaaagatacatagtaattaagataacatatcctaggtgccaaatgagtggttcagataagtgctatggcatgagaggatggaatgattgccatgacctggaattgtcagagagaactttgcaaaggaaattggtgagctgagcctgaatggatgagtagaaataatatgaaatctttgtaatagactgataattgcactttgattaatttgcccagcacaccatgttagaaggtaccttttaggttgattattttaataccacctacatctcattatcttggaatatatctaataatagaaaaaaaaaaaagcccgttggagctggggccagtagcac

SEQ ID NO: 33782 - DNA, 482 bp, Homo sapiens
ggtgtgatcttggctcaccacaacctccgactcccaggttcaagtgattctcctgcctcagcctcccgagtacctgggattacaggcatgtgccaccaggcctggctaattttagtagagacaggatttctccatgttggtcaggttggtctcaaactcccaacttcaggtgatctgcctgccttggcctcccagagtgctaggattacaggcgtgagccaccgcacccagcctatttctgcaaccttctaagcccaacagtccctctctctgttccagcttgtgactttgccctttgcccccttttccaatggggaaaaatgagtgacaagaaagcatggggaagatgtgctaactactgtgtcccggacatgtaaggtacagttgctcttctcttaggattcaactcaactatattttctagtctgcctctcctaactaccttatgcatcaatgtaataaacttcctagtgttcaccttg

SEQ ID NO: 33783 - DNA, 3338 bp, Homo sapiens
catgtgggcatcactggcgagagcgacggaccatccaagggcaagcacaattttcctgagcaaatctcaaacggatgtgcgagaaaagaggaagagcaaccatttgaaccatgtatctccagggcagcttactaaaaagtatagctcatgctcaacaatatttctagatgacagcacagtcagccagcctaatcttagaaccacagtaaaatgtgtgaccttagcaatatattaccacataaagaacagagatgcaaatagatccctggatatttttgatgagagatcacatccacttacacgagaaaaagttccagaggaatactttaagcatgatcctgagcacaaatttatttacagatttgttcgtactctttttagtgctgcacagctaacagctgaatgtgcaatagtaactttggtttacttagaaaggcttttaacttatgctgaaatcgacatttgtcccaccaactggaaaaggattgttctgggagccattcttcttgcctccaaggtttgggacgatcaggctgtatggaatgtggactactgccagatcctcaaggacattacagttgaggacatgaatgaaatggaaaggcattttctggagcttcttcagtttaatattaatgttcctgccagtgtttatgccaaatactactttgaccttcgctccttagcagatgacaacaacctgaattttctatttgctcctcttagcaaagaaagagcacagaacctagaggctatttctagattgtgtgaagacaaagacttgtgtagagccgctatgagaaggtctttcagtgctgataacttcattggtattcagcgctctaaagccatcctctcttaaaaggagaaatgaggggttataacgtcatgggaccttcatctacaaagactggagaaataccacctttcctgctcaaaaaccagcaaaattagtgttttcatcaaaaggaaagatctcaaattcaagagactcatggacaacaaggattatactccacaggaaagaatgggaccttgtcaatgcaacaaaacactcttctgtcctttttaatgtaaacagagttacaaaaaccactccaaagtgaaggctcccatcctacacacagatatttgcttactgtgtgggccgatagctgtgaactatgtaaggttttttaaacaatagtttaaatttttagactttaaagacactaaccatataacttttatgtttcttccagtttctctccctccccccgcattttgctgcatatgcctttaaaatcaatgcagtattaccattaaaacatgggactctaactaaagccacttaggagcagacagcagcgttgttaggtactgaagggttcttcctccctactgttaaccattgaagctgctagtcattggcaatcattttaaaccaaaaagctgctggataacatttgtcattcatattctttgcaagcattactttagcattttagcatgtttggggtcataaacagaggaagtatcagttattgatatctacttctattggagtccatgttgcatttcttgtgaactataaatggtgcttctcattttctgataatttttctcttgctaaataaatgtattaaaagatattttcataatgccaaccaacatggtggttcagtgacgatgagaaaaagtgaagcagttttaagcttgaatatagtttgggccctccaaggcactgcagcatgagtataaatgctataaacctttaaaaaacatgatttgaaagttttttgttttgtttgtttgtttttaaagagatgggggtcttactgcgttgtccaggctggagtgcagtggcttttcacaggtgcaatcattgtgcactcactgcagcctagaacttcctggtctcaagccatcctctagcctcagccacacaagtagctgggactacaagtgcaactggcacctgtctcctgaatattaagcttttaattttttgtttcggtcactcttgatagcagacattgactgaaacaaaaaattaaaagctttatattcaaaatttgcaaaatgaagctgggtgtggtggtgcacgcctatagtcccagctacttgggaggctgaggctggaggattgcttgaggtcaagtattggaggctgcagtgtaccatgatggtgcctataggaatagctactgcactccaacctggacaacgttatcaagaccccatctcttagaaaaatgcaaaattaaatgcaaaagaaatgggctgggcatagtgattcatgcctgtaatctcagtaccctgggaggctgaggtggaaggattgcttgagtgcaggagttcaagaccagtctaggcaacatagtgagaccctgcctgtaaaaaaaaataataaaaatagttggatatggtggcatgtgtctgtagtcccagccactctggaggctaaggtgggaggatcagtagagcccaggaggtcaaggctgcagtgggccatgatcatgtcactgctctccaacctgggcgacatccagaccctgtctcaaagaaaaaagcagaagaaaaatgttcagacaaggttttgtaaaggtttgtagcatttatatttctacaagtatcaaagcttaaaattacactgaacttttggaataccttgtatctccataaaatgccctctttttaaaagtagttacccgcagagctgtgctctatatgctttgattaccgcagtttctttaaaggaagattttgaagagcagtgttaattaacatgtaataaaaggaattggaccctaattatagaaggtgatatgaacagctgttttatcatcctacatgctaccaagctgtaggtgtcccattaagtcctgctatttaagaaatacttacataacccttaggaactcttcaggctttaaaaggcaaggagcaaataattttaggagaccgataatgtcacctaaatttgaaatactaagaagaggttagtgttctcaactatgtgaaatctgtttctcctactttctcaaatctaatcctaggaatcttgcttataaacaaagcatttctgggacaggagtacttcctctattatagcaatgcttcacatcatattgtgctgcagtttccatcatttttaaaggacagagacataaatgataaataatggtatacaaatattacaatctaccacctcaaaaaaacaaatattgtttatggaattcagagtttggagattcaagtattgattgcagttttattttgaaaagaatgctacaatttatgtggtttttatttctcatgtttatattaaaagctaataaactctattttaattaaaa

SEQ ID NO: 33784 - DNA, 2858 bp, Homo sapiens
tggaactctgaagaatgaggcccgagtcagcagcacaagtgcatcggaggccgtaaccttcaaccttcatcccagttccagagtgctgggatgcagaagggaccacaagaatgaaatggaaaggcattttctggagcttcttcagtttaatattaatgttcctgccagtgtttatgccaaatactactttgaccttcgctccttagcagatgacaacaacctgaattttctatttgctcctcttagcaaagaaagagcacagaacctagaggctatttctagattgtgtgaagacaaagacttgtgtagagccgctatgagaaggtctttcagtgctgataacttcattggtattcagcgctctaaagccatcctctcttaaaaggagaaatgaggggttataacgtcatgggaccttcatctacaaagactggagaaataccacctttcctgctcaaaaaccagcaaaattagtgttttcatcaaaaggaaagatctcaaattcaagagactcatggacaacaaggattatactccacaggaaagaatgggaccttgtcaatgcaacaaaacactcttctgtcctttttaatgtaaacagagttacaaaaaccactccaaagtgaaggctcccatcctacacacagatatttgcttactgtgtgggccgatagctgtgaactatgtaaggttttttaaacaatagtttaaatttttagactttaaagacactaaccatataacttttatgtttcttccagtttctctccctccccccgcattttgctgcatatgcctttaaaatcaatgcagtattaccattaaaacatgggactctaactaaagccacttaggagcagacagcagcgttgttaggtactgaagggttcttcctccctactgttaaccattgaagctgctagtcattggcaatcattttaaaccaaaaagctgctggataacatttgtcattcatattctttgcaagcattactttagcattttagcatgtttggggtcataaacagaggaagtatcagttattgatatctacttctattggagtccatgttgcatttcttgtgaactataaatggtgcttctcattttctgataatttttctcttgctaaataaatgtattaaaagatattttcataatgccaaccaacatggtggttcagtgacgatgagaaaaagtgaagcagttttaagcttgaatatagtttgggccctccaaggcactgcagcatgagtataaatgctataaacctttaaaaaacatgatttgaaagttttttgttttgtttgtttgtttttaaagagatgggggtcttactgcgttgtccaggctggagtgcagtggcttttcacaggtgcaatcattgtgcactcactgcagcctagaacttcctggtctcaagccatcctctagcctcagccacacaagtagctgggactacaagtgcaactggcacctgtctcctgaatattaagcttttaattttttgtttcggtcactcttgatagcagacattgactgaaacaaaaaattaaaagctttatattcaaaatttgcaaaatgaagctgggtgtggtggtgcacgcctatagtcccagctacttgggaggctgaggctggaggattgcttgaggtcaagtattggaggctgcagtgtaccatgatggtgcctataggaatagctactgcactccaacctggacaacgttatcaagaccccatctcttagaaaaatgcaaaattaaatgcaaaagaaatgggctgggcatagtgattcatgcctgtaatctcagtaccctgggaggctgaggtggaaggattgcttgagtgcaggagttcaagaccagtctaggcaacatagtgagaccctgcctgtaaaaaaaaataataaaaatagttggatatggtggcatgtgtctgtagtcccagccactctggaggctaaggtgggaggatcagtagagcccaggaggtcaaggctgcagtgggccatgatcatgtcactgctctccaacctgggcgacatccagaccctgtctcaaagaaaaaagcagaagaaaaatgttcagacaaggttttgtaaaggtttgtagcatttatatttctacaagtatcaaagcttaaaattacactgaacttttggaataccttgtatctccataaaatgccctctttttaaaagtagttacccgcagagctgtgctctatatgctttgattaccgcagtttctttaaaggaagattttgaagagcagtgttaattaacatgtaataaaaggaattggaccctaattatagaaggtgatatgaacagctgttttatcatcctacatgctaccaagctgtaggtgtcccattaagtcctgctatttaagaaatacttacataacccttaggaactcttcaggctttaaaaggcaaggagcaaataattttaggagaccgataatgtcacctaaatttgaaatactaagaagaggttagtgttctcaactatgtgaaatctgtttctcctactttctcaaatctaatcctaggaatcttgcttataaacaaagcatttctgggacaggagtacttcctctattatagcaatgcttcacatcatattgtgctgcagtttccatcatttttaaaggacagagacataaatgataaataatggtatacaaatattacaatctaccacctcaaaaaaacaaatattgtttatggaattcagagtttggagattcaagtattgattgcagttttattttgaaaagaatgctacaatttatgtggtttttatttctcatgtttatattaaaagctaataaactctattttaattaaaa

SEQ ID NO: 33785 - DNA, 2483 bp, Homo sapiens
tctagaggatcctgtggatgaggaacgtcagtcatgggaccttcatctacaaagactggagaaataccacctttcctgctcaaaaaccagcaaaattagtgttttcatcaaaaggaaagatctcaaattcaagagactcatggacaacaaggattatactccacaggaaagaatgggaccttgtcaatgcaacaaaacactcttctgtcctttttaatgtaaacagagttacaaaaaccactccaaagtgaaggctcccatcctacacacagatatttgcttactgtgtgggccgatagctgtgaactatgtaaggttttttaaacaatagtttaaatttttagactttaaagacactaaccatataacttttatgtttcttccagtttctctccctccccccgcattttgctgcatatgcctttaaaatcaatgcagtattaccattaaaacatgggactctaactaaagccacttaggagcagacagcagcgttgttaggtactgaagggttcttcctccctactgttaaccattgaagctgctagtcattggcaatcattttaaaccaaaaagctgctggataacatttgtcattcatattctttgcaagcattactttagcattttagcatgtttggggtcataaacagaggaagtatcagttattgatatctacttctattggagtccatgttgcatttcttgtgaactataaatggtgcttctcattttctgataatttttctcttgctaaataaatgtattaaaagatattttcataatgccaaccaacatggtggttcagtgacgatgagaaaaagtgaagcagttttaagcttgaatatagtttgggccctccaaggcactgcagcatgagtataaatgctataaacctttaaaaaacatgatttgaaagttttttgttttgtttgtttgtttttaaagagatgggggtcttactgcgttgtccaggctggagtgcagtggcttttcacaggtgcaatcattgtgcactcactgcagcctagaacttcctggtctcaagccatcctctagcctcagccacacaagtagctgggactacaagtgcaactggcacctgtctcctgaatattaagcttttaattttttgtttcggtcactcttgatagcagacattgactgaaacaaaaaattaaaagctttatattcaaaatttgcaaaatgaagctgggtgtggtggtgcacgcctatagtcccagctacttgggaggctgaggctggaggattgcttgaggtcaagtattggaggctgcagtgtaccatgatggtgcctataggaatagctactgcactccaacctggacaacgttatcaagaccccatctcttagaaaaatgcaaaattaaatgcaaaagaaatgggctgggcatagtgattcatgcctgtaatctcagtaccctgggaggctgaggtggaaggattgcttgagtgcaggagttcaagaccagtctaggcaacatagtgagaccctgcctgtaaaaaaaaataataaaaatagttggatatggtggcatgtgtctgtagtcccagccactctggaggctaaggtgggaggatcagtagagcccaggaggtcaaggctgcagtgggccatgatcatgtcactgctctccaacctgggcgacatccagaccctgtctcaaagaaaaaagcagaagaaaaatgttcagacaaggttttgtaaaggtttgtagcatttatatttctacaagtatcaaagcttaaaattacactgaacttttggaataccttgtatctccataaaatgccctctttttaaaagtagttacccgcagagctgtgctctatatgctttgattaccgcagtttctttaaaggaagattttgaagagcagtgttaattaacatgtaataaaaggaattggaccctaattatagaaggtgatatgaacagctgttttatcatcctacatgctaccaagctgtaggtgtcccattaagtcctgctatttaagaaatacttacataacccttaggaactcttcaggctttaaaaggcaaggagcaaataattttaggagaccgataatgtcacctaaatttgaaatactaagaagaggttagtgttctcaactatgtgaaatctgtttctcctactttctcaaatctaatcctaggaatcttgcttataaacaaagcatttctgggacaggagtacttcctctattatagcaatgcttcacatcatattgtgctgcagtttccatcatttttaaaggacagagacataaatgataaataatggtatacaaatattacaatctaccacctcaaaaaaacaaatattgtttatggaattcagagtttggagattcaagtattgattgcagttttattttgaaaagaatgctacaatttatgtggtttttatttctcatgtttatattaaaagctaataaactctattttaattaaaa

SEQ ID NO: 33786 - DNA, 3158 bp, Homo sapiens
catgtgggcatcactggcgagagcgacggaccatccaagggcaagcacaattttcctgagcaaatctcaaacggatgtgcgagaaaagaggaagagcaaccatttgaaccatgtatctccagggcagcttactaaaaagtatagctcatgctcaacaatatttctagatgacagcacagtcagccagcctaatcttagaaccacagtaaaatgtgtgaccttagcaatatattaccacataaagaacagagatgcaaatagatccctggatatttttgatgagagatcacatccacttacacgagaaaaagttccagaggaatactttaagcatgatcctgagcacaaatttatttacagatttgttcgtactctttttagtgctgcacagctaacagctgaatgtgcaatagtaactttggtttacttagaaaggcttttaacttatgctgaaatcgacatttgtcccaccaactggaaaaggattgttctgggagccattcttcttgcctccaaggtttgggacgatcaggctgtatggaatgtggactactgccagatcctcaaggacattacagttgaggacatgaatgaaatggaaaggcattttctggagcttcttcagtttaatattaatgttcctgccagtgtttatgccaaatactactttgaccttcgctccttagcagatgacaacaacctgaattttctatttgctcctcttagcaaagaaagagcacagaacctagaggctatttctagattgtgtgaagacaaagacttgtgtagagccgctatgagaaggtctttcagtgctgataacttcattggtattcagcgctctaaagccatcctctcttaaaaggagaaatgaggggttataacgtcatgggaccttcatctacaaagactggagaaataccacctttcctgctcaaaaaccagcaaaattagtgttttcatcaaaaggaaagatctcaaattcaagagactcatggacaacaaggattatactccacaggaaagaatgggaccttgtcaatgcaacaaaacactcttctgtcctttttaatgtaaacagagttacaaaaaccactccaaagtgaaggctcccatcctacacacagatatttgcttactgtgtgggccgatagctgtgaactatgtaaggttttttaaacaatagtttaaatttttagactttaaagacactaaccatataacttttatgtttcttccagtttctctccctccccccgcattttgctgcatatgcctttaaaatcaatgcagtattaccattaaaacatgggactctaactaaagccacttaggagcagacagcagcgttgttaggtactgaagggttcttcctccctactgttaaccattgaagctgctagtcattggcaatcattttaaaccaaaaagctgctggataacatttgtcattcatattctttgcaagcattactttagcattttagcatgtttggggtcataaacagaggaagtatcagttattgatatctacttctattggagtccatgttgcatttcttgtgaactataaatggtgcttctcattttctgataatttttctcttgctaaataaatgtattaaaagatattttcataatgccaaccaacatggtggttcagtgacgatgagaaaaagtgaagcagttttaagcttgaatatagtttgggccctccaaggcactgcagcatgagtataaatgctataaacctttaaaaaacatgatttgaaagttttttgttttgtttgtttgtttttaaagagatgggggtcttactgcgttgtccaggctggagtgcagtggcttttcacaggtgcaatcattgtgcactcactgcagcctagaacttcctggtctcaagccatcctctagcctcactacttgggaggctgaggctggaggattgcttgaggtcaagtattggaggctgcagtgtaccatgatggtgcctataggaatagctactgcactccaacctggacaacgttatcaagaccccatctcttagaaaaatgcaaaattaaatgcaaaagaaatgggctgggcatagtgattcatgcctgtaatctcagtaccctgggaggctgaggtggaaggattgcttgagtgcaggagttcaagaccagtctaggcaacatagtgagaccctgcctgtaaaaaaaaataataaaaatagttggatatggtggcatgtgtctgtagtcccagccactctggaggctaaggtgggaggatcagtagagcccaggaggtcaaggctgcagtgggccatgatcatgtcactgctctccaacctgggcgacatccagaccctgtctcaaagaaaaaagcagaagaaaaatgttcagacaaggttttgtaaaggtttgtagcatttatatttctacaagtatcaaagcttaaaattacactgaacttttggaataccttgtatctccataaaatgccctctttttaaaagtagttacccgcagagctgtgctctatatgctttgattaccgcagtttctttaaaggaagattttgaagagcagtgttaattaacatgtaataaaaggaattggaccctaattatagaaggtgatatgaacagctgttttatcatcctacatgctaccaagctgtaggtgtcccattaagtcctgctatttaagaaatacttacataacccttaggaactcttcaggctttaaaaggcaaggagcaaataattttaggagaccgataatgtcacctaaatttgaaatactaagaagaggttagtgttctcaactatgtgaaatctgtttctcctactttctcaaatctaatcctaggaatcttgcttataaacaaagcatttctgggacaggagtacttcctctattatagcaatgcttcacatcatattgtgctgcagtttccatcatttttaaaggacagagacataaatgataaataatggtatacaaatattacaatctaccacctcaaaaaaacaaatattgtttatggaattcagagtttggagattcaagtattgattgcagttttattttgaaaagaatgctacaatttatgtggtttttatttctcatgtttatattaaaagctaataaactctattttaattaaaa

SEQ ID NO: 33787 - DNA, 3270 bp, Homo sapiens
catgtgggcatcactggcgagagcgacggaccatccaagggcaagcacaattttcctgagcaaatctcaaacggatgtgcgagaaaagaggaagagcaaccatttgaaccatgtatctccagggcagcttactaaaaagtatagctcatgctcaacaatatttctagatgacagcacagtcagccagcctaatcttagaaccacagtaaaatgtgtgaccttagcaatatattaccacataaagaacagagatgcaaatagatccctggatatttttgatgagagatcacatccacttacacgagaaaaagttccagaggaatactttaagcatgatcctgagcacaaatttatttacagatttgttcgtactctttttagtgctgcacagctaacagctgaatgtgcaatagtaactttggtttacttagaaaggcttttaacttatgctgaaatcgacatttgtcccaccaactggaaaaggattgttctgggagccattcttcttgcctccaaggtttgggacgatcaggctgtatggaatgtggactactgccagatcctcaaggacattacagttgaggacatgaatgaaatggaaaggcattttctggagcttcttcagtttaatattaatgttcctgccagtgtttatgccaaatactactttgaccttcgctccttagcagatgacaacaacctgaattttctatttgctcctcttagcaaagaaagagcacagaacctagaggctatttctagattgtgtgaagacaaagacttgtgtagagccgctatgagaaggtctttcagtgctgataacttcattggtattcagcgctctaaagccatcctctcttaaaaggagaaatgaggggttataacgtcatgggaccttcatctacaaagactggagaaataccacctttcctgctcaaaaaccagcaaaattagtgttttcatcaaaaggaaagatctcaaattcaagagactcatggacaacaaggattatactccacaggaaagaatgggaccttgtcaatgcaacaaaacactcttctgtcctttttaatgtaaacagagttacaaaaaccactccaaagtgaaggctcccatcctacacacagatatttgcttactgtgtgggccgatagctgtgaactatgtaaggttttttaaacaatagtttaaatttttagactttaaagacactaaccatataacttttatgtttcttccagtttctctccctccccccgcattttgctgcatatgcctttaaaatcaatgcagtattaccattaaaacatgggactctaactaaagccacttaggagcagacagcagcgttgttaggtactgaagggttcttcctccctactgttaaccattgaagctgctagtcattggcaatcattttaaaccaaaaagctgctggataacatttgtcattcatattctttgcaagcattactttagcattttagcatgtttggggtcataaacagaggaagtatcagttattgatatctacttctattggagtccatgttgcatttcttgtgaactataaatggtgcttctcattttctgataatttttctcttgctaaataaatgtattaaaagatattttcataatgccaaccaacatggtggttcagtgacgatgagaaaaagtgaagcagttttaagcttgaatatagtttgggccctccaaggcactgcagcatgagtataaatgctataaacctttaaaaaacatgatttgaaagttttttgttttgtttgtttgtttttaaagagatgggggtcttactgcgttgtccaggctggagtgcagtggcttttcacaggtgcaatcattgtgcactcactgcagcctagaacttcctggtctcaagccatcctctagcctcagccacacaagtagctgggactacaagtgcaactggcacctgtctcctgaatattaagcttttaatttttgcaaaatgaagctgggtgtggtggtgcacgcctatagtcccagctacttgggaggctgaggctggaggattgcttgaggtcaagtattggaggctgcagtgtaccatgatggtgcctataggaatagctactgcactccaacctggacaacgttatcaagaccccatctcttagaaaaatgcaaaattaaatgcaaaagaaatgggctgggcatagtgattcatgcctgtaatctcagtaccctgggaggctgaggtggaaggattgcttgagtgcaggagttcaagaccagtctaggcaacatagtgagaccctgcctgtaaaaaaaaataataaaaatagttggatatggtggcatgtgtctgtagtcccagccactctggaggctaaggtgggaggatcagtagagcccaggaggtcaaggctgcagtgggccatgatcatgtcactgctctccaacctgggcgacatccagaccctgtctcaaagaaaaaagcagaagaaaaatgttcagacaaggttttgtaaaggtttgtagcatttatatttctacaagtatcaaagcttaaaattacactgaacttttggaataccttgtatctccataaaatgccctctttttaaaagtagttacccgcagagctgtgctctatatgctttgattaccgcagtttctttaaaggaagattttgaagagcagtgttaattaacatgtaataaaaggaattggaccctaattatagaaggtgatatgaacagctgttttatcatcctacatgctaccaagctgtaggtgtcccattaagtcctgctatttaagaaatacttacataacccttaggaactcttcaggctttaaaaggcaaggagcaaataattttaggagaccgataatgtcacctaaatttgaaatactaagaagaggttagtgttctcaactatgtgaaatctgtttctcctactttctcaaatctaatcctaggaatcttgcttataaacaaagcatttctgggacaggagtacttcctctattatagcaatgcttcacatcatattgtgctgcagtttccatcatttttaaaggacagagacataaatgataaataatggtatacaaatattacaatctaccacctcaaaaaaacaaatattgtttatggaattcagagtttggagattcaagtattgattgcagttttattttgaaaagaatgctacaatttatgtggtttttatttctcatgtttatattaaaagctaataaactctattttaattaaaa

SEQ ID NO: 33788 - DNA, 3034 bp, Homo sapiens
catgtgggcatcactggcgagagcgacggaccatccaagggcaagcacaattttcctgagcaaatctcaaacggatgtgcgagaaaagaggaagagcaaccatttgaaccatgtatctccagggcagcttactaaaaagtatagctcatgctcaacaatatttctagatgacagcacagtcagccagcctaatcttagaaccacagtaaaatgtgtgaccttagcaatatattaccacataaagaacagagatgcaaatagatccctggatatttttgatgagagatcacatccacttacacgagaaaaagttccagaggaatactttaagcatgatcctgagcacaaatttatttacagatttgttcgtactctttttagtgctgcacagctaacagctgaatgtgcaatagtaactttggtttacttagaaaggcttttaacttatgctgaaatcgacatttgtcccaccaactggaaaaggattgttctgggagccattcttcttgcctccaaggtttgggacgatcaggctgtatggaatgtggactactgccagatcctcaaggacattacagttgaggacatgaatgaaatggaaaggcattttctggagcttcttcagtttaatattaatgttcctgccagtgtttatgccaaatactactttgaccttcgctccttagcagatgacaacaacctgaattttctatttgctcctcttagcaaagaaagagcacagaacctagaggctatttctagattgtgtgaagacaaagacttgtgtagagccgctatgagaaggtctttcagtgctgataacttcattggtattcagcgctctaaagccatcctctcttaaaaggagaaatgaggggttataacgtcatgggaccttcatctacaaagactggagaaataccacctttcctgctcaaaaaccagcaaaattagtgttttcatcaaaaggaaagatctcaaattcaagagactcatggacaacaaggattatactccacaggaaagaatgggaccttgtcaatgcaacaaaacactcttctgtcctttttaatgtaaacagagttacaaaaaccactccaaagtgaaggctcccatcctacacacagatatttgcttactgtgtgggccgatagctgtgaactatgtaaggttttttaaacaatagtttaaatttttagactttaaagacactaaccatataacttttatgtttcttccagtttctctccctccccccgcattttgctgcatatgcctttaaaatcaatgcagtattaccattaaaacatgggactctaactaaagccacttaggagcagacagcagcgttgttaggtactgaagggttcttcctccctactgttaaccattgaagctgctagtcattggcaatcattttaaaccaaaaagctgctggataacatttgtcattcatattctttgcaagcattactttagcattttagcatgtttggggtcataaacagaggaagtatcagttattgatatctacttctattggagtccatgttgcatttcttgtgaactataaatggtgcttctcattttctgataatttttctcttgctaaataaatgtattaaaagatattttcataatgccaaccaacatggtggttcagtgacgatgagaaaaagtgaagcagttttaagcttgaatatagtttgggccctccaaggcactgcagcatgagtataaatgctataaacctttaaaaaacatgatttgaaagttttttgttttgtttgtttgtttttaaagagatgggggtcttactgcgttgtccaggctggagtgcagtggcttttcacaggtgcaatcattgtgcactcactgcagcctagaacttcctggtctcaagccatcctctagcctcagccacacaagtagctgggactacaagtgcaactggcacctgtctcctgaatattaagcttttaattttttgtttcggtcactcttgatagcagacattgactgaaacaaaaaattaaaagctttatattcaaaatttgcaaaatgaagctgggtgtggtggtgcacgcctatagtcccagctacttgggaggctgaggctggaggattgcttgaggtcaagtattggaggctgcagtgtaccatgatggtgcctataggaatagctactgcactccaacctggacaacgttatcaagaccccatctcttagaaaaatgcaaaattaaatgcaaaagaaatgggctgggcatagtgattcatgcctgtaatctcagtaccctgggaggctgaggtggaaggattgcttgagtgcaggagttcaagaccagtctaggcaacatagtgagaccctgcctgtaaaaaaaaataataaaaatagttggatatggtggcatgtgtctgtagtcccagccactctggaggctaaggtgggaggatcagtagagcccaggaggtcaaggctgcagtgggccatgatcatgtcactgctctccaacctgggcgacatccagaccctgtctcaaagaaaaaagcagaagaaaaatgttcagacaaggttttgtaaaggtttgtagcatttatatttctacaagtatcaaagcttaaaattacactgaacttttggaataccttgtatctccataaaatgccctctttttaaaagtagttacccgcagagctgtgctctatatgctttgattaccgcagtttctttaaaggaagattttgaagagcagtgttaattaacatgtaataaaaggaattggaccctaattatagaaggtgatatgaacagctgtttatcatctacatggtaacaaggtgttggtgtccattagtctgctatttagaaatattaataacttagaatcttcgggttaagggagggcactatttggggaccggatgtgccaattgaacaaaaaggggggctaaaggagagggtcattaaatatcggatggttaaagaatggggaacctaaagaacatggggggtagaggaaaaggaggtcac

SEQ ID NO: 33789 - DNA, 954 bp, Homo sapiens
catgtgggcatcactggcgagagcgacggaccatccaagggcaagcacaattttcctgagcaaatctcaaacggatgtgcgagaaaagaggaagagcaaccatttgaaccatgtatctccagggcagcttactaaaaagtatagctcatgctcaacaatatttctagatgacagcacagtcagccagcctaatcttagaaccacagtaaaatgtgtgaccttagcaatatattaccacataaagaacagagatgcaaatagatccctggatatttttgatgagagatcacatccacttacacgagaaaaagttccagaggaatactttaagcatgatcctgagcacaaatttatttacagatttgttcgtactctttttagtgctgcacagctaacagctgaatgtgcaatagtaactttggtttacttagaaaggcttttaacttatgctgaaatcgacatttgtcccaccaactggaaaaggattgttctgggagccattcttcttgcctccaaggtttgggacgatcaggctgtatggaatgtggactactgccagatcctcaaggacattacagttgaggacatgaatgaaatggaaaggcattttctggagcttcttcagtttaatattaatgttcctgccagtgtttatgccaaatactactttgaccttcgctccttagcagatgacaacaacctgaattttctatttgctcctcttagcaaagaaagagcacagaacctagagcttgtgactttgccctttgcccccttttccaatggggaaaaatgagtgacaagaaagcatggggaagatgtgctaactactgtgtcccggacatgtaaggtacagttgctcttctcttaggattcaactcaactatattttctagtctgcctctcctaactaccttatgcatcaatgtaataaacttcctagtgttcaccttg

SEQ ID NO: 33790 - DNA, 1445 bp, Homo sapiens
ggacagcagagacaacagtcacagtaaccctgtctagagcgttcctggagcccaagctcctctccacagaggaggacagagcaggcagcagagaccatggggcccccctcagcttgtccccacagagaatgcatcccctggcaggggctcttgctcacagcctcacttttaactttctggaacgcacccaccactgcctggctctttattgcatcagcgccctttgaagttgctgaaggggagaatgttcatctctctgtggtttatctgcccgagaatctttacagctatggctggtacaaagggaaaacggtggagcccaaccagctaatcgcagcatatgtaatagacactcacgttaggactccagggcctgcatacagcggtcgagagacaatatcacccagtggagatctgcatttccagaacgtcaccctagaggacacgggatactacaacctacaagtcacatacagaaattctcagattgaacaggcatctcaccatctccgtgtatacggagaatgttctaaatttgactctgagatctctgaggatgcagcatggccccaagacactttctgttggtcactctatccacagagtcagtggctcagccctccatccaagccagcagcaccacagtcacagagaagggctccgtggtcctgacctgccacacaaataacactggaacctctttccagtggattttcaacaaccagcgtctgcaggtcacgaagaggatgaagctgtcctggtttaaccatgtgctcaccatagaccccatcaggcaggaggacgctggggagtatcagtgtgaggtctccaacccagtcagctccaacaggagcgaccccctcaagctgactgtaaaatatgacaacactctaggcatcctgatcggggtcctggttgggagtcttctggtggctgcacttgtgtgtttcctgctcctccgaaaaactggcagggccagcgatcagagtgacttcagggagcagcagcccccagcctccacccccggccatggaccctctgacagctccatctcctatggaattgctacactctgacacaaacatttactgctggatcgaccacaaagcagatgtggcttcttaggttcctctgggagctgctcctgtgggttgatggagcgtccctgaagcccccagccctggggatggggaaggacatggagcctgagccagagaaccagctctgagtcctgaggagacacaggcctggggacaggaagggatgggggtccctgctgaatatatagagacctcaacagactgccccgggctctgggtgggccaaggcgaaggcttcccatcaccacaggaagtgggggcttgcagggaaagtgaatgggcctatggcccacccggggtcacctggaaaggatctgaataaaggggaaacttcctctcaaaaac

SEQ ID NO: 33791 - DNA, 424 bp, Homo sapiens
caaaaatattttaattaattttttcataaacctttcacaacttgcttaaacatttagctttattttatccaacttaaagcaattctttaaccttttaatctaggcaaaaaaaatccatcttctcataagagctttagagactcttaggcttctttactaggacagctgagctctaaagcatgtgaacttcacccaccacaactgtttgctccatctcaagctcagaaccctgccctgtctgcctaaccacaagtatccaacccagtatctacaaataaatgcttcactcatctactcctttcatgaaacattgcaaatctttttcttactagtgcttgggttgcagggaaagtgaatgggcctatggcccacccggggtcacctggaaaggatctgaataaaggggaaacttcctctcaaaaac

SEQ ID NO: 33792 - DNA, 1362 bp, Homo sapiens
ggacagcagagacaacagtcacagtaaccctgtctagagcgttcctggagcccaagctcctctccacagaggaggacagagcaggcagcagagaccatggggcccccctcagcttgtccccacagagaatgcatcccctggcaggggctcttgctcacagcctcacttttaactttctggaacgcacccaccactgcctggctctttattgcatcagcgccctttgaagttgctgaaggggagaatgttcatctctctgtggtttatctgcccgagaatctttacagctatggctggtacaaagggaaaacggtggagcccaaccagctaatcgcagcatatgtaatagacactcacgttaggactccagggcctgcatacagcggtcgagagacaatatcacccagtggagatctgcatttccagaacgtcaccctagaggacacgggatactacaacctacaagtcacatacagaaattctcagattgaacaggcatctcaccatctccgtgtatacgagtcagtggctcagccctccatccaagccagcagcaccacagtcacagagaagggctccgtggtcctgacctgccacacaaataacactggaacctctttccagtggattttcaacaaccagcgtctgcaggtcacgaagaggatgaagctgtcctggtttaaccatgtgctcaccatagaccccatcaggcaggaggacgctggggagtatcagtgtgaggtctccaacccagtcagctccaacaggagcgaccccctcaagctgactgtaaaatatgacaacactctaggcatcctgatcggggtcctggttgggagtcttctggtggctgcacttgtgtgtttcctgctcctccgaaaaactggcagggccagcgatcagagtgacttcagggagcagcagcccccagcctccacccccggccatggaccctctgacagctccatctcctatggaattgctacactctgacacaaacatttactgctggatcgaccacaaagcagatgtggcttcttaggttcctctgggagctgctcctgtgggttgatggagcgtccctgaagcccccagccctggggatggggaaggacatggagcctgagccagagaaccagctctgagtcctgaggagacacaggcctggggacaggaagggatgggggtccctgctgaatatatagagacctcaacagactgccccgggctctgggtgggccaaggcgaaggcttcccatcaccacaggaagtgggggcttgcagggaaagtgaatgggcctatggcccacccggggtcacctggaaaggatctgaataaaggggaaacttcctctcaaaaac

SEQ ID NO: 33793 - DNA, 685 bp, Homo sapiens
ctaaaacattgacttccttgtgtgagcaagagaggaaacaaaacttttgggaaaatctaagataaacttgtgcaaaaaaaaggatccattaatttctaatgtagtgtccttatgaaaatgtaccttttctctcatatcactaaggttcttcaaacactcatctgttagaaggaaattttaaaaaggaaatctttctccttcccataggagtgtcaatggcaagcctatcctcaaagaccagaaagaaagcatgttttttcagatagatgtacccacacccaggactcatctgtcatctctcagatctaaaactagctcttctttattgtttggcgtcagaagttttaagggctaaaccactaattctcatccttggctgaacatcaaattacttgtggagcttttaaaatgtactgaatttgggcagggcgtggtggctcatgactgtaatcccagcactttgagatgccagggtgggtggatcacctgaggtcaggagtttgagaccagcctgaccagtatgatgaaaccctgtcactactaaagatacaaaaattatctgggcatggtggtgtgcacctgtggtctcagctacttaggaggctgagacaggagaatcgcttgaacccgggaggcagaggttgcagtgagctgagatcgcgcctccagcctgctgggcaaacag

SEQ ID NO: 33794 - DNA, 581 bp, Homo sapiens
gagaaaagagaaagaggtcagttaaaattgttttatgttagagagttgatgaaattttctaagaaatggaaattttgatagccagagaatttttgcttgaactttatgacttatatatgttggtggcacttactcaggtcttagacattcttctttcaacattgagcaaatatatttagattgtccagcagtcactttgatgggtagtaaagatactaagatgaggatcggtcacattaacagaaatttctttttttttttgctgtactttccccattgcccagcacagtggctggcagagtaagcattcagcaagtatttgttaaacaactagagtcaaaactaaagggaagggtggaggatgaccaaaattgtttcttagggaattgagttgccttcgttatctgagacctgaattccttgattttatggtttatcttgacacatatttacttacttgtaccagaatttagctcagagattacattttttgtgccatggatacatttggcaatcaggtaaagcctttagatactttctcagaataatgcttttacatgtataaaataaaatacatggtt

SEQ ID NO: 33795 - DNA, 1095 bp, Homo sapiens
gagaaaagagaaagaggtcagttaaaattgttttatgttagagagttgatgaaattttctaagaaatggaaattttgatagccagagaatttttgcttgaactttatgacttatatatgttggtggcacttactcaggtcttagacattcttctttcaacattgagcaaatatatttagattgtccagcagtcactttgatgggtagtaaagatactaagatgaggatcggtcacattaacagaaatttctttttttttttgctgtactttccccattgcccagcacagtggctggcagagtaagcattcagcaagtatttgttaaacaactagagtcaaaactaaagggaagggtggaggatgaccaaaattgtttcttagggaattgagttgccttcgttatctgagacctgaattccttgattttatggtttatcttgacacatatttacttacttgtaccagaatttagctcagagattacattttttgtgccatggatacatttggcaatcaggtaaagcctttagatactttctcagaataatgcttttacatgtataaaataaaatacatggttacaaaagaaaaaattatatagaaatatagttatcaaagtattaaaacatttatgatacaataaacatgaaataagatatctgggcaggtgtgataacttctgtaagtgatattttgggctgtgtgcctatacagtaatgctacatggatttctgctggtgacaaagtcacaagtactactgtggtgtgttgcctgcattcatatttgaaggaaacaataaatttagaagttaatgaaaataaaaaggttttttgttcccactctctaagttcatggactccctgtatcctctctctagacctcacttcttcatttctttgcaaatatatttagagacttttcctatgaagtgcttaactcagccaggaattatacattgattagtgggactatttgattaatgtctgtctgcctgctggattgtgattgtggtgggtttttgttgttgttgttgttttggagacagagtctcactctgcactccatcctgggcgactggtaggatctcagctca

SEQ ID NO: 33796 - DNA, 571 bp, Homo sapiens
ttccagggcaccgacacagactcgtcgggggcacccttgctccaggtgtactgctaacccctgccaggcccagctgccacaccctttctgggagaagcatggcctacagaatgaagagggggaccaggaacccctgtgggagaggcttagacctgaagcagtgcccactctggctcctcctgccttggctgactgggttcctggaccatgtgcatttcactgggccatgggatctacatctccttgcatccccagctggtctgatccctgccagggccccttccttcctgctcatggtcttcaggtggcctgatcatggaaagtaaggagttaggcattaccttctgggagtgaaccctgactccatccccctattgccaccctaaccaatcatgcaaacttctccctccctggggtaattcaacagttaaaagaagcttatcttaaatgtattgtattggggggtgggcagggcccactctatgttatgttaaggagttggttctggttcttggctgatgttctgtatcttaacatgaccacagtttgtaagtacaaaggtaattggtat

SEQ ID NO: 33797 - DNA, 738 bp, Homo sapiens
aaatcttcatctcaaagtgctagaaaaataacaacaaaatcaataaaagaaattgggataaaatgtccacgtttttcctccaggcatttgccaattctaggcatgagaagagaggtaaagattccaggctgggcgcggtggctcatgcctgtaattctagcactttggaaggctgaggtaggcagattgcctgagctcaggagttcgagaccagcctaggcaacatggtgaaaccctgtctctactaaaacacaaaagaaattagccaggtgtggcggcatgcaccagtagtcccagttacttgggaggctgaagcaggagaattgcttgaacccgggaggcggaggttgcagtgagccaagattgtgacactggattccagcctgggtgacagagcaagattctgtctcaaaaaaataaaaataaaaataaaaagattccagacattccagacagagacatactgctaagaggcagacatactaacagaaaggtgtttctcagcctcagctctatttacattttgggatggacaattctttgttgcggggagctgccctatacattgtaggatgtttagtagcatctctgaccttccactagatgccagtagcattgtccccacttcttctgcacttgtgacaaacaaaaattcctccagacattctcaaatattccctggggcaaaattgtctcttgttgagaacagctgatctagacaaccaacagaatggtaaa

SEQ ID NO: 33798 - DNA, 702 bp, Homo sapiens
caattcaggatctggctcatgcctgcctctctaaccttactcgttcattcattcaacactatttatagctgctaagcaccatgctaggtcctggggattcagctttgaccaagacagacacaactactgcccttatgagctcacaattcagtgagggaaacactgaataatgtcacaaatgaccttaaaattacaactgcataaagttcaggggatgaaaattaggagacctccgagcctcgttctatctagtctttctctcagacttaacactctcaccagactggacttccttcacttccctgagtggacatgctctctctcacctcaggacctttgcacatgcttttcccctctgacaagaagtttctttcaactccattgcccactctcctggctagctcctccacatcctacaagtatcagcttagaggccactttcttcaggaagccatgcctggtgtcaccagtgtgggctccccttctgttctcctccatagcatgtgtttaacccccacttattacactccacggtgagtgccttttgcatttctagctagtgcactaggcgggaaatttcactgtggcatcaacaagttttactgaatgggtgagtcacatccttaccttttgttcagtcccattcactgtttgaccttggggtcctccagccctccataaaaataagtgtttctccagatt

SEQ ID NO: 33799 - DNA, 379 bp, Homo sapiens
ctaagaccccagagctctgtcctatccagagaggctaaaccaacttggatggctcaagacaatatagaaataaacgctaaaatatgggatctagagtacacccagggttgctatatcgaattcatgtttctagaggtcagttcaacacaatgaatgaagtggaccaggtgtaggtaagcagggagtggtgctggatgttgcaagctggaggacatgtgccaagggtgaaggggggcaggaccactcagttactctgttgcccagtagccatgtgggtccaatgttgtcacatgactttgttttttatgagaagctgggtgtctgttttttccataaaatatctttaaatttttggcaactaattcagtttaaaaaaaaa

SEQ ID NO: 33800 - DNA, 288 bp, Homo sapiens
tttttgtatttttagtagagtaaagacagggtttcactgtgttagccaggatggtctcaatctcctgacctcgtgatccgcacacctcggcctcccaaagtgctgggattacaggtgtgagccaccgcacccggtctaaccttgaaatttctaattgttggtgttatgttctttccattaaatcatttcatccacctttttgaaatctgtggatgacaaaatttcattcctttcattgcatctacctaaataatttaattatttaaatgtaaagtgctagtctgcatt

SEQ ID NO: 33801 - DNA, 318 bp, Homo sapiens
ctaattctatgtactggaatatctgtaaaggcaaccatttaaaataaaatagtccttgggtttttttttaaataacagtaagcacaaacaacttaaatgtctaacacaatagttaagtaaattagtttgtgatggactgcctaagaaaataagctttttaaaataacatgaaaaaatgtgttaaatgccacatgaaaaaagataattgtacagtagtaagaattacttaaaaaatacccccatgaaatgaaatactatctatgagaaatcataatcttacatattaaaattacaaacgtaacattttttcaccaattg

SEQ ID NO: 33802 - DNA, 3220 bp, Homo sapiens
  misc_feature (2177)..(2177): n is a, c, g, or t
  misc_feature (2616)..(2616): n is a, c, g, or t
cttgcatgtaccgggggagaaaccccatctctactaaaaatacaaaattagccaggtgtggtggcatgcacctgtaatgccaactactaagcctcccgagtatgctaggattataggcatgagccaccacgcccggcctcatctccagctcttataaggacaccagtcagccgggattaaggctcatcctcatgatgtccttttaacttaattacctctctacaggccctgtctccatatagagtcacacccttgagtaccggaggttaggtcttcagcataggagttaagagggacacaatttagccaatcacagcttcataacagatgctctgcagacacctctccatcaatcatagcccggtgtgtttaacttagagtagatggtggcaccacccgataacaatggtggtggcattcagcagcagctcagagggttccagaagcattcctccagccttgaggggaaatggtgcctctggctaacggagggaaccatcaaagccgggtatggtttctttgatcgtgtttagccgctttgtggctgagtagagattcttccttcttcctgtccaggtaattaatgagggacttcaaaggcatgaggcttttctgctccaatcaattattcagattggcatatccaaaggtctctgaacaggaaatagagaggaaatggattgctaagtggttatgatggagactaaatgaattacttgttaatcacccttgtctgctctggtagtatctgtgcaagccaggatagctgctcggggcacactcaccatcaaacacgggaggggaagggcagggtggggtaaatttcactcttagaaacaccagaatttcttccttttcaggatcaatgtcacccatatcttgtcaattgtgactgcaaacttcagaaggactcagagtggaaagtcttggcaaccatgttggggttcagacagtgggagccatgcttctgcgaatgagcctggggactggggactgtggtcccagccctggatttgatgaggggagtatccctgtcctgcgagggtgcagtgtcacttttccactcccatttggggtcaactcttaacagcatccctgagaagtgaggtggtgtaaagtcagggaagtgtggtctttgtcttattaaaaataatgcgatgagatggacgatggcagaagcttcagggtagaccatggagctcatcatggtatttgatatggcttggctttgtccccacccaaatctcatcttgaattgtagctcccatgattcccatgtgttgtgggagggacccagtgggagataactgaatcatggggtcattctcccccatactgttctcatagtagtgaacaagtctcatgagatctgatgattttataaggggaaacccctttctcttggctcccattctctcttgcctgctgccatgtagaacatgccctttcccttctgccatgattgtgaggcctccccagccatgtggaactatgagtccattaaacctttttttctacataaattacccagtcttaggtatatctttatcggcagcgtgaaaacagactaatacagtattactctttacattgctttatgtttgcgattttccattagaaaaggaacttgaaaattaaaaaaaataataataataatgcctacttctgctccaacttctacttgtggccaagatggagaaacagaaactggatttacctttcctcatgaaacaactgaaagaaaagataaaatatataaagtaataggttttacaaccagacaccaggtaataaatgatagtgatcactaaagcatgagaaacagatgggatgagccctatacttgccccagcttcttgcactgagcgtttccaggctgtggggcagggagagggaactcaggcagagactggaagaacatccacattgaagacattgaggccaggcgtggtggctcacgcctgtaatcccagtgctttcggaggccgaggtgggtggatcacaaggtcagtagttcaagaccaacctggctaacatggtgaaatcccatctctactacaaaaatacaaaaattagccgggcatggtggcacgcgcctgtaatcccagctattcgggaggctgaggcaggaagaattgcttgaacctgggaggcggaggttgcggtgagccgagatngcaccactgcactccagccttggcagcagagcaagacttcatctcaaaaataaataaatggatggatggatggatggatggatggatggatgaaactgcttccaggtgacttaactacacccagaacaaagctcaagaccaggatacagaactacccagcgcccccaacaagtacaattcatgatgtctggcatccattcagaaattcccagtcttgcaaagaagcaggaaaatacagcccgtaaggaagagaaaaatccattatcaaaattgactggggattaacaccgatgttagagttagcagacaaggatattaaaagaatcattaaaactgtattccatatgtccaaaaagttaaatgtagacacagaagatattttgaaagcccactggaatgtccatttttaaatggttaatatgataaattttgttgtatntattttagcataaagcagttctttacattttaacccaaatcaaacttccagtgatgaaaaccacagtgtctgagatgacggatacacaggatgagatcgagggtagattaaatgttataaagtaatagtgaactcagagaagtctcaatagaaactatcctgagtgaaacacagagaaaaaaaaagaattctttttaaaagaacatcagtcagtgagctgcaagatagcttccaacagcccaatatacatgtaagtagagtccctgaagagggggcgattgtagggggaggggagaaaaaatacttgaaggctgggtgcggtggctcatgcctgtaatcccagcactttgggaggctgaggcgggcagatcagttgaggtcaggagttcgagaccagcctggccaacacggtgaaaccccatctctactaaaaatatgaaaagttggctgggcatggtggtgggtgcctgtaatcccagctatttgggagactgagtcaggagaatctcttgaacccaggaggcggaggttgcaatgagctgagatcgcaccactgcactccagcctgggcaacagggtgagactccatctcaaaaaaaaaaaa

SEQ ID NO: 33803 - DNA, 2330 bp, Homo sapiens
ataaaaacattgtatatagtagaccaaatggtcatagttactgtgagcctggcagagcagaaaaggcagttgaaggaggcagagaaggggttggtgatacggtgctataaatctgtggtccagtccacctcccttttaagacgtcctccccctatttctgttcttagttagagatgcagcagcttactcctgtagcgacctactaaaaagcaacaaggagaaagacatcgtctttttgaaaaaacgttctttcgtctcttttctttgttccttggtttgtttttcttgcccctttttgtttagttgaacggcaataggagggtagtctctccgtctttttaaactcttttttaagtttcccctcccctttcatatttttttgggccatttcttttagctttggactttgggggtcgaaagcgtttctttttatttgcttcttttaagccgagcacagtttaggtttcgtgctgtcttaagagaactatccagcagcttcttgctcatccttattgggagaactgcaccgttactttaaaaacacacatacacaaaaaccttaagggagaaagcaggtaattgctgccatggaaacacaactgtctaatgggccaacttgcaataacacagccaatggtccaaccaccataaacaacaactgttcgtcaccagttgactctgggaacacagaagacagcaagaccaacttaatagtcaactaccttcctcagaacatgacacaggaggaactaaagagtctctttgggagcattggtgaaatagagtcctgtaagcttgtaagagacaaaataacagggcagagcttgggatatggctttgtgaactacattgaccccaaggatgcagagaaagctatcaacaccctgaatggattgagacttcaaaccaaaacaataaaagtttcctatgctcgcccaagttcagcttctatcagagatgcaaatttatatgtcagcggacttccaaaaacaatgacccagaaggagttggaacagcttttttcacaatatggacgcattattacttctcgtattcttgtcgaccaggtcactggcatatcaaggggtgtagggtttattcgatttgacaagcgaattgaggcagaagaagctatcaaaggcctaaatggccagaaacctcccggtgccacggagccaatcactgtaaagtttgctaataacccaagccaaaaaaccaatcaggccatcctttcccagctgtaccagtctccaaacagaaggtatccaggaccgctagctcagcaggcacagcgttttaggttggacaatctgctcaatatggcttatggagtaaagaggttttctccaatgaccattgacggaatgaccagtttggctggaattaatatccctgggcaccctggaacagggtggtgtatatttgtgtacaacctggctcctgacgcagatgagagtatcctgtggcaaatgtttgggccttttggagctgtcaccaatgtgaaggtcatccgtgactttaacaccaataaatgcaaaggttttggatttgtgactatgacaaactatgatgaggctgccatggcgatacgtagcctcaatggataccgtctgggagacagagtactgcaggtctcctttaagacaaacaaaacgcacaaagcctaatgagctcttgtcctcagtccatttatatatgaaaactatacaacaaaggcaagttaagagaaactttatacattagtaaatgtctttgtaagtcagtgttgagatggggataaaatgactacttagcatcctaagaaatatgtgagattttttattgctagtatttgaattaaaacttcttaaatatcttttatgttgaatatggacaagaggtacagggtttttacctgtcacattgcattctattgccttctttgaagaaggtggaccttttaaagtgtttcagctaagggaagacatttcttttctttttacataactgccttgaacctgtgagtaaatattgaggctttgtgttgtaattcttcagttggttgtgtcttttttttcccccctttttcctttttctgattagctttgtgtttggtttacatttaaagcattgctgttatgtctgtttaagaaaagtattttgaagtttacatttttatttatgaagtttaaaacagtatttattttgtaattatgatttgggttggggaagggggggctacattataaacgcttattgtaagaatactggagaacttttcgtaaagcagtaccttgccaaagagataagagcctctttgatgtgggtttaaaaaaagcatctatttttat

SEQ ID NO: 33804 - DNA, 2142 bp, Homo sapiens
agcccggcatctccctgccggcacggacccgaagggcggtcgggcagggcacgcgccggcggcggccgcggcgccgcgaactcgccgccggccccgcctcctggcgctcttccaagcaagcccctccttcccgccccgctacaaacggcgggaccgcggcgcctgggcgtcactgaggcagtagccggccgggtgaggagggcggttgccggcgcggcgcggcgcggcgcgggtggggcgggggttccgccggcttccagtcccctttcccgccgccgccgccgccaccgcctctccgcggagctcgccccgagcgactcctccgcggcagtgctgacggccagcggcacgagccgtagtagctgcagcttcgagtcacagcagcaggtaattgctgccatggaaacacaactgtctaatgggccaacttgcaataacacagccaatggtccaaccaccataaacaacaactgttcgtcaccagttgactctgggaacacagaagacagcaagaccaacttaatagtcaactaccttcctcagaacatgacacaggaggaactaaagagtctctttgggagcattggtgaaatagagtcctgtaagcttgtaagagacaaaataacagggcagagcttgggatatggctttgtgaactacattgaccccaaggatgcagagaaagctatcaacaccctgaatggattgagacttcaaaccaaaacaataaaagtttcctatgctcgcccaagttcagcttctatcagagatgcaaatttatatgtcagcggacttccaaaaacaatgacccagaaggagttggaacagcttttttcacaatatggacgcattattacttctcgtattcttgtcgaccaggtcactggcatatcaaggggtgtagggtttattcgatttgacaagcgaattgaggcagaagaagctatcaaaggcctaaatggccagaaacctcccggtgccacggagccaatcactgtaaagtttgctaataacccaagccaaaaaaccaatcaggccatcctttcccagctgtaccagtctccaaacagaaggtatccaggaccgctagctcagcaggcacagcgttttaggttggacaatctgctcaatatggcttatggagtaaagaggttttctccaatgaccattgacggaatgaccagtttggctggaattaatatccctgggcaccctggaacagggtggtgtatatttgtgtacaacctggctcctgacgcagatgagagtatcctgtggcaaatgtttgggccttttggagctgtcaccaatgtgaaggtcatccgtgactttaacaccaataaatgcaaaggttttggatttgtgactatgacaaactatgatgaggctgccatggcgatacgtagcctcaatggataccgtctgggagacagagtactgcaggtctcctttaagacaaacaaaacgcacaaagcctaatgagctcttgtcctcagtccatttatatatgaaaactatacaacaaaggcaagttaagagaaactttatacattagtaaatgtctttgtaagtcagtgttgagatggggataaaatgactacttagcatcctaagaaatatgtgagattttttattgctagtatttgaattaaaacttcttaaatatcttttatgttgaatatggacaagaggtacagggtttttacctgtcacattgcattctattgccttctttgaagaaggtggaccttttaaagtgtttcagctaagggaagacatttcttttctttttacataactgccttgaacctgtgagtaaatattgaggctttgtgttgtaattcttcagttggttgtgtcttttttttcccccctttttcctttttctgattagctttgtgtttggtttacatttaaagcattgctgttatgtctgtttaagaaaagtattttgaagtttacatttttatttatgaagtttaaaacagtatttattttgtaattatgatttgggttggggaagggggggctacattataaacgcttattgtaagaatactggagaacttttcgtaaagcagtaccttgccaaagagataagagcctctttgatgtgggtttaaaaaaagcatctatttttat

SEQ ID NO: 33805 - DNA, 2016 bp, Homo sapiens
ccctagtccgaactctgggcgggaacactggtgggggcggcggaggttgtgcccgcgaagttcctagagctcagcccgttgcggcgggagtagagagaattgggcgcctcgggaggtggcaccgcccctcccgtgggcacaagcaggttgggggcggcgggagccgagcggggacagtcgcgcctggcagcgtgcacgggcgtggacgtgcccgggtgcggccgcgtgtagcgcaagaaggaaactgttgagacgcagcaggtaattgctgccatggaaacacaactgtctaatgggccaacttgcaataacacagccaatggtccaaccaccataaacaacaactgttcgtcaccagttgactctgggaacacagaagacagcaagaccaacttaatagtcaactaccttcctcagaacatgacacaggaggaactaaagagtctctttgggagcattggtgaaatagagtcctgtaagcttgtaagagacaaaataacagggcagagcttgggatatggctttgtgaactacattgaccccaaggatgcagagaaagctatcaacaccctgaatggattgagacttcaaaccaaaacaataaaagtttcctatgctcgcccaagttcagcttctatcagagatgcaaatttatatgtcagcggacttccaaaaacaatgacccagaaggagttggaacagcttttttcacaatatggacgcattattacttctcgtattcttgtcgaccaggtcactggcatatcaaggggtgtagggtttattcgatttgacaagcgaattgaggcagaagaagctatcaaaggcctaaatggccagaaacctcccggtgccacggagccaatcactgtaaagtttgctaataacccaagccaaaaaaccaatcaggccatcctttcccagctgtaccagtctccaaacagaaggtatccaggaccgctagctcagcaggcacagcgttttaggttggacaatctgctcaatatggcttatggagtaaagaggttttctccaatgaccattgacggaatgaccagtttggctggaattaatatccctgggcaccctggaacagggtggtgtatatttgtgtacaacctggctcctgacgcagatgagagtatcctgtggcaaatgtttgggccttttggagctgtcaccaatgtgaaggtcatccgtgactttaacaccaataaatgcaaaggttttggatttgtgactatgacaaactatgatgaggctgccatggcgatacgtagcctcaatggataccgtctgggagacagagtactgcaggtctcctttaagacaaacaaaacgcacaaagcctaatgagctcttgtcctcagtccatttatatatgaaaactatacaacaaaggcaagttaagagaaactttatacattagtaaatgtctttgtaagtcagtgttgagatggggataaaatgactacttagcatcctaagaaatatgtgagattttttattgctagtatttgaattaaaacttcttaaatatcttttatgttgaatatggacaagaggtacagggtttttacctgtcacattgcattctattgccttctttgaagaaggtggaccttttaaagtgtttcagctaagggaagacatttcttttctttttacataactgccttgaacctgtgagtaaatattgaggctttgtgttgtaattcttcagttggttgtgtcttttttttcccccctttttcctttttctgattagctttgtgtttggtttacatttaaagcattgctgttatgtctgtttaagaaaagtattttgaagtttacatttttatttatgaagtttaaaacagtatttattttgtaattatgatttgggttggggaagggggggctacattataaacgcttattgtaagaatactggagaacttttcgtaaagcagtaccttgccaaagagataagagcctctttgatgtgggtttaaaaaaagcatctatttttat

SEQ ID NO: 33806 - DNA, 1848 bp, Homo sapiens
acggtggctcacgcctgtaatcccagcacattgggaggccgaggttggcagatcagttgaagccaggagttcgagacgagcctggccaacgtggcgaaaccctgtctctactaaaaatacaaaaaaatagctgggtgtggtgatgcatgcctgtaatcccagctacttgggaggccgaggcagaagaatcgcttgaacccaggaggtggaagttgcagtgatccgagatcatgcccactgccatccagtctggatgacagagagagagaccttgcctcaaaagaagaaagatttgaattaatggtttgaaaattcttagaacacttgaccacagggcagagcttgggatatggctttgtgaactacattgaccccaaggatgcagagaaagctatcaacaccctgaatggattgagacttcaaaccaaaacaataaaagtttcctatgctcgcccaagttcagcttctatcagagatgcaaatttatatgtcagcggacttccaaaaacaatgacccagaaggagttggaacagcttttttcacaatatggacgcattattacttctcgtattcttgtcgaccaggtcactggcatatcaaggggtgtagggtttattcgatttgacaagcgaattgaggcagaagaagctatcaaaggcctaaatggccagaaacctcccggtgccacggagccaatcactgtaaagtttgctaataacccaagccaaaaaaccaatcaggccatcctttcccagctgtaccagtctccaaacagaaggtatccaggaccgctagctcagcaggcacagcgttttaggttggacaatctgctcaatatggcttatggagtaaagaggttttctccaatgaccattgacggaatgaccagtttggctggaattaatatccctgggcaccctggaacagggtggtgtatatttgtgtacaacctggctcctgacgcagatgagagtatcctgtggcaaatgtttgggccttttggagctgtcaccaatgtgaaggtcatccgtgactttaacaccaataaatgcaaaggttttggatttgtgactatgacaaactatgatgaggctgccatggcgatacgtagcctcaatggataccgtctgggagacagagtactgcaggtctcctttaagacaaacaaaacgcacaaagcctaatgagctcttgtcctcagtccatttatatatgaaaactatacaacaaaggcaagttaagagaaactttatacattagtaaatgtctttgtaagtcagtgttgagatggggataaaatgactacttagcatcctaagaaatatgtgagattttttattgctagtatttgaattaaaacttcttaaatatcttttatgttgaatatggacaagaggtacagggtttttacctgtcacattgcattctattgccttctttgaagaaggtggaccttttaaagtgtttcagctaagggaagacatttcttttctttttacataactgccttgaacctgtgagtaaatattgaggctttgtgttgtaattcttcagttggttgtgtcttttttttcccccctttttcctttttctgattagctttgtgtttggtttacatttaaagcattgctgttatgtctgtttaagaaaagtattttgaagtttacatttttatttatgaagtttaaaacagtatttattttgtaattatgatttgggttggggaagggggggctacattataaacgcttattgtaagaatactggagaacttttcgtaaagcagtaccttgccaaagagataagagcctctttgatgtgggtttaaaaaaagcatctatttttat

SEQ ID NO: 33807 - DNA, 299 bp, Homo sapiens
cagttctaaatatatttctttgctattgtggatgatattcagtacagtgaataatggtcatttcataacttattaatatctcagtagtctagcatgtcactgcaaagccacacacagaccttggtcaaaacatgaaatagtttatatatttgttgggggaggagagttactaaaattcttggggatggaaaaggtatacgttcattgctataaccaacctctgtttttattttttgtgtgtatgtgtgtatttcctattctgtttagcaggttttctccaatgaccattgacggaatga

SEQ ID NO: 33808 - DNA, 2291 bp, Homo sapiens
ataaaaacattgtatatagtagaccaaatggtcatagttactgtgagcctggcagagcagaaaaggcagttgaaggaggcagagaaggggttggtgatacggtgctataaatctgtggtccagtccacctcccttttaagacgtcctccccctatttctgttcttagttagagatgcagcagcttactcctgtagcgacctactaaaaagcaacaaggagaaagacatcgtctttttgaaaaaacgttctttcgtctcttttctttgttccttggtttgtttttcttgcccctttttgtttagttgaacggcaataggagggtagtctctccgtctttttaaactcttttttaagtttcccctcccctttcatatttttttgggccatttcttttagctttggactttgggggtcgaaagcgtttctttttatttgcttcttttaagccgagcacagtttaggtttcgtgctgtcttaagagaactatccagcagcttcttgctcatccttattgggagaactgcaccgttactttaaaaacacacatacacaaaaaccttaagggagaaagcaggtaattgctgccatggaaacacaactgtctaatgggccaacttgcaataacacagccaatggtccaaccaccataaacaacaactgttcgtcaccagttgactctgggaacacagaagacagcaagaccaacttaatagtcaactaccttcctcagaacatgacacaggaggaactaaagagtctctttgggagcattggtgaaatagagtcctgtaagcttgtaagagacaaaataacagggcagagcttgggatatggctttgtgaactacattgaccccaaggatgcagagaaagctatcaacaccctgaatggattgagacttcaaaccaaaacaataaaagtttcctatgctcgcccaagttcagcttctatcagagatgcaaatttatatgtcagcggacttccaaaaacaatgacccagaaggagttggaacagcttttttcacaatatggacgcattattacttctcgtattcttgtcgaccaggtcactggcatatcaaggggtgtagggtttattcgatttgacaagcgaattgaggcagaagaagctatcaaaggcctaaatggccagaaacctcccggtgccacggagccaatcactgtaaagtttgctaataacccaagccaaaaaaccaatcaggccatcctttcccagctgtaccagtctccaaacagaaggtatccaggaccgctagctcagcaggcacagcgttttaggttttctccaatgaccattgacggaatgaccagtttggctggaattaatatccctgggcaccctggaacagggtggtgtatatttgtgtacaacctggctcctgacgcagatgagagtatcctgtggcaaatgtttgggccttttggagctgtcaccaatgtgaaggtcatccgtgactttaacaccaataaatgcaaaggttttggatttgtgactatgacaaactatgatgaggctgccatggcgatacgtagcctcaatggataccgtctgggagacagagtactgcaggtctcctttaagacaaacaaaacgcacaaagcctaatgagctcttgtcctcagtccatttatatatgaaaactatacaacaaaggcaagttaagagaaactttatacattagtaaatgtctttgtaagtcagtgttgagatggggataaaatgactacttagcatcctaagaaatatgtgagattttttattgctagtatttgaattaaaacttcttaaatatcttttatgttgaatatggacaagaggtacagggtttttacctgtcacattgcattctattgccttctttgaagaaggtggaccttttaaagtgtttcagctaagggaagacatttcttttctttttacataactgccttgaacctgtgagtaaatattgaggctttgtgttgtaattcttcagttggttgtgtcttttttttcccccctttttcctttttctgattagctttgtgtttggtttacatttaaagcattgctgttatgtctgtttaagaaaagtattttgaagtttacatttttatttatgaagtttaaaacagtatttattttgtaattatgatttgggttggggaagggggggctacattataaacgcttattgtaagaatactggagaacttttcgtaaagcagtaccttgccaaagagataagagcctctttgatgtgggtttaaaaaaagcatctatttttat

SEQ ID NO: 33809 - DNA, 2607 bp, Homo sapiens
acccaactccaccccgttcttctcgccccttccgccttcgtttttcgattttaggatcctctccttgcttaagtgtttggataaattcgccgtccgtaatcggttcagttggaaattacccgatggttttcgtactttttttgaacgctgactgcagaaaatggcatagggaggtgggggaagagggaggaaagtgtgtgtgcgtgtgtgtgtgtgtgcgcgcgagtgacaggggacagagacgagagataggagagagagggagaggaagagagggagagagagagagagagagagagagagagaaagcgagcccaagacctgaggggagggcagggggcttccctcccctctcctggaggacggacagaatgatacatactgtcattaacagtgttgacccacccagaccccacccttcggttgcatccatcatacagtcattacaaagaggtagcgctgtcacacggcttgccctgctcctggggctctcggctggcttaatgaggtgcacccagccggggctattgtgcagctcgaaagaggcaggaacgagacggcaaggatcctagcaggtgctcgcgggagcctcggctgcagcagcctcgcagcagcagccaaccccagacctcaagtggatgaatgcctctggaagtgttttcctgaaggaacccatcaggcagtggaagactgtggcagggctagtgaacttagatggggctttcctctcctgcagttgagctggctggagagatactttagccctgccttcccagttctgcgcccagcacaagcagttttgaaaatttaagtgcaaaaagcatgacaaagcaatatgaggttgccgtgcaggtaattgctgccatggaaacacaactgtctaatgggccaacttgcaataacacagccaatggtccaaccaccataaacaacaactgttcgtcaccagttgactctgggaacacagaagacagcaagaccaacttaatagtcaactaccttcctcagaacatgacacaggaggaactaaagagtctctttgggagcattggtgaaatagagtcctgtaagcttgtaagagacaaaataacagggcagagcttgggatatggctttgtgaactacattgaccccaaggatgcagagaaagctatcaacaccctgaatggattgagacttcaaaccaaaacaataaaagtttcctatgctcgcccaagttcagcttctatcagagatgcaaatttatatgtcagcggacttccaaaaacaatgacccagaaggagttggaacagcttttttcacaatatggacgcattattacttctcgtattcttgtcgaccaggtcactggcatatcaaggggtgtagggtttattcgatttgacaagcgaattgaggcagaagaagctatcaaaggcctaaatggccagaaacctcccggtgccacggagccaatcactgtaaagtttgctaataacccaagccaaaaaaccaatcaggccatcctttcccagctgtaccagtctccaaacagaaggtatccaggaccgctagctcagcaggcacagcgttttaggttggacaatctgctcaatatggcttatggagtaaagaggttttctccaatgaccattgacggaatgaccagtttggctggaattaatatccctgggcaccctggaacagggtggtgtatatttgtgtacaacctggctcctgacgcagatgagagtatcctgtggcaaatgtttgggccttttggagctgtcaccaatgtgaaggtcatccgtgactttaacaccaataaatgcaaaggttttggatttgtgactatgacaaactatgatgaggctgccatggcgatacgtagcctcaatggataccgtctgggagacagagtactgcaggtctcctttaagacaaacaaaacgcacaaagcctaatgagctcttgtcctcagtccatttatatatgaaaactatacaacaaaggcaagttaagagaaactttatacattagtaaatgtctttgtaagtcagtgttgagatggggataaaatgactacttagcatcctaagaaatatgtgagattttttattgctagtatttgaattaaaacttcttaaatatcttttatgttgaatatggacaagaggtacagggtttttacctgtcacattgcattctattgccttctttgaagaaggtggaccttttaaagtgtttcagctaagggaagacatttcttttctttttacataactgccttgaacctgtgagtaaatattgaggctttgtgttgtaattcttcagttggttgtgtcttttttttcccccctttttcctttttctgattagctttgtgtttggtttacatttaaagcattgctgttatgtctgtttaagaaaagtattttgaagtttacatttttatttatgaagtttaaaacagtatttattttgtaattatgatttgggttggggaagggggggctacattataaacgcttattgtaagaatactggagaacttttcgtaaagcagtaccttgccaaagagataagagcctctttgatgtgggtttaaaaaaagcatctatttttat

SEQ ID NO: 33810 - DNA, 1903 bp, Homo sapiens
ggcgttgctttcttcccttgcctttgaagactttctgcaggccctggaattgcctttgttcctctgtctgcccactttgccagtgtgaagcaggttttcatgggattctactggggtaaaccaaaagcagcagaaaaagtgtgaacaggtaattgctgccatggaaacacaactgtctaatgggccaacttgcaataacacagccaatggtccaaccaccataaacaacaactgttcgtcaccagttgactctgggaacacagaagacagcaagaccaacttaatagtcaactaccttcctcagaacatgacacaggaggaactaaagagtctctttgggagcattggtgaaatagagtcctgtaagcttgtaagagacaaaataacagggcagagcttgggatatggctttgtgaactacattgaccccaaggatgcagagaaagctatcaacaccctgaatggattgagacttcaaaccaaaacaataaaagtttcctatgctcgcccaagttcagcttctatcagagatgcaaatttatatgtcagcggacttccaaaaacaatgacccagaaggagttggaacagcttttttcacaatatggacgcattattacttctcgtattcttgtcgaccaggtcactggcatatcaaggggtgtagggtttattcgatttgacaagcgaattgaggcagaagaagctatcaaaggcctaaatggccagaaacctcccggtgccacggagccaatcactgtaaagtttgctaataacccaagccaaaaaaccaatcaggccatcctttcccagctgtaccagtctccaaacagaaggtatccaggaccgctagctcagcaggcacagcgttttaggttggacaatctgctcaatatggcttatggagtaaagaggttttctccaatgaccattgacggaatgaccagtttggctggaattaatatccctgggcaccctggaacagggtggtgtatatttgtgtacaacctggctcctgacgcagatgagagtatcctgtggcaaatgtttgggccttttggagctgtcaccaatgtgaaggtcatccgtgactttaacaccaataaatgcaaaggttttggatttgtgactatgacaaactatgatgaggctgccatggcgatacgtagcctcaatggataccgtctgggagacagagtactgcaggtctcctttaagacaaacaaaacgcacaaagcctaatgagctcttgtcctcagtccatttatatatgaaaactatacaacaaaggcaagttaagagaaactttatacattagtaaatgtctttgtaagtcagtgttgagatggggataaaatgactacttagcatcctaagaaatatgtgagattttttattgctagtatttgaattaaaacttcttaaatatcttttatgttgaatatggacaagaggtacagggtttttacctgtcacattgcattctattgccttctttgaagaaggtggaccttttaaagtgtttcagctaagggaagacatttcttttctttttacataactgccttgaacctgtgagtaaatattgaggctttgtgttgtaattcttcagttggttgtgtcttttttttcccccctttttcctttttctgattagctttgtgtttggtttacatttaaagcattgctgttatgtctgtttaagaaaagtattttgaagtttacatttttatttatgaagtttaaaacagtatttattttgtaattatgatttgggttggggaagggggggctacattataaacgcttattgtaagaatactggagaacttttcgtaaagcagtaccttgccaaagagataagagcctctttgatgtgggtttaaaaaaagcatctatttttat

SEQ ID NO: 33811 - DNA, 244 bp, Homo sapiens
tttttggcgggggaactgatttgctgacacttcccagcatttgcactactgttatggcacccgtggcactgtactataagcattcattaacagcatcctcactagaccctgaattccttaaaggatcagtgtcactcatctttagatcccagtaacttacatagtgtctggtacataatgagtgcagaaaaaaccatccaaagaaaagcttaagctaaatgtgctctcctttagtctattagta

SEQ ID NO: 33812 - DNA, 390 bp, Homo sapiens
gcaaggaatgtacaaaccagcccattattaatcaatgttgcacaatttaaatcctgacagcccactatgacccaaatccgcaaagatacattctgcctttctgctcctaagccgtccaaccctgttctgagaataaatactgttacataaacacgactttttagcagagctctatggaatctgggtctaagagaatcctgagggtatcgatttcagtatagacatcatttgatatcacctaaatttctggcagcatggctcaataacaaggccttctgcttaatgaaggatgactacttggttatgtccaggtgtgagatgatcactgcttctaaagctagaaagtgccacaactggacaaccaatcatttggaatttcttccatatgtc

SEQ ID NO: 33813 - DNA, 338 bp, Homo sapiens
ggtaacaggccaatcggtgtggcttcagcttctgaggatctgccgggtgctgaggtctctcaaactccttgcacaattccgtcaaattcgagttattattttggtcctggtcagggccctcaaggtgatttgactgttgcaagctaaagcagggggcaaggtagataaatgtgagggcttaacatagaatatgaaacaaattggccgggtgcggtggctcatgcctgtaatcccagcactttgggaggccgagggggatgggtcatgaggtcaggagttcgagaccagcctgaccaacatggtgaaaccctgtctctactaaaaataccaaaaaaaaa

SEQ ID NO: 33814 - DNA, 455 bp, Homo sapiens
gtacagtaaaattggtgcggattcattctcatgttgtcctttgttctcttcaaaatgttccaagttaaggagtgaagcctaaatatgttcattacatcaaaatactggtacccccagtgtacgggagccagaggtgtacacattccagtacttatttgttatgacttgtttctatctaggagagcaatatattaccctttcactgtatcagtttctttggtccatccaaccaggtgttgttgtccttctataagaagaaatacttaagctacacatagtagtagatgacttattattcagggtttctctgactgaaatgtcactataacatcagtcatttgactcctaatccagtagatataaacagtgcctggaacagtctattataacactctgaaaacatttggtaaatatatgaattttaataaaaggaaagattgctgctcaacaccaaa

SEQ ID NO: 33815 - DNA, 143 bp, Homo sapiens
gattcatttcacaaaacttgcaaggagtatattgtaatattagctaaactctccctgagaaatttttaaaagggaatactacttagcttgtgttattaggctagcaatgtctttgatagcaaaacctgtcaaggccattatgg

SEQ ID NO: 33816 - DNA, 548 bp, Homo sapiens
agttgggggtccaacagagtctggggccaggagggccttgtgggagccagctggggtgaggacagagcccggctctgagagccctggggcctagtagagaaggggtgctccttccccactcctcacatgggtgggaaggcgccctcaggcaagaagactgggacacaggtacactcgccagggaccatccttcactctgcagcctttattcactgatgggattctgccccagtcccacccccgtgggggcaggatttagagcaggaaccgcccctccgggtcctttcctggggcctgtgccaggctgagcagactcaggaggcgtctctccgagggtgtgggctgtgatggggccctgtgcacccatccaggctgcccagaccaggagagcacaggtcagccggacacatgatggtaatgggctgggcagtgggagggaaacgtgcctgggggagggggtggcaggtgccagctgagcttcccggtgacacaccctgggctcagctgagatgggctcagctgtgacggggcacccaggccaggctggc

SEQ ID NO: 33817 - DNA, 455 bp, Homo sapiens
ctccccaccttccccaggcctgctgacccagccagacaaaaccacccactcacaccagttcccctctggccgcactccggcctctcggccggtctgcaatgggcacactgagagctgctggacagaccaccaaggcaggccacaacaccggagacccccaaagacggggctttcaccaggcaactcataagactgctctctaagctgcccagatcctgcttggggaacccctgagcaggccatcctgccggcagacgccaggtctgggcggtgccggccctggcatggcacgacggcaggggtccatcagatgggagcctagtcacagctcgggccgcactccggcctctcggccggtctgcaatgggcacactgagagctgctggacagaccaccaaggcaggccacaacaccggagacccccaaagacggggctttcaccaggcaactcataa

SEQ ID NO: 33818 - DNA, 2709 bp, Homo sapiens
ctccccaccttccccaggcctgctgacccagccagacaaaaccacccactcacaccagttcccctctggccgcactccggcctctcggccggtctgcaatgggcacactgagagctgctggacagaccaccaaggcaggccacaacaccggagacccccaaagacggggctttcaccaggcaactcataagactgctctctaagctgcccagatcctgcttggggaacccctgagcaggccatcctgccggcagacgccaggtctgggcggtgccggccctggcatggcacgacggcaggggtccatcagatgggagcctagtcacagctcgggccaagaagccgcgtgccctgtgcaggcctccccccatgccagcctgctccactgtctgaggctcatgctgtggcctcagactggggatgaaaggggattcagaatttgtgtcacgaacctcctgccacacccaggacccggtgtcttggctgtaaggcagagcccactcttcgaacccaggatgaggtgctccccagaggccgtgcccccaggcctggctcagcctttctcctccttggcttggtggagctgaagagggcactcacatctctatgcccaaccctgccagcagggtggaaattcaggcaggctgtgggagggtggggttgtcctcctggggctctgcccagctctcccatctagcttcccgtacacccactgcaggggccacaggcacccaaggaggcctggaagatggactggccctccctgtctgctacacccacagggggcacgctagaaacgcagaaggggacgcagcagccacattccagtccacaaagacgccgcgcaggcccgtccatctgccccgtgaatgccaaccaggcagagacacacatacagctgaggctgggccggatcccagagcaaacccttgggtgcctctggagggagcccgccaagagggatggctcataaacactggggaaggaacagaaggggagggagcaaaggaactcggccgctcacctccgacccaaccacttcccgagaagccatctctgtggtcatggtggtcccaggcctggctctccctgcgcccacccccaccacccagtcactccacccagtcaccccacccagctgtgacctgccacttccctccatctcacatgctttcccctcacctccctcaggaagcctccccagcctctggcctccagtcccaacaagccatgctccttccagagggaacctctgccaggggagcctccactttcttgctcctgcctccctacctggcacccaggccggccctggtaccctggtactgaataaaggcacacgtctaaatgatgtcggggggaatctgcccagtgttggcactggagcgaacacgacccactgccagcatggcccacgagccacacccccccaagccagcacctcctccccagaggaagcacggggctcgacggggcacgcccctgaatgggaggtcacacatggtgagggctcccttgttcccagaggtctagctgtctccctgctaagatgcagagctcactatgggcctcgcagggggttaagccgagtcatttcatctttcacagcagctgtaggtcccgctgacattagctgacacatagagagctaaagtgacctgtgcaaggtcacaggctaggagtagcagcacggggcccagcacgaggaacagccttagcatcccccgcctccccaaccctgcagcctgccctgactccaatcccaggggaattcctgagctgcaggcaaaggctgaagcaggagctgacaagccctgctgagcccagagaggtctgggcggtcccaggagggcgtctccctagggctttgatgagttggtggccgcccaggcacctctgcctgcctgcccagcatggcaggtgtgtgggctggagcttctgcccagccctgccccacagccacaattaggggacgagtgcagataaagcacgggggccagttacatctgaatttcagataaacaatgaattgttattttagtacagtatgaaagtatttggccccaaagaactggaagcaggaaaaggaacagctcctcatacacccatgctcacagcattattcaccagagccggaaggtagaaacgatgtctctccacagtcgaatagattgtttccacaaactgtctgtaggtgcatacaatggaataggattaatccgtgaaaaggaagaaattctgacacatgctccggcgtggaggaaccttgaggacgacgctgagtgaaagaagccagacacgaaaggacagatacggcaagactcgacttatgtgaggtccctagaggagtcggattcatagagactgaaaggatggcgggcaccaggggcggtggagaggggaaatggggagttactgtttaatggggacagagtttcagttttacaagatgaaaagggtcctggagctggatgggggtgacggccgcacaacagcatgaatggactgaacgccactgaaaactgaactcttgaaaatggttaaactggcatattttgttatgcatattttgccacaaaaagcaaacaactcttctccccaaaaatatctggggtgtacttacactaaatatgtagggcatatttactctcaacatttatttccttatttgaaattaaagtatttgggacacactgcactacaaaatga

SEQ ID NO: 33819 - DNA, 1932 bp, Homo sapiens
agttgggggtccaacagagtctggggccaggagggccttgtgggagccagctggggtgaggacagagcccggctctgagagccctggggcctagtagagaaggggtgctccttccccactcctcacatgggtgggaaggcgccctcaggcaagaagactgggacacaggtacactcgccagggaccatccttcactctgcagcctttattcactgatgggattctgccccagtcccacccccgtgggggcaggatttagagcaggaaccgcccctccgggtcctttcctggggcctgtgccaggctgagcagactcaggaggcgtctctccgagggtgtgggctgtgatggggccctgtgcacccatccaggctgcccagaccaggagagcacaggtcagccggacacatgatggaagcctccccagcctctggcctccagtcccaacaagccatgctccttccagagggaacctctgccaggggagcctccactttcttgctcctgcctccctacctggcacccaggccggccctggtaccctggtactgaataaaggcacacgtctaaatgatgtcggggggaatctgcccagtgttggcactggagcgaacacgacccactgccagcatggcccacgagccacacccccccaagccagcacctcctccccagaggaagcacggggctcgacggggcacgcccctgaatgggaggtcacacatggtgagggctcccttgttcccagaggtctagctgtctccctgctaagatgcagagctcactatgggcctcgcagggggttaagccgagtcatttcatctttcacagcagctgtaggtcccgctgacattagctgacacatagagagctaaagtgacctgtgcaaggtcacaggctaggagtagcagcacggggcccagcacgaggaacagccttagcatcccccgcctccccaaccctgcagcctgccctgactccaatcccaggggaattcctgagctgcaggcaaaggctgaagcaggagctgacaagccctgctgagcccagagaggtctgggcggtcccaggagggcgtctccctagggctttgatgagttggtggccgcccaggcacctctgcctgcctgcccagcatggcaggtgtgtgggctggagcttctgcccagccctgccccacagccacaattaggggacgagtgcagataaagcacgggggccagttacatctgaatttcagataaacaatgaattgttattttagtacagtatgaaagtatttggccccaaagaactggaagcaggaaaaggaacagctcctcatacacccatgctcacagcattattcaccagagccggaaggtagaaacgatgtctctccacagtcgaatagattgtttccacaaactgtctgtaggtgcatacaatggaataggattaatccgtgaaaaggaagaaattctgacacatgctccggcgtggaggaaccttgaggacgacgctgagtgaaagaagccagacacgaaaggacagatacggcaagactcgacttatgtgaggtccctagaggagtcggattcatagagactgaaaggatggcgggcaccaggggcggtggagaggggaaatggggagttactgtttaatggggacagagtttcagttttacaagatgaaaagggtcctggagctggatgggggtgacggccgcacaacagcatgaatggactgaacgccactgaaaactgaactcttgaaaatggttaaactggcatattttgttatgcatattttgccacaaaaagcaaacaactcttctccccaaaaatatctggggtgtacttacactaaatatgtagggcatatttactctcaacatttatttccttatttgaaattaaagtatttgggacacactgcactacaaaatga

SEQ ID NO: 33820 - DNA, 2018 bp, Homo sapiens
ctccccaccttccccaggcctgctgacccagccagacaaaaccacccactcacaccagttcccctctggccgcactccggcctctcggccggtctgcaatgggcacactgagagctgctggacagaccaccaaggcaggccacaacaccggagacccccaaagacggggctttcaccaggcaactcataagactgctctctaagctgcccagatcctgcttggggaacccctgagcaggccatcctgccggcagacgccaggtctgggcggtgccggccctggcatggcacgacggcaggggtccatcagatgggagcctagtcacagctcgggccaagaagccgcgtgccctgtgcaggcctccccccatgccagcctgctccactgtctgaggctcatgctgtggcctcagactggggatgaaaggggattcagaatttgtgtcacgaacctcctgccacacccaggacccggtgtcttggctgtaaggcagagcccactcttcgaacccaggatgaggtgctccccagaggccgtgcccccaggcctggctcagcctttctcctccttggcttggtggagctgaagagggcactcacatctctatgcccaaccctgccagcagggtggaaattcaggcaggctgtgggagggtggggttgtcctcctggggctctgcccagctctcccatctagcttcccgtacacccactgcaggggccacaggcacccaaggaggcctggaagatggactggccctccctgtctgctacacccacagggggcacgctagaaacgcagaaggggacgcagcagccacattccagtccacaaagacgccgcgcaggcccgtccatctgccccgtgaatgccaaccaggcagagacacacatacagctgaggctgggccggatcccagagcaaacccttgggtgcctctggagggagcccgccaagagggatggctcataaacactggggaaggaacagaaggggagggagcaaaggaactcggccgctcacctccgacccaaccacttcccgagaagccatctctgtggtcatggtggtcccaggcctggctctccctgcgcccacccccaccacccagtcactccacccagtcaccccacccagctgtgacctgccacttccctccatctcacatgctttcccctcacctccctcaggaagcctccccagcctctggcctccagtcccaacaagccatgctccttccagagggaacctctgccaggggagcctccactttcttgctcctgcctccctacctggcacccaggccggccctggtaccctggtactgaataaaggcacacgtctaaatgatgtcggggggaatctgcccagtgttggcactggagcgaacacgacccactgccagcatggcccacgagccacacccccccaagccagcacctcctccccagaggaagcacggggctcgacggggcacgcccctgaatgggaggtcacacatggtgcatacaatggaataggattaatccgtgaaaaggaagaaattctgacacatgctccggcgtggaggaaccttgaggacgacgctgagtgaaagaagccagacacgaaaggacagatacggcaagactcgacttatgtgaggtccctagaggagtcggattcatagagactgaaaggatggcgggcaccaggggcggtggagaggggaaatggggagttactgtttaatggggacagagtttcagttttacaagatgaaaagggtcctggagctggatgggggtgacggccgcacaacagcatgaatggactgaacgccactgaaaactgaactcttgaaaatggttaaactggcatattttgttatgcatattttgccacaaaaagcaaacaactcttctccccaaaaatatctggggtgtacttacactaaatatgtagggcatatttactctcaacatttatttccttatttgaaattaaagtatttgggacacactgcactacaaaatga

SEQ ID NO: 33821 - DNA, 450 bp, Homo sapiens
  misc_feature (16)..(16): n is a, c, g, or t
  misc_feature (38)..(38): n is a, c, g, or t
  misc_feature (74)..(74): n is a, c, g, or t
  misc_feature (135)..(135): n is a, c, g, or t
  misc_feature (149)..(149): n is a, c, g, or t
  misc_feature (171)..(171): n is a, c, g, or t
gaggacctgttggtcntgtagtgatccccttggtaatnctattgatggaaagggtccaattggttccaaagacnccgtaggcgattggtctgaaaccccccggtatcattcctcggaatttcagtgcgggaaccnatgcaagactgcantaaggctgtggatagcttggtnccaattggtcgtggtcagcgtgaactgattattggtgaccgacagactgggaaaacctcaattgctattgacacaatcattaaccagaaacgtttcaatgatggatctgatgaaaagaagaagctgtactgtatttatgttgctattggtcaaaagagatccactgttgcccagttggtgaagagacttacagatgcagatgccatgaagtacaccattgtggtgtcggctacggcctcggatgctgccccacttcagtacctggctccttactctggc

SEQ ID NO: 33822 - DNA, 904 bp, Homo sapiens
ttttttttttgctgcctctaacaatgaatgcttatatctctgtgtatatctcacttgttttaagtcaatatcaaccaaactgaacctacactttttataagtgtttgaaacacaacctcaacactctgaggttaaagatcagcgagggccacaggattacttttaaaagcccttagttgttattggtagactagcagagagagtctactgggttgaatgtagttggtcagcagagtattccttctgctgttataatctgaaacactgtgggaaaagatcagtattttaccaagcagtcttggtaaaattcttttgataattattgttaattacctgtaagaggttttattacatccttcttacagtggtcactttgcagtcctaggatttatcatcctgtgtgtaagaagtgactaaaatgcatgtacattctctacacatcaattgaattcacctgggatcaggcctaaagcatgtttagcaaattctattaatattctaggaaataccatggtatttcctttagcatacttccagaaaacacataccaaagttccatttaggtacatttcctctattttctttgattttaataatgcaaatattaatatggcaattaggaatgttgagattctactgatgtcagatatatagaaaaataaagaaaagcaccataaactatatgaatgggcccatcgctactcaccataacattccaaattaaaaaagcaatgagatactttatacctcttgggagaacaaaattagaaagtggataatatcaagtattggtgaagatataagccgttaagtcccaatggccttctgatatttccaacttgtgatgagtttattgggatgtaacaccactgtaagtcaaggaacatttgtatctcaacatcca

SEQ ID NO: 33823 - DNA, 310 bp, Homo sapiens
gggactcttgatactcacaactcttggatataaaaattctctggaaattctctagcattaaaaacaaagtttcccttattccccccatttaattttctacttttctattccttaatccctcttcaaagccaacatgtttctgatcctctaacctcttccttttttctctctcactgctgcttcctgtacataatagtccacacagaccacactaaccctcagttggacctcaggatgtcagtgtaatctgtgccgctccattagccccggtaagcgagccacctaagcaaaggtaattacagtgtgtccg

SEQ ID NO: 33824 - DNA, 593 bp, Homo sapiens
  misc_feature (560)..(561): n is a, c, g, or t
  misc_feature (585)..(585): n is a, c, g, or t
aaattatgacagctaacatttattccatactgcctatgagccaggagttttaaggacactgctcacttataaaaatgtgtactgtatttctcccacattgtatatgaggaaactgaggcttagagaggttgagtcacttgcccaaagtcacacatccttcaagtagtagtgaatccattatatgagcccaggcatttggcccgagaggctacaagctcgacccctctgctctacaggaaaaagcctggaagcagaaggcctcttttatccaccagctgtgtgaccttgggttggtcactcacctctctgagcttccatctcctacagggttataaggagactcgaatatggagctgcatgtcgttgagctttgcaaactttgaagtgatgtcgagaaactcgcagatgactgaactcggctctcctctgcatgttccagagagactagcagatcactttacacgcagtaggtcttgtgctcttagccttttcaacttagaggcgtgcagtccagtttaccactgacctaggaggaaaaaggattgcaagggtttggggannggtcccctgggggaaccaaccccngggctcct

SEQ ID NO: 33825 - DNA, 751 bp, Homo sapiens
aaattatgacagctaacatttattccatactgcctatgagccaggagttttaaggacactgctcacttataaaaatgtgtactgtatttctcccacattgtatatgaggaaactgaggcttagagaggttgagtcacttgcccaaagtcacacatccttcaagtagtagtgaatccattatatgagcccaggcatttggcccgagaggctacaagctcgacccctctgctctacaggaaaaagcctggaagcagaaggcctcttttatccaccagctgtgtgaccttgggttggtcactcacctctctgagcttccatctcctacagggttataaggagactcgaatatggagctgcatgtcgttgagctttgcaaactttgaagtgatgtcgagaaactcgcagatgactgaactcggctctcctctgcatgttccagagagactagcagatcactttacacgcagtaggtcttgtgctcttagccttttcaacttagaggcgtgcagtccagtttaccactgacctagagaaaagatgcaggctgggacgtcctgggaccaaccgtgctctgtcttctgtgctattttccttatcgctcagttgttggcactccctcttttcagacctcatccctcatcccatcacattttatgacactgcaggtgtctttataagctgcctctaattcctattggagcagggtaagatacaaattagtcaaacaaataaataacagtggttgttcaat

SEQ ID NO: 33826 - DNA, 1169 bp, Homo sapiens
caagtgtattttgcgtgatttctgctatttccccttcttgtgtgtctcaggacatatcagaaaattttagtcctgagacagttaaatattttttaaatcacagtttaaacctagaacccagctgcatgaaggagttaaagagctacaactatttcttaaagtgttccattaatcaactaacaaatgtcactatcagactcttgccaagcagtttctgacatttctgccaaaggggaaaaaaatcagactttgagctgtattacaataaaaataataatgcaaataaggattcctaggcttgaattaaagaagttgtaatgattaggagtgcaaaagtataatgatatacactgacttgtttaaatccttatgtatggttcgctcccatctgagcttttcaaaaaatcccatctcaataagagatactctaatgacactggcaattgattatacttcttgtgtttgaagtcataggatactagtgaatggattatgcttaaatatgccaaccacctttgcaaataaatggttggtctgcttttaattcctaagtctacttttgctgcatagagatgttgcttctctgacaacctcttaccaatttagcaatgctgcttagtatatgaatttggatgcagtgctctctgctcatcatttagatggtcctttgatccaacatgctgggctcatggagaaggcttcataaaagattgggggataatgaacttttctcacaaggctccttaactcaaatatttattgcagaagaaggaactggtttcttatatgttgcactgtatgttcaactagcctaattaggacattgaaagtgacagaagagcagatcttaacccagtgttagaatgaatttcccataaacagagttgtccaacagtggaatggactgccttaatagtgagctccctgcctctgaaaatattcactggatgaccatctgttagaataccataaaaagattttctgtgctggctacatgttcaatataaagtcctttctggctctaagttctatgaatatataaactacatcagtgccatgctgtggttagatttatctgatgataacagctaagactatggagagggactttaaaaattctcaaaccattctgtgatcaatctttaacagcaactacatagctcttcctt

SEQ ID NO: 33827 - DNA, 364 bp, Homo sapiens
cctgcagtaaccaaaaacatgagctggataaggaggagaagaggagctggccgaatgatttttaagcagaagctgaatgttcaataagaatagagttgacaccttcagaggagaagtaagaaatagttttcctgtgtgtcatgtaagtcatgtttttaggcttacctttcatgcaattgcaacaacatcctctaagggtcttgaacgaaccttctattccccaaatattcctgaccattcccaatgactatctcagatgtgctccatcactttgtctctcctactgtgaaccttttggttggtatctactgttgacacatagcttacctaatgaactaggtggaagtatctggctaatgttgct

SEQ ID NO: 33828 - DNA, 668 bp, Homo sapiens
ttttttttttcccactctttctgctcctcaaactggataaatacaactgacctaggcttaagttcactgtttctttggtgtgctcaattctgctactgaatccctccagtgagtgttcttttcacttactatacttttcagtgccagaatttgtttgcttcctttagataattctctacttgcttctacatcattctgatatcttttaagcaacatccccatggtttccttgagcgccctggcacatttaagacagctgatttaaactttttgtctcctaagtctgatgtctggctttcctcaggggcagttactattaccttcttctgggagtgggccacattttgttttgttgcatgctttgtaatgttttttgtagaaaactggacatacgccgggtgcagtggctcacacctgtaatcccagcactttgggaggccaagatgataatggagctgaaaaattcttactgtcccagtgatgtagtagctgacgtgccaccgcagcacaaggagggaattcacgtgtttgtggtataaaacatcctgctgcaaaacatccacagcactgcagctgtgtcaaagtctagcacactcgattatgtactgaacagacttgataatgataataaatgaccacattactgagacagcaatcagggatcctct

SEQ ID NO: 33829 - DNA, 335 bp, Homo sapiens
agctggcacaagggagcagccatgtgttatctaggacaactgagaaaagcatttgaaaatgagtgcccaaatgacattaagcaaactttttttaaaaagcgatgcaataaaaagggtattcagagagccactagtatctatcttctaaacctagacagtgattcatgtaaactcaacatctaaagtggctgagggaaataatcaggtatctagggcaaagataaaggtatatgtgtttcctgtattacgaaccttatataacaaatattttagtgagggatgttgtaaagattgctaccttcctcttttggaaagaattttgggtgaataatact

SEQ ID NO: 33830 - DNA, 802 bp, Homo sapiens
gcaagaatatactggtctatgaaccaagaagtggcaccttgatcttggacttcccagccttcagaactaatgctcttttcatgttttgtgttcctccactggacttaatctaatgcatccaaagcatgagaagaaagagtcctgttcccaagtaccagggaaattgggcattgcttccagaagacatgaagaaacctgcagcagattctactctggattttgcacaagatcgtgtttcaagtcaaggtgaaccccagaaactgagaaagtcaatccactcaagagaaaatgctcaactaaggaggagataaagttcatttcttctgtgatttgattttttttcccttgcaaatagaaatcacattcattcaaaatcaaagacattgaattagctgcataagaagtcatggataattcattaaagatatagaatcacacagataatggcaagtgttggtgaggctttagaataactggaattctcatactttgcaggtgggagtgaaaaatggttcagcctcttgggaaaacagttgggcctttttttatgaacttattcgtacacttttagtgcatgacccagcagccctacttctaagtacttacctcagagaaatcaaaacatattcacacaataacttgtatgtgaattttttaaaggctttatttgtaatcacccaaaactggaaacaaatatccctcagttgaggaaaagatccctcagttaaggaaaagataaacaaattgtacatttgtaccatgtgatactattcaccagtaaaaaacaatgaactgattcctg

SEQ ID NO: 33831 - DNA, 912 bp, Homo sapiens
ttttctgttaactcagaattattatagcattcattattgttttgtgaaaatactagttaataatctccggttaatgaaataattatcttagataaatttactgaacttaatgtagaatatgttttttgtttcgttttgtttttgagacagggtctcacttgtcacccaggctggagtgcagtggcacaaacatgggtcactgcagcctcgactcctgggctcgagtgatgctcccacctcagcctctcaagtagctgggactacaggtgtgtgccactacacttggctaattttcatattttttgtagagacggggtttcaccatgttgcccagggctggtcttgaactcctcctgagttaaagcagtctgcttgtctctgtctgccagagtgctggcattataggcatgagccaccacccccttcttccactttcatttcaaacagttatgaagcagccactgaaaccggactctcgacaatgccaaaggaggttttgttttcttgtctttccatgtctttgctgtggtttgctctgaaactagaattaaacagctttttaaattgataaaaaagaaccaatgcaaataaaactacggtctgtagagtaaatggaaaaagttgtagaagtaataataaactacttttaaacaaatgagtaaggtagtagatattttgcaagaagtaaatagccaagtgtaaaagctgtcagttactttcatcaatcaggttagttgcagtcacgcaaattttaggtgattatataaggaactcaaattaggaatctttaaatgtaaatgacctaatactaaaaactacccaaaaaatatattcaaagataaatagaagaaatacttatgcatttgaaaaaatcgatgcattccacagttcctctgaatcaaaggtaaaaaa

SEQ ID NO: 33832 - DNA, 362 bp, Homo sapiens
gaggattagggcagaagcttatagatctgggtgaaggctgctcccacagcacagtagggagtctctgggtccagagagctcccaagggctgtagcagcttagggccctgtatctgcaaggctctatcttatcattaggaaacagctgtccatcgagattttatggggtctgcaaaggaggcaggcactaaatggatgaaaatctgcttatatgagctatttttgttaatgactgggcatggtaaaatttgagttaggtatgagccaagggatcagcaccagtcgacagtgaagaaataaacaaccgaggggccaatacacagaaacaatctttgacttgtttacataacacctctcatccaa

SEQ ID NO: 33833 - DNA, 414 bp, Homo sapiens
tgagacaaggtctcattctgtcgcccagcctggagtgcagtggcacaatcttggcccactgcaacctccgcctcccaggttcgagcaattctccggcctcagcctcccaaatagttgggattacaggcgcccaccaccacacctggctaatttttgtatttttagcagagatggggtttcaccatgttggccaggctgttctcaaactcctgacctcaggtgattcaacccgccttggcctcccaaagtgctggggttacaggcatgagccactgtgcccagccaactctgtctccaaaaaaaaaaaatttttttttgaaggcttttattctctctaaggaaaaaaaacaaacccaacaatcaaaaatttcctaattccttttgagaggtcttatactacagattgataaaagg

SEQ ID NO: 33834 - DNA, 1051 bp, Homo sapiens
caaaaaacttcaactctacctcctggttggaactcatattgtagattgcaaaagcacagaattaacatcataatactattgaattcaaaaagaaatctagaaacttcagggaatccagagaagatagagcagatggtctgaatagtcaccattcacattttgctttgttttggtaactattactatcacttaattacatagggtgaatataagaaaattgcctttttcttattttcagtgctaaccctaaaatggtaaaactcttgcaggttgaaattaacagcttctcagtggcccttcaacagaaggttgaagggtagcgaagttgcctctgtaatttccagggtgaacaaatctgaactcagttcttgcagttcccaaattcacagctatcttgggatatgttgatttgtgggctgcaaaatatgagaaattctacctcagagaattctgtttataaaaacttattcgcatctaataatctgaagagatataaacacagcaatgttgttacaactacctgttaattgttaatccttggaaaaagaattgacaattatttctgaagacatgaaaagcttcatataataaacaatagactctcaaatgtaaatcagtttttatttttaatttggagaagttaataataataaattgccagcaataaaaaataaatcattcatcaccgttaccgtgttactaatggctggtccatataggtttgcagtgattttggttcttccattctcaaaagaaataatccagcccagagacgaagagtgggtttgaagcataagtggggggttgttgaaaggaaataaagtacccttgggaaagaaccaagggtgtgacttgagagatcaagtgccagagaaaggtcatataccagttaaactccaatatttggcctctcagtgtgcatgcttgggtgtcttgcccaatatttgagattttatgaaacagctgctgcccctgagctcaggatgtgttctgtgtttaggaggtttccccctccctggtaccagctgagaccatttgtcaatcctgagct

SEQ ID NO: 33835 - DNA, 1373 bp, Homo sapiens
attcaccaagttcaccctgtctggtggcaggaaaagaagtcagctcaggaaccatggcagtgggaggtgaaggagagagagggtattagaggttgtccagaatgttttagcaaggccaatcagaaacaaactatagggtccccttattatggggctgaagaccagaaagtcatccctgctaatttttaggtagcagatctttgtttctagaattctgttcttttaaaagccttgggaggcatcattcattcctgaaagtcaacttacacatttgcctctgtagtttggagagaaatatatttagtatccagtgtgtcaggttgcaggcaaggaagtagttaacacttttctctttgttctccacaattgaactgtttttgggggggcagttctactgcttctggaattacataattgtgtgggtcatctcctttgaaggtctgtccatgctttttttaaagcacatcgttgaaagaagggtgctctgtacaaatgctgacatgcttttctcttgggttatacgtgagcaattgtagaatgaacagacttcagggttttggtgttggtatagctttctgtgaatagtgaaggtattaggaggctaatgttaaggcagcaggtgaggtggttttcaggcaacacatctgaactcattaattgatcaagtatttatcagatgctctttcctatatactaattatctccccaaaggaattctttgcagcacaaaagtttaacacttaattatacattttgagttgttctccagtgtttttttggcttttttgtttgtttgttttttgaaacagggtcttgttctgtcgcccaggctagagtgtagtggtaccatcgcggctcgctgcagccttgaccttacgggcttatgcgatcctcccacctcagcctcctgaatagctgggactacaggcatgtgtcaccatgcccggccaatttttttggatttttttgcagagacggggttttgccatgttgcccaggccggtcttgagctcctggactcaagtgatccgcctgcctcagcctcccaaagtgccgggattacaggcatgagctaccaccccggcccagtgttttggttagtctcttctcctcatagatttcaaccgccttgaggatggtttacgtttctctgtgtttactgtgcagactggacatccatattcatagcagtaaagatttcttcattttacaaactgctttttgtttttttgagatggagtctcactctgttgcgcaggctggagtgcagtgagccaagatcgctccattgccctccagcctgggtgacaagagcaaaactccatctcaaataaataaaaaggaaaaaaaagtcaataaactgtacaaattta

SEQ ID NO: 33836 - DNA, 1058 bp, Homo sapiens
attcaccaagttcaccctgtctggtggcaggaaaagaagtcagctcaggaaccatggcagtgggaggtgaaggagagagagggtattagaggttgtccagaatgttttagcaaggccaatcagaaacaaactatagggtccccttattatggggctgaagaccagaaagtcatccctgctaatttttaggtagcagatctttgtttctagaattctgttcttttaaaagccttgggaggcatcattcattcctgaaagtcaacttacacatttgcctctgtagtttggagagaaatatatttagtatccagtgtgtcaggttgcaggcaaggaagtagttaacacttttctctttgttctccacaattgaactgtttttgggggggcagttctactgcttctggaattacataattgtgtgggtcatctcctttgaaggtctgtccatgctttttttaaagcacatcgttgaaagaagggtgctctgtacaaatgctgacatgcttttctcttgggttatacgtgagcaattgtagaatgaacagacttcagggttttggtgttggtatagctttctgtgaatagtgaaggtattaggaggctaatgttaaggcagcaggtgaggtggttttcaggcaacacatctgaactcattaattgatcaagtatttatcagatgctctttcctatatactaattatctccccaaaggaattctttgcagcacaaaagtttaacacttaattatacattttgagttgttctccagtgtttttttggcttttttgtttgtttgttttttgaaacagggtcttgttctgtcgcccaggctagagtgtagtggtaccatcgcggctcgctgcagccttgaccttacgggcttatgcgatcctcccacctcagcctcctgaatagctgggactacaggcatgtgtcaccatgcccggccaatttttttggatttttttgcagcactttgggaggctgaggtgggacaattgctcaagaccagttcaacactagcctgggcagcatagtgagagtccacatatctacag

SEQ ID NO: 33837 - DNA, 458 bp, Homo sapiens
  misc_feature (27)..(27): n is a, c, g, or t
aaattttaaaaagggggccggttcccnaaagcgtcgaggtggaaaatatgccgttggatcagcttgcattggaggtggccaaggtattgctgtcatcattcagagcacagcctgaagagaccagtgagctcactgtgacccatccttactctacttggccaggccacagtaaaacaagtgaccttcagagcagctgccacaactggccatgccctgccattgaaacagtgattaagtttgatcaagccatggtgacacaaaaatgcattgatcatgaataggagcccatgctagaagtacattctctcagatttgaaccagtgaaatatgatgtatttctgagctaaaactcaactatagaagacattaaaagaaatcgtattcttgccaagtaaccaccacttctgccttagataatatgattataaggaaatcaaataaatgttgccttaacttca

SEQ ID NO: 33838 - DNA, 778 bp, Homo sapiens
cgagcggagctggcggccgcggccgcccgcgcgccaagttcctcagcccttggctcctgcccagtgtttagggtgttggcggagacaaaggggaagagtcatcgcctgtcggggctaggatatgatgggtgagaggtgtcaaaccaaattctctcggtttggaaacggagaaaatctaaaaatgaggatgtgaggaaagagtccgctctcaaggcgcgttgtggtctatccgagccccgtcccctgggctccctcgggctggggtgtgtttgtagttgctgctaagcgaacgccctttggagcttacggaggccttctgaaagacttcactgctactgacttgtctgaatttgctgccaaggctgccttgtctgctggcaaagtctcacctgaaacagttgacagtgtgattatgggcaatgtcctgcagagttcttcagatgctatatatttggcaaggcatgttggtttgcgtgtgggaatcccaaaggagaccccagctctcacgattaataggctctgtggttctggttttcagtccattgtgaatggatgtcaggaaatttgtgttaaagaagctgaagttgttttatgtggaggaaccgaaagcatgagccaagctccctactgtgtcagaaatgtgcgttttggaaccaagcttggatcagatatcaagtttctcacctggcctttttggaagttgaaaggaatgggacttaagagaatctatgcggattttagccaccaaacacatttgagatatcttttatgaagacag

SEQ ID NO: 33839 - DNA, 553 bp, Homo sapiens
tactaaattcgcggccgcgtcgacgtttgatcaagccatggtgacacaaaaatgcattgatcatgaataggagcccatgctagaagtacattctctcagatttgaaccagtgaaatatgatgtatttctgagctaaaactcaactatagaagacattaaaagaaatcgtattcttgccaagtaaccaccacttctgccttagataatatgattataaggaaatcaaataaatgttgccttaacttcagttaatattttcctgtcatttatatttttaaaaattttaaattgtgataagatacacattacataaactttaccatcttaacccttctttagcgtacaattcactggtattaagtacattcacatttttatacaaacatccccactttttatcaacagaactttttcagtcaccacacatggaaacaataactcctgattctcccatcccccatcccctgacaaccaccagtgtattttgtttctataaatttgatgactcgaggtacctcataagtgaaattataaatatctgtcctttcgtgac

SEQ ID NO: 33840 - DNA, 983 bp, Homo sapiens
  misc_feature (286)..(286): n is a, c, g, or t
tctgctcttggacacaggcatgcaactcaggtacaatataagtcagcttgaggagtggcttcggggaagaaaccttcaccagagtggagcagttcagaccatggaacctctgatccaagcagcccagctcctgcaattaaagaagaaaacccaggaggacgcagaggctatctgctccctgtgtacctccctcagcacccagcagattgtcaaaattttaaacctttatactcccctgaatgaatttgaagaacgggtaacagtggcctttatacgaacaatccanggtagcttcagtggagggaccaatccctagggcttcctactctgccattttatgtgatgtactcttctcccattctacaggcacaactacaagagcggaatgaccctcagcaactgctattagatgccaagcacatgtttcctgttttgtttccatttaatccatcttctctaaccatggactcaatccacatcccagcgtgtctcaatctggaattcctcaatgaagtctgaagatgcatgtttccagcattagtttgattcccaatgtgagcaagaaggaagtatatacagtaaagtaaattcaaggatctgttaaatctggtaaaagtagatcaaatcagagattgacagcctgtggagggtgctgaactatacagaattagacacaactatgtcattattttttgtacctactgctcagaataaaaacacttgaaatatggaagattttaagtttgatttcagtccaacacatatacataatttatagacaccaagcagtccccatagacatataaaaggtgtcaattctataaaacgaagctgcctagttttgatctttgcatagaactagagaatgtccaaattaaaataccaaatatatataagtcacataaattgccttcaaagggctttaacaaataatggtactaataaccatgataatggcatatactgacatttcccaaagtttg

SEQ ID NO: 33841 - DNA, 1997 bp, Homo sapiens
cgagcggagctggcggccgcggccgcccgcgcgccaagttcctcagcccttggctcctgcccagtgtttagggtgttggcggagacaaaggggaagagtcatcgcctgtcggggctaggatatgatgggtgagaggtgtcaaaccaaattctctcggtttggaaacggagaaaatctaaaaatgaggatgtgaggaaagagtccgctctcaaggcgcgttgtggtctatccgagccccgtcccctgggctccctcgggctggggtgaggcgggcagcgctacgcgtggggtaggaccatcttacgctgggaccccgccaaggagccccaggaagtaggtgaaagggcaggggcgtggctctcggggcgccacccacgctcttgaaatctgggtgattgcgagcggccgctcagcgtcccccacaccacagacccgcgccgccgacgacccagcagccgccatggctctgctccgaggtgtgtttgtagttgctgctaagcgaacgccctttggagcttacggaggccttctgaaagacttcactgctactgacttgtctgaatttgctgccaaggctgccttgtctgctggcaaagtctcacctgaaacagttgacagtgtgattatgggcaatgtcctgcagagttcttcagatgctatatatttggcaaggcatgttggtttgcgtgtgggaatcccaaaggagaccccagctctcacgattaataggctctgtggttctggttttcagtccattgtgaatggatgtcaggaaatttgtgttaaagaagctgaagttgttttatgtggaggaaccgaaagcatgagccaagctccctactgtgtcagaaatgtgcgttttggaaccaagcttggatcagatatcaagctggaagattctttatgggtatcattaacagatcagcatgtccagctccccatggcaatgactgcagagaatcttgctgtaaaacacaaaataagcagagaagaatgtgacaaatatgccctgcagtcacagcagagatggaaagctgctaatgatgctggctactttaatgatgaaatggcaccaattgaagtgaagacaaagaaaggaaaacagacaatgcaggtagacgagcatgctcggccccaaaccaccctggaacagttacagaaacttcctccagtattcaagaaagatggaactgttactgcagggaatgcatcgggtgtagctgatggtgctggagctgttatcatagctagtgaagatgctgttaagaaacataacttcacaccactggcaagaattgtgggctactttgtatctggatgtgatccctctatcatgggtattggtcctgtccctgctatcagtggggcactgaagaaagcaggactgagtcttaaggacatggatttggtagaggtgaatgaagcttttgctccccagtacttggctgttgagaggagtttggatcttgacataagtaaaaccaatgtgaatggaggagccattgctttgggtcacccactgggaggatctggatcaagaattactgcacacctggttcacgaattaaggcgtcgaggtggaaaatatgccgttggatcagcttgcattggaggtggccaaggtattgctgtcatcattcagagcacagcctgaagagaccagtgagctcactgtgacccatccttactctacttggccaggccacagtaaaacaagtgaccttcagagcagctgccacaactggccatgccctgccattgaaacagtgattaagtttgatcaagccatggtgacacaaaaatgcattgatcatgaataggagcccatgctagaagtacattctctcagatttgaaccagtgaaatatgatgtatttctgagctaaaactcaactatagaagacattaaaagaaatcgtattcttgccaagtaaccaccacttctgccttagataatatgattataaggaaatcaaataaatgttgccttaacttca

SEQ ID NO: 33842 - DNA, 2286 bp, Homo sapiens
cgagcggagctggcggccgcggccgcccgcgcgccaagttcctcagcccttggctcctgcccagtgtttagggtgttggcggagacaaaggggaagagtcatcgcctgtcggggctaggatatgatgggtgagaggtgtcaaaccaaattctctcggtttggaaacggagaaaatctaaaaatgaggatgtgaggaaagagtccgctctcaaggcgcgttgtggtctatccgagccccgtcccctgggctccctcgggctggggtgaggcgggcagcgctacgcgtggggtaggaccatcttacgctgggaccccgccaaggagccccaggaagtaggtgaaagggcaggggcgtggctctcggggcgccacccacgctcttgaaatctgggtgattgcgagcggccgctcagcgtcccccacaccacagacccgcgccgccgacgacccagcagccgccatggctctgctccgaggtgtgtttgtagttgctgctaagcgaacgccctttggagcttacggaggccttctgaaagacttcactgctactgacttgtctgaatttgctgccaaggctgccttgtctgctggcaaagtctcacctgaaacagttgacagtgtgattatgggcaatgtcctgcagagttcttcagatgctatatatttggcaaggcatgttggtttgcgtgtgggaatcccaaaggagaccccagctctcacgattaataggctctgtggttctggttttcagtccattgtgaatggatgtcaggaaatttgtgttaaagaagctgaagttgttttatgtggaggaaccgaaagcatgagccaagctccctactgtgtcagaaatgtgcgttttggaaccaagcttggatcagatatcaagctggaagattctttatgggtatcattaacagatcagcatgtccagctccccatggcaatgactgcagagaatcttgctgtaaaacacaaaataagcagagaagaatgtgacaaatatgccctgcagtcacagcagagatggaaagctgctaatgatgctggctactttaatgatgaaatggcaccaattgaagtgaagacaaagaaaggaaaacagacaatgcaggtagacgagcatgctcggccccaaaccaccctggaacagttacagaaacttcctccagtattcaagaaagatggaactgttactgcagggaatgcatcgggtgtagctgatggtgctggagctgttatcatagctagtgaagatgctgttaagaaacataacttcacaccactggcaagaattgtgggctactttgtatctggatgtgatccctctatcatgggtattggtcctgtccctgctatcagtggggcactgaagaaagcaggactgagtcttaaggacatggatttggtagaggtgaatgaagcttttgctccccagtacttggctgttgagaggagtttggatcttgacataagtaaaaccaatgtgaatggaggagccattgctttgggtcacccactgggaggatctggatcaagaattactgcacacctggttcacgaattaaggcgtcgaggtggaaaatatgccgttggatcagcttgcattggaggtggccaaggtattgctgtcatcattcagagcacagcctgaagagaccagtgagctcactgtgacccatccttactctacttggccaggccacagtaaaacaagtgaccttcagagcagctgccacaactggccatgccctgccattgaaacagtgattaagtttgatcaagccatggtgacacaaaaatgcattgatcatgaataggagcccatgctagaagtacattctctcagatttgaaccagtgaaatatgatgtatttctgagctaaaactcaactatagaagacattaaaagaaatcgtattcttgccaagtaaccaccacttctgccttagataatatgattataaggaaatcaaataaatgttgccttaacttcaaaaaaaaaaaagaaaaaaaacaaaaaacttgtggggggcgccgggacgctcgaaaaagttttcaaaacattcggtggggcggggggcccagaggttgaggaaatgggccataggttgccagaggaaaccgggctggacatggtcggggtctcaccaaaaaaaggcgggggaccggggttcggacaaccaagggcgtcgggctagggctcaacgagacaggactatcccccccgcgccgcggggaacaacaagaacacacgaaaacgagcaaacacaacaaccagagaca

SEQ ID NO: 33843 - DNA, 2303 bp, Homo sapiens
cgagcggagctggcggccgcggccgcccgcgcgccaagttcctcagcccttggctcctgcccagtgtttagggtgttggcggagacaaaggggaagagtcatcgcctgtcggggctaggatatgatgggtgagaggtgtcaaaccaaattctctcggtttggaaacggagaaaatctaaaaatgaggatgtgaggaaagagtccgctctcaaggcgcgttgtggtctatccgagccccgtcccctgggctccctcgggctggggtgaggcgggcagcgctacgcgtggggtaggaccatcttacgctgggaccccgccaaggagccccaggaagtaggtgaaagggcaggggcgtggctctcggggcgccacccacgctcttgaaatctgggtgattgcgagcggccgctcagcgtcccccacaccacagacccgcgccgccgacgacccagcagccgccatggctctgctccgaggtgtgtttgtagttgctgctaagcgaacgccctttggagcttacggaggccttctgaaagacttcactgctactgacttgtctgaatttgctgccaaggctgccttgtctgctggcaaagtctcacctgaaacagttgacagtgtgattatgggcaatgtcctgcagagttcttcagatgctatatatttggcaaggcatgttggtttgcgtgtgggaatcccaaaggagaccccagctctcacgattaataggctctgtggttctggttttcagtccattgtgaatggatgtcaggaaatttgtgttaaagaagctgaagttgttttatgtggaggaaccgaaagcatgagccaagctccctactgtgtcagaaatgtgcgttttggaaccaagcttggatcagatatcaagctggaagattctttatgggtatcattaacagatcagcatgtccagctccccatggcaatgactgcagagaatcttgctgtaaaacacaaaataagcagagaagaatgtgacaaatatgccctgcagtcacagcagagatggaaagctgctaatgatgctggctactttaatgatgaaatggcaccaattgaagtgaagacaaagaaaggaaaacagacaatgcaggtagacgagcatgctcggccccaaaccaccctggaacagttacagaaacttcctccagtattcaagaaagatggaactgttactgcagggaatgcatcgggtgtagctgatggtgctggagctgttatcatagctagtgaagatgctgttaagaaacataacttcacaccactggcaagaattgtgggctactttgtatctggatgtgatccctctatcatgggtattggtcctgtccctgctatcagtggggcactgaagaaagcaggactgagtcttaaggacatggatttggtagaggtgaatgaagcttttgctccccagtacttggctgttgagaggagtttggatcttgacataagtaaaaccaatgtgaatggaggagccattgctttgggtcacccactgggaggatctggatcaagaattactgcacacctggttcacgaattaaggcgtcgaggtggaaaatatgccgttggatcagcttgcattggaggtggccaaggtattgctgtcatcattcagagcacagcctgaagagaccagtgagctcactgtgacccatccttactctacttggccaggccacagtaaaacaagtgaccttcagagcagctgccacaactggccatgccctgccattgaaacagtgattaagtttgatcaagccatggtgacacaaaaatgcattgatcatgaataggagcccatgctagaagtacattctctcagatttgaaccagtgaaatatgatgtatttctgagctaaaactcaactatagaagacattaaaagaaatcgtattcttgccaagtaaccaccacttctgccttagataatatgattataaggaaatcaaataaatgttgccttaacttcagttaatattttcctgtcatttatatttttaaaaattttaaattgtgataagatacacattacataaactttaccatcttaacccttctttagcgtacaattcactggtattaagtacattcacatttttatacaaacatccccactttttatcaacagaactttttcagtcaccacacatggaaacaataactcctgattctcccatcccccatcccctgacaaccaccagtgtattttgtttctataaatttgatgactcgaggtacctcataagtgaaattataaatatctgtcctttcgtgac

SEQ ID NO: 33844 - DNA, 1969 bp, Homo sapiens
cgagcggagctggcggccgcggccgcccgcgcgccaagttcctcagcccttggctcctgcccagtgtttagggtgttggcggagacaaaggggaagagtcatcgcctgtcggggctaggatatgatgggtgagaggtgtcaaaccaaattctctcggtttggaaacggagaaaatctaaaaatgaggatgtgaggaaagagtccgctctcaaggcgcgttgtggtctatccgagccccgtcccctgggctccctcgggctggggtgaggcgggcagcgctacgcgtggggtaggaccatcttacgctgggaccccgccaaggagccccaggaagtaggtgaaagggcaggggcgtggctctcggggcgccacccacgctcttgaaatctgggtgattgcgagcggccgctcagcgtcccccacaccacagacccgcgccgccgacgacccagcagccgccatggctctgctccgaggtgtgtttgtagttgctgctaagcgaacgccctttggagcttacggaggccttctgaaagacttcactgctactgacttgtctgaatttgctgccaaggctgccttgtctgctggcaaagtctcacctgaaacagttgacagtgtgattatgggcaatgtcctgcagagttcttcagatgctatatatttggcaaggcatgttggtttgcgtgtgggaatcccaaaggagaccccagctctcacgattaataggctctgtggttctggttttcagtccattgtgaatggatgtcaggaaatttgtgttaaagaagctgaagttgttttatgtggaggaaccgaaagcatgagccaagctccctactgtgtcagaaatgtgcgttttggaaccaagcttggatcagatatcaagctggaagattctttatgggtatcattaacagatcagcatgtccagctccccatggcaatgactgcagagaatcttgctgtaaaacacaaaataagcagagaagaatgtgacaaatatgccctgcagtcacagcagagatggaaagctgctaatgatgctggctactttaatgatgaaatggcaccaattgaagtgaagacaaagaaaggaaaacagacaatgcaggtagacgagcatgctcggccccaaaccaccctggaacagttacagaaacttcctccagtattcaagaaagatggaactgttactgcagggaatgcatcgggtgtagctgatggtgctggagctgttatcatagctagtgaagatgctgttaagaaacataacttcacaccactggcaagaattgtgggctactttgtatctggatgtgatccctctatcatgggtattggtcctgtccctgctatcagtggggcactgaagaaagcaggactgagtcttaaggacatggatttggtagaggtgaatgaagcttttgctccccagtacttggctgttgagaggagtttggatcttgacataagtaaaaccaatgtgaatggaggagccattgctttgggtcacccactgggaggatctggatcaagaattactgcacacctggttcacgaattaaggcgtcgaggtggaaaatatgccgttggatcagcttgcattggaggtggccaaggtattgctgtcatcattcagagcacagcctgaagagaccagtgagctcactgtgacccatccttactctacttggccaggccacagtaaaacaagtgaccttcagagcagctgccacaactggccatgccctgccattgaaacagtgattaagtttgatcaagccatggtgacacaaaaatgcattgatcatgaataggagcccatgctagaagtacattctctcagatttgaaccagtgtggagagagctctctccacactggagcctccgtagacctaaccatcttctccttacacctagcaggtgtctcctctatcttaggggccatcaatttcatcacaacaa

SEQ ID NO: 33845 - DNA, 1746 bp, Homo sapiens
cgagcggagctggcggccgcggccgcccgcgcgccaagttcctcagcccttggctcctgcccagtgtttagggtgttggcggagacaaaggggaagagtcatcgcctgtcggggctaggatatgatgggtgagaggtgtcaaaccaaattctctcggtttggaaacggagaaaatctaaaaatgaggatgtgaggaaagagtccgctctcaaggcgcgttgtggtctatccgagccccgtcccctgggctccctcgggctggggtgaggcgggcagcgctacgcgtggggtaggaccatcttacgctgggaccccgccaaggagccccaggaagtaggtgaaagggcaggggcgtggctctcggggcgccacccacgctcttgaaatctgggtgattgcgagcggccgctcagcgtcccccacaccacagacccgcgccgccgacgacccagcagccgccatggctctgctccgaggtgtgtttgtagttgctgctaagcgaacgccctttggagcttacggaggccttctgaaagacttcactgctactgacttgtctgaatttgctgccaaggctgccttgtctgctggcaaagtctcacctgaaacagttgacagtgtgattatgggcaatgtcctgcagagttcttcagatgctatatatttggcaaggcatgttggtttgcgtgtgggaatcccaaaggagaccccagctctcacgattaataggctctgtggttctggttttcagtccattgtgaatggatgtcaggaaatttgtgttaaagaagctgaagttgttttatgtggaggaaccgaaagcatgagccaagctccctactgtgtcagaaatgtgcgttttggaaccaagcttggatcagatatcaagctggaagattctttatgggtatcattaacagatcagcatgtccagctccccatggcaatgactgcagagaatcttgctgtaaaacacaaaataagcagagaagaatgtgacaaatatgccctgcagtcacagcagagatggaaagctgctaatgatgctggctactttaatgatgaaatggcaccaattgaagtgaagacaaagaaaggaaaacagacaatgcaggtagacgagcatgctcggccccaaaccaccctggaacagttacagaaacttcctccagtattcaagaaagatggaactgttactgcagggaatgcatcgggtgtagctgatggtgctggagctgttatcatagctagtgaagatgctgttaagaaacataacttcacaccactggcaagaattgtgggctactttgtatctggatgtgatccctctatcatgggtattggtcctgtccctgctatcagtggggcactgaagaaagcaggactgagtcttaaggacatggatttggtagaggtgaatgaagcttttgctccccagtacttggctgttgagaggagtttggatcttgacataagtaaaaccaatgtgaatggaggagccattgctttgggtcacccactgggaggatctggatcaagaattactgcacacctggttcacgaattaaggcgtcgaggtggaaaatatgccgttggatcagcttgcattggaggtggccaaggtattgctgtcatcattcagagcacagcctgaagagaccagtgagctcactgtgacccatccttactctacttgcgcgagcggtattcgcgatcggagggatactctaggaacagctactgacc

SEQ ID NO: 33846 - DNA, 1944 bp, Homo sapiens
cgagcggagctggcggccgcggccgcccgcgcgccaagttcctcagcccttggctcctgcccagtgtttagggtgttggcggagacaaaggggaagagtcatcgcctgtcggggctaggatatgatgggtgagaggtgtcaaaccaaattctctcggtttggaaacggagaaaatctaaaaatgaggatgtgaggaaagagtccgctctcaaggcgcgttgtggtctatccgagccccgtcccctgggctccctcgggctggggtgaggcgggcagcgctacgcgtggggtaggaccatcttacgctgggaccccgccaaggagccccaggaagtaggtgaaagggcaggggcgtggctctcggggcgccacccacgctcttgaaatctgggtgattgcgagcggccgctcagcgtcccccacaccacagacccgcgccgccgacgacccagcagccgccatggctctgctccgaggtgtgtttgtagttgctgctaagcgaacgccctttggagcttacggaggccttctgaaagacttcactgctactgacttgtctgaatttgctgccaaggctgccttgtctgctggcaaagtctcacctgaaacagttgacagtgtgattatgggcaatgtcctgcagagttcttcagatgctatatatttggcaaggcatgttggtttgcgtgtgggaatcccaaaggagaccccagctctcacgattaataggctctgtggttctggttttcagtccattgtgaatggatgtcaggaaatttgtgttaaagaagctgaagttgttttatgtggaggaaccgaaagcatgagccaagctccctactgtgtcagaaatgtgcgttttggaaccaagcttggatcagatatcaagctggaagattctttatgggtatcattaacagatcagcatgtccagctccccatggcaatgactgcagagaatcttgctgtaaaacacaaaataagcagagaagaatgtgacaaatatgccctgcagtcacagcagagatggaaagctgctaatgatgctggctactttaatgatgaaatggcaccaattgaagtgaagacaaagaaaggagttacagaaacttcctccagtattcaagaaagatggaactgttactgcagggaatgcatcgggtgtagctgatggtgctggagctgttatcatagctagtgaagatgctgttaagaaacataacttcacaccactggcaagaattgtgggctactttgtatctggatgtgatccctctatcatgggtattggtcctgtccctgctatcagtggggcactgaagaaagcaggactgagtcttaaggacatggatttggtagaggtgaatgaagcttttgctccccagtacttggctgttgagaggagtttggatcttgacataagtaaaaccaatgtgaatggaggagccattgctttgggtcacccactgggaggatctggatcaagaattactgcacacctggttcacgaattaaggcgtcgaggtggaaaatatgccgttggatcagcttgcattggaggtggccaaggtattgctgtcatcattcagagcacagcctgaagagaccagtgagctcactgtgacccatccttactctacttggccaggccacagtaaaacaagtgaccttcagagcagctgccacaactggccatgccctgccattgaaacagtgattaagtttgatcaagccatggtgacacaaaaatgcattgatcatgaataggagcccatgctagaagtacattctctcagatttgaaccagtgaaatatgatgtatttctgagctaaaactcaactatagaagacattaaaagaaatcgtattcttgccaagtaaccaccacttctgccttagataatatgattataaggaaatcaaataaatgttgccttaacttca

SEQ ID NO: 33847 - DNA, 1734 bp, Homo sapiens
cgagcggagctggcggccgcggccgcccgcgcgccaagttcctcagcccttggctcctgcccagtgtttagggtgttggcggagacaaaggggaagagtcatcgcctgtcggggctaggatatgatgggtgagaggtgtcaaaccaaattctctcggtttggaaacggagaaaatctaaaaatgaggatgtgaggaaagagtccgctctcaaggtgtgtttgtagttgctgctaagcgaacgccctttggagcttacggaggccttctgaaagacttcactgctactgacttgtctgaatttgctgccaaggctgccttgtctgctggcaaagtctcacctgaaacagttgacagtgtgattatgggcaatgtcctgcagagttcttcagatgctatatatttggcaaggcatgttggtttgcgtgtgggaatcccaaaggagaccccagctctcacgattaataggctctgtggttctggttttcagtccattgtgaatggatgtcaggaaatttgtgttaaagaagctgaagttgttttatgtggaggaaccgaaagcatgagccaagctccctactgtgtcagaaatgtgcgttttggaaccaagcttggatcagatatcaagctggaagattctttatgggtatcattaacagatcagcatgtccagctccccatggcaatgactgcagagaatcttgctgtaaaacacaaaataagcagagaagaatgtgacaaatatgccctgcagtcacagcagagatggaaagctgctaatgatgctggctactttaatgatgaaatggcaccaattgaagtgaagacaaagaaaggaaaacagacaatgcaggtagacgagcatgctcggccccaaaccaccctggaacagttacagaaacttcctccagtattcaagaaagatggaactgttactgcagggaatgcatcgggtgtagctgatggtgctggagctgttatcatagctagtgaagatgctgttaagaaacataacttcacaccactggcaagaattgtgggctactttgtatctggatgtgatccctctatcatgggtattggtcctgtccctgctatcagtggggcactgaagaaagcaggactgagtcttaaggacatggatttggtagaggtgaatgaagcttttgctccccagtacttggctgttgagaggagtttggatcttgacataagtaaaaccaatgtgaatggaggagccattgctttgggtcacccactgggaggatctggatcaagaattactgcacacctggttcacgaattaaggcgtcgaggtggaaaatatgccgttggatcagcttgcattggaggtggccaaggtattgctgtcatcattcagagcacagcctgaagagaccagtgagctcactgtgacccatccttactctacttggccaggccacagtaaaacaagtgaccttcagagcagctgccacaactggccatgccctgccattgaaacagtgattaagtttgatcaagccatggtgacacaaaaatgcattgatcatgaataggagcccatgctagaagtacattctctcagatttgaaccagtgaaatatgatgtatttctgagctaaaactcaactatagaagacattaaaagaaatcgtattcttgccaagtaaccaccacttctgccttagataatatgattataaggaaatcaaataaatgttgccttaacttca

SEQ ID NO: 33848 - DNA, 1649 bp, Homo sapiens
cgagcggagctggcggccgcggccgcccgcgcgccaagttcctcagcccttggctcctgcccagtgtttagggtgttggcggagacaaaggggaagagtcatcgcctgtcggggctaggatatgatgggtgtgtttgtagttgctgctaagcgaacgccctttggagcttacggaggccttctgaaagacttcactgctactgacttgtctgaatttgctgccaaggctgccttgtctgctggcaaagtctcacctgaaacagttgacagtgtgattatgggcaatgtcctgcagagttcttcagatgctatatatttggcaaggcatgttggtttgcgtgtgggaatcccaaaggagaccccagctctcacgattaataggctctgtggttctggttttcagtccattgtgaatggatgtcaggaaatttgtgttaaagaagctgaagttgttttatgtggaggaaccgaaagcatgagccaagctccctactgtgtcagaaatgtgcgttttggaaccaagcttggatcagatatcaagctggaagattctttatgggtatcattaacagatcagcatgtccagctccccatggcaatgactgcagagaatcttgctgtaaaacacaaaataagcagagaagaatgtgacaaatatgccctgcagtcacagcagagatggaaagctgctaatgatgctggctactttaatgatgaaatggcaccaattgaagtgaagacaaagaaaggaaaacagacaatgcaggtagacgagcatgctcggccccaaaccaccctggaacagttacagaaacttcctccagtattcaagaaagatggaactgttactgcagggaatgcatcgggtgtagctgatggtgctggagctgttatcatagctagtgaagatgctgttaagaaacataacttcacaccactggcaagaattgtgggctactttgtatctggatgtgatccctctatcatgggtattggtcctgtccctgctatcagtggggcactgaagaaagcaggactgagtcttaaggacatggatttggtagaggtgaatgaagcttttgctccccagtacttggctgttgagaggagtttggatcttgacataagtaaaaccaatgtgaatggaggagccattgctttgggtcacccactgggaggatctggatcaagaattactgcacacctggttcacgaattaaggcgtcgaggtggaaaatatgccgttggatcagcttgcattggaggtggccaaggtattgctgtcatcattcagagcacagcctgaagagaccagtgagctcactgtgacccatccttactctacttggccaggccacagtaaaacaagtgaccttcagagcagctgccacaactggccatgccctgccattgaaacagtgattaagtttgatcaagccatggtgacacaaaaatgcattgatcatgaataggagcccatgctagaagtacattctctcagatttgaaccagtgaaatatgatgtatttctgagctaaaactcaactatagaagacattaaaagaaatcgtattcttgccaagtaaccaccacttctgccttagataatatgattataaggaaatcaaataaatgttgccttaacttca

SEQ ID NO: 33849 - DNA, 1942 bp, Homo sapiens
cgagcggagctggcggccgcggccgcccgcgcgccaagttcctcagcccttggctcctgcccagtgtttagggtgttggcggagacaaaggggaagagtcatcgcctgtcggggctaggatatgatgggtgagaggtgtcaaaccaaattctctcggtttggaaacggagaaaatctaaaaatgaggatgtgaggaaagagtccgctctcaaggcgcgttgtggtctatccgagccccgtcccctgggctccctcgggctggggtgaggcgggcagcgctacgcgtggggtaggaccatcttacgctgggaccccgccaaggagccccaggaagtaggtgaaagggcaggggcgtggctctcggggcgccacccacgctcttgaaatctgggtgattgcgagcggccgctcagcgtcccccacaccacagacccgcgccgccgacgacccagcagccgccatggctctgctccgaggtgtgtttgtagttgctgctaagcgaacgccctttggagcttacggaggccttctgaaagacttcactgctactgacttgtctgaatttgctgccaaggctgccttgtctgctggcaaagtctcacctgaaacagttgacagtgtgattatgggcaatgtcctgcagagttcttcagatgctatatatttggcaaggcatgttggtttgcgtgtgggaatcccaaaggagaccccagctctcacgattaataggctctgtggttctggttttcagtccattgtgaatggatgtcaggaaatttgtgttaaagaagctgaagttgttttatgtggaggaaccgaaagcatgagccaagctccctactgtgtcagaaatgtgcgttttggaaccaagcttggatcagatatcaagctggaagattctttatgggtatcattaacagatcagcatgtccagctccccatggcaatgactgcagagaatcttgctgtaaaacacaaaatactaatgatgctggctactttaatgatgaaatggcaccaattgaagtgaagacaaagaaaggaaaacagacaatgcaggtagacgagcatgctcggccccaaaccaccctggaacagttacagaaacttcctccagtattcaagaaagatggaactgttactgcagggaatgcatcgggtgtagctgatggtgctggagctgttatcatagctagtgaagatgctgttaagaaacataacttcacaccactggcaagaattgtgggctactttgtatctggatgtgatccctctatcatgggtattggtcctgtccctgctatcagtggggcactgaagaaagcaggactgagtcttaaggacatggatttggtagaggtgaatgaagcttttgctccccagtacttggctgttgagaggagtttggatcttgacataagtaaaaccaatgtgaatggaggagccattgctttgggtcacccactgggaggatctggatcaagaattactgcacacctggttcacgaattaaggcgtcgaggtggaaaatatgccgttggatcagcttgcattggaggtggccaaggtattgctgtcatcattcagagcacagcctgaagagaccagtgagctcactgtgacccatccttactctacttggccaggccacagtaaaacaagtgaccttcagagcagctgccacaactggccatgccctgccattgaaacagtgattaagtttgatcaagccatggtgacacaaaaatgcattgatcatgaataggagcccatgctagaagtacattctctcagatttgaaccagtgaaatatgatgtatttctgagctaaaactcaactatagaagacattaaaagaaatcgtattcttgccaagtaaccaccacttctgccttagataatatgattataaggaaatcaaataaatgttgccttaacttca

SEQ ID NO: 33850 - DNA, 1784 bp, Homo sapiens
cgagcggagctggcggccgcggccgcccgcgcgccaagttcctcagcccttggctcctgcccagtgtttagggtgttggcggagacaaaggggaagagtcatcgcctgtcggggctaggatatgatgggtgagaggtgtcaaaccaaattctctcggtttggaaacggagaaaatctaaaaatgaggatgtgaggaaagagtccgctctcaaggcgcgttgtggtctatccgagccccgtcccctgggctccctcgggctggggtgtgtttgtagttgctgctaagcgaacgccctttggagcttacggaggccttctgaaagacttcactgctactgacttgtctgaatttgctgccaaggctgccttgtctgctggcaaagtctcacctgaaacagttgacagtgtgattatgggcaatgtcctgcagagttcttcagatgctatatatttggcaaggcatgttggtttgcgtgtgggaatcccaaaggagaccccagctctcacgattaataggctctgtggttctggttttcagtccattgtgaatggatgtcaggaaatttgtgttaaagaagctgaagttgttttatgtggaggaaccgaaagcatgagccaagctccctactgtgtcagaaatgtgcgttttggaaccaagcttggatcagatatcaagctggaagattctttatgggtatcattaacagatcagcatgtccagctccccatggcaatgactgcagagaatcttgctgtaaaacacaaaataagcagagaagaatgtgacaaatatgccctgcagtcacagcagagatggaaagctgctaatgatgctggctactttaatgatgaaatggcaccaattgaagtgaagacaaagaaaggaaaacagacaatgcaggtagacgagcatgctcggccccaaaccaccctggaacagttacagaaacttcctccagtattcaagaaagatggaactgttactgcagggaatgcatcgggtgtagctgatggtgctggagctgttatcatagctagtgaagatgctgttaagaaacataacttcacaccactggcaagaattgtgggctactttgtatctggatgtgatccctctatcatgggtattggtcctgtccctgctatcagtggggcactgaagaaagcaggactgagtcttaaggacatggatttggtagaggtgaatgaagcttttgctccccagtacttggctgttgagaggagtttggatcttgacataagtaaaaccaatgtgaatggaggagccattgctttgggtcacccactgggaggatctggatcaagaattactgcacacctggttcacgaattaaggcgtcgaggtggaaaatatgccgttggatcagcttgcattggaggtggccaaggtattgctgtcatcattcagagcacagcctgaagagaccagtgagctcactgtgacccatccttactctacttggccaggccacagtaaaacaagtgaccttcagagcagctgccacaactggccatgccctgccattgaaacagtgattaagtttgatcaagccatggtgacacaaaaatgcattgatcatgaataggagcccatgctagaagtacattctctcagatttgaaccagtgaaatatgatgtatttctgagctaaaactcaactatagaagacattaaaagaaatcgtattcttgccaagtaaccaccacttctgccttagataatatgattataaggaaatcaaataaatgttgccttaacttca

SEQ ID NO: 33851 - DNA, 1996 bp, Homo sapiens
  misc_feature (286)..(286): n is a, c, g, or t
tctgctcttggacacaggcatgcaactcaggtacaatataagtcagcttgaggagtggcttcggggaagaaaccttcaccagagtggagcagttcagaccatggaacctctgatccaagcagcccagctcctgcaattaaagaagaaaacccaggaggacgcagaggctatctgctccctgtgtacctccctcagcacccagcagattgtcaaaattttaaacctttatactcccctgaatgaatttgaagaacgggtaacagtggcctttatacgaacaatccanggcacaactacaagagcggaatgaccctcagcaactgctattagatgccaagcacatgtttcctgttttgtttccatttaatccatcttctctaaccatggactcaatccacatcccagcgtgtctcaatctggaattcctcaatgaagtctgaagatgcatgtttccagcattagtttgattcccaatgtgtgtttgtagttgctgctaagcgaacgccctttggagcttacggaggccttctgaaagacttcactgctactgacttgtctgaatttgctgccaaggctgccttgtctgctggcaaagtctcacctgaaacagttgacagtgtgattatgggcaatgtcctgcagagttcttcagatgctatatatttggcaaggcatgttggtttgcgtgtgggaatcccaaaggagaccccagctctcacgattaataggctctgtggttctggttttcagtccattgtgaatggatgtcaggaaatttgtgttaaagaagctgaagttgttttatgtggaggaaccgaaagcatgagccaagctccctactgtgtcagaaatgtgcgttttggaaccaagcttggatcagatatcaagctggaagattctttatgggtatcattaacagatcagcatgtccagctccccatggcaatgactgcagagaatcttgctgtaaaacacaaaataagcagagaagaatgtgacaaatatgccctgcagtcacagcagagatggaaagctgctaatgatgctggctactttaatgatgaaatggcaccaattgaagtgaagacaaagaaaggaaaacagacaatgcaggtagacgagcatgctcggccccaaaccaccctggaacagttacagaaacttcctccagtattcaagaaagatggaactgttactgcagggaatgcatcgggtgtagctgatggtgctggagctgttatcatagctagtgaagatgctgttaagaaacataacttcacaccactggcaagaattgtgggctactttgtatctggatgtgatccctctatcatgggtattggtcctgtccctgctatcagtggggcactgaagaaagcaggactgagtcttaaggacatggatttggtagaggtgaatgaagcttttgctccccagtacttggctgttgagaggagtttggatcttgacataagtaaaaccaatgtgaatggaggagccattgctttgggtcacccactgggaggatctggatcaagaattactgcacacctggttcacgaattaaggcgtcgaggtggaaaatatgccgttggatcagcttgcattggaggtggccaaggtattgctgtcatcattcagagcacagcctgaagagaccagtgagctcactgtgacccatccttactctacttggccaggccacagtaaaacaagtgaccttcagagcagctgccacaactggccatgccctgccattgaaacagtgattaagtttgatcaagccatggtgacacaaaaatgcattgatcatgaataggagcccatgctagaagtacattctctcagatttgaaccagtgaaatatgatgtatttctgagctaaaactcaactatagaagacattaaaagaaatcgtattcttgccaagtaaccaccacttctgccttagataatatgattataaggaaatcaaataaatgttgccttaacttca

SEQ ID NO: 33852 - DNA, 1588 bp, Homo sapiens
ccgggagtgaatcggcgaggacagacccgcgctgcgacgaccagcagccgcatggctctgctccgaggtgtgtttgtagttgctgctaagcgaacgccctttggagcttacggaggccttctgaaagacttcactgctactgacttgtctgaatttgctgccaaggctgccttgtctgctggcaaagtctcacctgaaacagttgacagtgtgattatgggcaatgtcctgcagagttcttcagatgctatatatttggcaaggcatgttggtttgcgtgtgggaatcccaaaggagaccccagctctcacgattaataggctctgtggttctggttttcagtccattgtgaatggatgtcaggaaatttgtgttaaagaagctgaagttgttttatgtggaggaaccgaaagcatgagccaagctccctactgtgtcagaaatgtgcgttttggaaccaagcttggatcagatatcaagctggaagattctttatgggtatcattaacagatcagcatgtccagctccccatggcaatgactgcagagaatcttgctgtaaaacacaaaataagcagagaagaatgtgacaaatatgccctgcagtcacagcagagatggaaagctgctaatgatgctggctactttaatgatgaaatggcaccaattgaagtgaagacaaagaaaggaaaacagacaatgcaggtagacgagcatgctcggccccaaaccaccctggaacagttacagaaacttcctccagtattcaagaaagatggaactgttactgcagggaatgcatcgggtgtagctgatggtgctggagctgttatcatagctagtgaagatgctgttaagaaacataacttcacaccactggcaagaattgtgggctactttgtatctggatgtgatccctctatcatgggtattggtcctgtccctgctatcagtggggcactgaagaaagcaggactgagtcttaaggacatggatttggtagaggtgaatgaagcttttgctccccagtacttggctgttgagaggagtttggatcttgacataagtaaaaccaatgtgaatggaggagccattgctttgggtcacccactgggaggatctggatcaagaattactgcacacctggttcacgaattaaggcgtcgaggtggaaaatatgccgttggatcagcttgcattggaggtggccaaggtattgctgtcatcattcagagcacagcctgaagagaccagtgagctcactgtgacccatccttactctacttggccaggccacagtaaaacaagtgaccttcagagcagctgccacaactggccatgccctgccattgaaacagtgattaagtttgatcaagccatggtgacacaaaaatgcattgatcatgaataggagcccatgctagaagtacattctctcagatttgaaccagtgaaatatgatgtatttctgagctaaaactcaactatagaagacattaaaagaaatcgtattcttgccaagtaaccaccacttctgccttagataatatgattataaggaaatcaaataaatgttgccttaacttca

SEQ ID NO: 33853 - DNA, 1542 bp, Homo sapiens
cgagcggagctggcggccgcggccgcccgcgcgccaagttcctcagcccttggctcctgcccagtgtttagggtgttggcggagacaaaggggaagagtcatcgcctgtcggggctaggatatgatgggtgagaggtgtcaaaccaaattctctcggtttggaaacggagaaaatctaaaaatgaggatgtgaggaaagagtccgctctcaaggcgcgttgtggtctatccgagccccgtcccctgggctccctcgggctggggtgaggcgggcagcgctacgcgtggggtaggaccatcttacgctgggaccccgccaaggagccccaggaagtaggtgaaagggcaggggcgtggctctcggggcgccacccacgctcttgaaatctgggtgattgcgagcggccgctcagcgtcccccacaccacagacccgcgccgccgacgacccagcagccgccatggctctgctccgaggtgtgtttgtagttgctgctaagcgaacgccctttggagcttacggaggccttctgaaagacttcactgctactgacttgtctgaatttgctgccaaggctgccttgtctgctggcaaagtctcacctgaaacagttgacagtgtgattatgggcaatgtcctgcagagttcttcagatgctatatatttggcaaggcatgttggtttgcgtgtgggaatcccaaaggagaccccagctctcacgattaataggctctgtggttctggttttcagtccattgtgaatggatgtcaggaaatttgtgttaaagaagctgaagttgttttatgtggaggaaccgaaagcatgagccaagctccctactgtgtcagaaatgtgcgttttggaaccaagcttggatcagatatcaagctggaagattctttatgggtatcattaacagatcagcatgtccagctccccatggcaatgactgcagagaatcttgctgtaaaacacaaaataagcagagaagaatgtgacaaatatgccctgcagtcacagcagagatggaaagctgctaatgatgctggctactttaatgatgaaatggcaccaattgaagtgaagacaaagaaaggaaaacagacaatgcaggtagacgagcatgctcggccccaaaccaccctggaacagttacagaaacttcctccagtattcaagaaagatggaactgttactgcagggaatgcatcgggtgtagctggtggtgctggaactggtactcataagctagttgaagaattgtggtacgaaacctacatttcaccacatgggcaagaattgggggctcgctatggatcctggaggtgatcccctctaacaggaggatgggccagtcccggcaacagggggcaatgagacagcgaacggtttatgacacgcattgcaagtgcagagcatgacccaaaaggggtgcagagaggtcatcgtcataaacacaggcggagctggtaggaccaggagaggcaaacagcaggtcgacacacggagaacaaaagagaggtggataacgaacacgcact

SEQ ID NO: 33854 - DNA, 1868 bp, Homo sapiens
cgagcggagctggcggccgcggccgcccgcgcgccaagttcctcagcccttggctcctgcccagtgtttagggtgttggcggagacaaaggggaagagtcatcgcctgtcggggctaggatatgatgggtgagaggtgtcaaaccaaattctctcggtttggaaacggagaaaatctaaaaatgaggatgtgaggaaagagtccgctctcaaggcgcgttgtggtctatccgagccccgtcccctgggctccctcgggctggggtgaggcgggcagcgctacgcgtggggtaggaccatcttacgctgggaccccgccaaggagccccaggaagtaggtgaaagggcaggggcgtggctctcggggcgccacccacgctcttgaaatctgggtgattgcgagcggccgctcagcgtcccccacaccacagacccgcgccgccgacgacccagcagccgccatggctctgctccgaggtgtgtttgtagttgctgctaagcgaacgccctttggagcttacggaggccttctgaaagacttcactgctactgacttgtctgaatttgctgccaaggctgccttgtctgctggcaaagtctcacctgaaacagttgacagtgtgattatgggcaatgtcctgcaggaaatttgtgttaaagaagctgaagttgttttatgtggaggaaccgaaagcatgagccaagctccctactgtgtcagaaatgtgcgttttggaaccaagcttggatcagatatcaagctggaagattctttatgggtatcattaacagatcagcatgtccagctccccatggcaatgactgcagagaatcttgctgtaaaacacaaaataagcagagaagaatgtgacaaatatgccctgcagtcacagcagagatggaaagctgctaatgatgctggctactttaatgatgaaatggcaccaattgaagtgaagacaaagaaaggaaaacagacaatgcaggtagacgagcatgctcggccccaaaccaccctggaacagttacagaaacttcctccagtattcaagaaagatggaactgttactgcagggaatgcatcgggtgtagctgatggtgctggagctgttatcatagctagtgaagatgctgttaagaaacataacttcacaccactggcaagaattgtgggctactttgtatctggatgtgatccctctatcatgggtattggtcctgtccctgctatcagtggggcactgaagaaagcaggactgagtcttaaggacatggatttggtagaggtgaatgaagcttttgctccccagtacttggctgttgagaggagtttggatcttgacataagtaaaaccaatgtgaatggaggagccattgctttgggtcacccactgggaggatctggatcaagaattactgcacacctggttcacgaattaaggcgtcgaggtggaaaatatgccgttggatcagcttgcattggaggtggccaaggtattgctgtcatcattcagagcacagcctgaagagaccagtgagctcactgtgacccatccttactctacttggccaggccacagtaaaacaagtgaccttcagagcagctgccacaactggccatgccctgccattgaaacagtgattaagtttgatcaagccatggtgacacaaaaatgcattgatcatgaataggagcccatgctagaagtacattctctcagatttgaaccagtgaaatatgatgtatttctgagctaaaactcaactatagaagacattaaaagaaatcgtattcttgccaagtaaccaccacttctgccttagataatatgattataaggaaatcaaataaatgttgccttaacttca

SEQ ID NO: 33855 - DNA, 1218 bp, Homo sapiens
ggacctggtacggtcccgcgtttatgggatgaggaaccgaaagcatgagccaagctccctactgtgtcagaaatgtgcgttttggaaccaagcttggatcagatatcaagctggaagattctttatgggtatcattaacagatcagcatgtccagctccccatggcaatgactgcagagaatcttgctgtaaaacacaaaataagcagagaagaatgtgacaaatatgccctgcagtcacagcagagatggaaagctgctaatgatgctggctactttaatgatgaaatggcaccaattgaagtgaagacaaagaaaggaaaacagacaatgcaggtagacgagcatgctcggccccaaaccaccctggaacagttacagaaacttcctccagtattcaagaaagatggaactgttactgcagggaatgcatcgggtgtagctgatggtgctggagctgttatcatagctagtgaagatgctgttaagaaacataacttcacaccactggcaagaattgtgggctactttgtatctggatgtgatccctctatcatgggtattggtcctgtccctgctatcagtggggcactgaagaaagcaggactgagtcttaaggacatggatttggtagaggtgaatgaagcttttgctccccagtacttggctgttgagaggagtttggatcttgacataagtaaaaccaatgtgaatggaggagccattgctttgggtcacccactgggaggatctggatcaagaattactgcacacctggttcacgaattaaggcgtcgaggtggaaaatatgccgttggatcagcttgcattggaggtggccaaggtattgctgtcatcattcagagcacagcctgaagagaccagtgagctcactgtgacccatccttactctacttggccaggccacagtaaaacaagtgaccttcagagcagctgccacaactggccatgccctgccattgaaacagtgattaagtttgatcaagccatggtgacacaaaaatgcattgatcatgaataggagcccatgctagaagtacattctctcagatttgaaccagtgaaatatgatgtatttctgagctaaaactcaactatagaagacattaaaagaaatcgtattcttgccaagtaaccaccacttctgccttagataatatgattataaggaaatcaaataaatgttgccttaacttca

SEQ ID NO: 33856 - DNA, 926 bp, Homo sapiens
cagaaacttcctccagtattcaagaaagatggaactgttactgcagggaatgcatcgggtgtagctgatggtgctggagctgttacagaaacttcctccagtattcaagaaagatggaactgttactgcagggaatgcatcgggtgtagctgatggtgctggagctgttatcatagctagtgaagatgctgttaagaaacataacttcacaccactggcaagaattgtgggctactttgtatctggatgtgatccctctatcatgggtattggtcctgtccctgctatcagtggggcactgaagaaagcaggactgagtcttaaggacatggatttggtagaggtgaatgaagcttttgctccccagtacttggctgttgagaggagtttggatcttgacataagtaaaaccaatgtgaatggaggagccattgctttgggtcacccactgggaggatctggatcaagaattactgcacacctggttcacgaattaaggcgtcgaggtggaaaatatgccgttggatcagcttgcattggaggtggccaaggtattgctgtcatcattcagagcacagcctgaagagaccagtgagctcactgtgacccatccttactctacttggccaggccacagtaaaacaagtgaccttcagagcagctgccacaactggccatgccctgccattgaaacagtgattaagtttgatcaagccatggtgacacaaaaatgcattgatcatgaataggagcccatgctagaagtacattctctcagatttgaaccagtgaaatatgatgtatttctgagctaaaactcaactatagaagacattaaaagaaatcgtattcttgccaagtaaccaccacttctgccttagataatatgattataaggaaatcaaataaatgttgccttaacttca

SEQ ID NO: 33857 - DNA, 994 bp, Homo sapiens
cgagcggagctggcggccgcggccgcccgcgcgccaagttcctcagcccttggctcctgcccagtgtttagggtgttggcggagacaaaggggaagagtcatcgcctgtcggggctaggatatgatgggtgagaggtgtcaaaccaaattctctcggtttggaaacggagaaaatctaaaaatgaggatgtgaggaaagagtccgctctcaaggcgcgttgtggtctatccgagccccgtcccctgggctccctcgggctggggtgaggcgggcagcgctacgcgtggggtaggaccatcttacgctgggaccccgccaaggagccccaggaagtaggtgaaagggcaggggcgtggctctcggggcgccacccacgctcttgaaatctgggtgattgcgagcggccgctcagcgtcccccacaccacagacccgcgccgccgacgacccagcagccgccatggctctgctccgaggtgtgtttgtagttgctgctaagcgaacgccctttggagcttacggaggccttctgaaagacttcactgctactgacttgtctgaatttgctgccaaggctgccttgtctgctggcaaagtctcacctgaaacagttgacagtgtgattatgggcaatgtcctgcagagttcttcagatgctatatatttggcaaggcatgttggtttgcgtgtgggaatcccaaaggagaccccagctctcacgattaataggctctgtggttctggttttcagtccattgtgaatggatgtcaggaaatttgtgttaaagaagctgaagttgttttatgtggaggaaccgaaagcatgagccaagctccctactgtgtcagaaatgtgcgttttggaaccaagcttggatcagatatcaagggatttttaatggtaattaagttggataagctatggtcaagattctcattgtcaatgaactggcgtggttttgtttgcaccacattcagctgagaggtgtggccc

SEQ ID NO: 33858 - DNA, 913 bp, Homo sapiens
cgagcggagctggcggccgcggccgcccgcgcgccaagttcctcagcccttggctcctgcccagtgtttagggtgttggcggagacaaaggggaagagtcatcgcctgtcggggctaggatatgatgggtgagaggtgtcaaaccaaattctctcggtttggaaacggagaaaatctaaaaatgaggatgtgaggaaagagtccgctctcaaggcgcgttgtggtctatccgagccccgtcccctgggctccctcgggctggggtgaggcgggcagcgctacgcgtggggtaggaccatcttacgctgggaccccgccaaggagccccaggaagtaggtgaaagggcaggggcgtggctctcggggcgccacccacgctcttgaaatctgggtgattgcgagcggccgctcagcgtcccccacaccacagacccgcgccgccgacgacccagcagccgccatggctctgctccgaggtgtgtttgtagttgctgctaagcgaacgccctttggagcttacggaggccttctgaaagacttcactgctactgacttgtctgaatttgctgccaaggctgccttgtctgctggcaaagtctcacctgaaacagttgacagtgtgattatgggcaatgtcctgcagagttcttcagatgctatatatttggcaaggcatgttggtttgcgtgtgggaatcccaaaggagaccccagctctcacgattaataggctctgtggttctggttttcagtccattgtgaatggatgtcaggaaatttgtgttaaagaagctgaagttgttttatgtggaggaaccgaaagcatgagccaagctccctactgtgtcattacagacaacatgccagctcccatggaatgacggaaagaaatctgtgtaaacacttaggggggg

SEQ ID NO: 33859 - DNA, 904 bp, Homo sapiens
  misc_feature (286)..(286): n is a, c, g, or t
tctgctcttggacacaggcatgcaactcaggtacaatataagtcagcttgaggagtggcttcggggaagaaaccttcaccagagtggagcagttcagaccatggaacctctgatccaagcagcccagctcctgcaattaaagaagaaaacccaggaggacgcagaggctatctgctccctgtgtacctccctcagcacccagcagattgtcaaaattttaaacctttatactcccctgaatgaatttgaagaacgggtaacagtggcctttatacgaacaatccanggcacaactacaagagcggaatgaccctcagcaactgctattagatgccaagcacatgtttcctgttttgtttccatttaatccatcttctctaaccatggactcaatccacatcccagcgtgtctcaatctggaattcctcaatgaagtctgaagatgcatgtttccagcattagtttgattcccaatgtgagcaagaaggaagtatatacagtaaagtaaattcaaggatctgttaaatctggtaaaagtagatcaaatcagagattgacagcctgtggagggtgctgaactatacagaattagacacaactatgtcattattttttgtacctactgctcagaataaaaacacttgaaatatggaagattttaagtttgatttcagtccaacacatatacataatttatagacaccaagcagtccccatagacatataaaaggtgtcaattctataaaacgaagctgcctagttttgatctttgcatagaactagagaatgtccaaattaaaataccaaatatatataagtcacataaattgccttcaaagggctttaacaaataatggtactaataaccatgataatggcatatactgacatttcccaaagtttg

SEQ ID NO: 33860 - DNA, 470 bp, Homo sapiens
  misc_feature (404)..(404): n is a, c, g, or t
  misc_feature (418)..(418): n is a, c, g, or t
  misc_feature (456)..(456): n is a, c, g, or t
atgaccacctccttcacctccaccatcacttcttccaccatcatcattgtcaccatcatcaccactacccacctccaccaccaccaccacctctcccatcaccaccacgttctctgtggttagtcacttagtgactttagataagtttttccaattttatgggtcttaatttcctcagttttaaaataagaagggggggttgagagatttgagggctgatcaacgaaaaggataggaccataaaaagcagtgacatacaagctttcattgaggcaggcacttgggacagggtttacataaggaggcgggaaggccccttccccaggcatggaggaacaggccatagggcttggccagttgaggggaggggggaccattcccagtggggaggtcaggggggaaanttccccgggggggnaggaggggagggttttagggggccaggaggtttttttnggtttcttgggggt

SEQ ID NO: 33861 - DNA, 400 bp, Homo sapiens
aagagtaactttgatttgttttaaggaatatatcaaatatatgttagcagaatttaaagtactgttttttagttttagcatactgcaagcttggctacttttcctctgatcttttatgtatgttaagaaataactactaagtgctttaaattgctatgctacatttctagttgttttatttaaacactgacttctcctattaatatttttaaggctaaggattcagtatttaaataaaaagtatttcagtagaactaggactgaaagattttctgttaaaattatctttatgtctttaacaacaacaaaacactgcatgtttctaattgtatgtcattatctcttagcttcatttcttttatgaaataaaattattatattttccagtttaaaaaaaaaa

SEQ ID NO: 33862 - DNA, 314 bp, Homo sapiens
cctgttattcagttactgatcctgaaagttttagaaattattaggtaaatatcacagtaaaatatttaaaagtttaggtcagaggaaacatatcgcacaaactatctgctattgtataactatttttatttaacatagtgggaggattctgacaagaatgttggtcaagtcagatgtctttatttttaataatgttttataatatgaaaaacaagtctttctagggacactatttttatttttattaacttttttattttttatttttttgaggcagggtctcactcccatttcccagactggagtgcagtggc

SEQ ID NO: 33863 - DNA, 1348 bp, Homo sapiens
caataatataagattcctacatcagtttgcagtcctgactttacagtttgaaataagtagcaaaagaaaattatgataatcaagtaatttattattttgtaaaatagtataaaggaataaggaaattttaagtattgtttaggggccaaatttgaactcagctaatatgatttaagcgctctattaattgccctgatttttaaagaggtgcatgtaattttgaaatagcacacattttcatttgtaatcactctggataaatttgtatttttcagtgttcattgaacaggcttattgactctggtaaacttattttattgatgttttcatatggaaaataataagtggaatatgatacaattgttattttcagaacatatttctttagggctatttaatataacctttttaacgagcaaaaactttccatttgagagaaaaaattcttcctgctctgtgggaaaatatttgctgagattttgtatagaataagagacatgtatgtaacatatatgtatattcagcacaagtctactgcaattatgtacacattttggcaggaagaggggattttgtttagtctttgtttatgagttctagagtttcctgtatctagtgttaagttgtaaggaaaaactaaacatgccatttaaaggtaaacttggtaactatttatagagcatacaccaatgattatttctcacagttttcatgatcatttgtttattatttacttggattagactcattaaaaggtataatgctggtcacaattagaatgctaatatttggggaaactatgcagaaaatattttaaaatattaaaagagtgctggcttctattgttgatttatttttggatttaaaaacaaattagggctgggcccattagctcacacctgtaatcccagcactttgggaggctgagatgtgagaattgcttgagcccaggagtttgagaccagcctgggcaatatggtgagactccatctccatacaaaattaaaaaaaaaataattagccagatgtggtggtgtgcacttgtagtcctagctacttgggaggctgaggtgggaggatcgctggagcccaggacatcaaggttgcaaggagctatgttcattccactgcactccagcctgggctacagagtgagacctgtctaaaataaataaataaataaacaaactagctcatttacaatgtaaagcacttaatatcaaatgattatttggtgtactagaaaagaaacagcatataataatgtataatagtttcttaacaagtggggctaaaatcattttgtagtaatttttcacattgatattaaacttcatgagtttctttt

SEQ ID NO: 33864 - DNA, 423 bp, Homo sapiens
gaggtgggtagatcacgaggtcaggagttcaagaccagcctggccaagatggtgaaacctcatctgtactaaaaatacaaaaattagccaggcgtagtggcaggcacctgtaatcccagctactcaggaggctgaggcagagaattgcttgaacctgggaggcagaggttgcagtgagctgagatgtacccctgcactctagcctgggcgacagagtgagacagtgtctcaaataaataaataaataaataaaaataagattcccttgaactaacaacgtaagaattatttttaaaagaaactttttaatgtaaggttttttaaaaaaattattcgaataagaaattttactatatgtcttactgttattgttacttagaagtatattaaagaattaaaacattttttaaaagtgaacctgcc

SEQ ID NO: 33865 - DNA, 3216 bp, Homo sapiens
caataatataagattcctacatcagtttgcagtcctgactttacagtttgaaataagtagcaaaagaaaattatgataatcaagtaatttattattttgtaaaatagtataaaggaataaggaaattttaagtattgtttaggggccaaatttgaactcagctaatatgatttaagcgctctattaattgccctgatttttaaagaggtgcatgtaattttgaaatagcacacattttcatttgtaatcactctggataaatttgtatttttcagtgttcattgaacaggcttattgactctggtaaacttattttattgatgttttcatatggaaaataataagtggaatatgatacaattgttattttcagaacatatttctttagggctatttaatataacctttttaacgagcaaaaactttccatttgagagaaaaaattcttcctgctctgtgggaaaatatttgctgagattttgtatagaataagagacatgtatgtaacatatatgtatattcagcacaagtctactgcaattatgtacacattttggcaggaagaggggattttgtttagtctttgtttatgagttctagagtttcctgtatctagtgttaagttgtaaggaaaaactaaacatgccatttaaaggtaaacttggtaactatttatagagcatacaccaatgattatttctcacagttttcatgatcatttgtttattatttacttggattagactcattaaaaggtataatgctggtcacaattagaatgctaatatttggggaaactatgcagaaaatattttaaaatattaaaagagtgctggcttctattgttgatttatttttggatttaaaaacaaattagggctgggcccattagctcacacctgtaatcccagcactttgggaggctgagatgtgagaattgcttgagcccaggagtttgagaccagcctgggcaatatggtgagactccatctccatacaaaattaaaaaaaaaataattagccagatgtggtggtgtgcacttgtagtcctagctacttgggaggctgaggtgggaggatcgctggagcccaggacatcaaggttgcaaggagctatgttcattccactgcactccagcctgggctacagagtgagacctgtctaaaataaataaataaataaacaaactagctcatttacaatgtaaagcacttaatatcaaatgattatttggtgtactagaaaagaaacagcatataataatgtataatagtttcttaacaagtggggctaaaatcattttgtagtaatttttcacattgatattaaacttcatgagtttcttttagtcattattattattattattattatttgagatggaatctcgctctgtcgcccaggctggagtgcagtggcgcaatcttggctcactgaaagctctgcctcctgggttcacgccattcttctgcctcagcctcctgagtagctgggactgcgggtgcccaccaccacgcccggctaattttttgtatttttagtagagatggggtttcaccgtattggccaggatggtctcgatctcctgacctcgtgatctgtctgccttggcctccaaaagtgctgggaccgtgcccagccatcattattattttttaaaaagaaaactccccctacccccagtataccatttgtatctcaaaattttactttattgatttttaagagtaatttctacttttatcttttaaataaaacattttagagtatttttgaagacttaaaaagcttaaaatttagtgtttttggaaatgtataaaattttcttgaagtatgtatagttttccaaattactttactgacctgttaactcactgtacttgttttttacttattttttcctgacctcttaacaaggtgagtccatttaatcatctgtggtataaaatgcttctctagtcacctgttctcattaaacagttgtaagtaagttttaaaagccattattttaattactaaaagttctcaagtgtgtagtattatctgagtattttaattgaaaaattaatcaggcttttaaaaattacttttttattgtattaggtggcttttaaattcagattctttatattgcttgatttttcctgggagtcccagttttatgtgaatttgtagctgatagtaggttttacttgtgtaccccatctgcactttgatgttgtgtagatcgttttgtgagttatttgaaccgtgtaactcagagaatagtatttcctcatacataaagtgacctcacttttaatcagctcctttatagtatgttgaaaatcactgcgtgtaatgagaggtattgagagtttcttgcacacatgagtgtaaaaggttgagaactagattatacaaagtagtaagtcacagtgcatggcaactttctacaggttggattataagacttatgtggaataggagaattatattgggaaaaaattattttctctaacttgaagactccagagacacttttcttagtcatgaccagtaatatttttcatatattttgggaagaaataagctcctcactattacccaccagttagtgatttatttatttatgtattttagagacagggcctccttctgtcacccagtttggggtgcagtggtgtaatcatagcttactgcagcatcaaactcctgggctcaagtgttcctcctgcctcagcctcccaagtagctagaacctcagccccatgccaccacactcagctaattttaaattttactaatttcatttaatttttgtggagatgggggtcttgctgtgttgtttaggctggtcctgaactcctggcctcaagcgatccttctgccttggcctctcagtaaattatatagaagagcacttctgtataatttactcagtttcttcatcacatatttccaactgttgccctaaataggtttaaaaatgtgatcatgttattagaaaatcctttccattgaatttcagggatgctgaatttcagggagctaaattgttgacccttgcctgtagttgttattggttcagaagtaaattttattgatgctacaagtaaaaaattagatctgacttagtaaactcaaaagttttacaaaactgtattttactatgtagatgtatttctttaaaataggtatggatggatatttttatgaataaataatattgcatt

SEQ ID NO: 33866 - DNA, 3996 bp, Homo sapiens
caataatataagattcctacatcagtttgcagtcctgactttacagtttgaaataagtagcaaaagaaaattatgataatcaagtaatttattattttgtaaaatagtataaaggaataaggaaattttaagtattgtttaggggccaaatttgaactcagctaatatgatttaagcgctctattaattgccctgatttttaaagaggtgcatgtaattttgaaatagcacacattttcatttgtaatcactctggataaatttgtatttttcagtgttcattgaacaggcttattgactctggtaaacttattttattgatgttttcatatggaaaataataagtggaatatgatacaattgttattttcagaacatatttctttagggctatttaatataacctttttaacgagcaaaaactttccatttgagagaaaaaattcttcctgctctgtgggaaaatatttgctgagattttgtatagaataagagacatgtatgtaacatatatgtatattcagcacaagtctactgcaattatgtacacattttggcaggaagaggggattttgtttagtctttgtttatgagttctagagtttcctgtatctagtgttaagttgtaaggaaaaactaaacatgccatttaaaggtaaacttggtaactatttatagagcatacaccaatgattatttctcacagttttcatgatcatttgtttattatttacttggattagactcattaaaaggtataatgctggtcacaattagaatgctaatatttggggaaactatgcagaaaatattttaaaatattaaaagagtgctggcttctattgttgatttatttttggatttaaaaacaaattagggctgggcccattagctcacacctgtaatcccagcactttgggaggctgagatgtgagaattgcttgagcccaggagtttgagaccagcctgggcaatatggtgagactccatctccatacaaaattaaaaaaaaaataattagccagatgtggtggtgtgcacttgtagtcctagctacttgggaggctgaggtgggaggatcgctggagcccaggacatcaaggttgcaaggagctatgttcattccactgcactccagcctgggctacagagtgagacctgtctaaaataaataaataaataaacaaactagctcatttacaatgtaaagcacttaatatcaaatgattatttggtgtactagaaaagaaacagcatataataatgtataatagtttcttaacaagtggggctaaaatcattttgtagtaatttttcacattgatattaaacttcatgagtttcttttagtcattattattattattattattatttgagatggaatctcgctctgtcgcccaggctggagtgcagtggcgcaatcttggctcactgaaagctctgcctcctgggttcacgccattcttctgcctcagcctcctgagtagctgggactgcgggtgcccaccaccacgcccggctaattttttgtatttttagtagagatggggtttcaccgtattggccaggatggtctcgatctcctgacctcgtgatctgtctgccttggcctccaaaagtgctgggaccgtgcccagccatcattattattttttaaaaagaaaactccccctacccccagtataccatttgtatctcaaaattttactttattgatttttaagagtaatttctacttttatcttttaaataaaacattttagagtatttttgaagacttaaaaagcttaaaatttagtgtttttggaaatgtataaaattttcttgaagtatgtatagttttccaaattactttactgacctgttaactcactgtacttgttttttacttattttttcctgacctcttaacaaggtgagtccatttaatcatctgtggtataaaatgcttctctagtcacctgttctcattaaacagttgtaagtaagttttaaaagccattattttaattactaaaagttctcaagtgtgtagtattatctgagtattttaattgaaaaattaatcaggcttttaaaaattacttttttattgtattaggtggcttttaaattcagattctttatattgcttgatttttcctgggagtcccagttttatgtgaatttgtagctgatagtaggttttacttgtgtaccccatctgcactttgatgttgtgtagatcgttttgtgagttatttgaaccgtgtaactcagagaatagtatttcctcatacataaagtgacctcacttttaatcagctcctttatagtatgttgaaaatcactgcgtgtaatgagaggtattgagagtttcttgcacacatgagtgtaaaaggttgagaactagattatacaaagtagtaagtcacagtgcatggcaactttctacaggttggattataagacttatgtggaataggagaattatattgggaaaaaattattttctctaacttgaagactccagagacacttttcttagtcatgaccagtaatatttttcatatattttgggaagaaataagctcctcactattacccaccagttagtgatttatttatttatgtattttagagacagggcctccttctgtcacccagtttggggtgcagtggtgtaatcatagcttactgcagcatcaaactcctgggctcaagtgttcctcctgcctcagcctcccaagtagctagaacctcagccccatgccaccacactcagctaattttaaattttactaatttcatttaatttttgtggagatgggggtcttgctgtgttgtttaggctggtcctgaactcctggcctcaagcgatccttctgccttggcctctcagtaaattatatagaagagcacttctgtataatttactcagtttcttcatcacatatttccaactgttgccctaaataggtttaaaaatgtgatcatgttattagaaaatcctttccattgaatttcagggatgctgaatttcagggagctaaattgttgacccttgcctgtagttgttattggttcagaagtaaattttattgatgctacaagtaaaaaattagatctgacttagtaaactcaaaagttttacaaaactgtattttactatgtagatgtatttctttaaaataggtatggatggatatttttatgaataaataatattgcattatagatggaatgaaactttgcatttaatttgccccataagtaggctttttgtagaatgaattactctcttaaattgtccaatctaaatttttattagctacattaacttaaagcatattctctctcttttctcttcacactttcttcctccttcccagggtcttcctctccctctttcatcacctacattgttccccttcccttttatactattcttattgtatgtactagctgttgttatttatacaaatactcatacatccttacatagcatgtttttaaacaaaagatactgtagtggtcttaacagtttacaattttatatttaaaaattattcaggaaatctggaaatccctgactttttacaccgtgctgatcacttgactcctgtcttagtccattctggctgctctctcagaataccagagactggatagcttataaaaaacagaaatttatttcttctaagtctggaggctgggaaatacaatatcaaggtgccagcagatttggtgtctggtgaggggcccactcactggttcatagatggtgcattctagctgtgtcttcacctagtggaagggtcgagctagctctctgagacccttatgacctaatcatcccccaaaggttccacttcctaatactatacctcgggaattaaggtttcaacctgtgagttttgtggggacacaaatattcagaccatagcaactcctgtactctactaaaaagcatattagagaaataagtaattgtttttcaatttttaagaatta

SEQ ID NO: 33867 - DNA, 4138 bp, Homo sapiens
caataatataagattcctacatcagtttgcagtcctgactttacagtttgaaataagtagcaaaagaaaattatgataatcaagtaatttattattttgtaaaatagtataaaggaataaggaaattttaagtattgtttaggggccaaatttgaactcagctaatatgatttaagcgctctattaattgccctgatttttaaagaggtgcatgtaattttgaaatagcacacattttcatttgtaatcactctggataaatttgtatttttcagtgttcattgaacaggcttattgactctggtaaacttattttattgatgttttcatatggaaaataataagtggaatatgatacaattgttattttcagaacatatttctttagggctatttaatataacctttttaacgagcaaaaactttccatttgagagaaaaaattcttcctgctctgtgggaaaatatttgctgagattttgtatagaataagagacatgtatgtaacatatatgtatattcagcacaagtctactgcaattatgtacacattttggcaggaagaggggattttgtttagtctttgtttatgagttctagagtttcctgtatctagtgttaagttgtaaggaaaaactaaacatgccatttaaaggtaaacttggtaactatttatagagcatacaccaatgattatttctcacagttttcatgatcatttgtttattatttacttggattagactcattaaaaggtataatgctggtcacaattagaatgctaatatttggggaaactatgcagaaaatattttaaaatattaaaagagtgctggcttctattgttgatttatttttggatttaaaaacaaattagggctgggcccattagctcacacctgtaatcccagcactttgggaggctgagatgtgagaattgcttgagcccaggagtttgagaccagcctgggcaatatggtgagactccatctccatacaaaattaaaaaaaaaataattagccagatgtggtggtgtgcacttgtagtcctagctacttgggaggctgaggtgggaggatcgctggagcccaggacatcaaggttgcaaggagctatgttcattccactgcactccagcctgggctacagagtgagacctgtctaaaataaataaataaataaacaaactagctcatttacaatgtaaagcacttaatatcaaatgattatttggtgtactagaaaagaaacagcatataataatgtataatagtttcttaacaagtggggctaaaatcattttgtagtaatttttcacattgatattaaacttcatgagtttcttttagtcattattattattattattattatttgagatggaatctcgctctgtcgcccaggctggagtgcagtggcgcaatcttggctcactgaaagctctgcctcctgggttcacgccattcttctgcctcagcctcctgagtagctgggactgcgggtgcccaccaccacgcccggctaattttttgtatttttagtagagatggggtttcaccgtattggccaggatggtctcgatctcctgacctcgtgatctgtctgccttggcctccaaaagtgctgggaccgtgcccagccatcattattattttttaaaaagaaaactccccctacccccagtataccatttgtatctcaaaattttactttattgatttttaagagtaatttctacttttatcttttaaataaaacattttagagtatttttgaagacttaaaaagcttaaaatttagtgtttttggaaatgtataaaattttcttgaagtatgtatagttttccaaattactttactgacctgttaactcactgtacttgttttttacttattttttcctgacctcttaacaaggtgagtccatttaatcatctgtggtataaaatgcttctctagtcacctgttctcattaaacagttgtaagtaagttttaaaagccattattttaattactaaaagttctcaagtgtgtagtattatctgagtattttaattgaaaaattaatcaggcttttaaaaattacttttttattgtattaggtggcttttaaattcagattctttatattgcttgatttttcctgggagtcccagttttatgtgaatttgtagctgatagtaggttttacttgtgtaccccatctgcactttgatgttgtgtagatcgttttgtgagttatttgaaccgtgtaactcagagaatagtatttcctcatacataaagtgacctcacttttaatcagctcctttatagtatgttgaaaatcactgcgtgtaatgagaggtattgagagtttcttgcacacatgagtgtaaaaggttgagaactagattatacaaagtagtaagtcacagtgcatggcaactttctacaggttggattataagacttatgtggaataggagaattatattgggaaaaaattattttctctaacttgaagactccagagacacttttcttagtcatgaccagtaatatttttcatatattttgggaagaaataagctcctcactattacccaccagttagtgatttatttatttatgtattttagagacagggcctccttctgtcacccagtttggggtgcagtggtgtaatcatagcttactgcagcatcaaactcctgggctcaagtgttcctcctgcctcagcctcccaagtagctagaacctcagccccatgccaccacactcagctaattttaaattttactaatttcatttaatttttgtggagatgggggtcttgctgtgttgtttaggctggtcctgaactcctggcctcaagcgatccttctgccttggcctctcagtaaattatatagaagagcacttctgtataatttactcagtttcttcatcacatatttccaactgttgccctaaataggtttaaaaatgtgatcatgttattagaaaatcctttccattgaatttcagggatgctgaatttcagggagctaaattgttgacccttgcctgtagttgttattggttcagaagtaaattttattgatgctacaagtaaaaaattagatctgacttagtaaactcaaaagttttacaaaactgtattttactatgtagatgtatttctttaaaataggtatggatggatatttttatgaataaataatattgcattatagatggaatgaaactttgcatttaatttgccccataagtaggctttttgtagaatgaattactctcttaaattgtccaatctaaatttttattagctacattaacttaaagcatattctctctcttttctcttcacactttcttcctccttcccagggtcttcctctccctctttcatcacctacattgttccccttcccttttatactattcttattgtatgtactagctgttgttatttatacaaatactcatacatccttacatagcatgtttttaaacaaaagatactgtagtggtcttaacagtttacaattttatatttaaaaattattcaggaaatctggaaatccctgactttttacaccgtgctgatcacttgactcctgtcttagtccattctggctgctctctcagaataccagagactggatagcttataaaaaacagaaatttatttcttctaagtctggaggctgggaaatacaatatcaaggtgccagcagatttggtgtctggtgaggggcccactcactggttcatagatggtgaaacctcatctgtactaaaaatacaaaaattagccaggcgtagtggcaggcacctgtaatcccagctactcaggaggctgaggcagagaattgcttgaacctgggaggcagaggttgcagtgagctgagatgtacccctgcactctagcctgggcgacagagtgagacagtgtctcaaataaataaataaataaataaaaataagattcccttgaactaacaacgtaagaattatttttaaaagaaactttttaatgtaaggttttttaaaaaaattattcgaataagaaattttactatatgtcttactgttattgttacttagaagtatattaaagaattaaaacattttttaaaagtgaacctgcc

SEQ ID NO: 33868 - DNA, 671 bp, Homo sapiens
taccagttctaggcaagccattatagtgcactcgtatgtgtcagatggaatgtatgaaaagaatacagaaattaactgtggcaggtgcactgataagcctccagactctgagagttttatttgttgttgttgttttttttttaaagtagcagtagaaaagcagtaaagaacttacttattgaaaagcgaaagcttaaagacctttctggaggaaacttctcagaggccatgttaaggctattggaaagtccaatttaaatgacaaggttactgaccaaaaatcaaataaaatattcaagtcaccattactggcagttctggttttggaactgatcccagaattctaccttgcaggctaggagatctcttaaaatggctgttagtagctagtaatagtgcatggtggaaatagttgaagcctcaggggcagtgatgtggcctcacacatatgtggtgcctgcagttcctgtagctgttttgaagagggagggagaggtattaactctgctctaaagcagtttgggtccagaataaaggggtcagtgcctcataccccctactagggtgaaatcctaaaactgcccagggaaggcaaggaagcccttggcagataccaagatcagtggtattggaaataacttacaatcagcagcctaatgccctcacggaaa

SEQ ID NO: 33869 - DNA, 97 bp, Homo sapiens
ctaagaaaggatgccattcacatggtaatttatttagaaataaaatcatgctatagtttacatgggtggagactgatggaagcaatcaaagatcagc

SEQ ID NO: 33870 - DNA, 315 bp, Homo sapiens
tgtatttttagtagagatggggttttgccatgttggctaggctggtcttaaactcctgacctcaagtgatctgcctgcttcggcctcccaaagtgctgggactacaggcataagccactgcacctagccaagataactctttaaatagctactactttccttctctatccattattcatagtttaatatcaggcatgatattgtaaatgcaaagaactgcatgatagactcatttctttgtttattaaaaaagtatgattaaaattataatttgtggtggtagaatgacaatgtatatttaagcacacatcttag

SEQ ID NO: 33871 - DNA, 436 bp, Homo sapiens
actaatccaaataattatgtgctcatgtggatagaattgtttgctgcttaatcaagagagatgggtggggaagcacctgcttttagtcgttaaaatcttgttgcttttgtactgcatccaagaaactagttaacagacaaaaagtgatttgccttttcctgagaatgaaaaggaagacctctttggtttcaccctgtgaagaagagcagagagaaactccaaggtggattttctctacttgttgaaatggaaccatcagggacctcacaggaaaagtgattcttgggttttggttcttcctgccctttctctctgcctgtcatagaactcagcaattggaagaataccagtttttgttccttattggtgctgccacctgttcttactgctgaactaaatgttcttggctttctttggtgtgaacaggatctccctc

SEQ ID NO: 33872 - DNA, 333 bp, Homo sapiens
ggcacgagggggggccacaggacaaccctgagggtccgactgtcacaggtatgcaaaaactgaattaatcttccttatagtgggaagtcagtaaatgtcaaatttttaaaaccaagaaattgcagtataagcaagttattaatggctaaaagatgaaaaggttacatcttgggagtggaaaatgaagggtggaagggttcgggactacttttttttttaaataaaatgattttatttagttagtttgtaaatgtgaatatagttgggcaaaaaccaaaccaaaacagcataaaaccaaaaaatgacagttatatgattgatcatgcccaagta

SEQ ID NO: 33873 - DNA, 516 bp, Homo sapiens
tagaacaaccattaagggaaaaccaagaaaatcccaaatgatttagccttagtctttgagacatgaagccaaccttattgcttcaactgcctaccccaagcctctcaattatgtaaaaatgttaaactcccatttctttataaacccctattgtttgggttttctgttacatgcagattaactcaatcccaaatgatattcatgaatttgtaataaaagtaaaatcccatagtgctgggattacagacgtgagccaccacgccctgccaataaaaagattatctccagatgctggtatgaccagtaatttattttcttcctttttttttgtctgcactttctaccataatcatatgttagcttcttactaagaagaaaagtcaatgttatttccctgaaaaagtaatgttgtttggttattaaacaaatttaattttctaaacaagagtacgacaggtaaactgcctaccttaaaagcaaacgaacacaaataaataaactaaccatcttccactt

SEQ ID NO: 33874 - DNA, 455 bp, Homo sapiens
aggctgtgtcagaagacaatggccccggtggccagttagagcagagacttcactgactgacttacaggtgccctattctgaggtacaggagccgcggctttctgatgggggaaaatgccgccttaggctggagccaacatgactgtcctttaaactccagtggctggccagtgctgggattacagacgtgagccaccacgccctgccaataaaaagattatctccagatgctggtatgaccagtaatttattttcttcctttttttttgtctgcactttctaccataatcatatgttagcttcttactaagaagaaaagtcaatgttatttccctgaaaaagtaatgttgtttggttattaaacaaatttaattttctaaacaagagtacgacaggtaaactgcctaccttaaaagcaaacgaacacaaataaataaactaaccatcttccactt

SEQ ID NO: 33875 - DNA, 438 bp, Homo sapiens
agcttgtctgctccagaagtagaagagagccttccagttgctaaggctctgtccagggccgggctcctgccaggtggcaggcagaggcttcctcaagccctgcgtccctcttctgggttcagagaccactcccaggcttggttctatcagcacactccatgcatacaggtgcagaatgctctccccggccacccgagaccacacctcagccaggaccttgtgcagagcttgcttgggccaaggtacacgatccaggaaagctgagctcaagaaaaatgaatccaatgctggatgtggtgactcgtgcctataatcccagctaattaggaggctgaggtgggaggattgcctgagcccaagagttcgaggctgtgttgagccatgattgcaccaccgcactccagcttgggtgacaaagggccatgtttcttaaaaaga

SEQ ID NO: 33876 - DNA, 288 bp, Homo sapiens
gaaactactcacacaacttgattgtttcacttattccaataagtatcagtggcaaatgtattccagcccccaaacagacccctaagaagcctgggcttcttcctcagaataaaatgtctgagccagtagagccacagacaacggcacgaatcacgcctgtattgaagcccatgtattagcggagggccctgagcatgctcctcaagcatgggtttcctctccaagcctgggtttcctcacctgtaaaacagggaaaatccttagccttctcatcaccaacagagaagg

SEQ ID NO: 33877 - DNA, 249 bp, Homo sapiens
acagcgtctcattctgttgcccaggatggagtacagtggtgccatcttcgctcactgcagccttcgtctcccgggttcaagcaattctcctgtctcagcctcccaagtagctgggattacagacccatcaagccttcagataagactgcagcctcattacagaccttgaactggaggcagccagctgagtcacacctggattcctgacccttagaaactatgagataataaatgtttacagttttaagc

SEQ ID NO: 33878 - DNA, 384 bp, Homo sapiens
gtttaatccattttgtgttcatttttatatatggtataagataaaggtccaaattcattattttgcacatggatatttagttctcccaacactatttgctgtacagaccgtcccttccctgttgaatggtcttggtaccattgttgaagatcatttaaccatatatgtaagggtttgtttctgggctttctatgctgttctattggtctatttgtctgcctttatgccagtaaccacactgttttgattagtgtagctttataatatgttttaaaatcaggaaatgtgaaccttccaactttgttctttttcacagttgttttagctacttggggtcccttgatattccatatgaattttaggatgaatctctatttctgtaaa

SEQ ID NO: 33879 - DNA, 435 bp, Homo sapiens
accatcagctctcatgagaactcactcattatcgccagcacagcagcatgggggtaactgcccccatgattcaattacctcccactgggtccctcccaggacacgtgggaattatgagaactgcaattcaagatgagatttgggtggggacacagctcaaccccatcaccttggatttgattcctaaggctgttgtaacaaactagccacacttcattgtattgcgtttggcagatatcacggtctttgcaaattgaagctttgtgagaaccttgcaccaagcaagtctattgttcccattgttccaacagaatgtgttcccttagggtctgtgtgtaattcccacaatagttcaaactttatcattattattatgtctgacacggtgatctgtgatcagtgatctttgatattactattgtgcttgttttgggg

SEQ ID NO: 33880 - DNA, 607 bp, Homo sapiens
agtcagaatcgagcagcacatcctgggcgctgtctatcagagaccgtttcctaaacgccctgtgcctgctgctctgattcacgaaggccagactgaagtcaggtgtcctagcagtgggtgtctcacatgagtcagtgccactcgaaaaacaagcgtggattgcattggctttgtcttttgcctccagctttctttatcctgctgttttttgcttgaatccgtagctctgagccattgattaccagcagcagtttacagcaactgcagttttgtaaacagtagcttaatgtcatgaaagccttcccagtgtaaatgctacttacgcccttcctccagtagtctcacgcccagccccaaaaatgtaaattataagttgtaaagataaggtggggctcacaaagtgaggggaggttctcctttccctgggatcgcatctcacatttaagcgtcccataatgggcacttccacgcgttttccaaagtgggccgcgttacacagcgagaaaacagatgatttttaatgcactcgcctacctgttgcttaaccaaaagtggagtctttaaggagacagcttatcagaccttgtgatttcatcagctgatgtaa

SEQ ID NO: 33881 - DNA, 182 bp, Homo sapiens
ggtttgaatagcatacattcctttctattttgtggttgcctttatattattaacatgcgtatttaaacatgtttttctcacaacatctacagttataggtatttgtagcttctccctaagcaagagaacttgagtattctcttattctcctccattctctttcttggacctctcaggttgat

SEQ ID NO: 33882 - DNA, 508 bp, Homo sapiens
ttccggtaaatgtttagcagccatctcactgaaaaataaagccagaattgtgtttatccatttccgtgatgtgagtgctcccaatatggccaacattgtggttctgttactaacgtgatgtcactaaagacagagttggaaagggatgctcagtagcacttctcatatagtatttctgccacaccaattcaacacaggtaaataatgtcaagagcatagacaacagtaaactgtagtaaaataattaggaactgatgagtttgtatgtaacataatttatttcagagtgtgtttatgtaatttaaattttaataatgtctgcatttaacaacatggaattcctgaaaaatgaataactgactcttgcaagccagtccgagctggctgcagtgcactatcatttgtcctcctctgagattttctgaatagtcttgaccacccaacacaaatagccatttaggaatagtcttcagtatgctccacaatccattgtctttcagagaactgc

SEQ ID NO: 33883 - DNA, 313 bp, Homo sapiens
ttttccttccagcctcatttctcacagtctccttcgggacttgcctggagttagcctcactggcctgtttgcccttcacagaacaagtcctgcacttcataccctgtgtgttggctcacaccattccctcatcggggatgtccttcctttcctcttctacactactttcaaggtttcaggcaaatgctccctctttgctcccagagcacgaaggctgtgtttccacctattgaatattcatgtgtacttgcattagcattagctgtttacatgtctgtcgctcccaagagactgtgaactccttgagaagggg

SEQ ID NO: 33884 - DNA, 662 bp, Homo sapiens
catttccattttgcatatggggacacagaggtttagagaagtgaaagaaactgtccaaggacccaggagtggtgaggttagcagaggcacctgcacccaagccttctgacctttactcctgcccagtgctctctctctcctaatctggcaaactcagtctgggccagactgtgtgctccttaactagaaagtttcccaatggtcatagtttgttctttaggtttgtagttcaagacaaaccattgccctgtagctgcccttttccccactggcttatctttggaccgactgggaggtgaaggacactgtccttgtatgtgccattcccaattgggctacttcctggtgaacttgatttctcattttgggggcccaggagggtgatcattgcctaagaacattccagagtttacttaaggcaaactatgaaaaaggtaaattctgtgctttcttcctttcattccacttcagtaactgcctttttactggtattactcaaattctccagctttcttactctttaaataattttaccgagcctccactctgcgtctggatttgtgctctgtgttggacatataacgataaataagacaacttttattagtggtttcaggtatgttaacgagttagtatggtacagcaatgataaatgtgataaa

SEQ ID NO: 33885 - DNA, 730 bp, Homo sapiens
tcccctgccgacttgccccattcccgtaccagacccgtttctttgggagcttgtctttactaagtcacttgcacaggacccttcctctcaggatccacttctgggcaatcctcacaaataacagacaaatgataataggtagcattcactgagtttgaccatgtttcaggcactgtgataagagctttttacatgccctggtccacttagtcctccagaattccatcaggcaaagcaggtgcaattatagcctcttggcatagtttaaacttgggactgcagaccctggtgcctgactgcctggggtcaaatttcagttctcctagttactagctgtgtggccttgggcaagtcacctattttcctcacctgtaaaatggagataataatagaatctacttcactggtttgctctgatgagctaaagtgagcaaggcattgaaatgctctgtaggtatttcctaaatgaacaaatacttcacacagtaggccatggagatttacaaagatgaaggccaggcatggtgtaatctcagcactttggaaagccaatgtgagaggatcgcttgagcccaggagttcaagatcagcctgggcaacatagaaagaccccgtctctacaaaaaataaaaacgaattagctgggcatggtggggtgtgcctatggtcccagctactcaggtcgaggctgcagtgagctatgatcatttcagcctgggcaacagagcaa

SEQ ID NO: 33886 - DNA, 1764 bp, Homo sapiens
  misc_feature (227)..(227): n is a, c, g, or t
  misc_feature (287)..(287): n is a, c, g, or t
ggtgctagtgatcttgggttatttagaagaaaaatccataaaactgatgggttaagaatggaggtgaagccagacatagtggctcatgcctgtaatcccagcgttttgggaggcttgaggccaggagtttcagaccagcctgggcaacacagtgagacctcatttctaaaaaaaaaaaaaagaaaaaaataagccagacgtggtggtacacacctgtagtcccagtnacttgaggggctgaggtgggaggatcacttgagcccaggagtttgaagctgcggtgagcngtgattacaccactgcactccaacctgggcgacagagcgagaccttgtctccaaaataaaataaaacaaaataaaagaactcagggaaaatagacacctggtttctatctggtggctattctttcatttctgcctacaaagcatacatatttgtaaatggcgtgtcacatgtcaaaacattttgagtctgtcggtcttactcctctccacattcccacatccctccaaagggagtgggatgaaatgcccttctgcattctctcctttctcccaccaactcaccctttaggccaacccattctcacttcttcaggaggatcaccaggcctcccacactccctgcttccacaacctccagccccctgggccctcctgccccatctgctgtggctcagatggggcttcctatgaatctcatctctgtggacgttcatcacttcccaagatgggggtatgacatgcccttcctttctactcctgtcagtaaaacgtgctggagggcacggggacctcatgccacagccaagacgtctgagtggtaggagactgaagaaacgtataggaaatgtgctcagagttagcacccctgagagaccagtggtcagagagcaagctcaaatgggacagtctgttaaacatggaggatttgtgctgggggaaaatgcttcttactcacatctgttttcttctttgtggagagaatgcactatcgtcactactggtattagtgatccactattgtcattccctctttctctgctccctcattctttccctcactggggaaagaagtgtgactgagctaattggtgaatttgggagcaataaacagggtgtattccctggggctccttcctctttcccgttactaagcaggctagatcaggaggcacaccaactctgcccctcacatccccagggctgtctgagactggacggccaaggtcagctgtgcccctcacgtccttggggctgtctaagactgggtggccaagttcagctctggttttgttgtctggaaacctactttcttgcagagatattagccacatctctaatatccgtgtattagttataaagacaatattttaacttcctatctgctttacccttttgtcttattcttcaacagatggagacgtcaggcaggaaagggaagggacagtttactgaatctctgcccacaacaactatcaacatatatcgaccttctttccctcccaaagccccattaaaatgacagcaaaagatatgtaaaaatgattgactataaaaacaaagagaacagaataggaaacgtaaggagaagagaagtaaacttgatccctgcccaaattgacataaacacaatttttcttctatgtgtaaacatattagaagtgagccagttccaggcacagtgaatgaaaaatagaccagcctacttctttgtactaagtagaatgtttattatgaaaacaaaaacaaaaacaaaaac

SEQ ID NO: 33887 - DNA, 403 bp, Homo sapiens
tacttatggggtcccttctacctggagtgcctttctcctccatccgtgcctttccaaattccattctttttaatgtacgagacagaatgtcacgcctttttcagtaagcctcctctgaactcacttagcgttgtgtctgtccatctcgtggcatatctttctcatcaggttgtcagtattcaatgcattgtttttgtttcccctgatagcctctgagttccttccggataacactgcatcaacaatgctactgagcaccaactgagggcaggatgcagaatgctggatgttgtaggaaatataacagttaagaccagggctgggcacagtggctctcacctgtaatcctagcactttgggaggccgaggcaggcggatcacttgaggtcaggagttcgagacc

SEQ ID NO: 33888 - DNA, 762 bp, Homo sapiens
taaaatggaaagtgttttaatgctgactttgcactgcggtattgatttaaccatgaaaaaaaattaagaagctgggttggctgctctcaacataaagccaagcagcaagagaaacggaaaggtttggggtggaaggggactgcctcaaaaactgtcatgctggaattgcaaactgtggccccaatgagtgacactggttaccactactcgggaggcggatgactcagtaacgtaatgggcagtagcaacggtaaaggctggttcctgggaatatctccattcggacaggctcttccttcggggaccaaagaggcccacttttaagacctcactctcgggcacttgctctgttttgctgaagcgtctgccttccaggccagggaggacggccacatccttctccagctgtggagccttcttgaggtcatcttcttcaggactctgccggcgagactcggcctccttgatgggggccagggattcggacaatttccgctgtgtcgtctggacctctggtcctctcttggatttctcatcagcgagggtttccaggacctcatattctgccaggccgggaatgatcttcatggactctggtatttctttctccattttctgaagtgcttctgtagtggagggctgctccactttctcaccctctttagctttcccagtcatagtaacaattctcccggagacagtgtcataggattttcctagagtgtatattttctgtttgctgtcttctttcagttgcatttc

SEQ ID NO: 33889 - DNA, 3232 bp, Homo sapiens
ctgcgggcggcgggcggcgggcgcaccatgccctccttcgacgaggcgctgcagcgggtgggcgagttcgggcgcttccagaggcgcgtgtttttgctgctgtgcctgacgggcgtcaccttcgccttcctcttcgtcggcgtggtcttcctgggcacgcagcccgaccactactggtgccgcgggccaagtgccgcggcgctggccgagcgctgcggctggagcccggaggaggagtggaaccgcacggcgcccgcctcccgcggcccagagccccccgagcgccgcggccgctgccagcgctacctcctggaggcggccaacgacagcgcctccgccactagcgctctcagctgcgcggacccactcgccgccttccccaaccgttcggctccccttgtgccgtgccgcggcggctggcgctacgcccaggcccactccaccatcgtcagcgagtttgaccttgtctgtgtcaatgcgtggatgctggacctcacccaagccatcctgaacctcggcttcctgactggagcattcaccttaggctatgcagcagacaggtatggcaggatcgtcatttacttgctatcctgccttggtgttggcgtcactggggttgtggtggcctttgcaccaaacttccctgtgtttgtgatcttccgcttcctgcaaggtgtatttggaaaggggacgtggatgacttgctacgtgattgtgacagaaatagtaggttcgaaacaaaggaggattgtgggaatcgtgattcaaatgttctttacccttggaatcataattctccctggaattgcctacttcatccccaactggcaaggaatccagttagccatcacgctgcccagctttctcttcctcctttattactgggtggtccctgagtctccccgttggctgattactcggaagaaaggagataaagcattacagatcctgagacgcattgctaagtgcaatgggaaatacctctcatcaaattactcagagatcactgttacagatgaggaagttagtaatccatcctttttagatctggtgagaactccccaaatgaggaaatgcacacttattcttatgtttgcttggttcacaagcgcagtggtgtatcaaggacttgtcatgcgcctgggaattatagggggcaacctctatatagactttttcatctcgggcgtggtggaactgccaggagctctcttgatcttactaaccattgagcgccttggacgacgcctcccctttgcggcaagcaatatagtggcaggggtggcatgccttgtcactgcgttcttaccagaaggaatagcatggttgaggaccacagtggctacattgggaagactagggataaccatggcctttgaaattgtttatttggtaaattcagaattgtacccaacaacattacgaaatttcggagtttcgctctgttcaggtctgtgtgattttgggggaatcatagccccatttctgctctttcggctagcagccgtgtggctagaactacctctgatcatctttggtatcctggcatccatctgtggtggccttgtgatgcttttgcctgaaaccaagggtattgccttgccagagacagtggatgatgtagaaaaacttggcagtccacattcctgtaaatgtggcaggaataagaaaaccccagtttcccgctctcacctttgaggcccccgacaaagacagaaagaaggagctatccaggagctgatcctccttgcaaagctgtgccttgcagagatgcacgtgtgcatttcagctacatcatgccgcgctgttgtaatactgtataaagacctcaatctatccagagtatttttatataatgttggatgagttaggatttgtaatgctgttgaagtttctgggaacacataatatgtagccagtttaacaaagaagctgtcaggtgcacagcccttcctgggtttttttcttgtgttccctgtggtctctgacccattaggctaaagagagacaagagaagcccccaacctgattctcatgacagctccatcaagaatgtgggatgtgccgaccaaggatttgagaaagttgtacagaaatgtgttcatcaaatctggtcaagggactaagctcctagctgaccattcattctgaagattgcatggaggatgaacatctgggaatcctgttaatgagaaggctgaatcacaggcacctgggccaaagggtgtgagcattcatgttctctgctcaccttggtttccgcacaccttcgcaatgtgaacaggtcaggagtccctcccgtccacctcctctgtaacagctggggttccaggcatggtttaggccctgttccagcaataagaaccaatctgctgtacaatctgaggacttggctctgttatttacaaaatgatgctgtggttctgagattatttgggacatttttggctctcctttagtggacacctagagccacagattcccttctttactaaacaaatcccatggattctgatttctgggtcttaggattttaaaagtgaagggatatttttcttatatttgtgagttcagttccgatggtgcccgtggtcaaaagcgaaaaacatggacaattcctattcattcttagcactttgacatgtcttggggaaaagcttacattttaatttaaaagaaagatcaattatatccatgcttaacaggatcagcaggagctttataaatgactttacagagactaataagggatttgatctttctttttttgttatcgaggcttttgaaatgtggaacttgtgtgttctgctttatatgttatattcaatatcttttcagatgcagtctatattttatgctgagttttaaaaatgaaatactttatgcaaacaggcaaaattggtaccaaagggaaacattaaccatgaggaagagcatttttctaaggagaacaggtgacaatatacacatgtgcgctaatcgtaaaatgagcatcttagtctttaaaacacatcagaattgaatacgaataatctatttgtcgatgaaataaacacaactctttgaggatttgagactacattcaccctttattcacagtcacttgcagttttgcttttctctgcatttctctgctgtaagatgactgttgcattgttgaattgtattttgagtggatatttttgtttggtaacaattaaaattttaaatcgtaaaaaatgtacatttgccc

SEQ ID NO: 33890 - DNA, 1919 bp, Homo sapiens
atagataatggtccgtcgccaatataacggaacttgaccggaaggaacactaacctttgaagctgtggtaagggagagctggggcattgatctgggatgcagaggttgctgtggttgagagctactccagtgagcaacatgatggcttcagagtgagcaggccccatgggagagggcccagctgtgtcttcctggagcggtaacacctttcccctattccataggtatcctggcatccatctgtggtggccttgtgatgcttttgcctgaaaccaagggtattgccttgccagagacagtggatgatgtagaaaaacttggcagtccacattcctgtaaatgtggcaggaataagaaaaccccagtttcccgctctcacctttgaggcccccgacaaagacagaaagaaggagctatccaggagctgatcctccttgcaaagctgtgccttgcagagatgcacgtgtgcatttcagctacatcatgccgcgctgttgtaatactgtataaagacctcaatctatccagagtatttttatataatgttggatgagttaggatttgtaatgctgttgaagtttctgggaacacataatatgtagccagtttaacaaagaagctgtcaggtgcacagcccttcctgggtttttttcttgtgttccctgtggtctctgacccattaggctaaagagagacaagagaagcccccaacctgattctcatgacagctccatcaagaatgtgggatgtgccgaccaaggatttgagaaagttgtacagaaatgtgttcatcaaatctggtcaagggactaagctcctagctgaccattcattctgaagattgcatggaggatgaacatctgggaatcctgttaatgagaaggctgaatcacaggcacctgggccaaagggtgtgagcattcatgttctctgctcaccttggtttccgcacaccttcgcaatgtgaacaggtcaggagtccctcccgtccacctcctctgtaacagctggggttccaggcatggtttaggccctgttccagcaataagaaccaatctgctgtacaatctgaggacttggctctgttatttacaaaatgatgctgtggttctgagattatttgggacatttttggctctcctttagtggacacctagagccacagattcccttctttactaaacaaatcccatggattctgatttctgggtcttaggattttaaaagtgaagggatatttttcttatatttgtgagttcagttccgatggtgcccgtggtcaaaagcgaaaaacatggacaattcctattcattcttagcactttgacatgtcttggggaaaagcttacattttaatttaaaagaaagatcaattatatccatgcttaacaggatcagcaggagctttataaatgactttacagagactaataagggatttgatctttctttttttgttatcgaggcttttgaaatgtggaacttgtgtgttctgctttatatgttatattcaatatcttttcagatgcagtctatattttatgctgagttttaaaaatgaaatactttatgcaaacaggcaaaattggtaccaaagggaaacattaaccatgaggaagagcatttttctaaggagaacaggtgacaatatacacatgtgcgctaatcgtaaaatgagcatcttagtctttaaaacacatcagaattgaatacgaataatctatttgtcgatgaaataaacacaactctttgaggatttgagactacattcaccctttattcacagtcacttgcagttttgcttttctctgcatttctctgctgtaagatgactgttgcattgttgaattgtattttgagtggatatttttgtttggtaacaattaaaattttaaatcgtaaaaaatgtacatttgccc

SEQ ID NO: 33891 - DNA, 3145 bp, Homo sapiens
ctgcgggcggcgggcggcgggcgcaccatgccctccttcgacgaggcgctgcagcgggtgggcgagttcgggcgcttccagaggcgcgtgtttttgctgctgtgcctgacgggcgtcaccttcgccttcctcttcgtcggcgtggtcttcctgggcacgcagcccgaccactactggtgccgcgggccaagtgccgcggcgctggccgagcgctgcggctggagcccggaggaggagtggaaccgcacggcgcccgcctcccgcggcccagagccccccgagcgccgcggccgctgccagcgctacctcctggaggcggccaacgacagcgcctccgccactagcgctctcagctgcgcggacccactcgccgccttccccaaccgttcggctccccttgtgccgtgccgcggcggctggcgctacgcccaggcccactccaccatcgtcagcgagtttgaccttgtctgtgtcaatgcgtggatgctggacctcacccaagccatcctgaacctcggcttcctgactggagcattcaccttaggctatgcagcagacaggtatggcaggatcgtcatttacttgctatcctgccttggtgttggcgtcactggggttgtggtggcctttgcaccaaacttccctgtgtttgtgatcttccgcttcctgcaaggtgtatttggaaaggggacgtggatgacttgctacgtgattgtgacagaaatagtaggttcgaaacaaaggaggattgtgggaatcgtgattcaaatgttctttacccttggaatcataattctccctggaattgcctacttcatccccaactggcaaggaatccagttagccatcacgctgcccagctttctcttcctcctttattactgggtggtccctgagtctccccgttggctgattactcggaagaaaggagataaagcattacagatcctgagacgcattgctaagtgcaatgggaaatacctctcatcaaattactcagagatcactgttacagatgaggaagttagtaatccatcctttttagatctggtgagaactccccaaatgaggaaatgcacacttattcttatgtttgcttggttcacaagcgcagtggtgtatcaaggacttgtcatgcgcctgggaattatagggggcaacctctatatagactttttcatctcgggcgtggtggaactgccaggagctctcttgatcttactaaccattgagcgccttggacgacgcctcccctttgcggcaagcaatatagtggcaggggtggcatgccttgtcactgcgttcttaccagaaggaatagcatggttgaggaccacagtggctacattgggaagactagggataaccatggcctttgaaattgtttatttggtaaattcagaattgtacccaacaacattacgaaatttcggagtttcgctctgttcaggtctgtgtgattttgggggaatcatagccccatttctgctctttcggctagcagccgtgtggctagaactacctctgatcatctttggtatcctggcatccatctgtggtggccttgtgatgcttttgcctgaaaccaagggtattgccttgccagagacagtggatgatgtagaaaaacttggcagtccacattcctgtaaatgtggcaggaataagaaaaccccagtttcccgctctcacctttgaggcccccgacaaagacagaaagaaggagctatccaggagctgatcctccttgcaaagctgtgccttgcagagatgcacgtgtgcatttcagctacatcatgccgcgctgttgtaatactgtataaagacctcaatctatccagagtatttttatataatgttggatgagttaggatttgtaatgctgttgaagtttctgggaacacataatatgtagccagtttaacaaagaagctgtcaggtgcacagcccttcctgggtttttttcttgtgttccctgtggtctctgacccattaggctaaagagagacaagagaagcccccaacctgattctcatgacagtcctagctgaccattcattctgaagattgcatggaggatgaacatctgggaatcctgttaatgagaaggctgaatcacaggcacctgggccaaagggtgtgagcattcatgttctctgctcaccttggtttccgcacaccttcgcaatgtgaacaggtcaggagtccctcccgtccacctcctctgtaacagctggggttccaggcatggtttaggccctgttccagcaataagaaccaatctgctgtacaatctgaggacttggctctgttatttacaaaatgatgctgtggttctgagattatttgggacatttttggctctcctttagtggacacctagagccacagattcccttctttactaaacaaatcccatggattctgatttctgggtcttaggattttaaaagtgaagggatatttttcttatatttgtgagttcagttccgatggtgcccgtggtcaaaagcgaaaaacatggacaattcctattcattcttagcactttgacatgtcttggggaaaagcttacattttaatttaaaagaaagatcaattatatccatgcttaacaggatcagcaggagctttataaatgactttacagagactaataagggatttgatctttctttttttgttatcgaggcttttgaaatgtggaacttgtgtgttctgctttatatgttatattcaatatcttttcagatgcagtctatattttatgctgagttttaaaaatgaaatactttatgcaaacaggcaaaattggtaccaaagggaaacattaaccatgaggaagagcatttttctaaggagaacaggtgacaatatacacatgtgcgctaatcgtaaaatgagcatcttagtctttaaaacacatcagaattgaatacgaataatctatttgtcgatgaaataaacacaactctttgaggatttgagactacattcaccctttattcacagtcacttgcagttttgcttttctctgcatttctctgctgtaagatgactgttgcattgttgaattgtattttgagtggatatttttgtttggtaacaattaaaattttaaatcgtaaaaaatgtacatttgccc

SEQ ID NO: 33892 - DNA, 670 bp, Homo sapiens
ttcccagtggcccaggcagggatgttgtgtcagtagcctgaagggcccacagtgggagcatttaaaccatgcacattggcagatgctgccaatcagggcttgattgcccaaagagggttgttaggcatttaccagcacaccactaggctacaaagaagtggagaaaataggggagggtggcttttcaagaagtttggctctaaagagcagaaaaagaaaggatggtaatggaaggatgaggtgagattgagagaaggctggtcaaacaggaaaggtctgaatgtgtttgaaagcttctcccaataggttgaagatactggaggaagggttgatccctacagtgaggagcccaaagagacaggcctaggagaaggctggtcccggagtagacaccaggacaagctttccactgtaaggtaacaggaggaatcggagggagaggggcaggtaagtgagagtgtcagtgagcgggcgcagaggggactcccctccagcacttctgtttccctgtgatgcaggagaggaggccttgggtgttggaccctaagaaggaactcagtcaatcactgtgagatgtgtgagtgaacacatggctgccaggtatacaggggccgtggtgctactcagggtttgaggaagggagagaacctttgaagctgtggtaagggag

SEQ ID NO: 33893 - DNA, 283 bp, Homo sapiens
cagcgcctccgccactagcgctctcagctgcgcggacccactcgccgccttccccaaccgttcggctccccttgtgccgtgccgcggcggctggcgctacgcccaggcccactccaccatcgtcagcgaggtaagggcgccccggccctttggaagccggcgggagaggacgatgctggctcccaggcggacaagccgcgtgtgagacgctggccgccaggggaggtcggtggagacggggaccggtcggctacctctggggacagacaggattcagcgcacc

SEQ ID NO: 33894 - DNA, 2178 bp, Homo sapiens
ggttttaagtgatattaagagtattggcttatatttaagaagtcaaaagataccactttatgaggaatgccagcttttggtgagaaaaggatttgattttcagagaaaacagtatggcaaactaaagaagtttactactgtaaatcctgagttttataatgaaccaaaaaccaaactttatcttaagctaagtcggaaggaaagatcttcagcttatagcaaaaatgatctttgggtggtttcaaaaaccctagactttgagctggatacttttatcgcatgtagtgctttctttggaccatcatctatcaatgagatagaaatactgcctttgaaaggctatttcccttctaattggcccactaacatggttgtccatgcgttattggtttgtaatgctagcacagaactgactactttgaaaaacattcaggactactttaatccagctactctacctctaacacagtacctgttaacaacgtcttcgccaactatagttagtaacaaaagagtcagtaagagaaaatttatcccaccagccttcacaaatgtcagtacaaaatttgaactactcagcctaggagcaacattgaagttagctagtgagttgattcaggtacacaagttaaacaaggatcaagctacagctctaattcaaatagctcaaatgatggcatcacatgaaagcattgaagaagtgaaggaactgcaaactcataccttccctatcacaatcatacatggtgtgtttggagcaggaaagagttacttgctggcagtggtgattttgttctttgtacagctgtttgaaaagagtgaagctcccaccattggaaatgcaaggccgtggaaacttctgatttcttcttctactaatgtggctgttgacagagtacttcttgggcttctcagtcttggatttgaaaactttatcagagttgggagtgttaggaagattgccaaaccaattttaccttatagcttgcatgctggctcagaaaatgaaagtgaacagttaaaagaactacatgcactaatgaaagaagacctgactcctacggaaagagtctatgtgagaaaaagcattgagcagcataaactggggaccaatagaaccctgctgaagcaggtttgagtgtgaaaagctgattcttgttggggatcccaaacagctacctcctactattcagggttctgatgcagctcatgaaaatggattggaacaaactctttttgatcgactttgcttaatgggtcacaagccaattctattgagaactcaataccgttgtcatcctgcaatcagtgctattgctaatgatctgttttacaaaggagccctcatgaatggtgtaacagaaatagagcggagccctttattggaatggctaccaaccctgtgtttttataatgttaaaggactagaacagatagaaagagataacagctttcataatgtggcagaagctacgtttacactcaagctgattcaatcactgattgcaagtggaatagcaggctctatgattggtgtgataacattatacaaatcccagatgtacaagctttgtcatttactcagtgctgtggactttcaccatcctgatattaaaactgtgcaggtgtccacagtagatgcttttcagggagctgaaaaggagatcattattctgtcctgtgtaaggacaagacaagtaggattcattgattcagaaaaaagaatgaatgttgcattgactagaggaaagaggcatttgttgattgtgggaaatttagcctgtttgaggaaaaatcaactttggggacgagtgatccaacactgcgaaggaagggaagatggattgcaacatgcaaaccagtatgaaccacagctgaaccatctccttaaagattattttgaaaaacaagtggaagaaaaacagaagaaaaagagtgaaaaagagaaatctaaagataaatctcattcataaaaagacatggtgtaaatattttgtatttatgtaaattcagactcattttacatgatatattttttatatttttattactctaaaccctcttattaaaaatatgatatttaaataacatagtaaacacatgtaaaaattttgttcttcaaaaaagtgtacaaaaggtagtataaaatcctactaataaaaataagcttttttctaa

SEQ ID NO: 33895 - DNA, 2456 bp, Homo sapiens
  misc_feature (1877)..(1877): n is a, c, g, or t
  misc_feature (1882)..(1882): n is a, c, g, or t
  misc_feature (1884)..(1884): n is a, c, g, or t
  misc_feature (1887)..(1887): n is a, c, g, or t
  misc_feature (1890)..(1890): n is a, c, g, or t
cgatattggagtatgtatccatttacagtatatatccacttactgtttatttccataaaaaactgttctctgtaatgcttacaaagtgatggctaagttatgaattattctactcatctttttcaaatgcccctttttttaaaattgtttatttgcttcatttttattaggtcttcgccaactatagttagtaacaaaagagtcagtaagagaaaatttatcccaccagccttcacaaatgtcagtacaaaatttgaactactcagcctaggagcaacattgaagttagctagtgagttgattcaggtacacaagttaaacaaggatcaagctacagctctaattcaaatagctcaaatgatggcatcacatgaaagcattgaagaagtgaaggaactgcaaactcataccttccctatcacaatcatacatggtgtgtttggagcaggaaagagttacttgctggcagtggtgattttgttctttgtacagctgtttgaaaagagtgaagctcccaccattggaaatgcaaggccgtggaaacttctgatttcttcttctactaatgtggctgttgacagagtacttcttgggcttctcagtcttggatttgaaaactttatcagagttgggagtgttaggaagattgccaaaccaattttaccttatagcttgcatgctggctcagaaaatgaaagtgaacagttaaaagaactacatgcactaatgaaagaagacctgactcctacggaaagagtctatgtgagaaaaagcattgagcagcataaactggggaccaatagaaccctgctgaagcaggtttgagtgtgaaaagctgattcttgttggggatcccaaacagctacctcctactattcagggttctgatgcagctcatgaaaatggattggaacaaactctttttgatcgactttgcttaatgggtcacaagccaattctattgagaactcaataccgttgtcatcctgcaatcagtgctattgctaatgatctgttttacaaaggagccctcatgaatggtgtaacagaaatagagcggagccctttattggaatggctaccaaccctgtgtttttataatgttaaaggactagaacagatagaaagagataacagctttcataatgtggcagaagctacgtttacactcaagctgattcaatcactgattgcaagtggaatagcaggctctatgattggtgtgataacattatacaaatcccagatgtacaagctttgtcatttactcagtgctgtggactttcaccatcctgatattaaaactgtgcaggtgtccacagtagatgcttttcagggagctgaaaaggagatcattattctgtcctgtgtaaggacaagacaagtaggattcattgattcagaaaaaagaatgaatgttgcattgactagaggaaagaggcatttgttgattgtgggaaatttagcctgtttgaggaaaaatcaactttggggacgagtgatccaacactgcgaaggaagggaagatggattgcaacatgcaaaccagtatgaaccacagctgaaccatctccttaaagattattttgaaaaacaagtggaagaaaaacagaagaaaaagagtgaaaaagagaaatctaaagataaatctcattcataaaaagacatggtgtaaatattttgtatttatgtaaattcagactcattttacatgatatattttttatatttttattactctaaaccctcttattaaaaatatgatatttaaataacatagtaaacacatgtaaaaattttgttcttcaaaaaagtgtacaaaaggtagtataaaatcctactaataaaaataagcttttttctaaaaaaaaaaaaanaaaananaanaanaaaaaaaaaaaaaaaaaaaaaaaaaaaaaaaaaaaaaaaaaaaaaaagagaaggaggagaacaaaaaaacgagcgggagaaaaaaaaaaggagaaaagaaccagaaaaagacaaaaaaagaagcacaaaaagagagaggaacgatagctaagagaaagaaagagaggaagacaaaaaaaaaaggaagaaaagagcagaaacacaaaaaaagagaaaaacgggcgcaaaagagaaaagaaagagagagggagcgagagaagaaaaagagaagaaaaaaaacaagagaggacggaaagaagagagaaagagagaaagcaaaacaacacagaacagagaggtagagagaaaagaaagagagtgagaataaatcgatcgatggggcagggtcggcgacagaaagcaaggtgagtataaatacatagcgacattcatgggtctgagtagagcaggtagatcaaacggaccgagagaggagaactagaccgtaatgagagaaggaaggagaaaagatacaagaggagagagagaggcaagcaggaggggggagaggagaagaggggaggcgg

SEQ ID NO: 33896 - DNA, 923 bp, Homo sapiens
ggttttaagtgatattaagagtattggcttatatttaagaagtcaaaagataccactttatgaggaatgccagcttttggtgagaaaaggatttgattttcagagaaaacagtatggcaaactaaagaagtttactactgtaaatcctgagttttataatgaaccaaaaaccaaactttatcttaagctaagtcggaaggaaagatcttcagcttatagcaaaaatgatctttgggtggtttcaaaaaccctagactttgagctggatacttttatcgcatgtagtgctttctttggaccatcatctatcaatgagatagaaatactgcctttgaaaggctatttcccttctaattggcccactaacatggttgtccatgcgttattggtttgtaatgctagcacagaactgactactttgaaaaacattcaggactactttaatccagctactctacctctaacacagtacctgttaacaacgtaagtcattttttacctttgagtcattggtattaaaaaatggtaatcagaagtaaatatgaaaattcaataaaagtacagtatataaatgttgccaataaaattgtaattatttttcagactatgacattattctctgtcagtggttaaaaagagaaaaggggctgggtgcagtggctcatgcctgtaatcccagcactttgggaggccgaggtgggcagatcaccagaggtcgggagttcgagaccagcctgaccaacatggagaaaccctgtctctactaaaaatacaaaattagctgggcatactggcgcatgcctgtaatcacagctattcgggaggctgaggcaggagaattgcttgaacctgggaggcggaggttgcggtgaccgggtgccattgcaccccagcctgggcaacaagtgaaactctatctcaaa

SEQ ID NO: 33897 - DNA, 1865 bp, Homo sapiens
cgatattggagtatgtatccatttacagtatatatccacttactgtttatttccataaaaaactgttctctgtaatgcttacaaagtgatggctaagttatgaattattctactcatctttttcaaatgcccctttttttaaaattgtttatttgcttcatttttattaggtcttcgccaactatagttagtaacaaaagagtcagtaagagaaaatttatcccaccagccttcacaaatgtcagtacaaaatttgaactactcagcctaggagcaacattgaagttagctagtgagttgattcaggtacacaagttaaacaaggatcaagctacagctctaattcaaatagctcaaatgatggcatcacatgaaagcattgaagaagtgaaggaactgcaaactcataccttccctatcacaatcatacatggtgtgtttggagcaggaaagagttacttgctggcagtggtgattttgttctttgtacagctgtttgaaaagagtgaagctcccaccattggaaatgcaaggccgtggaaacttctgatttcttcttctactaatgtggctgttgacagagtacttcttgggcttctcagtcttggatttgaaaactttatcagagttgggagtgttaggaagattgccaaaccaattttaccttatagcttgcatgctggctcagaaaatgaaagtgaacagttaaaagaactacatgcactaatgaaagaagacctgactcctacggaaagagtctatgtgagaaaaagcattgagcagcataaactggggaccaatagaaccctgctgaagcaggtttgagtgtgaaaagctgattcttgttggggatcccaaacagctacctcctactattcagggttctgatgcagctcatgaaaatggattggaacaaactctttttgatcgactttgcttaatgggtcacaagccaattctattgagaactcaataccgttgtcatcctgcaatcagtgctattgctaatgatctgttttacaaaggagccctcatgaatggtgtaacagaaatagagcggagccctttattggaatggctaccaaccctgtgtttttataatgttaaaggactagaacagatagaaagagataacagctttcataatgtggcagaagctacgtttacactcaagctgattcaatcactgattgcaagtggaatagcaggctctatgattggtgtgataacattatacaaatcccagatgtacaagctttgtcatttactcagtgctgtggactttcaccatcctgatattaaaactgtgcaggtgtccacagtagatgcttttcagggagctgaaaaggagatcattattctgtcctgtgtaaggacaagacaagtaggattcattgattcagaaaaaagaatgaatgttgcattgactagaggaaagaggcatttgttgattgtgggaaatttagcctgtttgaggaaaaatcaactttggggacgagtgatccaacactgcgaaggaagggaagatggattgcaacatgcaaaccagtatgaaccacagctgaaccatctccttaaagattattttgaaaaacaagtggaagaaaaacagaagaaaaagagtgaaaaagagaaatctaaagataaatctcattcataaaaagacatggtgtaaatattttgtatttatgtaaattcagactcattttacatgatatattttttatatttttattactctaaaccctcttattaaaaatatgatatttaaataacatagtaaacacatgtaaaaattttgttcttcaaaaaagtgtacaaaaggtagtataaaatcctactaataaaaataagcttttttctaa

SEQ ID NO: 33898 - DNA, 356 bp, Homo sapiens
ttttttttattatctaatgctacatttagcattttaaaagcaagtacaagtgcctgattcttttcttgcatttacctagttttcaagacaatgaatttttccctgtcatcttcaaaatgcgactagttgttaatttttaatatcattaagaacttatgaatttaaacctatctgttgggtttcagttcattaaaatttttatccctttcgaagctcaaattgtcccatatttggtcaaaggggccttttaaaataaactcctgagtctttgaagtgagtctacaaatctttgatagcttccttattatctggtatgtcaagatgttccgactctgttcttttaatggaaaatgaca

SEQ ID NO: 33899 - DNA, 424 bp, Homo sapiens
tgtggtgaatcacctgagaatgcaggatgtgactcagggagtttggggtgggtctgagattctgcatttctcacagactcccaggtaatgctgatgctgccagttcggaaactacattttgagtagcaaggtactagagcactgcattgaaagggatctgaggctacatctgcactcagtggcaaagagtgttgtgatcaattagtaatgtctgccacaggcagagaaatgagctgtgaataatgtgccatctttgccctacaagtctatgttgaaaatgatgcattattcaagaaagaggagggaaaaagtaaggtattgatatcataatatgttatacaagcatacaaatgaatgtcttcatatttttgatagcataaattccaggctgtattgtgttttttaaaaggcaagtttggagaat

SEQ ID NO: 33900 - DNA, 516 bp, Homo sapiens
ctgtgcttcactttggatagttagtttcttttgctatgtcttcaagttcacagatactttttttggcagtatctaatctgctgtcaataccacccagtacatttttcatgtaaaatattgtattttccatctctataatttcaaattgggtctttttatgtcactcttgatcaggttcatgctttcctctatcttcatatacatttacagcatatctgtaatagctgtttaatgtttttgttggcttattttattacttctgtcatgtctggatctgtttttactaagtgacttttctccttgttatgagtcatttttttcccatgcttggaatttataattggatttccagagaatgaaaactttacattgttgttgttgttgttttaaaatattattattcctagccaagtgcggtgtcgcatgcctgtaccctagccctttgggaggctgagacaggtggattgcttgagtccaggagtttgagaccgacctgggcaacatggcaaaactcca

SEQ ID NO: 33901 - DNA, 330 bp, Homo sapiens
aggactccttaattcctagaaatttaacttgaatgaaatctttaacaaaacttagtgccataggaaaaaatatatacatgtatatgtacatacatagttttttcttactttcttattcattctgaaaatctctgccttttaaatgcagtgtttagaccacctacatttaatgcaattattaatttgatagttgttaggtctattatcttatgatttgttttacattcatgccatgtattcattgttgctcttttctttttctcatgtcctatcttcttttaattaatttttttatttaaatttgtctttagttttatcttactatttatt

SEQ ID NO: 33902 - DNA, 501 bp, Homo sapiens
ttgcaattcttttgtagtttccagcccatttcattttcagttgataaggaggagattgctcccaaattttcagaaatggactgtgtaggagtgtgactagggtctcagatgcagccatttcttggctgggtctggggaaaagccaagggatgtgtgctaaaggtagatggacagagggtgggaagtcccttattatttccacttttttctccatctctgactctgccatctctttctgcctctgtactttctgggagctggttctgctgatacttctgctgaatctaaatgctgacctaacttggcaattcttttatgttaggagtcttagctgtgacagttcatccgcttcttcgcccttccatttcacttcttttctccttctctgactgggagaggaggagcctccactcagtatttagaacagagtaaataccttctcctgatcactcctccttccaacctccagaattttttgaaattaaaattcacattctggga

SEQ ID NO: 33903 - DNA, 374 bp, Homo sapiens
ttctgttacagtaatttatcaccatttaattggtttaagtataattaaacaattttgagtaacaaaattttaccataagtgttttgcaggttcaggactgtggagcccttctatattggttccatatccctaaagtgtcatttctttagacctgataaagatcagacacagattgaatagttagttaagatcatgctcgtaggctaggtgcggtggctcactcctgtattcccagcactttgggaggccaaagcaggtgggtcacttgagttcaggagtccgagaccagcctgggcaatgtggcgaaatctcatctctaccaacaaatacaaagattagctgggtgcggtagtgctcacctaggcaaaaaaaaa

SEQ ID NO: 33904 - DNA, 996 bp, Homo sapiens
cttttattatggatgtacagataaaaagttactattttagtttgctaacaagaatgatttttaacaagggtgaccttgttaaaaatcattcttgttagcaaactaaaatagtaacttttattatggatgtacagataaatattaattttattatagttttaagtacttgtgatcatgtactttttgattctaaaatagttgtctaggacaattttgggattcttaattatattttagttaagaaaattgtttaaatatagcaatacaaccaataatttgttttatgtttcactgcatataaatatttccattaaatcaagaatgtatattatctagtttttactatacttattttaaaatttttgaggaatcatagattctaatttttaagaacaaattctgaaggtggtaggattaaaagaatatttccactgatggctaagcaaagaagttgtaagatgactcactgaggaagggactgctttatacatcacagtactgctatttaaaaggaaaacagaaatttttaaatcccttcaaatgtttcacttttgctatgctgggaaaaattttgaagttcttggtaaactgaataatgctaatccatgtttcctgcacattagttcctttaatggcagggaaggccatctggttaacctgtattcacaaactctcaagagtttctacttatttcaggagcttaagaatttagataactcagccgggcgtggtgactcatgcctataatcccagcactttgggaggctgaggcgggtagatcgctagaggcaaggagttcaaaaccagcctgggcaacatggtgaaaccctgtctctactaaaaatacagaaaattatccaggcgtggtggccggcatctgtaattccagctactcagaaggctgaggcataagaattgcttgaacctgggaggtggaggttgcagtgagccaagattgcaccactgcactccagcctgggtgacagagtatgactg

SEQ ID NO: 33905 - DNA, 1955 bp, Homo sapiens
cagagtgattcctttctttatgttgttataaataagacagcacagcataaattaagaggcactcaataaacatctacttataagtgttagaaagcatgtgtgtcaaaattgactacttgtatataaattttcaacttcaaactattccctgttagacttcagttttaaattgtgaaatattccatttaagaaaacaaaatttctttttttaacattggtttgaaaaagatgaaatttacttctcctatatgctctttaagtatatagttattattatttttgctttctcttcctagattttccacagaatgagcctcagatcaagaatcagtttaataagaagctatcaggaagacttgaaaatacaaaacagcaattgcagctgcctcttcatccttcatgggaagcaagcagaaggcgaaaagaacagcaatctaatattgctgtgtttcaggggaaaaaaattacgtttgatgattgattagtgcctctttctgcaaacttttccatctaaaaaaaaaaatgttttttttaagacaggatctcattctgttgcccagactagagtacaatattgcaatcacagctcactgcagcctcaaactcctgggctcaagtgatcctcccacctctgcctcccaaagggctgggactgcaggtgcatgcactaccatgcccagctttctcaccccaggctctgcagctattacttaaactcgtatttgaataagtctcttggggagaattatagaatgtttgtttttgtatttttttttaaagtaaattcaacttacgcttatataagcctttcacaaatccaatatgtacttaaattgatttttaataatatccctcagactgtttcccttatgaagtaatttggggattttagtgatctcatattttctctttagtgcttatcatgaaatgtgcttcactggttcagctctgttgtttccttaaacataaatgtcaatatatatttaaaataataatggaaacataggaaatcagctatttaaaccagatcacccttgttaaaaatcattcttgttagcaaactaaaatagtaacttttattatggatgtacagataaatattaattttattatagttttaagtacttgtgatcatgtactttttgattctaaaatagttgtctaggacaattttgggattcttaattatattttagttaagaaaattgtttaaatatagcaatacaaccaataatttgttttatgtttcactgcatataaatatttccattaaatcaagaatgtatattatctagtttttactatacttattttaaaatttttgaggaatcatagattctaatttttaagaacaaattctgaaggtggtaggattaaaagaatatttccactgatggctaagcaaagaagttgtaagatgactcactgaggaagggactgctttatacatcacagtactgctatttaaaaggaaaacagaaatttttaaatcccttcaaatgtttcacttttgctatgctgggaaaaattttgaagttcttggtaaactgaataatgctaatccatgtttcctgcacattagttcctttaatggcagggaaggccatctggttaacctgtattcacaaactctcaagagtttctacttatttcaggagcttaagaatttagataactcagccgggcgtggtgactcatgcctataatcccagcactttgggaggctgaggcgggtagatcgctagaggcaaggagttcaaaaccagcctgggcaacatggtgaaaccctgtctctactaaaaatacagaaaattatccaggcgtggtggccggcatctgtaattccagctactcagaaggctgaggcataagaattgcttgaacctgggaggtggaggttgcagtgagccaagattgcaccactgcactccagcctgggtgacagagtatgactg

SEQ ID NO: 33906 - DNA, 2823 bp, Homo sapiens
cgcggtctgagagaccggttcacgtgcaggcagcggcggatcatattccttcatctaccatggctcagccgggaactctgaacctcaataacgaggttgtgaagatgagaaaagaagtgaagagaattcgagttttagttatccgaaaacttgtcaggagtgttggccgactgaagtcaaaaaagggtactgaagatgcactgttaaaaaaccaaagacgggcgcaaagattgcttgaagaaatccatgccatgaaggaattgaaacctgacatagtaactaaatctgctcttggtgatgatatcaactttgaaaaaatcttcaaaaagccagattctactgcaactgaaagagcaattgccagactagcagtacatcctcttctgaagaaaaagatagatgtgctaaaagctgctgtacaagcctttaaagaagcaagacaaaatgttgctgaagttgagtcatcaaagaatgcttcagaggacaatcattctgagaatactttgtattcaaatgataatggaagtaatttacagcgtgaagcaactgtcatcagtgagcaaaaagtcaaagaaaccaaaatattggcgaagaaaccaatacataattcaaaggaaaaaatagcaaagatggaacatggacctaaagcagtgactattgcaaattctccatcaaagccttcagaaaaggattctgtagtttcccttgagtcccagaagacacctgctgacccaaaactgaaaactctaagtcaaaccaaaaaaaacaaaggatctgatagctcactctctggtaacagtgatggcggagaagaattttgtgaagaggagaaggaatattttgatgatagcacagaagaaaggttttacaagcagtcttccatgtctgaagatagtgatagcggtgacgacttcttcattgggaaagtcagacggacacgaaagaaggaaagtagttgtcattcttcagttaaggaacaaaaaccactagaaaaagtgtttcttaaagaagatacaggtgaaactcatggggatacaagaaatgacaaaatcaagccaagtacagaaaccagaaagttagaatcagtgtttttccactctttatctggatctaaaagctctagaagaaatttcaaagaacaggctccaaaaacaagatccctagattttccacagaatgagcctcagatcaagaatcagtttaataagaagctatcaggaagacttgaaaatacaaaacagcaattgcagctgcctcttcatccttcatgggaagcaagcagaaggcgaaaagaacagcaatctaatattgctgtgtttcaggggaaaaaaattacgtttgatgattgattagtgcctctttctgcaaacttttccatctaaaaaaaaaaatgttttttttaagacaggatctcattctgttgcccagactagagtacaatattgcaatcacagctcactgcagcctcaaactcctgggctcaagtgatcctcccacctctgcctcccaaagggctgggactgcaggtgcatgcactaccatgcccagctttctcaccccaggctctgcagctattacttaaactcgtatttgaataagtctcttggggagaattatagaatgtttgtttttgtatttttttttaaagtaaattcaacttacgcttatataagcctttcacaaatccaatatgtacttaaattgatttttaataatatccctcagactgtttcccttatgaagtaatttggggattttagtgatctcatattttctctttagtgcttatcatgaaatgtgcttcactggttcagctctgttgtttccttaaacataaatgtcaatatatatttaaaataataatggaaacataggaaatcagctatttaaaccagatcacccttgttaaaaatcattcttgttagcaaactaaaatagtaacttttattatggatgtacagataaatattaattttattatagttttaagtacttgtgatcatgtactttttgattctaaaatagttgtctaggacaattttgggattcttaattatattttagttaagaaaattgtttaaatatagcaatacaaccaataatttgttttatgtttcactgcatataaatatttccattaaatcaagaatgtatattatctagtttttactatacttattttaaaatttttgaggaatcatagattctaatttttaagaacaaattctgaaggtggtaggattaaaagaatatttccactgatggctaagcaaagaagttgtaagatgactcactgaggaagggactgctttatacatcacagtactgctatttaaaaggaaaacagaaatttttaaatcccttcaaatgtttcacttttgctatgctgggaaaaattttgaagttcttggtaaactgaataatgctaatccatgtttcctgcacattagttcctttaatggcagggaaggccatctggttaacctgtattcacaaactctcaagagtttctacttatttcaggagcttaagaatttagataactcagccgggcgtggtgactcatgcctataatcccagcactttgggaggctgaggcgggtagatcgctagaggcaaggagttcaaaaccagcctgggcaacatggtgaaaccctgtctctactaaaaatacagaaaattatccaggcgtggtggccggcatctgtaattccagctactcagaaggctgaggcataagaattgcttgaacctgggaggtggaggttgcagtgagccaagattgcaccactgcactccagcctgggtgacagagtatgactg

SEQ ID NO: 33907 - DNA, 3955 bp, Homo sapiens
ggccgcgtccccgccggccctgcagacgtggcggggcgggacccgctgggcactcccgcgcgtactcggccgcctgagcgatactaaaatgtctgatgatgctggtgacaccttagccactggagacaaagcagaagttactgagatgcctaatagtgattctttacctgaggatgcagaagtgcattgtgattcagctgcagtttcacatgagccaacaccagctgaccccagaggggaggggcatgaaaatgcagctgtgcagggtgcaggggctgccgccattgggccccctgtgcagcctcaggatgccaacgccctggagccccctctcaatggagacgtgactgaggatacacttgctgaatgtattgattccgtcagccttgaggcagaacccagatccgaaatacccctgcaagaacagaattatctggctgtggattcccctccaagtggaggaggatgggcaggctggggatcctggggcaaatctctgctgtcgtcagcatctgccacagtaggtcatggattgacggcagtcaaggaaaaagcaggagccactctacggattcatggtgtaaattctggatcttctgaaggagcccaaccaaatactgaaaacggagtccctgaaataacagatgcagccacagatcagggccctgcagaaagcccacccacttccccttcatcagcctctcggggtatgctgtctgccatcaccaatgtggttcaaaacacaggtaaaagtgtcttaactggaggccttgatgcgttggaattcatcggcaagaaaaccatgaatgtccttgcagaaagtgacccgggctttaagcggaccaagacgctcatggagagaactgtttccttgtctcagatgttaagggaagctaaggagaaggagaagcagagactggcacagcagctcacgatggagagaaccgcgcactacgggatgctgtttgatgaatatcaaggcttgtcacacctggaagccctggaaattctgtccaatgaaagcgaaagcaaggttcagtcatttttagcatcacttgatggagagaagctggaactcttaaaaaatgacctaatttccattaaagacatctttgcagccaaagaattagagaatgaagaaaatcaagaagaacaaggcttagaagaaaagggagaagaatttgctcgcatgcttacagagcttctctttgaattacatgtggcggccacacctgacaaactcaataaggccatgaagagggctcatgactgggtggaagaggatcaaaccgtggtgtcagtagatgtggcaaaagtgtccgaagaagaaacaaagaaggaagaaaaggaagagaaatctcaagaccctcaagaagacaaaaaggaggaaaagaaaactaagaccatagaggaagtatacatgtcgtccattgaaagtctggcggaggtaacagcgcgctgtattgagcagcttcataaagtagcagaattaattcttcatggacaagaagaggaaaaaccagctcaggaccaagcaaaagttctaataaaattaactactgcaatgtgcaatgaagtggcctccttatcaaagaagtttacgaattctttaaccactgttgggagcaacaagaaggccgaggtccttaaccccatgatcagtagtgtattgttagagggctgcaacagtacaacgtacatacaggatgccttccagctgctgctgcctgttctgcaggtctcacatatccagaccagttgtttgaaagcacagccgtgacctggccagactccatctagttaaaggagacagctggccgccttgcctcaatatgtaccatttaaggggatgttctctgtgcgcctggccacagacatccatttgaggacactacaagcaattttgcacagacaatattgagaatgcaaatttagagagagttatcatttctctcaatgtgtataattgtttttacaaacaattgtgttttctttatgttaatttaaacttacacagcttatattgaaaatttcctttcatctgaaatttatttacaaatattcgtgttcattttcctggttaagcatgctatatttagaaactcatggggagaccttagacttttgtttaatcctttatgtttcaacctttaaatgttccattcttatagtattactttaaatcaattctaaaactgaactttgttttgttacataaatgtcgcaggcaaaaataacactacttatagattttacctattatggtaaaaaataggaacatattgtcattctttttttttttttttttttgagacagagtctcactctgtcgccaggctggagtgcgttggcacaatctcggctcactgcaacctccgcctcctgggttcaatcgattctcctgcctcagcctcctgagtagctgggactacaggtgtgtgccaccacgcccagccaattttttttgtatttttagtagagacagggtttcaccatgttggccaggatggtctcgatctcctgacctcgtgatctgcccgcctcagcctcccaaagtgctgggattacaggcttgagccactgcgcccggccggtcattcattcttgcaacaagcatttattgagcacctactgtgtgctcacagtaaagaaacgtgatcttatcccagtagaggtagatattctgaaaaagaataattcttaaactgcttaaaacaggggtccccacccccaggccacagaccagtaccagtccgtggcactggttaggaaccaggccacacagcagggggtgagcggtgggtgagtgagcacagcttcatctgtatttacagctgctccccagagcttgcattactgcctgagctctgcctcccgtcaggtcagcagcagcattagagtctcatgggagtgcgaaccctgttgtgaactgcacatgcgagggatctaggttgtgcactccttatgagaatctaatgcctgatgaatctaatgcctcatgatctgaggttgaatagcttcgtgccgaaaccatcccccacccccatcccgctaccccgagtccgtgaaaaaattgtcttccatgaaaccggtccctggtaccagaaaggttggggaccactggcttaaaataccaataaatttttgaaccttaaaaactttgaagaacaaggtaaattggtgttttatttaatgtcctaccctttaatttgttgcattttcctatactctttacactattttatcccaaactatgtatatgaggtgaaaatatatatgaaaagggatactgaagaatatttagtttaaaattaatttcttacgatcacgagcacatggtggcataattacaaagcttggaagtattcaaatagaaaatcaaaggtgtttcaatacagtagaatcccaggactgcattttaaaatcgcctcacagatcacactcgctggtggcaaatatcatcatcgttgctaaaggacagaaaatactgatgtgtgttttaactaactggtatattgatccatgggaggctgcacagaagaccctgcggccaggaggggcattgtcagtggctgcttctcctgagctccacgccttcattgcagctgcatgttcgatacaatacacctgcttcacagccccatggacatccctacaggtactgtcatgtgaagccttgcctagtagttctctccagggcaaatgaagctcacagttttgcaaggtggaaacctcttattcacatttgctttgattccccgatggagtagactgcctttgttccatacaggcaaagtaaggatattttaatatcatcctacttcttattagcatttcatttgtctatgtactgtatttcatttgtatgtctcctgaaacatccaaatagagaacataagaacactttatgtacaatctggaaaaaaattacctgagaaatcaattaaagattttt

SEQ ID NO: 33908 - DNA, 4021 bp, Homo sapiens
acccacgccctgtctgttctttcagtccagccaacactctatgcaggcaccgcctccactcgcagcccccgggatgggtcccactctctaccgcagatccccaggccccctccacccagtcgggtagccctcgcctctgccatccgatactaaaatgtctgatgatgctggtgacaccttagccactggagacaaagcagaagttactgagatgcctaatagtgattctttacctgaggatgcagaagtgcattgtgattcagctgcagtttcacatgagccaacaccagctgaccccagaggggaggggcatgaaaatgcagctgtgcagggtgcaggggctgccgccattgggccccctgtgcagcctcaggatgccaacgccctggagccccctctcaatggagacgtgactgaggatacacttgctgaatgtattgattccgtcagccttgaggcagaacccagatccgaaatacccctgcaagaacagaattatctggctgtggattcccctccaagtggaggaggatgggcaggctggggatcctggggcaaatctctgctgtcgtcagcatctgccacagtaggtcatggattgacggcagtcaaggaaaaagcaggagccactctacggattcatggtgtaaattctggatcttctgaaggagcccaaccaaatactgaaaacggagtccctgaaataacagatgcagccacagatcagggccctgcagaaagcccacccacttccccttcatcagcctctcggggtatgctgtctgccatcaccaatgtggttcaaaacacaggtaaaagtgtcttaactggaggccttgatgcgttggaattcatcggcaagaaaaccatgaatgtccttgcagaaagtgacccgggctttaagcggaccaagacgctcatggagagaactgtttccttgtctcagatgttaagggaagctaaggagaaggagaagcagagactggcacagcagctcacgatggagagaaccgcgcactacgggatgctgtttgatgaatatcaaggcttgtcacacctggaagccctggaaattctgtccaatgaaagcgaaagcaaggttcagtcatttttagcatcacttgatggagagaagctggaactcttaaaaaatgacctaatttccattaaagacatctttgcagccaaagaattagagaatgaagaaaatcaagaagaacaaggcttagaagaaaagggagaagaatttgctcgcatgcttacagagcttctctttgaattacatgtggcggccacacctgacaaactcaataaggccatgaagagggctcatgactgggtggaagaggatcaaaccgtggtgtcagtagatgtggcaaaagtgtccgaagaagaaacaaagaaggaagaaaaggaagagaaatctcaagaccctcaagaagacaaaaaggaggaaaagaaaactaagaccatagaggaagtatacatgtcgtccattgaaagtctggcggaggtaacagcgcgctgtattgagcagcttcataaagtagcagaattaattcttcatggacaagaagaggaaaaaccagctcaggaccaagcaaaagttctaataaaattaactactgcaatgtgcaatgaagtggcctccttatcaaagaagtttacgaattctttaaccactgttgggagcaacaagaaggccgaggtccttaaccccatgatcagtagtgtattgttagagggctgcaacagtacaacgtacatacaggatgccttccagctgctgctgcctgttctgcaggtctcacatatccagaccagttgtttgaaagcacagccgtgacctggccagactccatctagttaaaggagacagctggccgccttgcctcaatatgtaccatttaaggggatgttctctgtgcgcctggccacagacatccatttgaggacactacaagcaattttgcacagacaatattgagaatgcaaatttagagagagttatcatttctctcaatgtgtataattgtttttacaaacaattgtgttttctttatgttaatttaaacttacacagcttatattgaaaatttcctttcatctgaaatttatttacaaatattcgtgttcattttcctggttaagcatgctatatttagaaactcatggggagaccttagacttttgtttaatcctttatgtttcaacctttaaatgttccattcttatagtattactttaaatcaattctaaaactgaactttgttttgttacataaatgtcgcaggcaaaaataacactacttatagattttacctattatggtaaaaaataggaacatattgtcattctttttttttttttttttttgagacagagtctcactctgtcgccaggctggagtgcgttggcacaatctcggctcactgcaacctccgcctcctgggttcaatcgattctcctgcctcagcctcctgagtagctgggactacaggtgtgtgccaccacgcccagccaattttttttgtatttttagtagagacagggtttcaccatgttggccaggatggtctcgatctcctgacctcgtgatctgcccgcctcagcctcccaaagtgctgggattacaggcttgagccactgcgcccggccggtcattcattcttgcaacaagcatttattgagcacctactgtgtgctcacagtaaagaaacgtgatcttatcccagtagaggtagatattctgaaaaagaataattcttaaactgcttaaaacaggggtccccacccccaggccacagaccagtaccagtccgtggcactggttaggaaccaggccacacagcagggggtgagcggtgggtgagtgagcacagcttcatctgtatttacagctgctccccagagcttgcattactgcctgagctctgcctcccgtcaggtcagcagcagcattagagtctcatgggagtgcgaaccctgttgtgaactgcacatgcgagggatctaggttgtgcactccttatgagaatctaatgcctgatgaatctaatgcctcatgatctgaggttgaatagcttcgtgccgaaaccatcccccacccccatcccgctaccccgagtccgtgaaaaaattgtcttccatgaaaccggtccctggtaccagaaaggttggggaccactggcttaaaataccaataaatttttgaaccttaaaaactttgaagaacaaggtaaattggtgttttatttaatgtcctaccctttaatttgttgcattttcctatactctttacactattttatcccaaactatgtatatgaggtgaaaatatatatgaaaagggatactgaagaatatttagtttaaaattaatttcttacgatcacgagcacatggtggcataattacaaagcttggaagtattcaaatagaaaatcaaaggtgtttcaatacagtagaatcccaggactgcattttaaaatcgcctcacagatcacactcgctggtggcaaatatcatcatcgttgctaaaggacagaaaatactgatgtgtgttttaactaactggtatattgatccatgggaggctgcacagaagaccctgcggccaggaggggcattgtcagtggctgcttctcctgagctccacgccttcattgcagctgcatgttcgatacaatacacctgcttcacagccccatggacatccctacaggtactgtcatgtgaagccttgcctagtagttctctccagggcaaatgaagctcacagttttgcaaggtggaaacctcttattcacatttgctttgattccccgatggagtagactgcctttgttccatacaggcaaagtaaggatattttaatatcatcctacttcttattagcatttcatttgtctatgtactgtatttcatttgtatgtctcctgaaacatccaaatagagaacataagaacactttatgtacaatctggaaaaaaattacctgagaaatcaattaaagattttt

SEQ ID NO: 33909 - DNA, 4169 bp, Homo sapiens
ggccgcgtccccgccggccctgcagacgtggcggggcgggacccgctgggcactcccgcgcgtactcggccgcctgagcgatactaaaatgtctgatgatgctggtgacaccttagccactggagacaaagcagaagttactgagatgcctaatagtgattctttacctgaggatgcagaagtgcattgtgattcagctgcagtttcacatgagccaacaccagctgaccccagaggggaggggcatgaaaatgcagctgtgcagggtgcaggggctgccgccattgggccccctgtgcagcctcaggatgccaacgccctggagccccctctcaatggagacgtgactgaggatacacttgctgaatgtattgattccgtcagccttgaggcagaacccagatccgaaatacccctgcaagaacagaattatctggctgtggattcccctccaagtggaggaggatgggcaggctggggatcctggggcaaatctctgctgtcgtcagcatctgccacagtaggtcatggattgacggcagtcaaggaaaaagcaggagccactctacggattcatggtgtaaattctggatcttctgaaggagcccaaccaaatactgaaaacggagtccctgaaataacagatgcagccacagatcagggccctgcagaaagcccacccacttccccttcatcagcctctcggggtatgctgtctgccatcaccaatgtggttcaaaacacaggtaaaagtgtcttaactggaggccttgatgcgttggaattcatcggcaagaaaaccatgaatgtccttgcagaaagtgacccgggctttaagcggaccaagacgctcatggagagaactgtttccttgtctcagatgttaagggaagctaaggagaaggagaagcagagactggcacagcagctcacgatggagagaaccgcgcactacgggatgctgtttgatgaatatcaaggcttgtcacacctggaagccctggaaattctgtccaatgaaagcgaaagcaaggttcagtcatttttagcatcacttgatggagagaagctggaactcttaaaaaatgacctaatttccattaaagacatctttgcagccaaagaattagagaatgaagaaaatcaagaagaacaaggcttagaagaaaagggagaagaatttgctcgcatgcttacagagcttctctttgaattacatgtggcggccacacctgacaaactcaataaggccatgaagagggctcatgactgggtggaagaggatcaaaccgtggtgtcagtagatgtggcaaaagtgtccgaagaagaaacaaagaaggaagaaaaggaagagaaatctcaagaccctcaagaagacaaaaaggaggaaaagaaaactaagaccatagaggaagtatacatgtcgtccattgaaagtctggcggaggtaacagcgcgctgtattgagcagcttcataaagtagcagaattaattcttcatggacaagaagaggaaaaaccagctcaggaccaagcaaaagttctaataaaattaactactgcaatgtgcaatgaagtggcctccttatcaaagaagtttacgaattctttaaccactgttgggagcaacaagaaggccgaggtccttaaccccatgatcagtagtgtattgttagagggctgcaacagtacaacgtacatacaggatgccttccagctgctgctgcctgttctgcaggtctcacatatccagaccagttgtttgaaagcacagccgtgacctggccagactccatctagttaaaggagacagctggccgccttgcctcaatatgtaccatttaaggggatgttctctgtgcgcctggccacagacatccatttgaggacactacaagcaattttgcacagacaatattgagaatgcaaatttagagagagttatcatttctctcaatgtgtataattgtttttacaaacaattgtgttttctttatgttaatttaaacttacacagcttatattgaaaatttcctttcatctgaaatttatttacaaatattcgtgttcattttcctggttaagcatgctatatttagaaactcatggggagaccttagacttttgtttaatcctttatgtttcaacctttaaatgttccattcttatagtattactttaaatcaattctaaaactgaactttgttttgttacataaatgtcgcaggcaaaaataacactacttatagattttacctattatggtaaaaaataggaacatattgtcattctttttttttttttttttttgagacagagtctcactctgtcgccaggctggagtgcgttggcacaatctcggctcactgcaacctccgcctcctgggttcaatcgattctcctgcctcagcctcctgagtagctgggactacaggtgtgtgccaccacgcccagccaattttttttgtatttttagtagagacagggtttcaccatgttggccaggatggtctcgatctcctgacctcgtgatctgcccgcctcagcctcccaaagtgctgggattacaggcttgagccactgcgcccggccggtcattcattcttgcaacaagcatttattgagcacctactgtgtgctcacagtaaagaaacgtgatcttatcccagtagaggtagatattctgaaaaagaataattcttaaactgcttaaaacaggggtccccacccccaggccacagaccagtaccagtccgtggcactggttaggaaccaggccacacagcagggggtgagcggtgggtgagtgagcacagcttcatctgtatttacagctgctccccagagcttgcattactgcctgagctctgcctcccgtcaggtcagcagcagcattagagtctcatgggagtgcgaaccctgttgtgaactgcacatgcgagggatctaggttgtgcactccttatgagaatctaatgcctgatgaatctaatgcctcatgatctgaggttgaatagcttcgtgccgaaaccatcccccacccccatcccgctaccccgagtccgtgaaaaaattgtcttccatgaaaccggtccctggtaccagaaaggttggggaccactggcttaaaataccaataaatttttgaaccttaaaaactttgaagaacaaggtaaattggtgttttatttaatgtcctaccctttaatttgttgcattttcctatactctttacactattttatcccaaactatgtatatgaggtgaaaatatatatgaaaagggatactgaagaatatttagtttaaaattaatttcttacgatcacgagcacatggtggcataattacaaagcttggaagtattcaaatagaaaatcaaaggtgtttcaatacagtagaatcccaggactgcattttaaaatcgcctcacagatcacactcgctggtggcaaatatcatcatcgttgctaaaggacagaaaatactgatgtgtgttttaactaactggtatattgatccatgggaggctgcacagaagaccctgcggccaggaggggcattgtcagtggctgcttctcctgagctccacgccttcattgcagctgcatgttcgatacaatacacctgcttcacagccccatggacatccctacaggtactgtcatgtgaagccttgcctagtagttctctccagggcaaatgaagctcacagttttgcaaggtggaaacctcttattcacatttgctttgattccccgatggagtagactgcctttgttccatacaggcaaagtaaggatattttaatatcatcctacttcttattagcatttcatttgtctatgtactgtatttcatttgtatgtctcctgaaacatccaaatagagaacataagaacactttatgtacaatctggaaaaaaattacctgagaaatcaattaaagattttttaccccctgttaaggaacaacagaccacaccacaacaatctctgtgcggcgcgcctcgcgcccaggaaaaggtttaaaaccatgcgggggggggccgcgcgccaagaggcggtaggaaacagggcaaaacgtgcctagggaacacccggcaaggcaagcgtgggttccccaaaaaacgcgcggggacggcggcgacaccaagggtcgagaaacg

SEQ ID NO: 33910 - DNA, 3468 bp, Homo sapiens
tgatatgtgaggtattgtgttagatactctaggattcaagagtgagcagaagaaatactgtctctgtccctcagtagcttccagggtgaaaggaagacagatcattaagaaatattgtaggaccagccaggtatcctagggaaccttgggaaatttctccagagagatggttgagactaattcggtttattcagcactgtggctctgtggacataaaagggcacctgggtaccattagggttgcaatgctaagcataacaatatcgaagtcataaatatgatgttgtcccaggtctcttaggcctgagaaaggtcatgcctttgttcatcccagtccttctttcagcaaatagctgctgaccacctacagctgtgaacaagacaagcgaggtccctccctgacctcttgttgcctttgggttgtcctgggggtgtccctgctggagctgccaaacagcaagacttcagcggccctgcacccggatgcatctgctgcctcactgccatgctcacgaatggaagacattcatcttttgcccagcggctggcgggcaggctgctacaacctccacttagtctaccccagctgcaggctgtaatgttgggggagctgccacatcctgaaggatgaaaaataaatcacgcttcttctgtcgtgttctatttctaggcttagaagaaaagggagaagaatttgctcgcatgcttacagagcttctctttgaattacatgtggcggccacacctgacaaactcaataaggccatgaagagggctcatgactgggtggaagaggatcaaaccgtggtgtcagtagatgtggcaaaagtgtccgaagaagaaacaaagaaggaagaaaaggaagagaaatctcaagaccctcaagaagacaaaaaggaggaaaagaaaactaagaccatagaggaagtatacatgtcgtccattgaaagtctggcggaggtaacagcgcgctgtattgagcagcttcataaagtagcagaattaattcttcatggacaagaagaggaaaaaccagctcaggaccaagcaaaagttctaataaaattaactactgcaatgtgcaatgaagtggcctccttatcaaagaagtttacgaattctttaaccactgttgggagcaacaagaaggccgaggtccttaaccccatgatcagtagtgtattgttagagggctgcaacagtacaacgtacatacaggatgccttccagctgctgctgcctgttctgcaggtctcacatatccagaccagttgtttgaaagcacagccgtgacctggccagactccatctagttaaaggagacagctggccgccttgcctcaatatgtaccatttaaggggatgttctctgtgcgcctggccacagacatccatttgaggacactacaagcaattttgcacagacaatattgagaatgcaaatttagagagagttatcatttctctcaatgtgtataattgtttttacaaacaattgtgttttctttatgttaatttaaacttacacagcttatattgaaaatttcctttcatctgaaatttatttacaaatattcgtgttcattttcctggttaagcatgctatatttagaaactcatggggagaccttagacttttgtttaatcctttatgtttcaacctttaaatgttccattcttatagtattactttaaatcaattctaaaactgaactttgttttgttacataaatgtcgcaggcaaaaataacactacttatagattttacctattatggtaaaaaataggaacatattgtcattctttttttttttttttttttgagacagagtctcactctgtcgccaggctggagtgcgttggcacaatctcggctcactgcaacctccgcctcctgggttcaatcgattctcctgcctcagcctcctgagtagctgggactacaggtgtgtgccaccacgcccagccaattttttttgtatttttagtagagacagggtttcaccatgttggccaggatggtctcgatctcctgacctcgtgatctgcccgcctcagcctcccaaagtgctgggattacaggcttgagccactgcgcccggccggtcattcattcttgcaacaagcatttattgagcacctactgtgtgctcacagtaaagaaacgtgatcttatcccagtagaggtagatattctgaaaaagaataattcttaaactgcttaaaacaggggtccccacccccaggccacagaccagtaccagtccgtggcactggttaggaaccaggccacacagcagggggtgagcggtgggtgagtgagcacagcttcatctgtatttacagctgctccccagagcttgcattactgcctgagctctgcctcccgtcaggtcagcagcagcattagagtctcatgggagtgcgaaccctgttgtgaactgcacatgcgagggatctaggttgtgcactccttatgagaatctaatgcctgatgaatctaatgcctcatgatctgaggttgaatagcttcgtgccgaaaccatcccccacccccatcccgctaccccgagtccgtgaaaaaattgtcttccatgaaaccggtccctggtaccagaaaggttggggaccactggcttaaaataccaataaatttttgaaccttaaaaactttgaagaacaaggtaaattggtgttttatttaatgtcctaccctttaatttgttgcattttcctatactctttacactattttatcccaaactatgtatatgaggtgaaaatatatatgaaaagggatactgaagaatatttagtttaaaattaatttcttacgatcacgagcacatggtggcataattacaaagcttggaagtattcaaatagaaaatcaaaggtgtttcaatacagtagaatcccaggactgcattttaaaatcgcctcacagatcacactcgctggtggcaaatatcatcatcgttgctaaaggacagaaaatactgatgtgtgttttaactaactggtatattgatccatgggaggctgcacagaagaccctgcggccaggaggggcattgtcagtggctgcttctcctgagctccacgccttcattgcagctgcatgttcgatacaatacacctgcttcacagccccatggacatccctacaggtactgtcatgtgaagccttgcctagtagttctctccagggcaaatgaagctcacagttttgcaaggtggaaacctcttattcacatttgctttgattccccgatggagtagactgcctttgttccatacaggcaaagtaaggatattttaatatcatcctacttcttattagcatttcatttgtctatgtactgtatttcatttgtatgtctcctgaaacatccaaatagagaacataagaacactttatgtacaatctggaaaaaaattacctgagaaatcaattaaagattttt

SEQ ID NO: 33911 - DNA, 2568 bp, Homo sapiens
cttgcttgtgtctattcatttcaggaagtatacatgtcgtccattgaaagtctggcggaggtaacagcgcgctgtattgagcagcttcataaagtagcagaattaattcttcatggacaagaagaggaaaaaccagctcaggaccaagcaaaagttctaataaaattaactactgcaatgtgcaatgaagtggcctccttatcaaagaagtttacgaattctttaaccactgttgggagcaacaagaaggccgaggtccttaaccccatgatcagtagtgtattgttagagggctgcaacagtacaacgtacatacaggatgccttccagctgctgctgcctgttctgcaggtctcacatatccagaccagttgtttgaaagcacagccgtgacctggccagactccatctagttaaaggagacagctggccgccttgcctcaatatgtaccatttaaggggatgttctctgtgcgcctggccacagacatccatttgaggacactacaagcaattttgcacagacaatattgagaatgcaaatttagagagagttatcatttctctcaatgtgtataattgtttttacaaacaattgtgttttctttatgttaatttaaacttacacagcttatattgaaaatttcctttcatctgaaatttatttacaaatattcgtgttcattttcctggttaagcatgctatatttagaaactcatggggagaccttagacttttgtttaatcctttatgtttcaacctttaaatgttccattcttatagtattactttaaatcaattctaaaactgaactttgttttgttacataaatgtcgcaggcaaaaataacactacttatagattttacctattatggtaaaaaataggaacatattgtcattctttttttttttttttttttgagacagagtctcactctgtcgccaggctggagtgcgttggcacaatctcggctcactgcaacctccgcctcctgggttcaatcgattctcctgcctcagcctcctgagtagctgggactacaggtgtgtgccaccacgcccagccaattttttttgtatttttagtagagacagggtttcaccatgttggccaggatggtctcgatctcctgacctcgtgatctgcccgcctcagcctcccaaagtgctgggattacaggcttgagccactgcgcccggccggtcattcattcttgcaacaagcatttattgagcacctactgtgtgctcacagtaaagaaacgtgatcttatcccagtagaggtagatattctgaaaaagaataattcttaaactgcttaaaacaggggtccccacccccaggccacagaccagtaccagtccgtggcactggttaggaaccaggccacacagcagggggtgagcggtgggtgagtgagcacagcttcatctgtatttacagctgctccccagagcttgcattactgcctgagctctgcctcccgtcaggtcagcagcagcattagagtctcatgggagtgcgaaccctgttgtgaactgcacatgcgagggatctaggttgtgcactccttatgagaatctaatgcctgatgaatctaatgcctcatgatctgaggttgaatagcttcgtgccgaaaccatcccccacccccatcccgctaccccgagtccgtgaaaaaattgtcttccatgaaaccggtccctggtaccagaaaggttggggaccactggcttaaaataccaataaatttttgaaccttaaaaactttgaagaacaaggtaaattggtgttttatttaatgtcctaccctttaatttgttgcattttcctatactctttacactattttatcccaaactatgtatatgaggtgaaaatatatatgaaaagggatactgaagaatatttagtttaaaattaatttcttacgatcacgagcacatggtggcataattacaaagcttggaagtattcaaatagaaaatcaaaggtgtttcaatacagtagaatcccaggactgcattttaaaatcgcctcacagatcacactcgctggtggcaaatatcatcatcgttgctaaaggacagaaaatactgatgtgtgttttaactaactggtatattgatccatgggaggctgcacagaagaccctgcggccaggaggggcattgtcagtggctgcttctcctgagctccacgccttcattgcagctgcatgttcgatacaatacacctgcttcacagccccatggacatccctacaggtactgtcatgtgaagccttgcctagtagttctctccagggcaaatgaagctcacagttttgcaaggtggaaacctcttattcacatttgctttgattccccgatggagtagactgcctttgttccatacaggcaaagtaaggatattttaatatcatcctacttcttattagcatttcatttgtctatgtactgtatttcatttgtatgtctcctgaaacatccaaatagagaacataagaacactttatgtacaatctggaaaaaaattacctgagaaatcaattaaagattttt

SEQ ID NO: 33912 - DNA, 2569 bp, Homo sapiens
gtacccctagtttagaagtgtcatagaagtatacatgtcgtccattgaaagtctggcggaggtaacagcgcgctgtattgagcagcttcataaagtagcagaattaattcttcatggacaagaagaggaaaaaccagctcaggaccaagcaaaagttctaataaaattaactactgcaatgtgcaatgaagtggcctccttatcaaagaagtttacgaattctttaaccactgttgggagcaacaagaaggccgaggtccttaaccccatgatcagtagtgtattgttagagggctgcaacagtacaacgtacatacaggatgccttccagctgctgctgcctgttctgcaggtctcacatatccagaccagttgtttgaaagcacagccgtgacctggccagactccatctagttaaaggagacagctggccgccttgcctcaatatgtaccatttaaggggatgttctctgtgcgcctggccacagacatccatttgaggacactacaagcaattttgcacagacaatattgagaatgcaaatttagagagagttatcatttctctcaatgtgtataattgtttttacaaacaattgtgttttctttatgttaatttaaacttacacagcttatattgaaaatttcctttcatctgaaatttatttacaaatattcgtgttcattttcctggttaagcatgctatatttagaaactcatggggagaccttagacttttgtttaatcctttatgtttcaacctttaaatgttccattcttatagtattactttaaatcaattctaaaactgaactttgttttgttacataaatgtcgcaggcaaaaataacactacttatagattttacctattatggtaaaaaataggaacatattgtcattctttttttttttttttttttgagacagagtctcactctgtcgccaggctggagtgcgttggcacaatctcggctcactgcaacctccgcctcctgggttcaatcgattctcctgcctcagcctcctgagtagctgggactacaggtgtgtgccaccacgcccagccaattttttttgtatttttagtagagacagggtttcaccatgttggccaggatggtctcgatctcctgacctcgtgatctgcccgcctcagcctcccaaagtgctgggattacaggcttgagccactgcgcccggccggtcattcattcttgcaacaagcatttattgagcacctactgtgtgctcacagtaaagaaacgtgatcttatcccagtagaggtagatattctgaaaaagaataattcttaaactgcttaaaacaggggtccccacccccaggccacagaccagtaccagtccgtggcactggttaggaaccaggccacacagcagggggtgagcggtgggtgagtgagcacagcttcatctgtatttacagctgctccccagagcttgcattactgcctgagctctgcctcccgtcaggtcagcagcagcattagagtctcatgggagtgcgaaccctgttgtgaactgcacatgcgagggatctaggttgtgcactccttatgagaatctaatgcctgatgaatctaatgcctcatgatctgaggttgaatagcttcgtgccgaaaccatcccccacccccatcccgctaccccgagtccgtgaaaaaattgtcttccatgaaaccggtccctggtaccagaaaggttggggaccactggcttaaaataccaataaatttttgaaccttaaaaactttgaagaacaaggtaaattggtgttttatttaatgtcctaccctttaatttgttgcattttcctatactctttacactattttatcccaaactatgtatatgaggtgaaaatatatatgaaaagggatactgaagaatatttagtttaaaattaatttcttacgatcacgagcacatggtggcataattacaaagcttggaagtattcaaatagaaaatcaaaggtgtttcaatacagtagaatcccaggactgcattttaaaatcgcctcacagatcacactcgctggtggcaaatatcatcatcgttgctaaaggacagaaaatactgatgtgtgttttaactaactggtatattgatccatgggaggctgcacagaagaccctgcggccaggaggggcattgtcagtggctgcttctcctgagctccacgccttcattgcagctgcatgttcgatacaatacacctgcttcacagccccatggacatccctacaggtactgtcatgtgaagccttgcctagtagttctctccagggcaaatgaagctcacagttttgcaaggtggaaacctcttattcacatttgctttgattccccgatggagtagactgcctttgttccatacaggcaaagtaaggatattttaatatcatcctacttcttattagcatttcatttgtctatgtactgtatttcatttgtatgtctcctgaaacatccaaatagagaacataagaacactttatgtacaatctggaaaaaaattacctgagaaatcaattaaagattttt

SEQ ID NO: 33913 - DNA, 2380 bp, Homo sapiens
ggacgcgtgggtcgacccacgcgtccggaattctttaaccactgttgggagcaacaagaaggccgaggtccttaaccccatgatcagtagtgtattgttagagggctgcaacagtacaacgtacatacaggatgccttccagctgctgctgcctgttctgcaggtctcacatatccagaccagttgtttgaaagcacagccgtgacctggccagactccatctagttaaaggagacagctggccgccttgcctcaatatgtaccatttaaggggatgttctctgtgcgcctggccacagacatccatttgaggacactacaagcaattttgcacagacaatattgagaatgcaaatttagagagagttatcatttctctcaatgtgtataattgtttttacaaacaattgtgttttctttatgttaatttaaacttacacagcttatattgaaaatttcctttcatctgaaatttatttacaaatattcgtgttcattttcctggttaagcatgctatatttagaaactcatggggagaccttagacttttgtttaatcctttatgtttcaacctttaaatgttccattcttatagtattactttaaatcaattctaaaactgaactttgttttgttacataaatgtcgcaggcaaaaataacactacttatagattttacctattatggtaaaaaataggaacatattgtcattctttttttttttttttttttgagacagagtctcactctgtcgccaggctggagtgcgttggcacaatctcggctcactgcaacctccgcctcctgggttcaatcgattctcctgcctcagcctcctgagtagctgggactacaggtgtgtgccaccacgcccagccaattttttttgtatttttagtagagacagggtttcaccatgttggccaggatggtctcgatctcctgacctcgtgatctgcccgcctcagcctcccaaagtgctgggattacaggcttgagccactgcgcccggccggtcattcattcttgcaacaagcatttattgagcacctactgtgtgctcacagtaaagaaacgtgatcttatcccagtagaggtagatattctgaaaaagaataattcttaaactgcttaaaacaggggtccccacccccaggccacagaccagtaccagtccgtggcactggttaggaaccaggccacacagcagggggtgagcggtgggtgagtgagcacagcttcatctgtatttacagctgctccccagagcttgcattactgcctgagctctgcctcccgtcaggtcagcagcagcattagagtctcatgggagtgcgaaccctgttgtgaactgcacatgcgagggatctaggttgtgcactccttatgagaatctaatgcctgatgaatctaatgcctcatgatctgaggttgaatagcttcgtgccgaaaccatcccccacccccatcccgctaccccgagtccgtgaaaaaattgtcttccatgaaaccggtccctggtaccagaaaggttggggaccactggcttaaaataccaataaatttttgaaccttaaaaactttgaagaacaaggtaaattggtgttttatttaatgtcctaccctttaatttgttgcattttcctatactctttacactattttatcccaaactatgtatatgaggtgaaaatatatatgaaaagggatactgaagaatatttagtttaaaattaatttcttacgatcacgagcacatggtggcataattacaaagcttggaagtattcaaatagaaaatcaaaggtgtttcaatacagtagaatcccaggactgcattttaaaatcgcctcacagatcacactcgctggtggcaaatatcatcatcgttgctaaaggacagaaaatactgatgtgtgttttaactaactggtatattgatccatgggaggctgcacagaagaccctgcggccaggaggggcattgtcagtggctgcttctcctgagctccacgccttcattgcagctgcatgttcgatacaatacacctgcttcacagccccatggacatccctacaggtactgtcatgtgaagccttgcctagtagttctctccagggcaaatgaagctcacagttttgcaaggtggaaacctcttattcacatttgctttgattccccgatggagtagactgcctttgttccatacaggcaaagtaaggatattttaatatcatcctacttcttattagcatttcatttgtctatgtactgtatttcatttgtatgtctcctgaaacatccaaatagagaacataagaacactttatgtacaatctggaaaaaaattacctgagaaatcaattaaagattttt

SEQ ID NO: 33914 - DNA, 2256 bp, Homo sapiens
ggccgcgtccccgccggccctgcagacgtggcggggcgggacccgctgggcactcccgcgcgtactcggccgcctgagcgatactaaaatgtctgatgatgctggtgacaccttagccactggagacaaagcagaagttactgagatgcctaatagtgattctttacctgaggatgcagaagtgcattgtgattcagctgcagtttcacatgagccaacaccagctgaccccagaggggaggggcatgaaaatgcagctgtgcagggtgcaggggctgccgccattgggccccctgtgcagcctcaggatgccaacgccctggagccccctctcaatggagacgtgactgaggatacacttgctgaatgtattgattccgtcagccttgaggcagaacccagatccgaaatacccctgcaagaacagaattatctggctgtggattcccctccaagtggaggaggatgggcaggctggggatcctggggcaaatctctgctgtcgtcagcatctgccacagtaggtcatggattgacggcagtcaaggaaaaagcaggagccactctacggattcatggtgtaaattctggatcttctgaaggagcccaaccaaatactgaaaacggagtccctgaaataacagatgcagccacagatcagggccctgcagaaagcccacccacttccccttcatcagcctctcggggtatgctgtctgccatcaccaatgtggttcaaaacacaggtaaaagtgtcttaactggaggccttgatgcgttggaattcatcggcaagaaaaccatgaatgtccttgcagaaagtgacccgggctttaagcggaccaagacgctcatggagagaactgtttccttgtctcagatgttaagggaagctaaggagaaggagaagcagagactggcacagcagctcacgatggagagaaccgcgcactacgggatgctgtttgatgaatatcaaggcttgtcacacctggaagccctggaaattctgtccaatgaaagcgaaagcaaggttcagtcatttttagcatcacttgatggagagaagctggaactcttaaaaaatgacctaatttccattaaagacatctttgcagccaaagaattagagaatgaagaaaatcaagaagaacaaggcttagaagaaaagggagaagaatttgctcgcatgcttacagagcttctctttgaattacatgtggcggccacacctgacaaactcaataaggccatgaagagggctcatgactgggtggaagaggatcaaaccgtggtgtcagtagatgtggcaaaagtgtccgaagaagaaacaaagaaggaagaaaaggaagagaaatctcaagaccctcaagaagacaaaaaggaggaaaagaaaactaagaccatagaggaagtatacatgtcgtccattgaaagtctggcggaggtaacagcgcgctgtattgagcagcttcataaagtagcagaattaattcttcatggacaagaagaggaaaaaccagctcaggaccaagcaaaagttctaataaaattaactactgcaatgtgcaatgaagtggcctccttatcaaagaagtttacgaattctttaaccactgttgggagcaacaagaaggccgaggtccttaaccccatgatcagtagtgtattgttagagggctgcaacagtacaacgtacatacaggatgccttccagctgctgctgcctgttctgcaggtctcacatatccagaccagttgtttgaaagcacagccgtgacctggccagactccatctagttaaaggagacagctggccgccttgcctcaatatgtaccatttaaggggatgttctctgtgcgcctggccacagacatccatttgaggacactacaagcaattttgcacagacaatattgagaatgcaaatttagagagagttatcatttctctcaatgtgtataattgtttttacaaacaattgtgttttctttatgttaatttaaacttacacagcttatattgaaaatttcctttcatctgaaatttatttacaaatattcgtgttcattttcctggttaagcatgctatatttagaaactcatggggagaccttagacttttgtttaatcctttatgtttcaacctttaaatgttccattcttatagtattactttaaatcaattctaaaactgaactttgttttgttacataaatgtcgcagcaatacttcggtgttctcttgtgtgttgt

SEQ ID NO: 33915 - DNA, 988 bp, Homo sapiens
cggacgcgtgggcggacgcgttgggtgcctcatgatctgaggttgaatagcttcgtgccgaaaccatcccccacccccatcccgctaccccgagtccgtgaaaaaattgtcttccatgaaaccggtccctggtaccagaaaggttggggaccactggcttaaaataccaataaatttttgaaccttaaaaactttgaagaacaaggtaaattggtgttttatttaatgtcctaccctttaatttgttgcattttcctatactctttacactattttatcccaaactatgtatatgaggtgaaaatatatatgaaaagggatactgaagaatatttagtttaaaattaatttcttacgatcacgagcacatggtggcataattacaaagcttggaagtattcaaatagaaaatcaaaggtgtttcaatacagtagaatcccaggactgcattttaaaatcgcctcacagatcacactcgctggtggcaaatatcatcatcgttgctaaaggacagaaaatactgatgtgtgttttaactaactggtatattgatccatgggaggctgcacagaagaccctgcggccaggaggggcattgtcagtggctgcttctcctgagctccacgccttcattgcagctgcatgttcgatacaatacacctgcttcacagccccatggacatccctacaggtactgtcatgtgaagccttgcctagtagttctctccagggcaaatgaagctcacagttttgcaaggtggaaacctcttattcacatttgctttgattccccgatggagtagactgcctttgttccatacaggcaaagtaaggatattttaatatcatcctacttcttattagcatttcatttgtctatgtactgtatttcatttgtatgtctcctgaaacatccaaatagagaacataagaacactttatgtacaatctggaaaaaaattacctgagaaatcaattaaagattttt

SEQ ID NO: 33916 - DNA, 2011 bp, Homo sapiens
ggccgcgtccccgccggccctgcagacgtggcggggcgggacccgctgggcactcccgcgcgtactcggccgcctgagcgatactaaaatgtctgatgatgctggtgacaccttagccactggagacaaagcagaagttactgagatgcctaatagtgattctttacctgaggatgcagaagtgcattgtgattcagctgcagtttcacatgagccaacaccagctgaccccagaggggaggggcatgaaaatgcagctgtgcagggtgcaggggctgccgccattgggccccctgtgcagcctcaggatgccaacgccctggagccccctctcaatggagacgtgactgaggatacacttgctgaatgtattgattccgtcagccttgaggcagaacccagatccgaaatacccctgcaagaacagaattatctggctgtggattcccctccaagtggaggaggatgggcaggctggggatcctggggcaaatctctgctgtcgtcagcatctgccacagtaggtcatggattgacggcagtcaaggaaaaagcaggagccactctacggattcatggtgtaaattctggatcttctgaaggagcccaaccaaatactgaaaacggagtccctgaaataacagatgcagccacagatcagggccctgcagaaagcccacccacttccccttcatcagcctctcggggtatgctgtctgccatcaccaatgtggttcaaaacacaggtaaaagtgtcttaactggaggccttgatgcgttggaattcatcggcaagaaaaccatgaatgtccttgcagaaagtgacccgggctttaagcggaccaagacgctcatggagagaactgtttccttgtctcagatgttaagggaagctaaggagaaggagaagcagagactggcacagcagctcacgatggagagaaccgcgcactacgggatgctgtttgatgaatatcaaggcttgtcacacctggaagccctggaaattctgtccaatgaaagcgaaagcaaggttcagtcatttttagcatcacttgatggagagaagctggaactcttaaaaaatgacctaatttccattaaagacatctttgcagccaaagaattagagaatgaagaaaatcaagaagaacaaggcttagaagaaaagggagaagaatttgctcgcatgcttacagagcttctctttgaattacatgtggcggccacacctgacaaactcaataaggccatgaagagggctcatgactgggtggaagaggatcaaaccgtggtgtcagtagatgtggcaaaagtgtccgaagaagaaacaaagaaggaagaaaaggaagagaaatctcaagaccctcaagaagacaaaaaggaggaaaagaaaactaagaccatagaggaagtatacatgtcgtccattgaaagtctggcggaggtaacagcgcgctgtattgagcagcttcataaagtagcagaattaattcttcatggacaagaagaggaaaaaccagctcaggaccaagcaaaagttctaataaaattaactactgcaatgtgcaatgaagtggcctccttatcaaagaagtttacgaattctttaaccactgttggggccttcagcaatagagcttcactgtatacaagcagaatgacaagggaggtggaagctcattgatatgataggctggacaaaatgcatttgcaccctcgtgtggtccaagttacctgatatccatggactttgatataaacactaggcttgcagagaggtgcgaggtcttaatcaagatggaatagccttagtgacaccggttcctaaggctctattgcaccctcttgttacccttttcacagtttactaggtgaggaaactgaggcctagaggggtgaattgattcactcaagcctctcagtagatctcctaattcccagttggttatccaccagatacatcagatagacaccaactctttggttctctgtgtttgtttaggcttga

SEQ ID NO: 33917 - DNA, 1145 bp, Homo sapiens
  misc_feature (1116)..(1116): n is a, c, g, or t
ggccgcgtccccgccggccctgcagacgtggcggggcgggacccgctgggcactcccgcgcgtactcggccgcctgagcgatactaaaatgtctgatgatgctggtgacaccttagccactggagacaaagcagaagttactgagatgcctaatagtgattctttacctgaggatgcagaagtgcattgtgattcagctgcagtttcacatgagccaacaccagctgaccccagaggggaggggcatgaaaatgcagctgtgcagggtgcaggggctgccgccattgggccccctgtgcagcctcaggatgccaacgccctggagccccctctcaatggagacgtgactgaggatacacttgctgaatgtattgattccgtcagccttgaggcagaacccagatccgaaatacccctgcaagaacagaattatctggctgtggattcccctccaagtggaggaggatgggcaggctggggatcctggggcaaatctctgctgtcgtcagcatctgccacagtaggtcatggattgacggcagtcaaggaaaaagcaggagccactctacggattcatggtgtaaattctggatcttctgaaggagcccaaccaaatactgaaaacggagtccctgaaataacagatgcagccacagatcagggccctgcagaaagcccacccacttccccttcatcagcctctcggggtatgctgtctgccatcaccaatgtggttcaaaacacaggtaaaagtgtcttaactggaggccttgatgcgttggaattcatcggcaagaaaaccatgaatgtccttgcagaaagtgacccgggctttaagcggaccaagacgctcatggagagaactgtttccttgtctcagatgttaagggaagctaaggagaaggagaagcagagactggcacagcagctcacgatggagagaaccgcgcactacgggatgctgtttgatgaatatcaaggcttgtcacacctggaagccctggaaattctgtccaatgaaagcgaaagcaaggtacttctgcactactcgtttgaaatggcatgcttagtcatgtgttgcttaaacatgaaagaaactggaaaatctgccattanaagatctcatttttagagcctcaaaaaaa

SEQ ID NO: 33918 - DNA, 345 bp, Homo sapiens
tgttaaaaattttaaagtctatgaaataagtaaattacaatagataacgttaatttaaagtctacagtagtgcatagtaatgtcttaggccttcacattcactcaccacccactcactgactcacccagagcaacttctcgtactgcaagctccattcatatacttaccattgtgttacaattgcctatggtattcagtatagtaacacactgtgcaggtgcctacgagcaataggctattccctgtaggctaggtgtataatagcctatacaatctaggtgtgtgtaagtatactctatgatgttagcacaacataactaaatcacctaatgacacattcctca

SEQ ID NO: 33919 - DNA, 474 bp, Homo sapiens
tacccacatctgtcccgtggttcggatccagttctcccgtgcgttatgggtatccacgtgtttggtcttagccatcactccaggaaagtggctcctccctgaggacagggctctgtctctgatgctgctggcctccctccagtgctgccctcctccgtttggggcttggtggatacaagtgctgacacacaaaggcaggcaggcaggcctcgggccagggtgtcctccaggcccctctgatggcagggaccagcgagacctggggaaactgcacagtctgtgcctgtctgtgctctcaggagactgagggaattagtgggtgggagagattttatgttggattaaaaactgcacctccaggccgggcatggtgtctcatgcctgtaatcccagcactttgggaggccaaggtgggaggatcacttgagccctggagtttgaggcttcaggaagctatgattacaccactgctct

SEQ ID NO: 33920 - DNA, 202 bp, Homo sapiens
tatcccttttttgaccaaaaattacatccaataatatgcatatagataacttatctgaaacaatgaaaacaagcaatgttcacaaagctgccatcattaacaagactcaaaccaagacttgtgatggtgccgaggccattggagctatggtcacataccccaatacctacaggtagcaggggacaacccctctttctagaat

SEQ ID NO: 33921 - DNA, 298 bp, Homo sapiens
tagcccctgggtcaaatctggccagccatgagtgagctaagaatggttgttacatttttacatggtcatatgttaaatggtttgaccaggcatggtggctcatgcatgtaatcccaccactttgggaggccaaagagggaggatcacttaaggccagtttgagaccagcctgggcaacttactgcctaggcaataagtaagaccccatttctacaaacaaacaaagcacaaacattttaaatggttatacaaatccctacataatatcctcaactttacctcttggctggcaaagcct

SEQ ID NO: 33922 - DNA, 289 bp, Homo sapiens
tgtcacctgtttttagtgtattcagggcataaacacacactgtatctctgaaatcctgaaacatttaaatcacccccatggaactcacacgtcgcaaatgagctctctgcatatgattaatttgcacatttgcctccaattcagtgtgtttattctaggcaaaggaataatcttctataaagcactgatgcttaggttttaaatagtgtaagatgttattgcatttgtaaaagaacatttgctcaaacttctagcacaaagttccaaatgtccaccgggggaaaaaaaa

SEQ ID NO: 33923 - DNA, 210 bp, Homo sapiens
taataaactacattacagtgtaaacattacttttatgttaacttgaaaaacaaaaaattgtgtgactttctttatttcaatattcactttattgcagtggtctggaagtaaacctgcaatatctgcaagttatgcctgtggtagatacacaaaagataaatacatagcactacaaaaaaatgcatcaaatcacaaaggaagacagcaaga

SEQ ID NO: 33924 - DNA, 659 bp, Homo sapiens
gtatttttagtagagatggagtttcaccgtgttagccaggatggtctcgatctcctgaccttgtgatctgcctgccttggcctcccgaagtgctgggattacaggcgtgagctaccacacccagccaaccccatcctttttttaaaaaaaagaaaaaagaaaaaggcagagtctcaggtgcttacccgaggcctgctgagttggaatctttacagtcatgcattgcttaatgatggggagctgctctgtgaaatgcattgttgggcgatttcatcattgtgcaaacatcataaagtgtgcttacgcagacctagacggtattgcctactacaaggtactgtgtgacgcttcacccgtcggtttgggcagtttatgggccaccctttaagtagcaaggggtctggggcactcttctcaacattggctgcacactgaaaactcccacagagcttaaaaaatatattgatgcctagatgccacccccagagcttccggtttaatggatatgcgggtgtagcctgggggtagtacattttcaaagttcgccaggtatttctacacaacacggaacagctggcctaaggcctgcagaagcagatcaaaccaactcggctctcagatgcttctttgttgcagcataagacatctacatcatcaag

SEQ ID NO: 33925 - DNA, 977 bp, Homo sapiens
ctagataaaatatatgaaaccacagtttttgacattgaacaacaggcaacatgggactgttatctctaagagaagggaaaaaaccaaggtgatccctacagttgccctggcttactgcttaggcacagtttctaggctacagcaagggaaagagaaccaaaactgaaactggcaaccttactgactagagacagagatgacagtctgagaagagtaaggcaaagtgctgaaaaggctggaactctctacagagacagccccttggttttttgtatatatagtaatctgtgcatgaatgagatgaagttcctcaaagcccaagatggaaccttcagaaagcaattgactgaataattcacaaaattcatgatttgtattcccaccagccagtgtgaagagtagtgggactaatttagtctcagaataaaaactattctggagcttccataacaaagtataaagcaagccttggaagaagcaaactgattagcaagttacataattgtgcaccacactaacaccaaataccctttaaaggaatatttaaaggagcacccttcaaacaaaacccactacccagaaaagtcacaaccttgcatttaatcagtaattatcgagtgtgcaaaaataccaacttacatgaccagtaagctgaggagggataatcaatcaataggaaaaaaccccagaatgacggtgataatagaatagaaaagaaccagcctggcacagtggctcatgcctgtaatctcagcactttgggaggcccaggcaggtggactgcctgaggtcaggagtttgagaccagcctggccaacatgttgaaaccccgtctgcatgaaaaatagaaaaaattagccaggcatggtggcgggtgcctgtaatcccagctactcgggaagctgaggcaggagaatcacttgaacccgggaggcagagcttgcagtgagccaagatcgtgccattgcactccagcc

SEQ ID NO: 33926 - DNA, 1115 bp, Homo sapiens
  misc_feature (1004)..(1004): n is a, c, g, or t
ctggtaccggtccgaaggtccgtaaatcagaagggagcgaaggtttttgctgcgccaacgcagtgaccgaaggctccgctcacgcccggctgatcctgcctgaagatggtgccactggtggctgtggtatcagggccccgtgcccagctctttgcctgcctgctcaggctgggcactcagcaggtcggcccccttcagctgcacaccggggccagccatgcggccaggaaccattatgaggtgctggtgctgggtgggggcagtggcggaatcaccatggctgcccgcatgaagaggaaagtgggtgcagagaatgtggccattgttgagcccagtgagagacatttctaccagccaatctggacactggtgggtgctggtgccaaacaattgtcctcatctggtcgtcccacggcaagtgtgattccatctggtgtagaatggatcaaagctagagtgactgagttgaacccagacaagaactgcattcacacagatgacgacgagaagatctcctaccgatatcttattattgctctcggaatccagctggactatgagaagattaaaggcctacctgaaggtttcgctcatcccaaaatagggtcgaattattcagttaagactgtagagaagacatggaaagctctgcaggacttcaaagagggcaatgccatcttcaccttcccaaatactccagtgaagtgtgctggagcccctcagaagatcatgtacttatcagaagcctacttcaggaagacagggaagcgatccaaggccaatatcattttcaacacttctcttggagccattttcggggttaagaagtatgcagatgccctgcaggagatcatccaggagcggaacctcactgttaactacaagaaaaacctcatattgaaatgcttcatgtcacacctccaatgagcccaccagatgtcctcaagaccagtcctgtggctgatgctgctggttggggtggatgtggataaagaaactctgcnacacaggaggtaccccaatgtgtttgggattggggactgcaccaaccttcctacgtcaaagaccgctgctgcagtagctgcccagtcaggaatacttgatagaacaattct

SEQ ID NO: 33927 - DNA, 1190 bp, Homo sapiens
  misc_feature (1079)..(1079): n is a, c, g, or t
ctggtaccggtccgaaggtccgtaaatcagaagggagcgaaggtttttgctgcgccaacgcagtgaccgaaggctccgctcacgcccggctgatcctgcctgaagatggtgccactggtggctgtggtatcagggccccgtgcccagctctttgcctgcctgctcaggctgggcactcagcaggtcggcccccttcagctgcacaccggggccagccatgcggccaggaaccattatgaggtgctggtgctgggtgggggcagtggcggaatcaccatggctgcccgcatgaagaggaaagtgggtgcagagaatgtggccattgttgagcccagtgagagacatttctaccagccaatctggacactggtgggtgctggtgccaaacaattgtcctcatctggtcgtcccacggcaagtgtgattccatctggtgtagaatggatcaaagctagagtgactgagttgaacccagacaagaactgcattcacacagatgacgacgagaagatctcctaccgatatcttattattgctctcggaatccagctggactatgagaagattaaaggcctacctgaaggtttcgctcatcccaaaatagggtcgaattattcagttaagactgtagagaagacatggaaagctctgcaggacttcaaagagggcaatgccatcttcaccttcccaaatactccagtgaagtgtgctggagcccctcagaagatcatgtacttatcagaagcctacttcaggaagacagggaagcgatccaaggccaatatcattttcaacacttctcttggagccattttcggggttaagaagtatgcagatgccctgcaggagatcatccaggagcggaacctcactgttaactacaagaaaaacctcattgaagtccgagccgataaacaagaggctgtatttgagaacctggacaaaccaggagagacccaagtgattttcatattgaaatgcttcatgtcacacctccaatgagcccaccagatgtcctcaagaccagtcctgtggctgatgctgctggttggggtggatgtggataaagaaactctgcnacacaggaggtaccccaatgtgtttgggattggggactgcaccaaccttcctacgtcaaagaccgctgctgcagtagctgcccagtcaggaatacttgatagaacaattct

SEQ ID NO: 33928 - DNA, 379 bp, Homo sapiens
gaggagggtaaagagacatatagggaatcaaggaataaggtttccgtacatctttcaaagtactaaaattttgaccctattaaaccatgataagttattacatgtgctgtaaaacctacagcatccactaagatgtctgcacacagagatatactcaaaaataccacagataaacctcaatggaattctaaaaaaagaaaattaaagtaacacacatgaaagcaaggcgttacaaaacaacaattacaaaaaaagaaaaaaaaacggataagcagaaatcataaagtaaaatggcaggtttgtgacccaacatatcaataattacaaataaaagtggtctaatgtgaacaaagttgctgagtattgaagagtgtctata

SEQ ID NO: 33929 - DNA, 419 bp, Homo sapiens
acacctgtaatcccagctactcaggatgctgaggcaggagaatcacttgaatccgggaggcggagggtgcagtgagccaagattgcgccattgcactccagcctgggtgacaacagcgaaactccatctcaaaaaaaaagaaaggggaagacatgcatgtaaaaatacatctggctatgatatatcagataaatgtaaccaacaacgaaaaggaagagtagtaatacaaacactaagcaaaatagaattcaaggcaaaaatggtaagtggaacaaagatgagtatttaatcatggtaaacaataaaaaaatccatgaagaaattataataaccatgaactttttttttgacacagggttaggctagaggctggagtgcagtggcacaatcacagctcgctgcagccttgacctcccggc

SEQ ID NO: 33930 - DNA, 887 bp, Homo sapiens
tattctttccaaagaagtattactgtcactgggttctaaaaaaaaatccaatatgcttatagaacacttcaaactaaaaaatcagcaactatttcttgaataatttatccttagttctaaaattgagtataatcagcaaagagatgaattgagtgcctcattcatagtcaatgtttattcttcaattaggcattgttatattcagcacagaaaagagtgacaagaaaataacttggctagagcatgactgactgggatgtgtgtttaaaagatttcgtaaaaggctgtatgtttatctagtcttaacttttattaatcactatgtgactgtccatttaaataacaattaatgaggtattattactacttaatagataaaagaaatgaagaggccagcctggagcctcatcataccataactagaacctgctgagacagatttacctcacgagaaactagtcctttacccaacaaactatttgaaaccttccagactatgccactaaggccatagatccctctagcctacaagagattaaaaggcctaaatctatcaacacctcatatccttgtttacgtaagtctccaccagaaatactgttaactctcatgcccctactactctacacatccctctcatctgaatgagctcctcagctctacctcttctgtgatcagcaaactccactttctagccttatggaaaacataactcccccaaatatgctactttaataaatcccacagaggctgatgttattcagttcctccacacgtctcaaaaccatgtccttgcaggccatggtggggcagaggttgggaagatggcctggtgaggctgggcagagagaggttggggcagcgaccaggcgtggtctccgccagtg

SEQ ID NO: 33931 - DNA, 830 bp, Homo sapiens
ttcctctagcacagcagctcgcaagctaaaattaccgccccccccggcccctccagatttcctcgcattttgtagcggccacctaccattactgactaaagaggtgtatgtacaagtgcaccaggaaagggcttctcttgttgagcacaggataaaggcttaggaaaaggcttttggcccatttgcttttatcctgcctggaaaatgaggtgagctactatctcgctttcatcctcatagcagcctggatattagcagtcatcttgcagccatgaggataaaacctataatctaatggtatggaaaaggaaaacaagagaagctgagatccatattgattcccttgagccgcagccccttcctcgtatgtctgcctcagcctttcttttgcctgaaaccaataaactccttacttctttaggccatttcttagtcaggttttctgtggcttgaaacaggacacattcctaattgatatactcatgtaaggagaagtaactcaaatggtaaacaataccatcggactaaacacaacatctaattagaagtaggttctggtgcaaacacgtccaggtgtcctgcagaagtcctgaccatgccagggagagtaaggaaatgtgtgttctgctcctccactttattgccaaattttctactttgtaacctccaaaagccatgttctggctgctaccccaaccacgtcaccaaaactatcctcatcaaggatatcaactgcctcctttgtcacaaaatccaatgaatacattttggctcttaacctctccacagaacttgacacttgttgactggttcctttttttaaaaaaaaa

SEQ ID NO: 33932 - DNA, 578 bp, Homo sapiens
ttcctctagcacagcagctcgcaagctaaaattaccgccccccccggcccctccagatttcctcgcattttgtagcggccacctaccattactgactaaagaggtgtatgtacaagtgcaccaggaaagggcttctcttgttgagcacaggataaaggcttaggaaaaggcttttggcccatttgcttttatcctgcctggaaaatgaggtgagctactatctcgctttcatcctcatagcagcctggatattagcagtcatcttgcagccatgaggataaaacctataatctaatggtatggaaaaggaaaacaagagaagctgagatccatattgattcccttgagccgcagccccttcctcgtatgtctgcctcagcctttcttttgcctgaaaccaataaactccttacttctttaggccatttcttagtcaggttttctgtggcttgaaacaggacacattcctaattgatatactcatgtaaggagaagtaactcaaatggtattgtttaccatttgagttacttctccttacatgagtatatcaattaggaatgtggcttgaaacaggaca

SEQ ID NO: 33933 - DNA, 397 bp, Homo sapiens
ggcggatgagaccagaaaacctgctatttgttaaaaaatcataaaacaacatctaattggccaataagaaatgagatttactgttctatctgcaggtgagtcaagagaatgtagaaactgggtaattaaaacaaagtcaggccaggtgtggtggctcatgcctgtaatcctagcactttgcaaggcggaggcaggcggatcacttgaggtcaggagctccagaccagcctggccaacatggtgaagccctatccctgctaaaaatacaaaaattagctggaaatcgctggaacctgggaggcagaggttgcagtgagctgagatcgtgccactgcactccagcctgggcaacagagcaagatgctgtctaaaaaaaaataaataaataaataaaatg

SEQ ID NO: 33934 - DNA, 348 bp, Homo sapiens
ttggggaataaaaaaaaagatgagattcattcacttctgaacccatctgcaaccatccaagcatggcagctgatttctaaggacagaaccaaggagggcagtaaacactcagtattcacccatctttgaggcgtaaaggggagtaaagacttagactgtaggtccagagcagacctcagcaagtaagaacaagtgatgctggccatttggtgtaagcctccacctttgctgatcccaggctctaaatagaatttgattgtggactccatctctctgaatttgctcctgccttcttctgagtgttgaaggatcctgaactatcatctccgtttctccttaaacaacagc

SEQ ID NO: 33935 - DNA, 594 bp, Homo sapiens
gggaagggaaggaaattcaggtctttagctatgcattcataaactggacttaagaagagccttcctcctcttataatgctaactgctcttaatatttccttcttaatgaacagttgatataagagttttctcctttcatctaagaaatacagaacaatctgcaagttttcttagttgtttgttaaatggacttcgaaatgattgagaaattcgtatttctcagcgaaaataagtattaagttaatggacaagtagcagtccttgttgccaccaagattttgcatctgaattgtatatataaactgtgtcaggaatatcataaaatcatgttgaggctgcagggacaaggaaatttcatctcatgaatctgtttgatgttttcgggatgtcctgagagaaaaattctttgacctgcctagtgagcaaggtctaagtttgtacacccaggtcacattgtaccctgggctttccaaagatttatcctgcatctgagccaaaggcttttgaagcctgtggttgctggaattttagggtgtatctctttgcttcttcagatgagacatttcttaaggtagaataatggttaaaaaaaaa

SEQ ID NO: 33936 - DNA, 246 bp, Homo sapiens
gtaggggcttgaagttggaccccacaggggagaccttgaaggttgttgagccagggaagggatgtactcagagccatggtggaggggcatccaggctataaacagctgccaaaatctggggaaaataggatcaaagttaggggacagttgtagttctggtgagagacggtgaggtcccgagctcctgggatgagaaaacgaaactggaataggtagacacagtattccttcaagttgtgctttatg

SEQ ID NO: 33937 - DNA, 913 bp, Homo sapiens
ttgggcgcgtactgtgtctatgtgttagcaacacgctgtgttgacataactcatggaacctgtgaagaagctggtctcatagtactaaatggtggtctaggagcagccgggcggatagcactgggtatatgcaaagaatggcaagtgtacgagctgtgcccaatcttgaaatcaacccctaccagccagcacctccttcaggttacttcatggcagctatcccacagactcagaacggtgctgcatactatcctcctagccaaattgctcaactaagaccaagtcctcgctggactgctgagggtgccagaccccatccattccaaaataggcccagtgctatccgcccggctgctcctagaccaccatttagtactatgagaccagcttcttcacaggttccatgagttatgtcaacacagcgtgttgctaacacatcgacacagacaatgggtccacgtcctgcagctgctgctgctgccactccacattataactatgctgcgggagttcgcagtcctcagaaacatcttaatgcacagccacaagttacaatgcaacagcctgctgctcatgtacaaggtcaggaacctttgactgcttccatgttggtatctgcccatgctcaagagcaaaagcaaatgttgggtgaacggctgtttcctcttattcaagccatgcaccttactcttgctggtaaaatcactggcatgttgttggagattggtaattcagaacttcttcatatgctggagtctccagagtcactccgttctaaggttaatgaaactgtagctgtactacaagcccaccaagctgaagtggctgcccagaaagcagttaaccgtgccaccggtgttccaactgtttaaaattgatcaggtaccatgaaaagaaacttgtgcttcacaga

SEQ ID NO: 33938 - DNA, 842 bp, Homo sapiens
tatgttgctttagctcagcgcaaagaagagtgccaggctcacctcactaaccagtatatgcaaagaatggcaagtgtacgagctgtgcccaatcttgaaatcaacccctaccagccagcacctccttcaggttacttcatggcagctatcccacagactcagaacggtgctgcatactatcctcctagccaaattgctcaactaagaccaagtcctcgctggactgctgagggtgccagaccccatccattccaaaataggcccagtgctatccgcccggctgctcctagaccaccatttagtactatgagaccagcttcttcacaggttccatgagttatgtcaacacagcgtgttgctaacacatcgacacagacaatgggtccacgtcctgcagctgctgctgctgccactccacattataactatgctgcgggagttcgcagtcctcagaaacatcttaatgcacagccacaagttacaatgcaacagcctgctgctcatgtacaaggtcaggaacctttgactgcttccatgttggtatctgcccatgctcaagagcaaaagcaaatgttgggtgaacggctgtttcctcttattcaagccatgcaccttactcttgctggtaaaatcactggcatgttgttggagattggtaattcagaacttcttcatatgctggagtctccagagtcactccgttctaaggttaatgaaactgtagctgtactacaagcccaccaagctgaagtggctgcccagaaagcagttaaccgtgccaccggtgttccaactgtttaaaattgatcaggtaccatgaaaagaaacttgtgcttcacaga

SEQ ID NO: 33939 - DNA, 302 bp, Homo sapiens
agagacatgtgcaaaaatgtttgcatcagcattttcacagtagcaaaaaatctagaaacaattcaaatgtccatcaacatgagagtgaattaattcatcgcataaaaattcacttaatggaatattaagtagagtttaaatgaatggattataaaaacatatgtcaatatgggtgaatcttagcagtataataccaactgactaaaaagcaaatctcaaggtaaataagttgatagagaaaggaaagctaaggaatgacgagatttggagggagagagtcaggagtgtgggaatttggagga

SEQ ID NO: 33940 - DNA, 941 bp, Homo sapiens
ggcccttgtccactagaggcaaggtgccccctgaccccttcttccaaatatacgcttttgtcttttattcctgcattcgcccgctttgttcagtccccctaggtccatgtgggttacatagtggcgccgcagaacagggacttcaaggacgtaaacgaagaaggtctgctggagcagaggaactgaaattgagaaggtgaacggggaccccaggccgagtctgccgacagggatataaggagatggacaagccgtgtgggtgccctcaaggtgtgtgcaaccatggaatgggagactggaggaacccagggtggccaaccatgggtccggtccctctggtgtgagccatgagccagctgagcctgagtgcgaagacggagagaaggccgaccacagtcatgacatcaacccccataacctggggacaactcaagaaaaccacacaggaggctgagaaactactggagcaccagggacagtctgtaaagttggatggaccatcaatgggaaaatgagagctgcccaccctggccttacactccttcaattaatacataaacagaaaggaggatatacagagagccaaaggcccatgggacgtgaccaacattccactgagtctatacgatcaaacagcaaactgtttatcatgaatacagaatgtgggcaaactcatgactgtgcctgccccagaaggtttgctgagggcaattgcttcctgacgccaagctccttgaggttatctattgggacatccagagaatgcagtcttgcaagcctactctggaccgagcagctgaccccctcttccacttcccttcacactatctcttttgcctaataaatacggaaggctgtgtacaaggtcaggtcccttgtccactagaggcaaggtgcttcctgacccttcttccaaatatactcttttgtctttgtctttt

SEQ ID NO: 33941 - DNA, 888 bp, Homo sapiens
ggcccttgtccactagaggcaaggtgccccctgaccccttcttccaaatatacgcttttgtcttttattcctgcattcgcccgctttgttcagtccccctaggtccatgtgggttacatagtggcgccgcagaacagggacttcaaggacgtaaacgaagaaggtctgctggagcagaggaactgaaattgagaaggtgaacggggaccccaggccgagtctgccgacagggatataaggagatggacaagccgtgtgggtgccctcaaggtgtgtgcaaccatggaatgggagactggaggaacccagggtggccaaccatgggtccggtccctctggtgtgagccatgagccagctgagcctgagtgcgaagacggagagaaggccgaccacagtcatgacatcaacccccataacctggggacaactcaagaaaaccacacaggaggctgagaaactactggagcaccagggacagtctgtaaagttggatggaccatcaatgggaaaatgagagctgcccaccctggccttacactccttcaattaatacataaacagaaaggaggatatacagagagccaaaggcccatgggacgtgaccaacattccactgagtctatacgatcaaacagcaaactgtttatcatgaatacagaatgtgggcaaactcatgactgtgcctgccccagaaggtttgctgagggcaattgcttcctgacgccaagctccttgaggttatctattgggacatccagagaatgcagtcttgcaagcctactctggaccgagcagctgaccccctcttccacttcccttctgtcgtcttctcccctactgtcgtcttctccccttctgtcgtctttctccccttctgtcgtcttctc

SEQ ID NO: 33942 - DNA, 2652 bp, Homo sapiens
  misc_feature (872)..(872): n is a, c, g, or t
gatgcaggaactgagcttcatcgctcttcaatgttagctgaagcaatggctaatttagtagttgacaaatctaaaaggagccaagggtcaagctctaaaatgggaaaatgttataattgtggaaaaactggacatttaaaaaaggaatgccaccagatctcaggacagaaaggatcttacaatgcagttcccccatcagcggaaaaaacgccaggactttgtcctcgctgtaacaaaggaaatcactgggctaatcactgctgctcaaaatttcatcggaatggcaccccgttttaggcatgggttcctggaggcacattgattccatcaccccaggaacaccaggaagtgcaggattagatctacctgccagagaaagaatcacattagttgggggagacaaacccatcaaagttcccactggtatttggggaacttcaccagcaggatacatgggactaattttaggcaaaagccgccttaacttgcaaggcatgactgtagtcccaggagctgttgactctgattatgaaggagaaactcaagtagttttaatgtcacaagatctttgggtttttgaactgggagaatatattgctcaattattgcttattccctgcaaattacacccttctccatgaaaggagaaacgaggaaataaagggtttgggagcacaactacatgggaaatctatctatcccgacccatagcctctaatagacccacctgtgtagtacaaattaaaggaaagaaattttatgggcttatggatacgggaactgatgtatcagtaatatctaaagacaattggcccacatcctggctcttgcaattaacttctacatccctagtggaagtaggaacagctcanagtgttcaacagagtgctgagattttaccttgtcttggtccggatgggcagtcatgtacttttcagccttatgttgcaaatatagctatcagtttatggggctgagacttacttacagcatgggagatgagacttacaaatgaaaactttgataacccaggatttaaaatgttgaaggacatggatatcagagtgaaaaaggtttagggaaattcctacaggaaaatcctaacctgatatcagtaactggcaaaacagatagaaaaaggctaggaaatcaggatttctgacagaggtcattgatatttctcccctgcccactgccttaccattagaatggcttagtgacaaacctgtgcgggtggatcaatggcccctaacacaggagaagctagatacctctggtgcttcagcgcaatgctgagagctaattacagtcattcaggttttacagctcacagcttcagatcctatcaacattgtctgtaattcagcttatgttgtaaacgtagccagtcacattcacatggaaactgctacagttaaaagtacactagacccagaactgcttaatttgtttcacttattctcaaatgctgcatgctacatgccaaacaggtgagacagctggtcatgtacagtgacattgtctgtcatcatttgctcatatggggatacttaaacaattaaaaactgacaatggactcgcttatactagtcatgcttttcaaaatttcttatagctttgggctataacccataaaataggaattccttataatcctaaaggacaaggcattgtagagcaggcacattgaacattacaacacatgttgaaaagacgaaaggggtataggaggccaactaccacctcaatcaaaactacatttagccttatttacttcacatttttggactcctggtacagatggtaagactccagcagaaagacattggcaagtgttagaggaaaagaggaaagtttatctgaaagcattatggaaatccctggaaggacaatggaaaggtcgggtggatttactgacgtggagaagagggtatgcttgtgttttcacaggagatggacaagccgtgtgggtgccctcaaggtgtgtgcaaccatggaatgggagactggaggaacccagggtggccaaccatgggtccggtccctctggtgtgagccatgagccagctgagcctgagtgcgaagacggagagaaggccgaccacagtcatgacatcaacccccataacctggggacaactcaagaaaaccacacaggaggctgagaaactactggagcaccagggacagtctgtaaagttggatggaccatcaatgggaaaatgagagctgcccaccctggccttacactccttcaattaatacataaacagaaaggaggatatacagagagccaaaggcccatgggacgtgaccaacattccactgagtctatacgatcaaacagcaaactgtttatcatgaatacagaatgtgggcaaactcatgactgtgcctgccccagaaggtttgctgagggcaattgcttcctgacgccaagctccttgaggttatctattgggacatccagagaatgcagtcttgcaagcctactctggaccgagcagctgaccccctcttccacttcccttcacactatctcttttgcctaataaatacggaaggctgtgtacaaggtcaggtcccttgtccactagaggcaaggtgcttcctgacccttcttccaaatatactcttttgtctttgtctttt

SEQ ID NO: 33943 - DNA, 489 bp, Homo sapiens
cactactctcgaaaaattgcttgtgacagtataaatgagtattcagacattgtggaagacactttggcggcaatatgcaatgatatccagggccataaatccgttcttatccttgggcctccagaaatctgattataggcagccataaggaaggaatcttaaaagaagagaaggctactaatatggtttggatctgtgtccccgcatgtcgaattgcaatccccagtgttggaggaagggcctggtggaaggtgactggatcatggggaaggatttctcccttgttgttctcgtgatagtgagcgagttctcgtaagatctggttctttaataaaagtgtaaggcacttccccctgtgttcctcctgctctggccacgtaagacattgcctgctttcccctttgccttctgccatgattgaaattcccgagcctccccagccatgcttcttgcacagcctgcagaaccatgagccaattaaacttctct

SEQ ID NO: 33944 - DNA, 585 bp, Homo sapiens
  misc_feature (1)..(1): n is a, c, g, or t
  misc_feature (8)..(8): n is a, c, g, or t
  misc_feature (28)..(28): n is a, c, g, or t
nacccccngtgaacctgcccccccctgnccccccccccaatgtgggattaccgggtgtgagcccccacccgtgccccggcccagcaaccccggtttaaccaagatggcctgggtgattccctcatgccagcctaaagtatgagaacctgataccagtagaggagttaaaacctaataatttgcccccatcaaaattatggaggtgaaggagtggggatccgttatgtgagataaattccctgtcctatccatggaaggaatttagtaaaataatgtcctagatcctgataaatcaacgagtagtagtatccagcatgttttcctagagatatggaaataatcatcaaaagaaacataaacggacgtgggtaataatgagtaataatggttgcccctggagaggaggactcagtatggcgaggtatgtggcagggggttattatttttctaaccatgtgattctttggttgaaattaaaataaaagaaaaaattgttcttagattgggaagattgtccaggagcctgagagaagttctgggagagcagttctttcttattgtccttttcctgattatggggaaaaa

SEQ ID NO: 33945 - DNA, 368 bp, Homo sapiens
tctaaaattgtaatggttttacattttacatttaatggtccattttgagataaatttaaataagatatgaagtttaggttgaggtttatttttttaaagcaagaggtgtacaatggctccagcatcaatagcatgattttactacctacttgctctagattatcaatcacatgtcctattcataatatcggttcctctgtttacataccatattggcatctatctatatgtgtgataggtgtttgaaactcaaattttcaaacttatattaataatttccactccaaactcagttttttctatatttcttattgagatttttgagccaaatatcctccaagcaaatggaattacaatgtggaaggtag

SEQ ID NO: 33946 - DNA, 669 bp, Homo sapiens
ccctagcaacttcctgtacccctagcaaccttcctgtacccctagcaaccttcctgtacccctagcaaccttcctgtatccctagcaaccttcctgtacccctagcaaccttcctgtacccctagcaaccttcctgtccttccaatatgtgacgtagatcattttcaacagagtagcaggcaagcgcattctacagagagtaaagtacaatcagagcacattccaaatggaagttggccttatagttaatgagtttcttagaacaacaaaagcccagctatgaagggtgactttggtcctgcgtgagttcagtctctggtgaggaagctgcaatgctttctaagactctggagagtctgggaaccttgaagcagccagatgcgtgatagttatttgcaggtgttgcctgaggaacgatgggacacgtatagcttttggtagtgctggttttgggactggggaacctaaaaccttcaagaggacagtttccctccaaagaattaatcagtggggaatgtttttgcaacaaaagtgttcaacccataggcagtggggggcaccacatgggggaggaaacagcattttaggatgctgggccaagggaaggaagttgggctctttacctaacagctgatcttcgacctaaaagttgtcattgcgttccctttc

SEQ ID NO: 33947 - DNA, 327 bp, Homo sapiens
aagacactgaagctatctgctgttaattcctttaaaaaaaaaaaaaaagcacctagttcattttcaggtggcctctttaaatttagtaatggttctaaagtgatacagaattattaattttaacttcagagaaatgctttttactattctaataattttctgttaaagttaattatttttacagcagtaaatttcaagtccataattgtgatctaagttctctcttaaaaattaagccccaaggccaggtgcactggctcatgctctgggaggacggcttgaggccaggagtttgagaccagcctgggtaacatagtgagaccccaa

SEQ ID NO: 33948 - DNA, 2026 bp, Homo sapiens
catatcttcaaatcaaatttcagtggagtgtttaccgggcaaggaaggcaggggggtcagcttgctgacagcctcaacctgccagccctcagcctgcacatttgtgatcacctggtcacacacctgggcaggaggctgcccctccctggtttgaggaagcaggaaaaggtacccgcgagagacagccagcagttctgtggagcagcggtggccggctaggatgggctgtctctggggtctggctctgccccttttcttcttctgctgggaggttggggtctctgggagctctgcaggccccagcacccgcagagcagacactgcgatgacaacggacgacacagaagtgcccgctatgactctagcaccgggccacgccgctctggaaactcaaacgctgagcgctgagacctcttctagggcctcaaccccagccggccccattccagaagcagagaccaggggagccaagagaatttcccctgcaagagagaccaggagtttcacaaaaacatctcccaacttcatggtgctgatcgccacctccgtggagacatcagccgccagtggcagccccgagggagctggaatgaccacagttcagaccatcacaggcagtgatcccgaggaagccatctttgacaccctttgcaccgatgacagctctgaagaggcaaagacactcacaatggacatattgacattggctcacacctccacagaagctaagggcctgtcctcagagagcagtgcctcttccgacggcccccatccagtcatcaccccgtcacgggcctcagagagcagcgcctcttccgacggcccccatccagtcatcaccccgtcacgggcctcagagagcagcgcctcttccgacggcccccatccagtcatcaccccgtcatggtccccgggatctgatgtcactctcctcgctgaagccctggtgactgtcacaaacatcgaggttattaattgcagcatcacagaaatagaaacaacaacttccagcatccctggggcctcagacatagatctcatccccacggaaggggtgaaggcctcgtccacctccgatccaccagctctgcctgactccactgaagcaaaaccacacatcactgaggtcacagcctctgccgagaccctgtcctcagccctctctgttgagacaccaagttacgtcaaagtctcaggagcagctccggtctccatagaggctgggtcagcagtgggcaaaacaacttcctttgctgggagctctgcttcctcctacagcccctcggaagccgccctcaagaacttcaccccttcagagacaccgaccatggacatcgcaaccaaggggcccttccccaccagcagggaccctcttccttctgtccctccgactacaaccaacagcagccgagggacgaacagcaccttagccaagatcacaacctcagcgaagaccacgatgaagcccccaacagccacgcccacgactgcccggacgaggccgaccacagacgtgagtgcaggtgaaaatggaggtttcctcctcctgcggctgagtgtggcttccccggaagacctcactgaccccagagtggcagaaaggctgatgcagcagctccaccgggaactccacgcccacgcgcctcacttccaggtctccttactgcgtgtcaggagaggctaacggacatcagctgcagccaggcatgtcccgtatgccaaaagagggtgctgcccctagcctgggcccccaccgacagactgcagctgcgttactgtgctgagaggtacccagaaggttcccatgaagggcagcatgtccaagcccctgaccccagatgtggcaacaggaccctcgctcacatccaccggagtgtatgtgtggggaggggcttcacctgttcccagaggtgtccttggactcaccttggcacatgttctgtgtttcagtaaagagagacctgatcacccatctgtgtgcttccatcctgcattaaaattcactcagtgtggcccagaaaaaaaa

SEQ ID NO: 33949 - DNA, 1233 bp, Homo sapiens
agagaaggactggaagaatcttggagttgggaatgtcacacgtaattgaaggaagaacaagaaaactatagcagctgctcccaaccccagaacctttgctgtcttgggacggatcaccactgcaagaggggaagttgctactgtgatgaattctgccatgtggcaccagactgccacccagaccacagtgtcctctgcaaccctggtaactcacatacaggcccgattccaccgacagcaaagctggatgctatggctggcagaggcaaaccctttgcctgcacttcaggccaaagccgggatgtggcctagatggttcctaagcttctcagatgaccaagatggtgctgcagatggtgctgaggatggagaacccaccaagccccgctaggagccacctagactggatgcagagcatggttcagcgagttctccaaaccagcctcccaggaatgccattcaccatggctgtgaggagaataaagaagagagcctgactcctctcctgaggccccttccccaccctgagccagcaggatccacggagcagaggtcatctgtccccagcttggcccactgaggccagcatggctgggcccaggatgcttgtctctcagctcccatcctgtgtacttccacattggtttaaccagaggaaaaccgaaatctacaattgtcataaacacatttaaatgtgcgtagaatcagccatacaaattgtgaaacataaaacatttggctcatggtattattcactgttttgtggtggttacagtgactatagcaaacatttcttgaaagtagaaaataagaacccagcaccccttgagctaagtaatgtgccctctgtcctcaatattccttcctgggctccacattactgcccttaagtctggaaatattctggtctgagccccgtagtccaggcctcatgttcaggctttctgtccccagtgatgagaggagagacggcagacctttctccggtgagctcagatgggcctcccggagtctcctggggtgcacaggatttcaaagatccaggaggcgctgccaggggctgtgaggtctgatgaacctctcaccttccctcccacacctgcccttttcctgtttctgtggatgcttttgctgtccttggcttcctggactccagacctcagggtcatcttttgcttctctctgcaaggtgccaagtctctctaggtttttgtttgtttgttttgttattga

SEQ ID NO: 33950 - DNA, 756 bp, Homo sapiens
aaggagtcacggggcgcgcacgccagtttattaaataacaagtgcagattgatgagtatgatcactccaagcccatccaggggcaacagaagaagccctttgaggtgcactggaggaagcacaccctgtcctatgtggacgtcggcactgggaagagccagaggacaacacatcacacacaagaaacagttgtgctcatgtgatgggggcctcagcactaggaaggagtggactgttggcgcacgcagcagcttgaataaatctgaaagtcactacgctgcgtaagagaagccaaataaagcgcatgctgtgtacagagggtgtcgagaatgcctcctacgtgacggaaagcagatccgtggttccctgcagactggcaggagcagattccaaaggcacaggaagaagcttgcaggtagaatgtgttcattaccttctgcgcattataccacaaaaaagctgggaataaaaatgctaaccaaaaaaaaaggtgaaagtagataaaatttctcaactgtgtgatgggtaaacgtgcaggtttgctgtcatgctttgtttatgaagctgtggggtacaaggactctcatacgtcactgtggaatgcagaacgttgcagcctcatggaagaggatttggcagcatctaacaaaacgacatggcatttgcccttagactcagcaattctagaatctgcctcaaaaaaaactctggcaaagaaatgaaaggactttatccacagagttcttttcacagcct

SEQ ID NO: 33951 - DNA, 418 bp, Homo sapiens
gcctctggcgagctcatgggccagatgggctgaaaggacagctggctcttttgctctccagctccaccgggaactccacgcccacgcgcctcacttccaggtctccttactgcgtgtcaggagaggctaacggacatcagctgcagccaggcatgtcccgtatgccaaaagagggtgctgcccctagcctgggcccccaccgacagactgcagctgcgttactgtgctgagaggtacccagaaggttcccatgaagggcagcatgtccaagcccctgaccccagatgtggcaacaggaccctcgctcacatccaccggagtgtatgtgtggggaggggcttcacctgttcccagaggtgtccttggactcaccttggcacatgttctgtgtttcagtaaagagagacctgatcaccca

SEQ ID NO: 33952 - DNA, 611 bp, Homo sapiens
ccagaaggaggaatgaggaacgcctattgataaggggcagagtacatataatataatgcaaatatatatttgctttttcttaaaacatacaaagataaaaatctaaagtggttgctgtggaggacaggggtcagtggtggaagtgagaccgaaatagactctgaagtaatatctggactttgaaattgtaagtgttttacatattaccaaactaagtttttaagatagtccctaaaattgaaagaatggtatctgaaatgaatgaatctaaattccttggattgcattctacaggcgccaaccctgagaccaaaatttggaaggtggccctgagcagcagctgaagggaagtgggaggtgaagatcaggacaagaggcggcagcatggggcgtccgggagccgggtctcatgtggacagctgggcccgtgttcactgtgggagctggtgcgttccttcaccagcccacgctgcacaggttcaggatggtcaattccgggcacccctggcctgctccaggacatgctgctgccaccagagaaagcccctaggcagcgtcccgggtgctggtggtgtcagaatcgagtttgagtctgaggagtgacctggggc

SEQ ID NO: 33953 - DNA, 411 bp, Homo sapiens
aaggagtcacggggcgcgcacgccagtttattaaataacaagtgcagattgatgagtatgatcactccaagcccatccaggggcaacagaagaagccctttgaggtgcactggaggaagcacaccctgtcctatgtggacgtcggcactgggaagagccagaggacaacacatcacacacaagaaacagttgtgctcatgtgatgggggcctcagcactaggaaggagtggactgttggcgcacgcagcagcttgaataaatctgaaagtcactacgctgcgtaagagaagccaaataaagcgcatgctgtgtacagagggtgtcgagaatgcctcctacgtgacggaaagcagatccgtggttccctgcagactggcaggcttgttgaaagtcctgtagatcgactcgca

SEQ ID NO: 33954 - DNA, 444 bp, Homo sapiens
agagcagaggcccaggaagaagcttgctacaaagataaaaatctaaagtggttgctgtggaggacaggggtcagtggtggaagtgagaccgaaatagactctgaagtaatatctggactttgaaattgcgccaaccctgagaccaaaatttggaaggtggccctgagcagcagctgaagggaagtgggaggtgaagatcaggacaagaggcggcagcatggggcgtccgggagccgggtctcatgtggacagctgggcccgtgttcactgtgggagctggtgcgttccttcaccagcccacgctgcacaggttcaggatggtcaattccgggcacccctggcctgctccaggacatgctgctgccaccagagaaagcccctaggcagcgtcccgggtgctggtggtgtcagaatcgagtttgagtctgaggagtgacctggggc

SEQ ID NO: 33955 - DNA, 309 bp, Homo sapiens
  misc_feature (45)..(46): n is a, c, g, or t
  misc_feature (297)..(297): n is a, c, g, or t
  misc_feature (299)..(299): n is a, c, g, or t
  misc_feature (303)..(303): n is a, c, g, or t
  misc_feature (306)..(306): n is a, c, g, or t
ctaggtactctcaggagttattcttagcttgtgttggacatgctnntacgtgacggaaagcagatccgtggttccctgcagactggcaggagcagattccaaaggcacaggaagaagcttgcagtacaaagataaaaatctaaagtggttgctgtggaggacaggggtcagtggtggaagtgagaccgaaatagactctgaagtaatatctggactttgaaatttgcacagccagagaacaacacatcacacacaagaaacagttgtgctcatgtgatggggacctcagcactaggngngaanggnctg

SEQ ID NO: 33956 - DNA, 353 bp, Homo sapiens
ggaggatccctaacgatacatacagcattacttctgcgcattataccacaaaaaagctgggaataaaaatgctaaccaaaaaaaaaggtgaaagtagataaaatttctcaactgtgtgatgggtaaacgtgcaggtttgctgtcatgctttgtttatgaagctgtggggtacaaggactctcatacgtcactgtggaatgcagaacgttgcagcctcatggaagaggatttggcagcatctaacaaaacgacatggcatttgcccttagactcagcaattctagaatctgcctcaaaaaaaactctggcaaagaaatgaaaggactttatccacagagttcttttcacagcct

SEQ ID NO: 33957 - DNA, 322 bp, Homo sapiens
gtcctcctcctcctgctgtggctgagccttggggtgaagacaggcagctgctcccaaccccagaacctttgctgtcttgggacggatcaccactgcaagaggggaagttgctactgtgatgaattctgccatgtggcaccagactgccacccagaccacagtgtcctctgcaaccctgcttctcagatgaccaagatggtgctgcagatggtgctgaggatggagaacccaccaagccccgctaggagccacctagactggatgcagagcatgatttgaagattgtaccaggagagcagcaggaggaggacggggatcctct

SEQ ID NO: 33958 - DNA, 278 bp, Homo sapiens
ccctctccgacattctgcggccgcggctgtggtgagtgagtgaattgagatcaggtatggagggacttggctcctggtgagtgagttaattgagatgaggtgtggagggacctgtctcctggtgagtgagttaattgagatgaggtatggagggacctgtctcctggtgagtgagtgaattgagatcaggtatggagggacttggctcctggtgagtgagttaattgagaggtgggcagaaaagtgttagtaccaccctcattttacaaacacatcct

SEQ ID NO: 33959 - DNA, 238 bp, Homo sapiens
ccagagccaccaaggaggaaagtggggagaagaaactgtattatgaaggcagacgaacagttcctgcaaaggtgagatttgtgtgtgcagctgggccgcactggaccagggatgagagtgggtgcccgggactcgcctatactgcctgggggtgcagcccgcactcctcactatagtcaaatcgactatgcgtgctttccaggggcccgggagaggactccatggggagggatgctta

SEQ ID NO: 33960 - DNA, 220 bp, Homo sapiens
agagaaggactggaagaatcttggagttgggaatgtcacacgtaattgaaggaagaacaagaaaactatagtaaagaaccctggggtggtgatgtagtcatgggccaagtgtcctggaaccctggggtggtgatgtagtcatgggccaagtgtcctggaaccctggggtggtgatgtagttgtgggccaagtgtcctgggttttgggtggagaaagagtc

SEQ ID NO: 33961 - DNA, 195 bp, Homo sapiens
aacaccaaggatccctgggctcacgtccgaacctgcagacctggaggggcagggcttcaccttcaagggtgtggagggacctggctcctggtgagtgagtgaattgagatgaggtatggagggacctggctcctggtgagtgagtgaattgagatgaggtgtggagggacctgtctcctggtgagtgagttaatt

SEQ ID NO: 33962 - DNA, 176 bp, Homo sapiens
cgctaaagctgcctctagtcagacatgatggtatcttgggtagaaacttgaaggcgtgtggagggacctgtctcctggtgagtgagttaattgagatgaggtatggagggacctgtctcctggtgagtgagtgaattgagatcaggtatggagggacttggctcctggtgagtgag

SEQ ID NO: 33963 - DNA, 2179 bp, Homo sapiens
catatcttcaaatcaaatttcagtggagtgtttaccgggcaaggaaggcaggggggtcagcttgctgacagcctcaacctgccagccctcagcctgcacatttgtgatcacctggtcacacacctgggcaggaggctgcccctccctggtttgaggaagcaggaaaaggtacccgcgagagacagccagcagttctgtggagcagcggtggccggctaggatgggctgtctctggggtctggctctgccccttttcttcttctgctgggaggttggggtctctgggagctctgcaggccccagcacccgcagagcagacactgcgatgacaacggacgacacagaagtgcccgctatgactctagcaccgggccacgccgctctggaaactcaaacgctgagcgctgagacctcttctagggcctcaaccccagccggccccattccagaagcagagaccaggggagccaagagaatttcccctgcaagagagaccaggagtttcacaaaaacatctcccaacttcatggtgctgatcgccacctccgtggagacatcagccgccagtggcagccccgagggagctggaatgaccacagttcagaccatcacaggcagtgatcccgaggaagccatctttgacaccctttgcaccgatgacagctctgaagaggcaaagacactcacaatggacatattgacattggctcacacctccacagaagctaagggcctgtcctcagagagcagtgcctcttccgacggcccccatccagtcatcaccccgtcacgggcctcagagagcagcgcctcttccgacggcccccatccagtcatcaccccgtcacgggcctcagagagcagcgcctcttccgacggcccccatccagtcatcaccccgtcatggtccccgggatctgatgtcactctcctcgctgaagccctggtgactgtcacaaacatcgaggttattaattgcagcatcacagaaatagaaacaacaacttccagcatccctggggcctcagacatagatctcatccccacggaaggggtgaaggcctcgtccacctccgatccaccagctctgcctgactccactgaagcaaaaccacacatcactgaggtcacagcctctgccgagaccctgtccacagccggcaccacagagtcagctgcacctcatgccacggttgggaccccactccccactaacagcgccacagaaagagaagtgacagcacccggggccacgaccctcagtggagctctggtcacagttagcaggaatcccctggaagaaacctcagccctctctgttgagacaccaagttacgtcaaagtctcaggagcagctccggtctccatagaggctgggtcagcagtgggcaaaacaacttcctttgctgggagctctgcttcctcctacagcccctcggaagccgccctcaagaacttcaccccttcagagacaccgaccatggacatcgcaaccaaggggcccttccccaccagcagggaccctcttccttctgtccctccgactacaaccaacagcagccgagggacgaacagcaccttagccaagatcacaacctcagcgaagaccacgatgaagcccccaacagccacgcccacgactgcccggacgaggccgaccacagacgtgagtgcaggtgaaaatggaggtttcctcctcctgcggctgagtgtggcttccccggaagacctcactgaccccagagtggcagaaaggctgatgcagcagctccaccgggaactccacgcccacgcgcctcacttccaggtctccttactgcgtgtcaggagaggctaacggacatcagctgcagccaggcatgtcccgtatgccaaaagagggtgctgcccctagcctgggcccccaccgacagactgcagctgcgttactgtgctgagaggtacccagaaggttcccatgaagggcagcatgtccaagcccctgaccccagatgtggcaacaggaccctcgctcacatccaccggagtgtatgtgtggggaggggcttcacctgttcccagaggtgtccttggactcaccttggcacatgttctgtgtttcagtaaagagagacctgatcacccatctgtgtgcttccatcctgcattaaaattcactcagtgtggcccagaaaaaaaa

SEQ ID NO: 33964 - DNA, 4259 bp, Homo sapiens
gtgttgcctaggctggtctcaaactgctgggcttaagtgatcgttcctccttggcctcccgaagtgctggaattataggtgtgaaccaccatgtctggccttgtagtttatttctaagttcaaattaatgttggtgcttttcctccttttttcttagcagatggtttgctaggtgagtgtgtcctcgattctttaaatcaggggtccccaatccccaggccacagattgttccagtccatggcctgttaggaaccaggccacacagtaggaggtgagcagccagccagtgagcattactgtgtgagctccgccccctgccagagcattactgtgtgagctccgccccctgtcagagcattactgtgtgagctccgccccctgccagagattactgtgtgagctccgccccctgccagagcattactgtgtgagctccgccccctgtcattactgtgtgagctccgccccctgtcatatcattactgtgtgagctccgccccctgtcatatcattattgtgagctccgcccctgtcatatcattgctgtgtgagctccgcctcctgtcagatcagtggtggcattagattctcataggagtggaatcctgttgtgaactgcgcatgagaaggatctaggttatgccccgcttatgagaatctaatactgatgatctgagatggaaccgtttcatctccaaaccatccccacacttgtcagtggaaaaagtgtcttccgtgaaaccagtccctggtgccaaaaaggttagggactgccggtttaaataaccaaatgctaaaagaactggcatagaagtaaatgggctgctgctttatttttaggctgttctttttagagagcaatgacagttatttccaagtttgtcattagaaaataatattaggttggagcaaaagtaattgcagtttttgccattgctttcaatggtaaaaggcacaattacttttgcagcaacttaatattataaatttgttcttaaagtgtatttttgataagaaagccgttttgtttttccttctgttaattttttgtttttttcttggtcgagacagagtcttgccatgctgcccaggctggagtgcagtggtgtgatctcggctcactgcagcctccacctcctgggctccagcagtcctcccacctcaacctccctaagagctgagactacaggtgtgagccaccatgcctggctaatttttagagacagggtttcaccctcttgcccaggctggtcccaaactcctgggctcaagcagtcctcctgcctcagcctcccagagtattgggattataggtgtgagccactgccagaaaaacgtttcctaagacaaggcaggtcttacattatatttaaattttttttaatgatgtcttttttggcagtgcacagccagaggacaacacatcacacacaagaaacagttgtgctcatgtgatgggggcctcagcactaggaaggagtggactgttggcgcacgcagcagcttgaataaatctgaaagtcactacgctgcgtaagagaagccaaataaagcgcatgctgtgtacagagggtgtcgagaatgcctcctacgtgacggaaagcagatccgtggttccctgcagactggcaggagcagattccaaaggcacaggaagaagcttgcaggcagctgctcccaaccccagaacctttgctgtcttgggacggatcaccactgcaagaggggaagttgctactgtgatgaattctgccatgtggcaccagactgccacccagaccacagtgtcctctgcaaccctggtaactcacatacaggcccgattccaccgacagcaaagctggatgctatggctggcagaggcaaaccctttgcctgcacttcaggccaaagccgggatgtggcctagatggttcctaaggtccctgacaatcctgagatcttgcatcttgtctatttcaggtcaaaggtgcctacatgctccttctagctttgtttccctgatgttccttgccacctgctactcctctctgagctacttttccaggttccacagggagaggttcagctgtccgtggtagacatgagggtagagagtgaggtggttgggttccacttacctttctatcatcttgcagtatggatgtctcttgactggtaccgtgtagacttttgagggcacacaggagtctgcagagagatactggggacattgagcagcagcagtggggttgggaggcagaaatgaggacaggaacatttaccttgtgtttctctcagcttctcagatgaccaagatggtgctgcagatggtgctgaggatggagaacccaccaagccccgctaggagccacctagactggatgcagagcatggccccagcacccgcagagcagacactgcgatgacaacggacgacacagaagtgcccgctatgactctagcaccgggccacgccgctctggaaactcaaacgctgagcgctgagacctcttctagggcctcaaccccagccggccccattccagaagcagagaccaggggagccaagagaatttcccctgcaagagagaccaggagtttcacaaaaacatctcccaacttcatggtgctgatcgccacctccgtggagacatcagccgccagtggcagccccgagggagctggaatgaccacagttcagaccatcacaggcagtgatcccgaggaagccatctttgacaccctttgcaccgatgacagctctgaagaggcaaagacactcacaatggacatattgacattggctcacacctccacagaagctaagggcctgtcctcagagagcagtgcctcttccgacggcccccatccagtcatcaccccgtcacgggcctcagagagcagcgcctcttccgacggcccccatccagtcatcaccccgtcacgggcctcagagagcagcgcctcttccgacggcccccatccagtcatcaccccgtcatggtccccgggatctgatgtcactctcctcgctgaagccctggtgactgtcacaaacatcgaggttattaattgcagcatcacagaaatagaaacaacaacttccagcatccctggggcctcagacatagatctcatccccacggaaggggtgaaggcctcgtccacctccgatccaccagctctgcctgactccactgaagcaaaaccacacatcactgaggtcacagcctctgccgagaccctgtccacagccggcaccacagagtcagctgcacctcatgccacggttgggaccccactccccactaacagcgccacagaaagagaagtgacagcacccggggccacgaccctcagtggagctctggtcacagttagcaggaatcccctggaagaaacctcagccctctctgttgagacaccaagttacgtcaaagtctcaggagcagctccggtctccatagaggctgggtcagcagtgggcaaaacaacttcctttgctgggagctctgcttcctcctacagcccctcggaagccgccctcaagaacttcaccccttcagagacaccgaccatggacatcgcaaccaaggggcccttccccaccagcagggaccctcttccttctgtccctccgactacaaccaacagcagccgagggacgaacagcaccttagccaagatcacaacctcagcgaagaccacgatgaagcccccaacagccacgcccacgactgcccggacgaggccgaccacagacgtgagtgcaggtgaaaatggaggtttcctcctcctgcggctgagtgtggcttccccggaagacctcactgaccccagagtggcagaaaggctgatgcagcagctccaccgggaactccacgcccacgcgcctcacttccaggtctccttactgcgtgtcaggagaggctaacggacatcagctgcagccaggcatgtcccgtatgccaaaagagggtgctgcccctagcctgggcccccaccgacagactgcagctgcgttactgtgctgagaggtacccagaaggttcccatgaagggcagcatgtccaagcccctgaccccagatgtggcaacaggaccctcgctcacatccaccggagtgtatgtgtggggaggggcttcacctgttcccagaggtgtccttggactcaccttggcacatgttctgtgtttcagtaaagagagacctgatcacccatctgtgtgcttccatcctgcattaaaattcactcagtgtggcccagaaaaaaaa

SEQ ID NO: 33965 - DNA, 3646 bp, Homo sapiens
gtgttgcctaggctggtctcaaactgctgggcttaagtgatcgttcctccttggcctcccgaagtgctggaattataggtgtgaaccaccatgtctggccttgtagtttatttctaagttcaaattaatgttggtgcttttcctccttttttcttagcagatggtttgctaggtgagtgtgtcctcgattctttaaatcaggggtccccaatccccaggccacagattgttccagtccatggcctgttaggaaccaggccacacagtaggaggtgagcagccagccagtgagcattactgtgtgagctccgccccctgccagagcattactgtgtgagctccgccccctgtcagagcattactgtgtgagctccgccccctgccagagattactgtgtgagctccgccccctgccagagcattactgtgtgagctccgccccctgtcattactgtgtgagctccgccccctgtcatatcattactgtgtgagctccgccccctgtcatatcattattgtgagctccgcccctgtcatatcattgctgtgtgagctccgcctcctgtcagatcagtggtggcattagattctcataggagtggaatcctgttgtgaactgcgcatgagaaggatctaggttatgccccgcttatgagaatctaatactgatgatctgagatggaaccgtttcatctccaaaccatccccacacttgtcagtggaaaaagtgtcttccgtgaaaccagtccctggtgccaaaaaggttagggactgccggtttaaataaccaaatgctaaaagaactggcatagaagtaaatgggctgctgctttatttttaggctgttctttttagagagcaatgacagttatttccaagtttgtcattagaaaataatattaggttggagcaaaagtaattgcagtttttgccattgctttcaatggtaaaaggcacaattacttttgcagcaacttaatattataaatttgttcttaaagtgtatttttgataagaaagccgttttgtttttccttctgttaattttttgtttttttcttggtcgagacagagtcttgccatgctgcccaggctggagtgcagtggtgtgatctcggctcactgcagcctccacctcctgggctccagcagtcctcccacctcaacctccctaagagctgagactacaggtgtgagccaccatgcctggctaatttttagagacagggtttcaccctcttgcccaggctggtcccaaactcctgggctcaagcagtcctcctgcctcagcctcccagagtattgggattataggtgtgagccactgccagaaaaacgtttcctaagacaaggcaggtcttacattatatttaaattttttttaatgatgtcttttttggcagtgcacagccagaggacaacacatcacacacaagaaacagttgtgctcatgtgatgggggcctcagcactaggaaggagtggactgttggcgcacgcagcagcttgaataaatctgaaagtcactacgctgcgtaagagaagccaaataaagcgcatgctgtgtacagagggtgtcgagaatgcctcctacgtgacggaaagcagatccgtggttccctgcagactggcaggagcagattccaaaggcacaggaagaagcttgcagcttctcagatgaccaagatggtgctgcagatggtgctgaggatggagaacccaccaagccccgctaggagccacctagactggatgcagagcatggccccagcacccgcagagcagacactgcgatgacaacggacgacacagaagtgcccgctatgactctagcaccgggccacgccgctctggaaactcaaacgctgagcgctgagacctcttctagggcctcaaccccagccggccccattccagaagcagagaccaggggagccaagagaatttcccctgcaagagagaccaggagtttcacaaaaacatctcccaacttcatggtgctgatcgccacctccgtggagacatcagccgccagtggcagccccgagggagctggaatgaccacagttcagaccatcacaggcagtgatcccgaggaagccatctttgacaccctttgcaccgatgacagctctgaagaggcaaagacactcacaatggacatattgacattggctcacacctccacagaagctaagggcctgtcctcagagagcagtgcctcttccgacggcccccatccagtcatcaccccgtcacgggcctcagagagcagcgcctcttccgacggcccccatccagtcatcaccccgtcacgggcctcagagagcagcgcctcttccgacggcccccatccagtcatcaccccgtcatggtccccgggatctgatgtcactctcctcgctgaagccctggtgactgtcacaaacatcgaggttattaattgcagcatcacagaaatagaaacaacaacttccagcatccctggggcctcagacatagatctcatccccacggaaggggtgaaggcctcgtccacctccgatccaccagctctgcctgactccactgaagcaaaaccacacatcactgaggtcacagcctctgccgagaccctgtccacagccggcaccacagagtcagctgcacctcatgccacggttgggaccccactccccactaacagcgccacagaaagagaagtgacagcacccggggccacgaccctcagtggagctctggtcacagttagcaggaatcccctggaagaaacctcagccctctctgttgagacaccaagttacgtcaaagtctcaggagcagctccggtctccatagaggctgggtcagcagtgggcaaaacaacttcctttgctgggagctctgcttcctcctacagcccctcggaagccgccctcaagaacttcaccccttcagagacaccgaccatggacatcgcaaccaaggggcccttccccaccagcagggaccctcttccttctgtccctccgactacaaccaacagcagccgagggacgaacagcaccttagccaagatcacaacctcagcgaagaccacgatgaagcccccaacagccacgcccacgactgcccggacgaggccgaccacagacgtgagtgcaggtgaaaatggaggtttcctcctcctgcggctgagtgtggcttccccggaagacctcactgaccccagagtggcagaaaggctgatgcagcagctccaccgggaactccacgcccacgcgcctcacttccaggtctccttactgcgtgtcaggagaggctaacggacatcagctgcagccaggcatgtcccgtatgccaaaagagggtgctgcccctagcctgggcccccaccgacagactgcagctgcgttactgtgctgagaggtacccagaaggttcccatgaagggcagcatgtccaagcccctgaccccagatgtggcaacaggaccctcgctcacatccaccggagtgtatgtgtggggaggggcttcacctgttcccagaggtgtccttggactcaccttggcacatgttctgtgtttcagtaaagagagacctgatcacccatctgtgtgcttccatcctgcattaaaattcactcagtgtggcccagaaaaaaaa

SEQ ID NO: 33966 - DNA, 2125 bp, Homo sapiens
catatcttcaaatcaaatttcagtggagtgtttaccgggcaaggaaggcaggggggtcagcttgctgacagcctcaacctgccagccctcagcctgcacatttgtgatcacctggtcacacacctgggcaggaggctgcccctccctggtttgaggaagcaggaaaaggtacccgcgagagacagccagcagttctgtggagcagcggtggccggctaggatgggctgtctctggggtctggctctgccccttttcttcttctgctgggaggttggggtctctgggagctctgcaggccccagcacccgcagagcagacactgcgatgacaacggacgacacagaagtgcccgctatgactctagcaccgggccacgccgctctggaaactcaaacgctgagcgctgagacctcttctagggcctcaaccccagccggccccattccagaagcagagaccaggggagccaagagaatttcccctgcaagagagaccaggagtttcacaaaaacatctcccaacttcatggtgctgatcgccacctccgtggagacatcagccgccagtggcagccccgagggagctggaatgaccacagttcagaccatcacaggcagtgatcccgaggaagccatctttgacaccctttgcaccgatgacagctctgaagaggcaaagacactcacaatggacatattgacattggctcacacctccacagaagctaagggcctgtcctcagagagcagtgcctcttccgacggcccccatccagtcatcaccccgtcacgggcctcagagagcagcgcctcttccgacggcccccatccagtcatcaccccgtcacgggcctcagagagcagcgcctcttccgacggcccccatccagtcatcaccccgtcatggtccccgggatctgatgtcactctcctcgctgaagccctggtgactgtcacaaacatcgaggttattaattgcagcatcacagaaatagaaacaacaacttccagcatccctggggcctcagacatagatctcatccccacggaaggggtgaaggcctcgtccacctccgatccaccagctctgcctgactccactgaagcaaaaccacacatcactgaggtcacagcctctgccgagaccctgtccacagccggcaccacagagtcagctgcacctcatgccacggttgggaccccactccccactaacagcgccacagaaagagaagtgacagcacccggggccacgaccctcagtggagctctggtcacagttagcaggaatcccctggaagaaacctcagccctctctgttgagacaccaagttacgtcaaagtctcaggagcagctccggtctccatagaggctgggtcagcagtgggcaaaacaacttcctttgctgggagctctgcttcctcctacagcccctcggaagccgccctcaagaacttcaccccttcagagacaccgaccatggacatcgcaaccaaggggcccttccccaccagcagggaccctcttccttctgtccctccgactacaaccaacagcagccgagggacgaacagcaccttagccaagatcacaacctcagcgaagaccacgatgaagcccccaacagccacgcccacgactgcccggacgaggccgaccacagacgtgagtgcaggtgaaaatggaggtttcctcctcctgcggctgagtgtggcttccccggaagacctcactgaccccagagtggcagaaaggctgatgcagcagctccaccgggaactccacgcccacgcgcctcacttccaggtctccttactgcgtgtcaggagaggctaacggacatcagctgcagccaggcatgtcccgtatgccaaaagagggtgctgcccctagcctgggcccccaccgacagactgcagctgcgttactgtgctgagaggtacccagaaggttcccatgaagggcagcatgtccaagcccctgaccccagatgtggcaacaggaccctcgctcacatccaccggagtgtatgtgtggggaggggcttcacctgttcccagaggtgtccttggactcaccttggcacatgttctgtgtttcagtaaagagagacctgatcaccca

SEQ ID NO: 33967 - DNA, 4316 bp, Homo sapiens
gtgttgcctaggctggtctcaaactgctgggcttaagtgatcgttcctccttggcctcccgaagtgctggaattataggtgtgaaccaccatgtctggccttgtagtttatttctaagttcaaattaatgttggtgcttttcctccttttttcttagcagatggtttgctaggtgagtgtgtcctcgattctttaaatcaggggtccccaatccccaggccacagattgttccagtccatggcctgttaggaaccaggccacacagtaggaggtgagcagccagccagtgagcattactgtgtgagctccgccccctgccagagcattactgtgtgagctccgccccctgtcagagcattactgtgtgagctccgccccctgccagagattactgtgtgagctccgccccctgccagagcattactgtgtgagctccgccccctgtcattactgtgtgagctccgccccctgtcatatcattactgtgtgagctccgccccctgtcatatcattattgtgagctccgcccctgtcatatcattgctgtgtgagctccgcctcctgtcagatcagtggtggcattagattctcataggagtggaatcctgttgtgaactgcgcatgagaaggatctaggttatgccccgcttatgagaatctaatactgatgatctgagatggaaccgtttcatctccaaaccatccccacacttgtcagtggaaaaagtgtcttccgtgaaaccagtccctggtgccaaaaaggttagggactgccggtttaaataaccaaatgctaaaagaactggcatagaagtaaatgggctgctgctttatttttaggctgttctttttagagagcaatgacagttatttccaagtttgtcattagaaaataatattaggttggagcaaaagtaattgcagtttttgccattgctttcaatggtaaaaggcacaattacttttgcagcaacttaatattataaatttgttcttaaagtgtatttttgataagaaagccgttttgtttttccttctgttaattttttgtttttttcttggtcgagacagagtcttgccatgctgcccaggctggagtgcagtggtgtgatctcggctcactgcagcctccacctcctgggctccagcagtcctcccacctcaacctccctaagagctgagactacaggtgtgagccaccatgcctggctaatttttagagacagggtttcaccctcttgcccaggctggtcccaaactcctgggctcaagcagtcctcctgcctcagcctcccagagtattgggattataggtgtgagccactgccagaaaaacgtttcctaagacaaggcaggtcttacattatatttaaattttttttaatgatgtcttttttggcagtgcacagccagaggacaacacatcacacacaagaaacagttgtgctcatgtgatgggggcctcagcactaggaaggagtggactgttggcgcacgcagcagcttgaataaatctgaaagtcactacgctgcgtaagagaagccaaataaagcgcatgctgtgtacagagggtgtcgagaatgcctcctacgtgacggaaagcagatccgtggttccctgcagactggcaggagcagattccaaaggcacaggaagaagcttgcaggcagctgctcccaaccccagaacctttgctgtcttgggacggatcaccactgcaagaggggaagttgctactgtgatgaattctgccatgtggcaccagactgccacccagaccacagtgtcctctgcaaccctggtaactcacatacaggcccgattccaccgacagcaaagctggatgctatggctggcagaggcaaaccctttgcctgcacttcaggccaaagccgggatgtggcctagatggttcctaaggtccctgacaatcctgagatcttgcatcttgtctatttcaggtcaaaggtgcctacatgctccttctagctttgtttccctgatgttccttgccacctgctactcctctctgagctacttttccaggttccacagggagaggttcagctgtccgtggtagacatgagggtagagagtgaggtggttgggttccacttacctttctatcatcttgcagtatggatgtctcttgactggtaccgtgtagacttttgagggcacacaggagtctgcagagagatactggggacattgagcagcagcagtggggttgggaggcagaaatgaggacaggaacatttaccttgtgtttctctcagcttctcagatgaccaagatggtgctgcagatggtgctgaggatggagaacccaccaagccccgctaggagccacctagactggatgcagagcatggccccagcacccgcagagcagacactgcgatgacaacggacgacacagaagtgcccgctatgactctagcaccgggccacgccgctctggaaactcaaacgctgagcgctgagacctcttctagggcctcaaccccagccggccccattccagaagcagagaccaggggagccaagagaatttcccctgcaagagagaccaggagtttcacaaaaacatctcccaacttcatggtgctgatcgccacctccgtggagacatcagccgccagtggcagccccgagggagctggaatgaccacagttcagaccatcacaggcagtgatcccgaggaagccatctttgacaccctttgcaccgatgacagctctgaagaggcaaagacactcacaatggacatattgacattggctcacacctccacagaagctaagggcctgtcctcagagagcagtgcctcttccgacggcccccatccagtcatcaccccgtcacgggcctcagagagcagcgcctcttccgacggcccccatccagtcatcaccccgtcacgggcctcagagagcagcgcctcttccgacggcccccatccagtcatcaccccgtcacgggcctcagagagcagcgcctcttccgacggcccccatccagtcatcaccccgtcatggtccccgggatctgatgtcactctcctcgctgaagccctggtgactgtcacaaacatcgaggttattaattgcagcatcacagaaatagaaacaacaacttccagcatccctggggcctcagacatagatctcatccccacggaaggggtgaaggcctcgtccacctccgatccaccagctctgcctgactccactgaagcaaaaccacacatcactgaggtcacagcctctgccgagaccctgtccacagccggcaccacagagtcagctgcacctcatgccacggttgggaccccactccccactaacagcgccacagaaagagaagtgacagcacccggggccacgaccctcagtggagctctggtcacagttagcaggaatcccctggaagaaacctcagccctctctgttgagacaccaagttacgtcaaagtctcaggagcagctccggtctccatagaggctgggtcagcagtgggcaaaacaacttcctttgctgggagctctgcttcctcctacagcccctcggaagccgccctcaagaacttcaccccttcagagacaccgaccatggacatcgcaaccaaggggcccttccccaccagcagggaccctcttccttctgtccctccgactacaaccaacagcagccgagggacgaacagcaccttagccaagatcacaacctcagcgaagaccacgatgaagcccccaacagccacgcccacgactgcccggacgaggccgaccacagacgtgagtgcaggtgaaaatggaggtttcctcctcctgcggctgagtgtggcttccccggaagacctcactgaccccagagtggcagaaaggctgatgcagcagctccaccgggaactccacgcccacgcgcctcacttccaggtctccttactgcgtgtcaggagaggctaacggacatcagctgcagccaggcatgtcccgtatgccaaaagagggtgctgcccctagcctgggcccccaccgacagactgcagctgcgttactgtgctgagaggtacccagaaggttcccatgaagggcagcatgtccaagcccctgaccccagatgtggcaacaggaccctcgctcacatccaccggagtgtatgtgtggggaggggcttcacctgttcccagaggtgtccttggactcaccttggcacatgttctgtgtttcagtaaagagagacctgatcacccatctgtgtgcttccatcctgcattaaaattcactcagtgtggcccagaaaaaaaa

SEQ ID NO: 33968 - DNA, 2083 bp, Homo sapiens
gaggaggtttcacagcagaaaggacaccccggggctcctggataagccagaaaatgtgccaggggaagtcgggctccaagggcaccactctgggcttccagctgtgtgggctggaccaagaaggctcagagaaatgatctcaggcttgaagtggggagaagaaactgtattatgaaggcagacgaacagttcctgcaaaggccccagcacccgcagagcagacactgcgatgacaacggacgacacagaagtgcccgctatgactctagcaccgggccacgccgctctggaaactcaaacgctgagcgctgagacctcttctagggcctcaaccccagccggccccattccagaagcagagaccaggggagccaagagaatttcccctgcaagagagaccaggagtttcacaaaaacatctcccaacttcatggtgctgatcgccacctccgtggagacatcagccgccagtggcagccccgagggagctggaatgaccacagttcagaccatcacaggcagtgatcccgaggaagccatctttgacaccctttgcaccgatgacagctctgaagaggcaaagacactcacaatggacatattgacattggctcacacctccacagaagctaagggcctgtcctcagagagcagtgcctcttccgacggcccccatccagtcatcaccccgtcacgggcctcagagagcagcgcctcttccgacggcccccatccagtcatcaccccgtcacgggcctcagagagcagcgcctcttccgacggcccccatccagtcatcaccccgtcatggtccccgggatctgatgtcactctcctcgctgaagccctggtgactgtcacaaacatcgaggttattaattgcagcatcacagaaatagaaacaacaacttccagcatccctggggcctcagacatagatctcatccccacggaaggggtgaaggcctcgtccacctccgatccaccagctctgcctgactccactgaagcaaaaccacacatcactgaggtcacagcctctgccgagaccctgtccacagccggcaccacagagtcagctgcacctcatgccacggttgggaccccactccccactaacagcgccacagaaagagaagtgacagcacccggggccacgaccctcagtggagctctggtcacagttagcaggaatcccctggaagaaacctcagccctctctgttgagacaccaagttacgtcaaagtctcaggagcagctccggtctccatagaggctgggtcagcagtgggcaaaacaacttcctttgctgggagctctgcttcctcctacagcccctcggaagccgccctcaagaacttcaccccttcagagacaccgaccatggacatcgcaaccaaggggcccttccccaccagcagggaccctcttccttctgtccctccgactacaaccaacagcagccgagggacgaacagcaccttagccaagatcacaacctcagcgaagaccacgatgaagcccccaacagccacgcccacgactgcccggacgaggccgaccacagacgtgagtgcaggtgaaaatggaggtttcctcctcctgcggctgagtgtggcttccccggaagacctcactgaccccagagtggcagaaaggctgatgcagcagctccaccgggaactccacgcccacgcgcctcacttccaggtctccttactgcgtgtcaggagaggctaacggacatcagctgcagccaggcatgtcccgtatgccaaaagagggtgctgcccctagcctgggcccccaccgacagactgcagctgcgttactgtgctgagaggtacccagaaggttcccatgaagggcagcatgtccaagcccctgaccccagatgtggcaacaggaccctcgctcacatccaccggagtgtatgtgtggggaggggcttcacctgttcccagaggtgtccttggactcaccttggcacatgttctgtgtttcagtaaagagagacctgatcacccatctgtgtgcttccatcctgcattaaaattcactcagtgtggcccagaaaaaaaa

SEQ ID NO: 33969 - DNA, 2236 bp, Homo sapiens
catatcttcaaatcaaatttcagtggagtgtttaccgggcaaggaaggcaggggggtcagcttgctgacagcctcaacctgccagccctcagcctgcacatttgtgatcacctggtcacacacctgggcaggaggctgcccctccctggtttgaggaagcaggaaaaggtacccgcgagagacagccagcagttctgtggagcagcggtggccggctaggatgggctgtctctggggtctggctctgccccttttcttcttctgctgggaggttggggtctctgggagctctgcaggccccagcacccgcagagcagacactgcgatgacaacggacgacacagaagtgcccgctatgactctagcaccgggccacgccgctctggaaactcaaacgctgagcgctgagacctcttctagggcctcaaccccagccggccccattccagaagcagagaccaggggagccaagagaatttcccctgcaagagagaccaggagtttcacaaaaacatctcccaacttcatggtgctgatcgccacctccgtggagacatcagccgccagtggcagccccgagggagctggaatgaccacagttcagaccatcacaggcagtgatcccgaggaagccatctttgacaccctttgcaccgatgacagctctgaagaggcaaagacactcacaatggacatattgacattggctcacacctccacagaagctaagggcctgtcctcagagagcagtgcctcttccgacggcccccatccagtcatcaccccgtcacgggcctcagagagcagcgcctcttccgacggcccccatccagtcatcaccccgtcacgggcctcagagagcagcgcctcttccgacggcccccatccagtcatcaccccgtcacgggcctcagagagcagcgcctcttccgacggcccccatccagtcatcaccccgtcatggtccccgggatctgatgtcactctcctcgctgaagccctggtgactgtcacaaacatcgaggttattaattgcagcatcacagaaatagaaacaacaacttccagcatccctggggcctcagacatagatctcatccccacggaaggggtgaaggcctcgtccacctccgatccaccagctctgcctgactccactgaagcaaaaccacacatcactgaggtcacagcctctgccgagaccctgtccacagccggcaccacagagtcagctgcacctcatgccacggttgggaccccactccccactaacagcgccacagaaagagaagtgacagcacccggggccacgaccctcagtggagctctggtcacagttagcaggaatcccctggaagaaacctcagccctctctgttgagacaccaagttacgtcaaagtctcaggagcagctccggtctccatagaggctgggtcagcagtgggcaaaacaacttcctttgctgggagctctgcttcctcctacagcccctcggaagccgccctcaagaacttcaccccttcagagacaccgaccatggacatcgcaaccaaggggcccttccccaccagcagggaccctcttccttctgtccctccgactacaaccaacagcagccgagggacgaacagcaccttagccaagatcacaacctcagcgaagaccacgatgaagcccccaacagccacgcccacgactgcccggacgaggccgaccacagacgtgagtgcaggtgaaaatggaggtttcctcctcctgcggctgagtgtggcttccccggaagacctcactgaccccagagtggcagaaaggctgatgcagcagctccaccgggaactccacgcccacgcgcctcacttccaggtctccttactgcgtgtcaggagaggctaacggacatcagctgcagccaggcatgtcccgtatgccaaaagagggtgctgcccctagcctgggcccccaccgacagactgcagctgcgttactgtgctgagaggtacccagaaggttcccatgaagggcagcatgtccaagcccctgaccccagatgtggcaacaggaccctcgctcacatccaccggagtgtatgtgtggggaggggcttcacctgttcccagaggtgtccttggactcaccttggcacatgttctgtgtttcagtaaagagagacctgatcacccatctgtgtgcttccatcctgcattaaaattcactcagtgtggcccagaaaaaaaa

SEQ ID NO: 33970 - DNA, 2898 bp, Homo sapiens
ccaccctcatcccctgtgtaggaccactcctggctcgtgcacaccagagccagaggacaacacatcacacacaagaaacagttgtgctcatgtgatgggggcctcagcactaggaaggagtggactgttggcgcacgcagcagcttgaataaatctgaaagtcactacgctgcgtaagagaagccaaataaagcgcatgctgtgtacagagggtgtcgagaatgcctcctacgtgacggaaagcagatccgtggttccctgcagactggcaggagcagattccaaaggcacaggaagaagcttgcaggcagctgctcccaaccccagaacctttgctgtcttgggacggatcaccactgcaagaggggaagttgctactgtgatgaattctgccatgtggcaccagactgccacccagaccacagtgtcctctgcaaccctggtaactcacatacaggcccgattccaccgacagcaaagctggatgctatggctggcagaggcaaaccctttgcctgcacttcaggccaaagccgggatgtggcctagatggttcctaaggtccctgacaatcctgagatcttgcatcttgtctatttcaggtcaaaggtgcctacatgctccttctagctttgtttccctgatgttccttgccacctgctactcctctctgagctacttttccaggttccacagggagaggttcagctgtccgtggtagacatgagggtagagagtgaggtggttgggttccacttacctttctatcatcttgcagtatggatgtctcttgactggtaccgtgtagacttttgagggcacacaggagtctgcagagagatactggggacattgagcagcagcagtggggttgggaggcagaaatgaggacaggaacatttaccttgtgtttctctcagcttctcagatgaccaagatggtgctgcagatggtgctgaggatggagaacccaccaagccccgctaggagccacctagactggatgcagagcatggccccagcacccgcagagcagacactgcgatgacaacggacgacacagaagtgcccgctatgactctagcaccgggccacgccgctctggaaactcaaacgctgagcgctgagacctcttctagggcctcaaccccagccggccccattccagaagcagagaccaggggagccaagagaatttcccctgcaagagagaccaggagtttcacaaaaacatctcccaacttcatggtgctgatcgccacctccgtggagacatcagccgccagtggcagccccgagggagctggaatgaccacagttcagaccatcacaggcagtgatcccgaggaagccatctttgacaccctttgcaccgatgacagctctgaagaggcaaagacactcacaatggacatattgacattggctcacacctccacagaagctaagggcctgtcctcagagagcagtgcctcttccgacggcccccatccagtcatcaccccgtcacgggcctcagagagcagcgcctcttccgacggcccccatccagtcatcaccccgtcacgggcctcagagagcagcgcctcttccgacggcccccatccagtcatcaccccgtcatggtccccgggatctgatgtcactctcctcgctgaagccctggtgactgtcacaaacatcgaggttattaattgcagcatcacagaaatagaaacaacaacttccagcatccctggggcctcagacatagatctcatccccacggaaggggtgaaggcctcgtccacctccgatccaccagctctgcctgactccactgaagcaaaaccacacatcactgaggtcacagcctctgccgagaccctgtccacagccggcaccacagagtcagctgcacctcatgccacggttgggaccccactccccactaacagcgccacagaaagagaagtgacagcacccggggccacgaccctcagtggagctctggtcacagttagcaggaatcccctggaagaaacctcagccctctctgttgagacaccaagttacgtcaaagtctcaggagcagctccggtctccatagaggctgggtcagcagtgggcaaaacaacttcctttgctgggagctctgcttcctcctacagcccctcggaagccgccctcaagaacttcaccccttcagagacaccgaccatggacatcgcaaccaaggggcccttccccaccagcagggaccctcttccttctgtccctccgactacaaccaacagcagccgagggacgaacagcaccttagccaagatcacaacctcagcgaagaccacgatgaagcccccaacagccacgcccacgactgcccggacgaggccgaccacagacgtgagtgcaggtgaaaatggaggtttcctcctcctgcggctgagtgtggcttccccggaagacctcactgaccccagagtggcagaaaggctgatgcagcagctccaccgggaactccacgcccacgcgcctcacttccaggtctccttactgcgtgtcaggagaggctaacggacatcagctgcagccaggcatgtcccgtatgccaaaagagggtgctgcccctagcctgggcccccaccgacagactgcagctgcgttactgtgctgagaggtacccagaaggttcccatgaagggcagcatgtccaagcccctgaccccagatgtggcaacaggaccctcgctcacatccaccggagtgtatgtgtggggaggggcttcacctgttcccagaggtgtccttggactcaccttggcacatgttctgtgtttcagtaaagagagacctgatcacccatctgtgtgcttccatcctgcattaaaattcactcagtgtggcccagaaaaaaaa

SEQ ID NO: 33971 - DNA, 2179 bp, Homo sapiens
catatcttcaaatcaaatttcagtggagtgtttaccgggcaaggaaggcaggggggtcagcttgctgacagcctcaacctgccagccctcagcctgcacatttgtgatcacctggtcacacacctgggcaggaggctgcccctccctggtttgaggaagcaggaaaaggtacccgcgagagacagccagcagttctgtggagcagcggtggccggctaggatgggctgtctctggggtctggctctgccccttttcttcttctgctgggaggttggggtctctgggagctctgcaggccccagcacccgcagagcagacactgcgatgacaacggacgacacagaagtgcccgctatgactctagcaccgggccacgccgctctggaaactcaaacgctgagcgctgtgatcgtatatatgcccgcaatctggggaaggaaaaatatgttcatacccaaaacgggagccaagagaatttcccctgcaagagagaccaggagtttcacaaaaacatctcccaacttcatggtgctgatcgccacctccgtggagacatcagccgccagtggcagccccgagggagctggaatgaccacagttcagaccatcacaggcagtgatcccgaggaagccatctttgacaccctttgcaccgatgacagctctgaagaggcaaagacactcacaatggacatattgacattggctcacacctccacagaagctaagggcctgtcctcagagagcagtgcctcttccgacggcccccatccagtcatcaccccgtcacgggcctcagagagcagcgcctcttccgacggcccccatccagtcatcaccccgtcacgggcctcagagagcagcgcctcttccgacggcccccatccagtcatcaccccgtcatggtccccgggatctgatgtcactctcctcgctgaagccctggtgactgtcacaaacatcgaggttattaattgcagcatcacagaaatagaaacaacaacttccagcatccctggggcctcagacatagatctcatccccacggaaggggtgaaggcctcgtccacctccgatccaccagctctgcctgactccactgaagcaaaaccacacatcactgaggtcacagcctctgccgagaccctgtccacagccggcaccacagagtcagctgcacctcatgccacggttgggaccccactccccactaacagcgccacagaaagagaagtgacagcacccggggccacgaccctcagtggagctctggtcacagttagcaggaatcccctggaagaaacctcagccctctctgttgagacaccaagttacgtcaaagtctcaggagcagctccggtctccatagaggctgggtcagcagtgggcaaaacaacttcctttgctgggagctctgcttcctcctacagcccctcggaagccgccctcaagaacttcaccccttcagagacaccgaccatggacatcgcaaccaaggggcccttccccaccagcagggaccctcttccttctgtccctccgactacaaccaacagcagccgagggacgaacagcaccttagccaagatcacaacctcagcgaagaccacgatgaagcccccaacagccacgcccacgactgcccggacgaggccgaccacagacgtgagtgcaggtgaaaatggaggtttcctcctcctgcggctgagtgtggcttccccggaagacctcactgaccccagagtggcagaaaggctgatgcagcagctccaccgggaactccacgcccacgcgcctcacttccaggtctccttactgcgtgtcaggagaggctaacggacatcagctgcagccaggcatgtcccgtatgccaaaagagggtgctgcccctagcctgggcccccaccgacagactgcagctgcgttactgtgctgagaggtacccagaaggttcccatgaagggcagcatgtccaagcccctgaccccagatgtggcaacaggaccctcgctcacatccaccggagtgtatgtgtggggaggggcttcacctgttcccagaggtgtccttggactcaccttggcacatgttctgtgtttcagtaaagagagacctgatcacccatctgtgtgcttccatcctgcattaaaattcactcagtgtggcccagaaaaaaaa

SEQ ID NO: 33972 - DNA, 2130 bp, Homo sapiens
catatcttcaaatcaaatttcagtggagtgtttaccgggcaaggaaggcaggggggtcagcttgctgacagcctcaacctgccagccctcagcctgcacatttgtgatcacctggtcacacacctgggcaggaggctgcccctccctggtttgaggaagcaggaaaaggtacccgcgagagacagccagcagttctgtggagcagcggtggccggctaggatgggctgtctctggggtctggctctgccccttttcttcttctgctgggaggttggggtctctgggagctctgcaggccccagcacccgcagagcagacactgcgatgacaacggacgacacagaagtgcccgctatgactctagcaccgggccacgccgctctggaaactcaaacgctgagcgctgagacctcttctagggcctcaaccccagccggccccattccagaagcagagaccaggggagccaagagaatttcccctgcaagagagaccaggagtttcacaaaaacatctcccaacttcatggtgctgatcgccacctccgtggagacatcagccgccagtggcagccccgagggagctggaatgaccacagttcagaccatcacaggcagtgatcccgaggaagccatctttgacaccctttgcaccgatgacagctctgaagaggcaaagacactcacaatggacatattgacattggctcacacctccacagaagctaagggcctgtcctcagagagcagtgcctcttccgacggcccccatccagtcatcaccccgtcacgggcctcagagagcagcgcctcttccgacggcccccatccagtcatcaccccgtcacgggcctcagagagcagcgcctcttccgacggcccccatccagtcatcaccccgtcatggtccccgggatctgatgtcactctcctcgctgaagccctggtgactgtcacaaacatcgaggttattaattgcagcatcacagaaatagaaacaacaacttccagcatccctggggcctcagacatagatctcatccccacggaaggggtgaaggcctcgtccacctccgatccaccagctctgcctgactccactgaagcaaaaccacacatcactgaggtcacagcctctgccgagaccctgtccacagccggcaccacagagtcagctgcacctcatgccacggttgggaccccactccccactaacagcgccacagaaagagaagtgacagcacccggggccacgaccctcagtggagctctggtcacagttagcaggaatcccctggaagaaacctcagccctctctgttgagacaccaagttacgtcaaagtctcaggagcagctccggtctccatagaggctgggtcagcagtgggcaaaacaacttcctttgctgggagctctgcttcctcctacagcccctcggaagccgccctcaagaacttcaccccttcagagacaccgaccatggacatcgcaaccaaggggcccttccccaccagcagggaccctcttccttctgtccctccgactacaaccaacagcagccgagggacgaacagcaccttagccaagatcacaacctcagcgaagaccacgatgaagcccccaacagccacgcccacgactgcccggacgaggccgaccacagacgtgagtgcaggtgaaaatggaggtttcctcctcctgcggctgagtgtggcttccccggaagacctcactgaccccagagtggcagaaaggctgatgcagcaggtgagtgggcactttccgggccaggggagtagaggaaggggcgaggttcgcaggggctgcagggaagacccgcaggacacagaagagcagctaccgcacttggaagggagtctcgtttcttacggagaattgggagctgaatctgaggatctctgcctggctttgcttctgcctgccttctccgagttcttcatttccttctctgcaatgtaaacatgtgactcctagagcccccagtttcttctggtccttggaagcttggccttctggcctctgaggcaaaggtcagtgatactgatgggagggtaggtcggactcttggttgcaagtggcagaaacccaagtcagggcagtttatgcaa

SEQ ID NO: 33973 - DNA, 1184 bp, Homo sapiens
cggcctgatgttgacttcgggctggggcctcagacatagatctcatccccacggaaggggtgaaggcctcgtccacctccgatccaccagctctgcctgactccactgaagcaaaaccacacatcactgaggtcacagcctctgccgagaccctgtccacagccggcaccacagagtcagctgcacctcatgccacggttgggaccccactccccactaacagcgccacagaaagagaagtgacagcacccggggccacgaccctcagtggagctctggtcacagttagcaggaatcccctggaagaaacctcagccctctctgttgagacaccaagttacgtcaaagtctcaggagcagctccggtctccatagaggctgggtcagcagtgggcaaaacaacttcctttgctgggagctctgcttcctcctacagcccctcggaagccgccctcaagaacttcaccccttcagagacaccgaccatggacatcgcaaccaaggggcccttccccaccagcagggaccctcttccttctgtccctccgactacaaccaacagcagccgagggacgaacagcaccttagccaagatcacaacctcagcgaagaccacgatgaagcccccaacagccacgcccacgactgcccggacgaggccgaccacagacgtgagtgcaggtgaaaatggaggtttcctcctcctgcggctgagtgtggcttccccggaagacctcactgaccccagagtggcagaaaggctgatgcagcagctccaccgggaactccacgcccacgcgcctcacttccaggtctccttactgcgtgtcaggagaggctaacggacatcagctgcagccaggcatgtcccgtatgccaaaagagggtgctgcccctagcctgggcccccaccgacagactgcagctgcgttactgtgctgagaggtacccagaaggttcccatgaagggcagcatgtccaagcccctgaccccagatgtggcaacaggaccctcgctcacatccaccggagtgtatgtgtggggaggggcttcacctgttcccagaggtgtccttggactcaccttggcacatgttctgtgtttcagtaaagagagacctgatcacccatctgtgtgcttccatcctgcattaaaattcactcagtgtggcccagaaaaaaaa

SEQ ID NO: 33974 - DNA, 4176 bp, Homo sapiens
gtgttgcctaggctggtctcaaactgctgggcttaagtgatcgttcctccttggcctcccgaagtgctggaattataggtgtgaaccaccatgtctggccttgtagtttatttctaagttcaaattaatgttggtgcttttcctccttttttcttagcagatggtttgctaggtgagtgtgtcctcgattctttaaatcaggggtccccaatccccaggccacagattgttccagtccatggcctgttaggaaccaggccacacagtaggaggtgagcagccagccagtgagcattactgtgtgagctccgccccctgccagagcattactgtgtgagctccgccccctgtcagagcattactgtgtgagctccgccccctgccagagattactgtgtgagctccgccccctgccagagcattactgtgtgagctccgccccctgtcattactgtgtgagctccgccccctgtcatatcattactgtgtgagctccgccccctgtcatatcattattgtgagctccgcccctgtcatatcattgctgtgtgagctccgcctcctgtcagatcagtggtggcattagattctcataggagtggaatcctgttgtgaactgcgcatgagaaggatctaggttatgccccgcttatgagaatctaatactgatgatctgagatggaaccgtttcatctccaaaccatccccacacttgtcagtggaaaaagtgtcttccgtgaaaccagtccctggtgccaaaaaggttagggactgccggtttaaataaccaaatgctaaaagaactggcatagaagtaaatgggctgctgctttatttttaggctgttctttttagagagcaatgacagttatttccaagtttgtcattagaaaataatattaggttggagcaaaagtaattgcagtttttgccattgctttcaatggtaaaaggcacaattacttttgcagcaacttaatattataaatttgttcttaaagtgtatttttgataagaaagccgttttgtttttccttctgttaattttttgtttttttcttggtcgagacagagtcttgccatgctgcccaggctggagtgcagtggtgtgatctcggctcactgcagcctccacctcctgggctccagcagtcctcccacctcaacctccctaagagctgagactacaggtgtgagccaccatgcctggctaatttttagagacagggtttcaccctcttgcccaggctggtcccaaactcctgggctcaagcagtcctcctgcctcagcctcccagagtattgggattataggtgtgagccactgccagaaaaacgtttcctaagacaaggcaggtcttacattatatttaaattttttttaatgatgtcttttttggcagtgcacagccagaggacaacacatcacacacaagaaacagttgtgctcatgtgatgggggcctcagcactaggaaggagtggactgttggcgcacgcagcagcttgaataaatctgaaagtcactacgctgcgtaagagaagccaaataaagcgcatgctgtgtacagagggtgtcgagaatgcctcctacgtgacggaaagcagatccgtggttccctgcagactggcaggagcagattccaaaggcacaggaagaagcttgcaggcagctgctcccaaccccagaacctttgctgtcttgggacggatcaccactgcaagaggggaagttgctactgtgatgaattctgccatgtggcaccagactgccacccagaccacagtgtcctctgcaaccctggtaactcacatacaggcccgattccaccgacagcaaagctggatgctatggctggcagaggcaaaccctttgcctgcacttcaggccaaagccgggatgtggcctagatggttcctaaggtccctgacaatcctgagatcttgcatcttgtctatttcaggtcaaaggtgcctacatgctccttctagctttgtttccctgatgttccttgccacctgctactcctctctgagctacttttccaggttccacagggagaggttcagctgtccgtggtagacatgagggtagagagtgaggtggttgggttccacttacctttctatcatcttgcagtatggatgtctcttgactggtaccgtgtagacttttgagggcacacaggagtctgcagagagatactggggacattgagcagcagcagtggggttgggaggcagaaatgaggacaggaacatttaccttgtgtttctctcagcttctcagatgaccaagatggtgctgcagatggtgctgaggatggagaacccaccaagccccgctaggagccacctagactggatgcagagcatggtgagctccctgcaggttctctgagaaggggtggatggcagcctgctccttgcctttgtgccctccaggccccaaagtcagggaaccaaaagaagaaaggggccgtagctagggcagagctccactgcaatgattgttttaggggtaggagccaggattgccgtctgtggacactgaaatttgaatctcatatacttttgtgacaaaacattcttcctcttttgttcttctcctaccatctaaaaatgtagaaaacattcttagcctatgagttgcacaaaaacaggcagtggccagatttggcccatagaccatagtttgctgacttctgccctaaatcatcctccatttctttccttctgtgtccttgttactgacaaagccactttccctaaaatggggtctttccctgtttggtgccatgaagccaatatgcaaaaccgaaagtgagcctcaagcagtgcaggctttatttggtggccatggaattgagaagtgagagcttggctcacaaatcaacttttctgctcgtgagacccaggaagtcacagatacagggcatctttagtgaaggggctgagcattaaaagcaaggggaggagtggccaggtgcaatggctcactcccataaacccagaactttgggaggccaaaatgagaggattgctgagaccaggagttcgagaccatcctggtcaacatagtgatacacccccatctctacaaaaataaaaatgaaaaaagcaaggggaggaatcatgtgttttctgggtctgggtggagaaattttcaaaaccagagtgccaccttcctatttgtttttttatgttattttttcccatcattgtcatgttggttgttgactgttacggtgttagtgggactgtcatttaacatggaaattagattataatgaagttagaggtcaaatgagctgccatcttggattccatcagtcttagctggtttgatcaccagggagaagtttggacctcaggcatcctgcttcctaaagataaacagtgttaaggcagggtagatattcacggaggtcatgtgggtattgcactggatgacatcttggcttcagccctgatctgttcagagccctcagcacggtactggaggagaggccttgggccgcatcgtggcatattgtggctttggggagaaagaaaagcagatagtgcaatggaacgagcgtggacttgagagtcagacttgccttcaactcctagctctaccacttaccacctaggtgcccttaagccactttctcagcctttctgagactctgtatcctcatgtgtatcctagagtttgtctgatagggctatagtgagaattaattgaattaagtgtagtgagaattaagccaggtctggagaggcctggctactggtgagtgaggtaactgagatcaggtatggagaggactggctcctgatgagtgagttaattgagatgaggtatggagggacctgtctcctggtgactgagttaattgaaatgaggtgtggagggacctggctcctggtgagtgagttaattgagatccattatggagggacctggctcctggcgagtgagttaattgagacccggtatggagggacttggctcctggtgagtgagttaattgagatgcggtgtggagggacctggctcctggtgagtgagtgaattgagatgaggtatggagggacctggctcctggtgagtgagtgaattgagatgaggtttggagggacctggctcctggtgagtgagttaattgagatgaggtatggagggacctgg

SEQ ID NO: 33975 - DNA, 4928 bp, Homo sapiens
gtgttgcctaggctggtctcaaactgctgggcttaagtgatcgttcctccttggcctcccgaagtgctggaattataggtgtgaaccaccatgtctggccttgtagtttatttctaagttcaaattaatgttggtgcttttcctccttttttcttagcagatggtttgctaggtgagtgtgtcctcgattctttaaatcaggggtccccaatccccaggccacagattgttccagtccatggcctgttaggaaccaggccacacagtaggaggtgagcagccagccagtgagcattactgtgtgagctccgccccctgccagagcattactgtgtgagctccgccccctgtcagagcattactgtgtgagctccgccccctgccagagattactgtgtgagctccgccccctgccagagcattactgtgtgagctccgccccctgtcattactgtgtgagctccgccccctgtcatatcattactgtgtgagctccgccccctgtcatatcattattgtgagctccgcccctgtcatatcattgctgtgtgagctccgcctcctgtcagatcagtggtggcattagattctcataggagtggaatcctgttgtgaactgcgcatgagaaggatctaggttatgccccgcttatgagaatctaatactgatgatctgagatggaaccgtttcatctccaaaccatccccacacttgtcagtggaaaaagtgtcttccgtgaaaccagtccctggtgccaaaaaggttagggactgccggtttaaataaccaaatgctaaaagaactggcatagaagtaaatgggctgctgctttatttttaggctgttctttttagagagcaatgacagttatttccaagtttgtcattagaaaataatattaggttggagcaaaagtaattgcagtttttgccattgctttcaatggtaaaaggcacaattacttttgcagcaacttaatattataaatttgttcttaaagtgtatttttgataagaaagccgttttgtttttccttctgttaattttttgtttttttcttggtcgagacagagtcttgccatgctgcccaggctggagtgcagtggtgtgatctcggctcactgcagcctccacctcctgggctccagcagtcctcccacctcaacctccctaagagctgagactacaggtgtgagccaccatgcctggctaatttttagagacagggtttcaccctcttgcccaggctggtcccaaactcctgggctcaagcagtcctcctgcctcagcctcccagagtattgggattataggtgtgagccactgccagaaaaacgtttcctaagacaaggcaggtcttacattatatttaaattttttttaatgatgtcttttttggcagtgcacagccagaggacaacacatcacacacaagaaacagttgtgctcatgtgatgggggcctcagcactaggaaggagtggactgttggcgcacgcagcagcttgaataaatctgaaagtcactacgctgcgtaagagaagccaaataaagcgcatgctgtgtacagagggtgtcgagaatgcctcctacgtgacggaaagcagatccgtggttccctgcagactggcaggagcagattccaaaggcacaggaagaagcttgcaggcagctgctcccaaccccagaacctttgctgtcttgggacggatcaccactgcaagaggggaagttgctactgtgatgaattctgccatgtggcaccagactgccacccagaccacagtgtcctctgcaaccctggtaactcacatacaggcccgattccaccgacagcaaagctggatgctatggctggcagaggcaaaccctttgcctgcacttcaggccaaagccgggatgtggcctagatggttcctaaggtccctgacaatcctgagatcttgcatcttgtctatttcaggtcaaaggtgcctacatgctccttctagctttgtttccctgatgttccttgccacctgctactcctctctgagctacttttccaggttccacagggagaggttcagctgtccgtggtagacatgagggtagagagtgaggtggttgggttccacttacctttctatcatcttgcagtatggatgtctcttgactggtaccgtgtagacttttgagggcacacaggagtctgcagagagatactggggacattgagcagcagcagtggggttgggaggcagaaatgaggacaggaacatttaccttgtgtttctctcagcttctcagatgaccaagatggtgctgcagatggtgctgaggatggagaacccaccaagccccgctaggagccacctagactggatgcagagcatggtgagctccctgcaggttctctgagaaggggtggatggcagcctgctccttgcctttgtgccctccaggccccaaagtcagggaaccaaaagaagaaaggggccgtagctagggcagagctccactgcaatgattgttttaggggtaggagccaggattgccgtctgtggacactgaaatttgaatctcatatacttttgtgacaaaacattcttcctcttttgttcttctcctaccatctaaaaatgtagaaaacattcttagcctatgagttgcacaaaaacaggcagtggccagatttggcccatagaccatagtttgctgacttctgccctaaatcatcctccatttctttccttctgtgtccttgttactgacaaagccactttccctaaaatggggtctttccctgtttggtgccatgaagccaatatgcaaaaccgaaagtgagcctcaagcagtgcaggctttatttggtggccatggaattgagaagtgagagcttggctcacaaatcaacttttctgctcgtgagacccaggaagtcacagatacagggcatctttagtgaaggggctgagcattaaaagcaaggggaggagtggccaggtgcaatggctcactcccataaacccagaactttgggaggccaaaatgagaggattgctgagaccaggagttcgagaccatcctggtcaacatagtgatacacccccatctctacaaaaataaaaatgaaaaaagcaaggggaggaatcatgtgttttctgggtctgggtggagaaattttcaaaaccagagtgccaccttcctatttgtttttttatgttattttttcccatcattgtcatgttggttgttgactgttacggtgttagtgggactgtcatttaacatggaaattagattataatgaagttagaggtcaaatgagctgccatcttggattccatcagtcttagctggtttgatcaccagggagaagtttggacctcaggcatcctgcttcctaaagataaacagtgttaaggcagggtagatattcacggaggtcatgtgggtattgcactggatgacatcttggcttcagccctgatctgttcagagccctcagcacggtactggaggagaggccttgggccgcatcgtggcatattgtggctttggggagaaagaaaagcagatagtgcaatggaacgagcgtggacttgagagtcagatgaattgagatcaggtatggagggacttggctcctggtgagtgagttaattgagatgaggtgtggagggacctgtctcctggtgagtgagttaattgagatgaggtatggagggacctgtctcctggtgagtgagtgaattgagatcaggtatggagggacttggctcctggtgagtgagttaattgagactcggtgtggagggacctggctcctggtgagtgagttaattgagatgaggtatggagggacctggctcctggtgagtgagttaattgagatgaggtatggagggacctggctcctggtgagtgagttaattgagatgaggtatggagggacctggctcctggtgagtgagtgaattgagatcaggtatggagggacttggctcctggtgagtgagttaattgagactctgtatggagggacctggctcctggtgagtctcctggaggcagctgctatctgggaacacaggcacaggtgggaacagaccttcacttcctgctcacttaggttcagcgagttctccaaaccagcctcccaggaatgccattcaccatggctgtgaggagaataaagaagagagcctgactcctctcctgaggccccttccccaccctgagccagcaggatccacggagcagaggtcatctgtccccagcttggcccactgaggccagcatggctgggcccaggatgcttgtctctcagctcccatcctgtgtacttccacattggtttaaccagaggaaaaccgaaatctacaattgtcataaacacatttaaatgtgcgtagaatcagccatacaaattgtgaaacataaaacatttggctcatggtattattcactgttttgtggtggttacagtgactatagcaaacatttcttgaaagtagaaaataagaacccagcaccccttgagctaagtaatgtgccctctgtcctcaatattccttcctgggctccacattactgcccttaagtctggaaatattctggtctgagccccgtagtccaggcctcatgttcaggctttctgtccccagtgatgagaggagagacggcagacctttctccggtgagctcagatgggcctcccggagtctcctggggtgcacaggatttcaaagatccaggaggcgctgccaggggctgtgaggtctgatgaacctctcaccttccctcccacacctgcccttttcctgtttctgtggatgcttttgctgtccttggcttcctggactccagacctcagggtcatcttttgcttctctctgcaaggtgccaagtctctctaggtttttgtttgtttgttttgttattga

SEQ ID NO: 33976 - DNA, 4021 bp, Homo sapiens
gtgttgcctaggctggtctcaaactgctgggcttaagtgatcgttcctccttggcctcccgaagtgctggaattataggtgtgaaccaccatgtctggccttgtagtttatttctaagttcaaattaatgttggtgcttttcctccttttttcttagcagatggtttgctaggtgagtgtgtcctcgattctttaaatcaggggtccccaatccccaggccacagattgttccagtccatggcctgttaggaaccaggccacacagtaggaggtgagcagccagccagtgagcattactgtgtgagctccgccccctgccagagcattactgtgtgagctccgccccctgtcagagcattactgtgtgagctccgccccctgccagagattactgtgtgagctccgccccctgccagagcattactgtgtgagctccgccccctgtcattactgtgtgagctccgccccctgtcatatcattactgtgtgagctccgccccctgtcatatcattattgtgagctccgcccctgtcatatcattgctgtgtgagctccgcctcctgtcagatcagtggtggcattagattctcataggagtggaatcctgttgtgaactgcgcatgagaaggatctaggttatgccccgcttatgagaatctaatactgatgatctgagatggaaccgtttcatctccaaaccatccccacacttgtcagtggaaaaagtgtcttccgtgaaaccagtccctggtgccaaaaaggttagggactgccggtttaaataaccaaatgctaaaagaactggcatagaagtaaatgggctgctgctttatttttaggctgttctttttagagagcaatgacagttatttccaagtttgtcattagaaaataatattaggttggagcaaaagtaattgcagtttttgccattgctttcaatggtaaaaggcacaattacttttgcagcaacttaatattataaatttgttcttaaagtgtatttttgataagaaagccgttttgtttttccttctgttaattttttgtttttttcttggtcgagacagagtcttgccatgctgcccaggctggagtgcagtggtgtgatctcggctcactgcagcctccacctcctgggctccagcagtcctcccacctcaacctccctaagagctgagactacaggtgtgagccaccatgcctggctaatttttagagacagggtttcaccctcttgcccaggctggtcccaaactcctgggctcaagcagtcctcctgcctcagcctcccagagtattgggattataggtgtgagccactgccagaaaaacgtttcctaagacaaggcaggtcttacattatatttaaattttttttaatgatgtcttttttggcagtgcacagccagaggacaacacatcacacacaagaaacagttgtgctcatgtgatgggggcctcagcactaggaaggagtggactgttggcgcacgcagcagcttgaataaatctgaaagtcactacgctgcgtaagagaagccaaataaagcgcatgctgtgtacagagggtgtcgagaatgcctcctacgtgacggaaagcagatccgtggttccctgcagactggcaggagcagattccaaaggcacaggaagaagcttgcaggcagctgctcccaaccccagaacctttgctgtcttgggacggatcaccactgcaagaggggaagttgctactgtgatgaattctgccatgtggcaccagactgccacccagaccacagtgtcctctgcaaccctggtaactcacatacaggcccgattccaccgacagcaaagctggatgctatggctggcagaggcaaaccctttgcctgcacttcaggccaaagccgggatgtggcctagatggttcctaaggtccctgacaatcctgagatcttgcatcttgtctatttcaggtcaaaggtgcctacatgctccttctagctttgtttccctgatgttccttgccacctgctactcctctctgagctacttttccaggttccacagggagaggttcagctgtccgtggtagacatgagggtagagagtgaggtggttgggttccacttacctttctatcatcttgcagtatggatgtctcttgactggtaccgtgtagacttttgagggcacacaggagtctgcagagagatactggggacattgagcagcagcagtggggttgggaggcagaaatgaggacaggaacatttaccttgtgtttctctcagcttctcagatgaccaagatggtgctgcagatggtgctgaggatggagaacccaccaagccccgctaggagccacctagactggatgcagagcatggtgagctccctgcaggttctctgagaaggggtggatggcagcctgctccttgcctttgtgccctccaggccccaaagtcagggaaccaaaagaagaaaggggccgtagctagggcagagctccactgcaatgattgttttaggggtaggagccaggattgccgtctgtggacactgaaatttgaatctcatatacttttgtgacaaaacattcttcctcttttgttcttctcctaccatctaaaaatgtagaaaacattcttagcctatgagttgcacaaaaacaggcagtggccagatttggcccatagaccatagtttgctgacttctgccctaaatcatcctccatttctttccttctgtgtccttgttactgacaaagccactttccctaaaatggggtctttccctgtttggtgccatgaagccaatatgcaaaaccgaaagtgagcctcaagcagtgcaggctttatttggtggccatggaattgagaagtgagagcttggctcacaaatcaacttttctgctcgtgagacccaggaagtcacagatacagggcatctttagtgaaggggctgagcattaaaagcaaggggaggagtggccaggtgcaatggctcactcccataaacccagaactttgggaggccaaaatgagaggattgctgagaccaggagttcgagaccatcctggtcaacatagtgatacacccccatctctacaaaaataaaaatgaaaaaagcaaggggaggaatcatgtgttttctgggtctgggtggagaaattttcaaaaccagagtgccaccttcctatttgtttttttatgttattttttcccatcattgtcatgttggttgttgactgttacggtgttagtgggactgtcatttaacatggaaattagattataatgaagttagaggtcaaatgagctgccatcttggattccatcagtcttagctggtttgatcaccagggagaagtttggacctcaggcatcctgcttcctaaagataaacagtgttaaggcagggtagatattcacggaggtcatgtgggtattgcactggatgacatcttggcttcagccctgatctgttcagagccctcagcacggtactggaggagaggccttgggccgcatcgtggcatattgtggctttggggagaaagaaaagcagatagtgcaatggaacgagcgtggacttgagagtcagacttgccttcaactcctagctctaccacttaccacctaggtgcccttaagccactttctcagcctttctgagactctgtatcctcatgtgtatcctagagtttgtctgatagggctatagtgagaattaattgaattaagtgtagtgagaattaagccaggtctggagaggcctggctactggtgagtgaggtaactgagatcaggtatggagaggactggctcctgatgagtgagttaattgagatgaggtatggagggacctgtctcctggtgactgagttaattgaaatgaggtgtggagggacctggctcctggtgagtgagttaattgagatccattatggagggacctggctcctggcgagtgagttaattgagacccggtatggagggacccttggctaaggaccttgggtcacgcccc

SEQ ID NO: 33977 - DNA, 3863 bp, Homo sapiens
gtgttgcctaggctggtctcaaactgctgggcttaagtgatcgttcctccttggcctcccgaagtgctggaattataggtgtgaaccaccatgtctggccttgtagtttatttctaagttcaaattaatgttggtgcttttcctccttttttcttagcagatggtttgctaggtgagtgtgtcctcgattctttaaatcaggggtccccaatccccaggccacagattgttccagtccatggcctgttaggaaccaggccacacagtaggaggtgagcagccagccagtgagcattactgtgtgagctccgccccctgccagagcattactgtgtgagctccgccccctgtcagagcattactgtgtgagctccgccccctgccagagattactgtgtgagctccgccccctgccagagcattactgtgtgagctccgccccctgtcattactgtgtgagctccgccccctgtcatatcattactgtgtgagctccgccccctgtcatatcattattgtgagctccgcccctgtcatatcattgctgtgtgagctccgcctcctgtcagatcagtggtggcattagattctcataggagtggaatcctgttgtgaactgcgcatgagaaggatctaggttatgccccgcttatgagaatctaatactgatgatctgagatggaaccgtttcatctccaaaccatccccacacttgtcagtggaaaaagtgtcttccgtgaaaccagtccctggtgccaaaaaggttagggactgccggtttaaataaccaaatgctaaaagaactggcatagaagtaaatgggctgctgctttatttttaggctgttctttttagagagcaatgacagttatttccaagtttgtcattagaaaataatattaggttggagcaaaagtaattgcagtttttgccattgctttcaatggtaaaaggcacaattacttttgcagcaacttaatattataaatttgttcttaaagtgtatttttgataagaaagccgttttgtttttccttctgttaattttttgtttttttcttggtcgagacagagtcttgccatgctgcccaggctggagtgcagtggtgtgatctcggctcactgcagcctccacctcctgggctccagcagtcctcccacctcaacctccctaagagctgagactacaggtgtgagccaccatgcctggctaatttttagagacagggtttcaccctcttgcccaggctggtcccaaactcctgggctcaagcagtcctcctgcctcagcctcccagagtattgggattataggtgtgagccactgccagaaaaacgtttcctaagacaaggcaggtcttacattatatttaaattttttttaatgatgtcttttttggcagtgcacagccagaggacaacacatcacacacaagaaacagttgtgctcatgtgatgggggcctcagcactaggaaggagtggactgttggcgcacgcagcagcttgaataaatctgaaagtcactacgctgcgtaagagaagccaaataaagcgcatgctgtgtacagagggtgtcgagaatgcctcctacgtgacggaaagcagatccgtggttccctgcagactggcaggagcagattccaaaggcacaggaagaagcttgcaggcagctgctcccaaccccagaacctttgctgtcttgggacggatcaccactgcaagaggggaagttgctactgtgatgaattctgccatgtggcaccagactgccacccagaccacagtgtcctctgcaaccctggtaactcacatacaggcccgattccaccgacagcaaagctggatgctatggctggcagaggcaaaccctttgcctgcacttcaggccaaagccgggatgtggcctagatggttcctaaggtccctgacaatcctgagatcttgcatcttgtctatttcaggtcaaaggtgcctacatgctccttctagctttgtttccctgatgttccttgccacctgctactcctctctgagctacttttccaggttccacagggagaggttcagctgtccgtggtagacatgagggtagagagtgaggtggttgggttccacttacctttctatcatcttgcagtatggatgtctcttgactggtaccgtgtagacttttgagggcacacaggagtctgcagagagatactggggacattgagcagcagcagtggggttgggaggcagaaatgaggacaggaacatttaccttgtgtttctctcagcttctcagatgaccaagatggtgctgcagatggtgctgaggatggagaacccaccaagccccgctaggagccacctagactggatgcagagcatggtgagctccctgcaggttctctgagaaggggtggatggcagcctgctccttgcctttgtgccctccaggccccaaagtcagggaaccaaaagaagaaaggggccgtagctagggcagagctccactgcaatgattgttttaggggtaggagccaggattgccgtctgtggacactgaaatttgaatctcatatacttttgtgacaaaacattcttcctcttttgttcttctcctaccatctaaaaatgtagaaaacattcttagcctatgagttgcacaaaaacaggcagtggccagatttggcccatagaccatagtttgctgacttctgccctaaatcatcctccatttctttccttctgtgtccttgttactgacaaagccactttccctaaaatggggtctttccctgtttggtgccatgaagccaatatgcaaaaccgaaagtgagcctcaagcagtgcaggctttatttggtggccatggaattgagaagtgagagcttggctcacaaatcaacttttctgctcgtgagacccaggaagtcacagatacagggcatctttagtgaaggggctgagcattaaaagcaaggggaggagtggccaggtgcaatggctcactcccataaacccagaactttgggaggccaaaatgagaggattgctgagaccaggagttcgagaccatcctggtcaacatagtgatacacccccatctctacaaaaataaaaatgaaaaaagcaaggggaggaatcatgtgttttctgggtctgggtggagaaattttcaaaaccagagtgccaccttcctatttgtttttttatgttattttttcccatcattgtcatgttggttgttgactgttacggtgttagtgggactgtcatttaacatggaaattagattataatgaagttagaggtcaaatgagctgccatcttggattccatcagtcttagctggtttgatcaccagggagaagtttggacctcaggcatcctgcttcctaaagataaacagtgttaaggcagggtagatattcacggaggtcatgtgggtattgcactggatgacatcttggcttcagccctgatctgttcagagccctcagcacggtactggaggagaggccttgggccgcatcgtggcatattgtggctttggggagaaagaaaagcagatagtgcaatggaacgagcgtggacttgagagtcagatgaattgagatcaggtatggagggacttggctcctggtgagtgagttaattgagatgaggtgtggagggacctgtctcctggtgagtgagaccctgtctctaaaagaagaaaaagaccacctgggcatgggtctggaacccaccctagtggatcccagattccccacagagtctgtctaccccccttggtggcagttcttgagccaaacgagttactgctagaaattgaagggtttcctttgtgataaagtttttaagtatccatta

SEQ ID NO: 33978 - DNA, 1462 bp, Homo sapiens
catatcttcaaatcaaatttcagtggagtgtttaccgggcaaggaaggcaggggggtcagcttgctgacagcctcaacctgccagccctcagcctgcacatttgtgatcacctggtcacacacctgggcaggaggctgcccctccctggtttgaggaagcaggaaaaggtacccgcgagagacagccagcagttctgtggagcagcggtggccggctaggatgggctgtctctggggtctggctctgccccttttcttcttctgctgggaggttggggtctctgggagctctgcaggccccagcacccgcagagcagacactgcgatgacaacggacgacacagaagtgcccgctatgactctagcaccgggccacgccgctctggaaactcaaacgctgagcgctgagacctcttctagggcctcaaccccagccggccccattccagaagcagagaccaggggagccaagagaatttcccctgcaagagagaccaggagtttcacaaaaacatctcccaacttcatggtgctgatcgccacctccgtggagacatcagccgccagtggcagccccgagggagctggaatgaccacagttcagaccatcacaggcagtgatcccgaggaagccatctttgacaccctttgcaccgatgacagctctgaagaggcaaagacactcacaatggacatattgacattggctcacacctccacagaagctaagggcctgtcctcagagagcagtgcctcttccgacggcccccatccagtcatcaccccgtcacgggcctcagagagcagcgcctcttccgacggcccccatccagtcatcaccccgtcacgggcctcagagagcagcgcctcttccgacggcccccatccagtcatcaccccgtcatggtccccgggatctgatgtcactctcctcgctgaagccctggtgactgtcacaaacatcgaggttattaattgcagcatcacagaaatagaaacaacaacttccagcatccctggggcctcagacatagatctcatccccacggaaggggtgaaggcctcgtccacctccgatccaccagctctgcctgactccactgaagcaaaaccacacatcactgaggtcacagcctctgccgagaccctgtccacagccggcaccacagagtcagctgcacctcatgccacggttgggaccccactccccactaacagcgccacagaaagagaagtgacagcacccggggccacgaccctcagtggagctctggtcacagttagcaggaatcccctggaagaaacctcagccctctctgttgagacaccaagttacgtcaaagtctcaggagcagctccggtctccatagaggctgggtcagcagtgggcaaaacaacttcctttgctgggagctctgcttcctcctacagccccccgaaggtcaaaatcagggccgagtat

SEQ ID NO: 33979 - DNA, 904 bp, Homo sapiens
aacttggtgatagttgttcctagagtatcactcagccctctctgttgagacaccaagttacgtcaaagtctcaggagcagctccggtctccatagaggctgggtcagcagtgggcaaaacaacttcctttgctgggagctctgcttcctcctacagcccctcggaagccgccctcaagaacttcaccccttcagagacaccgaccatggacatcgcaaccaaggggcccttccccaccagcagggaccctcttccttctgtccctccgactacaaccaacagcagccgagggacgaacagcaccttagccaagatcacaacctcagcgaagaccacgatgaagcccccaacagccacgcccacgactgcccggacgaggccgaccacagacgtgagtgcaggtgaaaatggaggtttcctcctcctgcggctgagtgtggcttccccggaagacctcactgaccccagagtggcagaaaggctgatgcagcagctccaccgggaactccacgcccacgcgcctcacttccaggtctccttactgcgtgtcaggagaggctaacggacatcagctgcagccaggcatgtcccgtatgccaaaagagggtgctgcccctagcctgggcccccaccgacagactgcagctgcgttactgtgctgagaggtacccagaaggttcccatgaagggcagcatgtccaagcccctgaccccagatgtggcaacaggaccctcgctcacatccaccggagtgtatgtgtggggaggggcttcacctgttcccagaggtgtccttggactcaccttggcacatgttctgtgtttcagtaaagagagacctgatcacccatctgtgtgcttccatcctgcattaaaattcactcagtgtggcccagaaaaaaaa

SEQ ID NO: 33980 - DNA, 3190 bp, Homo sapiens
gtgttgcctaggctggtctcaaactgctgggcttaagtgatcgttcctccttggcctcccgaagtgctggaattataggtgtgaaccaccatgtctggccttgtagtttatttctaagttcaaattaatgttggtgcttttcctccttttttcttagcagatggtttgctaggtgagtgtgtcctcgattctttaaatcaggggtccccaatccccaggccacagattgttccagtccatggcctgttaggaaccaggccacacagtaggaggtgagcagccagccagtgagcattactgtgtgagctccgccccctgccagagcattactgtgtgagctccgccccctgtcagagcattactgtgtgagctccgccccctgccagagattactgtgtgagctccgccccctgccagagcattactgtgtgagctccgccccctgtcattactgtgtgagctccgccccctgtcatatcattactgtgtgagctccgccccctgtcatatcattattgtgagctccgcccctgtcatatcattgctgtgtgagctccgcctcctgtcagatcagtggtggcattagattctcataggagtggaatcctgttgtgaactgcgcatgagaaggatctaggttatgccccgcttatgagaatctaatactgatgatctgagatggaaccgtttcatctccaaaccatccccacacttgtcagtggaaaaagtgtcttccgtgaaaccagtccctggtgccaaaaaggttagggactgccggtttaaataaccaaatgctaaaagaactggcatagaagtaaatgggctgctgctttatttttaggctgttctttttagagagcaatgacagttatttccaagtttgtcattagaaaataatattaggttggagcaaaagtaattgcagtttttgccattgctttcaatggtaaaaggcacaattacttttgcagcaacttaatattataaatttgttcttaaagtgtatttttgataagaaagccgttttgtttttccttctgttaattttttgtttttttcttggtcgagacagagtcttgccatgctgcccaggctggagtgcagtggtgtgatctcggctcactgcagcctccacctcctgggctccagcagtcctcccacctcaacctccctaagagctgagactacaggtgtgagccaccatgcctggctaatttttagagacagggtttcaccctcttgcccaggctggtcccaaactcctgggctcaagcagtcctcctgcctcagcctcccagagtattgggattataggtgtgagccactgccagaaaaacgtttcctaagacaaggcaggtcttacattatatttaaattttttttaatgatgtcttttttggcagtgcacagccagaggacaacacatcacacacaagaaacagttgtgctcatgtgatgggggcctcagcactaggaaggagtggactgttggcgcacgcagcagcttgaataaatctgaaagtcactacgctgcgtaagagaagccaaataaagcgcatgctgtgtacagagggtgtcgagaatgcctcctacgtgacggaaagcagatccgtggttccctgcagactggcaggagcagattccaaaggcacaggaagaagcttgcaggcagctgctcccaaccccagaacctttgctgtcttgggacggatcaccactgcaagaggggaagttgctactgtgatgaattctgccatgtggcaccagactgccacccagaccacagtgtcctctgcaaccctggtaactcacatacaggcccgattccaccgacagcaaagctggatgctatggctggcagaggcaaaccctttgcctgcacttcaggccaaagccgggatgtggcctagatggttcctaaggtccctgacaatcctgagatcttgcatcttgtctatttcaggtcaaaggtgcctacatgctccttctagctttgtttccctgatgttccttgccacctgctactcctctctgagctacttttccaggttccacagggagaggttcagctgtccgtggtagacatgagggtagagagtgaggtggttgggttccacttacctttctatcatcttgcagtatggatgtctcttgactggtaccgtgtagacttttgagggcacacaggagtctgcagagagatactggggacattgagcagcagcagtggggttgggaggcagaaatgaggacaggaacatttaccttgtgtttctctcagcttctcagatgaccaagatggtgctgcagatggtgctgaggatggagaacccaccaagccccgctaggagccacctagactggatgcagagcatggttcagcgagttctccaaaccagcctcccaggaatgccattcaccatggctgtgaggagaataaagaagagagcctgactcctctcctgaggccccttccccaccctgagccagcaggatccacggagcagaggtcatctgtccccagcttggcccactgaggccagcatggctgggcccaggatgcttgtctctcagctcccatcctgtgtacttccacattggtttaaccagaggaaaaccgaaatctacaattgtcataaacacatttaaatgtgcgtagaatcagccatacaaattgtgaaacataaaacatttggctcatggtattattcactgttttgtggtggttacagtgactatagcaaacatttcttgaaagtagaaaataagaacccagcaccccttgagctaagtaatgtgccctctgtcctcaatattccttcctgggctccacattactgcccttaagtctggaaatattctggtctgagccccgtagtccaggcctcatgttcaggctttctgtccccagtgatgagaggagagacggcagacctttctccggtgagctcagatgggcctcccggagtctcctggggtgcacaggatttcaaagatccaggaggcgctgccaggggctgtgaggtctgatgaacctctcaccttccctcccacacctgcccttttcctgtttctgtggatgcttttgctgtccttggcttcctggactccagacctcagggtcatcttttgcttctctctgcaaggtgccaagtctctctaggtttttgtttgtttgttttgttattga

SEQ ID NO: 33981 - DNA, 930 bp, Homo sapiens
ctgctccgcccctctctggtgcagtgaagggcgttcggcctccccggctctctgcaggtgcccaccagagtttaagccaaacaacccaggttccgcagctgccaagggctcctttgccaacctgggaatgctcggatccttgtagtaaattcctttgctgggagctctgcttcctcctacagcccctcggaagccgccctcaagaacttcaccccttcagagacaccgaccatggacatcgcaaccaaggggcccttccccaccagcagggaccctcttccttctgtccctccgactacaaccaacagcagccgagggacgaacagcaccttagccaagatcacaacctcagcgaagaccacgatgaagcccccaacagccacgcccacgactgcccggacgaggccgaccacagacgtgagtgcaggtgaaaatggaggtttcctcctcctgcggctgagtgtggcttccccggaagacctcactgaccccagagtggcagaaaggctgatgcagcagctccaccgggaactccacgcccacgcgcctcacttccaggtctccttactgcgtgtcaggagaggctaacggacatcagctgcagccaggcatgtcccgtatgccaaaagagggtgctgcccctagcctgggcccccaccgacagactgcagctgcgttactgtgctgagaggtacccagaaggttcccatgaagggcagcatgtccaagcccctgaccccagatgtggcaacaggaccctcgctcacatccaccggagtgtatgtgtggggaggggcttcacctgttcccagaggtgtccttggactcaccttggcacatgttctgtgtttcagtaaagagagacctgatcacccatctgtgtgcttccatcctgcattaaaattcactcagtgtggcccagaaaaaaaa

SEQ ID NO: 33982 - DNA, 2712 bp, Homo sapiens
gtgttgcctaggctggtctcaaactgctgggcttaagtgatcgttcctccttggcctcccgaagtgctggaattataggtgtgaaccaccatgtctggccttgtagtttatttctaagttcaaattaatgttggtgcttttcctccttttttcttagcagatggtttgctaggtgagtgtgtcctcgattctttaaatcaggggtccccaatccccaggccacagattgttccagtccatggcctgttaggaaccaggccacacagtaggaggtgagcagccagccagtgagcattactgtgtgagctccgccccctgccagagcattactgtgtgagctccgccccctgtcagagcattactgtgtgagctccgccccctgccagagattactgtgtgagctccgccccctgccagagcattactgtgtgagctccgccccctgtcattactgtgtgagctccgccccctgtcatatcattactgtgtgagctccgccccctgtcatatcattattgtgagctccgcccctgtcatatcattgctgtgtgagctccgcctcctgtcagatcagtggtggcattagattctcataggagtggaatcctgttgtgaactgcgcatgagaaggatctaggttatgccccgcttatgagaatctaatactgatgatctgagatggaaccgtttcatctccaaaccatccccacacttgtcagtggaaaaagtgtcttccgtgaaaccagtccctggtgccaaaaaggttagggactgccggtttaaataaccaaatgctaaaagaactggcatagaagtaaatgggctgctgctttatttttaggctgttctttttagagagcaatgacagttatttccaagtttgtcattagaaaataatattaggttggagcaaaagtaattgcagtttttgccattgctttcaatggtaaaaggcacaattacttttgcagcaacttaatattataaatttgttcttaaagtgtatttttgataagaaagccgttttgtttttccttctgttaattttttgtttttttcttggtcgagacagagtcttgccatgctgcccaggctggagtgcagtggtgtgatctcggctcactgcagcctccacctcctgggctccagcagtcctcccacctcaacctccctaagagctgagactacaggtgtgagccaccatgcctggctaatttttagagacagggtttcaccctcttgcccaggctggtcccaaactcctgggctcaagcagtcctcctgcctcagcctcccagagtattgggattataggtgtgagccactgccagaaaaacgtttcctaagacaaggcaggtcttacattatatttaaattttttttaatgatgtcttttttggcagtgcacagccagaggacaacacatcacacacaagaaacagttgtgctcatgtgatgggggcctcagcactaggaaggagtggactgttggcgcacgcagcagcttgaataaatctgaaagtcactacgctgcgtaagagaagccaaataaagcgcatgctgtgtacagagggtgtcgagaatgcctcctacgtgacggaaagcagatccgtggttccctgcagactggcaggagcagattccaaaggcacaggaagaagcttgcaggcagctgctcccaaccccagaacctttgctgtcttgggacggatcaccactgcaagaggggaagttgctactgtgatgaattctgccatgtggcaccagactgccacccagaccacagtgtcctctgcaaccctgcttctcagatgaccaagatggtgctgcagatggtgctgaggatggagaacccaccaagccccgctaggagccacctagactggatgcagagcatggttcagcgagttctccaaaccagcctcccaggaatgccattcaccatggctgtgaggagaataaagaagagagcctgactcctctcctgaggccccttccccaccctgagccagcaggatccacggagcagaggtcatctgtccccagcttggcccactgaggccagcatggctgggcccaggatgcttgtctctcagctcccatcctgtgtacttccacattggtttaaccagaggaaaaccgaaatctacaattgtcataaacacatttaaatgtgcgtagaatcagccatacaaattgtgaaacataaaacatttggctcatggtattattcactgttttgtggtggttacagtgactatagcaaacatttcttgaaagtagaaaataagaacccagcaccccttgagctaagtaatgtgccctctgtcctcaatattccttcctgggctccacattactgcccttaagtctggaaatattctggtctgagccccgtagtccaggcctcatgttcaggctttctgtccccagtgatgagaggagagacggcagacctttctccggtgagctcagatgggcctcccggagtctcctggggtgcacaggatttcaaagatccaggaggcgctgccaggggctgtgaggtctgatgaacctctcaccttccctcccacacctgcccttttcctgtttctgtggatgcttttgctgtccttggcttcctggactccagacctcagggtcatcttttgcttctctctgcaaggtgccaagtctctctaggtttttgtttgtttgttttgttattga

SEQ ID NO: 33983 - DNA, 2009 bp, Homo sapiens
gtgttgcctaggctggtctcaaactgctgggcttaagtgatcgttcctccttggcctcccgaagtgctggaattataggtgtgaaccaccatgtctggccttgtagtttatttctaagttcaaattaatgttggtgcttttcctccttttttcttagcagatggtttgctaggtgagtgtgtcctcgattctttaaatcaggggtccccaatccccaggccacagattgttccagtccatggcctgttaggaaccaggccacacagtaggaggtgagcagccagccagtgagcattactgtgtgagctccgccccctgccagagcattactgtgtgagctccgccccctgtcagagcattactgtgtgagctccgccccctgccagagattactgtgtgagctccgccccctgccagagcattactgtgtgagctccgccccctgtcattactgtgtgagctccgccccctgtcatatcattactgtgtgagctccgccccctgtcatatcattattgtgagctccgcccctgtcatatcattgctgtgtgagctccgcctcctgtcagatcagtggtggcattagattctcataggagtggaatcctgttgtgaactgcgcatgagaaggatctaggttatgccccgcttatgagaatctaatactgatgatctgagatggaaccgtttcatctccaaaccatccccacacttgtcagtggaaaaagtgtcttccgtgaaaccagtccctggtgccaaaaaggttagggactgccggtttaaataaccaaatgctaaaagaactggcatagaagtaaatgggctgctgctttatttttaggctgttctttttagagagcaatgacagttatttccaagtttgtcattagaaaataatattaggttggagcaaaagtaattgcagtttttgccattgctttcaatggtaaaaggcacaattacttttgcagcaacttaatattataaatttgttcttaaagtgtatttttgataagaaagccgttttgtttttccttctgttaattttttgtttttttcttggtcgagacagagtcttgccatgctgcccaggctggagtgcagtggtgtgatctcggctcactgcagcctccacctcctgggctccagcagtcctcccacctcaacctccctaagagctgagactacaggtgtgagccaccatgcctggctaatttttagagacagggtttcaccctcttgcccaggctggtcccaaactcctgggctcaagcagtcctcctgcctcagcctcccagagtattgggattataggtgtgagccactgccagaaaaacgtttcctaagacaaggcaggtcttacattatatttaaattttttttaatgatgtcttttttggcagtgcacagccagaggacaacacatcacacacaagaaacagttgtgctcatgtgatgggggcctcagcactaggaaggagtggactgttggcgcacgcagcagcttgaataaatctgaaagtcactacgctgcgtaagagaagccaaataaagcgcatgctgtgtacagagggtgtcgagaatgcctcctacgtgacggaaagcagatccgtggttccctgcagactggcaggagcagattccaaaggcacaggaagaagcttgcaggtagaatgtgttcattaccttctgcgcattataccacaaaaaagctgggaataaaaatgctaaccaaaaaaaaaggtgaaagtagataaaatttctcaactgtgtgatgggtaaacgtgcaggtttgctgtcatgctttgtttatgaagctgtggggtacaaggactctcatacgtcactgtggaatgcagaacgttgcagcctcatggaagaggatttggcagcatctaacaaaacgacatggcatttgcccttagactcagcaattctagaatctgcctcaaaaaaaactctggcaaagaaatgaaaggactttatccacagagttcttttcacagcct

SEQ ID NO: 33984 - DNA, 1194 bp, Homo sapiens
catatcttcaaatcaaatttcagtggagtgtttaccgggcaaggaaggcaggggggtcagcttgctgacagcctcaacctgccagccctcagcctgcacatttgtgatcacctggtcacacacctgggcaggaggctgcccctccctggtttgaggaagcaggaaaaggtacccgcgagagacagccagcagttctgtggagcagcggtggccggctaggatgggctgtctctggggtctggctctgccccttttcttcttctgctgggaggttggggtctctgggagctctgcaggccccagcacccgcagagcagacactgcgatgacaacggacgacacagaagtgcccgctatgactctagcaccgggccacgccgctctggaaactcaaacgctgagcgctgagacctcttctagggcctcaaccccagccggccccattccagaagcagagaccaggggagccaagagaatttcccctgcaagagagaccaggagtttcacaaaaacatctcccaacttcatggtgctgatcgccacctccgtggagacatcagccgccagtggcagccccgagggagctggaatgaccacagttcagaccatcacaggcagtgatcccgaggaagccatctttgacaccctttgcaccgatgacagctctgaagaggcaaagacactcacaatggacatattgacattggctcacacctccacagaagctaagggcctgtcctcagagagcagtgcctcttccgacggcccccatccagtcatcaccccgtcacgggcctcagagagcagcgcctcttccgacggcccccatccagtcatcaccccgtcacgggcctcagagagcagcgcctcttccgacggcccccatccagtcatcaccccgtcatggtccccgggatctgatgtcactctcctcgctgaagccctggtgactgtcacaaacatcgaggttattaattgcagcatcacagaaatagaaacaacaacttccagcatccctggggcctcagacatagatctcatccccacggaaggggtgaaggcctcgtccacctccgatccaccagctctgcctgaggccccagggatgctggaagttgtcggtcctatctcggtgatgctgcaattaataacctcgaggttggtgacagtcaccagggcttcaagggaggagag

SEQ ID NO: 33985 - DNA, 2875 bp, Homo sapiens
gtgttgcctaggctggtctcaaactgctgggcttaagtgatcgttcctccttggcctcccgaagtgctggaattataggtgtgaaccaccatgtctggccttgtagtttatttctaagttcaaattaatgttggtgcttttcctccttttttcttagcagatggtttgctaggtgagtgtgtcctcgattctttaaatcaggggtccccaatccccaggccacagattgttccagtccatggcctgttaggaaccaggccacacagtaggaggtgagcagccagccagtgagcattactgtgtgagctccgccccctgccagagcattactgtgtgagctccgccccctgtcagagcattactgtgtgagctccgccccctgccagagattactgtgtgagctccgccccctgccagagcattactgtgtgagctccgccccctgtcattactgtgtgagctccgccccctgtcatatcattactgtgtgagctccgccccctgtcatatcattattgtgagctccgcccctgtcatatcattgctgtgtgagctccgcctcctgtcagatcagtggtggcattagattctcataggagtggaatcctgttgtgaactgcgcatgagaaggatctaggttatgccccgcttatgagaatctaatactgatgatctgagatggaaccgtttcatctccaaaccatccccacacttgtcagtggaaaaagtgtcttccgtgaaaccagtccctggtgccaaaaaggttagggactgccggtttaaataaccaaatgctaaaagaactggcatagaagtaaatgggctgctgctttatttttaggctgttctttttagagagcaatgacagttatttccaagtttgtcattagaaaataatattaggttggagcaaaagtaattgcagtttttgccattgctttcaatggtaaaaggcacaattacttttgcagcaacttaatattataaatttgttcttaaagtgtatttttgataagaaagccgttttgtttttccttctgttaattttttgtttttttcttggtcgagacagagtcttgccatgctgcccaggctggagtgcagtggtgtgatctcggctcactgcagcctccacctcctgggctccagcagtcctcccacctcaacctccctaagagctgagactacaggtgtgagccaccatgcctggctaatttttagagacagggtttcaccctcttgcccaggctggtcccaaactcctgggctcaagcagtcctcctgcctcagcctcccagagtattgggattataggtgtgagccactgccagaaaaacgtttcctaagacaaggcaggtcttacattatatttaaattttttttaatgatgtcttttttggcagtgcacagccagaggacaacacatcacacacaagaaacagttgtgctcatgtgatgggggcctcagcactaggaaggagtggactgttggcgcacgcagcagcttgaataaatctgaaagtcactacgctgcgtaagagaagccaaataaagcgcatgctgtgtacagagggtgtcgagaatgcctcctacgtgacggaaagcagatccgtggttccctgcagactggcaggagcagattccaaaggcacaggaagaagcttgcaggcagctgctcccaaccccagaacctttgctgtcttgggacggatcaccactgcaagaggggaagttgctactgtgatgaattctgccatgtggcaccagactgccacccagaccacagtgtcctctgcaaccctggtaactcacatacaggcccgattccaccgacagcaaagctggatgctatggctggcagaggcaaaccctttgcctgcacttcaggccaaagccgggatgtggcctagatggttcctaaggtccctgacaatcctgagatcttgcatcttgtctatttcaggtccttctcagatgaccaagatggtgctgcagatggtgctgaggatggagaacccaccaagccccgctaggagccacctagactggatgcagagcatggttcagcgagttctccaaaccagcctcccaggaatgccattcaccatggctgtgaggagaataaagaagagagcctgactcctctcctgaggccccttccccaccctgagccagcaggatccacggagcagaggtcatctgtccccagcttggcccactgaggccagcatggctgggcccaggatgcttgtctctcagctcccatcctgtgtacttccacattggtttaaccagaggaaaaccgaaatctacaattgtcataaacacatttaaatgtgcgtagaatcagccatacaaattgtgaaacataaaacatttggctcatggtattattcactgttttgtggtggttacagtgactatagcaaacatttcttgaaagtagaaaataagaacccagcaccccttgagctaagtaatgtgccctctgtcctcaatattccttcctgggctccacattactgcccttaagtctggaaatattctggtctgagccccgtagtccaggcctcatgttcaggctttctgtccccagtgatgagaggagagacggcagacctttctccggtgagctcagatgggcctcccggagtctcctggggtgcacaggatttcaaagatccaggaggcgctgccaggggctgtgaggtctgatgaacctctcaccttccctcccacacctgcccttttcctgtttctgtggatgcttttgctgtccttggcttcctggactccagacctcagggtcatcttttgcttctctctgcaaggtgccaagtctctctaggtttttgtttgtttgttttgttattga

SEQ ID NO: 33986 - DNA, 3201 bp, Homo sapiens
gtgttgcctaggctggtctcaaactgctgggcttaagtgatcgttcctccttggcctcccgaagtgctggaattataggtgtgaaccaccatgtctggccttgtagtttatttctaagttcaaattaatgttggtgcttttcctccttttttcttagcagatggtttgctaggtgagtgtgtcctcgattctttaaatcaggggtccccaatccccaggccacagattgttccagtccatggcctgttaggaaccaggccacacagtaggaggtgagcagccagccagtgagcattactgtgtgagctccgccccctgccagagcattactgtgtgagctccgccccctgtcagagcattactgtgtgagctccgccccctgccagagattactgtgtgagctccgccccctgccagagcattactgtgtgagctccgccccctgtcattactgtgtgagctccgccccctgtcatatcattactgtgtgagctccgccccctgtcatatcattattgtgagctccgcccctgtcatatcattgctgtgtgagctccgcctcctgtcagatcagtggtggcattagattctcataggagtggaatcctgttgtgaactgcgcatgagaaggatctaggttatgccccgcttatgagaatctaatactgatgatctgagatggaaccgtttcatctccaaaccatccccacacttgtcagtggaaaaagtgtcttccgtgaaaccagtccctggtgccaaaaaggttagggactgccggtttaaataaccaaatgctaaaagaactggcatagaagtaaatgggctgctgctttatttttaggctgttctttttagagagcaatgacagttatttccaagtttgtcattagaaaataatattaggttggagcaaaagtaattgcagtttttgccattgctttcaatggtaaaaggcacaattacttttgcagcaacttaatattataaatttgttcttaaagtgtatttttgataagaaagccgttttgtttttccttctgttaattttttgtttttttcttggtcgagacagagtcttgccatgctgcccaggctggagtgcagtggtgtgatctcggctcactgcagcctccacctcctgggctccagcagtcctcccacctcaacctccctaagagctgagactacaggtgtgagccaccatgcctggctaatttttagagacagggtttcaccctcttgcccaggctggtcccaaactcctgggctcaagcagtcctcctgcctcagcctcccagagtattgggattataggtgtgagccactgccagaaaaacgtttcctaagacaaggcaggtcttacattatatttaaattttttttaatgatgtcttttttggcagtgcacagccagaggacaacacatcacacacaagaaacagttgtgctcatgtgatgggggcctcagcactaggaaggagtggactgttggcgcacgcagcagcttgaataaatctgaaagtcactacgctgcgtaagagaagccaaataaagcgcatgctgtgtacagagggtgtcgagaatgcctcctacgtgacggaaagcagatccgtggttccctgcagactggcaggagcagattccaaaggcacaggaagaagcttgcaggcagctgctcccaaccccagaacctttgctgtcttgggacggatcaccactgcaagaggggaagttgctactgtgatgaattctgccatgtggcaccagactgccacccagaccacagtgtcctctgcaaccctggtaactcacatacaggcccgattccaccgacagcaaagctggatgctatggctggcagaggcaaaccctttgcctgcacttcaggccaaagccgggatgtggcctagatggttcctaaggtccctgacaatcctgagatcttgcatcttgtctatttcaggtcaaaggtgcctacatgctccttctagctttgtttccctgatgttccttgccacctgctactcctctctgagctacttttccaggttccacagggagaggttcagctgtccgtggtagacatgagggtagagagtgaggtggttgggttccacttacctttctatcatcttgcagtatggatgtctcttgactggtaccgtgtagacttttgagggcacacaggagtctgcagagagatactggggacattgagcagcagcagtggggttgggaggcagaaatgaggacaggaacatttaccttgtgtttctctcagcttctcagatgaccaagatggtgctgcagatggtgctgaggatggagaacccaccaagccccgctaggagccacctagactggatgcagagcatggtgagctccctgcaggttctctgagaaggggtggatggcagcctgctccttgcctttgtgccctccaggccccaaagtcagggaaccaaaagaagaaaggggccgtagctagggcagagctccactgcaatgattgttttaggggtaggagccaggattgccgtctgtggacactgaaatttgaatctcatatacttttgtgacaaaacattcttcctcttttgttcttctcctaccatctaaaaatgtagaaaacattcttagcctatgagttgcacaaaaacaggcagtggccagatttggcccatagaccatagtttgctgacttctgccctaaatcatcctccatttctttccttctgtgtccttgttactgacaaagccactttccctaaaatggggtctttccctgtggaaaagctcaagttagaatgagcaatagaaaaccagacagccctgtatctatgggaatgttgcttgcatcagagccaccacaccttgctgtgaggttgatcggtttctcgcagctggaaatagttgcttcccgccccccatcttcctcactcttttaaactctcaaaaatcccccagcctcccaaatttgttttaatttttaagagaattcttttctacaaaagagggaaaccttctttcaaatggcccttcataaatttccctaaagaggtttttatctctgatagaaatatgaaaaacagataaccagataattgccctctatctaggctttaaacacttattcatacattgaatttctgcaagttacagatgattgttgctgtgtgattactggccctgtgaaaagta

SEQ ID NO: 33987 - DNA, 2894 bp, Homo sapiens
gtgttgcctaggctggtctcaaactgctgggcttaagtgatcgttcctccttggcctcccgaagtgctggaattataggtgtgaaccaccatgtctggccttgtagtttatttctaagttcaaattaatgttggtgcttttcctccttttttcttagcagatggtttgctaggtgagtgtgtcctcgattctttaaatcaggggtccccaatccccaggccacagattgttccagtccatggcctgttaggaaccaggccacacagtaggaggtgagcagccagccagtgagcattactgtgtgagctccgccccctgccagagcattactgtgtgagctccgccccctgtcagagcattactgtgtgagctccgccccctgccagagattactgtgtgagctccgccccctgccagagcattactgtgtgagctccgccccctgtcattactgtgtgagctccgccccctgtcatatcattactgtgtgagctccgccccctgtcatatcattattgtgagctccgcccctgtcatatcattgctgtgtgagctccgcctcctgtcagatcagtggtggcattagattctcataggagtggaatcctgttgtgaactgcgcatgagaaggatctaggttatgccccgcttatgagaatctaatactgatgatctgagatggaaccgtttcatctccaaaccatccccacacttgtcagtggaaaaagtgtcttccgtgaaaccagtccctggtgccaaaaaggttagggactgccggtttaaataaccaaatgctaaaagaactggcatagaagtaaatgggctgctgctttatttttaggctgttctttttagagagcaatgacagttatttccaagtttgtcattagaaaataatattaggttggagcaaaagtaattgcagtttttgccattgctttcaatggtaaaaggcacaattacttttgcagcaacttaatattataaatttgttcttaaagtgtatttttgataagaaagccgttttgtttttccttctgttaattttttgtttttttcttggtcgagacagagtcttgccatgctgcccaggctggagtgcagtggtgtgatctcggctcactgcagcctccacctcctgggctccagcagtcctcccacctcaacctccctaagagctgagactacaggtgtgagccaccatgcctggctaatttttagagacagggtttcaccctcttgcccaggctggtcccaaactcctgggctcaagcagtcctcctgcctcagcctcccagagtattgggattataggtgtgagccactgccagaaaaacgtttcctaagacaaggcaggtcttacattatatttaaattttttttaatgatgtcttttttggcagtgcacagccagaggacaacacatcacacacaagaaacagttgtgctcatgtgatgggggcctcagcactaggaaggagtggactgttggcgcacgcagcagcttgaataaatctgaaagtcactacgctgcgtaagagaagccaaataaagcgcatgctgtgtacagagggtgtcgagaatgcctcctacgtgacggaaagcagatccgtggttccctgcagactggcaggagcagattccaaaggcacaggaagaagcttgcagtacaaagataaaaatctaaagtggttgctgtggaggacaggggtcagtggtggaagtgagaccgaaatagactctgaagtaatatctggactttgaaattgcagctgctcccaaccccagaacctttgctgtcttgggacggatcaccactgcaagaggggaagttgctactgtgatgaattctgccatgtggcaccagactgccacccagaccacagtgtcctctgcaaccctgaaaggtgcctacatgctccttctagctttgtttccctgatgttccttgccacctgctactcctctctgagctacttttccagcttctcagatgaccaagatggtgctgcagatggtgctgaggatggagaacccaccaagccccgctaggagccacctagactggatgcagagcatggttcagcgagttctccaaaccagcctcccaggaatgccattcaccatggctgtgaggagaataaagaagagagcctgactcctctcctgaggccccttccccaccctgagccagcaggatccacggagcagaggtcatctgtccccagcttggcccactgaggccagcatggctgggcccaggatgcttgtctctcagctcccatcctgtgtacttccacattggtttaaccagaggaaaaccgaaatctacaattgtcataaacacatttaaatgtgcgtagaatcagccatacaaattgtgaaacataaaacatttggctcatggtattattcactgttttgtggtggttacagtgactatagcaaacatttcttgaaagtagaaaataagaacccagcaccccttgagctaagtaatgtgccctctgtcctcaatattccttcctgggctccacattactgcccttaagtctggaaatattctggtctgagccccgtagtccaggcctcatgttcaggctttctgtccccagtgatgagaggagagacggcagacctttctccggtgagctcagatgggcctcccggagtctcctggggtgcacaggatttcaaagatccaggaggcgctgccaggggctgtgaggtctgatgaacctctcaccttccctcccacacctgcccttttcctgtttctgtggatgcttttgctgtccttggcttcctggactccagacctcagggtcatcttttgcttctctctgcaaggtgccaagtctctctaggtttttgtttgtttgttttgttattga

SEQ ID NO: 33988 - DNA, 1853 bp, Homo sapiens
  misc_feature (1841)..(1841): n is a, c, g, or t
  misc_feature (1843)..(1843): n is a, c, g, or t
  misc_feature (1847)..(1847): n is a, c, g, or t
  misc_feature (1850)..(1850): n is a, c, g, or t
gtgttgcctaggctggtctcaaactgctgggcttaagtgatcgttcctccttggcctcccgaagtgctggaattataggtgtgaaccaccatgtctggccttgtagtttatttctaagttcaaattaatgttggtgcttttcctccttttttcttagcagatggtttgctaggtgagtgtgtcctcgattctttaaatcaggggtccccaatccccaggccacagattgttccagtccatggcctgttaggaaccaggccacacagtaggaggtgagcagccagccagtgagcattactgtgtgagctccgccccctgccagagcattactgtgtgagctccgccccctgtcagagcattactgtgtgagctccgccccctgccagagattactgtgtgagctccgccccctgccagagcattactgtgtgagctccgccccctgtcattactgtgtgagctccgccccctgtcatatcattactgtgtgagctccgccccctgtcatatcattattgtgagctccgcccctgtcatatcattgctgtgtgagctccgcctcctgtcagatcagtggtggcattagattctcataggagtggaatcctgttgtgaactgcgcatgagaaggatctaggttatgccccgcttatgagaatctaatactgatgatctgagatggaaccgtttcatctccaaaccatccccacacttgtcagtggaaaaagtgtcttccgtgaaaccagtccctggtgccaaaaaggttagggactgccggtttaaataaccaaatgctaaaagaactggcatagaagtaaatgggctgctgctttatttttaggctgttctttttagagagcaatgacagttatttccaagtttgtcattagaaaataatattaggttggagcaaaagtaattgcagtttttgccattgctttcaatggtaaaaggcacaattacttttgcagcaacttaatattataaatttgttcttaaagtgtatttttgataagaaagccgttttgtttttccttctgttaattttttgtttttttcttggtcgagacagagtcttgccatgctgcccaggctggagtgcagtggtgtgatctcggctcactgcagcctccacctcctgggctccagcagtcctcccacctcaacctccctaagagctgagactacaggtgtgagccaccatgcctggctaatttttagagacagggtttcaccctcttgcccaggctggtcccaaactcctgggctcaagcagtcctcctgcctcagcctcccagagtattgggattataggtgtgagccactgccagaaaaacgtttcctaagacaaggcaggtcttacattatatttaaattttttttaatgatgtcttttttggcagtgcacagccagaggacaacacatcacacacaagaaacagttgtgctcatgtgatgggggcctcagcactaggaaggagtggactgttggcgcacgcagcagcttgaataaatctgaaagtcactacgctgcgtaagagaagccaaataaagcgcatgctgtgtacagagggtgtcgagaatgcctcctacgtgacggaaagcagatccgtggttccctgcagactggcaggagcagattccaaaggcacaggaagaagcttgcagtacaaagataaaaatctaaagtggttgctgtggaggacaggggtcagtggtggaagtgagaccgaaatagactctgaagtaatatctggactttgaaatttgcacagccagagaacaacacatcacacacaagaaacagttgtgctcatgtgatggggacctcagcactaggngngaanggnctg

SEQ ID NO: 33989 - DNA, 2192 bp, Homo sapiens
gtgttgcctaggctggtctcaaactgctgggcttaagtgatcgttcctccttggcctcccgaagtgctggaattataggtgtgaaccaccatgtctggccttgtagtttatttctaagttcaaattaatgttggtgcttttcctccttttttcttagcagatggtttgctaggtgagtgtgtcctcgattctttaaatcaggggtccccaatccccaggccacagattgttccagtccatggcctgttaggaaccaggccacacagtaggaggtgagcagccagccagtgagcattactgtgtgagctccgccccctgccagagcattactgtgtgagctccgccccctgtcagagcattactgtgtgagctccgccccctgccagagattactgtgtgagctccgccccctgccagagcattactgtgtgagctccgccccctgtcattactgtgtgagctccgccccctgtcatatcattactgtgtgagctccgccccctgtcatatcattattgtgagctccgcccctgtcatatcattgctgtgtgagctccgcctcctgtcagatcagtggtggcattagattctcataggagtggaatcctgttgtgaactgcgcatgagaaggatctaggttatgccccgcttatgagaatctaatactgatgatctgagatggaaccgtttcatctccaaaccatccccacacttgtcagtggaaaaagtgtcttccgtgaaaccagtccctggtgccaaaaaggttagggactgccggtttaaataaccaaatgctaaaagaactggcatagaagtaaatgggctgctgctttatttttaggctgttctttttagagagcaatgacagttatttccaagtttgtcattagaaaataatattaggttggagcaaaagtaattgcagtttttgccattgctttcaatggtaaaaggcacaattacttttgcagcaacttaatattataaatttgttcttaaagtgtatttttgataagaaagccgttttgtttttccttctgttaattttttgtttttttcttggtcgagacagagtcttgccatgctgcccaggctggagtgcagtggtgtgatctcggctcactgcagcctccacctcctgggctccagcagtcctcccacctcaacctccctaagagctgagactacaggtgtgagccaccatgcctggctaatttttagagacagggtttcaccctcttgcccaggctggtcccaaactcctgggctcaagcagtcctcctgcctcagcctcccagagtattgggattataggtgtgagccactgccagaaaaacgtttcctaagacaaggcaggtcttacattatatttaaattttttttaatgatgtcttttttggcagtgcacagccagaggacaacacatcacacacaagaaacagttgtgctcatgtgatgggggcctcagcactaggaaggagtggactgttggcgcacgcagcagcttgaataaatctgaaagtcactacgctgcgtaagagaagccaaataaagcgcatgctgtgtacagagggtgtcgagaatgcctcctacgtgacggaaagcagatccgtggttccctgcagactggcaggagcagattccaaaggcacaggaagaagcttgcagtacaaagataaaaatctaaagtggttgctgtggaggacaggggtcagtggtggaagtgagaccgaaatagactctgaagtaatatctggactttgaaattgtaagtgttttacatattaccaaactaagtttttaagatagtccctaaaattgaaagaatggtatctgaaatgaatgaatctaaattccttggattgcattctacaggcgccaaccctgagaccaaaatttggaaggtggccctgagcagcagctgaagggaagtgggaggtgaagatcaggacaagaggcggcagcatggggcgtccgggagccgggtctcatgtggacagctgggcccgtgttcactgtgggagctggtgcgttccttcaccagcccacgctgcacaggttcaggatggtcaattccgggcacccctggcctgctccaggacatgctgctgccaccagagaaagcccctaggcagcgtcccgggtgctggtggtgtcagaatcgagtttgagtctgaggagtgacctggggc

SEQ ID NO: 33990 - DNA, 1603 bp, Homo sapiens
gaaaatgtaaaaaggatcaagtggatgcagcctctacctaaataattaaaatatatttcagtatatttctgaattaacaccaggtcttcattatttagaacttactaaattgttttcattttcttagttttacctgtgtatctccatgtttgcaaaaattactataagtcaaattttgccagtgaatttaactatttttctttccttgcaattaaggggaaaaaagcatttatcttatcttctcataccccttgcatctaagtacttagcaaagtcaatattttcccattttccaaatgcgtccatctctaacataaatattaattgaacatagagctatgtttggagtgagtggactggcaggacagttggaagtccatcacagtctattgacagtttcatcaaagctgtatagtccaactagtggggcagcttggctactatggtggaagtctcagcaaactgcctggttttgtttgtttgttttgttttaaggtacaggaaataagaggaataatagtggccaaagcaattagaacatcttcattccagaactgtgttcagcaatccaggcagattgatacatttttctttaaaaataaattgctattacagctagacgtcaattgggataaataaagggatgaagatccactaagtttgtgactttcatacacacccagtacatctcaaaggatgctaagggacattttctgccagtagagttctccccctttttggtgacagcaatattattatgttcacatctaactccagagcttacttcctgtggtgccaatgtatttgttgcaatttactacatttttatatgagcctatttataggtgccattaaactcaggtctttcaaatgaaagagtttctagcccacttagggaaaaagataattgtttagaaaaccataaaatcaatggtaggaaaagttggaactggttacctggatgccatggttctctgttaaataaagtaagagaccaggtgtattctgagtgtcatcagtgttattttcagcatgctaataaatgtctttccggttatatatctatctaaattaacctttaaaatattggtttccttgataaaagcaccacttttgcttttgttagctgtaatattttttgtcatttagataagacctggtttggctctcaataaaagatgaagacagtagctctgtacagggatatatctatattagtcttcatctgatgaatgaagaaattttctcatattatgttcaagaaagtatttacttcctaaaaatagaattcccgattctgtctattttggttgaataccagaacaaatctttccgttgcaatcccagtaaaacgaaagaaaaggaatatcttacagactgttcatattagatgtatgtagactgttaatttgcagtttccccatatttcctgcctatcttacccagataactttctttgaaggtaaaagctgtgcaaaaggcatgagactcaggcctactctttgtttaaatgatggaaaaatataaattattttctaagtaataaaagtataaaaattatcattataaataaagtctaaagtttgaaattaataaaaaaaaa

SEQ ID NO: 33991 - DNA, 1001 bp, Homo sapiens
gaaaatgtaaaaaggatcaagtggatgcagcctctacctaaataattaaaatatatttcagtatatttctgaattaacaccaggtcttcattatttagaacttactaaattgttttcattttcttagttttacctgtgtatctccatgtttgcaaaaattactataagtcaaattttgccagtgaatttaactatttttctttccttgcaattaaggggaaaaaagcatttatcttatcttctcataccccttgcatctaagtacttagcaaagtcaatattttcccattttccaaatgcgtccatctctaacataaatattaattgaacatagagctatgtttggagtgagtggactggcaggacagttggaagtccatcacagtctattgacagtttcatcaaagctgtatagtccaactagtggggcagcttggctactatggtggaagtctcagcaaactgcctggttttgtttgtttgttttgttttaaggtacaggaaataagaggaataatagtggccaaagcaattagaacatcttcattccagaactgtgttcagcaatccaggcagattgatacatttttctttaaaaataaattgctattacagctagacgtcaattgggataaataaagggatgaagatccactaagtttgtgactttcatacacacccagtacatctcaaaggatgctaagggacattttctgccagtagagttctccccctttttggtgacagcaatattattatgttcacatctaactccagagcttacttcctgtggtgccaatgtatttgttgcaatttactacatttttatatgagcctatttataggtgccattaaactcaggtctttcaaatgaaagagtttctagcccacttagggaaaaagataattgtttagaaaaccataaaatcaatggtaggaaaagttggaactggttacctggatgccatggttctctgttaaataaagtaagagaccaggtg

SEQ ID NO: 33992 - DNA, 653 bp, Homo sapiens
gaaaatgtaaaaaggatcaagtggatgcagcctctacctaaataattaaaatatatttcagtatatttctgaattaacaccaggtcttcattatttagaacttactaaattgttttcattttcttagttttacctgtgtatctccatgtttgcaaaaattactataagtcaaattttgccagtgaatttaactatttttctttccttgcaattaaggggaaaaaagcatttatcttatcttctcataccccttgcatctaagtacttagcaaagtcaatattttcccattttccaaatgcgtccatctctaacataaatattaattgaacatagagctatgtttggagtgagtggactggcaggacagttggaagtccatcacagtctattgacagtttcatcaaagctgtatagtccaactagtggggcagcttggctactatggtggaagtctcagcaaactgcctggttttgtttgtttgttttgttttaaggtacaggaaataagaggaataatagtggccaaagcaattagaacatcttcattccagaactgtgttcagcaatccaggcagattgatacatttttctttaaaaataaattgctattacagctagacgtcaattgggataaataaagggatgaagatcc

SEQ ID NO: 33993 - DNA, 2652 bp, Homo sapiens
  misc_feature (4)..(5): n is a, c, g, or t
ggcnngagggcgcgctctgctcggctgcaggctcaggaagcggcgcggcggcagctgctgggccagagccccgcgccctgcgtccagccgccgggtgtgtgcgcccgcgtagcccagcgtcgcgcctcggcgcccccacgcgcccacgcagcggcgcggggacccgggcgggggcagagggagggcccggcccagggaggagaaggggccggtcctcccggcgcaggcagcagccgcggcagcccaggaggcggaggcagcggcaacggcagagacagcaacgtgcccgccgcagtcagcccggcctcgtcggacccgcaccggcccgcccgcccgcccgcaccgcgtcggggcgccctctccactgcgcgcggtacaaggaaatggtagaactagtgatctcacccagcctcactgtaaacagcgattgtctggataaactgaagtttaaccgtgctgacgctgctgtgtggactctgagtgacagacaaggcatcaccaaatcggcccccctgagagtgtcccagctcttctccagatcttgcccacgtgtcctcccccgccagccttccacagccatggcagcctacggccagacgcagtacagtgcggggatccagcaggctaccccctatacagcttacccacctccagcacaagcctatggaatcccttcctacacttcagcacctcacccactggacagagcccatacacctaccagatgcacggcacaacagggttctatcaaggaggaaatggactgggcaacgcagccggtttcgggagtgtgcaccaggactatccttcctaccccggcttcccccagagccagtacccccagtattacggctcatcctacaaccctccctacgtcccggccagcagcatctgcccttcgcccctctccacgtccacctacgtcctccaggaggcatctcacaacgtccccaaccagagttccgagtcacttgctggtgaatacaacacacacaatggaccttccacaccagcgaaagagggagacacagacaggccgcaccgggcctccgacgggaagctccgaggccggtctaagaggagcagtgacccgtccccggcaggggacaatgagattgagcgtgtgttcgtgtgggacttggatgagacaataattatttttcactccttactcacggggacatttgcatccagatacgggaaggacaccacgacgtccgtgcgcattggccttatgatggaagagatgatcttcaaccttgcagatacacatctgttcttcaatgacctggaggattgtgaccagatccacgttgatgacgtctcatcagatgacaatggccaagatttaagcacatacaacttctccgctgacggcttccacagttcggccccaggagccaacctgtgcctgggctctggcgtgcacggcggcgtggactggatgaggaagctggccttccgctaccggcgggtgaaggagatgtacaatacctacaagaacaacgttggtgggttgataggcactcccaaaagggagacctggctacagctccgagctgagctggaagctctcacagacctctggctgacccactccctgaaggcactaaacctcatcaactcccggcccaactgtgtcaatgtgctggtcaccaccactcaactaattcctgccctggccaaagtcctgctatatggcctggggtctgtgtttcctattgagaacatctacagtgcaaccaagacagggaaggagagctgcttcgagaggataatgcagagattcggcagaaaagctgtctacgtggtgatcggtgatggtgtggaagaggagcaaggagcgaaaaagcacaacatgcctttctggcggatatcctgccacgcagacctggaggcactgaggcacgccctggagctggagtatttatagcaggatcagcagcatctccacctgccatctcaccctcagaccccctcgccttccccacctccccaccgagaactccagagacccagatgttggacaccaggaaggggccccacagccgagacgacgtgtccagtgaccatctcagaagccgtccatcagtccaaatgggggttctgagaaggaaagtacccaacattggcttcggagtatttgactttggggaaaagggctggctcggagtctagactcttctgtaagactcacagaacaaaagcaaggaattgctgatttggggggtgcctggtgatgaggaggggatgggtttgtcttgtcttctttttaatttatggactagtctcattactccggaattatgctcttgtacctgtgtggctgggtttcttagtcgttggtttggtttggttttttgaactggtatgtggggtggttcacagttctaatgtaagcactctattctccaagttgtgctttgtggggacaatcattctttgaacattagagaggaaggcagttcaagctgttgaaaagactattgcttatttttgtttttaaagacctacttgacgtcatgtggacagtgcacgtgccttacgctacatcttgttttctaggaagagggggatgctgggaaggaatgggtgctttgtgatggataaaaggcattaaataaaaccacgtttacattttgaaaaaaaaaa

SEQ ID NO: 33994 - DNA, 2482 bp, Homo sapiens
  misc_feature (4)..(5): n is a, c, g, or t
ggcnngagggcgcgctctgctcggctgcaggctcaggaagcggcgcggcggcagctgctgggccagagccccgcgccctgcgtccagccgccgggtgtgtgcgcccgcgtagcccagcgtcgcgcctcggcgcccccacgcgcccacgcagcggcgcggggacccgggcgggggcagagggagggcccggcccagggaggagaaggggccggtcctcccggcgcaggcagcagccgcggcagcccaggaggcggaggcagcggcaacggcagagacagcaacgtgcccgccgcagtcagcccggcctcgtcggacccgcaccggcccgcccgcccgcccgcaccgcgtcggggcgccctctccactgcgcgcggtacaaggaaatggtagaactagtgatctcacccagcctcactgtaaacagcgattgtctggataaactgaagtttaaccgtgctgacgctgctgtgtggactctgagtgacagacaaggcatcaccaaatcggcccccctgagagtgtcccagctcttctccagatcttgcccacgtgtcctcccccgccagccttccacagccatggcagcctacggccagacgcagtacagtgcggggatccagcaggctaccccctatacagcttacccacctccagcacaagcctatggaatcccttcctacagcatcaagacagaagacagcttgaaccattcccctggccagagtggattcctcagctatggctccagcttcagcacctcacccactggacagagcccatacacctaccagatgcacggcacaacagggttctatcaaggaggaaatggactgggcaacgcagccggtttcgggagtgtgcaccaggactatccttcctaccccggcttcccccagagccagtacccccagtattacggctcatcctacaaccctccctacgtcccggccagcagcatctgcccttcgcccctctccacgtccacctacgtcctccaggaggcatctcacaacgtccccaaccagagttccgagtcacttgctggtgaatacaacacacacaatggaccttccacaccagcgaaagagggagacacagacaggccgcaccgggcctccgacgggaagctccgaggccggtctaagaggagcagtgacccgtccccggcaggggacaatgagattgagcgtgtgttcgtgtgggacttggatgagacaataattatttttcactccttactcacggggacatttgcatccagatacgggaaggacaccacgacgtccgtgcgcattggccttatgatggaagagatgatcttcaaccttgcagatacacatctgttcttcaatgacctggaggattgtgaccagatccacgttgatgacgtctcatcagatgacaatggccaagatttaagcacatacaacttctccgctgacggcttccacagttcggccccaggagccaacctgtgcctgggctctggcgtgcacggcggcgtggactggatgaggaagctggccttccgctaccggcgggtgaaggagatgtacaatacctacaagaacaacgttggtgggaaggagagctgcttcgagaggataatgcagagattcggcagaaaagctgtctacgtggtgatcggtgatggtgtggaagaggagcaaggagcgaaaaagcacaacatgcctttctggcggatatcctgccacgcagacctggaggcactgaggcacgccctggagctggagtatttatagcaggatcagcagcatctccacctgccatctcaccctcagaccccctcgccttccccacctccccaccgagaactccagagacccagatgttggacaccaggaaggggccccacagccgagacgacgtgtccagtgaccatctcagaagccgtccatcagtccaaatgggggttctgagaaggaaagtacccaacattggcttcggagtatttgactttggggaaaagggctggctcggagtctagactcttctgtaagactcacagaacaaaagcaaggaattgctgatttggggggtgcctggtgatgaggaggggatgggtttgtcttgtcttctttttaatttatggactagtctcattactccggaattatgctcttgtacctgtgtggctgggtttcttagtcgttggtttggtttggttttttgaactggtatgtggggtggttcacagttctaatgtaagcactctattctccaagttgtgctttgtggggacaatcattctttgaacattagagaggaaggcagttcaagctgttgaaaagactattgcttatttttgtttttaaagacctacttgacgtcatgtggacagtgcacgtgccttacgctacatcttgttttctaggaagagggggatgctgggaaggaatgggtgctttgtgatggataaaaggcattaaataaaaccacgtttacattttgaaaaaaaaaa

SEQ ID NO: 33995 - DNA, 652 bp, Homo sapiens
  misc_feature (69)..(69): n is a, c, g, or t
tcagtcccagccaagccacgtggactgagagtcatggggagacctagggaaattaaataactcacaaanacctgtaaaaactgttacagtgactggtgtgtgtgatagagggccatgggcctgtgaaagctgcaggagggaaatcgcttactcagggagagcctggggaaatcctgccggaactgaggcctctgcagggtgagcaggagggactggagttccaggcagagggaacagcatgtacaaaggccctgtggcaagagggagtgtggagcgagagaaaggccagcgtgctggaatcagatattggacaaggagaagccagatcaaggctgtgttcggaactctttgctttatcttaagagcaatggaaagccgtcagaggttataagcaaggatgaggtggcagaggttcctggaaacaccaaaaaaaaaaaaaaaaagtggaggatgacaccagaagttataaagcgttgagctcaacgcttaatacttcatgtttaaacatgaagtagaaatggggttgtgcgttctccccagattgtacatacttggaagagccatgcagcaggcagaggagaggaacagaggagctgtgtggtttgaccctcctcggaatctgcagtgtggctggctctgtgtgctccctgta

SEQ ID NO: 33996 - DNA, 2719 bp, Homo sapiens
  misc_feature (4)..(5): n is a, c, g, or t
ggcnngagggcgcgctctgctcggctgcaggctcaggaagcggcgcggcggcagctgctgggccagagccccgcgccctgcgtccagccgccgggtgtgtgcgcccgcgtagcccagcgtcgcgcctcggcgcccccacgcgcccacgcagcggcgcggggacccgggcgggggcagagggagggcccggcccagggaggagaaggggccggtcctcccggcgcaggcagcagccgcggcagcccaggaggcggaggcagcggcaacggcagagacagcaacgtgcccgccgcagtcagcccggcctcgtcggacccgcaccggcccgcccgcccgcccgcaccgcgtcggggcgccctctccactgcgcgcggtacaaggaaatggtagaactagtgatctcacccagcctcactgtaaacagcgattgtctggataaactgaagtttaaccgtgctgacgctgctgtgtggactctgagtgacagacaaggcatcaccaaatcggcccccctgagagtgtcccagctcttctccagatcttgcccacgtgtcctcccccgccagccttccacagccatggcagcctacggccagacgcagtacagtgcggggatccagcaggctaccccctatacagcttacccacctccagcacaagcctatggaatcccttcctacagcatcaagacagaagacagcttgaaccattcccctggccagagtggattcctcagctatggctccagcttcagcacctcacccactggacagagcccatacacctaccagatgcacggcacaacagggttctatcaaggaggaaatggactgggcaacgcagccggtttcgggagtgtgcaccaggactatccttcctaccccggcttcccccagagccagtacccccagtattacggctcatcctacaaccctccctacgtcccggccagcagcatctgcccttcgcccctctccacgtccacctacgtcctccaggaggcatctcacaacgtccccaaccagagttccgagtcacttgctggtgaatacaacacacacaatggaccttccacaccagcgaaagagggagacacagacaggccgcaccgggcctccgacgggaagctccgaggccggtctaagaggagcagtgacccgtccccggcaggggacaatgagattgagcgtgtgttcgtgtgggacttggatgagacaataattatttttcactccttactcacggggacatttgcatccagatacgggaaggacaccacgacgtccgtgcgcattggccttatgatggaagagatgatcttcaaccttgcagatacacatctgttcttcaatgacctggaggattgtgaccagatccacgttgatgacgtctcatcagatgacaatggccaagatttaagcacatacaacttctccgctgacggcttccacagttcggccccaggagccaacctgtgcctgggctctggcgtgcacggcggcgtggactggatgaggaagctggccttccgctaccggcgggtgaaggagatgtacaatacctacaagaacaacgttggtgggttgataggcactcccaaaagggagacctggctacagctccgagctgagctggaagctctcacagacctctggctgacccactccctgaaggcactaaacctcatcaactcccggcccaactgtgtcaatgtgctggtcaccaccactcaactaattcctgccctggccaaagtcctgctatatggcctggggtctgtgtttcctattgagaacatctacagtgcaaccaagacagggaaggagagctgcttcgagaggataatgcagagattcggcagaaaagctgtctacgtggtgatcggtgatggtgtggaagaggagcaaggagcgaaaaagcacaacatgcctttctggcggatatcctgccacgcagacctggaggcactgaggcacgccctggagctggagtatttatagcaggatcagcagcatctccacctgccatctcaccctcagaccccctcgccttccccacctccccaccgagaactccagagacccagatgttggacaccaggaaggggccccacagccgagacgacgtgtccagtgaccatctcagaagccgtccatcagtccaaatgggggttctgagaaggaaagtacccaacattggcttcggagtatttgactttggggaaaagggctggctcggagtctagactcttctgtaagactcacagaacaaaagcaaggaattgctgatttggggggtgcctggtgatgaggaggggatgggtttgtcttgtcttctttttaatttatggactagtctcattactccggaattatgctcttgtacctgtgtggctgggtttcttagtcgttggtttggtttggttttttgaactggtatgtggggtggttcacagttctaatgtaagcactctattctccaagttgtgctttgtggggacaatcattctttgaacattagagaggaaggcagttcaagctgttgaaaagactattgcttatttttgtttttaaagacctacttgacgtcatgtggacagtgcacgtgccttacgctacatcttgttttctaggaagagggggatgctgggaaggaatgggtgctttgtgatggataaaaggcattaaataaaaccacgtttacattttgaaaaaaaaaa

SEQ ID NO: 33997 - DNA, 2751 bp, Homo sapiens
  misc_feature (69)..(69): n is a, c, g, or t
tcagtcccagccaagccacgtggactgagagtcatggggagacctagggaaattaaataactcacaaanacctgtaaaaactgttacagtgactggtgtgtgtgatagagggccatgggcctgtgaaagctgcaggagggaaatcgcttactcagggagagcctggggaaatcctgccggaactgaggcctctgcagggtgagcaggagggactggagttccaggcagagggaacagcatgtacaaaggccctgtggcaagagggagtgtggagcgagagaaaggccagcgtgctggaatcagatattggacaaggagaagccagatcaaggctgtgttcggaactctttgctttatcttaagagcaatggaaagccgtcagaggttataagcaaggatgaggtggtacaaggaaatggtagaactagtgatctcacccagcctcactgtaaacagcgattgtctggataaactgaagtttaaccgtgctgacgctgctgtgtggactctgagtgacagacaaggcatcaccaaatcggcccccctgagagtgtcccagctcttctccagatcttgcccacgtgtcctcccccgccagccttccacagccatggcagcctacggccagacgcagtacagtgcggggatccagcaggctaccccctatacagcttacccacctccagcacaagcctatggaatcccttcctacagcatcaagacagaagacagcttgaaccattcccctggccagagtggattcctcagctatggctccagcttcagcacctcacccactggacagagcccatacacctaccagatgcacggcacaacagggttctatcaaggaggaaatggactgggcaacgcagccggtttcgggagtgtgcaccaggactatccttcctaccccggcttcccccagagccagtacccccagtattacggctcatcctacaaccctccctacgtcccggccagcagcatctgcccttcgcccctctccacgtccacctacgtcctccaggaggcatctcacaacgtccccaaccagagttccgagtcacttgctggtgaatacaacacacacaatggaccttccacaccagcgaaagagggagacacagacaggccgcaccgggcctccgacgggaagctccgaggccggtctaagaggagcagtgacccgtccccggcaggggacaatgagattgagcgtgtgttcgtgtgggacttggatgagacaataattatttttcactccttactcacggggacatttgcatccagatacgggaaggacaccacgacgtccgtgcgcattggccttatgatggaagagatgatcttcaaccttgcagatacacatctgttcttcaatgacctggaggattgtgaccagatccacgttgatgacgtctcatcagatgacaatggccaagatttaagcacatacaacttctccgctgacggcttccacagttcggccccaggagccaacctgtgcctgggctctggcgtgcacggcggcgtggactggatgaggaagctggccttccgctaccggcgggtgaaggagatgtacaatacctacaagaacaacgttggtgggttgataggcactcccaaaagggagacctggctacagctccgagctgagctggaagctctcacagacctctggctgacccactccctgaaggcactaaacctcatcaactcccggcccaactgtgtcaatgtgctggtcaccaccactcaactaattcctgccctggccaaagtcctgctatatggcctggggtctgtgtttcctattgagaacatctacagtgcaaccaagacagggaaggagagctgcttcgagaggataatgcagagattcggcagaaaagctgtctacgtggtgatcggtgatggtgtggaagaggagcaaggagcgaaaaagcacaacatgcctttctggcggatatcctgccacgcagacctggaggcactgaggcacgccctggagctggagtatttatagcaggatcagcagcatctccacctgccatctcaccctcagaccccctcgccttccccacctccccaccgagaactccagagacccagatgttggacaccaggaaggggccccacagccgagacgacgtgtccagtgaccatctcagaagccgtccatcagtccaaatgggggttctgagaaggaaagtacccaacattggcttcggagtatttgactttggggaaaagggctggctcggagtctagactcttctgtaagactcacagaacaaaagcaaggaattgctgatttggggggtgcctggtgatgaggaggggatgggtttgtcttgtcttctttttaatttatggactagtctcattactccggaattatgctcttgtacctgtgtggctgggtttcttagtcgttggtttggtttggttttttgaactggtatgtggggtggttcacagttctaatgtaagcactctattctccaagttgtgctttgtggggacaatcattctttgaacattagagaggaaggcagttcaagctgttgaaaagactattgcttatttttgtttttaaagacctacttgacgtcatgtggacagtgcacgtgccttacgctacatcttgttttctaggaagagggggatgctgggaaggaatgggtgctttgtgatggataaaaggcattaaataaaaccacgtttacattttgaaaaaaaaaa

SEQ ID NO: 33998 - DNA, 1992 bp, Homo sapiens
actgtgcaagacaagcccatcaagccacatcatgagtaactagggaagcccatacacctaccagatgcacggcacaacagggttctatcaaggaggaaatggactgggcaacgcagccggtttcgggagtgtgcaccaggactatccttcctaccccggcttcccccagagccagtacccccagtattacggctcatcctacaaccctccctacgtcccggccagcagcatctgcccttcgcccctctccacgtccacctacgtcctccaggaggcatctcacaacgtccccaaccagagttccgagtcacttgctggtgaatacaacacacacaatggaccttccacaccagcgaaagagggagacacagacaggccgcaccgggcctccgacgggaagctccgaggccggtctaagaggagcagtgacccgtccccggcaggggacaatgagattgagcgtgtgttcgtgtgggacttggatgagacaataattatttttcactccttactcacggggacatttgcatccagatacgggaaggacaccacgacgtccgtgcgcattggccttatgatggaagagatgatcttcaaccttgcagatacacatctgttcttcaatgacctggaggattgtgaccagatccacgttgatgacgtctcatcagatgacaatggccaagatttaagcacatacaacttctccgctgacggcttccacagttcggccccaggagccaacctgtgcctgggctctggcgtgcacggcggcgtggactggatgaggaagctggccttccgctaccggcgggtgaaggagatgtacaatacctacaagaacaacgttggtgggttgataggcactcccaaaagggagacctggctacagctccgagctgagctggaagctctcacagacctctggctgacccactccctgaaggcactaaacctcatcaactcccggcccaactgtgtcaatgtgctggtcaccaccactcaactaattcctgccctggccaaagtcctgctatatggcctggggtctgtgtttcctattgagaacatctacagtgcaaccaagacagggaaggagagctgcttcgagaggataatgcagagattcggcagaaaagctgtctacgtggtgatcggtgatggtgtggaagaggagcaaggagcgaaaaagcacaacatgcctttctggcggatatcctgccacgcagacctggaggcactgaggcacgccctggagctggagtatttatagcaggatcagcagcatctccacctgccatctcaccctcagaccccctcgccttccccacctccccaccgagaactccagagacccagatgttggacaccaggaaggggccccacagccgagacgacgtgtccagtgaccatctcagaagccgtccatcagtccaaatgggggttctgagaaggaaagtacccaacattggcttcggagtatttgactttggggaaaagggctggctcggagtctagactcttctgtaagactcacagaacaaaagcaaggaattgctgatttggggggtgcctggtgatgaggaggggatgggtttgtcttgtcttctttttaatttatggactagtctcattactccggaattatgctcttgtacctgtgtggctgggtttcttagtcgttggtttggtttggttttttgaactggtatgtggggtggttcacagttctaatgtaagcactctattctccaagttgtgctttgtggggacaatcattctttgaacattagagaggaaggcagttcaagctgttgaaaagactattgcttatttttgtttttaaagacctacttgacgtcatgtggacagtgcacgtgccttacgctacatcttgttttctaggaagagggggatgctgggaaggaatgggtgctttgtgatggataaaaggcattaaataaaaccacgtttacattttgaaaaaaaaaa

SEQ ID NO: 33999 - DNA, 1958 bp, Homo sapiens
ggcacgaggcagctcttctccagatcttgcccacgtgtcctcccccgccagccttccacagccatggcagcctacggccagacgcagtacagtgcggggatccagcaggctaccccctatacagcttacccacctccagcacaagcctatggaatcccttcctacagcatcaagacagaagacagcttgaaccattcccctggccagagtggattcctcagctatggctccagcttcagcacctcacccactggacagagcccatacacctaccagatgcacggtgaatacaacacacacaatggaccttccacaccagcgaaagagggagacacagacaggccgcaccgggcctccgacgggaagctccgaggccggtctaagaggagcagtgacccgtccccggcaggggacaatgagattgagcgtgtgttcgtgtgggacttggatgagacaataattatttttcactccttactcacggggacatttgcatccagatacgggaaggacaccacgacgtccgtgcgcattggccttatgatggaagagatgatcttcaaccttgcagatacacatctgttcttcaatgacctggaggattgtgaccagatccacgttgatgacgtctcatcagatgacaatggccaagatttaagcacatacaacttctccgctgacggcttccacagttcggccccaggagccaacctgtgcctgggctctggcgtgcacggcggcgtggactggatgaggaagctggccttccgctaccggcgggtgaaggagatgtacaatacctacaagaacaacgttggtgggttgataggcactcccaaaagggagacctggctacagctccgagctgagctggaagctctcacagacctctggctgacccactccctgaaggcactaaacctcatcaactcccggcccaactgtgtcaatgtgctggtcaccaccactcaactaattcctgccctggccaaagtcctgctatatggcctggggtctgtgtttcctattgagaacatctacagtgcaaccaagacagggaaggagagctgcttcgagaggataatgcagagattcggcagaaaagctgtctacgtggtgatcggtgatggtgtggaagaggagcaaggagcgaaaaagcacaacatgcctttctggcggatatcctgccacgcagacctggaggcactgaggcacgccctggagctggagtatttatagcaggatcagcagcatctccacctgccatctcaccctcagaccccctcgccttccccacctccccaccgagaactccagagacccagatgttggacaccaggaaggggccccacagccgagacgacgtgtccagtgaccatctcagaagccgtccatcagtccaaatgggggttctgagaaggaaagtacccaacattggcttcggagtatttgactttggggaaaagggctggctcggagtctagactcttctgtaagactcacagaacaaaagcaaggaattgctgatttggggggtgcctggtgatgaggaggggatgggtttgtcttgtcttctttttaatttatggactagtctcattactccggaattatgctcttgtacctgtgtggctgggtttcttagtcgttggtttggtttggttttttgaactggtatgtggggtggttcacagttctaatgtaagcactctattctccaagttgtgctttgtggggacaatcattctttgaacattagagaggaaggcagttcaagctgttgaaaagactattgcttatttttgtttttaaagacctacttgacgtcatgtggacagtgcacgtgccttacgctacatcttgttttctaggaagagggggatgctgggaaggaatgggtgctttgtgatggataaaaggcattaaataaaaccacgtttacattttgaaaaaaaaaa

SEQ ID NO: 34000 - DNA, 1233 bp, Homo sapiens
ttcaatttctacacaattaaaacaaagcatcgcgaaggcccgcggcgggtgttgacgcgatgctttgtttgttcaatttctacacaacgttggtgggttgataggcactcccaaaagggagacctggctacagctccgagctgagctggaagctctcacagacctctggctgacccactccctgaaggcactaaacctcatcaactcccggcccaactgtgtcaatgtgctggtcaccaccactcaactaattcctgccctggccaaagtcctgctatatggcctggggtctgtgtttcctattgagaacatctacagtgcaaccaagacagggaaggagagctgcttcgagaggataatgcagagattcggcagaaaagctgtctacgtggtgatcggtgatggtgtggaagaggagcaaggagcgaaaaagcacaacatgcctttctggcggatatcctgccacgcagacctggaggcactgaggcacgccctggagctggagtatttatagcaggatcagcagcatctccacctgccatctcaccctcagaccccctcgccttccccacctccccaccgagaactccagagacccagatgttggacaccaggaaggggccccacagccgagacgacgtgtccagtgaccatctcagaagccgtccatcagtccaaatgggggttctgagaaggaaagtacccaacattggcttcggagtatttgactttggggaaaagggctggctcggagtctagactcttctgtaagactcacagaacaaaagcaaggaattgctgatttggggggtgcctggtgatgaggaggggatgggtttgtcttgtcttctttttaatttatggactagtctcattactccggaattatgctcttgtacctgtgtggctgggtttcttagtcgttggtttggtttggttttttgaactggtatgtggggtggttcacagttctaatgtaagcactctattctccaagttgtgctttgtggggacaatcattctttgaacattagagaggaaggcagttcaagctgttgaaaagactattgcttatttttgtttttaaagacctacttgacgtcatgtggacagtgcacgtgccttacgctacatcttgttttctaggaagagggggatgctgggaaggaatgggtgctttgtgatggataaaaggcattaaataaaaccacgtttacattttgaaaaaaaaaa

SEQ ID NO: 34001 - DNA, 2224 bp, Homo sapiens
  misc_feature (4)..(5): n is a, c, g, or t
ggcnngagggcgcgctctgctcggctgcaggctcaggaagcggcgcggcggcagctgctgggccagagccccgcgccctgcgtccagccgccgggtgtgtgcgcccgcgtagcccagcgtcgcgcctcggcgcccccacgcgcccacgcagcggcgcggggacccgggcgggggcagagggagggcccggcccagggaggagaaggggccggtcctcccggcgcaggcagcagccgcggcagcccaggaggcggaggcagcggcaacggcagagacagcaacgtgcccgccgcagtcagcccggcctcgtcggacccgcaccggcccgcccgcccgcccgcaccgcgtcggggcgccctctccactgcgcgcggtacaaggaaatggtagaactagtgatctcacccagcctcactgtaaacagcgattgtctggataaactgaagtttaaccgtgctgacgctgctgtgtggactctgagtgacagacaaggcatcaccaaatcggcccccctgagagtgtcccagctcttctccagatcttgcccacgtgtcctcccccgccagccttccacagccatggcagcctacggccagacgcagtacagtgcggggatccagcaggctaccccctatacagcttacccacctccagcacaagcctatggaatcccttcctacagcatcaagacagaagacagcttgaaccattcccctggccagagtggattcctcagctatggctccagcttcagcacctcacccactggacagagcccatacacctaccagatgcacggcacaacagggttctatcaaggaggaaatggactgggcaacgcagccggtttcgggagtgtgcaccaggactatccttcctaccccggcttcccccagagccagtacccccagtattacggctcatcctacaaccctccctacgtcccggccagcagcatctgcccttcgcccctctccacgtccacctacgtcctccaggaggcatctcacaacgtccccaaccagagttccgagtcacttgctggtgaatacaacacacacaatggaccttccacaccagcgaaagagggagacacagacaggccgcaccgggcctccgacgggaagctccgaggccggtctaagaggagcagtgacccgtccccggcaggggacaatgagattgagcgtgtgttcgtgtgggacttggatgagacaataattatttttcactccttactcacggggacatttgcatccagatacgggaaggacaccacgacgtccgtgcgcattggccttatgatggaagagatgatcttcaaccttgcagatacacatctgttcttcaatgacctggaggattgtgaccagatccacgttgatgacgtctcatcagatgacaatggccaagatttaagcacatacaacttctccgctgacggcttccacagttcggccccaggagccaacctgtgcctgggctctggcgtgcacggcggcgtggactggatgaggaagctggccttccgctaccggcgggtgaaggagatgtacaatacctacaagaacaacgttggtgggttgataggcactcccaaaagggagacctggctacagctccgagctgagctggaagctctcacagacctctggctgacccactccctgaaggcactaaacctcatcaactcccggcccaactgtgtcaatgtgctggtcaccaccactcaactaattcctgccctggccaaagtcctgctatatggcctggggtctgtgtttcctattgagaacatctacagtgcaaccaagacagctgccatctcaccctcagaccccctcgccttccccacctccccaccgagaatccggaattatgctcttgtacctgtgtggctgggtttcttagtcgttggtttggtttggttttttgaactggtatgtggggtggttcacagttctaatgtaagcactctattctccaagttgtgctttgtggggacaatcattctttgaacattagagaggaaggcagttcaagctgttgaaaagactattgcttatttttgtttttaaagacctacttgacgtcatgtggacagtgcacgtgccttacgctacatcttgttttctaggaagagggggatgctgggaaggaatgggtgctttgtgatggataaaaggcattaaataaaaccacgtttacattttgaaaaaaaaaa

SEQ ID NO: 34002 - DNA, 1998 bp, Homo sapiens
  misc_feature (4)..(5): n is a, c, g, or t
  misc_feature (1934)..(1934): n is a, c, g, or t
  misc_feature (1937)..(1937): n is a, c, g, or t
  misc_feature (1939)..(1940): n is a, c, g, or t
ggcnngagggcgcgctctgctcggctgcaggctcaggaagcggcgcggcggcagctgctgggccagagccccgcgccctgcgtccagccgccgggtgtgtgcgcccgcgtagcccagcgtcgcgcctcggcgcccccacgcgcccacgcagcggcgcggggacccgggcgggggcagagggagggcccggcccagggaggagaaggggccggtcctcccggcgcaggcagcagccgcggcagcccaggaggcggaggcagcggcaacggcagagacagcaacgtgcccgccgcagtcagcccggcctcgtcggacccgcaccggcccgcccgcccgcccgcaccgcgtcggggcgccctctccactgcgcgcggtacaaggaaatggtagaactagtgatctcacccagcctcactgtaaacagcgattgtctggataaactgaagtttaaccgtgctgacgctgctgtgtggactctgagtgacagacaaggcatcaccaaatcggcccccctgagagtgtcccagctcttctccagatcttgcccacgtgtcctcccccgccagccttccacagccatggcagcctacggccagacgcagtacagtgcggggatccagcaggctaccccctatacagcttacccacctccagcacaagcctatggaatcccttcctacagcatcaagacagaagacagcttgaaccattcccctggccagagtggattcctcagctatggctccagcttcagcacctcacccactggacagagcccatacacctaccagatgcacggcacaacagggttctatcaaggaggaaatggactgggcaacgcagccggtttcgggagtgtgcaccaggactatccttcctaccccggcttcccccagagccagtacccccagtattacggctcatcctacaaccctccctacgtcccggccagcagcatctgcccttcgcccctctccacgtccacctacgtcctccaggaggcatctcacaacgtccccaaccagagttccgagtcacttgctggtgaatacaacacacacaatggaccttccacaccagcgaaagagggagacacagacaggccgcaccgggcctccgacgggaagctccgaggccggtctaagaggagcagtgacccgtccccggcaggggacaatgagattgagcgtgtgttcgtgtgggacttggatgagacaataattatttttcactccttactcacggggacatttgcatccagatacgggaaggacaccacgacgtccgtgcgcattggccttatgatggaagagatgatcttcaaccttgcagatacacatctgttcttcaatgacctggaggattgtgaccagatccacgttgatgacgtctcatcagatgacaatggccaagatttaagcacatacaacttctccgctgacggcttccacagttcggccccaggagccaacctgtgcctgggctctggcgtgcacggcggcgtggactggatgaggaagctggccttccgctaccggcgggtgaaggagatgtacaatacctacaagaacaacgttggtgggttgataggcactcccaaaagggagacctggctacagctccgagctgagctggaagctctcacagacctctggctgacccactccctgaaggcactaaacctcatcaactcccggcccaactgtgtcaatgtgctggtcaccaccactcaactaattcctgccctggccaaagtcctgctatatggcctggggtctgtgtttcctattgagaacatctacagtgcaaccaagacagggaaggagagctgcttcgagaggataatgcagagattcggcagaaaagctgtctacgtggtgatcggtgatggtgtggaagaggagcaaggagcgaaaaagcacaacatgcctttnctngnntccgaattcggcacgagtttttttttttttttttttttttttttttttttctcgtgcc

SEQ ID NO: 34003 - DNA, 1817 bp, Homo sapiens
  misc_feature (4)..(5): n is a, c, g, or t
ggcnngagggcgcgctctgctcggctgcaggctcaggaagcggcgcggcggcagctgctgggccagagccccgcgccctgcgtccagccgccgggtgtgtgcgcccgcgtagcccagcgtcgcgcctcggcgcccccacgcgcccacgcagcggcgcggggacccgggcgggggcagagggagggcccggcccagggaggagaaggggccggtcctcccggcgcaggcagcagccgcggcagcccaggaggcggaggcagcggcaacggcagagacagcaacgtgcccgccgcagtcagcccggcctcgtcggacccgcaccggcccgcccgcccgcccgcaccgcgtcggggcgccctctccactgcgcgcggtacaaggaaatggtagaactagtgatctcacccagcctcactgtaaacagcgattgtctggataaactgaagtttaaccgtgctgacgctgctgtgtggactctgagtgacagacaaggcatcaccaaatcggcccccctgagagtgtcccagctcttctccagatcttgcccacgtgtcctcccccgccagccttccacagccatggcagcctacggccagacgcagtacagtgcggggatccagcaggctaccccctatacagcttacccacctccagcacaagcctatggaatcccttcctacagcatcaagacagaagacagcttgaaccattcccctggccagagtggattcctcagctatggctccagcttcagcacctcacccactggacagagcccatacacctaccagatgcacggcacaacagggttctatcaaggaggaaatggactgggcaacgcagccggtttcgggagtgtgcaccaggactatccttcctaccccggcttcccccagagccagtacccccagtattacggctcatcctacaaccctccctacgtcccggccagcagcatctgcccttcgcccctctccacgtccacctacgtcctccaggaggcatctcacaacgtccccaaccagagttccgagtcacttgctggtgaatacaacacacacaatggaccttccacaccagcgaaagagggagacacagacaggccgcaccgggcctccgacgggaagctccgaggccggtctaagaggagcagtgacccgtccccggcaggggacaatgagattgagcgtgtgttcgtgtgggacttggatgagacaataattatttttcactccttactcacggggacatttgcatccagatacgggaaggacaccacgacgtccgtgcgcattggccttatgatggaagagatgatcttcaaccttgcagatacacatctgttcttcaatgacctggaggattgtgaccagatccacgttgatgacgtctcatcagatgacaatggccaagatttaagcacatacaacttctccgctgacggcttccacagttcggccccaggagccaacctgtgcctgggctctggcgtgcacggcggcgtggactggatgaggaagctggccttccgctaccggcgggtgaaggagatgtacaatacctacaagaacaacgttggtggtgagtactgtgagccttgggcctccgaggaagggaaactcattgggatggatgctgtcagtgcgccaggcagagaggttcacaagttcagtaccagcccacttaatgcaaccctgacgacacccttcggaatagagcactgggattttgtcaccttcactttgggggtgggaaagctgagggacggaggctgcatctggtccaagatccttcaggccacaaatggcgcggggtgg

SEQ ID NO: 34004 - DNA, 1458 bp, Homo sapiens
  misc_feature (4)..(5): n is a, c, g, or t
ggcnngagggcgcgctctgctcggctgcaggctcaggaagcggcgcggcggcagctgctgggccagagccccgcgccctgcgtccagccgccgggtgtgtgcgcccgcgtagcccagcgtcgcgcctcggcgcccccacgcgcccacgcagcggcgcggggacccgggcgggggcagagggagggcccggcccagggaggagaaggggccggtcctcccggcgcaggcagcagccgcggcagcccaggaggcggaggcagcggcaacggcagagacagcaacgtgcccgccgcagtcagcccggcctcgtcggacccgcaccggcccgcccgcccgcccgcaccgcgtcggggcgccctctccactgcgcgcggtacaaggaaatggtagaactagtgatctcacccagcctcactgtaaacagcgattgtctggataaactgaagtttaaccgtgctgacgctgctgtgtggactctgagtgacagacaaggcatcaccaaatcggcccccctgagagtgtcccagctcttctccagatcttgcccacgtgtcctcccccgccagccttccacagccatggcagcctacggccagacgcagtacagtgcggggatccagcaggctaccccctatacagcttacccacctccagcacaagcctatggaatcccttcctacagcatcaagacagaagacagcttgaaccattcccctggccagagtggattcctcagctatggctccagcttcagcacctcacccactggacagagcccatacacctaccagatgcacggcacaacagggttctatcaaggaggaaatggactgggcaacgcagccggtttcgggagtgtgcaccaggactatccttcctaccccggcttcccccagagccagtacccccagtattacggctcatcctacaaccctccctacgtcccggccagcagcatctgcccttcgcccctctccacgtccacctacgtcctccaggaggcatctcacaacgtccccaaccagagttccgagtcacttgctggtgaatacaacacacacaatggaccttccacaccagcgaaagagggagacacagacaggccgcaccgggcctccgacgggaagctccgaggccggtctaagaggagcagtgacccgtccccggcaggggacaatgagattgaggaaaagcaacttaaggatgtattcaagcaaaacaaggaagaaaaccaaggaagagagacttgggatccagaaaacagtggatccaacccagaaatacaatgaagggaagtctgcagcaagcctaaaaatgatccagtccacattggaggtttctatcactgaggatagatatctccaatacagagtgtgtggctgaatttgacattttaatgaaggtacattgttgcaaacaagaaaaaattaataaattctgacaaaaccaaaaaagtta

SEQ ID NO: 34005 - DNA, 1342 bp, Homo sapiens
gagagagttctggcgagggctgcgggaaggaaagggggcggcgtccttcacagggagggtgcagctgacctccctccccttgtgcagactggaaaagaatggcccagatcctctggactcctcagatgagcggattcagagagaagcttttgagagcgtgctggcggagacatttttcacaaaagagcccttgcggtgctggtgtccgtggcgtgcctgggaaggcccaccaacgctggccggcctccaagcacccgggcctctgctcatgtacagctcctgaactgccctgcctctgagttactgtggaaaatgagcttatatatgaagaagtcagcgagtggacaaagccaggcgcaatggatagcaaagatgtggaagtctcctcgattcaagttagaagaaaaccgcagcatggagtctgctctcagctgttggggaattaccgatgcctttgactaagtcaagactgacttttccagaatatcacccaagagatagagccgtccctgtccaagtttgtgcgctagcccttcatggaggtcagagaggaagaaacaaaggcagctgtggcctcggcggtcacagtgtcagaacgcacaagccccataaagaggtttcacgcaggccacccatcccttttcattctccagcagaacaggacagagagcgttctgttctgcggaaggtcttccactctacaaggcaatccctccagctgctttgctgtattgtgctgtctcctgtcacactatgaatgcagtgacctcagccagcaacagggagaacccccctgcctcccgaacaaaggacctcacgtgaaatcctgagctcagagcttacagatatgtgtgcgctttcactttacatcggccgtgacttccaaacaacttcaggaaactttaggatctctgaggtatactggagatgacagcagcgtagaatgttcatttggatttagaacagaaatgcttattttatatttggctgctcccaaactgtccccagacttcctctccagtggttaccctccactgccctggatgtcccacgtttacactccacactcacacctccaccttaacaaagtcctccactgggtcaaaccatacatcgcttcgtctctgtagtgatgacttcctgtcctctgctctgtggataaagaccccagataaagatgcctgtgttgctcaactcttgtaaatactcttgagacattttgaaagcagaaggaaaggagacagacggggaaaataaaagggatggtctgcttgtgcggaaacgttttgagaatgcccttccctaagagagaacagtaaaagtgagcaatacttcctgagct

SEQ ID NO: 34006 - DNA, 1257 bp, Homo sapiens
gagagagttctggcgagggctgcgggaaggaaagggggcggcgtccttcacagggagggtgcagctgacctccctccccttgtgcagactggaaaagaatggcccagatcctctggactcctcagatgagcggattcagagagaagcttttgagagcgtgctggcggagacatttttcacaaaagagcccttgcggtgctggtgtccgtggcgtgcctgggtggaaaatgagcttatatatgaagaagtcagcgagtggacaaagccaggcgcaatggatagcaaagatgtggaagtctcctcgattcaagttagaagaaaaccgcagcatggagtctgctctcagctgttggggaattaccgatgcctttgactaagtcaagactgacttttccagaatatcacccaagagatagagccgtccctgtccaagtttgtgcgctagcccttcatggaggtcagagaggaagaaacaaaggcagctgtggcctcggcggtcacagtgtcagaacgcacaagccccataaagaggtttcacgcaggccacccatcccttttcattctccagcagaacaggacagagagcgttctgttctgcggaaggtcttccactctacaaggcaatccctccagctgctttgctgtattgtgctgtctcctgtcacactatgaatgcagtgacctcagccagcaacagggagaacccccctgcctcccgaacaaaggacctcacgtgaaatcctgagctcagagcttacagatatgtgtgcgctttcactttacatcggccgtgacttccaaacaacttcaggaaactttaggatctctgaggtatactggagatgacagcagcgtagaatgttcatttggatttagaacagaaatgcttattttatatttggctgctcccaaactgtccccagacttcctctccagtggttaccctccactgccctggatgtcccacgtttacactccacactcacacctccaccttaacaaagtcctccactgggtcaaaccatacatcgcttcgtctctgtagtgatgacttcctgtcctctgctctgtggataaagaccccagataaagatgcctgtgttgctcaactcttgtaaatactcttgagacattttgaaagcagaaggaaaggagacagacggggaaaataaaagggatggtctgcttgtgcggaaacgttttgagaatgcccttccctaagagagaacagtaaaagtgagcaatacttcctgagct

SEQ ID NO: 34007 - DNA, 1395 bp, Homo sapiens
gagagggggaggcaggaagagaagcaaagatagcaattcttaaggcctgttatctattagttacccttgccttggcggcagacacagctgagtcctaacgcagacttttccatatcccctctcccgcctcaacagtgatctctcctcccacttcgagagttaattcagtgctgctttagctttacgcccccatgaaaacaggaaaacggtttgcagctttatcataaccttgcttatgtctgttgttgtatgtctcaaataccctgtcctcaggaaggcccaccaacgctggccggcctccaagcacccgggcctctgctcatgtacagctcctgaactgccctgcctctgagttactgtggaaaatgagcttatatatgaagaagtcagcgagtggacaaagccaggcgcaatggatagcaaagatgtggaagtctcctcgattcaagttagaagaaaaccgcagcatggagtctgctctcagctgttggggaattaccgatgcctttgactaagtcaagactgacttttccagaatatcacccaagagatagagccgtccctgtccaagtttgtgcgctagcccttcatggaggtcagagaggaagaaacaaaggcagctgtggcctcggcggtcacagtgtcagaacgcacaagccccataaagaggtttcacgcaggccacccatcccttttcattctccagcagaacaggacagagagcgttctgttctgcggaaggtcttccactctacaaggcaatccctccagctgctttgctgtattgtgctgtctcctgtcacactatgaatgcagtgacctcagccagcaacagggagaacccccctgcctcccgaacaaaggacctcacgtgaaatcctgagctcagagcttacagatatgtgtgcgctttcactttacatcggccgtgacttccaaacaacttcaggaaactttaggatctctgaggtatactggagatgacagcagcgtagaatgttcatttggatttagaacagaaatgcttattttatatttggctgctcccaaactgtccccagacttcctctccagtggttaccctccactgccctggatgtcccacgtttacactccacactcacacctccaccttaacaaagtcctccactgggtcaaaccatacatcgcttcgtctctgtagtgatgacttcctgtcctctgctctgtggataaagaccccagataaagatgcctgtgttgctcaactcttgtaaatactcttgagacattttgaaagcagaaggaaaggagacagacggggaaaataaaagggatggtctgcttgtgcggaaacgttttgagaatgcccttccctaagagagaacagtaaaagtgagcaatacttcctgagct

SEQ ID NO: 34008 - DNA, 1241 bp, Homo sapiens
gagagggggaggcaggaagagaagcaaagatagcaattcttaaggcctgttatctattagttacccttgccttggcggcagacacagctgagtcctaacgcagacttttccatatcccctctcccgcctcaacagtgatctctcctcccacttcgagagttaattcagtgctgctttagctttacgcccccatgaaaacaggaaaacggtttgcagctttatcataaccttgcttatgtctgttgttgtatgtctcaaataccctgtcctcaggaaggcccaccaacgctggccggcctccaagcacccgggcctctgctcatgtacagctcctgaactgccctgcctctgagttactgtggaaaatgagcttatatatgaagaagtcagcgagtggacaaagccaggcgcaatggatagcaaagatgtggaagtctcctcgattcaagttagaagaaaaccgcagcatggagtctgctctcagctgttggggaattaccgatgcctttgactaagtcaagactgacttttccagaatatcacccaagagatagagccgtccctgtccaagtttgtgcgctagcccttcatggaggtcagagaggaagaaacaaaggcagctgtggcctcggcggtcacagtgtcagaacgcacaagccccataaagaggtttcacgcaggccacccatcccttttcattctccagcagaacaggacagagagcgttctgttctgcggaaggtcttccactctacaaggcaatccctccagctgctttgctgtattgtgctgtctcctgtcacactatgaatgcagtgacctcagccagcaacagggagaacccccctgcctcccgaacaaaggacctcacgtgaaatcctgagctcagagcttacagatatgtgtgcgctttcactttacatcggccgtgacttccaaacaacttcaggaaactttaggatctctgaggtatactggagatgacaccgagtgcctgcgtcccagatgcaaatcagtaagaaccacccgagacagtgacagacaggtgacagcgagtgcctgcgtcccaggtgcaaatcagtaagaaccacccgagacagtgacagacaggtgacacggagtgcctgcgtcccaggtgcaaatcagtatagaacacccgagacagtgacagacaggtgacagcaagtgcctgcgtcccgggtgcaaatcagtaagaaccacccgagactgcctcgccaaat

SEQ ID NO: 34009 - DNA, 331 bp, Homo sapiens
gatcacttgttaaatacaaaattttaaaacataccacaatatttggcacttcattttctttattaaacaaggagactcagaaaatcatagtggcctgggcccatgtgaacctctgtgaaagcctcccacagggagagaggactgggatgccatggtcctaggtgggaatggggggagcagtgtaggcctcggtgcggacccaatgctggggccctaaggctctctcctcttttcttccaggtggaaaatgagcttatatatgaagaagtcagcgagtggacaaagccaggcgcaatggatagcaaagatgtggaagtctcctcgattcaag

SEQ ID NO: 34010 - DNA, 105 bp, Homo sapiens
gttttttgcaatttgatataaatggaatgataaaatccttttaatctgactcttttcacttaatatgatgtttttcagattcttccatattgttgcttgtatcag

SEQ ID NO: 34011 - DNA, 776 bp, Homo sapiens
atatttccgaggaggaaacttcatgcgcagggatctttcttagtggatttaatggctaaaaggtctgtctgaatccaggacgctggctttagccttcctcggcagctgccgtaaccccggtgtctaaacctgaagcatcccaggagcacccactccaggagttttctcggccgcggaactcattagttagagcgccctcttgtgttctcatgtggtaatcggtcactgaaggacttaaaatggtccttagccaacacacagtaaaacttttccctcttctgaccccaagaggtcagccacccatttcatgagcatatactggtcgccccatcagcgttctctgattggctaactgaacccactccccgacctagactcaagacaggcgaagtgacgcttaggtcaacattcactcactaaagcaacgactgtcgggcgattttgtctcccgctggttttggaatggtgtctggagacatttttggttgtcacagctgggtgggtgtgctcccggcatctggtgggtagaaaccaagcatgctcctaaacatcctacaggcacagaaccgtctcccacgaccaagcatgatcaagtcccaaatgccaataatggccaggttgagaaactctgcacagaagcatccagttatttgtctgtttgctcaacaagcttgtgctcatcatgctctgtgttcctgacgctgtgctgggtgttggcggtgggaagattacaagagtcacatggcagctgtcctcctggaaggtacaacccagta

SEQ ID NO: 34012 - DNA, 503 bp, Homo sapiens
agctgctctaggctgaggcaggagaatctcttgaacctgggaggcggaagttgcagtgaagtatgattgtgccactgcactcctacctgggctacagagtgagactctgtctccaaaaaaaaaaaaagaacaatgattccttgatacccagtccatatagtatgatcccacttgtctcaaaaatatcttttgaaagttaatttgttgtctctctcaagtgtctaatctagagcagtctcctcttcctctcacctccttttttatccttgcaattgaattgttggagtcaattgctcttaaaagaatgtacagcatttcggagttgtcttttgcttcctagaggtgtcttttaaccagttcttccactatattttttgtaaaaggaatcagctgtaaagatgtaaccagaggttcagcaaaccaccatggcacacgtatacctatgtaacaaacctgcacgttctgcacatgtacccctccagaacttaaagtgtaaaaaaaaa

SEQ ID NO: 34013 - DNA, 386 bp, Homo sapiens
gccctggtccgcgcctgccccgttgctttcctcaggctctaaggcccgcggtgtggagcgcggcgtctgttgagattgtctattttttcttgagtcagccgtctgaaaagaacacgaggtggacagggcagagcggtcaaggaaagccataggaggagggcacttatttgagcaaagaccggcgggacgtgggcgtcgaggacatcctgaggttcccaccaagtggacattggcttattctacaagcaacaggatgaggcccctggactcctcactagcaaaatagtgcagtgacagcaacacccccccccacacacacacacacaaagatgtccacatcttaattcctggaacctgtgaatgtgtgaccttacctggtgtcttag

SEQ ID NO: 34014 - DNA, 1561 bp, Homo sapiens
ggaacgccgtgagagtttgcattccgaggatttggtctgagaacctcaccagcgaaatagagaactgcccccgggagagccggcccacgtgccgcccaccggcgccttgacggcagggagaggtcgagcttccagggagcgggcgcccggcgcggggctcccagcctgtctgtacctggtcgagacaccccgtgccagaggcggaacatgtatgaaatgccaggtgcccagaggacccaggcagtccgtcattcacataccaacccacgtgcaggcttcaattcaaccttgaagccatttgggcctgggcttttttgatgacttatttgattcatagttttttggttactaattgagtctcttcacttgttataggtctgttgagattgtctattttttcttgagtcagccgtctgaaaagaacacgaggtggacagggcagagcggtcaaggaaagccataggaggagggcacttatttgagcaaagaccggcgggacgtgggcgtcgagggtaaggatatctgcagaagtactgtcttgagcaaggagcacggcagacagagcctctgagacacgagagcctggagtgtaagaaacacagtagaggccactaagtcgagaacgcaggagctggaaggactggtaggaaatgggaggtggggacatggagggatgcagacaggtcctgcacagtcagaactgtggccccttctctgcaggaaatgggcagccttcggaagactgagcacacggaaggatatgactaaccctttaaaagggtcattctgactcctgggtgaagaacagactaggaagggctgaggaggaggcaggaggccatctactgttatatgggatgtggagtgtgacccggaaaggtcaagtgtgactctaagggctttttgtgtactgatcttttatcctgcaaccttgctaaacccatttattagttcttcttgtcttttagtggcatttattagttgttctagtgttttagtggattccttgggattttatacaaaagcgtgtcatttgtgaatagagatcagtttatctcttcctttctaatctggatgccttttatttcttctccttgcctagctgccctatctagaagctccagtacaatattgactagaagcagcaagagtggacatccttgtcttgctcctgatttcagggaggaggcatccagtctttcacctttgggcattaaaagcattatctgaatctcaaagaaaagtccaagacctgatggtttcctggtgaattctaccaaacgtgtaaagaagaactaatacgagcccttcataaacatttccaaaaaactgaagagaagggaacacttcttaacgcattctatgaggccagcattaccctggtaccaaagccagacatacacatgacaagaaaagaaaactacagaccaatattccttatgaacactgatgcaaaaaacctcaacaaagtactggcaaacttcagcggcatattgaaaggattatacactatgaccaaggagatttattcctggaattcaaggatggcttagtatacaaa

SEQ ID NO: 34015 - DNA, 1612 bp, Homo sapiens
ggaacgccgtgagagtttgcattccgaggatttggtctgagaacctcaccagcgaaatagagaactgcccccgggagagccggcccacgtgccgcccaccggcgccttgacggcagggagaggtcgagcttccagggagcgggcgcccggcgcggggctcccagcctgtctgtacctggtcgagacaccccgtgccagaggcggaacatgtatgaaatgccaggtgcccagaggacccaggcagtccgtcattcacataccaacccacgtgcaggcttcaattcaaccttgaagccatttgggcctgggcttttttgatgacttatttgattcatagttttttggttactaattgagtctcttcacttgttataggtctgttgagattgtctattttttcttgagtcagccgtctgaaaagaacacgaggtggacagggcagagcggtcaaggaaagccataggaggagggcacttatttgagcaaagaccggcgggacgtgggcgtcgagggtaaggatatctgcagaagtactgtcttgagcaaggagcacggcagacagagcctctgagacacgagagcctggagtgtaagaaacacagtagaggccactaagtcgagaacgcaggagctggaaggactggtaggaaatgggaggtggggacatggagggatgcagacaggtcctgcacagtcagaactgtggccccttctctgcaggaaatgggcagccttcggaagactgagcacacggaaggatatgactaaccctttaaaagggtcattctgactcctgggtgaagaacagactaggaagggctgaggaggaggcaggaggccatctactgttatatgggatgtggagtgtgacccggaaaggtcaagtgtgactctaagggctttttgtgtactgatcttttatcctgcaaccttgctaaacccatttattagttcttcttgtcttttagtggcatttattagttgttctagtgttttagtggattccttgggattttatacaaaagcgtgtcatttgtgaatagagatcagtttatctcttcctttctaatctggatgccttttatttcttctccttgcctagctgccctatctagaagctccagtacaatattgactagaagcagcaagagtggacatccttgtcttgctcctgatttcagggaggaggcatccagtctttcacctttgggtatgatgatagctgtgggtgcttaaaaaataggttttatcaggcgtgagctaccacgcccagccgaggaagtatcttctatttctagtttgttgagtgtgtttatcatgaaaacgtgtcagatttggttaaatgatttttccacatccattgagatgatgatcatgggtttttttccttgttctagtaatgtggtgtgttacattaattgactttcagatattgaaaagacacttatcccctgcgttcagataaattccagttggtcatggagtatctgtcttcctggattcagtttaatacaattttgttgagtgattttttttatccatattcatcatagatactggtctgaagttttcttgtggtgtctgtgtctggttttggtatcggtatcagtgt

SEQ ID NO: 34016 - DNA, 1483 bp, Homo sapiens
ggaacgccgtgagagtttgcattccgaggatttggtctgagaacctcaccagcgaaatagagaactgcccccgggagagccggcccacgtgccgcccaccggcgccttgacggcagggagaggtcgagcttccagggagcgggcgcccggcgcggggctcccagcctgtctgtacctggtcgagacaccccgtgccagaggcggaacatgtatgaaatgccaggtgcccagaggacccaggcagtccgtcattcacataccaacccacgtgcaggcttcaattcaaccttgaagccatttgggcctgggcttttttgatgacttatttgattcatagttttttggttactaattgagtctcttcacttgttataggtctgttgagattgtctattttttcttgagtcagccgtctgaaaagaacacgaggtggacagggcagagcggtcaaggaaagccataggaggagggcacttatttgagcaaagaccggcgggacgtgggcgtcgagggtaaggatatctgcagaagtactgtcttgagcaaggagcacggcagacagagcctctgagacacgagagcctggagtgtaagaaacacagtagaggccactaagtcgagaacgcaggagctggaaggactggtaggaaatgggaggtggggacatggagggatgcagacaggtcctgcacagtcagaactgtggccccttctctgcaggaaatgggcagccttcggaagactgagcacacggaaggatatgactaaccctttaaaagggtcattctgactcctgggtgaagaacagactaggaagggctgaggaggaggcaggaggccatctactgttatatgggatgtggagtgtgacccggaaaggtcaagtgtgactctaagggctttttgtgtactgatcttttatcctgcaaccttgctaaacccatttattagttcttcttgtcttttagtggcatttattagttgttctagtgttttagtggattccttgggattttatacaaaagcgtgtcatttgtgaatagagatcagtttatctcttcctttctaatctggatgccttttatttcttctccttgcctagctgccctatctagaagctccagtacaatattgactagaagcagcaagagtggacatccttgtcttgctcctgatttcagggaggaggcatccagtctttcacctttgggtatgatgatagctgtgggtgcttaaaaaataggttttatcaggcgtgagctaccacgcccagccgaggaagtatcttctatttctagtttgttgagtgtgtttatcatgaaaacgtgtcagatttggttaaatgatttttccacatccattgagatgatgatcatgggtttttttccttgttctagtaatgtggtgtgttacattaattgactttcagatattgaaaagacacttatcccctgcgttcagataaattccagttggtcatgga

SEQ ID NO: 34017 - DNA, 1625 bp, Homo sapiens
ggaacgccgtgagagtttgcattccgaggatttggtctgagaacctcaccagcgaaatagagaactgcccccgggagagccggcccacgtgccgcccaccggcgccttgacggcagggagaggtcgagcttccagggagcgggcgcccggcgcggggctcccagcctgtctgtacctggtcgagacaccccgtgccagaggcggaacatgtatgaaatgccaggtgcccagaggacccaggcagtccgtcattcacataccaacccacgtgcaggcttcaattcaaccttgaagccatttgggcctgggcttttttgatgacttatttgattcatagttttttggttactaattgagtctcttcacttgttataggtctgttgagattgtctattttttcttgagtcagccgtctgaaaagaacacgaggtggacagggcagagcggtcaaggaaagccataggaggagggcacttatttgagcaaagaccggcgggacgtgggcgtcgagggtaaggatatctgcagaagtactgtcttgagcaaggagcacggcagacagagcctctgagacacgagagcctggagtgtaagaaacacagtagaggccactaagtcgagaacgcaggagctggaaggactggtaggaaatgggaggtggggacatggagggatgcagacaggtcctgcacagtcagaactgtggccccttctctgcaggaaatgggcagccttcggaagactgagcacacggaaggatatgactaaccctttaaaagggtcattctgactcctgggtgaagaacagactaggaagggctgaggaggaggcaggaggccatctactgttatatgggatgtggagtgtgacccggaaaggtcaagtgtgactctaagggctttttgtgtactgatcttttatcctgcaaccttgctaaacccatttattagttcttcttgtcttttagtggcatttattagttgttctagtgttttagtggattccttgggattttatacaaaagcgtgtcatttgtgaatagagatcagtttatctcttcctttctaatctggatgccttttatttcttctccttgcctagctgccctatctagaagctccagtacaatattgactagaagcagcaagagtggacatccttgtcttgctcctgatttcagggaggaggcatccagtctttcacctttgggtatgatgatagctgtgggtgcttaaaaaataggttttatcaggctgggcacagtggctcacgcctgtaatcccaaccctttgggaggtcgaggcgggcggatcacgtggggtccagagctggtcttgaactcctgacctccagtaatccacccccctgggcctcccaaaatgctgggattataggcgtgagctaccacgcccagccgaggaagtatcttctatttctagtttgttgagtgtgtttatcatgaaaacgtgtcagatttggttaaatgatttttccacatccattgagatgatgatcatgggtttttttccttgttctagtaatgtggtgtgttacattaattgactttcagatattgaaaagacacttatcccctgcgttcagataaattccagttggtcatgga

SEQ ID NO: 34018 - DNA, 1820 bp, Homo sapiens
ggaacgccgtgagagtttgcattccgaggatttggtctgagaacctcaccagcgaaatagagaactgcccccgggagagccggcccacgtgccgcccaccggcgccttgacggcagggagaggtcgagcttccagggagcgggcgcccggcgcggggctcccagcctgtctgtacctggtcgagacaccccgtgccagaggcggaacatgtatgaaatgccaggtgcccagaggacccaggcagtccgtcattcacataccaacccacgtgcaggcttcaattcaaccttgaagccatttgggcctgggcttttttgatgacttatttgattcatagttttttggttactaattgagtctcttcacttgttataggtctgttgagattgtctattttttcttgagtcagccgtctgaaaagaacacgaggtggacagggcagagcggtcaaggaaagccataggaggagggcacttatttgagcaaagaccggcgggacgtgggcgtcgagggtaaggatatctgcagaagtactgtcttgagcaaggagcacggcagacagagcctctgagacacgagagcctggagtgtaagaaacacagtagaggccactaagtcgagaacgcaggagctggaaggactggtaggaaatgggaggtggggacatggagggatgcagacaggtcctgcacagtcagaactgtggccccttctctgcaggaaatgggcagccttcggaagactgagcacacggaaggatatgactaaccctttaaaagggtcattctgactcctgggtgaagaacagactaggaagggctgaggaggaggcaggaggccatctactgttatatgggatgtggagtgtgacccggaaaggtcaagtgtgactctaagggctttttgtgtactgatcttttatcctgcaaccttgctaaacccatttattagttcttcttgtcttttagtggcatttattagttgttctagtgttttagtggattccttgggattttatacaaaagcgtgtcatttgtgaatagagatcagtttatctcttcctttctaatctggatgccttttatttcttctccttgcctagctgccctatctagaagctccagtacaatattgactagaagcagcaagagtggacatccttgtcttgctcctgatttcagggaggaggcatccagtctttcacctttgggcaaccaactgctgcagcagcatcagcagtgtccgggactccacctcctacagaagtcgtggatgtctcacatcacatcaccattgctgcagatgccacagaataccattctgctcatcattgctccaaaattaccataactcctggaccagctgcttgattacattatttaatgcattcataaagaggcacatgcagtactgtaccaccgtttaaaatttgtgatgaaagtactttaatttcatttttaattttgtaggcattaaaagcattatctgaatctcaaagaaaagtccaagacctgatggtttcctggtgaattctaccaaacgtgtaaagaagaactaatacgagcccttcataaacatttccaaaaaactgaagagaagggaacacttcttaacgcattctatgaggccagcattaccctggtaccaaagccagacatacacatgacaagaaaagaaaactacagaccaatattccttatgaacactgatgcaaaaaacctcaacaaagtactggcaaacttcagcggcatattgaaaggattatacactatgaccaaggagatttattcctggaattcaaggatggcttagtatacaaa

SEQ ID NO: 34019 - DNA, 1039 bp, Homo sapiens
ggaacgccgtgagagtttgcattccgaggatttggtctgagaacctcaccagcgaaatagagaactgcccccgggagagccggcccacgtgccgcccaccggcgccttgacggcagggagaggtcgagcttccagggagcgggcgcccggcgcggggctcccagcctgtctgtacctggtcgagacaccccgtgccagaggcggaacatgtatgaaatgccaggtgcccagaggacccaggcagtccgtcattcacataccaacccacgtgcaggcttcaattcaaccttgaagccatttgggcctgggcttttttgatgacttatttgattcatagttttttggttactaattgagtctcttcacttgttataggtctgttgagattgtctattttttcttgagtcagccgtctgaaaagaacacgaggtggacagggcagagcggtcaaggaaagccataggaggagggcacttatttgagcaaagaccggcgggacgtgggcgtcgagggtaaggatatctgcagaagtactgtcttgagcaaggagcacggcagacagagcctctgagacacgagagcctggagtgtaagaaacacagtagaggccactaagtcgagaacgcaggagctggaaggactggtaggaaatgggaggtggggacatggagggatgcagacaggtcctgcacagtcagaactgtggccccttctctgcaggaaatgggcagccttcggaagactgagcacacggaaggatatgactaaccctttaaaagggtcattctgactcctgggtgaagaacagactaggaagggctgaggaggaggcaggaggccatctactgttatatgggatgtggagtgtgacccggaaaggtcaagtgtgactcaggtggtgtgactcaggtggtgtgactcaggtggtgtgactcaggtggtgtgactcaggtggtgtgactcaggtggtgtgactcaggtggtgtgactcaggtggtgtgactcaggtggtgtgactcaggtggtggggtgcccagct

SEQ ID NO: 34020 - DNA, 654 bp, Homo sapiens
ggcctttaaccaaaatttaacattttcctgaattatgaatctaggcaaccaactgctgcagcagcatcagcagtgtccgggactccacctcctacagaagtcgtggatgtctcacatcacatcaccattgctgcagatgccacagaataccattctgctcatcattgctccaaaattaccataactcctggaccagctgcttgattacattatttaatgcattcataaagaggcacatgcagtactgtaccaccgtttaaaatttgtgatgaaagtactttaatttcatttttaattttgtaggcattaaaagcattatctgaatctcaaagaaaagtccaagacctgatggtttcctggtgaattctaccaaacgtgtaaagaagaactaatacgagcccttcataaacatttccaaaaaactgaagagaagggaacacttcttaacgcattctatgaggccagcattaccctggtaccaaagccagacatacacatgacaagaaaagaaaactacagaccaatattccttatgaacactgatgcaaaaaacctcaacaaagtactggcaaacttcagcggcatattgaaaggattatacactatgaccaaggagatttattcctggaattcaaggatggcttagtatacaaa

SEQ ID NO: 34021 - DNA, 739 bp, Homo sapiens
ccctttaaaagggtcattctgactcctgggtgaagaacagactaggaagggctgaggaggaggcaggaggccatctactgttatatgggatgtggagtgtgacccggaaaggtcaagtgtgactctaagggctttttgtgtactgatcttttatcctgcaaccttgctaaacccatttattagttcttcttgtcttttagtggcatttattagttgttctagtgttttagtggattccttgggattttatacaaaagcgtgtcatttgtgaatagagatcagtttatctcttcctttctaatctggatgccttttatttcttctccttgcctagctgccctatctagaagctccagtacaatattgactagaagcagcaagagtggacatccttgtcttgctcctgatttcagggaggaggcatccagtctttcacctttgggtatgatgatagctgtgggtgcttaaaaaataggttttatcaggctgggcacagtggctcacgcctgtaatcccaaccctttgggaggtcgaggcgggcggatcacgtggggtccagagtttgagaccagcctggccaacatggagaaatcccatctctactaaaaatacaaaaagttagctgaggttggtggccggtgcctgtaatcccagctaaaaaagggaaactgtctaaaaatcattaaaaaaaagggtacttcctcaacctgataaaacctattttttgtttgtttgagat

SEQ ID NO: 34022 - DNA, 350 bp, Homo sapiens
aggtccaaaatgaccaagggagcaggcagtgcagtgaggagaggactcaaactcagatgggcaaggcaccagtgcccacatctgggcccacctggccctcagtggctccagctctttaagcaacagcatgtggctgagatttgagacaggcagatgatacagtgtgggacctctcgtcactgcccaacgatgttacctcaggagaagcactgactctctgggctttggttctctacctcctacccatggccaagaggcatagcgggttcagtgggtatttggaaaacagcacaagctaagcttgccccactttgcccagtttccagtcaggaatgaccaagatgcgaacc

SEQ ID NO: 34023 - DNA, 605 bp, Homo sapiens
gctcgaccttgggaaaaaagggaccggaagcatgttttatttacctcatagaaaacacatctggagccgggcacagtagctcgcacctgtaatcccaaggagtgtctgcccatcttgctcgggctgactcaccgtcatccttcagaccacattgataccatgtccttctggaaagcattccaatccccccaacccccacccccaggtgggttcatggcccattccaagtgctcccgtaccaggcagtgatgattgcattcttttgccattgccctttcaccagactcagagtgccagtgggcagtgagcacacagcttttgcaccattgcattttcagcatgtagcatgtggcaggctctgggggaggggaggatcagagtgagtgagaagcagagtatcatggtcaaggtagaaacccccagggccagtcagacctaggctcagataacagcactgtgttatcgtctaactttggacaaatttaacctttctgtgcctcagctgctgcttctggatattgaggatgacagtagtatttacatgaggggttgtgatgataagttcacatgtgtaaagctctgagcgcccacaacgtaatgttgtc

SEQ ID NO: 34024 - DNA, 447 bp, Homo sapiens
gaatgaataatcaagctttggcatttttattcaatgaaatatgcagcaataaaaagaaccaactactgacatgcagcaatatgaataaatctcgaaaacattatattgagcaaaggaagctagtcataaaattgtacataatttactacagtattttagttttatgaagttctaaaacagacaaagccaatcaatgatggagaaaaatttgaacagtagttttcttggggtgtggtcaggattggtgattgagaagggacacaaaagattttgctagggtgatagtaatgttgtataatgatgggctttgagttataaaagtatatacatttttcagaactaagtaaaatgtgtgtgtaaattaattgtgtattaattgtacatcaaaaggaaaaaattgaacattgaactctaattaatggcagagcatgtggaaagatctaggag

SEQ ID NO: 34025 - DNA, 674 bp, Homo sapiens
aatgggctaagtgaatacttataacaactaaaatactaaatcttattttgcttgactttcatcaatttttttaagacatagttgacaacatctaattactcatttccttctaacttgcacatcttgtgaatatgataggaaggcaaactaagagtctgagaaaatagaaattgtattaatagctcttagaaattgatcttcattcattcatttaaaaaacattagtaagtgtctactatatgctcagcactgtgctggaccctgggacacaaagatgaatgacaagtctctgctttcaagggactcaatattcagtgagtcatatagaccagcaaacatgctcgtaattataatttgttgtcacagttgccagggtagaaagtgtataggggctctgacctggaagactcgggcatgctgacatgtgggggagaccccttaagagagctatgaaagtgtggctggctaaggctagcttgaggaccatgaaagtgaccagggaatctttagattacagtaaaaagtaaagatggggtgatttaggcagatggtatgaaccttcaagaaataagtgcttttacacaagtgcagagggttagtgatttggaagttacgttgaaaatcccgtgaataccaaccctaccctgaccacaataagttaacagaaaaaaaaa

SEQ ID NO: 34026 - DNA, 498 bp, Homo sapiens
tgggtcttgcattgtggattcaacaaaccttcagttgaaaatatctgggaaaagaagttgatgtttgcatctgtactgaacttgtacaggctttttttcttgtcattatgccctaaaaaatagaatataacaactatgtacatagtatttacatggttattaggtgttataagtaatctagagagggtttaaagaatatgggaggatttccatagattatatgcaaataccgtgttcattttatataagggacttgagcatctgtgtatgttggtggggaggggtcctggagggacactgagggatgactatgtgaaagtggtttgcgaatatgctcaagtctctggatgaattgtatgacagtgaaggggtatgtgattagactgttgtggctttgaggttgatgtgtatgttttaaaggattatgattgagttggagatcatgtgagatttggtgtgtttaaatgtgacatgaattaaaatccgaatgaaagattg

SEQ ID NO: 34027 - DNA, 350 bp, Homo sapiens
acaaagagcatccaggaatattttactggatactgtgagaattgaaggagactttcaagataaatgaaattcaagaggccaacatggggaggaatgcattccaggtaggggaactggctacttgtgagttctttgagaatcccaaaattactatctttgaagttttccaagtctttcacattttgtacttttccacaaagttaacagttgccaaataccaaataattttatattttactatataatgtgggagattaatgttgttcaactgtaggagaggttctttttaattctgggttatataagagtaataataagtacttacatagttcctactatgttccaggcac

SEQ ID NO: 34028 - DNA, 310 bp, Homo sapiens
tttttttacaaatggtagcagttctgttcggcctactgccactggactgccatgtatgtaagtcccctcgataaactctgtgttttggttgccggctctgggtcccttctttggcctctcaaacatggtgccatccctattgaagtcaataggttctggcatgacactcattaacatggataactctaatgatacactatctttggtcaacattcacagaaaaatttaaatcttacactaattcaactattacattctctacttctgggttgctaagttttgttggataaaattatgctttctcccactg

SEQ ID NO: 34029 - DNA, 580 bp, Homo sapiens
ggctgatagatggtggagctgggcagttggcactaccattcagtctgccttataccaataacgaagttgtttttgcaactgaaaactgacctgagcatgtatgattgggtttactcactaaaaagggaggtctaggagataaaggggacagttagacctttggagtaccaggatcaccttgagatgacaaagccaacctggctcatgataattcatttcagcacattattgacgcaaactagagagcagagaggcaggcaaaccttgctaaccaaacaaatatgctgccacccccaggacatcataagtcacctggggacaggatgtgctcctgaatcccttcagagactggatgtcctcaaaacagcccagttagaaggattgatgggtcgagctagtcacacaaatgaaaatatccatgtggacctcaaccggctgctgttgcttcctaagtcccttagtaattcataaacccaaatccaatgaatgctaaaatgacttgcagctgaagtctcgatcacactgtgctgaaacaacttggatgcataagtaaataaatcctctttcaaagctcaaaaaa

SEQ ID NO: 34030 - DNA, 1158 bp, Homo sapiens
ctcctgacctcagatgatccacccgcctcagcctcccaaagtgctgggattacaggcgtgagccaccgcgcctggcctgtttattctcttaagagagaaaatgaggggattaatggactgtagttctggacaaggtggaaaactcttaaagtggaagtattggggcgaatgctctgacaggctaggatggtgcagtcagtcccttcacccagaaatcagtagaatgttagcagttcagactcaaaccttgtgaaaaacaggtggtggaaaggaaatccctcacagcaactggcaccataatcaagacaatgtttgcagaataaatggagttacctgctttcagccccaggtcatagctattgtctgccctgctgatatgtgataataatttgtgatcatgttgtcttaaaatggggtcactcatctccagtagaattaagtccacagtgaagttgtccccccatccccaaagagataaacatatatgaatgaactcacgtgataacaactactgctgcctgggatcatgagagacctgaactgaactgataggaagtgaaaggtggctgagataatgagaatagacccatctgcagaggatcataaaaccagcaaagacaagatcttgtctaagatgccttcacaaactttgtccatgagaactcttaaggatttcaccagacctgttggctgctgctgtgatctctgcccaagaggagcctctgaccaacatccaaagggcttctggacccactggactcctctggaggtaccttagtctcccgatccatggctgtgtttttttactccctttatcgctgcctgtgtgtagaatgataattgcacaattgatagtgtgaagacctcttgataaatggtaaatctgagcatatgtatttggctgacatgtcattgtgaaacctcacagcttcagtcagtgtcaacgcagctagggagcatgtacctaatgcacatatcactgggcatagtctacaggcacctaataactcaggtaccttaacagtcactaatgagtgtctctccaaggactaaacaatggaagactgtagaagatgctattcattaagatatctcaagaatatggaagactattattcgcttctcatgggacaggactttatagggcacctgaaaaaa

SEQ ID NO: 34031 - DNA, 463 bp, Homo sapiens
tcaccttcagctgtacttaagatgttttcctggaaaaattcattctgctttctgaccaggatttccagaaactctgacccttctaagaggtctgggtggaattgtgatggtgattctgctagtagacagtgtaacttctgcgtctacaaaaagaggataggccgtcactgctcacatggctttgcgtgaaagcccaatggtactgtctctatggcagagatgaggaaggaacaccagcgtcctccaactttcctgttcttcctttgggttaatggccactgtaaggaaacagttttctgccacgtgtggggtgatttgaatgtaaaatgcccaactctcatagcaggctgaacagaaacattttttatactcattgttaatttgttctaatctaaattacttttagactattaaatattattctattttaaagttaagggactaatgcctctgataacctgat

SEQ ID NO: 34032 - DNA, 197 bp, Homo sapiens
cctacaggaggtcgttgcatccttaaccctcttcctggctgggaggcaaccacagcctgtgctggtacctgacatcattcctccagcctgtcagtccactcagcttctcctaaggggatatgtgttttctgtcctgggtacggatctagggttggaagcctgaataaactgctctgccttgagtttgtggactcaag

SEQ ID NO: 34033 - DNA, 311 bp, Homo sapiens
gaggaagcccccctggggatttggtttggtcttgtgatcaggtggtctatggggctatccctacaaagaagaatccagaaataggggcacattgaggaatgatactgagcccaaagagcattcaatcattgttttatttgccttattttcacaccattggtgagggagggattaccaccctggggttatgaagatggttgaacaccccacacatagcaccggagatatgagatcaacagtttcttagccatagagattcacagcccagagcaggaggacgctgcacaccatgcaggatgacatgggggatg

SEQ ID NO: 34034 - DNA, 469 bp, Homo sapiens
gatacaaacttcaacatgtgtaggatatttgtgctgaaaattacaaaactgatgaaacaaatcagaggacccaaatgttgccacaaaccatattgacatactggaatattcaacacggtaaatgtgtcagttctccctgaattatcgtagcttttatgcagttcctatataaaatcccagcaaagatttttggtagatacataaaaaggttattgaaaaacctgtatggaaaggcataggccccagaataactaaaacgatctagtaaaagaataaagcagttggaatcactctactgatattaaagctttcccttatagtgatagtaatcaagatacacagatcaatgcggtggaacagagaactaaaaaaatacataaatatgccaaattaatttttgacaaaggtgaaaaagcaattcactgatagattattcttctcaacaaatggtgttggagcagaaattgga

SEQ ID NO: 34035 - DNA, 1098 bp, Homo sapiens
gtgtgtgtgtgtgtgtgtgtgtgtgtgtgtgtgtgcctgcgcgtgctaagaaactgcatgttaagattccacctactgaatcatgagcggaggaagtcgtgggacactggctggtggagaagccatctagcatattattcaagatgacaccagctccaagtctggaatgagtctgtgggaaaccaaggtacttcttggacattcacctataactcacgtgtttcgtggactggtcacagtggttcggataaattgaacagaactttatgaacacctcccagcaccaggtgttgttatagaaactaagaacagagcaatgagaaggacccaactcctgctctcaaatggatgcagtggaaaataagcagactttgaaccattggttagtcagaagagacttgggagactgaaaacttgtttcaacttgggccagaacaaaaaattaggaagcaacacttgctgccaacatgatttacaagtgccagcaccttcacctctgttacttccttctcactacacacacacacacacacacacacatatcctatagcttttacagaactttaaccatgagataaatacaaattcactggcttgcaaacaaaaaacctattggatccaaactgtgatttttttttatcataatagaaaaataacagcagatttaaagcaggcagaaaataaaatagagaaaaaggggaacttaggaactctatagtttgcaggtctactttagggctctttttctttaacgtaaatgtgcacgaagacgatattacttccattttacattaactctggcaagtagaggtgccataaaacctacagagtgctcgcaagagggtcattcttcttgttttctcctcattcttaggttatttgtttcacactttttttttcttaagagaaggaactgagctgtagcctagggtttttgtgtggtggattgatgtgtgctgcttgtagacaggactccacagtgtgtcaccagtgagttgtttccgccctgttatgtatctcagtttctctctctagaggtctatgacctctgagagggctccaaacaccaggtgatcagcccttatatgcatttcctag

SEQ ID NO: 34036 - DNA, 2857 bp, Homo sapiens
gtgtgtgtgtgtgtgtgtgtgtgtgtgtgtgtgtgcctgcgcgtgctaagaaactgcatgttaagattccacctactgaatcatgagcggaggaagtcgtgggacactggctggtggagaagccatctagcatattattcaagatgacaccagctccaagtctggaatgagtctgtgggaaaccaaggtacttcttggacattcacctataactcacgtgtttcgtggactggtcacagtggttcggataaattgaacagaactttatgaacacctcccagcaccaggtgttgttatagaaactaagaacagagcaatgagaaggacccaactcctgctctcaaatggatgcagtggaaaataagcagactttgaaccattggttagtcagaagagacttgggagactgaaaacttgtttcaacttgggccagaacaaaaaattaggaagcaacacttgctgccaacatgatttacaagtgccagcaccttcacctctgttacttccttctcactacacactgaaagcagttgctcttgttttacatggacaggctcagagaagttaagcaacttgtccaaggtcacacagtagtggaattgagattgaatcagttccaactgacttgcaatcttgtgcttttcagacgatcccactaattgtccatatctgttccaaagccaaatcaagaggaacaagagcaaaatctgtcctctcatattattcatggtcctgcgtggatcataaatggcatgctgactgtctgatggagacttacttttcccttccccctggacacctgccatggcaatgacagaggctgtattttactgaagtggagggaagaggtgaatgcaaatgcctagggcctaagtatacaggaaggtgtagggagaggtaagcagtgtgtatgtggaggagatagcagacgtaagcagagagaaatcagagagcttagttcttcctctggggcgcactttgtggttaattaggacatgcaaatgagctagaagctcatttaatatcctccctgacatgtagccccaccccaccctgccccacttccctggcaggtacaagggccacctgattggcccaggtatctgtggaaggttccacctgcttctttgtggcccagggaacagaaaagagtccctgctgggcatggctagtggggccggcctggtctccctcctccctttctcttcccaacctttcagacttgggacctctcttttccctctccctcagacacttcccttgtgccccgcccctcagggtgatctctgaacccaaacttgccccaaagaaggttgctcttgtcctctccacatccccatctcctccctagggccttgttggggagaggctcctccatctttcccaagtcacaccatcgtttcctacgtggtctggacaagagcaagagcacaccttgtccccaccttctccagagcagccagaacccacctcaggtgccttccccatccggtgcagttaaggcacttctgccagcaccatggtatgagcactagacttggagttaagatttgagagccccctctgtcactgtggaagcttgagcatgttgcttgatctctctgaaccttgtgtttctcatctgtgaaaggtgataatgtggggctgctgtgagatttaaaggacataatgcacctacggtccaagcactgcctggaatacagcagaagctcagcagatactggacaacccatccccttagtagaggcactaaccatgtgacccaaggcaaaagtgcttaagaaaaagtgctttctctgagcgttggtctcttcttctgtcgaaacatttatattgatttaatatctcacaggattgtagcaagggtcagagaagacaataggtgacatgtttttgtacactgtatactagccacccagatgggctgttatttgctaaatggcaaatttacactgttccccaaaggatgacatgcactggggaggcggggggtgtggaggtggagaaaggctgagcttggagaaaaggtgcttgaggaccccactgcctaaggacctgctctaggaaacattcccactccctacaccctagctgcccctcacagtcaacccttaaggacctcaaattcttggcaaggggtaaagagttgaaagtgccaagtcctagtggttttgagaagcctctggtctgctctttctgctctgtaaagtcttagttgccagagtcccctatagcccccacatcgctcccttcctcctgccctccggccaccctggaaactaatggcctaaaggtgctgtggctgtcctcctaaaatccattccctcctgatggggtggagggaatctgtgaagcccaccttcaggagaggtctcggggctcgggctggtgctgccagagaaagggtgactgaaccagaaaggcctaggggaaagcagctcaaactgcagccatccccttagtacgattactaggatgtcccttgccttccttttgcctcctccacccaacccctaaaataaacagtatgatgaaaaaaacaaaaaacaaaaaacaaacaaaaaatgtgtggggagcccgcatgaggccacctggaagcaaaaggtttataagaaacaccatcggtgggggggacgagggcgcccccagaggagggtgcaggcagcacacggggcaacacacaggcgtccccacagagaagacccagggggcaggaaacaagggtggtggagttctccacccataaaaaaaacgcgccggggagacacaccaggcggtctgggacacatcgcagagggagtccggaggcaatcggacctataacacgggagcccacgccaggcgaattaattaccga

SEQ ID NO: 34037 - DNA, 2009 bp, Homo sapiens
ttttaaataaaagtcagtttgtacaagttccctcacttctgtatggcatcatgtacttgagctgcagggaatcatgcatttcatacagttatctgcataagggtgtgtgagagagagagagagagagtgtgtgtgtgtgtgtgtgtgagagggtgtgagtgtgtgagagagtgtgtgtgtgtgtgaatgtgtgtgtggacacatacattttcaaagggagactggtaatgactgtgaatatgccctctgctcatgcatccccagtttcaggaagcaggacctgggtgaacacacttgcagagagcctcactggggttctttcctggctgctgtcttgtctgctgatggaaaggtgtctggcttcgggccctgaccttgatgagagctcttggcacatgctggaggcctggaatgtcatcccacagttccactgtcatcagttctcagccaaccccactgttgccttttcagccaatttcatggtgtttattctggtgtcagtctcctcaccggagcgtgggcactcaagggcatcgagcgagtctgtcttgtttgctgctgcagccccagcacagagtccgatgccttgctctgcccctgctcttggaaggcctggctgaggcagtttccctgtctcttcccatttcaagggcacccactcatcaggttcctcgaggaagaaacttcacgcatctcaggcctgccttccctccatctgtccccaaacctcccattccttgacccctgtgcctaagtactcatcacttccacttagaacccacggctgcacatcagcaaactgagtacatgcttttgttgatccaaatgtgctgacagtgcagtggcactgcttactgaagtctgctgtctgcaggctgtcacacaggattgtctgtaaatttatcagaacacttccaggaaggcattactgtccccattctacagacaagaaaactggtgcttggagaggtagggaacttgcccaggatcatgcagtgagcagagtctttctggccccagagctgattctgtctcagcttctgaaagcagctcacatagccaggcacatgctgtggcagggttctccctgccctactgttttactgcttctcaggaggccctgtggggcgggtgtctacaacgtgtacatttgtaggagtgtcccaggaggagcattttgttccacttttgctctactgctggctcgctctgtgtgtcttaggacacatctcttaacctctctgggctcaaccactgcacagtgaaggctctggattgataatctgtgaatgctgtgttctaattaaatagtgggtttcttggccttgggtattctgtgtctcatttttgtctttacttgttggctccacaaagcaaaacctattgtcagtaattcttactaactttatattgatgttgactgtgtagaccaattctagctacgttagccttttgttcatataaaatgaacaactgacacgtaattgttactgttttccatagtgcactgtgtcatcctgactccacgtatagagtgttcactgtgtgccagggctgctctcggataaaacctattctgttgaagtcctggctggccctaactttttaagtttaacaaggttgagaacacaagtgactttgattagcattgtcctaatctggtttatcagtagcaggggaatttataagcagttaccaaaatgcatccaaaataagatggcttaatggctaggcagaggggagagatgtgatgaagtcagtacagcagaatggtaacaagtgagcatctccctaatgggaatgggacattcctggtagagctgggagaaaaaatgaccaaagctactgggaaattctgcagagataattgtcccattactttttaattaattaaaactaattaattaactattttttttttgagacggtgtctcgctctgtcacccaggctgaaattgcaccaatgcactcatctgggcaatggaacaagactctgtttaaaaaaaaaa

SEQ ID NO: 34038 - DNA, 1954 bp, Homo sapiens
ttttaaataaaagtcagtttgtacaagttccctcacttctgtatggcatcatgtacttgagctgcagggaatcatgcatttcatacagttatctgcataagggtgtgtgagagagagagagagagagtgtgtgtgtgtgtgtgtgtgagagggtgtgagtgtgtgagagagtgtgtgtgtgtgtgaatgtgtgtgtggacacatacattttcaaagggagactggtaatgactgtgaatatgccctctgctcatgcatccccagtttcaggaagcaggacctgggtgaacacacttgcagagagcctcactggggttctttcctggctgctgtcttgtctgctgatggaaaggtgtctggcttcgggccctgaccttgatgagagctcttggcacatgctggaggcctggaatgtcatcccacagttccactgtcatcagttctcagccaaccccactgttgccttttcagccaatttcatggtgtttattctggtgtcagtctcctcaccggagcgtgggcactcaagggcatcgagcgagtctgtcttgtttgctgctgcagccccagcacagagtccgatgccttgctctgcccctgctcttggaaggcctggctgaggcagtttccctgtctcttcccatttcaagggcacccactcatcaggttcctcgaggaagaaacttcacgcatctcaggcctgccttccctccatctgtccccaaacctcccattccttgacccctgtgcctaagtactcatcacttccacttagaacccacggctgcacatcagcaaactgagtacatgcttttgttgatccaaatgtgctgacagtgcagtggcactgcttactgaagtctgctgtctgcaggctgtcacacaggattgtctgtaaatttatcagaacacttccaggaaggcattactgtccccattctacagacaagaaaactggtgcttggagaggtagggaacttgcccaggatcatgcagtgagcagagtctttctggccccagagctgattctgtctcagcttctgaaagcagctcacatagccaggcacatgctgtggcagggttctccctgccctactgttttactgcttctcaggaggccctgtggggcgggtgtctacaacgtgtacatttgtaggagtgtcccaggaggagcattttgttccacttttgctctactgctggctcgctctgtgtgtcttaggacacatctcttaacctctctgggctcaaccactgcacagtgaaggctctggattgataatctgtgaatgctgtgttctaattaaatagtgggtttcttggccttgggtattctgtgtctcatttttgtctttacttgttggctccacaaagcaaaacctattgtcagtaattcttactaactttatattgatgttgactgtgtagaccaattctagctacgttagccttttgttcatataaaatgaacaactgacacgtaattgttactgttttccatagtgcactgtgtcatcctgactccacgtatagagtgttcactgtgtgccagggctgctctcggataaaacctattctgttgaagtcctggctggccctaactttttaagtttaacaaggttgagaacacaagtgactttgattagcattgtcctaatctggtttatcagtagcaggggaatttataagcagttaccaaaatgcatccaaaataagatggcttaatggctaggcagaggggagagatgtgatgaagtcagtacagcagaatggtaacaagtgagcatctccctaatgggaatgggacattcctggtagagctgggagaaaaaatgaccaaagctactgggaaattctgcagagataattgtcccattactttttaattaattaaaactaattaattaactattttttttttgagacgccgtctcaaacagaaaacaaaaaaacc

SEQ ID NO: 34039 - DNA, 2126 bp, Homo sapiens
taaatgtgatgtatgtggcaagatctttaatcagaagcaatacattgtatatcatcatagatgtcacactggtgagaaaacttacaagtgtaatgagtgtgggaagaccttcactcagatgtcatcccttgtatgccatcgtagacttcatactggagagaaaccttacaagtgtaatgagtgtggcaagaccttcagtgagaagtcatcccttagatgccatcgtagacttcatactggagagaaaccttacaagtgtaatgagtgtggcaagacttttggtcgaaattcagcccttgtaattcataaggcaattcatactggagagaaaccttacaagtgtaatgagtgtggcaagaccttcagtcagaaatcatcccttcaatgccatcatatacttcacactggagagaaaccttacaaatgtgaagaatgtgacaatgtttacattcgcagatcacaccttgaaagacataggaagattcatactggagagggatcatacaaatgtaaggtttgtgacaaggttttccggagtgattcataccttgcagaacatcagagagttcatactggagagaaaccatacaagtgtaataaatgtggcaggagtttcagtcggaagtcatcccttcaataccatcatacacttcacactggagagaaaccttacacatgtaatgaatgtggcaaggtttttagtcgaagagaaaaccttgcacgtcatcatagacttcatgctggagagaaaccttacaaatgtgaagaatgtgacaaagttttcagtcgcagatcacaccttgaaagacataggagaattcatactggggaaaaaccatacaaatgtaaggtttgtgacaaggctttccggagtgattcatgccttgcaaaccatacgagagttcatactggagagaaaccttacaagtgtaataaatgtgcgaaggtttttaatcaaaaaggaatccttgcacaacatcagagagttcatactggagagaaaccttacaagtgtaatgaatgtggcaaggtttttaatcaaaaagcaagccttgcaaaacatcagagagttcatactgcagagaaaccttacaagtgtaatgagtgtggcaaagcctttactggacagtcaacacttattcaccatcaagcaatccatgggtgtagggaaactttacaaatgtaatgattgtcacaaagtcttcagtaatgctacaaccattgcaaatcattacagaatccatattgaagagagatctacaagtgtaataaatgtggcaaatttttcagacgtcattcataacttgtagttcatcagtgaactcatactggagagaaaccttacaaatatcatgactgtgacaaggtcttcagtcaagcttcatcctatgcaaaacatagaattcatacaggagagaaacctcacaagtgtgatgattgtggcaaagcctttacttcatgttcacacctcattagacatcagagaattcatactggacagatgccttacaaatgtaagggtggcaaggtcttcactctgtggtcattccatgcagaacatcagaaaattcatttttgagataattgttccaaataaaatgaatataaaaaatcataaaactttaattgacattagagttgattcaacattgacttgagtttgagttgacttaacattgagttcacgcattaattgacataaaaagtgttaatgttaagaagaatgggtcaggtgcagtggctcatgcctgttttcccagtactttgggaggccaaggcaggtagatcacttgaggtcagcagtttgagaccagcctggccaacagacttgagccactttacccagcctgttttttatttttattttttgagatggagtcttgctcttgtcactcaggctatagtgcaatgacatgatctcagctcactggaaccttcacctcctgcattcaagcaattctcctgcctcagcctcctgagtagctgggattagtgatgcatgccaccacaccatgctaatttttgtatttttatttattttttattttattttattttttgttgagaagtgggggggggtgggccggggatgaagttggcgggctggagttgcctggtacaggcaa

SEQ ID NO: 34040 - DNA, 2379 bp, Homo sapiens
ggtggtgtttgtgtatgatgtgcagtgtgtgtgtgtgtggtgtgtctttcatgacactgacattattaaagagttcaggcaagtttgtggaatgtcccacaatctagacttttttactgattgtttcctcattacgagatacaggttacattttttttcccaagactgctacatgtgtgatgttgtttccttactactgcctcacctcaggaagcacataatgtctacttgtctcttttctgatattaggactgatcaggtgttgtctgcctgatccaatcattatcaagttccataattcattattaagctctgaaattcaggacacatacatttatagagtgtgaggctgtgcatacgtacattcatcccttaatgttctcaaggaggcccaggatccccaaaatattataagcattgcagtcagatgatatagcactagcaaagcattcatccctttccatataacaggagggaggggaagaaggaagtttccatgtgcaggcaatacgtgagagcatgggcaagtgaggatttgtatgctccctgtagccagaggtgaaatattcaacgcttttattttttctccccgtcttcaatgacctcccatttggacccatagtttatttatagagagcacacactccctaattgtcagatggtttttttgggaaaactcttagatagtacagtgagttgtgaccctccaaaggatcacaagtacataaacagatacaaagtatttatgtggtattaaaatttcatggtgatggtgcaagggagagatgattaggaagaaaatgtcttaaacggctgtaattgagaaatactgatctagagtcatttcctgcttcttaaattgttcgttttctcttccctgggtattttctcatttccaaagacccagagtctcagagccaggttaagtggaagaaactttgagaggtttcttaatcaattccttctatctctcaaaccatgccagtaacttccttggtgaaaaaatctatactcctctcacagttcttcgggcatggaaattctatagcattctttggtataaccaacccactgaaccctccacaacatcttgaattccattcaactcgagctgaagtattctttttgagtttcagtatatcttttctagtgtcccacttttagaaaggtccaaagatgatatataataagtgaaaatacaattaatcagagctttatttgcatatccattaaatatctgaaggctattaccagttgtgcttcagcctcctttcccttgcaattctcccagggtggcatcctctacggagtcttgttgctccattgttgaccactgatgtaactcaacgtgaaaccttcccaaagctctccacatcactctctgttatggctgtgaccagcagtgaacatgaaaagaacttatttcatgccttctccaaactatattgtttctttgctaagtccagacctgctttttctacatttataggttttctattttaatcgccatgcaaaattctttatcatactcaatcattttggtttatcttcctgacttcttacctttaacatccctgttaaagattacactgttgttgtttcaaaaaaaaaaaaaaaaaaaccttaattggcaaaacattaagggacttgaatagaattacacttatctttttgtgctgatttatgtcaatccatcattctggttattgatggaagcaaattgcttcctatgttctctaaaccttatgtcccttccatactccatgagtaccacactgggagaaaacaaaagcaaaaagattgtgggaaaagtatagccattatctttgaggaaatgtgtaccaaggcacaatcattaaaaggagttggaggcatcatttggttgacactgttgtcattcttgttctgatcattttggaccttgaagaaattggtgattctctcctagaattagacaaacaaagtgtgtttggaaataatgattgttttcctgccttaaaaaatatattaacagaaagcttttataacaggctgtttccctctggacaggtattaattctgagtaagaattttcagtgactacataaggatttgtgtaacttatgaaggaagagtccatttctaatcaaataattcacctgttttactagcttatagtgatctgatttcagaattttcctgtatcttttttacatacatcagaaaaagaaatgtttactatatttttggttccatttatgattgtattaagcatttgactataaggaaaactaacaattaaatcaattagaaaagcaacataaaattaaatgatatttaggaaatcagttatatgtgagcttgggtattcaaatgtcacaaataaaaagcatataacca

SEQ ID NO: 34041 - DNA, 2697 bp, Homo sapiens
ggtggtgtttgtgtatgatgtgcagtgtgtgtgtgtgtggtgtgtctttcatgacactgacattattaaagagttcaggcaagtttgtggaatgtcccacaatctagacttttttactgattgtttcctcattacgagatacaggttacattttttttcccaagactgctacatgtgtgatgttgtttccttactactgcctcacctcaggaagcacataatgtctacttgtctcttttctgatattaggactgatcaggtgttgtctgcctgatccaatcattatcaagttccataattcattattaagctctgaaattcaggacacatacatttatagagtgtgaggctgtgcatacgtacattcatcccttaatgttctcaaggaggcccaggatccccaaaatattataagcattgcagtcagatgatatagcactagcaaagcattcatccctttccatataacaggagggaggggaagaaggaagtttccatgtgcaggcaatacgtgagagcatgggcaagtgaggatttgtatgctccctgtagccagaggtgaaatattcaacgcttttattttttctccccgtcttcaatgacctcccatttggacccatagtttatttatagagagcacacactccctaattgtcagatggtttttttgggaaaactcttagatagtacagtgagttgtgaccctccaaaggatcacaagtacataaacagatacaaagtatttatgtggtattaaaatttcatggtgatggtgcaagggagagatgattaggaagaaaatgtcttaaacggctgtaattgagaaatactgatctagagtcatttcctgcttcttaaattgttcgttttctcttccctgggtattttctcatttccaaagacccagagtctcagagccaggttaagtggaagaaactttgagaggtttcttaatcaattccttctatctctcaaaccatgccagtaacttccttggtgaaaaaatctatactcctctcacagttcttcgggcatggaaattctatagcattctttggtataaccaacccactgaaccctccacaacatcttgaattccattcaactcgagctgaagtattctttttgagtttcagtatatcttttctagtgtcccacttttagaaaggtccaaagatgatatataataagtgaaaatacaattaatcagagctttatttgcatatccattaaatatctgaaggctattaccagttgtgcttcagcctcctttcccttgcaattctcccagggtggcatcctctacggagtcttgttgctccattgttgaccactgatgtaactcaacgtgaaaccttcccaaagctctccacatcactctctgttatggctgtgaccagcagtgaacatgaaaagaacttatttcatgccttctccaaactatattgtttctttgctaagtccagacctgctttttctacatttataggttttctattttaatcgccatgcaaaattctttatcatactcaatcattttggtttatcttcctgacttcttacctttaacatccctgttaaagattacactgttgttgtttcaaaaaaaaaaaaaaaaaaaccttaattggcaaaacattaagggacttgaatagaattacacttatctttttgtgctgatttatgtcaatccatcattctggttattgatggaagcaaattgcttcctatgttctctaaaccttatgtcccttccatactccatgagtaccacactgggagaaaacaaaagcaaaaagattgtgggaaaagtatagccattatctttgaggaaatgtgtaccaaggcacaatcattaaaaggagttggaggcatcatttggttgacactgttgtcattcttgttctgatcattttggaccttgaagaaattggtgattctctcctagaattagacaaacaaagtgtgtttggaaataatgattgttttcctgccttaaaaaatatattaacagaaagcttttataacaggctgtttccctctggacaggtattaattctgagtaagaattttcagtgactacataaggatttgtgtaacttatgaaggaagagtccatttctaatcaaataattcacctgttttactagcttatagtgatctgatttcagaattttcctgtatcttttttacatacatcagaaaaagaaatgtttactatatttttggttccatttatgattgtattaagcatttgactataaggaaaactaacaattaaatcaattagaaaagcaacataaaattaaatgatatttaggaaatcagttatatgtgagcttgggtattcaaatgtcacaaataaaaagcatataaccaaaaaaaaaaagaaaacaagaaaacaaaaaaactgtgtcgcgcgcgctcctgggcgccctctgcaaaaaaacctttctaaaaacaatctgcgctggggggacgcgcggccccagtgaggtgacgtgacacatgggcgcatgagtcgtctcgaggaaaaccggccagcgaacaacagcggtcggggcttctccaccccaataaaaaaacgcgccggtcgacacacgaaggcttgcgaaacacactcaccatgacagtcgctggagcactcaacactggtacccacaagagggactcccaggcacctcgatatcaattaca

SEQ ID NO: 34042 - DNA, 353 bp, Homo sapiens
tttttttttagacagggtcttgctctgttacccaggctgggtgcatgccacgattacagtttactgcagcctcagcgtcctgggttcaaaatcttcctgcctcaggctcccaagtagctgggactacaggtgtgcactaccatgcttggctaattattttactttttggaggaatcagggtcccactacattgcccaggctggtctcgaactcctgggcataaggaatcctccggcctcagcatgccaaagtactgggattataggtgtgagccaccgcagcaggacacccagctaatttttaaactttcttgtagaggtagagtctcatttatgttgtgtagggtagtttag

SEQ ID NO: 34043 - DNA, 999 bp, Homo sapiens
tctcccatcctttttaactgttccctggcttcgagaaagatcaaattagcgcagtattatcctttatcaataatcagctttttaaaatgacattcttttttaaattctagaacacagcatacccagccccaaacataccaaatttaacaggctttctctttgcctacaacaatatacaaatatatattcacctctctatgggtttgggttttattttaatggcattatgttgtagagttagcagcttccttttttcacgtagctgtctaccatgcacgtggctgtaggtcgatcacacagggccaagacatgtttctccaatatctctcgttctcgtaaatcgtagttcattcagctgtcacttatcaccagacatttcagttgttttcagtttttccctctgataaacattgctgcaataaacattttgtgaccctactgttagtagtggtgcatttatttttgtgggttagtttcaaagatgggctaaaggttgtgcccatttattaaatactacctaatgacctacccaaaatgttgtagcaattcacatattcatcagcaacttagagtgtccaatttcccctattcttgcccatactagttgtcaccagtctttttaatttttgccaatttgatgggcaaaaaaaaatggtgactactaatgaggctgacatcttgttttatgtgtattgaacatttatatttcctttcctgtgaattgctggtttacctctttgcctatttttcttttgtattgtttaactttaaatcaacatgtaggaatcttaatccctaatattaggaatattaaccctttctcataaatgttgcttagatattcccttagtctgcttctttatttattgtaccttttcccatataaaaaaatattagttttatgtagtcaaggtataagtctttttctttatgacttctggatttgctatattccttaagaagtcaggttgggaatttttctcttccagtaaaaaaaaa

SEQ ID NO: 34044 - DNA, 438 bp, Homo sapiens
tctcccatcctttttaactgttccctggcttcgagaaagatcaaattagcgcagtattatcctttatcaataatcagctttttaaaatgacattcttttttaaattctagaacacagcatacccagccccaaacataccaaatttaacaggctttctctttgcctacaacaatatacaaatatatattcacctctctatgggtttgggttttattttaatggcattatgttgtagagttagcagcttccttttttcacgtagctgtctaccatgcacgtggctgtaggtcgatcacacagggccaagacatgtttctccaatatctctcgttctcgtaaatcgtagttcattcagctgtcacttatcaccagacatttcagttgttttcagtttttccctctgataaacattgctgcaataaacattttgtgacccta

SEQ ID NO: 34045 - DNA, 355 bp, Homo sapiens
gccacaaattgcctctagggcagacccccactctcaggatggattggaattttaactaaaaggaattttggatatgatggtcttatttggatcccgatttgaacaagctaatcagaaaaagacatcttgcgataattggaaaaaatctgaacataaactgagtattagagaaaattaaagatttatttttgttttcattaggagtgataatgacatagtggttttataaaagataaaaggccttatcggttaaagatgacagtaaaatgacccaattttggccaggcgtggtggcttatgcttgtaatcctagcactttgggaggccgaggcaggcagatcatgaggtcagtagt

SEQ ID NO: 34046 - DNA, 575 bp, Homo sapiens
tcagggtcacattccttcctggaggcactagaggagaatccttttccttgcttttctagcttctagaggcctaccacattcctccaccatcaaaatccgcaactgcattttagatgagtcttttcgcaatggcatcaccctaactttctctcctgcctgcctcttacaggaagacttttaaggacccctgtgactgcatcattgggaccaccagtataattcagaatactgtccctattttaactcagctgattagtgtgactaatccatctgccaccttaattcctctttgtcatgtaacctaacatattcaaaggttctggggttagaaaatagagatctttgggaggccattattatgcttaccacacagagcaattaatttttgtggaactttcattagggaaaaaacgaggagtaatagaatatagaaaatgagctcagtggtagataaggatttattacttatttgcctttgttgtgatagttacaatatattacccacaactcaaaaataattaagtttgcaaaatttatcaagcatgctgctatggtctgaatgtgttcattcccca

SEQ ID NO: 34047 - DNA, 685 bp, Homo sapiens
tgacctcaggtgatccacccaccttggcctcccaaagtgctgggattacaggcgtgggcctggcctactattttgaggtataatggaaggatgtttgcattttaatggagggaacacctctcatgcactgatgtgttgcagcatcagggcaacaaagtggctgtctgcttccaggtccacactgacttctagacacagaatgtcaccaaggaaatgtaccctgtcttaaaagaaaagatgaagggaattcaaatttggagagtgccgggagccacacgctttttatgtgtgcttggtcatgcagtcattttacacacttgttagcattgtcaggtgaaatgaggattcatctttccattttatatagagggggcagttagaggttaagtagctgtctgagtccctttgggctgctcttacaaaatgccatagactgggtggcttaagcaacaaacatttgtctcacagttctggagtctggtaagtctaaaatcaagatgccagcagatctggtgttcagtgagggcccagttcctgacttgcagatggccatcttctcattgtatcctcacattgcttaacagtggccccagagagcaggagtagtgatgctggtgattcggatatgccaaagagaagccacaaagtgcttccttttaaatgaaaaggtgaaagttctcaaatc

SEQ ID NO: 34048 - DNA, 490 bp, Homo sapiens
ccatgttcggcatcactgattagctctagaggtccatgcatacttaatattatacttgaattccatatgccgggagccacacgctttttatgtgtgcttggtcatgcagtcattttacacacttgttagcattgtcaggtgaaatgaggattcatctttccattttatatagagggggcagttagaggttaagtagctgtctgagtccctttgggctgctcttacaaaatgccatagactgggtggcttaagcaacaaacatttgtctcacagttctggagtctggtaagtctaaaatcaagatgccagcagatctggtgttcagtgagggcccagttcctgacttgcagatggccatcttctcattgtatcctcacattgcttaacagtggccccagagagcaggagtagtgatgctggtgattcggatatgccaaagagaagccacaaagtgcttccttttaaatgaaaaggtgaaagttctcaaatc

SEQ ID NO: 34049 - DNA, 2174 bp, Homo sapiens
gctgcaatgagccaggattgtgcctctgcactctagcctgggtgacagggcaagactccatctcaaaaaataaaaataaaaatagtttatctgggtgggcattccaaaatttccgcatagatgatcacgtgaaacaatcactgtgctaaatgtggaggaaaattcatcacgataatcacaaaatttgtatcagaaaaaaattacaaatgtactttgtttcatgtaattttatgagttggaagtattttcttaaattggaacactataagataatatctttaggaaatggatatgccacaataggaagtatagtggggcaagtcttgtttttctcaagggaaaagccaccagcctgctttcataggcattgataaaaccaggaagaaaataaagtcacaaccaaatagtatacactgtctctactgaattcttctaattccttcccaacagaagtctaaatcctgcttagcctaaacatatctatagccagcgatgggcaaattatatttgctgtcagcatgatagaataagaatcagaaaccccccagcagtggggtaagatcgtgcacttcatcccctcaaaatgctgtcaaccccattccctctccatgccctcaaacaactgcacagtcacttgttagtgaatttctcgttcagcgttttgtttttttctctccatacttaaagaccaaatcatttgtttgctctgaagaaaaagaaaaaacaaaacaaaacaaaacaaaaaaccacccaccaaatcatttgaaatcactacccgttaaaaaaaatcaccagtggaactaaacagttgagtggtttgggatgtgttccccatttctgtgtttgacctacatggcctctaattctttggaccattgtaactgtgaaactatggcttaatactgttaaagaccccaaggctccactctgtagccagggtgtacctcaggctgcacaaatatcacaccagaatgtcacaatcattcattgctccagctactgagtgaacagggtgcaagacagcactggcttgggttgtatttttgcagccagttaactttgcatcaggtctacacagtccttgcagcctttgatttctccagttgtagagatttgaaatggggtgcccgggttcctctcgtttttccttcaacctacctagcatgcattttacacacattggaggagtcttatgcactgtttttctctgttgctgatggaggcaagaaggccttctaattagtctaacttaaacggacgggattcacctaacaaaagcaagaagaaaagcacaagaacaggtgtcttaatgcatttggataatttatttggggtgtgtgcgtgtgtgtgtgtgtcttggtggaggtgggggccgtgttctcaccaagccttttcataatcaagtttgctttgcaaactttatggccttacacccagcagaacagtccttgctaataaaaggaggatgccctgtcacagtctctgtaaattatcatgtgttgggaagttctgttgatgcttagtttgatcttccatggtggacacatctgttctgtatgtacaaggcattacatgtgtgttttagcggatgggaattgaagcctttccacagtccttgtgctctgagatggctgttgagctctgctcagctgtcgtagctgaattctttttttgtgctgaacactgggcagcctcaccatgttgtcaatgtgcttctggggcccctgtgactgctgccagatgccatgcacacaagcagagtgcctttgcaggtttgtgcaccccttggcgagctggaactgggagccctgtggggtgatctcgccttctcatggggggtcggggaggggagtgcctatttttaatcttgtctgtttgttgcaccatggaaatcactgtgatttgtatatatgccctaggaaatttttactgctgtctaatttatgtaataatgttgattccaggtttgtttaataaagctttgtatcttttaagaaaaaaaaaactgtagcatgtagaggaaagtgcactgggataatccaaggccaggctttgaggttccaccgctacattatgtgactcttagtctaaaccttttggtgtaatttctttggtctgattatttataagtagcagataataaatgaattttatactacaaacacaagtgacaa

SEQ ID NO: 34050 - DNA, 697 bp, Homo sapiens
tgagacagagtttcaaaataattttgaaatgagcaattcacctatttgactacacagacttccagtatgcttgcataaaaggaaaagtcatgtgagaacatctgaatttagaagtacttgaaagtacaagactgaagacataaaggaaatgtaagcaggatgataaatgtcagttgatttaaactgacaggagctctgttctgctttatagcatattcttgtagggagagctgatcctagctgatggctagctctggagcaggcttgttgaagctgttcataaatgtatttatgtttttagagacagtatctcacactgtcacccagactggagtatggtggcatgattatggttcactgaagccttgaacccctgggcctcaagtgaccctcctactttaggctcccaaatagctggcattacagcagtgtgccacctgttcataaatttagaacaatatttagtgtcaagttagtgatttttctaagggtggaacagggattactacaaggtgaacatgcttctgtaatcgccacacaggtcaggaaataaaacgttatttttattctatatttctttatgtgatgtctagacactatcttcatattccccagaggtaactactgtcctgatttaaaacaccatagattttatgtgatttaaaaatatatggacacagtattatttagcctaaaa

SEQ ID NO: 34051 - DNA, 2189 bp, Homo sapiens
tgggatgcaatcagaaaagccgagtggggctgcctcctgtttctgagtgtgttggtttggtttaattcttttcaagggttggagttggaaagtgaaaaccctagacacttgctgtggaatgtttgcctggttgtattggtgtgtccctcttcttcactggcatgtcgctttcaagtgtaccaaaggacattttgttctgttgaaagccacaggaccaaaaggaaaatattgcaactatttgcaaacatacttccctacctatacaagcagccatatactaaaaagcactaaacaagcacaaatgaacactaaatagccttataccaaaaagcattcttgtaactgtcagggcatggtatgaattccttcctctttaagcagcaacttaccacaggcttggtggctttaagtaatatagcattaagcaaatggtcagttattttttaatgttgaaaacttccaagtgtgaataatacggacatagtttactaccttttgcttttaatatacctggttatctatttccatttgaaataaaatgaaaggagacctcaaactgatgctgagaagtagacaaaatcagctctcagacttaactctccccaattaaaatagtttttttttcccttcccatttttttgtttttaagagatagggtcttgctgtgttgcccaggctagagtgcagcagtgacatgatcatagctcactgcagcctggaactcctgggctcaggatccttctgcttcggcctcctgagtagctaagaccacaggtgtgtgccaccacacctggctaatttttttaaaattttttgtagagatggggacttgctatgttgcccagactggtctcgaactcctggcctcaagccaccaacctctcaaattgctagaattacaagcatgagccaccacacctggcctgttattccttctttatctaatgtgtgctaagcttgtgaaaaatatatgttgaggtaaatagggcaaaacattagttgataaattatgctaattaatgggaaaaatagacatgttcctctctgaacatttagaaggactctgccctacaactatcttctgtttttagaatttgtagtcactgttcttagtgccactggaaatatattcattctttgagcatgtacagggtgggctccctgttgtatttattacacttttcaaaatgccagcaagtttttgtttgtatagagttggaatgtattgttcgtgcatgcctgtgatattcatcatcaaaatatacctgtaaaaaataaactactgcttcctctccacagcttaggcctccctcttactaaaaacaatagtagtttctgtagaagtttcagtgagaaattatggttatataaataacagatatggcagaacaattttgttgtagtatttttttccgtagcatttcttaataatagctcagtttttaaaggaggggaacaataccccatgagttcaaattaattttctctactttgaggtataccttcctaattatattttacataggctgttttttttaagtttaaattctcactgttaagttgcattgagagacaattagaaatgttgtaattgtcatatctttacatgtggattatgaacaaatgaaagtttgctgtgtgattgcagttttaaattataacatttcataaatatgtcaattttagaaactcaaactctttcccatcttttgtatggataaagtttatggtttcatttctgagaatagagttggtctgctgtgctaacttcatgtttcttattccaaaggcttgattatatttttttctccagtgattaaaaatgcagcgaaaatccaatctacaagttcatatattggtatttctagacatagtctagttctaaaagaatgtacttggtgtgcatttttaagtgtttcatgtagacagattaatatatttttgtacaacattgtatttctacatttatttcaagactgtacttttcagtgactttttcaagtgcatgtgttaacagaagattgtttggaacgagagtgcagtggcttctttactagcaaagagaagtgtaatacaagtgatcatagaaggtgagaatgtgtttatactgtatatggaaacctaatgcctcttttctaaagctttgtacatttttttcgtgaaatagattaaatattttctctctaaaa

SEQ ID NO: 34052 - DNA, 2263 bp, Homo sapiens
ctggtcgtctctagcaggatccccttttatctgaaggctgccccaatcacagagcctgggtaaggtggaacaggaggcagccccactcggcttttctgattgcatcccacctgtttctgagtgtgttggtttggtttaattcttttcaagggttggagttggaaagtgaaaaccctagacacttgctgtggaatgtttgcctggttgtattggtgtgtccctcttcttcactggcatgtcgctttcaagtgtaccaaaggacattttgttctgttgaaagccacaggaccaaaaggaaaatattgcaactatttgcaaacatacttccctacctatacaagcagccatatactaaaaagcactaaacaagcacaaatgaacactaaatagccttataccaaaaagcattcttgtaactgtcagggcatggtatgaattccttcctctttaagcagcaacttaccacaggcttggtggctttaagtaatatagcattaagcaaatggtcagttattttttaatgttgaaaacttccaagtgtgaataatacggacatagtttactaccttttgcttttaatatacctggttatctatttccatttgaaataaaatgaaaggagacctcaaactgatgctgagaagtagacaaaatcagctctcagacttaactctccccaattaaaatagtttttttttcccttcccatttttttgtttttaagagatagggtcttgctgtgttgcccaggctagagtgcagcagtgacatgatcatagctcactgcagcctggaactcctgggctcaggatccttctgcttcggcctcctgagtagctaagaccacaggtgtgtgccaccacacctggctaatttttttaaaattttttgtagagatggggacttgctatgttgcccagactggtctcgaactcctggcctcaagccaccaacctctcaaattgctagaattacaagcatgagccaccacacctggcctgttattccttctttatctaatgtgtgctaagcttgtgaaaaatatatgttgaggtaaatagggcaaaacattagttgataaattatgctaattaatgggaaaaatagacatgttcctctctgaacatttagaaggactctgccctacaactatcttctgtttttagaatttgtagtcactgttcttagtgccactggaaatatattcattctttgagcatgtacagggtgggctccctgttgtatttattacacttttcaaaatgccagcaagtttttgtttgtatagagttggaatgtattgttcgtgcatgcctgtgatattcatcatcaaaatatacctgtaaaaaataaactactgcttcctctccacagcttaggcctccctcttactaaaaacaatagtagtttctgtagaagtttcagtgagaaattatggttatataaataacagatatggcagaacaattttgttgtagtatttttttccgtagcatttcttaataatagctcagtttttaaaggaggggaacaataccccatgagttcaaattaattttctctactttgaggtataccttcctaattatattttacataggctgttttttttaagtttaaattctcactgttaagttgcattgagagacaattagaaatgttgtaattgtcatatctttacatgtggattatgaacaaatgaaagtttgctgtgtgattgcagttttaaattataacatttcataaatatgtcaattttagaaactcaaactctttcccatcttttgtatggataaagtttatggtttcatttctgagaatagagttggtctgctgtgctaacttcatgtttcttattccaaaggcttgattatatttttttctccagtgattaaaaatgcagcgaaaatccaatctacaagttcatatattggtatttctagacatagtctagttctaaaagaatgtacttggtgtgcatttttaagtgtttcatgtagacagattaatatatttttgtacaacattgtatttctacatttatttcaagactgtacttttcagtgactttttcaagtgcatgtgttaacagaagattgtttggaacgagagtgcagtggcttctttactagcaaagagaagtgtaatacaagtgatcatagaaggtgagaatgtgtttatactgtatatggaaacctaatgcctcttttctaaagctttgtacatttttttcgtgaaatagattaaatattttctctctaaaa

SEQ ID NO: 34053 - DNA, 2538 bp, Homo sapiens
ctggtcgtctctagcaggatccccttttatctgaaggctgccccaatcacagagcctgggtaaggtggaacaggaggcagccccactcggcttttctgattgcatcccacctgtttctgagtgtgttggtttggtttaattcttttcaagggttggagttggaaagtgaaaaccctagacacttgctgtggaatgtttgcctggttgtattggtgtgtccctcttcttcactggcatgtcgctttcaagtgtaccaaaggacattttgttctgttgaaagccacaggaccaaaaggaaaatattgcaactatttgcaaacatacttccctacctatacaagcagccatatactaaaaagcactaaacaagcacaaatgaacactaaatagccttataccaaaaagcattcttgtaactgtcagggcatggtatgaattccttcctctttaagcagcaacttaccacaggcttggtggctttaagtaatatagcattaagcaaatggtcagttattttttaatgttgaaaacttccaagtgtgaataatacggacatagtttactaccttttgcttttaatatacctggttatctatttccatttgaaataaaatgaaaggagacctcaaactgatgctgagaagtagacaaaatcagctctcagacttaactctccccaattaaaatagtttttttttcccttcccatttttttgtttttaagagatagggtcttgctgtgttgcccaggctagagtgcagcagtgacatgatcatagctcactgcagcctggaactcctgggctcaggatccttctgcttcggcctcctgagtagctaagaccacaggtgtgtgccaccacacctggctaatttttttaaaattttttgtagagatggggacttgctatgttgcccagactggtctcgaactcctggcctcaagccaccaacctctcaaattgctagaattacaagcatgagccaccacacctggcctgttattccttctttatctaatgtgtgctaagcttgtgaaaaatatatgttgaggtaaatagggcaaaacattagttgataaattatgctaattaatgggaaaaatagacatgttcctctctgaacatttagaaggactctgccctacaactatcttctgtttttagaatttgtagtcactgttcttagtgccactggaaatatattcattctttgagcatgtacagggtgggctccctgttgtatttattacacttttcaaaatgccagcaagtttttgtttgtatagagttggaatgtattgttcgtgcatgcctgtgatattcatcatcaaaatatacctgtaaaaaataaactactgcttcctctccacagcttaggcctccctcttactaaaaacaatagtagtttctgtagaagtttcagtgagaaattatggttatataaataacagatatggcagaacaattttgttgtagtatttttttccgtagcatttcttaataatagctcagtttttaaaggaggggaacaataccccatgagttcaaattaattttctctactttgaggtataccttcctaattatattttacataggctgttttttttaagtttaaattctcactgttaagttgcattgagagacaattagaaatgttgtaattgtcatatctttacatgtggattatgaacaaatgaaagtttgctgtgtgattgcagttttaaattataacatttcataaatatgtcaattttagaaactcaaactctttcccatcttttgtatggataaagtttatggtttcatttctgagaatagagttggtctgctgtgctaacttcatgtttcttattccaaaggcttgattatatttttttctccagtgattaaaaatgcagcgaaaatccaatctacaagttcatatattggtatttctagacatagtctagttctaaaagaatgtacttggtgtgcatttttaagtgtttcatgtagacagattaatatatttttgtacaacattgtatttctacatttatttcaagactgtacttttcagtgactttttcaagtgcatgtgttaacagaagattgtttggaacgagagtgcagtggcttctttactagcaaagagaagtgtaatacaagtgatcatagaaggtgagaatgtgtttatactgtatatggaaacctaatgcctcttttctaaagctttgtacatttttttcgtgaaatagattaaatattttctctctaaaaaaaaaaaaaaaaaaaaaaaaaaaaaaaccaaacgaaacaattcagcagcaacaacaaacgaacattgatacacgagacgctacaaacacaaacacaagcaacaaacatagatagaataaaaaaagagggagagagaataaacaaagagagagccaaaacacaacgttaaatcggcccaaaaggattataagaagaggaaaataacaggaaaaagcagtaggagaactgtagtggtcaacacaagagaaaaataggatgccgcgagatctcgagca

SEQ ID NO: 34054 - DNA, 351 bp, Homo sapiens
cgtgaaatagattaaatattttctctctaaaaccatgtttctgttttaatgtgctttctaagtatatcatgaggtaactctactacttagaaacctgtaagctgtgatttacttgagcttttggggaaatggaaagcagaatacttagtttaaaaaaaatttttttttaactgcaagcagatacctcaagatcaaatcatgcaatcataattagagatttttaatatatatattgggaaagggtaatctattcaataaacgatactgggaacatttgaaaagaacaacaacagaaattagatctctatctaacactgcacactgaatttgaaaggaattaatgacataaca

SEQ ID NO: 34055 - DNA, 750 bp, Homo sapiens
aggcgtctgccaccacgcttagctgattttttgtatttttagtggagatggggtttcgccatgcttgccaggctggtctcgaactcctgacctcaggtgatctgcctgccttggccttccaaagtgctgggattacaggcgtgagccgctgcgcccagcgcactaaatactattaaaaggaattaagcaaaatgctacgtaccaatgattatgattcatgatcacctaaacacagaatgcagacttaacttttcattcttagtgtgctaattaagtagtagtatggtgcagtaaggaattttgttaattttgttataaactccctctcctgaaatccgtaaggaaatgtgataataagaaagtgataatagtgtcatattttaaaagtagaatccactgttaagcaccaagattaccttttcttccccctgtggcacagtttatttaaatgaagtattagcaataatcatgtcactattttgtcctgaataattaagagtttgcttttttcccatgtctttgcaataggataatataaagaatagtattaaaagtcagaggctttactaatctacctatatgtattccatggctaacaaaccctggcccctttacatatgagctctggaggttcgcctggctgcctcaggcttgcagaaggctgccccaatcacagagcctgggtaaggtggaacaggaggcagccccactcggcttttctgattgcatcccacctgtttctgagtgtgt

SEQ ID NO: 34056 - DNA, 2715 bp, Homo sapiens
ggtggcgatctagaggatcccttctcgtgacaatgattatgattcatgatcacctaaacacagaatgcagacttaacttttcattcttagtgtgctaattaagtagtagtatggtgcagtaaggaattttgttaattttgttataaactccctctcctgaaatccgtaaggaaatgtgataataagaaagtgataatagtgtcatattttaaaagtagaatccactgttaagcaccaagattaccttttcttccccctgtggcacagtttatttaaatgaagtattagcaataatcatgtcactattttgtcctgaataattaagagtttgcttttttcccatgtctttgcaataggataatataaagaatagtattaaaagtcagaggctttactaatctacctatatgtattccatggctaacaaaccctggcccctttacatatgagctctggaggttcgcctggctgcctcaggcttgcagaaggctgccccaatcacagagcctgggtaaggtggaacaggaggcagccccactcggcttttctgattgcatcccacctgtttctgagtgtgttggtttggtttaattcttttcaagggttggagttggaaagtgaaaaccctagacacttgctgtggaatgtttgcctggttgtattggtgtgtccctcttcttcactggcatgtcgctttcaagtgtaccaaaggacattttgttctgttgaaagccacaggaccaaaaggaaaatattgcaactatttgcaaacatacttccctacctatacaagcagccatatactaaaaagcactaaacaagcacaaatgaacactaaatagccttataccaaaaagcattcttgtaactgtcagggcatggtatgaattccttcctctttaagcagcaacttaccacaggcttggtggctttaagtaatatagcattaagcaaatggtcagttattttttaatgttgaaaacttccaagtgtgaataatacggacatagtttactaccttttgcttttaatatacctggttatctatttccatttgaaataaaatgaaaggagacctcaaactgatgctgagaagtagacaaaatcagctctcagacttaactctccccaattaaaatagtttttttttcccttcccatttttttgtttttaagagatagggtcttgctgtgttgcccaggctagagtgcagcagtgacatgatcatagctcactgcagcctggaactcctgggctcaggatccttctgcttcggcctcctgagtagctaagaccacaggtgtgtgccaccacacctggctaatttttttaaaattttttgtagagatggggacttgctatgttgcccagactggtctcgaactcctggcctcaagccaccaacctctcaaattgctagaattacaagcatgagccaccacacctggcctgttattccttctttatctaatgtgtgctaagcttgtgaaaaatatatgttgaggtaaatagggcaaaacattagttgataaattatgctaattaatgggaaaaatagacatgttcctctctgaacatttagaaggactctgccctacaactatcttctgtttttagaatttgtagtcactgttcttagtgccactggaaatatattcattctttgagcatgtacagggtgggctccctgttgtatttattacacttttcaaaatgccagcaagtttttgtttgtatagagttggaatgtattgttcgtgcatgcctgtgatattcatcatcaaaatatacctgtaaaaaataaactactgcttcctctccacagcttaggcctccctcttactaaaaacaatagtagtttctgtagaagtttcagtgagaaattatggttatataaataacagatatggcagaacaattttgttgtagtatttttttccgtagcatttcttaataatagctcagtttttaaaggaggggaacaataccccatgagttcaaattaattttctctactttgaggtataccttcctaattatattttacataggctgttttttttaagtttaaattctcactgttaagttgcattgagagacaattagaaatgttgtaattgtcatatctttacatgtggattatgaacaaatgaaagtttgctgtgtgattgcagttttaaattataacatttcataaatatgtcaattttagaaactcaaactctttcccatcttttgtatggataaagtttatggtttcatttctgagaatagagttggtctgctgtgctaacttcatgtttcttattccaaaggcttgattatatttttttctccagtgattaaaaatgcagcgaaaatccaatctacaagttcatatattggtatttctagacatagtctagttctaaaagaatgtacttggtgtgcatttttaagtgtttcatgtagacagattaatatatttttgtacaacattgtatttctacatttatttcaagactgtacttttcagtgactttttcaagtgcatgtgttaacagaagattgtttggaacgagagtgcagtggcttctttactagcaaagagaagtgtaatacaagtgatcatagaaggtgagaatgtgtttatactgtatatggaaacctaatgcctcttttctaaagctttgtacatttttttcgtgaaatagattaaatattttctctctaaaa

SEQ ID NO: 34057 - DNA, 245 bp, Homo sapiens
gtaaaagtcctaatttctctctcctccaggagacaaataccactttcagggaaaagatggaaatgttgaaaaggaaaaaagagagttctgcaatttcaattataaaaatattgatggtatgaccacacctcctcaacacatcttcaatgaatcagccattttaaaatatgtaaaactcactgcattcagagaattttctgatcaaaagcaattgctaataatatgataataaagatgcaagaatt

SEQ ID NO: 34058 - DNA, 391 bp, Homo sapiens
tttttttttttgcgacagagtctggctctgtcgcccaagctggagtgcagtggcgctatctcggctcactgcaagctccgcctcctgggttcacgccattctcctgcctcagcctcctgagtacctgagcctacaggcgcccgccaccatgccgggctaatttttttgtatttttagtagagacggggtttcacagtgttagccaggatggtctcgatctcctcacctccagatctgcccgcctccgcctcccaaagtgctgggatcacaggcgtgagccactgcacccggccccaattgcacatttttaaggtccacataattaacaaatcagcaagttctatttatgtttttatgcgaatctatacgtctacaaggttaagtgtagaca

SEQ ID NO: 34059 - DNA, 925 bp, Homo sapiens
agcgggccgggggcggggggcggcgggcgacggggcgggcgcaggatgagggcggccattgctggggctccgcttcggggaggaggacgctgaggaggcgccgagccgcgcagcgctgcgggggaggcgcccgcgccgacgcggggcccatggccaggaccaccagccagctgtatgacgccgtgcccatccagtccagcgtggtgttatgttcctgcccatccccatcaatggtgaggacccagactgagtccagcacgccccctggcattcctggtggcagcaggcagggccccgccatggacggcactgcagccgagcctcggcccggcgccggctccctgcagcatgcccagcctccgccgcagcctcggaagaagcggcctgaggacttcaagtttgggaaaatccttggggaaggctctttttccacggttgtcctggctcgagaactggcaacctccagagaatatgcgattaaaattctggagaagcgacatatcataaaagagaacaaggtcccctatgtaaccagagagcgggatgtcatgtcgcgcctggatcaccccttctttgttaagctttacttcacatttcaggacgacgagaagctgtatttcggccttagttatgccaaaaatggagaactacttaaatatattcgcaaaatcggttcattcgatgagacctgtacccgattttacacggctgagattgtgtctgctttagagtacttgcacggcaagggcatcattcacagggaccttaaaccggaaaacattttgttaaatgaagatatgcacatccagatcacagattttggaacagcaaaagtcttatccccagagagcaaacaagggttgttgaagcaacacgtccttggcctcgtggggcgtgtggacctggtcctctctctgggccttaa

SEQ ID NO: 34060 - DNA, 715 bp, Homo sapiens
agcgggccgggggcggggggcggcgggcgacggggcgggcgcaggatgagggcggccattgctggggctccgcttcggggaggaggacgctgaggaggcgccgagccgcgcagcgctgcgggggaggcgcccgcgccgacgcggggcccatggccaggaccaccagccagctgtatgacgccgtgcccatccagtccagcgtggtgttatgttcctgcccatccccatcaatggtgaggacccagactgagtccagcacgccccctggcattcctggtggcagcaggcagggccccgccatggacggcactgcagccgagcctcggcccggcgccggctccctgcagcatgcccagcctccgccgcagcctcggaagaagcggcctgaggacttcaagtttgggaaaatccttggggaaggctctttttccacggttgtcctggctcgagaactggcaacctccagagaatatgcgaccagggccaactcattcgtgggaacagcgcagtacgtttctccagagctgctcacggagaagtccgctgtaagagttcagacctttgggctcttggatgcataatataccagcttgtggcaggactcccaccattccgagctggaaacgagtatcttatatttcagaagatcattaagttggaatatgactttccagaaaaattcttccctaaggcaagagacctcgtggagaaactt

SEQ ID NO: 34061 - DNA, 1251 bp, Homo sapiens
agcgggccgggggcggggggcggcgggcgacggggcgggcgcaggatgagggcggccattgctggggctccgcttcggggaggaggacgctgaggaggcgccgagccgcgcagcgctgcgggggaggcgcccgcgccgacgcggggcccatggccaggaccaccagccagctgtatgacgccgtgcccatccagtccagcgtggtgttatgttcctgcccatccccatcaatggtgaggacccagactgagtccagcacgccccctggcattcctggtggcagcaggcagggccccgccatggacggcactgcagccgagcctcggcccggcgccggctccctgcagcatgcccagcctccgccgcagcctcggaagaagcggcctgaggacttcaagtttgggaaaatccttggggaaggctctttttccacggttgtcctggctcgagaactggcaacctccagagaatatgcgattaaaattctggagaagcgacatatcataaaagagaacaaggtcccctatgtaaccagagagcgggatgtcatgtcgcgcctggatcaccccttctttgttaagctttacttcacatttcaggacgacgagaagctgtatttcggccttagttatgccaaaaatggagaactacttaaatatattcgcaaaatcggttcattcgatgagacctgtacccgattttacacggctgagattgtgtctgctttagagtacttgcacggcaagggcatcattcacagggaccttaaaccggaaaacattttgttaaatgaagatatgcacatccagatcacagattttggaacagcaaaagtcttatccccagagagcaaacaagccagggccaactcattcgtgggaacagcgcagtacgtttctccagagctgctcacggagaagtccgctgtaagagttcagacctttgggctcttggatgcataatataccagcttgtggcaggactcccaccattccgagctggaaacgagtatctaaattcagaagactataaggggatatgcttccgaaaattttcttagggaggactgggggaactgggttgacgcccaccgggtgcgtagcagtcagaagaactctagaaccggtgacgcgtgggataggcgagataagaagtctcgtttttaacacacgcctgtacctgacagagaagtagaccacaaacacaggaaaaagagaagcagcgaggacacctactaaccatgcgcgtcta

SEQ ID NO: 34062 - DNA, 1954 bp, Homo sapiens
cttggctggtggcagtccctctgtcctggcacagacgcagggggagaccctgtgtcttcagacagcatggacttcaggaccctactgagagatggaatcaagagctctccggggttctttgagtggggagttgtatcggaaaccaccatcagcgcgcctgagctcgcctcgcattgttcttctgtagtgcggggggccactgccaccaccgtgaggacacgttggggtctggggagggattgttatggctgtgggtgcaccttgcacgtcttgccgacctagctttgcacgctgatcttccctccgtgcccgcttacattgttaactgggtttctgccctccctcctctccttcgtatttctgtgtctcattgacaactgttctgtagtcgctttgttgacagttgccaaactgctttccaaaaacatttccactgcaatcccggtttttggtgccagccgcagtggtgtgagtgcgctcgctttattatagtcttgccagcactgggcgtctctgtgtattgtaaacacatgcgatcatcactcttatctctccatcccccccacaattaaagatgtgccgtgctatctctgctcaggttaccttggccttgggatgagttggctggaggctcaggcagcgcgagggacaggaggagggcgaggcgctgcctggtggattagcggggagccatggcacgggcaggactcaggagaggaggccggcagctcacagcagaccgcggggctcagctggcctgccctgtgcttggggtttgtttttgagcgttgaaatgaggtccttaaaccttagtccgtgcattgagagcaaggcagctgccttgagccttacttccttttcctctttgtcgcctagtatgacgccgtgcccatccagtccagcgtggtgttatgttcctgcccatccccatcaatggtgaggacccagactgagtccagcacgccccctggcattcctggtggcagcaggcagggccccgccatggacggcactgcagccgagcctcggcccggcgccggctccctgcagcatgcccagcctccgccgcagcctcggaagaagcggcctgaggacttcaagtttgggaaaatccttggggaaggctctttttccacggttgtcctggctcgagaactggcaacctccagagaatatgcgattaaaattctggagaagcgacatatcataaaagagaacaaggtcccctatgtaaccagagagcgggatgtcatgtcgcgcctggatcaccccttctttgttaagctttacttcacatttcaggacgacgagaagctgtatttcggccttagttatgccaaaaatggagaactacttaaatatattcgcaaaatcggttcattcgatgagacctgtacccgattttacacggctgagattgtgtctgctttagagtacttgcacggcaagggcatcattcacagggaccttaaaccggaaaacattttgttaaatgaagatatgcacatccagatcacagattttggaacagcaaaagtcttatccccagagagcaaacaagccagggccaactcattcgtgggaacagcgcagtacgtttctccagagctgctcacggagaagtccgctgtaagagttcagacctttgggctcttggatgcataatataccagcttgtggcaggactcccaccattccgagctggaaacgagtatctaaattcagaagactataaggggatatgcttccgaaaattttcttagggaggactgggggaactgggttgacgcccaccgggtgcgtagcagtcagaagaactctagaaccggtgacgcgtgggataggcgagataagaagtctcgtttttaacacacgcctgtacctgacagagaagtagaccacaaacacaggaaaaagagaagcagcgaggacacctactaaccatgcgcgtcta

SEQ ID NO: 34063 - DNA, 1102 bp, Homo sapiens
cgcggcggcggactggacgcgccgtatgacgccgtgcccatccagtccagcgtggtgttatgttcctgcccatccccatcaatggtgaggacccagactgagtccagcacgccccctggcattcctggtggcagcaggcagggccccgccatggacggcactgcagccgagcctcggcccggcgccggctccctgcagcatgcccagcctccgccgcagcctcggaagaagcggcctgaggacttcaagtttgggaaaatccttggggaaggctctttttccacggttgtcctggctcgagaactggcaacctccagagaatatgcgattaaaattctggagaagcgacatatcataaaagagaacaaggtcccctatgtaaccagagagcgggatgtcatgtcgcgcctggatcaccccttctttgttaagctttacttcacatttcaggacgacgagaagctgtatttcggccttagttatgccaaaaatggagaactacttaaatatattcgcaaaatcggttcattcgatgagacctgtacccgattttacacggctgagattgtgtctgctttagagtacttgcacggcaagggcatcattcacagggaccttaaaccggaaaacattttgttaaatgaagatatgcacatccagatcacagattttggaacagcaaaagtcttatccccagagagcaaacaagccagggccaactcattcgtgggaacagcgcagtacgtttctccagagctgctcacggagaagtccgctgtaagagttcagacctttgggctcttggatgcataatataccagcttgtggcaggactcccaccattccgagctggaaacgagtatctaaattcagaagactataaggggatatgcttccgaaaattttcttagggaggactgggggaactgggttgacgcccaccgggtgcgtagcagtcagaagaactctagaaccggtgacgcgtgggataggcgagataagaagtctcgtttttaacacacgcctgtacctgacagagaagtagaccacaaacacaggaaaaagagaagcagcgaggacacctactaaccatgcgcgtcta

SEQ ID NO: 34064 - DNA, 687 bp, Homo sapiens
ggggtttgtttttgagcgttgaaatgaggtccttaaaccttagtccgtgcattgagagcaaggcagctgccttgagccttacttccttttcctctttgtcgcctagtatgacgccgtgcccatccagtccagcgtggtgttatgttcctgcccatccccatcaatggtgaggacccagactgagtccagcacgccccctggcattcctggtggcagcaggcagggccccgccatggacggcactgcagccgagcctcggcccggcgccggctccctgcagcatgcccagcctccgccgcagcctcggaagaagcggcctgaggacttcaagtttgggaaaatccttggggaaggctctttttccacggtgagtatttgctgctgctgtgtgtcaaacgtacgtgatttccttggggaggctcaccttcctcggggcttgccggagactccaagcaaggctggtgtccttccaggcaggaggtctcaggccccttgaggggtgtcacctgttgtgaaggccacttgagtctttgggggctgggtaccccccaagcagatgacgtgatgagtgtggctaaatatttaacctggttttgtagatgagaacgttagacacatctcttgatggtctgcggaggttttttctgatgtagttaatttcattttaacctggcatcagcaagttac

SEQ ID NO: 34065 - DNA, 253 bp, Homo sapiens
ttcatttttattatatctgttatgataatccatgatgagtgatctctgatgttaccatcagaattgttttggggcatcacaaactgcactcatatgagatgatgaacttaaatgatgtgtgtgttctgactgcttcactgactggctgttccctcgttttttgctttatcctgacttccctattcattgaccataacaatattgaaattaggccaattaataaccctacaatggccaataaaggttcaagtga

SEQ ID NO: 34066 - DNA, 381 bp, Homo sapiens
gggcattttttaaatctttaatttggattttttaaaagttcatttttgattccattattacattgagtataagtaaatctctttatgtatcagtgactcttagaattgactaatctgagagagagttgtaagtcaggaagcagtaagctcatcctctgtaaataaatccacttttccttttgtatatttaatgcttaaaattggtatttcataccctaaaacccattgcataatttaaattatcacacttttttagtatatgaatatatgctgtactacaaaaatattaaaaccatttgtaaaaataaaacatggaaaagtatgtgctctgtgtaaaagttttcaaataccttaaaaccaaaaattaaacacatacaacct

SEQ ID NO: 34067 - DNA, 316 bp, Homo sapiens
acccctgatgttgacctcggccccctggtgcaggtggggtcactggatgtcccggggcccattgccatcgtctcctgtccctgccctgttctgcggcagcgagtccctcagtccagcccacactgggcagggggtggggggagttttatttagaagatgaattttcatacagaaaagcctaaaaatgaaaggacaaatggcccatcattgcattgcttagatgcctgttgacattcagaggcatgtagtaaatacacatggtaaaaaaaaatgtttgagtactacagaaaagtactattaaaactatcacaaagca

SEQ ID NO: 34068 - DNA, 423 bp, Homo sapiens
cagacaccaagtaagggatcaatcagttgttgcttttattaatagtaggcatccatctgcccatttgcacgtaagaaggaaacacccaagaatgaaaagtagcttgttgtaggtcacccagccaactagcacatagtggaaattagaatccaggcactcccagcagggcactttccaccaccctgcacttttgtattcatcaggcacagtatccttactgttgtctgtaactgtctatgttcccagtgtctgactctgcagggccctagtggtataaaggtactgagacttgcctgtgttcagggcttcctgaagattaaatggctgccgaagttcttgagtttagctttagctcaaaagatactgcgtcagactctgcgttctgagtagagtctcagagaatgaaaaaagaaatacaatgaa

SEQ ID NO: 34069 - DNA, 410 bp, Homo sapiens
ttttttttatttttagtagacacagggttttgccatgttggccaggctggtctcgaactcctgacctcaggtgatccacctgcctcagccttccaaagtgctaggattacaggcgtgagccaccgcgcccggccgactgcatactctttaacccttctttgtatgacctaattttgtagcactgtttccacaaagagaacagaaagagaacgcagccattccttggcaaactcttctcagcaaaccattcctcagcaaattctttctgtaaaagggccagagagtaactattgtagactttgcaggctatataatctctgttgcaattaatcaattctgccatcagagcttgaaagcagctatagacaacctataaatgaatggacatggctgtgttccttattggaact

SEQ ID NO: 34070 - DNA, 1064 bp, Homo sapiens
cagcctaaaagaggaaacagttttgcccattcattctttaaactttcttttgagagagccagacactttgtcagtaaatagtaaagcataatatgtgaaaaacatttcaaactaattatgtagaatctttaattccaggtagtaaggaatctgtatttatttaattttttaaattatgataaaatatgcatacacataaaatgtaccattttaagtgttgtaagtgtaccattcagaggcattaagtacattcacattgttgtgcaactgttgttgctattcatctccagaacttttccatcatccgaaactgaaacactgtattcattttttaaaaaactctcaatttccctttgcccctacctcctggtaatctctgttcccttgtatgtctctatgatttgcctattttaggtaccctttataagtagaatcatgcaattatttgatctcttgtgtcttacttatttcacttagtgtaatgacttcaagggtcatccatggtatagcaagtatcagaatttctttcctttttaaacatgaataatatcctgatgtatgattatagtacattttgtttaacctattcatccattgatggacagttggattactttcactttttggctattgtgactagtactgccataagcatggatagacaaatatctgtttgaatttctggtgtcagttcttttggatatatacccagaagtaaaattgttggattgtatgaaattttgtgtttaatttttcagtatttatttactaaatataatattttattcccacctgtttaatgttgcttgcttacatctattctttttcattcctgcatgtattatatattatagctagaccagattacagatcacatgctccatattttccagccttctattgctgtagtcatctggcttgttccctttgccttcctctttccttcttgatctgtcaacacattgaccatttatcaagatctaaataccattcctttgatacataatagagttcaacggtgacagtaaattagaaaaccaaaatataattgataatgaaactcc

SEQ ID NO: 34071 - DNA, 436 bp, Homo sapiens
  misc_feature (37)..(37): n is a, c, g, or t
  misc_feature (44)..(44): n is a, c, g, or t
  misc_feature (53)..(53): n is a, c, g, or t
  misc_feature (61)..(61): n is a, c, g, or t
  misc_feature (75)..(75): n is a, c, g, or t
  misc_feature (93)..(93): n is a, c, g, or t
  misc_feature (178)..(178): n is a, c, g, or t
  misc_feature (181)..(181): n is a, c, g, or t
tactccctgggctgttggggtgttggcagtcttggcnagtaccnaagggcccnacacaggnctccataggccccnggacggaccttggctccnagtcccttcaacgttaacctgccgatgacctttgtctggctcggaaaacaaccttcctcagtggatggccagcttcccctttttnccnaatgcgaattcggcacgagcaggaatgaaaaagaatagatgtaagctagaccagattacagatcacatgctccatattttccagccttctattgctgtagtcatctggcttgttccctttgccttcctctttccttcttgatctgtcaacacattgaccatttatcaagatctaaataccattcctttgatacataatagagttcaacggtgacagtaaattagaaaaccaaaatataattgataatgaaactcc

SEQ ID NO: 34072 - DNA, 3258 bp, Homo sapiens
gaagacacggacagatgaacttaaaagagaagctttagctgccaaagattgggaaagggaaaggacaaaaaagacccctgggctacacggcgtaggtgcagggtttcctactgctgttcttttatgctgggagctgtggctgtaaccaactaggaaataacgtatgcagcagctatggctgtcagagagttgtgcttcccaagacaaaggcaagtcctgtttctttttcttttttggggagtgtccttggcaggttctgggtttggacgttattcggtgactgaggaaacagagaaaggatcctttgtggtcaatctggcaaaggatctgggactagcagagggggagctggctgcaaggggaaccagggtggtttccgatgataacaaacaatacctgctcctggattcacataccgggaatttgctcacaaatgagaaactggaccgagagaagctgtgtggccctaaagagccctgtatgctgtatttccaaattttaatggatgatccctttcagatttaccgggctgagctgagagtcagggatataaatgatcacgcgccagtatttcaggacaaagaaacagtcttaaaaatatcagaaaatacagctgaagggacagcatttagactagaaagagcacaggatccagatggaggacttaacggtatccaaaactacacgatcagccccaactcttttttccatattaacattagtggcggtgatgaaggcatgatatatccagagctagtgttggacaaagcactggatcgggaggagcagggagagctcagcttaaccctcacagcgctggatggtgggtctccatccaggtctgggacctctactgtacgcatcgttgtcttggacgtcaatgacaatgccccacagtttgcccaggctctgtatgagacccaggctccagaaaacagccccattgggttccttattgttaaggtatgggcagaagatgtagactctggagtcaacgcggaagtatcctattcattttttgatgcctcagaaaatattcgaacaacctttcaaatcaatcctttttctggggaaatctttctcagagaattgcttgattatgagttagtaaattcttacaaaataaatatacaggcaatggacggtggaggcctttctgcaagatgtagggttttagtggaagtattggacaccaatgacaatccccctgaactgatcgtatcatcattttccaactctgttgctgagaattctcctgagacgccgctggctgtttttaagattaatgacagagactctggagaaaatggaaagatggtttgctacattcaagagaatctgccattcctactaaaaccttctgtggagaatttttacatcctaattacagaaggcgcgctggacagagagatcagagccgagtacaacatcactatcaccgtcactgacttggggacacccaggctgaaaaccgagcacaacataacggtcctggtctccgacgtcaatgacaacgcccccgccttcacccaaacctcctacaccctgttcgtccgcgagaacaacagccccgccctgcacatcggcagcgtcagcgccacagacagagactcgggcaccaacgcccaggtcacctactcgctgctgccgccccaagacccgcacctgcccctcgcctccctggtctccatcaacgcggacaacggccacctgttcgccctcaggtcgctggactacgaggccctgcaggctttcgagttccgcgtgggcgccacagaccgcggctcccccgcgctgagcagagaggcgctggtgcgcgtgctggtgctggacgccaacgacaactcgcccttcgtgctgtacccgctgcagaacggctccgcgccctgcaccgagctggtgccccgggcggccgagccgggctacctggtgaccaaggtggtggcggtggacggcgactcgggccagaacgcctggctgtcgtaccagctgctcaaggccacggagcccgggctgttcggtgtgtgggcgcacaatggggaggtgcgcaccgccaggctgctgagcgagcgcgacgcagccaagcacaggctcgtggtgcttgtcaaggacaatggcgagcctcctcgctcggccaccgccacgctgcacttgctcctggtggacggcttctcccagccctacctgcctctcccggaggcggccccggcccaggcccaggccgaggccgacttgctcaccgtctacctggtggtggcgttggcctcggtgtcttcgctcttcctcctctcggtgctcctgttcgtggcggtgcggctgtgcaggaggagcagggcggcctcggtgggtcgctgctcggtgcccgagggtccttttccagggcatctggtggacgtgaggggcgctgagaccctgtcccagagctaccagtatgaggtgtgtctgacgggaggccccgggaccagtgagttcaagttcttgaaaccagttatttcggatattcaggcacagggccctgggaggaagggtgaagaaaattccaccttccgaaatagctttggatttaatattcagtaaagtctgtttttagtttcatatacttttggtgtgttacatagccatgtttctattagtttacttttaaatctcaaatttaagttattatgcaacttcaagcattattttcaagtagtatacccctgtggttttacaatgtttcatcatttttttgcattaataacaactgggtttaatttaatgagtatttttttctaaatgatagtgttaaggttttaattctttccaactgcccaaggaattaattactattatatctcattacagaaatctgaggttttgattcatttcagagcttgcatctcatgattctaatcacttctgtctatagtgtacttgctctatttaagaaggcatatctacatttccaaactcattctaacattctatatattcgtgtttgaaaaccatgtcatttatttctacatcatgtatttaaaaagaaatatttctctactactatgctcatgacaaaatgaaacaaagcatattgtgagcaatactgaacatcaataatacccttagtttatatacttattattttatctttaagcatgctacttttacttggccaatattttcttatgttaacttttgctgatgtataaaacagactatgccttataattgaaataaaattataatctgcctgaaaatgaataaaaataaaacattttgaaa

SEQ ID NO: 34073 - DNA, 600 bp, Homo sapiens
caatagggttaatgtgcagaatcctgtgggcatcaggatagggcctgaatgcaaagctccatctctcttaacctagagtaagtcgcccttctgggccaatggctcagagaggaatgaaaatgacaatgtcgactgaccagggaacatcaaagtgtttcatgatgcctagccataaaacacttcctcccattttctcctccctgctctgctaaggcagttgtgggaacatttacccagattcttaagaaatagactctttaaatcccaggcctgattccttgatgacagaaaattaaggtggaaagagctttaggaccttagatactacacgagacatattgttaagtaggaaaaaaggaagttataaaatagcgtgaataatatgataccatctgcataaaactaataatgaaaggagaagaagagggactctttgcaaaggaatcagatatttatggaggaaattaatgactgcctcagaggaagtgacagagttgtctatctgggattgtcggacagagacttcacttttggtacctgttgcattttgtgctgtgatcttctattacctaagcacagtcatcacagaaaatttagatt

SEQ ID NO: 34074 - DNA, 1756 bp, Homo sapiens
agggctggagggttcttgtggcctctggcgggcctccagccagttaggtaaaacgtgtgtgtgtgtgtgtgtgtgtgtgtgtgtacacgagcgcatgcctctctctgatcacaggtagcactcagattaccctgcctgctctgtgctttgctgcagaccatttgaccagaacgtgtgcagctcagccagccacagaactggaatttttcaggagcagggggagcatggagtttggactttgctgagcaactgaagtggagcgcagagcttgctcgcttaggagagagcatcatggatggcaaacaagggggcatggatgggagcaagcccgcggggccaagggactttcctggcatcaggcttctttcaaacccattgatgggcgatgctgtgtctgattggtctcctatgcatgaagctgcaatccacggacatcagctgtctctgaggaacctcatcagccaggggtgggctgtgaacatcatcacggcagatcatgtttccccactccatgaagcctgtcttggaggtcatctctcttgtgtgaagattttattaaagcatggagctcaggtgaatggtgtgacagcagactggcacactccactgtttaatgcttgtgtcagcggcagctgggattgtgtgaatttgcttctgcagcacggagccagcgttcaacctgagagtgatctggcatcccccatccatgaagctgctaggagaggccacgtggagtgtgtcaactctcttatagcttatgggggcaacattgaccataagatcagccacctgggcactccactctatttggcttgtgaaaaccaacagagagcctgtgtcaagaagcttctggagtcaggagcggacgtgaaccaagggaaaggtcaggattccccacttcatgcagtggccaggacagccagtgaagagctggcctgcctgctcatggattttggagcggacacccaggccaagaatgctgaaggcaaacgtcctgtggagctggtgcctccagagagccccttggcccagctcttcttggagagagaaggtgcttctttgccaaaacctaagccctaatctgttgacatcccttggggctctagtagaagggcccccttctttgatgcagttatgccgccttagaattcggaagtgttttggaatccagcagcatcataagataaccaaactcgtcctcccagaggatctgaaacagtttctcctacatctttaaatgcatctagggaatggattcacaaacgatgtgaaaacattattgagtgttgtagccactagaattttaaaatcaagttggatttatagagtttgactagttttttcgattagatttgtatttgttataaacttgtttatggagtttgactaattttttctattcaatttgtatttgttaaactcaagccagggtggaaagacactgcatacgtttgtattattagttagaaggcatgaagacttttttccctgcttggagagtgtcataagttattgttttgcatatctactgcatgccaagcactttctgcatcatctaatttagccctcacagccactgggtcaagatgtccaattttccagagtaaggatagaggagtcaaattcaaatacaggttttctgacattaacttatgtgatgacttgatcgaggcaggcttttccagcatcactgtcctggttccatctctgctatatgggaatgaaaataaagaaacatatttcttggcttgtctaa

SEQ ID NO: 34075 - DNA, 1695 bp, Homo sapiens
agggctggagggttcttgtggcctctggcgggcctccagccagttaggtaaaacgtgtgtgtgtgtgtgtgtgtgtgtgtgtgtacacgagcgcatgcctctctctgatcacaggtagcactcagattaccctgcctgctctgtgctttgctgcagaccatttgaccagaacgtgtgcagctcagccagccacagaactggaatttttcaggagcagggggagcatggagtttggactttgctgagcaactgaagtggagcgcagagcttgctcgcttaggagagagcatcatggatggcaaacaagggggcatggatgggagcaagcccgcggggccaagggactttcctggcatcaggcttctttcaaacccattgatgggcgatgctgtgtctgattggtctcctatgcatgaagctgcaatccacggacatcagctgtctctgaggaacctcatcagccaggggtgggctgtgaacatcatcacggcagatcatgtttccccactccatgaagcctgtcttggaggtcatctctcttgtgtgaagattttattaaagcatggagctcaggtgaatggtgtgacagcagactggcacactccactgtttaatgcttgtgtcagcggcagctgggattgtgtgaatttgcttctgcagcacggagccagcgttcaacctgagagtgatctggcatcccccatccatgaagctgctaggagaggccacgtggagtgtgtcaactctcttatagcttatgggggcaacattgaccataagatcagccacctgggcactccactctatttggcttgtgaaaaccaacagagagcctgtgtcaagaagcttctggagtcaggagcggacgtgaaccaagggaaaggtcaggattccccacttcatgcagtggccaggacagccagtgaagagctggcctgcctgctcatggattttggagcggacacccaggccaagaatgctgaaggcaaacgtcctgtggagctggtgcctccagagagccccttggcccagctcttcttggagagagaagggcccccttctttgatgcagttatgccgccttagaattcggaagtgttttggaatccagcagcatcataagataaccaaactcgtcctcccagaggatctgaaacagtttctcctacatctttaaatgcatctagggaatggattcacaaacgatgtgaaaacattattgagtgttgtagccactagaattttaaaatcaagttggatttatagagtttgactagttttttcgattagatttgtatttgttataaacttgtttatggagtttgactaattttttctattcaatttgtatttgttaaactcaagccagggtggaaagacactgcatacgtttgtattattagttagaaggcatgaagacttttttccctgcttggagagtgtcataagttattgttttgcatatctactgcatgccaagcactttctgcatcatctaatttagccctcacagccactgggtcaagatgtccaattttccagagtaaggatagaggagtcaaattcaaatacaggttttctgacattaacttatgtgatgacttgatcgaggcaggcttttccagcatcactgtcctggttccatctctgctatatgggaatgaaaataaagaaacatatttcttggcttgtctaa

SEQ ID NO: 34076 - DNA, 1647 bp, Homo sapiens
agggctggagggttcttgtggcctctggcgggcctccagccagttagaccatttgaccagaacgtgtgcagctcagccagccacagaactggaatttttcaggagcagggggagcatggagtttggactttgctgagcaactgaagtggagcgcagagcttgctcgcttaggagagagcatcatggatggcaaacaagggggcatggatgggagcaagcccgcggggccaagggactttcctggcatcaggcttctttcaaacccattgatgggcgatgctgtgtctgattggtctcctatgcatgaagctgcaatccacggacatcagctgtctctgaggaacctcatcagccaggggtgggctgtgaacatcatcacggcagatcatgtttccccactccatgaagcctgtcttggaggtcatctctcttgtgtgaagattttattaaagcatggagctcaggtgaatggtgtgacagcagactggcacactccactgtttaatgcttgtgtcagcggcagctgggattgtgtgaatttgcttctgcagcacggagccagcgttcaacctgagagtgatctggcatcccccatccatgaagctgctaggagaggccacgtggagtgtgtcaactctcttatagcttatgggggcaacattgaccataagatcagccacctgggcactccactctatttggcttgtgaaaaccaacagagagcctgtgtcaagaagcttctggagtcaggagcggacgtgaaccaagggaaaggtcaggattccccacttcatgcagtggccaggacagccagtgaagagctggcctgcctgctcatggattttggagcggacacccaggccaagaatgctgaaggcaaacgtcctgtggagctggtgcctccagagagccccttggcccagctcttcttggagagagaaggtgcttctttgccaaaacctaagccctaatctgttgacatcccttggggctctagtagaagggcccccttctttgatgcagttatgccgccttagaattcggaagtgttttggaatccagcagcatcataagataaccaaactcgtcctcccagaggatctgaaacagtttctcctacatctttaaatgcatctagggaatggattcacaaacgatgtgaaaacattattgagtgttgtagccactagaattttaaaatcaagttggatttatagagtttgactagttttttcgattagatttgtatttgttataaacttgtttatggagtttgactaattttttctattcaatttgtatttgttaaactcaagccagggtggaaagacactgcatacgtttgtattattagttagaaggcatgaagacttttttccctgcttggagagtgtcataagttattgttttgcatatctactgcatgccaagcactttctgcatcatctaatttagccctcacagccactgggtcaagatgtccaattttccagagtaaggatagaggagtcaaattcaaatacaggttttctgacattaacttatgtgatgacttgatcgaggcaggcttttccagcatcactgtcctggttccatctctgctatatgggaatgaaaataaagaaacatatttcttggcttgtctaa

SEQ ID NO: 34077 - DNA, 1726 bp, Homo sapiens
agggctggagggttcttgtggcctctggcgggcctccagccagttaggtaaaacgtgtgtgtgtgtgtgtgtgtgtgtgtgtgtacacgagcgcatgcctctctctgatcacaggtagcactcagattaccctgcctgctctgtgctttgctgcagaccatttgaccagaacgtgtgcagctcagccagccacagaactggaatttttcaggagcagggggagcatggagtttggactttgctgagcaactgaagtggagcgcagagcttgctcgcttaggagagagcatcatggatggcaaacaagggggcatggatgggagcaagcccgcggggccaagggactttcctggcatcaggcttctttcaaacccattgatgggcgatgctgtgtctgattggtctcctatgcatgaagctgcaatccacggacatcagctgtctctgaggaacctcatcagccaggggtgggctgtgaacatcatcacggcagatcatgtttccccactccatgaagcctgtcttggaggtcatctctcttgtgtgaagattttattaaagcatggagctcaggtgaatggtgtgacagcagactggcacactccactgtttaatgcttgtgtcagcggcagctgggattgtgtgaatttgcttctgcagcacggagccagcgttcaacctgagagtgatctggcatcccccatccatgaagctgctaggagagcttatgggggcaacattgaccataagatcagccacctgggcactccactctatttggcttgtgaaaaccaacagagagcctgtgtcaagaagcttctggagtcaggagcggacgtgaaccaagggaaaggtcaggattccccacttcatgcagtggccaggacagccagtgaagagctggcctgcctgctcatggattttggagcggacacccaggccaagaatgctgaaggcaaacgtcctgtggagctggtgcctccagagagccccttggcccagctcttcttggagagagaaggtgcttctttgccaaaacctaagccctaatctgttgacatcccttggggctctagtagaagggcccccttctttgatgcagttatgccgccttagaattcggaagtgttttggaatccagcagcatcataagataaccaaactcgtcctcccagaggatctgaaacagtttctcctacatctttaaatgcatctagggaatggattcacaaacgatgtgaaaacattattgagtgttgtagccactagaattttaaaatcaagttggatttatagagtttgactagttttttcgattagatttgtatttgttataaacttgtttatggagtttgactaattttttctattcaatttgtatttgttaaactcaagccagggtggaaagacactgcatacgtttgtattattagttagaaggcatgaagacttttttccctgcttggagagtgtcataagttattgttttgcatatctactgcatgccaagcactttctgcatcatctaatttagccctcacagccactgggtcaagatgtccaattttccagagtaaggatagaggagtcaaattcaaatacaggttttctgacattaacttatgtgatgacttgatcgaggcaggcttttccagcatcactgtcctggttccatctctgctatatgggaatgaaaataaagaaacatatttcttggcttgtctaa

SEQ ID NO: 34078 - DNA, 1669 bp, Homo sapiens
agggctggagggttcttgtggcctctggcgggcctccagccagttaggtaaaacgtgtgtgtgtgtgtgtgtgtgtgtgtgtgtacacgagcgcatgcctctctctgatcacaggtagcactcagattaccctgcctgctctgtgctttgctgcagaccatttgaccagaacgtgtgcagctcagccagccacagaactggaatttttcaggagcagggggagcatggagtttggactttgctgagcaactgaagtggagcgcagagcttgctcgcttaggagagagcatcatggatggcaaacaagggggcatggatgggagcaagcccgcggggccaagggactttcctggcatcaggcttctttcaaacccattgatgggcgatgctgtgtctgattggtctcctatgcatgaagctgcaatccacggacatcagctgtctctgaggaacctcatcagccaggggtgggctgtgaacatcatcacggcagatcatgtttccccactccatgaagcctgtcttggaggtcatctctcttgtgtgaagattttattaaagcatggagctcagcacggagccagcgttcaacctgagagtgatctggcatcccccatccatgaagctgctaggagaggccacgtggagtgtgtcaactctcttatagcttatgggggcaacattgaccataagatcagccacctgggcactccactctatttggcttgtgaaaaccaacagagagcctgtgtcaagaagcttctggagtcaggagcggacgtgaaccaagggaaaggtcaggattccccacttcatgcagtggccaggacagccagtgaagagctggcctgcctgctcatggattttggagcggacacccaggccaagaatgctgaaggcaaacgtcctgtggagctggtgcctccagagagccccttggcccagctcttcttggagagagaaggtgcttctttgccaaaacctaagccctaatctgttgacatcccttggggctctagtagaagggcccccttctttgatgcagttatgccgccttagaattcggaagtgttttggaatccagcagcatcataagataaccaaactcgtcctcccagaggatctgaaacagtttctcctacatctttaaatgcatctagggaatggattcacaaacgatgtgaaaacattattgagtgttgtagccactagaattttaaaatcaagttggatttatagagtttgactagttttttcgattagatttgtatttgttataaacttgtttatggagtttgactaattttttctattcaatttgtatttgttaaactcaagccagggtggaaagacactgcatacgtttgtattattagttagaaggcatgaagacttttttccctgcttggagagtgtcataagttattgttttgcatatctactgcatgccaagcactttctgcatcatctaatttagccctcacagccactgggtcaagatgtccaattttccagagtaaggatagaggagtcaaattcaaatacaggttttctgacattaacttatgtgatgacttgatcgaggcaggcttttccagcatcactgtcctggttccatctctgctatatgggaatgaaaataaagaaacatatttcttggcttgtctaa

SEQ ID NO: 34079 - DNA, 1702 bp, Homo sapiens
agggctggagggttcttgtggcctctggcgggcctccagccagttaggtaaaacgtgtgtgtgtgtgtgtgtgtgtgtgtgtgtacacgagcgcatgcctctctctgatcacaggtagcactcagattaccctgcctgctctgtgctttgctgcagaccatttgaccagaacgtgtgcagctcagccagccacagaactggaatttttcaggagcagggggagcatggagtttggactttgctgagcaactgaagtggagcgcagagcttgctcgcttaggagagagcatcatggatggcaaacaagggggcatggatgggagcaagcccgcggggccaagggactttcctggcatcaggcttctttcaaacccattgatgggcgatgctgtgtctgattggtctcctatgcatgaagctgcaatccacggacatcagctgtctctgaggaacctcatcagccaggggtgggctgtgaacatcatcacggcagatcatgtttccccactccatgaagcctgtcttggaggtcatctctcttgtgtgaagattttattaaagcatggagctcaggtgaatggtgtgacagcagactggcacactccactgtttaatgcttgtgtcagcggcagctgggattgtgtgaatttgcttctgcagcacggagccagcgttcaacctgagagtgatctggcatcccccatccatgaagctgctaggagaggccacgtggagtgtgtcaactctcttatagcttatgggggcaacattgaccataagatcagccacctgggcactccactctatttggcttgtgaaaaccaacagagagcctgtgtcaagaagcttctggagtcaggagcggacgtgaaccaagggaaaggtcaggattccccacttcatgcagtggccaggacagccagtgaagagctggcctgcctgctcatggattttggagcggacacccaggccaagaatgctgaaggcaaacgtcctgtggagctggtgcctccagagagccccttggcccagctcttcttggagagagaaggtgcttctttgccaaaacctaagccctaatctgttgacatcccttggggctctagtagaagggcccccttctttgatgcagttatgccgccttagaattcggaagtgttttggaatccagcagcatcataagataaccaaactcgtcctcccagaggatctgaaacagtttctcctacatctttaaatgcatctagggaatggattcacaaacgatgtgaaaacattattgagtgttgtagccactagaatttttgttataaacttgtttatggagtttgactaattttttctattcaatttgtatttgttaaactcaagccagggtggaaagacactgcatacgtttgtattattagttagaaggcatgaagacttttttccctgcttggagagtgtcataagttattgttttgcatatctactgcatgccaagcactttctgcatcatctaatttagccctcacagccactgggtcaagatgtccaattttccagagtaaggatagaggagtcaaattcaaatacaggttttctgacattaacttatgtgatgacttgatcgaggcaggcttttccagcatcactgtcctggttccatctctgctatatgggaatgaaaataaagaaacatatttcttggcttgtctaa

SEQ ID NO: 34080 - DNA, 1608 bp, Homo sapiens
agggctggagggttcttgtggcctctggcgggcctccagccagttaggtaaaacgtgtgtgtgtgtgtgtgtgtgtgtgtgtgtacacgagcgcatgcctctctctgatcacaggtagcactcagattaccctgcctgctctgtgctttgctgcagaccatttgaccagaacgtgtgcagctcagccagccacagaactggaatttttcaggagcagggggagcatggagtttggactttgctgagcaactgaagtggagcgcagagcttgctcgcttaggagagagcatcatggatggcaaacaagggggcatggatgggagcaagcccgcggggccaagggactttcctggcatcaggcttctttcaaacccattgatgggcgatgctgtgtctgattggtctcctatgcatgaagctgcaatccacggacatcagctgtctctgaggaacctcatcagccaggggtgggctgtgaacatcatcacggcagatcatgtttccccactccatgaagcctgtcttggaggtcatctctcttgtgtgaagattttattaaagcatggagctcagcacggagccagcgttcaacctgagagtgatctggcatcccccatccatgaagctgctaggagaggccacgtggagtgtgtcaactctcttatagcttatgggggcaacattgaccataagatcagccacctgggcactccactctatttggcttgtgaaaaccaacagagagcctgtgtcaagaagcttctggagtcaggagcggacgtgaaccaagggaaaggtcaggattccccacttcatgcagtggccaggacagccagtgaagagctggcctgcctgctcatggattttggagcggacacccaggccaagaatgctgaaggcaaacgtcctgtggagctggtgcctccagagagccccttggcccagctcttcttggagagagaagggcccccttctttgatgcagttatgccgccttagaattcggaagtgttttggaatccagcagcatcataagataaccaaactcgtcctcccagaggatctgaaacagtttctcctacatctttaaatgcatctagggaatggattcacaaacgatgtgaaaacattattgagtgttgtagccactagaattttaaaatcaagttggatttatagagtttgactagttttttcgattagatttgtatttgttataaacttgtttatggagtttgactaattttttctattcaatttgtatttgttaaactcaagccagggtggaaagacactgcatacgtttgtattattagttagaaggcatgaagacttttttccctgcttggagagtgtcataagttattgttttgcatatctactgcatgccaagcactttctgcatcatctaatttagccctcacagccactgggtcaagatgtccaattttccagagtaaggatagaggagtcaaattcaaatacaggttttctgacattaacttatgtgatgacttgatcgaggcaggcttttccagcatcactgtcctggttccatctctgctatatgggaatgaaaataaagaaacatatttcttggcttgtctaa

SEQ ID NO: 34081 - DNA, 1450 bp, Homo sapiens
agggctggagggttcttgtggcctctggcgggcctccagccagttaggtaaaacgtgtgtgtgtgtgtgtgtgtgtgtgtgtgtacacgagcgcatgcctctctctgatcacaggtagcactcagattaccctgcctgctctgtgctttgctgcagaccatttgaccagaacgtgtgcagctcagccagccacagaactggaatttttcaggagcagggggagcatggagtttggactttgctgagcaactgaagtggagcgcagagcttgctcgcttaggagagagcatcatggatggcaaacaagggggcatggatgggagcaagcccgcggggccaagggactttcctggcatcaggcttctttcaaacccattgatgggcgatgctgtgtctgattggtctcctatgcatgaagctgcaatccacggacatcagctgtctctgaggaacctcatcagccaggggtgggctgtgaacatcatcacggcagatcatgtttccccactccatgaagcctgtcttggaggtcatctctcttgtgtgaagattttattaaagcatggagctcaggtgaatggtgtgacagcagactggcacactccactgtttaatgcttgtgtcagcggcagctgggattgtgtgaatttgcttctgcagcacggagccagcgttcaacctgagagtgatctggcatcccccatccatgaagctgctaggagaggccacgtggagtgtgtcaactctcttatagcttatgggggcaacattgaccataagatcagccacctgggcactccactctatttggcttgtgaaaaccaacagagagcctgtgtcaagaagcttctggagtcaggagcggacgtgaaccaagggaaaggtcaggattccccacttcatgcagtggccaggacagccagtgaagagctggcctgcctgctcatggattttggagcggacacccaggccaagaatgctgaaggcaaacgtcctgtggagctggtgcctccagagagccccttggcccagctcttcttggagagagaagacggagtcacgctctgtcgcccaggttggagtgcagtggcgcgatctcggctcattgcaacctccgcctcccggaattcagataagatgtgttccccaggccagcagtccttcatgctgcttgtcataaggagaaaagaatatggagagagcagcatagatgcaaatcagcctttactcgttggaagaccattgctggcaggaacctaactgaaacagagccacagttatgaaaaaaaacagcaggagttcttccaacaatcaacaggacccgtacgattgggggccggtgcttggtcaagccggaatcccgcttgggggcgggggggtccgtggtccgggtccaccctctcgtgtttgggttacttccaccccggggtaaaacagtgggccacacttg

SEQ ID NO: 34082 - DNA, 896 bp, Homo sapiens
  misc_feature (725)..(725): n is a, c, g, or t
  misc_feature (896)..(896): n is a, c, g, or t
agggctggagggttcttgtggcctctggcgggcctccagccagttaggtaaaacgtgtgtgtgtgtgtgtgtgtgtgtgtgtgtacacgagcgcatgcctctctctgatcacaggtagcactcagattaccctgcctgctctgtgctttgctgcagaccatttgaccagaacgtgtgcagctcagccagccacagaactggaatttttcaggagcagggggagcatggagtttggactttgctgagcaactgaagtggagcgcagagcttgctcgcttaggagagagcatcatggatggcaaacaagggggcatggatgggagcaagcccgcggggccaagggactttcctggcatcaggcttctttcaaacccattgatgggcgatgctgtgtctgattggtctcctatgcatgaagctgcaatccacggacatcagctgtctctgaggaacctcatcagccaggggtgggctgtgaacatcatcacggcagatcatgtttccccactccatgaagcctgtcttggaggtcatctctcttgtgtgaagattttattaaagcatggagctcagcacggagccagcgttcaacctgagagtgatctggcatcccccatccatgaagctgctaggagagcctggccaacatggtgaaaccccatctctgcgaaaaatacaaaagtagccaggcatggtggcacacgcctgtagtctaagctacttgngaggctgagatgggagaatctcttgaacccagaaggtaaaggctgcactgagctggaatgcagtggcgcgatttcagctcactgcaagctccgctttccgggttcatgccattctcatgtctaagcctaaataaagcagattaccctcaattgcgggttggccctttcccn

SEQ ID NO: 34083 - DNA, 554 bp, Homo sapiens
ttgcacccgttaagaaattgaattggtgtgggatgggtctaggaaagaagtttaaaatagggattagtttgtaagcgattgaaattatcctaactagtttcaaagttcatgttcctggggagggcatggaggagatagaacattgagtaacattttcgatgctttatagccactccctaattccatttttcacaaaaacctgtggaatttcgtagttatttctccattttatagctgaggaatttaaggctcagagatgttaaataacatcttcagagtggtggaccccacatttgaacccaaaacatcccccttcctgtcttcattctggagcttcttttaccaggtgaatggtgtgacagcagactggcacactccactgtttaatgcttgtgtcagcggcagctgggattgtgtgaatttgcttctgcagcacggagccagcgttcaacctgagagtgatctggcatcccccatccatgaagctgctaggagaggtaaatctgttgagaatttttttttctacccactccttcaagggacatcttactgct

SEQ ID NO: 34084 - DNA, 479 bp, Homo sapiens
tcagaataattttcatgacaattagaagatagacagagactgaacatcactggaggcaaataaattgcttagaagactttgaaaaaaaagtccaaatgagagatgaagagcacccaaaccaagaaactggcagtgctcatggagagcaagaggatgtgatacagagatccacattaggtgtctcctcatcagagattactaatcttatagtccttaatcatctctcaaacttcagcttaaatctcagtttccaaagaaggtgcatgataccactgtgaacacaaaaccatgacttcaattgagaacaggagaaaaatcccccttccattccaagacttcatgtgtgaataagacaaagactttgtactctttgctgattttttgacaatagttatacacaactgtgactcttgccactaaaagatgccagtgtcctctgaatatcaaattaaaaatttatgcactttcagtagaaaaat

SEQ ID NO: 34085 - DNA, 370 bp, Homo sapiens
ggctgaacacagttttatgcttaggcttacataattaaggttgtaatgttatttctggatctttgaggcattagtagagatcactgatgaagtaaactgacaaacataactccttttctttggaaaagatggatgctgtctgctaaactaatcaagttatagagccttaggccgggtgtgtcggctcatgcctgtaatcccggcactttgggaggccaaggtgggcggatcatgaggtcaggagtttaagatcatcctggccaacatggtgaaaccccatctctactaaacacacacacacacacacacacacacacacacacacacacacacgccaggcatggtggtgggcatctgtaatcccagctac

SEQ ID NO: 34086 - DNA, 260 bp, Homo sapiens
agaaaatcagtgggtgagctaatatctttgggaaagggaaggttaggatttgaaaggacaatctctcaatgttatataatagcattcacatagaaatactgatgtacagatcaaacactcttagatattacaagggaaacttggagggttcaaagatttttaaggttaaaccacctaatggaaatatttccaacatttagtgaggtcagtcacaagtaatcgccatagatcaagcaagataccaaagggatgccaggaat

SEQ ID NO: 34087 - DNA, 841 bp, Homo sapiens
ttgctgtggctagcagaaaaagaaacatgtccaagaacaaattgagacaacttaggaacaacttaggaaccaaaaaagtattcccaaatatgtatgaaattcttggaggaaaaccaaaagatatgtgcttactataaggctgccaaatacgacgtatcttgaaacaggctggaagtttcaactaaattagtctgccaacaaagcagctggccaaggaagcaggctctaattcaacctgaaaatcttgcatgatagccaatgctggagaagtgacatatcccttaataggagaggaagtcccaaggacagcatccagatttcttttcccagttcaccttggctaggccatagtgagatcctttaaagtccatatctttgtaaatttaattttagactctttccatagtggataggggctcaatatttaaaggagaaaagggagaaagaaagggagaggagaaaggagaagtaatactgctaaccctaacctagatatatataaaattgcccttgtttacaagaaaagaaccacaaacataggtattaatcacaaggagcttacattttcattgtggaaagggcaccatgaatatgattcaaatgaagacatacaaaaaactcataagcagaggcacacactcactccactccatcccattaagggatttggaagcagaagaaggtggattttttttcactaacacttaagattttcctggccaggcgcagtgctcaagcctgtaatcctagcactttaggaggctgaggcgggaggacagcttgagcccaggagttaagacgccagcctggacaacatggtgagaactcatctttaaaaaaa

SEQ ID NO: 34088 - DNA, 223 bp, Homo sapiens
tctaaaccaagacgtcttcaactttagcctgcatatgcatcacctggaaatcgaggtgtagggtgggccctgagtttgcctttctaaggagagatgctaacaagatctggaccatcagccactcaagacctttaacatgtttcatacctgtcgacaccctgatacaccttggcctctgaaatactttacaagctttgctaaagaacacgttcataatgtacca

SEQ ID NO: 34089 - DNA, 1240 bp, Homo sapiens
ctccttgtcaggaagctcaatattttgtctccaacagacatttttaatgttattaaacaaaagtagtttgtgatgccatgagtcatcaaagattagattagtagttcttaatcccatcaggccagataactgcttttttgaataaataatttgtagtctgtacacttctgaagtgaacttcattgatgactgccacacacaaatttctaaaaaaggcaccaccacaggtacgcacacatgcatgcacgcgcaggcttggagaaagccttactgcttccattgagaaatagtggtctggaataaatcatgctaaaataatcctatttttttaataggattgctggagtggtcaaggacattgtagccagaacaatacaggcaaccttttgagctaatttgtggatcatggtagaggaacatggctttttagctgcatgagtgaaaggtcattcccaaagtaagttttccctggatgtttgttacctgtgagacaagtatgcagagagtgctgtaagattctttacttggccccgtcctatttaacagtttatattaatgtagatggtcttgctttgtaatttatagctgattcaaaacgacaagtagaagttcactagatttcaggatttgagaagatattttgatgttaaacttaacagaaacttaaactgtaaaagttaaataaagataaataggaagttctgtactttgcttaccaacctcaattccagggtttgttagattggttaattagagttcataaaaacaatcctgtgttttagatgattggtgtgaactcttgaggtgtcatgttcttccccacttaatagaatacttaatagatgttcagagtggtggagcttcatttttgaggggagtttactagaagggagaatggtctggaaatcatgaagaacagtaaagggaagattagtatttagctgggttaaaagagacttgcgattatagttattttcagatatttaaagaatattttttggaagtaggatttgatttattttatataggcctagaatataggggatgagaaggatataggacatcatatttggatttcattatggaaatttttttcctgtggaaagataagagaatgtggccaggcacaatggctcacacctgtaatcccagctctttgggaggctaaggtgggaaggttgcttaaagccaggagtttgagaccagcctgggcaacaaagtgagaccctgtttctacaaa

SEQ ID NO: 34090 - DNA, 310 bp, Homo sapiens
ataaattattatttattatttcctgaacataattaagaaaaatgtgtgtgttcacttacaaataacctttaaaaggttctgaagagataaagcaaaacatcgtatgtaaacaattgatgattcaaataatgttagagaaagaaggtctgaaacttcctatttcttattttcaagttcctatgttaaagctgatctgattaccaaacatttgttcactgatctttcagagtttcaagctgtatttctcaacttaccaatattcatgagtgcttttgattcactgtgctgaaaaccagaacaaaggaaggac

SEQ ID NO: 34091 - DNA, 368 bp, Homo sapiens
tattaaatataagatctagtaataagtctattactttttctttttttttcaagacagagtcttactctgtcacccaggctgagtgcagtggcaccatctcagctcattgcagcctccacctactgggttcaaacgattcttatgcctcaagcctcccaagcagctgggaatacaggcatagaccaccacacccagctgattttttgtattttcataaagagggtggtgtcgaactcctgagctcaggcagtctgcctgcctcagcctcccaaagtgctaggattacaggcatgagcgaccatgcctggccttttctgtgcttttaaagtagtgaggattgaagacaatattttaagacatctgcaaca

SEQ ID NO: 34092 - DNA, 416 bp, Homo sapiens
gaaattcattatcatctgagtcctcatttcttgactgatagaatggggataattatatccacctcaaattatgggaaatcaaatggggacaaagctatagtagggttctgaaatgcattgctaaaatgtttaggatcattattattaatattgttttgaaatatcaagtcagaagactttactttctactgttaatgtcaactgatccctaatatactgagatcctttcccctggctcttttgtattattttaaaattaaattaaattattaaaaaatagagatgaagtctcactatgttgcccatgctggtctcgaactcctgggctgaagtgatcctacttggcttcccaaagtgccaggattgcaggtgtgagccaatgtgcttggcctcttctgtattcttgacaatgagaa

SEQ ID NO: 34093 - DNA, 452 bp, Homo sapiens
ttatttctcataattctggaggctgggaagtccaagatcaaaatgtcagcagattcagtgtctggtaaaggcatgtttcctggttcataggtggtaccttctcactgtgtcttcacatagtggaaggggcaaggcagctctctggggcctcttttattaggtcaataatcccatctgtgagcgttctgccctcatgacctaatcacctctccaagcccccagctccccacaccatagcgctgctaagttttaacacatgaattttagagtgacacaaatattcagaccatagaactgttttccccgaacacttcatcttgaggttgttctaaactgaaagttcacatttcattagtacccctgctttactgtgacagacatatagtttgtcatacataaaacccacaaactcaagaaaaaaagaaagcacccatggaaatatataattaaca

SEQ ID NO: 34094 - DNA, 432 bp, Homo sapiens
tgagacagagtctcactctttcgcccaggctggagtgaagtgctgctatcttggttcactgcaaactccgccctctgggttcaagtgattctcctggctcagcctcccaagcggctgggattacaggtgtccaccaccatgcccagctaatttttgtatttttagtagaggcgggatttcaccatgttggccaggctggtctcaaacacctgacctcaggtgatccacctgtctcggcatcccaaagtgttgggattaccacacctggccacaaatgtgcattataaaggaatgtgaaagtaatgattactcacccccaacccactattgaacttctcaatgaaaaagacttcagggagataaggcacatgcatcctatggcttccaacacctagaaaagcaagtgtcccctggagggagtgtcccatggag

SEQ ID NO: 34095 - DNA, 362 bp, Homo sapiens
tcagttggatatctatacagaataccaggaacccgacccctatttcatatcatacacaaaaattaactagggctggatcatagacttaaaagtccaaagacagaacaataactcttttaaaacaaaacataggtaaatatctcaatgaccttagaacagataaagagttcttaacaggatgcaaactgcaccaccataaaagaaaataataaattatgttttatgaaaattcaatcttttcattaaaaaacaccatttagaaaagataaggacaaactgcagagagggagaagatatttgttacatgtgtatccaacaagggacttgtatccagaacatctaaagaagttctacaactcaaa

SEQ ID NO: 34096 - DNA, 449 bp, Homo sapiens
ttccagattatggactaagtgtgggcattatacaaattgagaggagcggtccctatgttttccaggtatatattgttatgacataaagttgatttcagtaagtctggaaagacttaagtagatagcctggataaacagagctaggaggcagggaaccttggtctcagtgcagattttattgctgaactttcttcagtcatcttagtcaaatcctgtagcatctctggacctcaattcttacctgtcaatgagaataaaaacacctatcttttctaacttctacagtttctgcctgagaaaatttaaatatgtgccataaacatagataacattgctaaagacggcttacctctttttatttattctttaaaataatctgcaaacactaccagtttttcagctgcttttggtttcaaaaatgtctcagagcaaagagaattaaaaaaaaa

SEQ ID NO: 34097 - DNA, 577 bp, Homo sapiens
tattgcaaaaaccatagtgtatatagggtttggtactatccacagtttcagtcatccactgagggggtcttggaatgtatcccctttaaataagagggaactgctatgtatgaaaaatgctcaggatcaccagggaaatgcaaattaagatcacagtgagataattacctcacacctgttaggatggctttcaccaaaaagacaaaagatacgtgtaggcaaggatgtggaggaaagagaactcttgtatacgtaaaaaaaaaaaaaaaaaaaattctcctgacttttatttgaattcattatatgttgcctagattgcgatatataatgcccatttattattccattccctctgtgatcaccaattaccaaaatagtgattcttccttatttgaggcctctgacagaaaaaactagaatgagatttgacatcacaaccaacacatccccaaagacataggttaaaaacatattgataaggatcaatatgtatattaaaacagtatgtatatcaaaacattatgttgtatatactttaaatatataaatttttattaattatactttagtaaagctg

SEQ ID NO: 34098 - DNA, 388 bp, Homo sapiens
cacctatgacatacccacagccaacataatactgaatggggaaaagttgaaagcatcccctttgggaactgggacaagacaaggatgcctactttcaccactcctcttcaacatagaactggaagtcctaaccagagcaatcagacaagagaaagaaatcaagggcatccaaattggtaaagacgaagtcaaactgtcactatttgatgatatgattttttaccttgaaaaccctaaggactcctccagaaagctcctagaactgataaaagaattcagcagagttcccatatacaagattaatgtacacaaatcagtagcttttctgtacaccaacagcgaccaagcagagaatcaagaactccaccacttttacaatagctgcaaa

SEQ ID NO: 34099 - DNA, 494 bp, Homo sapiens
ctctttttttcaaaaattaattgaccatatttgtgtgagtctgtttcttggatatctttccattgatctttgtgtctgtcctttagccaataccatgttgccttgagttctgtataataagtcttgaatttgataatgtgagtcctccaactttgttcttaaaattgtttggctattctggttcctttgcactttaatgtatattttataatccgcttgttgatgtctacggaaagtgtgctagaattttagttaggattgtgttgtgtctatagatcaaattgtgaagaagtcacatcttagcaatacttagtttttgattccatgaacacaatataatctaatcagcacatagatcctgtacatatcttactggatttatacccaagtatgaactgttttctggtttttttttgtgtgtgtgtgtgggggtggggggacatgtgctatttgaaatggtatattcaattgttcattgctggtatatggaaaaa

SEQ ID NO: 34100 - DNA, 424 bp, Homo sapiens
aataaataaaataagtaaataaaataaataaaaaaggatgtcaggaattcgagacctgcctgaccaacatggagaaaccccgtctctactaaaaaagaaatacaaaattagccaggcatgatggcacatgcttgtaatcccagctagtcgggaggctgaagcaggagaattgcttgaacttgggaggcggaggttgcggtgagccaaggttgcgccaagattgtgccactgcgctccaacctaggcaataagagcgaaagtccatccccaaaaaaaaaaaagtgatctgaggaaaggcaaaggcctgggctcagaaggtgggatagagagggtggatgtgagagtgtggccagagcgggacacacagcagtggcttggggatgagaaggaagggagaatctcaacggagatgcagtggctttgg

SEQ ID NO: 34101 - DNA, 123 bp, Homo sapiens
tttgactatatctatcaaaagctaaaatgtacttccctttgaaccagtttgaaccagcaattctactgcatgtattggataaatttgcacaagtttcaaatatatatgcaactttgtaatagc

SEQ ID NO: 34102 - DNA, 923 bp, Homo sapiens
ggctaattgaacactaactacagtgatcaaatttgcattttccctgtcaaatgtgccactctgtgaatagctaaattaacttagtcttcctggaatatacccaaatgttgagaaccatctaggacctttcaaaaccatttggtctgttctgtcttaagataagcagaataaatacgtccctgaaatcaaaggaaaactaattgtagtacctctttccagctttaagtcatcaaagtttgaccatctcaagtatgttctaatggggttcattattttgtttgttctacatctgagatacttttacatttgcattgttaatatccatttttcaaaatttattgacatgtctatttattttcaagaatagtaacttattagcctctcctttcaaagcacaaaagctacacatggccaccagaacaagtcaaacaacacagaagtatatcacggaagagctaactcaggccccttctcctcttaaatttctgtcttcctccttaaccagcattaacaatttggtgtttattcttcaatacccatctaagctcatataaaatacacaagtatttataaatgtggtgaacattttctcataaaaatgagatcacactatgttaattctcttcttaacatttaaaaaaaaaatctgtcatctgggcatattggctcactcctgtaatcccagcactttgggaggacaaggcaggaggatcgtctgagcccaggagtttgagaccagcctggacaacatagggagaccctcatctctacaaaaactacaaaactcacacctgtagtcccagatgcttgcttgggaggttgagttagtattgcttgagcctgggagtttgaagctgcagtgagctgtgattggaccattggactctaacctggatgacagagaaacaccctcaaaaaaaaaa

SEQ ID NO: 34103 - DNA, 266 bp, Homo sapiens
gggtagtagagttagagattccatcctcttgaaagcacagttgccccgggaagagtaaaagggagcagaaggcgtaagccaggcacggctgttttcactgttgttcaccttttgtatccttacgaatatgaagatgtactaagttgtgtgttttgcgtgcatatataattttaagctacttgagttgtaggtccctccagtctgtgattcagtttgagatgggactgtatgggaattaacagtgccttgtcttcttaaggagtgat

SEQ ID NO: 34104 - DNA, 1167 bp, Homo sapiens
aactctgggatttctaaggaaggatgcagtgcagagacaggtcccagaggagacaagagctgagagaccatccaaactgggaccaccttgtcactagacttcaaattttcaatattgatagagtgttttctaagagtcaggccctttgctgagtgctatgtgcagcaggatcaaaggcagccaggaggtagaggagtcttgaggtacatcagtcattggagttgaagagcagagattcaaaggaaagttggaactggagctttaaaggagatgtgaagtgggtgactcaacctctgactcagaaaaattgatacctgcagaagaaaaaacccggcgggcttaggactcccagctgagtgttgtatcctccatccctttccacctggtcccttcattttctacccctcacagttccctaacgagaaggtggtccacccaacagacaacgctgcctcagatggttatcaagagggtaccctaagaaagaaatcatctcaccctctctttgtccccatttgtcaagcagcagtgaggccgagccaggggatggtgaaagtggaaggaggtgggagttgggcatcgggtgtgaagatgctcttgaaaggggttttaataaccacttgctaccaggccagtgaacacttaccatagttgatgccttttgagcatgttgcattgtaaactgtccctgaaattactgtgcacttggcttatgggatgaaacatcctcctagttctcttgtctctcagcttctctgaagtctcattgagcaccttctcttcaatttcttttacacagtaagaataggatcagctgtgctaaactaacaaatacccagatatccaggtttggctcatgctacacgtccaaagtaagtcatccaggaagctctgctcatcatcgtactcaggaagccaggctgacagtctttctcctgcacatctgctcccagaacctccccagcagaatgaagggaacctaagaatttattcactggcttttaatgatccctcctagaaagaacacacttctcgcatttcattttccaatgtaaatcatatggctgcaactaacttcaaataagtgggaatacttgaaggtggaaaacatttaagaagtacatactaaataaataataaaatacttctacaagagaaaaaaaaaaa

SEQ ID NO: 34105 - DNA, 1042 bp, Homo sapiens
ttttaatatcctacctcttctttatctagaacattatgaattcaatatttcacatacattgtaggacaaattactgttactctgatcatgatatagcaacatttaagtcagtttccccaaatattcattcaacaaatacttattgagcaactattgagtgctagccccctctctgttcatcagggatttagtagtaacaaagcagacaaatacatacacacagactatgtcaggtggtgttcagagctgtgaaggagagtcagagtgagggaatcaagggtgatgggtgctttttcagacagggcctttctctattaaacaggcttccagtggaagactctgctaatgtttagcagataaccaaaatgcatcagttagaaaaaaatatgatgagaatgagggactggttataggaatgcaattgggcacaaatgtgggaagagctgggtagtgaagctctagaagggagaggtagagaattggaagaagaagcactggtacaggtagacaattcagaacttgcacagaatctgagaagctgaagtaggactgtgattgggagcttgtggagaggtctatggaaattatcatgctgctgaaattgttgcctctatttatctgctacccttctggtccgtggccaagatcctggtgggtgggcttggagccagccttcgtcagcaggcctgcggtaagaaagatgggatggacacacagtggtggagatcaaggatcagctgcagcaggctgggtccctctgcatctgtccatcactgcgactgatggcaatgactgagtataacacctttcttcatggtcaactctacccaggaaccacgtagggaaggaaattctggaaaacagctcccagccttagccaacttgacatatcataatccaacagaactcaacctctaccaacttggaaatcatgtacatttgtcaggactgtatttaatttccacatagagagaaagcaaaattatacttttgaccaaactaatagaattatccattaaacaaacaaaactgtgaaaaaagt

SEQ ID NO: 34106 - DNA, 426 bp, Homo sapiens
ttgtgggggcactggggggacatgggaccactcactctgtcacccaggctgaagtacagtgatgaaatcagagctcattgcagcttcaaactcctgggctcaagagatcctcctgcctcagcctcctgagtagctaggactgcaactgcgtgccaccacacccagctttttatttttttgtagagataggatcttgctatgttgcccagactagtctcaaattcctggcctcaagcgatcttcccacctcggcctctcaacttgctgggatgacaggcatgagccattgtgtctggcctatattttcatatgcaaagatcagacacttctaacaacatggtctgccttttttatttaagttaaaaatgtgattcttacaaaggaacaatttaggttatattctttagaaggcaaacaatccttatt

SEQ ID NO: 34107 - DNA, 1116 bp, Homo sapiens
  misc_feature (304)..(304): n is a, c, g, or t
cgtgggatgttagcggtgggggcaatggagggcacccggcagagcgcattcctgctcagcagccctcccctggccgccctgcacagcatggccgagatgaagaccccgctgtaccctgccgcgtatcccccgctgcctgccggccccccctcctcctcgtcctcgtcgtcgtcctcctcgtcgccctccccgcctctgggcacccacaacccaggcggcctgaagcccccggccacgggggggctctcatccctcggcagccccccgcagcagctctcggccgccaccccacacggcatcaacnatatcctgagccggccctccatgcccgtggcctcgggggccgccctgccctccgcctcgccctccggttcctcctcctcctcttcctcgtccgcctctgcctcctccgcctctgccgccgccgcggctgctgccgcggccgcagccgccgcctcatccccggcggggctgctggccggactgccacgctttagcagcctgagcccgccgccgccgccgcccgggctctacttcagccccagcgccgcggccgtggccgccgtgggccggtaccccaagccgctggctgagctgcctggccggacgcccatcttctggcccggagtgatgcagagcccgccctggagggacgcacgcctggcctgtacccctcatcaaggatccattttgttggacaaagacgggaagagaaaacacacgagacccactttttccggacagcagatcttcgccctggagaagactttcgaacaaacaaaatacttggcggggcccgagagggctcgtttggcctattcgttggggatgacagagagtcaggtcaaggtctggttccagaaccgccggaccaagtggaggaagaagcacgctgccgagatggccacggccaagaagaagcaggactcggagacagagcgcctcaagggggcctcggagaacgaggaagaggacgacgactacaataagcctctggatcccaactcggacgacgagaaaatcacgcagctgttgaagaagcacaagtccagcagcggcggcggcggcggcctcctactgcacgcgtccgagccggagagctcatcctgaacgccg

SEQ ID NO: 34108 - DNA, 724 bp, Homo sapiens
tttttttttttaaaaaacaatgaaccatgaatgccattaatgctttttctatttaaattggtagagcctctcaagatagcaagagagcatattgtggtgttgtagaaagaatatggtctttggagtcagccttatttaaaggtccaatctgagtaatttcagaaaagttgatttgacacaattagttaagtgttctcttctacgaaatagtgataatgttgtccacttttctgagttgcgacaattagaggttatatatgtaagctacctggaacagagtcagtgctctattcacctggatgaatggatcaatgacattataaagactctataaatttgcaattccagaaaagccaaatactttcccttttgcattttgcatgtatgtgcatgaatatatggctccaaagacaattatgaaggagagatgccacaaaatatgatgctatgttctagatgcatagtggcacgggattgcaaaatagttccaattgcactaagaataataaagtcgagaaaatagagatcctacagaaatattttatcttatggagccaggaatgggaatttaaatttaactttgcaattactgacaggaatctatgaatattttatgtgattccaggaaagtgagaatttgctaactacatcttaaattacctgacacaggtgaattccctcagcaagttcatggtcgacgcggccgcgaatttagtagtagaag

SEQ ID NO: 34109 - DNA, 133 bp, Homo sapiens
ccattcatcgaaccttcctgagacaacggaattctggcgatggaacacatgtcagtggtggccaggggacaggtgtggctatgaaggggtggctgccttgtgatgattcaatatgctgtttttcctttgtggt

SEQ ID NO: 34110 - DNA, 541 bp, Homo sapiens
ctcctatccatggtgccttgtgtcctggctgtggcaacctgcatgctgaactgagtccaacagcaggcaccaaggctatgacatccactgtgggtcccagcacagtggctataaagatcagtgaagataatatggtgagaatgaaggcaggcaagctaaagcagtgatgggtgaccttccttgggcccagaagccccctgcccccccaacctgggcgttccagagccacatgtcatacacaagaaatggatttctgtctccagccgctggcttcccctagttatagagaatacaaattgcaaaacgatgcaatgataagatgacccacagccagagcctggggatgagccaaggcggtgcttttagaggcctgcagagacacaccagtctgattccagggtcagcggcagctggcagtcagggagagggttccttggcctccactgtcccatttctggctcctcggtcttagcccagagacagcccaggtcccaggttgaactggcaggagcctgtggccccaataagtgacttggtgtca

SEQ ID NO: 34111 - DNA, 546 bp, Homo sapiens
aaaaatgatcagggtggtggtctgcataaaccctgaagttccattctgtgctcagaatgggcagtaggaatgctgaggttttaaatttgggatcaaggccaggtggggtggcttacttctgtaatcccagcactttgggaggccgaagtgggaggatcacttgaggccagaagcccgagaccagcctgggtaacatcatgagtacccgtctctacaaaacaatacaaaaattagccaggtgtggtggcgggcacctgtagtcctagctgctcaggaggctgaggtggaaggatcagttgaggccaggagttggaggctgccgtgagctatgattgtgccgttgcactccagcctaggtggcagagtgagagcggcatgtttccccacctcccccagcgtgctgtgctgtagctgtgctgggcggcacactgtgggcgcaggccaggcctcttgctttctcagttcctcgcaatactactaattcctccaggccagctcagtggtgcctccgctggcagccctggcagagctgatgcctccgctggg

SEQ ID NO: 34112 - DNA, 662 bp, Homo sapiens
tggactagaatctagacactgaaatgcacatacatgctttatgtaatgcagaatgcatttattggagaactcataaacatcctataaaattttcttccctgagatgcaactataaaacttggccttattctgagaatgcttaacatagatttcatccatactgtaacactgattttgttgttgttgtccttaaagcagctcagcttcctgaggtagtgttatgtctctgtggcaacaaggtgaaaatgtctagcttattttgtcaaagtcaacaataatccacagactccagacctcaatatctgtcccaatttgccattttactttagtgctccaaaaatatggcttatagaaaaaacaataggtgttttaaagagatttacctgaatgatatagagaatgtctagatattttctggctatcaggtaaaacctacccttcaagatggtagaatatataatagcatacaaaacctctatttacctaataagtactttaatttacagaaaaaaaatgtaaatgtaagtgtcggatttagtgccaagtgcagggaatctgaaaaatgtatactaggtctctgctctccgtaattctgccttcatgggtcctagccccatccctcaggaggttgtcctaagatcgtcagtatcaggatgctgtca

SEQ ID NO: 34113 - DNA, 612 bp, Homo sapiens
ctcagctgaaatcagccattttgcaggcagtttttcagaagctggatgaaaggattcattctgtatttacatcagcctgacatattctgtatttatatcagcctgacatttctgattttctaggactttttagtttttttcctgccgtacagtgtattgactaccatttccagctctttcagttggcaaacttgataatagttttagttaaataactagtttgtgttttcgattttaaaaaatgttgtgaagatcagtattagttaggaagccctgcagcatatctgtagaaccttctttccaggttgacctttatcttatgccagactctttgggtaaacttattcaagcattcgttaatttgttgaattatattatcctctagctcacctttctcagtcttgtctacagagatgttttgagacacattttcagacacctgccaaaatccttcccctgatgtaaggctgcgaatctataatatcaaaaaaggaaactaggtttatttggtataacttgctcttattataagcatgctgctgtctgttgacatcatttcccatcctcagtgccaataaaaccatgaatgtaggatttgtcggaaactaatat

SEQ ID NO: 34114 - DNA, 346 bp, Homo sapiens
gtccttctttcactcagtatattgactttgagatccatttatgtcatagcatgtatcaataattcaccatttttttcgctgcatagtattccactgtatagacatactataatttgtttatccattcacttaaggatgggcatttagactgtttacaatttttagcaatacaaataaagtagcagtgagcatctgtgcacaagtctttataaaaatatggccacgtgcggtggctcacgcctgtaatcccagcactttgggaggccaaggggggtggatcacctgaggttaggagttcaagaccagcctggctaacacggtgaaaccttgtctctactcaaaatac

SEQ ID NO: 34115 - DNA, 324 bp, Homo sapiens
ttttttttaagagatgggggtctcactatgttgcccaggctgtctcaaactcctgggctcgagcaatcctcctgcctcagcctcccaaagcactgggattacaggcatgtgcctcagaaattcttgatacggcaaaactaaggtgacagaaagcagatccagggttgcctagggctgaggtagagaaggcacacgtaaaagggcataaaggaaatctggggtgataaaaatactctatgacttgattgtggtggtgactataagactctatacatttggcaggacgcgatggctcacgcctgtaatcccagcactttgggaggc

SEQ ID NO: 34116 - DNA, 318 bp, Homo sapiens
gtaaactcttccttttgaactatggcatacctgagtggacaggcaagttgcagggatggggacatttgacacagagaacttaggaagttccaggaaaccagtatttctgaaactgtagtcaattctgttttgattttttgctacattgatgtaatacctatttcattgttgacctaatattgttctttaagtgggagtgcttgttctttttgaagggacactcttcgtttaataaagaacaagtataattcgcccaaaatagtaagtaaccataagcgttgatatgtaaactctagtgtttgtgtcctacataaagcg

SEQ ID NO: 34117 - DNA, 346 bp, Homo sapiens
gctgcaaccccccgggctcacagcacactcttaaggccagtgctaccagctcccttgggtggatagaggagctacggctcagaagcatgcccacagctcccccaggaccctgaggccagcctgtggcagggcctgtgatttgaacccctctacaaggcttcaaatcagtgctgtttgtcctggcctcataaaacctggctgcccagttgggattggtgtcatctgccttgctgaactgggcactccttgggaagagggtgggtgctgcgagaaggcggtggatcctggctgtgcaaccttcgcaggtggctgaacctctctgtgtctcagtttgctcatctgcaaa

SEQ ID NO: 34118 - DNA, 476 bp, Homo sapiens
gaaaatgagccagtgggcaggaaggaaccccaaattctgtatataaactctgcctaaatctctggatgatccctgatctactcatgtgtagggcagtttccaagtaactaaaagagctgaaccaaaatatgacccactgcctaaaagacagaatttgctgttttgagtccaaccaagttatacagatctgtgggacagtatcattggggctaacatattaatatgtgtaagagtctgggacaactccccactctccgcaaaaaagagcaaagcatattcaatctaaaaacaaccacaagtaggtatatcacagttgaagacgaagatacttgaaatggctagagaaaaatgaaactttacataaagaagaacaataaattggatgaccacagacatcttcatattgtactgcagaaacaaaagagaacagagacaataaaacaacatctttaaagagctcaaatacaaagctgcca

SEQ ID NO: 34119 - DNA, 1499 bp, Homo sapiens
ggcttaaaaagatgaatcgagatgcagtgtgtaggaagcatgggcaagggatgaggaacgccactttgaaaattactaaaactaaagcaagtgactaagagtgtgaatgaccctggctgcaatgactacgcctgctgggcttctattaaaattagactctatttcctgagcacccacaaatggacctgacaaagggaagacacagatgtactgcgtgatgaggaaagcctatcaggattaaaatatggctataactcagcctctccagagtgcagccaccatgacctccgcagattgatgatggaagaaaagaaaaccaggatatcctgtgctctggcttccctggaccatggatggaggacagcccatcccctcatccctagtcccccttgggaacgtatcagcagattctagcatgtccctggagcagaaaatgacatttgtttttgtgattctgttgtttattttcttgggcattctcattgtccggtgcttccggattcttttggatccatatcgaagcatgccaacctctacctgggctgatggacttgaaggcctggagaaagggcagttcgaccatgcccttgcttaggagggatggtgtgggatctcctcctgaggagatgaagtgctttgtgtcttggtgaggattccctttatttagtgttctcaacaaatcaaatttaaacaatatttggtcccaggaccataatccattattccataaatatgcagttgggttaaagacatttgaggatgttggaaatggacacttatataactaatccaacataagaaggtttaaatttttatgtttgctcaatgaatgagtactcttaaaattgtgtgattgtgaaaccaagagcgttaatactgacatagatttgccatcaaacaaaacaccacctgatctgactaaagaataaaagactagaaaggatctcatatgaatctggtgacaaggccaggaagagatttccttgctctaattatgtctatatttgttttatttcatgggcacctatctgggtcctgagcagaatgaggaagattgcgctgaatggacccaaagtagtttcttgttttctcctaaagcagggagctttgggaagcaatggaaaagcttaaaagagatgattctgtccttggtaaatgtgagtgagaatagcgttttgtttttcaagtaaaacttaattcaaaggctacaaagttttaaaaactatttaccaagccaactacattatatgtattcatattaataacatgtgtagaggtagctatacattacttgaatttacactttacacaaatgatttaaaaaataggttgcaagtgcagcttaaagttttttttcaatgaaaagttaattgtttagaggagaagacttttatagtcttcagaggaatgtgtatttatgattgtatatagtcaccaaataaaacttttcaagaaacaaagacacaagaaagcagaataagcaaacaacaagagggggc

SEQ ID NO: 34120 - DNA, 187 bp, Homo sapiens
gctttagaaggcagcgtttcccttagaggagcacagtgggctgggcagcaacagtggatgacgtgcgtattacggcactgctgggtatcatcataaccaacatgaacttgtggcttgttcttacaatgcgccagacgtctcatgaaacattcaacgtttcttaattcaccctcacaaccagaatgag

SEQ ID NO: 34121 - DNA, 516 bp, Homo sapiens
gggccccgtggacacagcctggagcgccgtccgcatcggcctgtacgcccagcacctggaccactggctgcgctacttccccctgtcccacttcctgttcgtcagcggggagcgtctggtcagcgacccggccggagaggtcggccgcgtgcaggacttcctgggcctgaaacgggtcgtcacggacaagcacttctacttcaacgccaccaagggcttcccctgcctcaagaaggcccagggcggcagccgtccccgctgcctgggcaagtccaagggccggccacacccacgcgtgccccaggccgtggtccggcgcctgcaggagttctaccggcccttcaaccgcaggttctaccagatgacgggccaggacttcggctggggctgagcggcaccctggggatgctcagcaccttgattgacacccgctcgcctggccagagcgggctgcgtgcacatgctgggcagagaggaatatttaagaaataaagcttggacccagatttttccaca

SEQ ID NO: 34122 - DNA, 317 bp, Homo sapiens
ctttggctgtaccaatcaagtctactgggttttgctttctatttcgttactgcttttagatttattaaaatttcttctattgcctgatggttaaaattcatacacatagacaccacacagtataaaagagttatgaaaaaatatacaccaatgggttaagaatgattgtctttaggtaagtgagattgtcaggcttttgctttgttttattttgtttttatttgaatattcgttttctacagtgagcatgtattttgtaacaatgaaacatatgcagattacttgtaaataaaattatatctgggagactataaatt

SEQ ID NO: 34123 - DNA, 620 bp, Homo sapiens
attcacaaatacctttcctcagttttttattccaatctggtagacaaaggtggtgctcagtaagttaagtgttggttgaattgagggtgtatgatgcttttcaaagcttgactatcaacccagatagagatttctgtgttcatcttgctggattttttttcttgttttgtgtccactactcctagactctcacatgtgtccaggtatatatacaaagattgaaattgtttaattagcttactctggctaatggtaatgactgatatttcagatttctttttaaaagaaggcctatatttgatgtgtctatctttcactcatttttatgcctactctcatattcttagctcatttccttctctttagtactctgcctttgggttttagagtaacttaatatcacacatgtgggttgtgtcgattatgagcagagcaatatgcgaacctcttttttttttttccatttgattttttcaagactctgtcacccaggctggagtcaggtggcacgatcacgactcactgcagccttaaactcttcctgggctcaagcaatcctcctgccttggcctcctgagtagctaggactacaggcacataccgctgtgccccattaattt

SEQ ID NO: 34124 - DNA, 231 bp, Homo sapiens
gctttggggctcccacaggctggtgtctccagggtgggttgctcattctgtgccgtattccatcccctgtcgcagttgacaccttttccctttgcacccacagtggtgaagacctgtgcttatgctcctagagagacgcaggtgagaacccaagtcacacccctcagtgttttgttttgttggtgtgtgtgtgtgtgtgtgtgtgtgtggtggagtctcactctgttgccc

SEQ ID NO: 34125 - DNA, 440 bp, Homo sapiens
gtatatcagtgttgaaggtaagttctccacctgccctttctgcctgcatcagaatctttttatcccaaaacggtcaacagtgagctactccaagtgtggtccatagatcaccagcattgggatcatcttggggcttgttagaaatgcagaacccgggctgggcacagtggctcacacctgtaatcccaacgcttttgagttgctgtggtgggacggtcgcttgaggccaggagtttgagaccagcctaggcaatatggcaagaccttgtctctacagaaaaatttcaaaaagttagtagggcatggtggcacgcacctgtagtctcagttattcgggaggctaaggtatgatgattgcttgagcctgggagttcaaggttacagtgagctatgatagtgccactgcacttcagcttggactgaagatcctgtctcagaaa

SEQ ID NO: 34126 - DNA, 477 bp, Homo sapiens
ctggactactaagttgaggcctctgccatgagcagcttcagaaggcctgctagtgttcccttctccttgcctgcatgcacagaaggccacacaagggaaacagccatggccagctgataagaacaggggccatcatgcaagcagaaggggaggacaaggccaccttccaacaggcactaaagtaacaatgagaacaacaaaaacaaaatacatagaaaagaaaaaaatggcaaaattgcacttcaggctttaatgccctccttactttcaccccagataatgcaaaaatttttcctcttccttcgacagagcgtaaatgatatgacctggctgggcgctgtggcttacgcctataatcccatcactttgagagcctgaggcaagaggactgctggagcccaggagctccaggctacagtgagctatggtcacgccactacacttcagcctgggcaaaagagtgagagtctgtctcaa

SEQ ID NO: 34127 - DNA, 428 bp, Homo sapiens
gtcaggctgatctcgaactcctgacctcatgatccgcccaccccagcctcccagagtgctgggattacaggcataagccaccgtgccaggccgagaaaacttattaatacatgctctacctgctaaatattttccttcaaagcaaaggaagggccgggcacggtggctcacacctgtaatcccagcagtttgggaggccaagacaggcggatcatttgaggtcaggagttcaagaccagcctggccaacatgatgaaaccccatctctactaaaaatacaaaaactagccaggtttggtggcacacaccttgtaatcccagctctagagaggccaaggcaagaatcacttgaaccgggaggaggttgcagtgagctgagactgcaccaccgcactccatccagcctgggtgacagagcaagactcctc

SEQ ID NO: 34128 - DNA, 374 bp, Homo sapiens
ctaaacaggaatctggtgtcactaggttactgcagtttaagacagattgcctttgtccaacctttccgtgtttgccaagtaaatagtaaataactggacagtatctttgtgattaaaatgatcttccaaaatagtttcctccacaagatactccaatatgtttctgcatatttaagtaagctagactgtgtctctaggataatttattttagacacctgaagagttcataaagtgctacagagtgaaattattatttgagttgtatcatgtatcaaattccatatgaaactgcttttcttctaagactgaaccaggaagaagttgaatacctgaacagaccaataatgagctccaaaactgaatcagtaataag

SEQ ID NO: 34129 - DNA, 465 bp, Homo sapiens
tcttcacacccacagccaaggcccctccggccattggaggctcacacaagggggttatggaaacgccagtgtggcagcgtggggtcaccaacacctcagtggccaggctgcatggtgcctgggccagcttctctgtgaggaaggggagtttgcagggaaactgtttgcagaaaagctgttcctactgtggagggactgaccttggcccctggagcaaactcagtccttaaccacgtgctcaggctacttaattttaaatgaatttgcacagttgcgtgttatgagtgaattcataaacctacaaaggcatagtcttttattcatgctggtatgtgtggaagggggttacttttttaaagttctaaaattaaagaaaaaaagataaatcatcctgtgttgaggattggattttgcaactgaattctctttatcctttgctagatcttgagaaaagaaagaagaaaa

SEQ ID NO: 34130 - DNA, 2685 bp, Homo sapiens
cgcgggggcggtggcgcgcggtcagctgacccggcgggccttgacccagaagctgggccctggcggcggatctggacgtggcggcccgcgccgggctgagtcaccaggagggagctgtggccgaggacgccgaggcctggagtgggtggtagccccgagctgggacgctcctccctccacaatctccccaggtctgcagggaccgagggcctacactgcctcctcccacgccgtgcttaggaacccttgctggcctcagaacaccagcgccctccctccggtgcagccctgcctggccgggggcccctcctccacagccatggtctggaagaaactgggctcccgcaacttctccagctgccccagtggctccatccagtggatatgggatgtgttgggtgaatgtgcccaggacggctgggacgaggccagcgtgggcctgggcttgatctccattctctgctttgctgcatctaccttcccccagttcatcaaagcctacaagacgggcaacatggaccaggcgctgtccctgtggttcctcctgggctggattggcggagactcctgcaacctcatcggctccttccttgctgaccagctgcccctgcagacctacacggctgtgtattatgtcttggcagacctggtgatgctgacgctgtacttttactacaagttcaggacgcgcccctctctgttgtctgcccccatcaactccgtgctgttgttcctcatggggatggcgtgcgccacaccgctgctgagtgctgctgggcccgtggctgcccctagggaagccttccgggggcgggcgctcctgtccgtggagtcgggcagcaagcccttcacccggcaggaagtcattggcttcgtcatcggctccatctccagcgtgttgtacctgctttcccggctgcctcagatccgcaccaacttcctccggaagtccacccaggggatctcctactctctgttcgcgctggtgatgctggggaacacgctgtatgggctgagcgtgctgctcaaaaaccccgaggagggccagagcgagggcagctacctgctgcaccacctgccctggcttgtgggcagcctgggcgtgctgctgctcgacaccatcatctccatccagttcctggtgtacaggcgcagcaccgccgcctcggagcttgagcccctcctccccagctgaccagaaccaggctgagcgcaggaggacaggcaccaccggatgccacaccaggcaggaggaggtgtggacagtgatggtacggcggccctgcatcagcctgcgggtggcctctggatcctccgtggaccgaaccgtccccccaggaacacaccttcaggtagaccccgaagcctcaaggccggggctggagcggagaccccagggcctctcaggagacagtgaggctgcccctcctaccacctacctcattctgcctactcaccccaggggccacagccacagcctgctggtctcgaactccttacctcaggtgatctgcttgcctcagcctctcaaagtgctgggattacaggtgtgccaccgcgcccggccaagatgggagtatttttatgaccattttacagatgggagaacagtctcagcacaattgagcagcttgcccagctaggagcagcagcaacacgagaccctccagctttgggagccaccccacacctggccaacgctggcggcccgtgtccccttcctccatccttgctgggggcccatggcttgtggcagttcagcttcaccctcaggagtggcccgaaccctgctggacccaggctcccttctcaccatcctgaatagcgactttgctgagcctctggccctgccgagatttcaggataagttacccccaggcccgaagccccagcttgccctggcctgtgcctgcctcaggtgccagctagatgtctcgctccacctgggtctgggacctggctccacaccagttacctgggaccagtaggtgcccttccagcctgaagatctgggggcacagtatagccacatgagccccaagtgtggtcctgaactggggccgggtggggaagagtgagatgggataacatagcccctgcttggaggcccttctctgatggggtgacataatcccttcctcctgggaaacaccagcttttggggtgatagcactttcaggcaggagctatggttccttcctcaggaggcctccaatctgatggggaagacatggcccctccccctggggagtgccctgtgtgatggaggcgatacagcccctaccttcagagagcacctggcctgcagctcatccaaacctgagtctcctctcccttggaggcctcattccagcgccccaaggaggattcaaactgttggggctggaagaacttggtggcctgggtccctggagccctgttgaaggagctggtgacattctgatgctggaggcaggtgacggggagcacagactttgtgtcctgcacactgagctccaagtgtgccccagccactgagccttgtgacttgagcagatgtccgaagccgtttcttcatcccatgagaccagtaatactgtctgcctcagaacatagccgtgatcaagatgagcacggaggctcgtgtcccagcacctggcacacagtaagtgcctggtaaataaacaatggctatatttgcttgtc

SEQ ID NO: 34131 - DNA, 1996 bp, Homo sapiens
cgcgggggcggtggcgcgcggtcagctgacccggcgggccttgacccagaagctgggccctggcggcggatctggacgtggcggcccgcgccgggctgagtcaccaggagggagctgtggccgaggacgccgaggcctggagtgggtggtagccccgagctgggacgctcctccctccacaatctccccaggtctgcagggaccgagggcctacactgcctcctcccacgccgtgcttaggccagttcatcaaagcctacaagacgggcaacatggaccaggcgctgtccctgtggttcctcctgggctggattggcggagactcctgcaacctcatcggctccttccttgctgaccagctgcccctgcagacctacacggctgtgtattatgtcttggcagacctggtgatgctgacgctgtacttttactacaagttcaggacgcgcccctctctgttgtctgcccccatcaactccgtgctgttgttcctcatggggatggcgtgcgccacaccgctgctgagtgctgctgggcccgtggctgcccctagggaagccttccgggggcgggcgctcctgtccgtggagtcgggcagcaagcccttcacccggcaggaagtcattggcttcgtcatcggctccatctccagcgtgttgtacctgctttcccggctgcctcagatccgcaccaacttcctccggaagtccacccaggggatctcctactctctgttcgcgctggtgatgctggggaacacgctgtatgggctgagcgtgctgctcaaaaaccccgaggagggccagagcgagggcagctacctgctgcaccacctgccctggcttgtgggcagcctgggcgtgctgctgctcgacaccatcatctccatccagttcctggtgtacaggcgcagcaccgccgcctcggagcttgagcccctcctccccagctgaccagaaccaggctgagcgcaggaggacaggcaccaccggatgccacaccaggcaggaggaggtgtggacagtgatggtacggcggccctgcatcagcctgcgggtggcctctggatcctccgtggaccgaaccgtccccccaggaacacaccttcaggtagaccccgaagcctcaaggccggggctggagcggagaccccagggcctctcaggagacagtgaggctgcccctcctaccacctacctcattctgcctactcaccccaggggccacagccacagcctgctggactcaggactgtcctgtcaactccagacaactgaataaacaggccgggtacagtggctcgcacctgtaatcctagcactttgggaggccgaagcgggtggaccacttgacgtccgtagttcgagaccagcctggccaacatggtgaaaccccatctctactaaaaatacaaaaattagccaggtgtggtggcacacatctgtagtcccagctacttgggaggctgaggcaggagaactgtttgaacctgggagacagaggttgcggtgaaccgagatcgtgccactgtactccagcctgggtgacagagtgagactccgtctcaaaaaaataaaaaagataaccgaggaaacggtacctccccatgaaacacacacaaaacacaaccaaaacaaccaacacgaaaagaaacaacgcacgagaacaccgcgacacaataaccgcggcgaacaccggccacaccacgcgcacgtagaacagaggcccagccccaaattcggaacacgggtgaaatacggcggcccccatggcgcccaacacaccaaacgacgcccagcacaatgtcacacgagcagacccacacgcaaccgcaaccaccacacgcacacgccaaacaaagccgagcaacaggacacagcacacgcgcagaaacacaccgaataaacaaacagcggaaaggaacagaaaagctagaaacaacgcagaagcagacacgtcaccctgaacacaacagcaaagcaaggacaacagacac

SEQ ID NO: 34132 - DNA, 2207 bp, Homo sapiens
cgcgggggcggtggcgcgcggtcagctgacccggcgggccttgacccagaagctgggccctggcggcggatctggacgtggcggcccgcgccgggctgagtcaccaggagggagctgtggccgaggacgccgaggcctggagtgggtggtagccccgagctgggacgctcctccctccacaatctccccaggtctgcagggaccgagggcctacactgcctcctcccacgccgtgcttaggaacccttgctggcctcagaacaccagcgccctccctccggtgcagccctgcctggccgggggcccctcctccacagccatggtctggaagaaactgggctcccgcaacttctccagctgccccagtggctccatccagtggatatgggatgtgttgggtgaatgtgcccaggacggctgggacgaggccagcgtgggcctgggcttgatctccattctctgctttgctgcatctaccttcccccagttcatcaaagcctacaagacgggcaacatggaccaggcgctgtccctgtggttcctcctgggctggattggcggagactcctgcaacctcatcggctccttccttgctgaccagctgcccctgcagacctggtgatgctgacgctgtacttttactacaagttcaggacgcgcccctctctgttgtctgcccccatcaactccgtgctgttgttcctcatggggatggcgtgcgccacaccgctgctgagtgctgctgggcccgtggctgcccctagggaagccttccgggggcgggcgctcctgtccgtggagtcgggcagcaagcccttcacccggcaggaagtcattggcttcgtcatcggctccatctccagcgtgttgtacctgctttcccggctgcctcagatccgcaccaacttcctccggaagtccacccaggggatctcctactctctgttcgcgctggtgatgctggggaacacgctgtatgggctgagcgtgctgctcaaaaaccccgaggagggccagagcgagggcagctacctgctgcaccacctgccctggcttgtgggcagcctgggcgtgctgctgctcgacaccatcatctccatccagttcctggtgtacaggcgcagcaccgccgcctcggagcttgagcccctcctccccagctgaccagaaccaggctgagcgcaggaggacaggcaccaccggatgccacaccaggcaggaggaggtgtggacagtgatggtacggcggccctgcatcagcctgcgggtggcctctggatcctccgtggaccgaaccgtccccccaggaacacaccttcaggtagaccccgaagcctcaaggccggggctggagcggagaccccagggcctctcaggagacagtgaggctgcccctcctaccacctacctcattctgcctactcaccccaggggccacagccacagcctgctggactcaggactgtcctgtcaactccagacaactgaataaacaggccgggtacagtggctcgcacctgtaatcctagcactttgggaggccgaagcgggtggaccacttgacgtccgtagttcgagaccagcctggccaacatggtgaaaccccatctctactaaaaatacaaaaattagccaggtgtggtggcacacatctgtagtcccagctacttgggaggctgaggcaggagaactgtttgaacctgggagacagaggttgcggtgaaccgagatcgtgccactgtactccagcctgggtgacagagtgagactccgtctcaaaaaaataaaaaagataaccgaggaaacggtacctccccatgaaacacacacaaaacacaaccaaaacaaccaacacgaaaagaaacaacgcacgagaacaccgcgacacaataaccgcggcgaacaccggccacaccacgcgcacgtagaacagaggcccagccccaaattcggaacacgggtgaaatacggcggcccccatggcgcccaacacaccaaacgacgcccagcacaatgtcacacgagcagacccacacgcaaccgcaaccaccacacgcacacgccaaacaaagccgagcaacaggacacagcacacgcgcagaaacacaccgaataaacaaacagcggaaaggaacagaaaagctagaaacaacgcagaagcagacacgtcaccctgaacacaacagcaaagcaaggacaacagacac

SEQ ID NO: 34133 - DNA, 1729 bp, Homo sapiens
cgcgggggcggtggcgcgcggtcagctgacccggcgggccttgacccagaagctgggccctggcggcggatctggacgtggcggcccgcgccgggctgagtcaccaggagggagctgtggccgaggacgccgaggcctggagtgggtggtagccccgagctgggacgctcctccctccacaatctccccaggtctgcagggaccgagggcctacactgcctcctcccacgccgtgcttaggaacccttgctggcctcagaacaccagcgccctccctccggtgcagccctgcctggccgggggcccctcctccacagccatggtctggaagaaactgggctcccgcaacttctccagctgccccagtggctccatccagtggatatgggatgtgttgggtgaatgtgcccaggacggctgggacgaggccagcgtgggcctgggcttgatctccattctctgctttgctgcatctaccttcccccagttcatcaaagcctacaagacgggcaacatggaccaggcgctgtccctgtggttcctcctgggctggattggcggagactcctgcaacctcatcggctccttccttgctgaccagctgcccctgcagacctacacggctgtgtattatgtcttggcagacctggtgatgctgacgctgtacttttactacaagttcaggacgcgcccctctctgttgtctgcccccatcaactccgtgctgttgttcctcatggggatggcgtgcgccacaccgctgctgagtgctgctgggcccgtggctgcccctagggaagccttccgggggcgggcgctcctgtccgtggagtcgggcagcaagcccttcacccggcaggaagtcattggcttcgtcatcggctccatctccagcgtgttgtacctgctttcccggctgcctcagatccgcaccaactcgtgcacacctcctgtgtgccaggcacccagctggaccctggagccgtgagtgagcaagaacagccatgagtgccccagaagcttacagcccagcggggcgcagagaggacacaacgctatcatcaaagaattacttcattgcagtggcaccaagtgctgcagagaaaaacaacaagagcgtctagccagggaccgtcctggttagaggggcagcaaaggcccctataagtctcattgaacctgtgacttgacagagtaggagaagtcaggcgaaggcaggagaggaatgttctaggctgtgcagacgagagctggagtgtggagagacacatgacttggtcagacaaacctgggttcaaatcctggctcctcccctgcttcctagctgtgtgacgcagggcacacagtcaacctctctgtgctgccgtgtcttcacctcagttaacagccactgtctcgtcaggatgttgtgtaagatgaggtatctggaaacactccccacaggaccccgttttcagtgagggctcagaaagtgtttgctgaatggctgtaaagagcgttacctgggtctcatttcggagcaagtaaacatggcctttgttttaatatttgttaagtccctgccgggcgcagggaggggtgaaagtttaggctcttgtgccccaaaacggcccagccacctggaagcctccaggacgccacagctgagagcaagcgaagatcctgggccagggtcaagggaggctgcccacgggaaggagaagtcagtgctaggcttggagacagatgg

SEQ ID NO: 34134 - DNA, 1969 bp, Homo sapiens
cgcgggggcggtggcgcgcggtcagctgacccggcgggccttgacccagaagctgggccctggcggcggatctggacgtggcggcccgcgccgggctgagtcaccaggagggagctgtggccgaggacgccgaggcctggagtgggtggtagccccgagctgggacgctcctccctccacaatctccccaggtctgcagggaccgagggcctacactgcctcctcccacgccgtgcttaggaacccttgctggcctcagaacaccagcgccctccctccggtgcagccctgcctggccgggggcccctcctccacagccatggtctggaagaaactgggctcccgcaacttctccagctgccccagtggctccatccagtggatatgggatgtgttgggtgaatgtgcccaggacggctgggacgaggccagcgtgggcctgggcttgatctccattctctgctttgctgcatctaccttcccccagttcatcaaagcctacaagacgggcaacatggaccaggcgctgtccctgtggttcctcctgggctggattggcggagactcctgcaacctcatcggctccttccttgctgaccagctgcccctgcagacctacacggctgtgtattatgtcttggcagacctggtgatgctgacgctgtacttttactacaagttcaggacgcgcccctctctgttgtctgcccccatcaactccgtgctgttgttcctcatggggatggcgtgcgccacaccgctgctgagtgctgctgggcccgtggctgcccctagggaagccttccgggggcgggcgctcctgtccgtggagtcgggcagcaagcccttcacccggcaggaagtcattggcttcgtcatcggctccatctccagcgtgttgtacctgctttcccggctgcctcagatccgcaccaacttcctccggaagtccacccaggggatctcctactctctgttcgcgctggtgatgctggggaacacgctgtatgggctgagcgtgctgctcaaaaaccccgaggagggccagagcgagggcagctacctgctgcaccacctgccctggcttgtgggcagcctgggcgtgctgctgctcgacaccatcatctccatccagttcctggtgtacaggcgcagcaccgccgcctcggagcttgagcccctcctccccagctgaccagaaccaggctgagcgcaggaggacaggcaccaccggatgccacaccaggcaggaggaggtgtggacagtgatggtacggcggccctgcatcagcctgcgggtggcctctggatcctccgtggaccgaaccgtccccccaggaacacaccttcaggtagaccccgaagcctcaaggccggggctggagcggagaccccagggcctctcaggagacagtgaggctgcccctcctaccacctacctcattctgcctactcaccccaggggccacagccacagcctgctggactcaggactgtcctgtcaactccagcctgggtgacagagtgagactccgtctcaaaaaaataaaaaagataaccgaggaaacggtacctccccatgaaacacacacaaaacacaaccaaaacaaccaacacgaaaagaaacaacgcacgagaacaccgcgacacaataaccgcggcgaacaccggccacaccacgcgcacgtagaacagaggcccagccccaaattcggaacacgggtgaaatacggcggcccccatggcgcccaacacaccaaacgacgcccagcacaatgtcacacgagcagacccacacgcaaccgcaaccaccacacgcacacgccaaacaaagccgagcaacaggacacagcacacgcgcagaaacacaccgaataaacaaacagcggaaaggaacagaaaagctagaaacaacgcagaagcagacacgtcaccctgaacacaacagcaaagcaaggacaacagacac

SEQ ID NO: 34135 - DNA, 811 bp, Homo sapiens
ctcccagtgctgaaagcctcctcccttcctccctgtagaacccttgctggcctcagaacaccagcgccctccctccggtgcagccctgcctggccgggggcccctcctccacagccatggtctggaagaaactgggctcccgcaacttctccagctgccccagtggctccatccagtggatatgggatgtgttgggtgaatgtgcccaggacggctgggacgaggccagcgtgggcctgggcttgatctccattctctgctttgctgcatctaccttcccccagttcatcaaagcctacaagacgggccacagccacagcctgctggactcaggactgtcctgtcaactccagcctgggtgacagagtgagactccgtctcaaaaaaataaaaaagataaccgaggaaacggtacctccccatgaaacacacacaaaacacaaccaaaacaaccaacacgaaaagaaacaacgcacgagaacaccgcgacacaataaccgcggcgaacaccggccacaccacgcgcacgtagaacagaggcccagccccaaattcggaacacgggtgaaatacggcggcccccatggcgcccaacacaccaaacgacgcccagcacaatgtcacacgagcagacccacacgcaaccgcaaccaccacacgcacacgccaaacaaagccgagcaacaggacacagcacacgcgcagaaacacaccgaataaacaaacagcggaaaggaacagaaaagctagaaacaacgcagaagcagacacgtcaccctgaacacaacagcaaagcaaggacaacagacac

SEQ ID NO: 34136 - DNA, 424 bp, Homo sapiens
tgaaaccccatctctactaaaaatacaaaaaaaaattaggcatggtgacaggtgcctgtagtcccagctacttgggaggctgaggcgggaaaatcgcttgaacccgggaggtggaggttgcagtgagctgagaccgcaccattgcactccagcccgggtaaaaagaatgaaactcaatctcaaaaaacaaacaaacaaaacgcaaagttgatagaacctccacagatttttctctaatctccacgtgtcctatgtttcccagtctctgagcgttgtatgtacaaatgtagaaacaaattccacaaatgtttattaagggactctgtgccaggcactgttctggatgctgagggatacagcaggaaacacaaccaacaatccctgtcctcaagaaacttcatattgtggtggagagagattaaca

SEQ ID NO: 34137 - DNA, 679 bp, Homo sapiens
  misc_feature (10)..(10): n is a, c, g, or t
accagggttnaagtaatagactccctataagggcgcgagatttcattcactttcaagtaatctgtacgaagaagttgagaataataaaaaatggacagaaaaccaatttctcaaatatagaaaagaccacctgggccatataaatgaatgtctgaaggtcctacaggagaaactggaaaagtctgaaaataaaatggaagaaaaactgctgcagctttcaagcaaagtagagaatttcattaacacacagaaacaggaaacacaactaagtaaagtaaagcatatggaaaataaattgtccaaaaagatggaacaaatggaaaagcagatctggggtgaattagagacaatgcagaatgaatatcaatcaggatttaaatcaattcatgactctctcagctccctccaacaaatacagaaaacaaagatggatttagagaaatataaagtacagaaagacctaaagaaattacagcgcaagatagtggaactccaggaagtataaaccttttcagtcatcttctttttcatcagccaatggagtgatttgttggaaaaagttctgaagaagaaagttactatctctgggatgtttactgcttctaatgtctccttttaaggagacgaatgtaccagaaaaataataaagcaaagaagcttcggatgtcctcaatggaaa

SEQ ID NO: 34138 - DNA, 1579 bp, Homo sapiens
gtcacccttgggaagaggccccagaaacaggaagaccttagttaggatgcaattacaattccttggtacattggcttcctcagaaaaaagaaaaaaatcacagagattgtttttcaaaaatatcaaatctacaaaaaataaagctggaaaagcaagcatcatgagttcagatacaaatgtaaacaaaagtgcctctccaactgcgactgcagaggaacagccagttgaacctgatggcccccttcctggctcagacaataaccaagaaaagaaagtaagattatctccagccaaaatgtcaaccaagaattctacagatctagttgaatatgttgacaagagtcatgcttttctccccatcattccaaacacccagagaggtcagctagaagacagactgaacaaccaggcgcgtaccatagctttccttcttgaacaagccttccgcatcaaggaggacatctctgcttgcctgcaggggacccatggctttcgaaaagaggaatcgctcgccaggaagttactggaaagccacatccagaccatcaccagcatcgtcaaaaaactcagccaaaatattgagattttagaagaccaaataagagctcgagatcaggcggccacaggaactaactttgcagtacacgagataaacatcaaacacctacaaggagttggagatcttcgaggaagagtagccagatgtgattcaagcattgtgaagctttctggagacattcacttattcaggcaagagcaccggcaaattgagaaagccattcaagaattcgtgcccgccctggaaactctttccaagaacttggacatgaaggtgatgcagctcttaggaaagatagaaactgccagttctgagcaaacctcgaatttaaagatggtccagggggattatcgccacgaaatgaaccttttggaattcaaatttcattcactttcaagtaatctgtacgaagaagttgagaataataaaaaatggacagaaaaccaatttctcaaatatagaaaagaccacctgggccatataaatgaatgtctgaaggtcctacaggagaaactggaaaagtctgaaaataaaatggaagaaaaactgctgcagctttcaagcaaagtagagaatttcattaacacacagaaacaggaaacacaactaagtaaagtaaagcatatggaaaataaattgtccaaaaagatggaacaaatggaaaagcagatctggggtgaattagagacaatgcagaatgaatatcaatcaggatttaaatcaattcatgactctctcagctccctccaacaaatacagaaaacaaagatggatttagagaaatataaagtacagaaagacctaaagaaattacagcgcaagatagtggaactccaggaagtataaaccttttcagtcatcttctttttcatcagccaatggagtgatttgttggaaaaagttctgaagaagaaagttactatctctgggatgtttactgcttctaatgtctccttttaaggagacgaatgtaccagaaaaataataaagcaaagaagcttcggatgtcctcaatggaaa

SEQ ID NO: 34139 - DNA, 1440 bp, Homo sapiens
gtcacccttgggaagaggccccagaaacaggaagaccttagttaggatgcaattacaattccttggtacattggcttcctcagaaaaaagaaaaaaatcacagagattgtttttcaaaaatatcaaatctacaaaaaataaagctggaaaagcaagcatcatgagttcagatacaaatgtaaacaaaagtgcctctccaactgcgactgcagaggaacagccagttgaacctgatggcccccttcctggctcagacaataaccaagaaaagaaagtaagattatctccagccaaaatgtcaaccaagaattctacagatctagttgaatatgttgacaagggacccatggctttcgaaaagaggaatcgctcgccaggaagttactggaaagccacatccagaccatcaccagcatcgtcaaaaaactcagccaaaatattgagattttagaagaccaaataagagctcgagatcaggcggccacaggaactaactttgcagtacacgagataaacatcaaacacctacaaggagttggagatcttcgaggaagagtagccagatgtgattcaagcattgtgaagctttctggagacattcacttattcaggcaagagcaccggcaaattgagaaagccattcaagaattcgtgcccgccctggaaactctttccaagaacttggacatgaaggtgatgcagctcttaggaaagatagaaactgccagttctgagcaaacctcgaatttaaagatggtccagggggattatcgccacgaaatgaaccttttggaattcaaatttcattcactttcaagtaatctgtacgaagaagttgagaataataaaaaatggacagaaaaccaatttctcaaatatagaaaagaccacctgggccatataaatgaatgtctgaaggtcctacaggagaaactggaaaagtctgaaaataaaatggaagaaaaactgctgcagctttcaagcaaagtagagaatttcattaacacacagaaacaggaaacacaactaagtaaagtaaagcatatggaaaataaattgtccaaaaagatggaacaaatggaaaagcagatctggggtgaattagagacaatgcagaatgaatatcaatcaggatttaaatcaattcatgactctctcagctccctccaacaaatacagaaaacaaagatggatttagagaaatataaagtacagaaagacctaaagaaattacagcgcaagatagtggaactccaggaagtataaaccttttcagtcatcttctttttcatcagccaatggagtgatttgttggaaaaagttctgaagaagaaagttactatctctgggatgtttactgcttctaatgtctccttttaaggagacgaatgtaccagaaaaataataaagcaaagaagcttcggatgtcctcaatggaaa

SEQ ID NO: 34140 - DNA, 1443 bp, Homo sapiens
gtcacccttgggaagaggccccagaaacaggaagaccttagttaggatgcaattacaattccttggtacattggcttcctcagaaaaaagaaaaaaatcacagagattgtttttcaaaaatatcaaatctacaaaaaataaagctggaaaagcaagcatcatgagttcagatacaaatgtaaacaaaagtgcctctccaactgcgactgcagaggaacagccagttgaacctgatggcccccttcctggctcagacaataaccaagaaaagaaagtaagattatctccagccaaaatgtcaaccaagaattctacagatctagttgaatatgttgacaagagtcatgcttttctccccatcattccaaacacccagagaggtcagctagaagacagactgaacaaccaggcgcgtaccatagctttccttcttgaacaagccttccgcatcaaggaggacatctctgcttgcctgcaggggacccatggctttcgaaaagaggaatcgctcgccaggaagttactggaaagccacatccagaccatcaccagcatcgtcaaaaaactcagccaaaatattgagattttagaagaccaaataagagctcgagatcaggcggccacaggaactaactttgcagtacacgagataaacatcaaacacctacaaggagttggagatcttcgaggaagagtagccagatgtgattcaagcattgtgaagctttctggagacattcacttattcaggcaagagcaccggcaaattgagaaagccattcaagaattcgtgcccgccctggaaactctttccaagaacttggacatgaaggtgatgcagctcttaggaaagatagaaactgccagttctgagcaaacctcgaatttaaagatggtccagggggattatcgccacgaaatgaaccttttggaattcaagaaaagtctgaaaataaaatggaagaaaaactgctgcagctttcaagcaaagtagagaatttcattaacacacagaaacaggaaacacaactaagtaaagtaaagcatatggaaaataaattgtccaaaaagatggaacaaatggaaaagcagatctggggtgaattagagacaatgcagaatgaatatcaatcaggatttaaatcaattcatgactctctcagctccctccaacaaatacagaaaacaaagatggatttagagaaatataaagtacagaaagacctaaagaaattacagcgcaagatagtggaactccaggaagtataaaccttttcagtcatcttctttttcatcagccaatggagtgatttgttggaaaaagttctgaagaagaaagttactatctctgggatgtttactgcttctaatgtctccttttaaggagacgaatgtaccagaaaaataataaagcaaagaagcttcggatgtcctcaatggaaa

SEQ ID NO: 34141 - DNA, 568 bp, Homo sapiens
tcttttcctattatgacgcgccccttatgtcatttttaaagcttacgagatttggccagcatccgaaaagtctgaaaataaaatggaagaaaaactgctgcagctttcaagcaaagtagagaatttcattaacacacagaaacaggaaacacaactaagtaaagtaaagcatatggaaaataaattgtccaaaaagatggaacaaatggaaaagcagatctggggtgaattagagacaatgcagaatgaatatcaatcaggatttaaatcaattcatgactctctcagctccctccaacaaatacagaaaacaaagatggatttagagaaatataaagtacagaaagacctaaagaaattacagcgcaagatagtggaactccaggaagtataaaccttttcagtcatcttctttttcatcagccaatggagtgatttgttggaaaaagttctgaagaagaaagttactatctctgggatgtttactgcttctaatgtctccttttaaggagacgaatgtaccagaaaaataataaagcaaagaagcttcggatgtcctcaatggaaa

SEQ ID NO: 34142 - DNA, 845 bp, Homo sapiens
gtcacccttgggaagaggccccagaaacaggaagaccttagttaggatgcaattacaattccttggtacattggcttcctcagaaaaaagaaaaaaatcacagagattgtttttcaaaaatatcaaatctacaaaaaataaagctggaaaagcaagcatcatgagttcagatacaaatgtaaacaaaagtgcctctccaactgcgactgcagaggaacagccagttgaacctgatggcccccttcctggctcagacaataaccaagaaaagaaagtaagattatctccagccaaaatgtcaaccaagaattctacagatctagttgaatatgttgacaagagtcatgcttttctccccatcattccaaacacccagagaggtcagctagaagacagactgaacaaccaggcgcgtaccatagctttccttcttgaacaagccttccgcatcaaggaggacatctctgcttgcctgcaggggacccatggctttcgaaaagaggaatcgctcgccaggaagttactggaaagccacatccagaccatcaccagcatcgtcaaaaaactcagccaaaatattgagattttagaagaccaaataagagctcgagatcaggcggccacaggaactaactttgcagtacacgagataaacatcaaacacctacaaggagttggagatcttcgaggaagagtagccaggacctccctccttgcccgcttatacctgagagaaactggctgaagtgcgacaggctgaggaaggagagagatttgatactgcaagcctgaatagaggatgctatctaccagccaccaaacacactcactgatcctctgcaggt

SEQ ID NO: 34143 - DNA, 1243 bp, Homo sapiens
gtcacccttgggaagaggccccagaaacaggaagaccttagttaggatgcaattacaattccttggtacattggcttcctcagaaaaaagaaaaaaatcacagagattgtttttcaaaaatatcaaatctacaaaaaataaagctggaaaagcaagcatcatgagttcagatacaaatgtaaacaaaagtgcctctccaactgcgactgcagaggaacagccagttgaacctgatggcccccttcctggctcagacaataaccaagaaaagaaagtaagattatctccagccaaaatgtcaaccaagaattctacagatctagttgaatatgttgacaatgccatacctggagctcccccaggaaaggtgtaccacagagggacaactccaggcacttggaaatagagtaacacactgttaacacatgcacattgtccaaaatacccaaggatgccagtgatgaaggtggcattgcaaaggcaatgcatattaatttgagttgttttctattccatatgtcaaagcaggatttggtctaatgctgtcattcatgttttcagggcactggggatttagtgtcagtccttctactactttgctgtgtaacaccagtcagttccataatgtctctgggctttagttttttcatttgaaaaacaaagaggttggactagaaactactgcagctttaaaataattctgattttaataatcatgaccacagaagaaaaaaatagccaaatgaatgaaatgagttcatgtgaagagaaaaatctaaatacacctggaacttcgattttttaaaaattatctttaacaattaagatgataagatttcttcactaatttttactgcatttttttcacaagaattcccctgtcccttggccagttaaatttaatacattccaaatagttcaatcacagtatgttagcgttagccccttttttcatgttccacataacttgtatttgtttatatgactatgagtctatgatttagaaaaaaataaaactaagcatgggaaaaatatttttaaatgtttaaaaaatgcaatatttggacagatgacttttcttctgagttaaggacaatgaatgtagtatgcacaaaaataattattataaataaatgtattagctaaccttatcttccaaggagaaaagggaaacttgtccccacctgactctctacatgacaaatggaaaataaaaatcattcttctgatccgtcaaattcta

SEQ ID NO: 34144 - DNA, 463 bp, Homo sapiens
gcagactttttcaatactaattttttatgtttaaattaacttatttaaatgaaacaaaacattttttcccatagatttcattcactttcaagtaatctgtacgaagaagttgagaataataaaaaatggacagaaaaccaatttctcaaatatagaaaagaccacctgggccatataaatgaatgtctgaaggtcctacaggagaaactggtgaggagttctgttattttgtgaagcaagcacctgcatagtccttgttagcagtgagtaaaggtctgggaatttgtacttcaacatttatggtaatcttcactgcttcagtaacttttttttttttaaacaccacaataggagtccagaggcctgtcttctggtcctgtttgctactccccaactctgcaaacctgtgtttctcagagtgtgctctacctgtaccaaaagaatctgaagaggtttttttttt

SEQ ID NO: 34145 - DNA, 207 bp, Homo sapiens
ttgagacagagtcttgctttgtcgcccaggctgccgtccagggttgcgatctcggctcactgcaatctccacctactgggttcagcgaaactgcttctcaaactgtggatccagacaaggtgaaggaccctggtaaactgaggacaatgtttgtagcagaactccccaaaactatcgtcaccgactcatgacatcacacaggtaata

SEQ ID NO: 34146 - DNA, 1042 bp, Homo sapiens
tccagcctgggtgacagagcgagactctgtctcaaaaaaaaaaaaagagggggtgctgcccacatgttgcttttacagtacctgcaatttcaggggggaaaacccccaaaaaactaggaagtgcaagtatgtctcaattcaggaaagttcatagaaactttacaaattacaccagataaactggggaattaagttcaacaattgaaggtctgatatgtgttacttttattcaggtgttctgtggatatgaatataaatgagaaagttgaaacatagttcactaacaacattttgaaatgagattaaaatcactaacaacattttaaatgaggtgaattgtatgtgatgtggactaaactagatagctgtttaaaaacttgtttagagaaaatacaattatagttttagatgacctagtgttagtctagattaatctagtcccatcctctagggattggaagtccaagaggggaccattctaagaatggttgtgaaccccttatagaatctgatgaaagctgtggattttgttttcaggaaatctcacttgtccattttcacacggtttagcataaagtttagtctgtttagcctaaagcattgttgggcttacaggcctccagctcctgagaggtctgcttcccgcttgatccttttatctgtttacttgggctcctctggagcatgagagtaggtgaacatggagttttccaaagcagggggcctaacttacttattgagctaggcatgtaacaggaagaaagaagtaaagggcattgcaagctgaccaaaaagtaatactttaaagagaatatacttttcccaagttatttctattatttgtcttttttctcttttccagttaaaagtttgggcagggtgcggaggctcacatctgtaatcccaacatttcgggaggctgaggcaggcagatcatttgaggtcaggagttcgagaccaccctggctaacatggccagactctgtctctactaaaaatacaaaaaaaattagctgggcagagtgatccctcatctctaaaa

SEQ ID NO: 34147 - DNA, 283 bp, Homo sapiens
tttatttttatttttttgtcagtgggtcttttctagacagaattcttagaatacaaaccatttcttctcatcatacagttttggccacaagtctcaaaaacctattttgaaattctgaaaacaaaaattcattcattgttttgctcaacatttctgttatgtcatcactcagaaaatgtcaaacaacccagtgctaaagctgttagtttctgctggggagagagaggcaggagagatgacattattgtatcaaaatgattgtttgcaactctatggtcttgtt

SEQ ID NO: 34148 - DNA, 412 bp, Homo sapiens
cctcctgtcctttttttattatgaaatatttcatatatcaaagaatatgtctaacatatgtgtattacaaagtatatcctctgcctccctcctcatttgaagatcctgccaatcctctgcagagctaatgcttattctgactttggggttttcatttcctttcatatatcccttatatatgtagtcctagtaggtgtatacatatgtatatcatgaatagttatatatataataattgcaaatacatcctgtttatttaatgggttatgtttctttaagttccaatacaatattttctaaattagaaaggtattacaattttaaaaaatgtgccaggacaaaattaataccaaattacaagaatggtaaagcttagaacattgtcattgactataaataatagctgcaattc

SEQ ID NO: 34149 - DNA, 484 bp, Homo sapiens
  misc_feature (1)..(1): n is a, c, g, or t
  misc_feature (368)..(368): n is a, c, g, or t
ngccaagaattcggcacgagggagattcgatcctcttaaggcattatcagtgagcaaatgtgaaggaaatggtgtctggaagaaagttctggttcacatgccttgtagctaagtctttctgcaaacaacctcccttccccccgtcgagtcatttggtgactttgatggggggatttctggttatgtcaaggctctggagacaggaaaggctttggccgccttgggtagttgacctgccttttctgactccgggacgagccagtcctaggctgcctccgggagcacttgaggtatcccgcaggccatgaggacccactgggcagctcctggacagcctcttggctccagcccccacccgaaagtggacnactgtccgccctggccacctggggactggcactgtggtgcacagtggcccaatgtggccaacggaagttttataaaagacaaaatgtatatcaataaacattttataacttgcagc

SEQ ID NO: 34150 - DNA, 321 bp, Homo sapiens
ggcttggacacagagggaaggaaggactcaaggccacccctcagggctgcgttctagtgtgggaagacaaacacatgccaggaaatgaggggacgcctgatactgcaggacctggtcagcgccatgaaggacagcagggaaaacggtggaaagactgtgcaagtgcagggcagcacttcatctgtgctgctggcagcttctctctgttaagatgactttgagcagagactggaatgagtaaaggagagagccacagagatgactgttggcatccaagagttcaaaccaatggcaaatggaaaacattcagaaaaataaaaa

SEQ ID NO: 34151 - DNA, 291 bp, Homo sapiens
cagacacagtacaagtggtgaagatgtaaagaaattggaaccatcacacattgctcctaggattgtaaaatggtggagtcactttggaagtttggcagttcctcaaaaatttaaacagagttaccatatgacccaacaattccattcaggcatatacccgagataactgaaaacagatgtccacacaaaaacctatatatgaatgttcatggcagtagtgtttataatatgcataagacagaaatttcaacatagctaaaagagtgttttttgaatgtccagccactgttg

SEQ ID NO: 34152 - DNA, 406 bp, Homo sapiens
gaggcaagagaaagaaaaaggaagagacagcatttggttatattacatcatttctaaaatctaatttcctggagtgagaatgacactaagggtacctacgagaacattccttcccatgtaaactaatagtgtaataaatactcatatagttactagttttagttgccaaacctagtttgtaaatggtaaatttgagaccagaactatattcttatgactatcagaccactgatagtttcactaagtcaactcccttcactaacaatttgattctacacacacacacacacacacacacacaccagtttcaacaattttctcataagctttaaatcaaattgatgagagaactttccctgtttttctgtcataaactacattatctggataaagttcatactatttt

SEQ ID NO: 34153 - DNA, 468 bp, Homo sapiens
gagatgggtttctgccatgttgcccaggctggtcttgaacatctgcctccgcttcccaaagtgctcggattacaagcgtgagctactgagcctggcctgatatctgtttttagagttgctcctgcagtggtgacaacctcttcctttttgttagacatgtcattccaatacgcccatgagccctggctctgacttcctgcagaactggaatctaggggtagaactgcagatggagctgagagatggagaagctggggtgattggcaagcttgagaaaatgtctgtgacttaatgcatttccagatttacatgaaaaaaaatctttggaccactggggagagacctactttctatgcaataaagaagagattttaatgccatgcagcctgattgcagaagcctctctcctcaatatacacagtccccagttactataccatggaatggagagattgattaggtttatcc

SEQ ID NO: 34154 - DNA, 440 bp, Homo sapiens
aaaatgtgttgtttgaaaattttttatgatgaatgcttgacagagatttacccactttcattatttctagtttttaaaaatgtcagtagactgcttatttgtgtattttatttttttggcttttttcctcctaagattttttttcataggttctcttttatcataatctcaaattcttctcattctatttcccctcccaccatacacactgtgaagcagtgactagctccttcttagctgcggtaaaacctgcaaatctttacggcatttgaacacagtgaccatttgtttcaaggatttagggcaaggaaatgtggagaagtactttttctggaatgtgaatggtattagacacaaccgtggatgtttaggattatagatcatgctgtgacagaatgacaaaggtgtcaatgtggtctttaatataatttgtgtgttgg

SEQ ID NO: 34155 - DNA, 341 bp, Homo sapiens
  misc_feature (11)..(12): n is a, c, g, or t
  misc_feature (14)..(14): n is a, c, g, or t
aaaggcagagnngnaggctgggggtggtagctcatgcctgtaatcccacccaacatactaacaaattaaactatttctatattgaacagtttgtggcctttgtcccagactggtatttctactagttactcaaacaatgacaccctgttgagtttagtttaaaaatacacgcagaagttcatgattatctatattacaagaataaatacagaaatcaaagaatcttccagcttacttgaactatattaaccagtttgccatactgagtggtaagttggatgacttcagtgtttatttatttataaagttacatcttaaagtggccaggcacagtggctcac

SEQ ID NO: 34156 - DNA, 382 bp, Homo sapiens
agaagagcaagtagaaggcaagaaaagcaggagatgatgtcagagaggtggccatgtaggagcctgtgagccacaacaaggagtcttcttactcttcccattgggctgccacaagcaaagagccacatcctgcacaaggttaatacaaatgatattacaagtatcccaagttaatgcaagatactccaaggtaatacaaaagataagggaggaaaatttcatttaaaaacatggttttggccaggcgcggtggctcattacctgtaatcccagcactttgggatgccaaagcagacagatcacttgagctcaggagttcaagaccagcctgggcaacatggtgaaaccccatgttgtctctaccaaaaatacaaaaaaaaaa

SEQ ID NO: 34157 - DNA, 1531 bp, Homo sapiens
  misc_feature (658)..(658): n is a, c, g, or t
  misc_feature (849)..(849): n is a, c, g, or t
  misc_feature (1199)..(1199): n is a, c, g, or t
ggggggcccgggcacaagcagttgagggaaggagactgtgcccctcctggctcccaagtcttcaaggagaagattctcccaggaaatctgacctcagaagacacctccttggggcctctctgctgtcacagccatgccaccttagagctttgtaaagcctgcaaagggctctttaaaaacttcaagccaggcgcagtggctcacacctgtaatcccagcactttgggaggctgaggcaggcggacacttgagcccaggggttcacagctgcagtgagctgcggtcatgccactgcactccagcctgggtgacagagtaagaccctgtctcacagaaataagtctaactttaattgaaatgctgtagcaggctgagcgcagtggctcttgcctgtaatcccagcactttggggaggacaaagtgggcggatcacctgaggtcaggagttcgagaccagcctggccaacatggtgaaacccgtctctactaaaaatacaaaaattagccaggtgtggtggtgtgcacctatagccccagctattcaggagactgaggcaggagaatcgcttgaacctgggaggcggaggttgcggtgagctgagatcatgccactgcactccagcctgggcaacagagcgagactccgcctcaaaaaaanaaataaataaataaataaatacatagccaggcgtggtggcaggtacctgtaatcccagctactcgggaggtgaggcaggagaatggcttgagcccaggaggcagaggctgcagtgagccgagatcgtgccactgcgttccagcttgggcgacagagcaagactgtctcaaaaaaaaaaaaaaaaaaaaaanaatagcagcgtccaactgctacaagctttgtttctaaacccaattcctgcactcacctagtgtcagaaaggtacaagatggactcgctacatggtgtgaccctcctagggaactgcttccaacttcaacttttaagcatgagccaaggactcctgacactagaggaacaagacaccaaaagaaacatgatgtggacagaagcctcctaatgacccatgctatggcttgggactcagagaaagcgctgtgactcagaactgaccctgaaggcccacagtggggagagtggaaaagagctcctgaagatgaaaagcatcagacaaaatcaaaagctcaaagataacaaaccnggaaaagaaaaaggttacgaggacactccaggtctgacatctgagtttgaaagtcacgagtttccaagacggaaagaggccaccaagcgcacagcacggtggataaaagaaaccctaggatgtggaagagaaaaggacaatctcacaagaaaaaaatacatcccaacagaaatggctaagaaaaatcatggaagaactgccctcagaattctgaagggactaggtgcagtggctcaggcctgtaatcattccattttgggaggccaaagtgggaggattgcttgagctcaagacaagtgtgggcaacacagcaagaccccatctcttaaaag

SEQ ID NO: 34158 - DNA, 523 bp, Homo sapiens
ctaaaatagtattacacataattgctattttatcatttcaagttttatttcagattcggggatacatatgtgcgttagttacatgggtatgttgcatgttgctgagggtccgggtatgattggtcccatcacccaggtaaagaacatagtacccaatagttagtttttcaacccttgctcccttccctcacccccaggagtccccagtgtctactggggacatctttatgtccatgaatacacaatgtttagctctcacatatagggtgtattttttaaggtactaacgggtggaattaggcctaccctattgcttagcttgccatgattattcaaatccaaagttgacataaataggactttaaggccttgaaccaggcttgtttaaggagtcactccttcagccttatgaaatgttccattgtaattttttaaaaataataggaagtatgaatagaaatctgtacctttcttgtgttttctcctagaaacgttaataaaataatttagaagtagaaggaca

SEQ ID NO: 34159 - DNA, 345 bp, Homo sapiens
ggtcgacacatgatccacccacctcggccccccaaagtgctaggattacaggcatgagagaaccttggtcttattattgaattggcttaaatgcagctgctcttctgcagatgtggggtctgtctgccacatagattcattctgtgcagtcaaaagacttcccctggatggtgatgcagattgacaagatcctcttctctgacgttccaaagactagattctgtgcaggtcactcgcccttcagtgtgctcattttattgttttcttcaaacaggttgatgcacttgataaggccacagcttcttcttatcttaaccttgttttttggttaaatcgacagtgcaa

SEQ ID NO: 34160 - DNA, 302 bp, Homo sapiens
actgaagctttgagagattagataatttaccaaagggctcagagttaacaaggcagggatctgaatttaggtggcagactcaagcccatgtgcttcagtcacccattgaagcactatccttgggtaatacagatacctatgatgacattcagacctcataggctcctataagctgtcagggatacctggaaatattctttgttactggtccaaaatggctgatgcagttgccacgatgcaattgctcaagcagagatgtctgtggtctactacagagtttatctgtattaatctcttctcat

SEQ ID NO: 34161 - DNA, 674 bp, Homo sapiens
cctgtaatcccaacattttgggaggccgaggcgggtggatcacctgaggtcaggagttcgagaccagcctggtcaacatggtgaaaccccgtctctactaaaaatacaaaaaaaaaaaaattagctgggcgtggtggcacacgcctgtaatcccagctacttgggaggctgaggcaggagaatcgcttgaacccaggaggcggcggttgcagtgagctgagattgtgccattgtactccagcctgggcaacaagagcgaaactccatctcagaaaaaaaaaaaaaagctatcggatgtcactctaatgccatgtgactatcctgtttcccaataacctcttccctaaagattttagcatccgttgattactgtttcctgactcagtcatttaatattttttaattttttaatttattttggtcagatgcagtggctcacacctgtaatcccagcactttgggaggctgaagctggaggatttcttgagtacaggagtttgagaacagccctggggaatatggtgagaccatgtctctaccaaaaaaaaaaaaaagtagccagatgtcatagcgcaatacccgttattccaactaacttggaaggatcattggaccatgatatccagagtttccagtgggcgagatcacaccattgcactcagccctgtgtgaca

SEQ ID NO: 34162 - DNA, 1480 bp, Homo sapiens
tcatttacttttttttgagatagggtctcactatgtttatcaggctggtcttgaacttctggcctcaaatgatcctcctgcctctgcctctgcctcccaaagtgctgggattacaggcttgagccactgtgtctgtcctctttttggaattaattagggcttgttaatttttttaaattatatgttttgtgataaaacatttagaagtccatgttttttattctgtactgtgtagcttaagaaatgtcaaaaccaggagtacaggcttattgggcacactagaaacaagagtgggaaagggttaattcacagacctggccagtctcctcctgtcttcaaggcgatgatttaccctgtgattctcagacttcacatgtaccagaaatctttggggcaacgtgctaacgtgcaggttctcagtccctttccccagcgattctgattcgtggaatttcagttgatcattcaggacacagtataaagttcttatgcagagagaagctgacttgaactatccctatatgactgaggtgcttttaccaggaaggggcttttatagtttcagtcatatatggatgaaaaaggtgctgtattctttttctatgaactactttgtgtattttataagcagtatatatgtactgatacttgtttatcagacattgtgcggtgcatggtgtagaaaactcaaggttattcttttaacttgcacatcttttttactttatttcaatcatttacatcaaactatttcttaatttagtatacatttctctgcttttgcaaacacagtctactggggataattaaatcttttcagagtcgtcatatatgtttttaattctttcaggccctacttagttttgttaaagtccctacactgaaggctccagatacatttgctctttgagttctaccatggtttttagagtttttcttttccctcacttttatctgtcatttatctctcccattactgtgcctacctctaggaagctttctctaatttgccctggggttgggaaattgtgtaactgcatactatatgttgaataagagtagagaggatttgaatgaggttttgagaggctgttctagcaataaaaatgaatgtactttgctacattgacttggtgacattatttcagtggctcaactctcttcccctaacttacttctttatcctcatctgcagttgtcatatttgtgaactcgcggcaagtgagatattgctagaaataatttctcttgatcaataaaccattgtctcccccagctgtgttagtgtttttgtgtattcagttctataatgtgaaacttaagaggattaaaactcaaaaaatgatcaggccaaatttttatgtgggatgaagtgtttctgattcagtgttattgtgatatagagctataaattagttgtttacctatgaaattccttcctgcagtcattctgaaataaagttgttacagctgaaaaata

SEQ ID NO: 34163 - DNA, 349 bp, Homo sapiens
agaaaccccgtctctactaaaaatacaaaattagcagggcgtggtggcacatgtctgtaatcccagctactcgggaggctgaggcaggagaatcgcttgaacctgggaggcacaagttgcagtgagccgagatcgcgccattgcactacagcctgggcaacaagagcgaaactctgtctcaaaaaaaattaaaaaaaaataaataaataacaggcactcacctttcaaagatactcagtgtattattttttaacttttctgtaggtttaaattcttatttatttatttttttgagatggagtcttgctctgttgcccaggctggagtgcaatggcatgatctcagctca

SEQ ID NO: 34164 - DNA, 688 bp, Homo sapiens
ttagaagctatgaattggtccacatactctgcatgtgctgtctgctagaggctgcaaggcgagctgcttcactgtttcatgttccaatctccaccacccagactcctgctccaataacatctctagatctattcacttgtaacaaatggagcccagttctcctccctccccaaggaggccagacactcgatacaatgaaaagaacacaggattcagacccaaacaaatttgtgtccacattctgattctgccatttactctccatgccatgtgcccctgggtgcgtttcttaaccactctgaacttcggttcttaatgcttaaaaatggggagcagtatttgttttatagaatctttgggagtattacacaaaattctaaagacagtgtctggagcctagaaaacgctcactaaattctgattatgactgtttcaaggtgtgactaatcaggatgccaggaaccctacgatggaggcacttcagtttctgggccttgctgaaacattcttgaaaagaggaaacaataaccgtagcctgagatattcgttccttttttttttactctttggagagtacttaaaaaaagaagaaaaaagaaatagtcatagtgattggcatgctattctacctctacatttccaggaaatatacatggtactttttcttatagaaacagcatctcctcca

SEQ ID NO: 34165 - DNA, 1576 bp, Homo sapiens
gataataggttttttacatcacattaacactattttttccaagtcacaaataagaaaaacacttattcaatgaaacaaggtgcaagttttaaatttgggtacacaaatagcctagaagcttcctacagacgctaagacacagccaataatcagatcctttcacttcatcgagaaacttggacaagtcgatattgatgtattagatgaaagttgtctacacacaacttctgagggatacaaacgataataaaaccaaatgttgtctgtttctcctttagaaacacctcctaaaattaatatcatttagtctctagtgtctgtaggattctacagatgagcacaaatagattgggtttgtataacaaatgctaatagtcataactgtttctacaaatatggggtgtccattaagagaatgtgatgttttcctactgctgttgaatcccatggggtgattataggacttgaaataggcagagtcacctctgatgacatcagcttgcctctgtgatttcacagtctgatcctggcaacaagacaaagcacccttggacacacagccaatctctggttgtgatatttccccattgattccttccttgttaacaaggtcattttaatggttcaggtgaggacagcagccagattcaaagtccagaatttgtgctgttacatagagttcacactgtcaaataacattgaatttaataatgatcaaatttttctagtagtctttggcagagtgtataatctcattggcatgattggtgaatattactaatctctttataatgaaagatgctttacaaataccttatatttgctaacatttcaaaactactaaataaatgaaatagccatgtgtacagaaatggtcatttaaagctttaatagaaccaaattcaagacaatgtatcatttagacacacagaaaaggaacttgtatgttttccctattatttttctcatttgccaacaatctatagttttaggttatcaaacagatagatcaacttaactggctagtacattgaaaaatcttcctaagaatcctttgttagcataatctatagagataatttctcaaattatatcatcatgatgcatataaactctataatgtataattgtgtttcatttatttaatgtatgagaacatattgaaatacaaaaccatgcattagccaaaaaattggaatacaggtagtgttcagatcagcaaaacattcagtctggtaaatgcctgcctggggctatgatatcattctcaatgcaggttttatggaaaaactaaaagaatatgttgttagatgatgttggttttgaaaaaaaaaaagacattaacatacacattagttagcccagttaattgcattctactaatatagttgcacattagcaataattttgctgtctctggtctttattttgtggcttcaactaactggaccatgtggactgtaaaggtcaaatggaaaaaacgagcagtggcccctcatcctgtaaggtactgctacatcagagtgacctaaaagtctaacactgtgaggaaaactgtgatttgtaggaaaaaaaa

SEQ ID NO: 34166 - DNA, 398 bp, Homo sapiens
catggcatggtgccgagggttgttcatcctcccacgtggggctgggggccgaccccactgcccacaggcacattttctactgtggacaaccctgtcagctggagccagcccaaggagtggcacacagcctcacccttcagtgcctttttgctctactcctgcccatgcttacagtttacctttcattggtgcagcactgagtgctctggaacacacattcctcctgtagttgggcttgtagttgttaatatcatattgcccatctccagggacaaatttgggatattcactctttatttccatgaagagcccaatctagggtggttctttttattttttttttaaacagtctcactctctcgcctaggctggagtgcagtggcatcatctcagctcac

SEQ ID NO: 34167 - DNA, 137 bp, Homo sapiens
tctttagaattctgggtattattaaaggaagttttcctgatgcactgtcttctgctttaattcattcactcaaccatgctacagatgtttattgagaacacctaatattccaagcactctgctagaagttattttga

SEQ ID NO: 34168 - DNA, 444 bp, Homo sapiens
atctgctttaaagcctaaaaaccagagaggtgcccagtagccaaaaatcaaaacataggctgaacctgagaagacatgtaatcaaaaactgacctctagtgatggcttgttaccaaaacccaccatctaggtaaaatcaggctacagaaaaggtagctttaatgtcttttcattgtggttattatgttacatggttattggcaatttattgtctcagcttcccttttataaataattattagtaaagtgaacagccccagagagatgggattcttagatttcagtgtgtctaacaatgcagacactcgacaggttttaagggaaccatcactaaccttaatcttagccctcttctcccaggctgaccaatcaagagtgtttgattttaggaaataaatgttaactgactaaatgagctgatgctaatcaacattaactggaaga

SEQ ID NO: 34169 - DNA, 407 bp, Homo sapiens
tagggagctggggtgaagcgcagccaggctgtgagtacagcctcctcgctgctctcagcccccaggcgaggctctctccacagccccaactgctgtcagtggacagcctcctgtccccaacctctaaccgtggcagccagtgagcagtggctggacagcgggatcgggcttatctgacttgcatctaaagtaaagctttgctcctgagtgcacataatcacacacacacgtgagccatggttctcatacccacttctctctggggagagaaccagagtttgatcagggcctcagaggaatgcatgactcaaaaaggtcaagaattacaagagaagccaggctcagggtgagagcctgctgtgccgggtgcagggactgggaagcatctacaaccacaactgtaagat

SEQ ID NO: 34170 - DNA, 291 bp, Homo sapiens
ctttacacctagaaagttcattcattcatttgttcattcaacagatatttattgagtgcttactttgtattaggaactcttctaggccgggcgcggtggctcacgcctgtaatcccagcactttgggaggccgaggcgggcggatcacgaggtcaggagatcgagaccatcccggctaaaacggtgaaaccccgtctctactaaaaatacaaaaaattagccgggcgtagtggcgggcgcctgtagtcccagctacttgggaggctgaggcaggagaatggcgtgaacccg

SEQ ID NO: 34171 - DNA, 544 bp, Homo sapiens
agaggaggtgattcatagtgagaagacattctgtgaagtatactaccctattagagattctagtatcctagagatgagtggatctcaggttttagtatacataggaaccccctggaaccccctgtttgttaaaacaggttcctggcccccaccccagaggtcttgggtacagcctgagaatttgcatttctgatctgctttcagatgatcttgtaagattttgtaagattgagaactaaactttgggtagcatctttatagattagacatatgctgtacttaaatgggtgaattttatgacgtgaagtatatctcaataaagatgctaaaaaattggtataaagatagtaaaatgtaagttttagtggtttgttaatggcaagacaatgctctgtaagggaattggtttaattattaatttcttcatttgtaaaatgtgtcactctcctgtgtatgtaccacctagggttgtggtgaaaatggggttatgtgttcttttccaaatggtgttctgtgggtaaaacgtgttgccttaaaaaaaaaa

SEQ ID NO: 34172 - DNA, 3201 bp, Homo sapiens
  misc_feature (299)..(299): n is a, c, g, or t
cattgcattgcgcagagctcagccatctttctcatccgtcaggcattcctgagaaagagggccactctacctctcttgctgccagccttcactccagcaaggagggtgctgggtgacctgagcccacatagccccgagtgagcagtgaggctgtctcctgccctcttctgcctggagggctcgtcagtgtccccaggtgtcaggccctgcctcctgacgttggccttttcactacaggcacccgaagcacacacagcagagtcctctggactttgaggaagaacccacagcaggaggangctgtgtgaaacctgggaccacttctgccttcctacgtggcagtggctcagagttatttgagtgctgtcaaactgagctgattgctgccctagtattagatcagtccatagaaagtgggagcaatggcactgacactgctagaggattggtgcaaggggatggacatggaccccagaaaggccctgctgattgtaggcatccccatggagtgtagtgaggtggaaattcaggacactgtgaaggcaggcttacagcccctgtgcgcatacagggtcctagggagaatgttcaggagggaagacaatgccaaggcagtcttcattgaactggctgacactgtcaattacactactctgcccagtcacataccaggaaagggtggctcctgggaagtggtggtaaaaccccgtaacccagatgatgagtttctcagtagactgaactacttcctgaaagatgagggccgaagtatgacagatgtggccagagccctgggatgttgcagcctccctgccgagagcctggatgcagaggtcatgccccaagttagatccccacctttagagcctccgaaagaaagtatgtggtacaggaaactgaaagtgttttcgggaactgcttcccctagcccaggcgaagagacctttgaagactggctagagcaggtcactgagataatgcccatatggcaagtgtctgaggtggagaagaggcggcgtttgctggagagcttacgtgggcctgctctgtcaatcatgcgggtgctccaggccaacaatgactccataactgtggagcagtgccttgacgccctaaagcagatctttggggataaagaggactttagagcctctcagtttaggtttctgcagacctctccgaagattggagagaaagtctccactttcctgctgcgcttagagcccctgctgcagaaagccgtgcacaagagccccttgtcagtgcgcagcacagacatgattcgtctgaaacatctcttagctcgggtcgccatgacccccgccctcaggggcaagctggagctcttggatcagcgagggtgtcctcccaattttctggagttaatgaagctcattcgagatgaagaagagtgggagaacactgaggcagtgatgaagaataaggagaagccatcagggagaggccggggggcctccggtagacaggcaagagcagaagccagtgtctctgcacctcaggccaccgtgcaggcaaggtcttttagcgacagcagcccccagaccatacagggaggcttacccccattagtgaaacgcaggcggctgttaggcagtgaaagcactaggggagaagaccatggccaggccacgtatcccaaggctgaaaaccagactccaggcagggaggggccacaggctgcaggagaggagttgggaaacgaggcaggggctggggccatgagccatcccaagccctgggaaacataggctcagaagaccgaagcactccttcccctggcaggcagcagggacatttgaacaaggggaaggggcagcttacactaacagggaacttgactggggcagagggacagggaagccaggtcgagatcaagcccccttactttccaccagctggaagggacttcaccaaccaagaccaaatagcatctggttcagtgggggccgggcccatagcccctaacaggtacaggagacacaagcggggaaccactacacttagcacatggggtgcctgggcttcagatggggaccccagcgaagcaggggctgaagaaggtgtggctgggggctctggcctggtcctctggacacccccaaatatctaccctgtggactttgagctgagcatgcccactggcacccaggccacgtgggacctggaggagcctgcctggggcctgcctctgccagaaggagccagggctgctgaggaagagctgtggggcagaagtgaagccccgcaggggaggccacagggtccagcctgtctttaggatcatctacactgcatgaggggagccccaggaaggcagcattcataagcccctgcaccagtgaggaagagaaagaggaggagaattaagaagaggatgatcgggaggaggaagaggagaataaggaggagcaggaggaagagggggaggagaaggaggaagagggggaggaggaagaggggaaggaggaggaagaagtgtaagaagagaagagaggatgtgttgggggtgggtagttgtttttggtttgcgtcatcatcaggcccgggctctgctcactgctgttccgtgtcaagaactccacctctgctttgccggtgtagatctcggccagtggctgcttgttctcttggggatgtgtgtgtttttatctgagcagctcctttccagagtaccccagcgcagttccaggagacggtgggaaggaggcatggcagacgctcaccttgtgactgtgacctcgactgcaggaggaccaaccagacacgggaaggagcagggctgcctgaggctccccaggaagctttgtgctttggcgttccacccctgctgttactcgtgactcagtttcctcaacttggtggggtgttccctgctatgttttccagcatcctgtgactgtcctgtgcagtctatagggcagggccctgccccagcgggtgggctcaggagggggttccctgaagcgagtacacattgccagagcccaccatcctggcaagaggtggatcctggggccctatggaaggagggatgtggtggggggggccacactgagggaggggccggggacttgtgacctgtagtggctgtttgcagtttctctctgtgttagattcccttttcttcagcagtttcagttcatgtttctcttcagtaaattttgttcagtgttccagtgg

SEQ ID NO: 34173 - DNA, 363 bp, Homo sapiens
ggagatgtgggtgaacaactacatggaacaaaagcatggtagaagaggggattataaaaagagaggtctacaatgaaagggccaggtgagacggctcatgcctgtaatcccagcattttgggaggcagaggtgggcagatcacttgaggtcaggagtttgagaccagcctggccaacatggtgaaatcctgtctctactaaaaacacaaaaattatccaggtgtgatggcactcgtacctgcaatcccagctactcggtaggctgaggcaggagaatctctacaacctgggaggcagaggttgcagtgagccaagatcatgcccatgcactccagcctgggtgacagactgagactatgtctc

SEQ ID NO: 34174 - DNA, 324 bp, Homo sapiens
acaggatgaatatccactagacttaaatgagggtataaataaatagattacttctcattcttcaacttaactaaaagcagagtgatgaactaaaatataatattattttgtaagattttcattggtagccaatacattcaagtagaaccttttaaagtggagcctttgatctttttcacaaaattcagacacttgcaatggtttggatgtgtgtgtctgtacatgcttttattttctttccctgtgctgccccaactatgactgggaggatcaaatccacagcaagttcatttctgggccaactctgccaaattatatgatgtg

SEQ ID NO: 34175 - DNA, 211 bp, Homo sapiens
ggtaagtttggcccacaaaactcattggcatgctttggcaccaactccagccctgaatatgttcattttacatctggactcaccatagctaactaattcaatccctgtattcaaatttcaaatttcacagaagaatttgctagcttaagtcagatgtccatttagtccagttaactgtaactgggtaaggcagagtcatatgaaaaaaaaa

SEQ ID NO: 34176 - DNA, 968 bp, Homo sapiens
gtgtgggatgaagggtgccaaggagacagggcagggcagggaccctcaagaaaagcggggaggcggggggaagggatggtacaagcagccatggcacctcagtgtgtccctcaggcacctggacacacaggtgggcaaagatgctgacactgggggccagaaacgccgatacccccattcttccatttttactcagtctcaggtggtcccaaggaggggaccttcgtggccttgctgtgctcacaggctcacctttgtgtttccagctgcagagaaagtaccctgggccatgcagctgcactcccctcccaggaaaggggcaggatggctgcccagatgagtgaggcatcagccctggccccccaggtcttcccgagtccactggaactgatggtgggtgagcccagctccaagagccctggccagtgcttctgggggttctgctatgagaaggcagcagggccccgaggggccctggctcagctgcgtgagctgtgttgccagtggctgatgcctgaggcctgctccaaggagcagatgctggagctcttggtgctggagcagttattgggcacactgctcccagagatccaggcctacacgcaggagcagtggctaggcagccctgaggaggccactgccctggcagagcggctacagcaggagtcagctgggccaggactccagatgaatgggggctggtctgggggctgggtgtgcttcccctgctcacgaccccagctgagccagcactggggccagtcgtgggttggtggctgagagggcctgggggctgtgggaaagtgatggtgacaggtgggagtttggtggtcttggcttggacggcagagtcagagatctccagtccacacctgtgtgctccgcattgtgtcctgagaactgaaggtgcagagaagggtgggtcatgccaccgcatgccccttgttttctcagatctgctaggctga

SEQ ID NO: 34177 - DNA, 457 bp, Homo sapiens
ccacctgctcagaaaatcgaaccttcacaggattggacctcaacttggccttcttcgcagcactgatgaaagcagatttgggggactggaaaaagaacagagagatggtcttcatggccctgcaacttcctcttcagctgagcttggagaggcatcgtctggaaaacatggtggtatctggattctttttctggttgtccaaacagttgcttttccccagtgggctggaatggagacacctgtcacccattctagcaggtcaggagggagcagggggagagaccaaggtcatctttcctttcacaaatacctggaaacctggagtcaccttgcaaaagaccaaccccataatgcttcaaagagggaactgcagaggaccctctatacagctgtcccctcccctgtcccctcctccctcctgaagctatagtcaataaattcagacatgttgtctaat

SEQ ID NO: 34178 - DNA, 412 bp, Homo sapiens
attcactctattttatcttgatggaaatatttatacttatattcttaagtgctattgttttgaaaggaaaacatatctattagtacaatcaaggggctctgcaaaacttattaataatagggtttgctggtattttagacatgttggcaagtaacttttcaccatgctttcagacagtttttaactagagcctaggtgcgtatcaggtaacatatttcacttttctgaaagaaaatgctctaagacacttttcagagtgaccatgggactgcatgatctttctgcagactcatctgcacctaagtggctggactttcattgttctaattttaatcacatcaatcccttgaaaaatacctaatccttcttctggcttcgctgtactttgcgcatatgttggaagtttaagttg

SEQ ID NO: 34179 - DNA, 4273 bp, Homo sapiens
gtggtcgaccatcctgttcaatgtactgccctacaaggcgacagacacctacatcctgaagagcccggacgaggcctcacagctgctggacgaccacatcgtcatgacccagaatatgtcattttcaccctacaagaagccctttgagcagcgcatcaactcctgggagaacaaactgaagctgacccaggaggttctggaggagtggctgaactgtcagcggtcctggctctacctggagcccatctttagctctgaggacatcaaccagcagctgcctgtggagagcaagcgctaccagaccatggagcggatctggaagaagatcatgaagaatgcctacgagaaccgggaggtgatcaatgtgtgttccgacctgagaatgctggacagcctgcgggactgcaacaagattctggacctggtgcagaagggcctcagcgagtatctggagaccaagaggagcgccttccccagattctacttcctgtcagatgatgaactactagagatcttgtcgcagacaaaggaccccacggccgtgcagccacacctgcgcaagtgcttcgagaacatcgctcggctgctattccaggaggacctggagatcacgcacatgtactcagccgagggggaggaggtacagttgtgcttctccatctacccctccagcaacgtggaggactggctgcgggaggtggagcgcagcatgaaggccagtgtgcacgacatcattgagaaggccatcagggcctaccccacgatgcccaggacccagtgggttctgaactggcctggccaggtgaccatcgctgggtgccagacctactggaccatggaggtggcagaggctctggaggccggcaacctcagaagccaactgttcccccagctctgccagcagctcagtgatctggtggcccttgtgcgggggaagctgtcccgcatgcagcgggcagtgctgtcagcgctaatcgtcattgaggtccatgccaaggacgtggtgagcaagctaatccaggagaacgtggtcagcgtgaatgacttccagtggatctcacagctgaggtactactggacaaataatgacctgtatatccgtgctgtgaatgctgagttcatctatggctatgagtacctgggcaacagtgggaggctggtgatcacgcccctcaccgacaggtgctacctgacactgaccggagctctgcacctcaagtttgggggtgccccagctggcccagctggcacaggcaaaactgagaccaccaaagacctgggtaaggccttggccatacagaccgttgtgttcaactgctctgaccagctcgacttcatggccatgggcaagttcttcaagggcctggccagtgctggggcctgggcctgcttcgacgagttcaatcgcatcgacatcgaggtgctgtctgtggtggcgcagcagatcaccaccatccagaaggcgcagcagcagcgggtggaacgcttcatgtttgagggtgtggagatcccactggtgccatcctgcgcagtgtttatcaccatgaacccgggctacgctggccgcacggagctgcctgacaatctgaaggcgctcttccgacccgtggccatgatggttccagattacgccatgatcactgagatctccctctattcctttggctttaatgaggccagtgtgctggctaagaagatcacaaccaccttcaagctgtcttctgagcagctcagctcccaggatcactatgacttcgggatgagagccgtgaaaactgtgatctcggctgctgggaacctcaagcgagaaaaccccagcatgaatgaggagctgatctgcctccgggccatccgtgatgtgaacgtgcccaagttcctgcaggaggacctcaagctcttctctggcatcgtgtccgacctgtttcccaccatcaaggaggaggacacggactacggcatcctggatgaggccatccgcgaggcctgcaggaacagcaacctcaaggatgtggagggcttcctgacaaagtgcatccagctctacgagaccacggtggtacgacacggcctcatgctcgtcgggcccacaggctccggcaagagtacttgttacagagtcctggcagctgccatgacgtcactgaaagggcagccatccatcagtggtggcatgtacgaggctgtcaactactacgtgctcaaccccaagtccatcacgatgggccagctgtacggggagtttgacctcctcacccatgagtggacagacgggatattctcctcgttcatccgggcgggggccatcacctccgacaccaacaagaagtggtacatgttcgatgggccggtggatgccatctggattgagaacatgaacacggtgctggatgacaacaagaagctgtgcctcagctctggggagatcatcaagctcacagaggcaatgaccatgatgttcgaggtgcaagacctggcggtggcttcaccagctacagtctcccgctgtggcatggtgtacctggagcccagcatcctggggctcatgcccttcatcgagtgctggctgaggaagctgcctcccttgctgaagccctatgaggagcatttcaaggccctctttgtcagcttcctggaggaatccatctccttcgttcggtcctcagtgaaggaggtgatcgcctcaaccaactgcaacctgaccatgagcctcctcaagctgctggactgcttcttcaagccctttctgcctagagagggcctcaagaaaataccctctgaaaagctgagtcgcatcgtagagttgatcgagccctggttcatcttctccctgatctggagcgtgggtgccactggggacagcagtggccgcaccagtttcagccactggctaaggctcaagatggagaacgaacagctgactctgcttttcccagaagaggggctggtgttcgattacaggctggaggacgcgggcatcagtggcaccaacgacagtgaggatgaagaggaggaatacaagcaggttgcctgggtgaagtggatggactcctcagctccattcaccatggtaccagacaccaactactgcaacatcattgtgcccaccatggacaccgtgcagatgtcccatttactggacatgctgctcaccaacaagaagcccgtgctgtgcattgggccaacaggcacggggaagacgctcaccatctctgacaagctcctcaagaacctggcactggattacatcagccacttcctcaccttctcagcccgcacttcagccaaccagacccaggacttcattgacagcaagctggacaagaggcggaagggtgtgtttggaccacctctggggcgcaactttatcttcttcatcgatgacctgaacatgccggccctggagacctacggtgcacagccacccatcgagctgttgcgccagtggatggaccacggcggctggtacgaccgcaagatcattggtgccttcaagaacctagtggacatcaactttgtctgtgccatgggccccccgggtggaggcaggaacaccgtcaccccgcggctgatgcgtcacttcaactacctgtctttcgctgagatggacgaggtcagcaagaaacgcatcttctccaccatcctgggcaactggttggatggactccttggagaaaaaagctaccgggagcgtgtgcctggggccccccacattgcccacttcacggagccccttgtggatgccaccatcatggtgtatgcaaccatcacctcccagctgctgcccactccagccaagtcccactacaccttcaacctgagggacctctccaaggtcttccaaggcatgctcatggctgacccggccaaggtcgaggaccaagtgcagctgctgcgactgtggtatcacgagaactgccgcgtgttccgggaccgactggtgaatgaggaggaccgcagctggttcgaccagctcctcaagcgctgcatggagcagtgggaggtgaccttcaacaaggtctgccccttccagcccattctttacggggacttcatgtcaccaggctccgatgtcaagtcctacgagctcatcaccagtgagagtaagatgatgcaggtgatagaggagtacatagaggactacaaccagatcaacacggccaagctgaagctggtcctcttcatggacgccatgagccacatctgtcgcatcagccgcaccctacgccaggcgctgggcaatgcactcctgctgggcgtgggtggcagcggccgc

SEQ ID NO: 34180 - DNA, 3917 bp, Homo sapiens
ttcaaccacggaggggtcattttttaatcatcctcatttccccctcttaccgtgaggttatttcatccaagcctggactagtgacagaatctttacccccctaatcagagctgcactcagatctcaggtcttcaatcttattgggtatatcctcagaggttgcacttatgccttttatatacaatagttaattatatacaggtagtagtacatattatcctacacaaaaagtatatgaaatttggagaaactgaaatgagccgtactcagccgagggggaggaggtacagttgtgcttctccatctacccctccagcaacgtggaggactggctgcgggaggtggagcgcagcatgaaggccagtgtgcacgacatcattgagaaggccatcagggcctaccccacgatgcccaggacccagtgggttctgaactggcctggccaggtgaccatcgctgggtgccagacctactggaccatggaggtggcagaggctctggaggccggcaacctcagaagccaactgttcccccagctctgccagcagctcagtgatctggtggcccttgtgcgggggaagctgtcccgcatgcagcgggcagtgctgtcagcgctaatcgtcattgaggtccatgccaaggacgtggtgagcaagctaatccaggagaacgtggtcagcgtgaatgacttccagtggatctcacagctgaggtactactggacaaataatgacctgtatatccgtgctgtgaatgctgagttcatctatggctatgagtacctgggcaacagtgggaggctggtgatcacgcccctcaccgacaggtgctacctgacactgaccggagctctgcacctcaagtttgggggtgccccagctggcccagctggcacaggcaaaactgagaccaccaaagacctgggtaaggccttggccatacagaccgttgtgttcaactgctctgaccagctcgacttcatggccatgggcaagttcttcaagggcctggccagtgctggggcctgggcctgcttcgacgagttcaatcgcatcgacatcgaggtgctgtctgtggtggcgcagcagatcaccaccatccagaaggcgcagcagcagcgggtggaacgcttcatgtttgagggtgtggagatcccactggtgccatcctgcgcagtgtttatcaccatgaacccgggctacgctggccgcacggagctgcctgacaatctgaaggcgctcttccgacccgtggccatgatggttccagattacgccatgatcactgagatctccctctattcctttggctttaatgaggccagtgtgctggctaagaagatcacaaccaccttcaagctgtcttctgagcagctcagctcccaggatcactatgacttcgggatgagagccgtgaaaactgtgatctcggctgctgggaacctcaagcgagaaaaccccagcatgaatgaggagctgatctgcctccgggccatccgtgatgtgaacgtgcccaagttcctgcaggaggacctcaagctcttctctggcatcgtgtccgacctgtttcccaccatcaaggaggaggacacggactacggcatcctggatgaggccatccgcgaggcctgcaggaacagcaacctcaaggatgtggagggcttcctgacaaagtgcatccagctctacgagaccacggtggtacgacacggcctcatgctcgtcgggcccacaggctccggcaagagtacttgttacagagtcctggcagctgccatgacgtcactgaaagggcagccatccatcagtggtggcatgtacgaggctgtcaactactacgtgctcaaccccaagtccatcacgatgggccagctgtacggggagtttgacctcctcacccatgagtggacagacgggatattctcctcgttcatccgggcgggggccatcacctccgacaccaacaagaagtggtacatgttcgatgggccggtggatgccatctggattgagaacatgaacacggtgctggatgacaacaagaagctgtgcctcagctctggggagatcatcaagctcacagaggcaatgaccatgatgttcgaggtgcaagacctggcggtggcttcaccagctacagtctcccgctgtggcatggtgtacctggagcccagcatcctggggctcatgcccttcatcgagtgctggctgaggaagctgcctcccttgctgaagccctatgaggagcatttcaaggccctctttgtcagcttcctggaggaatccatctccttcgttcggtcctcagtgaaggaggtgatcgcctcaaccaactgcaacctgaccatgagcctcctcaagctgctggactgcttcttcaagccctttctgcctagagagggcctcaagaaaataccctctgaaaagctgagtcgcatcgtagagttgatcgagccctggttcatcttctccctgatctggagcgtgggtgccactggggacagcagtggccgcaccagtttcagccactggctaaggctcaagatggagaacgaacagctgactctgcttttcccagaagaggggctggtgttcgattacaggctggaggacgcgggcatcagtggcaccaacgacagtgaggatgaagaggaggaatacaagcaggttgcctgggtgaagtggatggactcctcagctccattcaccatggtaccagacaccaactactgcaacatcattgtgcccaccatggacaccgtgcagatgtcccatttactggacatgctgctcaccaacaagaagcccgtgctgtgcattgggccaacaggcacggggaagacgctcaccatctctgacaagctcctcaagaacctggcactggattacatcagccacttcctcaccttctcagcccgcacttcagccaaccagacccaggacttcattgacagcaagctggacaagaggcggaagggtgtgtttggaccacctctggggcgcaactttatcttcttcatcgatgacctgaacatgccggccctggagacctacggtgcacagccacccatcgagctgttgcgccagtggatggaccacggcggctggtacgaccgcaagatcattggtgccttcaagaacctagtggacatcaactttgtctgtgccatgggccccccgggtggaggcaggaacaccgtcaccccgcggctgatgcgtcacttcaactacctgtctttcgctgagatggacgaggtcagcaagaaacgcatcttctccaccatcctgggcaactggttggatggactccttggagaaaaaagctaccgggagcgtgtgcctggggccccccacattgcccacttcacggagccccttgtggatgccaccatcatggtgtatgcaaccatcacctcccagctgctgcccactccagccaagtcccactacaccttcaacctgagggacctctccaaggtcttccaaggcatgctcatggctgacccggccaaggtcgaggaccaagtgcagctgctgcgactgtggtatcacgagaactgccgcgtgttccgggaccgactggtgaatgaggaggaccgcagctggttcgaccagctcctcaagcgctgcatggagcagtgggaggtgaccttcaacaaggtctgccccttccagcccattctttacggggacttcatgtcaccaggctccgatgtcaagtcctacgagctcatcaccagtgagagtaagatgatgcaggtgatagaggagtacatagaggactacaaccagatcaacacggccaagctgaagctggtcctcttcatggacgccatgagccacatctgtcgcatcagccgcaccctacgccaggcgctgggcaatgcactcctgctgggcgtgggtggcagcggccgc

SEQ ID NO: 34181 - DNA, 1300 bp, Homo sapiens
ggctgatgtagtcactcttgagggccagcgtccagatgcccactgccatgacagccagacctgagcaagccaggcctggcttgctcaggtcatggtaccagacaccaactactgcaacatcattgtgcccaccatggacaccgtgcagatgtcccatttactggacatgctgctcaccaacaagaagcccgtgctgtgcattgggccaacaggcacggggaagacgctcaccatctctgacaagctcctcaagaacctggcactggattacatcagccacttcctcaccttctcagcccgcacttcagccaaccagacccaggacttcattgacagcaagctggacaagaggcggaagggtgtgtttggaccacctctggggcgcaactttatcttcttcatcgatgacctgaacatgccggccctggagacctacggtgcacagccacccatcgagctgttgcgccagtggatggaccacggcggctggtacgaccgcaagatcattggtgccttcaagaacctagtggacatcaactttgtctgtgccatgggccccccgggtggaggcaggaacaccgtcaccccgcggctgatgcgtcacttcaactacctgtctttcgctgagatggacgaggtcagcaagaaacgcatcttctccaccatcctgggcaactggttggatggactccttggagaaaaaagctaccgggagcgtgtgcctggggccccccacattgcccacttcacggagccccttgtggatgccaccatcatggtgtatgcaaccatcacctcccagctgctgcccactccagccaagtcccactacaccttcaacctgagggacctctccaaggtcttccaaggcatgctcatggctgacccggccaaggtcgaggaccaagtgcagctgctgcgactgtggtatcacgagaactgccgcgtgttccgggaccgactggtgaatgaggaggaccgcagctggttcgaccagctcctcaagcgctgcatggagcagtgggaggtgaccttcaacaaggtctgccccttccagcccattctttacggggacttcatgtcaccaggctccgatgtcaagtcctacgagctcatcaccagtgagagtaagatgatgcaggtgatagaggagtacatagaggactacaaccagatcaacacggccaagctgaagctggtcctcttcatggacgccatgagccacatctgtcgcatcagccgcaccctacgccaggcgctgggcaatgcactcctgctgggcgtgggtggcagcggccgc

SEQ ID NO: 34182 - DNA, 473 bp, Homo sapiens
atggctgtgaaggaacggtagtcacagtggaaagaatggctagcatttacagagtttctactctgccaagttctgtgcttagggcttcacctgcccctgcctatgatgtaggtgctaccaccatcctcattttatagatgaggaaattgaggctcagggagtgcagtgactcacccaaggtcacacaagttagtggtgtggccaggacccaagcccatgctctgacccttgggccccatgccatgtcccccaggcttcctgacaaagtgcatccagctctacgagaccacggtggtacgacacggcctcatgctcgtcgggcccacaggctccggcaagagtactgtaagcagagccaagcttggcagccagtgtccggatagtgggcctgtaggggggtgcagcttcaacaggggttggcctccatttgtgccccttggcatagaatacccctccccctccccttggccccc

SEQ ID NO: 34183 - DNA, 387 bp, Homo sapiens
gaactgacaccagacgcagggagagagggaaacgtggctcacacatctgccagccagccagcccacgagcccaccacactgcacctgcatcgtagctggttccattttcaccacaaatcttatccacaggaaatgggctttcttaggagaagggaggaaatgcatttaatcagcacggaaggaaggtaattggtggttggcaaatttgtagctccgggcgtctagcgcaggtctgatgcccttcactcagcctgacgcccttcacagaagtgttgattgaataaacgatggtggtcctgatgctggagtgctaagtagatatttaaaaaaccacatttttgaagaattgctaatgtggggaatgtcccccttgtagtgctgagtgaa

SEQ ID NO: 34184 - DNA, 405 bp, Homo sapiens
tgagacagagttttgctcttgttgcccaggctggagtacaatggcatgatctcagctcaccacaatctccgccacctggtttcaagcaattctcctgcctcagcctcccgagtagctgggattacaggcatgtgccaccacgcctgactaattttgtattttcagtagagacggggtttctccatgttggtcaggctggtctccaactcccgacctgaggtgatctgcccacctcagcctcccaaagtgctgggattacaggcatgagccaccatgcctggccaaaaataaagaacttttaagacaaacctgaaaatcccagtaagagccatcttttgactggctttatgttactcttcagataccgtctaaaaggctcaagaccagccagattttaggtagggt

SEQ ID NO: 34185 - DNA, 443 bp, Homo sapiens
ttttttttgagacagagtctcagtctgtcgcccagactggaatgcagtggtatgatcttggctcactgcagcctcgacttctcgggtacaagcaattctcccacctcagcccctggagtagctgggactacaggagtataccaccatgcccaactcgtttttatatttttatagaaatggtgtctcaccatattacccaggctggtctcaaactcctgggctcaagcgatccatctgcctgccttggtctcccaaagtgctgggattacaggtgtgatcctctgagtctggccaatttttatttaaagatattttttaaattggactggacgcggtggctcatgcctgtaattaatcccagcaactttgggaggccaaggcggatggctttagaccagcctgggtaacatggcaagaccccatctctaaaaacaaaaaaagga

SEQ ID NO: 34186 - DNA, 571 bp, Homo sapiens
agtagcctagggttactgggcaacacaatggtgtcaccagctcactgtcccggctgcctgggtctggtggcagctgggggcttttatgacatcgcgtgtggggacctatggcaggagcctcgccctgtcctggcacacgttggccccaagcaaatgtggaggtcctccagagggacaaggaggcatcatgggcatctccacagctgatggcaggatcccgggtgccctgtaccccttcgtctgctgcctgcaatatggtgggtgggcacttcctgctgcttgccagcctagcctggcgagggacaacctctagtctcagacagcctcctgccatgcatgctcacggaaagcaccgttgttcattccggacccttcctgcgtgttctccatgatactgacctcttctgtggtggaataatctgcctggctccctgctgccgctagcttgcatggccacagcagggggcactcggccaccctttccactttctacccagccctggacttttaagatgaggctctttacggaaggaggcctgggctggagactcagccttgcttcccctcactg

SEQ ID NO: 34187 - DNA, 398 bp, Homo sapiens
gagatcctctgccctaagatatccattatccattacatgtaaggaattaacttctctcctatgcgaccaggatggcctttgttacatagtatccttagagctgagaaaacagttacctaaatcactgcctgtgttctgtggttcagataaagaacccactgaaagaggctgcgtgcatgaaccggctctgaccaactgaacatgaaacacaggttggaataaaaatatttttttatttgatggtcttccatatagacagaatttcatcaggaatcaaagaaaggtggttaccacatataaacaccaactaaactctgagctttctggcaactgaaaaggaaaacgttgagttctagaatagcctttgttgtttgatgcaactaaccatatcacctttt

SEQ ID NO: 34188 - DNA, 705 bp, Homo sapiens
atttataatagatgtcctactaattccatgcggtcctgacacaccttgaaaaacaggctaagactgagctgagggggatgttgaaagaggcagcactttcaacaaatgtccagctattatataggtcatgttataactgcaggtgtggagcttctgctccagagactgctcctataaatgattttgtaaaacagattacacctactctcttgatttttcaacaattcagattttcatatactgagactgcttaaagcagaagtcttttatgccattctaaagcaagaagatatgctggtcattttgcgtagccttttagtttttaggcatttttaaaatgcttaaaaaattaaataccaacccccaaataactcagtcaactcaattctactgactcaaaaggaaatggtttcagataaagatgcccacatggcttttagttcagccagttctttctaactacaagtaacataataatttcctttgcataggaaagttcttagaatcatcagtcatgaaaacagatgttgggcacagaggtgaagcagcagccagcatcagtaaatttgccattattaaccgcccaccgccaccctcaaccccattcccaccccctgttggaattggattagccttctggtattattttaagagtgattggaatttaattttagttaggaagaactgagtccattgtttacttac

SEQ ID NO: 34189 - DNA, 507 bp, Homo sapiens
attgccgagaagagccctgcagacagttcacacctctgtttcttttgcaagatatagctacctcaaaaaatcctttcttgatcaaactcttatggcctggaatccttgcgtttctgctgatgactgtcattttagagtacttactaaagacaatggttggggaaatagatattttaaaaataagggaaaaagtgggtagggtaaacccaggcttacttatgtaaactctgagtgctgaagttagaagacaacctttaagattaaaaaaaaaaaaaaaaaaaaagatttctggtagccgccagaagctaaggaacagattctccctctgagcctccagaacccagatgacaccttgatttcagacttctgacctccaaaactgtgaggaggaaggaaatgtgttgttttaagggcacccagctgggtgacagtttcattcacagtagccacaggaaactaatacccagccccatggcaggcataggtcaagcctggcacagtctggat

SEQ ID NO: 34190 - DNA, 129 bp, Homo sapiens
gtatagagacaatagtggaatctcagagattaaggtctttgagggtgaagaatgaagggctgagaactgagcctttgccattgtaggtgatagtgtctattacatgcctactatgtgctgagcactggc

SEQ ID NO: 34191 - DNA, 408 bp, Homo sapiens
gaacataaatgtaaaataaaggaggtgctatccagcagtaatttaagcaatgttgcactagccacccacttgcaatcatatatgcaacatgcttacattttttcccatgtaaaaatgggaaaaataatagtaatagtaaaatacagttgtccctcggtatccgtgggggattggtttcaggacctcccactgcatacccaaatccacaaatcctcaagtctgttatataaaatggtgtagtatttgaatataatctacacacatcctcctgtatactttgaataatactaggtaacttttaatacctaacataaggtaaatgctatgtaactagttatactgtatttaggtaatattgacaagaaagcctgtacatgttcagtacagatacaactatcttgttttaaa

SEQ ID NO: 34192 - DNA, 303 bp, Homo sapiens
gtgtccgaggcacctactaaagccgggcgcagtgtccgaggcacctactaaagccgggcgcagtgtccgaggcacctactaaagccgggcgcagtgtccgaggcacctactaaagccgggcgcagtgtccgaggcacctactaaagccgggcgcagtgtccgaggcacctactaaagccgggcgcagtgtccgaggcacctactaaagccgggcacagtgtctgaggcacctactaaagctgtaggctggaggttcttgcacttgagataagccccgattacaaaataacactctgtggaagg

SEQ ID NO: 34193 - DNA, 351 bp, Homo sapiens
tttaagaggaaaaactatttctttcatttctagctaagtctgatgggccctttcaaacactgctttcatcatgcaccttttatttcacgatttctgcataatgaaaatacaagatcgataactgtggattatcgtaatgccttgagcctttgaaaatgaacattttctagattataaatgttccctttgtaattcatttcaaacttcatcctcccatttgtcctaattcccgaaatttaactgttgccttttgagcctcctaggaaattctgggtatcctttaggcaagggaggtagctcttgggggaatagcattcaggccacaggcaattcatttgcgacttgggctct

SEQ ID NO: 34194 - DNA, 341 bp, Homo sapiens
aaacacacacacatacagagcaatcaatcgatatttaaaacacggatgttatatccaggaagcataatataaactacctagtttataattagcagtaagcaacttgatatgagccttgtctttttcaaaaaggattaacaataaaagccaaaaacacattaagatattcagacattaataaatgccatttattaatcactgttgccaattggtatcagtcaccaatctcctacaaaagtgatgacatctaacagattatgttcagagttagctgtgtcccctaccaactgtgtgaatttgagtaagttacgtaaactctctaaaaatcaatttgtttcagt

SEQ ID NO: 34195 - DNA, 333 bp, Homo sapiens
aaaaaagtaaaaaatttaaaaattagatgggcatggtgacatgtgcctgtaatccaggtactaaggaagctgaggtaggaggatgacttgagtctaggagttcgaggctgcagtgagctctgatcgcaccactgcactccagcctgagtgacacagcaagaccctgcttcaaaaaaaaaaaaaaaaaaaaattactggacacaattattgtgccagacccctaggttaacagtgaggattcagtgggagaactaaacagataaacagatccagtccccaccctcagagagttacagtttaatgggaaaaagacattcaccaaagaaggacaca

SEQ ID NO: 34196 - DNA, 979 bp, Homo sapiens
  misc_feature (804)..(804): n is a, c, g, or t
aaaatttgagccatgggtaaggcctggtagaaagggaggaggttggggaggcgtgaataggcctttggaaagaggtgctgttaacccaaaacagagaggcagcagctttgcaattagattttctttttgaaatagcaggctctgtccctggtagcaatagggataaataaaaagtaatatgtattcattgggaaaataattggaaaaagaattaggcaaaataagcatgtggttttgtatcttgttttttaaaacagcttgttgtaatacattagatattctttgaaaaaaatagaatttgaagttcagaaaatcaaatcagttttagggattgagaatctcactacatattttgtctttcaaaattgtttgtttatttatttatttagaaatggggtcttgctatgttgtccgggctggagtgtagtggtacaatcatacctcactgcagcctcaaactcgtgggctcaagggatcctcctgtctcagtctcctgagtagctgggactatagtcaggcacacctcaccttgttcccagaccaaactgagggtcgggctgcttattcttgcggcccagtaatgagatgcagatgaactgggaaagaagggagtttattgctgtaactgggtacagggaggtctggaaaatatcaccagaacaattcaaaattacaaagttttccagagcttatataccttctaagctatatgtctatgtgtacgtgtgcattcatctaaagacataagtaagtgattaacttcttctaatctataactaagatctgagtcctgaaggccttccnttggagccttcgtaaattcatttaatctaaatgggtgaaggtgctggggtgattacccttatcttgtgtcctgctaaatcacagggttttggggagttcctttagtccccagtaaagcttgtttgtgaaggtctggggagttccttaagatccacaataaaacttgtttaatcct

SEQ ID NO: 34197 - DNA, 450 bp, Homo sapiens
gcctcggcctcccaaagtgctgggattacaggcatgagccaccgtgcctggccagtctcagattttcatgatagccctctgaactctccttggcttcttgcctttggctgttttctcaatgcatatattttcctgggggacaaatctaagttttcatctgatgctctgccttcagaggggaaccattccttaatgacctatttaattgtattatcattgttgtttaattcatcacatatttactgagcttcttttgttggtggtggtgccatcagacacagtggtccaggagatggagaccatcctggctaacacaaagaaaccccgtctctactaggaatacctatataaaaaattagccaggcgtggtggcagacgccgtagtgccagcactcgggaggcgaggcaggagaatgcatgaaccccaaggcagagttgcagtgagccaga

SEQ ID NO: 34198 - DNA, 313 bp, Homo sapiens
ccaagccccacacacacaccggcccctaggaaggcctagccgaggggctcaagtccagccagcagctcaggctggccaggccacttccaagcagagtcctggaccagggttctggtcccagctcccacaggacctgactactgcctcagtttccccatctgtcaatggagccagcaaggcctgtctggagtgcaaatcttgaccaagtcaccccggaagtcccttcaaaagcaagaccaggggttgtgggccggtcccagaggagaagccagagctgctagtcctcctcctgctgggcaggcgcctgcaccca

SEQ ID NO: 34199 - DNA, 394 bp, Homo sapiens
agctcgaggctgtgataaaggagaagatgagaaactgtgcgaggaagccagggtccaactatgaggcaggccctctgtgtcagaatagaatggcggcagccacaaggagaatgttaggacttaaaagcaacagtcagaatgggcaagaggccagatgagaaggaggcacaaagcccccctcccagtaaggaaaaccccaaacaagcagaaactgtaggaaaaaaacaaacttttgaagaaaggcagggtccaaatctggggcacactaaaatgtggggtgattttgggcgactggtagagtaacagaggaactcctttaaatgatgctttgagtggctcaggtcatgatggtggagctgtagaggacacgtgcccacagctggcttctgtgatg

SEQ ID NO: 34200 - DNA, 566 bp, Homo sapiens
ggatacctgggtttctcagcctcagtactattgatgttttgggctggataattctttgttgtggggaactgtcccttccattatagaatgttttaacagcatcccgggcctctacccactaaatgccgatagcgttcctccaattgtgataaccaaacatgacttcatccccagttgagaaccactaccttaggccagaggaaaagattatctggactggtgtagatcaatcatgattcatcccccgggcctggggaaggggggaagggaactttccttcctaaactcaaaagattttcacaggctacaaaatctggattctgttagcaggattgagtggtaaaatggctgttgggtaatccaccagtatcagtcacacgaagaaaacagctcggatcaataaaaccaaaggtggtagaggccaggcatggtggctctcacctataatcccaacactttgggagatcaaagtgggaggattgtttgagcccaggaggtcaaggctgcagtgagctgtgttcatgccagtgtactccatcctgggcaacacagtgagatcctgtctg

SEQ ID NO: 34201 - DNA, 256 bp, Homo sapiens
gcaactagattggttttgagaccaccttgaatgtcaagaattcattgccgtagtttcaaaagtagcactatatttatttttccgggcattttttttccctctttgctttcatggataaagtaaattcagaaatatattttaagaataaaagaggtgatcttgttttcctggtggaaataatatttcaatgactttgaccctatgcattttatttcatagttttttattttattaaataaactgctttttccatttt

SEQ ID NO: 34202 - DNA, 2142 bp, Homo sapiens
cgccgctgtaaccccggaagcaatcctgagaggtcgggaccggcaagatggcggcgcggacagcgttcggtgctgtgtgccggcgcctctggcagggattggggaatttttctgtaaacacttctaagggcaatacagccaaaaatggtggcttgcttctcagtaccaatatgaagtgggtacagttttcaaacctacacgttgatgttccaaaggatttgaccaaacctgtggtaacaatctctgatgaaccagacatattatataagcgcctctcggttttggtgaaaggtcacgataaggctgtattggacagttatgaatattttgctgtgcttgctgctaaagaacttggtatctctattaaagtacatgaacctccaaggaaaatagagcgatttactcttctccaatcagtgcatatttacaagaagcacagagttcagtatgaaatgagaacactttacagatgtttagagttagaacatctaactggaagcacagcagatgtctacttggaatatattcagcgaaacttacctgaaggggttgccatggaagtaacaaagacacaattagaacagttaccagaacacatcaaggagccaatctgggaaacactatcagaagaaaaagaagaaagcaagtcataaagcctcagggaggccatttttgcctaaatttgaaatgagggtgggccagatgagtatgtttaagtggagagtgcttccagctgagatgatttgagtctgtcctaactgctccattgagttctcgtgccctcatcagctgagggcagggaatggaactttaatggaagaaccacttttatctattctttttattcattgtttcagttctgatttcagcaaacatgagcaaaccactttgactgaaagcagaaagagtgaaaattctattttgttacgctactggtgttcaattattagtttgtaccatttttaatttatgtcagttgatgcatctgaaaataagtgcttggagtgttcgtacccttatttttttttaagattcctagaaggaatctttggttaattcagattgagcagttaaagtttttgctatttacctttgtgcaggctggcatatgctaatttgggggtggtaaccaaccgattttatctcatgtaagcattacattttgaagactgaatatacttcacagcagatcaaacacatttatggcatgcactgacctcttcttggagcccagaactttatagagttgcctaccagggttactgtaatggaatttatgatcttaagaaattactagttgtattatttatcctatgattcattcattcaataagcttttactgcataaactttacatccagcactgtagttaagtacccaaaattgaatagaaataatggcttttgaaaattgcacaaagcaggccaggcacggtggctcacgcctgtaatcccagcactttgggaggccgaggcaggcggatcacgaggtcaagagatccagaccatcctggctaacacggtgaaaccccgtctctaataaaaatacaaaaattagctggacatggtggcacgtgcctgtaatcccagctactcaggaggctgaggcaggagaatcgcgtgaacccgggcccggtggaggctgcagtgagacgagatcgcgccactgcactccagcctggcgacagagcgagacaccgtctcaaaaaaaaaaaaaagaaaattgtgcaaagcataggtaaatatttttctttattaagcttctcactgagaagccctctttattttggtaaatgtcactctgtttgttaggagatgtctgcttttccatgaaatgaaatagtggctaaagccctgaaagaggcaagactacaatgggctgaaacagttggtatagcaaccccagagaagtgcttcattttctttttatagtagaagcaggtccatgtcttttgtggtttcctgcacatctttggagtagttatgacttctcagtttttccccccttaaactgcattgcctattcttttttcctgacatgctatcaggtatcagtgtgttgaatacataatgcttgtgtatcagacttacgttactgtcatcaccattaaaagaattgcagccttgtgccccatgaccttca

SEQ ID NO: 34203 - DNA, 2482 bp, Homo sapiens
cgccgctgtaaccccggaagcaatcctgagaggtcgggaccggcaagatggcggcgcggacagcgttcggtgctgtgtgccggcgcctctggcagggattggggaatttttctgtaaacacttctaagggcaatacagccaaaaatggtggcttgcttctcagtaccaatatgaagtgggtacagttttcaaacctacacgttgatgttccaaaggatttgaccaaacctgtggtaacaatctctgatgaaccagacatattatataagcgcctctcggttttggtgaaaggtcacgataaggctgtattggacagttatgaatattttgctgtgcttgctgctaaagaacttggtatctctattaaagtacatgaacctccaaggaaaatagagcgatttactcttctccaatcagtgcatatttacaagaagcacagagttcagtatgaaatgagaacactttacagatgtttagagttagaacatctaactggaagcacagcagatgtctacttggaatatattcagcgaaacttacctgaaggggttgccatggaagtaacaaagacacaattagaacagttaccagaacacatcaaggagccaatctgggaaacactatcagaagaaaaagaagaaagcaagtcataaagcctcagggaggccatttttgcctaaatttgaaatgagggtgggccagatgagtatgtttaagtggagagtgcttccagctgagatgatttgagtctgtcctaactgctccattgagttctcgtgccctcatcagctgagggcagggaatggaactttaatggaagaaccacttttatctattctttttattcattgtttcagttctgatttcagcaaacatgagcaaaccactttgactgaaagcagaaagagtgaaaattctattttgttacgctactggtgttcaattattagtttgtaccatttttaatttatgtcagttgatgcatctgaaaataagtgcttggagtgttcgtacccttatttttttttaagattcctagaaggaatctttggttaattcagattgagcagttaaagtttttgctatttacctttgtgcaggctggcatatgctaatttgggggtggtaaccaaccgattttatctcatgtaagcattacattttgaagactgaatatacttcacagcagatcaaacacatttatggcatgcactgacctcttcttggagcccagaactttatagagttgcctaccagggttactgtaatggaatttatgatcttaagaaattactagttgtattatttatcctatgattcattcattcaataagcttttactgcataaactttacatccagcactgtagttaagtacccaaaattgaatagaaataatggcttttgaaaattgcacaaagcaggccaggcacggtggctcacgcctgtaatcccagcactttgggaggccgaggcaggcggatcacgaggtcaagagatccagaccatcctggctaacacggtgaaaccccgtctctaataaaaatacaaaaattagctggacatggtggcacgtgcctgtaatcccagctactcaggaggctgaggcaggagaatcgcgtgaacccgggcccggtggaggctgcagtgagacgagatcgcgccactgcactccagcctggcgacagagcgagacaccgtctcaaaaaaaaaaaaaagaaaattgtgcaaagcataggtaaatatttttctttattaagcttctcactgagaagccctctttattttggtaaatgtcactctgtttgttaggagatgtctgcttttccatgaaatgaaatagtggctaaagccctgaaagaggcaagactacaatgggctgaaacagttggtatagcaaccccagagaagtgcttcattttctttttatagtagaagcaggtccatgtcttttgtggtttcctgcacatctttggagtagttatgacttctcagtttttccccccttaaactgcattgcctattcttttttcctgacatgctatcaggtatcagtgtgttgaatacataatgcttgtgtatcagacttacgttactgtcatcaccattaaaagaattgcagccttgtgccccatgaccttcaaaaaaaaaaaaaaaaaaaaaaaaaaaaaaacggtggtggggcggccgtgggccccggaaaagctttttaagaacaaatctgggtgggggcacgggggccccaagattgggataggcgtgaaacggtggctcaatagcgtgtttcccatgaggagaaacacggggcgccacagagcacaagagaggcgcagaggagatcctccacccccatataaagagacaggcccgccggggagaaaaccgcgagagggttagcggacaacacaatatctccgaagagggagagtcctgcgaggagcacaaatacaagggggagactcctaaacacacgaggaagcccc

SEQ ID NO: 34204 - DNA, 1711 bp, Homo sapiens
cgccgctgtaaccccggaagcaatcctgagaggtcgggaccggcaagatggcggcgcggacagcgttcggtgctgtgtgccggcgcctctggcagggattggggaatttttctgtaaacacttctaagggcaatacagccaaaaatggtggcttgcttctcagtaccaatatgaagtgggtacagttttcaaacctacacgttgatgttccaaaggatttgaccaaacctgtggtaacaatctctgatgaaccagacatattatataagcgcctctcggttttggtgaaaggtcacgataaggctgtattggacagttatgaatattttgctgtgcttgctgctaaagaacttggtatctctattaaagtacatgaacctccaaggaaaatagagcgatttactcttctccaatcagtgcatatttacaagaagcacagagttcagtatgaaatgagaacactttacagatgtttagagttagaacatctaactggaagcacagcagatgtctacttggaatatattcagcgaaacttacctgaaggggttgccatggaagtaacaaagacacaattagaacagttaccagaacacatcaaggagccaatctgggaaacactatcagaagaaaaagaagaaagcaagtcataaagcctcagggaggccatttttgcctaaatttgaaatgagggtgggccagatgagtatgtttaagtggagagtgcttccagctgagatgatttgagtctgtcctaactgctccattgagttctcgtgccctcatcagctgagggcagggaatggaactttaatggaagaaccacttttatctattctttttattcattgtttcagttctgatttcagcaaacatgagcaaaccactttgactgaaagcagaaagagtgaaaattctattttgttacgctactggtgttcaattattagtttgtaccatttttaatttatgtcagttgatgcatctgaaaataagtgcttggagtgttcgtacccttatttttttttaagattcctagaaggaatctttggttaattcagattgagcagttaaagtttttgctatttacctttgtgcaggctggcatatgctaatttgggggtggtaaccaaccgattttatctcatgtaagcattacattttgaagactgaatatacttcacagcagatcaaacacatttatggcatgcactgacctcttcttggagcccagaactttatagagttgcctaccagggttactgtaatggaatttatgatcttaagaaattactagttgtattatttatcctatgattcattcattcaataagcttttactgcataaactttacatccagcactgtagttaagtacccaaaattgaatagaaataatggcttttgaaaattgcacagcctggcccaaaactagcagtatttcttcgacgaaagtatttggcatatttgaagcccgcttcttgatataaacaagtttggcatgaagtacagtactgaaaaaatgatataaacaaaataacttcttagcttatcaggatatagctatcttgataggctaagaagatttttggttttcttttgttggttttaaattaggcctctgagtaaaatgcatatcctgaaaattagaattaatgcctgggtcacactttctgtccatggtgggtatgggagatggtgagagaagagtg

SEQ ID NO: 34205 - DNA, 1537 bp, Homo sapiens
cgccgctgtaaccccggaagcaatcctgagaggtcgggaccggcaagatggcggcgcggacagcgttcggtgctgtgtgccggcgcctctggcagggattggggaatttttctgtaaacacttctaagggcaatacagccaaaaatggtggcttgcttctcagtaccaatatgaagtgggtacagttttcaaacctacacgttgatgttccaaaggatttgaccaaacctgtggtaacaatctctgatgaaccagacatattatataagcgcctctcggttttggtgaaaggtcacgataaggctgtattggacagttatgaatattttgctgtgcttgctgctaaagaacttggtatctctattaaagtacatgaacctccaaggaaaatagagcgatttactcttctccaatcagtgcatatttacaagaagcacagagttcagtatgaaatgagaacactttacagatgtttagagttagaacatctaactggaagcacagcagatgtctacttggaatatattcagcgaaacttacctgaaggggttgccatggaagtaacaaagacacaattagaacagttaccagaacacatcaaggagccaatctgggaaacactatcagaagaaaaagaagaaagcaagtcataaagcctcagggaggccatttttgcctaaatttgaaatgagggtgggccagatgagtatgtttaagtggagagtgcttccagctgagatgatttgagtctgtcctaactgctccattgagttctcgtgccctcatcagctgagggcagggaatggaactttaatggaagaaccacttttatctattctttttattcattgtttcagttctgatttcagcaaacatgagcaaaccactttgactgaaagcagaaagagtgaaaattctattttgttacgctactggtgttcaattattagtttgtaccatttttaatttatgtcagttgatgcatctgaaaataagtgcttggagtgttcgtacccttatttttttttaagattcctagaaggaatctttggttaattcagattgagcagttaaagtttttgctatttacctttgtgcaggctggcatatgctaatttgggggtggtaaccaaccgattttatctcatgtaagcattacattttgaagactgaatatacttcacagcagatcaaacacatttatggcatgcactgacctcttcttggagcccagaactttatagagttgcctaccagggttactgtaatggaatttatgatcttaagaaattactagttgtattatttatcctatgattcattcattcaataagcttttactgcataaactttacatccagcactgtagttaagtacccaaaattgaatagaaataatggcttttgaaaattgcacagtgcccggccaagtaaaatgttttttaaaatggttatgtgcattattcataaaaaataatggtgtccagtctttttaaacttgtaaagacacatcttattgaataaagagatgagagctt

SEQ ID NO: 34206 - DNA, 2168 bp, Homo sapiens
cgccgctgtaaccccggaagcaatcctgagaggtcgggaccggcaagatggcggcgcggacagcgttcggtgctgtgtgccggcgcctctggcagggattggggaatttttctgtaaacacttctaagggcaatacagccaaaaatggtggcttgcttctgtttctctttttttccccacacatagcagtaccaatatgaagtgggtacagttttcaaacctacacgttgatgttccaaaggatttgaccaaacctgtggtaacaatctctgatgaaccagacatattatataagcgcctctcggttttggtgaaaggtcacgataaggctgtattggacagttatgaatattttgctgtgcttgctgctaaagaacttggtatctctattaaagtacatgaacctccaaggaaaatagagcgatttactcttctccaatcagtgcatatttacaagaagcacagagttcagtatgaaatgagaacactttacagatgtttagagttagaacatctaactggaagcacagcagatgtctacttggaatatattcagcgaaacttacctgaaggggttgccatggaagtaacaaagacacaattagaacagttaccagaacacatcaaggagccaatctgggaaacactatcagaagaaaaagaagaaagcaagtcataaagcctcagggaggccatttttgcctaaatttgaaatgagggtgggccagatgagtatgtttaagtggagagtgcttccagctgagatgatttgagtctgtcctaactgctccattgagttctcgtgccctcatcagctgagggcagggaatggaactttaatggaagaaccacttttatctattctttttattcattgtttcagttctgatttcagcaaacatgagcaaaccactttgactgaaagcagaaagagtgaaaattctattttgttacgctactggtgttcaattattagtttgtaccatttttaatttatgtcagttgatgcatctgaaaataagtgcttggagtgttcgtacccttatttttttttaagattcctagaaggaatctttggttaattcagattgagcagttaaagtttttgctatttacctttgtgcaggctggcatatgctaatttgggggtggtaaccaaccgattttatctcatgtaagcattacattttgaagactgaatatacttcacagcagatcaaacacatttatggcatgcactgacctcttcttggagcccagaactttatagagttgcctaccagggttactgtaatggaatttatgatcttaagaaattactagttgtattatttatcctatgattcattcattcaataagcttttactgcataaactttacatccagcactgtagttaagtacccaaaattgaatagaaataatggcttttgaaaattgcacaaagcaggccaggcacggtggctcacgcctgtaatcccagcactttgggaggccgaggcaggcggatcacgaggtcaagagatccagaccatcctggctaacacggtgaaaccccgtctctaataaaaatacaaaaattagctggacatggtggcacgtgcctgtaatcccagctactcaggaggctgaggcaggagaatcgcgtgaacccgggcccggtggaggctgcagtgagacgagatcgcgccactgcactccagcctggcgacagagcgagacaccgtctcaaaaaaaaaaaaaagaaaattgtgcaaagcataggtaaatatttttctttattaagcttctcactgagaagccctctttattttggtaaatgtcactctgtttgttaggagatgtctgcttttccatgaaatgaaatagtggctaaagccctgaaagaggcaagactacaatgggctgaaacagttggtatagcaaccccagagaagtgcttcattttctttttatagtagaagcaggtccatgtcttttgtggtttcctgcacatctttggagtagttatgacttctcagtttttccccccttaaactgcattgcctattcttttttcctgacatgctatcaggtatcagtgtgttgaatacataatgcttgtgtatcagacttacgttactgtcatcaccattaaaagaattgcagccttgtgccccatgaccttca

SEQ ID NO: 34207 - DNA, 2069 bp, Homo sapiens
cgccgctgtaaccccggaagcaatcctgagaggtcgggaccggcaagatggcggcgcggacagcgttcggtgctgtgtgccggcgcctctggcagggattggggaatttttctgtaaacacttctaagggcaatacagccaaaaatggtggcttgcttctgtaacaatctctgatgaaccagacatattatataagcgcctctcggttttggtgaaaggtcacgataaggctgtattggacagttatgaatattttgctgtgcttgctgctaaagaacttggtatctctattaaagtacatgaacctccaaggaaaatagagcgatttactcttctccaatcagtgcatatttacaagaagcacagagttcagtatgaaatgagaacactttacagatgtttagagttagaacatctaactggaagcacagcagatgtctacttggaatatattcagcgaaacttacctgaaggggttgccatggaagtaacaaagacacaattagaacagttaccagaacacatcaaggagccaatctgggaaacactatcagaagaaaaagaagaaagcaagtcataaagcctcagggaggccatttttgcctaaatttgaaatgagggtgggccagatgagtatgtttaagtggagagtgcttccagctgagatgatttgagtctgtcctaactgctccattgagttctcgtgccctcatcagctgagggcagggaatggaactttaatggaagaaccacttttatctattctttttattcattgtttcagttctgatttcagcaaacatgagcaaaccactttgactgaaagcagaaagagtgaaaattctattttgttacgctactggtgttcaattattagtttgtaccatttttaatttatgtcagttgatgcatctgaaaataagtgcttggagtgttcgtacccttatttttttttaagattcctagaaggaatctttggttaattcagattgagcagttaaagtttttgctatttacctttgtgcaggctggcatatgctaatttgggggtggtaaccaaccgattttatctcatgtaagcattacattttgaagactgaatatacttcacagcagatcaaacacatttatggcatgcactgacctcttcttggagcccagaactttatagagttgcctaccagggttactgtaatggaatttatgatcttaagaaattactagttgtattatttatcctatgattcattcattcaataagcttttactgcataaactttacatccagcactgtagttaagtacccaaaattgaatagaaataatggcttttgaaaattgcacaaagcaggccaggcacggtggctcacgcctgtaatcccagcactttgggaggccgaggcaggcggatcacgaggtcaagagatccagaccatcctggctaacacggtgaaaccccgtctctaataaaaatacaaaaattagctggacatggtggcacgtgcctgtaatcccagctactcaggaggctgaggcaggagaatcgcgtgaacccgggcccggtggaggctgcagtgagacgagatcgcgccactgcactccagcctggcgacagagcgagacaccgtctcaaaaaaaaaaaaaagaaaattgtgcaaagcataggtaaatatttttctttattaagcttctcactgagaagccctctttattttggtaaatgtcactctgtttgttaggagatgtctgcttttccatgaaatgaaatagtggctaaagccctgaaagaggcaagactacaatgggctgaaacagttggtatagcaaccccagagaagtgcttcattttctttttatagtagaagcaggtccatgtcttttgtggtttcctgcacatctttggagtagttatgacttctcagtttttccccccttaaactgcattgcctattcttttttcctgacatgctatcaggtatcagtgtgttgaatacataatgcttgtgtatcagacttacgttactgtcatcaccattaaaagaattgcagccttgtgccccatgaccttca

SEQ ID NO: 34208 - DNA, 2089 bp, Homo sapiens
cgccgctgtaaccccggaagcaatcctgagaggtcgggaccggcaagatggcggcgcggacagcgttcggtgctgtgtgccggcgcctctggcagggattggggaatttttctgtaaacacttctaagggcaatacagccaaaaatggtggcttgcttctcagtaccaatatgaagtgggtacagttttcaaacctacacgttgatgttccaaaggatttgaccaaacctgtggtaacaatctctgatgaaccagacatattatataagcgcctctcggttttggtgaaaggtcacgataaggctgtattggacagttatgaatattttgctgtgcttgctgctaaagaacttggtatctctattaaagtacatgaacctccaaggaaaatagagcgatttactcttctccaatcagtgcatatttacaagaagcacagagttcagtatgaaatgagaacactttacagatgtttagagttagaacatctaactggaagcacagcagatgtctacttggaatatattcagcgaaacttacctgaaggggttgccatggaagtaacaaagacacaattagaacagttaccagaacacatcaaggagccaatctgggaaacactatcagaagaaaaagaagggtgggccagatgagtatgtttaagtggagagtgcttccagctgagatgatttgagtctgtcctaactgctccattgagttctcgtgccctcatcagctgagggcagggaatggaactttaatggaagaaccacttttatctattctttttattcattgtttcagttctgatttcagcaaacatgagcaaaccactttgactgaaagcagaaagagtgaaaattctattttgttacgctactggtgttcaattattagtttgtaccatttttaatttatgtcagttgatgcatctgaaaataagtgcttggagtgttcgtacccttatttttttttaagattcctagaaggaatctttggttaattcagattgagcagttaaagtttttgctatttacctttgtgcaggctggcatatgctaatttgggggtggtaaccaaccgattttatctcatgtaagcattacattttgaagactgaatatacttcacagcagatcaaacacatttatggcatgcactgacctcttcttggagcccagaactttatagagttgcctaccagggttactgtaatggaatttatgatcttaagaaattactagttgtattatttatcctatgattcattcattcaataagcttttactgcataaactttacatccagcactgtagttaagtacccaaaattgaatagaaataatggcttttgaaaattgcacaaagcaggccaggcacggtggctcacgcctgtaatcccagcactttgggaggccgaggcaggcggatcacgaggtcaagagatccagaccatcctggctaacacggtgaaaccccgtctctaataaaaatacaaaaattagctggacatggtggcacgtgcctgtaatcccagctactcaggaggctgaggcaggagaatcgcgtgaacccgggcccggtggaggctgcagtgagacgagatcgcgccactgcactccagcctggcgacagagcgagacaccgtctcaaaaaaaaaaaaaagaaaattgtgcaaagcataggtaaatatttttctttattaagcttctcactgagaagccctctttattttggtaaatgtcactctgtttgttaggagatgtctgcttttccatgaaatgaaatagtggctaaagccctgaaagaggcaagactacaatgggctgaaacagttggtatagcaaccccagagaagtgcttcattttctttttatagtagaagcaggtccatgtcttttgtggtttcctgcacatctttggagtagttatgacttctcagtttttccccccttaaactgcattgcctattcttttttcctgacatgctatcaggtatcagtgtgttgaatacataatgcttgtgtatcagacttacgttactgtcatcaccattaaaagaattgcagccttgtgccccatgaccttca

SEQ ID NO: 34209 - DNA, 1802 bp, Homo sapiens
cgccgctgtaaccccggaagcaatcctgagaggtcgggaccggcaagatggcggcgcggacagcgttcggtgctgtgtgccggcgcctctggcagggattggggaatttttctgtaaacacttctaagggcaatacagccaaaaatggtggcttgcttctcagtaccaatatgaagtgggtacagttttcaaacctacacgttgatgttccaaaggatttgaccaaacctgtggtaacaatctctgatgaaccagacatattatataagcgcctctcggttttggtgaaaggtcacgataaggctgtattggacagttatgaatattttgctgtgcttgctgctaaagaacttggtatctctattaaagtacatgaacctccaaggaaaatagagcgatttactcttctccaatcagtgcatatttacaagaagcacagagttcagtatgaaatgagaacactttacagatgtttagagttagaacatctaactggaagcacagcagatgtctacttggaatatattcacaaacatgagcaaaccactttgactgaaagcagaaagagtgaaaattctattttgttacgctactggtgttcaattattagtttgtaccatttttaatttatgtcagttgatgcatctgaaaataagtgcttggagtgttcgtacccttatttttttttaagattcctagaaggaatctttggttaattcagattgagcagttaaagtttttgctatttacctttgtgcaggctggcatatgctaatttgggggtggtaaccaaccgattttatctcatgtaagcattacattttgaagactgaatatacttcacagcagatcaaacacatttatggcatgcactgacctcttcttggagcccagaactttatagagttgcctaccagggttactgtaatggaatttatgatcttaagaaattactagttgtattatttatcctatgattcattcattcaataagcttttactgcataaactttacatccagcactgtagttaagtacccaaaattgaatagaaataatggcttttgaaaattgcacaaagcaggccaggcacggtggctcacgcctgtaatcccagcactttgggaggccgaggcaggcggatcacgaggtcaagagatccagaccatcctggctaacacggtgaaaccccgtctctaataaaaatacaaaaattagctggacatggtggcacgtgcctgtaatcccagctactcaggaggctgaggcaggagaatcgcgtgaacccgggcccggtggaggctgcagtgagacgagatcgcgccactgcactccagcctggcgacagagcgagacaccgtctcaaaaaaaaaaaaaagaaaattgtgcaaagcataggtaaatatttttctttattaagcttctcactgagaagccctctttattttggtaaatgtcactctgtttgttaggagatgtctgcttttccatgaaatgaaatagtggctaaagccctgaaagaggcaagactacaatgggctgaaacagttggtatagcaaccccagagaagtgcttcattttctttttatagtagaagcaggtccatgtcttttgtggtttcctgcacatctttggagtagttatgacttctcagtttttccccccttaaactgcattgcctattcttttttcctgacatgctatcaggtatcagtgtgttgaatacataatgcttgtgtatcagacttacgttactgtcatcaccattaaaagaattgcagccttgtgccccatgaccttca

SEQ ID NO: 34210 - DNA, 827 bp, Homo sapiens
acgtctgtgctcgagagcgtatgcggatggcttccccgcaggcttgtgcccgttcagtgctcatgccactggcctggttgccgtccgccatctgcactagggcgttctccctcgtattgaccggatcttcacgcgctgcacgtccccgtagacgccgaaagaattaagaggctttggggttgactctctctgggttgaggttgctgacccgccataccaggatttcctgcccccgcccggcccgggatggcgatccgacctgccgccgccgctgccccgcccccgaggggatggcccaggggggccagggccccgtggacccttcggacggaaggcctgcagcttgaggaatggccaaggtgggagggaaacccgctcctgcatacggagaaaaaaaaaaaagaaaattgtgcaaagcataggtaaatatttttctttattaagcttctcactgagaagccctctttattttggtaaatgtcactctgtttgttaggagatgtctgcttttccatgaaatgaaatagtggctaaagccctgaaagaggcaagactacaatgggctgaaacagttggtatagcaaccccagagaagtgcttcattttctttttatagtagaagcaggtccatgtcttttgtggtttcctgcacatctttggagtagttatgacttctcagtttttccccccttaaactgcattgcctattcttttttcctgacatgctatcaggtatcagtgtgttgaatacataatgcttgtgtatcagacttacgttactgtcatcaccattaaaagaattgcagccttgtgccccatgaccttca

SEQ ID NO: 34211 - DNA, 435 bp, Homo sapiens
gcaaagcataggtaaatatttttctttattaagcttctcactgagaagccctctttattttggtaaatgtcactctgtttgttaggagatgtctgcttttccatgaaatgaaatagtggctaaagccctgaaagaggcaagactacaatgggctgaaacagttggtatagcaaccccagagaagtgcttcattttctttttatagtagaagcaggtccatgtcttttgtggtttcctgcacatctttggagtagttatgacttctcagtttttccccccttaaactgcattgcctattcttttttcctgacatgctatcaggtatcagtgtgttgaatacataatgcttgtgtatcagacttacgttactgtcatcaccattaaaagaattgcagccttgtgccccatgaccttcagctcagttgttgactgtca

SEQ ID NO: 34212 - DNA, 603 bp, Homo sapiens
tggccaccccagcctcccaaagtgctgggattacaggcgtgagccactgcacctggcccaatttaggattctatgccaaactgtagtatgaacataaagacatctttatttttatttatttattttatttatttttgagacggagctccatctgtcgccctggctggggcccaggggcaagatctccactcactgcagcctccgcctcccggattcagggagttatcctgcctcagcctcctaagtagttgggactacagacgcgtgccaccacacctggttaatttttgtatttttagtagagacggagttttgccatgttgaccaggctgatctcaaacttctgacctcaagtgagccgcctaccttgtgctcccaaagtgctgagatcacaggcatataccaccatgctcggcctattatttttaatttgatggtcatattattccagatttggccaatgggatttccttcaagctgactcctgtgtccttttgacaaatatctataatcctttatttatttttatttttttgagacagagtcctgttctgtcacccaagctggaatgtagtggcgtgatctcgcctcactgcaaccccg

SEQ ID NO: 34213 - DNA, 686 bp, Homo sapiens
tggccaccccagcctcccaaagtgctgggattacaggcgtgagccactgcacctggcccaatttaggattctatgccaaactgtagtatgaacataaagacatctttatttttatttatttattttatttatttttgagacggagctccatctgtcgccctggctggggcccaggggcaagatctccactcactgcagcctccgcctcccggattcagggagttatcctgcctcagcctcctaagtagttgggactacagacgcgtgccaccacacctggttaatttttgtatttttagtagagacggagttttgccatgttgaccaggctgatctcaaacttctgacctcaagtgagccgcctaccttgtgctcccaaagtgctgagatcacaggcatataccaccatgctcggccaaggatgttaatttcttaaaaatggaaaaacttacacatttttattctcatatttttctgtcactggatagaaacattactagcagagtaaataatccagatgcctgtcttcagcctttttgtcagacatgaagagtaagcttagaaggtaggagccgcatgactgtgagatcgttgtactgatcgtttcctgaacaccgccaatactataatggtttttgtcaccacttgaaatggtctccataccgggatcctctagacagcataca

SEQ ID NO: 34214 - DNA, 389 bp, Homo sapiens
cgtctgacaccaaagcccatgcccctctcactgtacctggtccttcctggagtgaataacattcgtgggtctgtgcagggaagctgccagcctgggcagtgggagctgggcccagcaggtgggcacgtcactcctggccaccgcttgggggcgcccctgtgaaaggttccccacctcccggcagtccaaataggggaactcctgggcagcttgcctcttgggcttggtatgagcttcagcagggtggggaccatggcactcactggaattaggtcttcccagcaccagaggggctgagtggactcaggctacccacttcccctctctgtacttgtttcctttcctgtaaaatgatatgatttcctaggacctcttgtcttgtggctttt

SEQ ID NO: 34215 - DNA, 742 bp, Homo sapiens
ccatttcttccaaaagagaatgtaaaagtgctagaacagactagtattcagctaaagggtcctaaaagcaccatacaatgttcaatatggcaacaggagaaatctggtcaaaagccagtttgtctccagttttcttctgcctttgcctcaggctcccaaaattgaatagtggagttttagctgctcagtgaggttcctgtagagatttctctccatccatgacatacaattcttccttaagaagccagacaactggcactcctatatataaatagaagtaattaaaaacttatctgaagaagagaaaaggaaaaggaatctacttttctatatgccaattgctgggatcaaaataaactacaaaggatttatgaagaaaattgtgaatgttcacgttacaaattcttttaagaagtgcatacatttatgtatatgtatacaactatatgtaagagattttgctgtatgatatgcattatgggtgaaagttcacgataagttttattattgctttattactttttattggtatgttgacaggaatatcatggatatgtttacagtgacttttatattacagtggacgctttgatcttaaaacagccacaacaactcatctacggctgaaatataatatgcgtggacaagcttttgctgaagtgtagtgtgtcctttaagtttgttttttaaaaagtaacttacctcagaagaaataaatgataactataaagaaaaaaaaaag

SEQ ID NO: 34216 - DNA, 493 bp, Homo sapiens
aagaggctggaaataaacgaatctgctattatcaattactgtcatgtaccaagcactaaaaaataggtcatgtgatatgctaaaagcatacctgcattgtttgatggctttttcaacatggcactattgacactgggaccaggtaattatttgttgtgagggactgtcctgtgtatggtaggatgcttcgcagcatcttgacatctacccactagatgccagtagccccttccccgttcccagccatgacagcccaaagtgtctccagacactgctaaatgtccccccagggagcaaaatcaccccaagtttaaaaccccagttgacctatcttgtgctgataatcttcgaaggagggaatcacttcattttaatagtggagaaaatgagactcagaaaggctacttcacccagtgttacattgaagtaaataacaacggatttgagattgaaacccaaatatccttcttacatgtggttcatgtgagaccaa

SEQ ID NO: 34217 - DNA, 413 bp, Homo sapiens
atgctatcttatttctgtctcattatctgcctggtcatcttttttcaacacaggtaaacttaaaagaactttaaaacttaccatacagtaaaattaactttttctttaggggtagagttccatgagttttgacacacatgtatccatttagttaccaccacaatcaggatagaaaacaattccatcaccccaaaacacctccttgcatgttccctatataggaacattctcctagtctctggcaagcactgaccctgttccttatcattatagtttagcattttagaatgtcattataaatggaattatacagtatgaagccttttgagattggcttctttcactcagcttaatgcctttgaggttcacccatgttgatcaatttaccaatgatatatttctttttcaaagta

SEQ ID NO: 34218 - DNA, 484 bp, Homo sapiens
gtttttttgtttttttttttttttttgagatgaagtctcactcttgtcatccaggctggagtgcaatggcgtgatcacagcaacctctgcctcccaggttcaagcgattctcctgcctgagcctcccacgtggctgggatttacaggcacctgccaccatacccagctaatttttgtacttttagtagacacagggtttcgccatgttggccaggctggtcttgaactcctgacctcaggtgatccacacacctcggcctcccaaagcactgggattacaggtgtgagccaccacacccggcccatgagtgttttttgtggtggaaaacttgaaaaatccagtgtctattaatagaaaactggctaataaaaataactcatagctctaaagaaaatagtagagaagaaatttcaaaaacctgcatgaatggcaggaagaacatttaagtctctggactataagggcccattacatgctcagaac

SEQ ID NO: 34219 - DNA, 408 bp, Homo sapiens
gaacttgggtcttaggtcagacccttgaactgattgctatttaattatcatgtatattctgtattagcaattatcaacagtaaaatctcgtcatttttgtaggagaggtgtccttatttaaactggtggggaaactaatcattgctttcatacttgagcagcagtgtcactcttttgaatctttttggaaataaagagggctcatcatttgtcttctgtttcaattggaaggttccaatagaaatactcctaatgaactagatttggcctgacccccaacagtttatctgcaggccttgaatgcatgtgctttgattagtagaattatttacagctgtttttgttttgtggcccttttttagtttgctgacatacctttttctgaggaagttcaaaaaatctggatgt

SEQ ID NO: 34220 - DNA, 476 bp, Homo sapiens
ccaaactgggccagtgacttatactagggctattagaacagggattcacatttctggtgagtctgtgaagcttctagtatataagctgggagcctctggtagccatatttggtacctctcataccataaagtgaagctcacacagaggcaaacagggccaaaggatgaggcaacattgagagaacattgagcatctggatccagctgtgcctgaaagccctaaactacaacaaatttctttttggggtaggggttggggataagccagtttgaattggatatttgtcccttgcaaccaaacaacaccttactaattcagaaatagaggcaaaggtaagtaagatggttgagatcagacttgggttcaaatcctggccctgccacttagagctgtgtgcccttgaggagtcttgatctccgcatctgtcaaatgggaatagtcatgctgcctttgaggtggttgtgagggtaaacca

SEQ ID NO: 34221 - DNA, 743 bp, Homo sapiens
cactggaagaaaaatgtttcccaagcaaccagctttattctagctgactcactttgtactccctccttccatgtcattgctcctttttacctctttaggagtctgttaggaattttgcaacctgacaaaaggcttctgcagagccaaccaccttttttttcctcagggcctgaaaaaaaagtgagtcttcctactgacaggaaaataaaaagagaccttgttagtcaatttttttctgtatgttcaattgttctggtatattcttttccttgagtataaagaaaagtctgaaaataatggtaaaagtgtgagattgctctgatatttcctttttgtactttaggaggtggttctttgagttcctagttgtttagttgaacatgaagcaggtggcaaatgtaagtttagtctacacactgattccttcctgttcgcagaagggttcatgtgttcgtttttaaataatcttcgggtaaggaatagagaaacaccaagcccaagaggcagaaggatctgtctatagctaatgagtgagaaactaactgtgggatggtttatggtctctggctctttgaaaccacagaaatttaaagttatttttaaaaagccaacttgactgggcacagtggctcatgcctgtaatcccgaggcaggcggggggccaaggcagacagatttcttgagcccaagagttcaagaacagcctgggcaatatggtgaaaccccatcttctcaaaaaagtt

SEQ ID NO: 34222 - DNA, 738 bp, Homo sapiens
  misc_feature (453)..(454): n is a, c, g, or t
  misc_feature (458)..(458): n is a, c, g, or t
  misc_feature (509)..(509): n is a, c, g, or t
  misc_feature (517)..(517): n is a, c, g, or t
  misc_feature (529)..(529): n is a, c, g, or t
  misc_feature (592)..(592): n is a, c, g, or t
  misc_feature (615)..(615): n is a, c, g, or t
  misc_feature (621)..(621): n is a, c, g, or t
  misc_feature (624)..(624): n is a, c, g, or t
  misc_feature (632)..(632): n is a, c, g, or t
  misc_feature (650)..(650): n is a, c, g, or t
  misc_feature (654)..(654): n is a, c, g, or t
  misc_feature (659)..(659): n is a, c, g, or t
  misc_feature (662)..(663): n is a, c, g, or t
  misc_feature (667)..(667): n is a, c, g, or t
  misc_feature (673)..(673): n is a, c, g, or t
  misc_feature (682)..(682): n is a, c, g, or t
  misc_feature (687)..(687): n is a, c, g, or t
  misc_feature (697)..(697): n is a, c, g, or t
cttatctatgctgtgcaaaggaataagaaactagtgctgtctcgggaaccagcaacacagatgttcccaggagcaatgtttgcagggttctatgaggctgaaaatattggatcagtattcctgaggaatctgcgtttcagaatcccaggtccggaaggacaagaagtactttgcaaacaaatcaaatgtacgtttaggaagatgaaatcatgcaacagaaagatttttcagaatttttcagcaacagattttacacacaattcagaaggaagaaagaacagatgagtttgggaatcaggagaccagatgtcaagactggactacatctttatattcatttccagatttaaagttctatgttgtattttatttgatgcaaagcaataaaatattcctccctcctgtgaaaaaaaaaaaaaaaaaaaaactcgagactagttcttcctcgtgccnnattncggacgagctcgtgccgaattcggcacgaggtaaaatattttttttttggnattatcgngtaatttaactncatggatcccctgaaggggtttttgagcaccctcagagatctttagacctcacttgctctggntgctttattgtaagccactttgngagganttngagaacantaggatttagaagactantttngaatntgnntacntatagncggcgtggnggttntgcctgtatnccaacccattgttctgagggggggggtggagactcctgcgg

SEQ ID NO: 34223 - DNA, 400 bp, Homo sapiens
accagccacctcactggtcctctgttgccagtagaaaaagccctacaaggattaatgcaagaagaagttctgctttggggttctatgaggctgaaaatattggatcagtattcctgaggaatctgcgtttcagaatcccaggtccggaaggacaagaagtactttgcaaacaaatcaaatgtacgtttaggaagatgaaatcatgcaacagaaagatttttcagaatttttcagcaacagattttacacacaattcagaaggaagaaagaacagatgagtttgggaatcaggagaccagatgtcaagactggactacatctttatattcatttccagatttaaagttctatgttgtattttatttgatgcaaagcaataaaatattcctccctcctgtga

SEQ ID NO: 34224 - DNA, 407 bp, Homo sapiens
cttatctatgctgtgcaaaggaataagaaactagtgctgtctcgggaaccagcaacacagatgttcccaggagcaatgtttgcagggttctatgaggctgaaaatattggatcagtattcctgaggaatctgcgtttcagaatcccaggtccggaaggacaagaagtactttgcaaacaaatcaaatgtacgtttaggaagatgaaatcatgcaacagaaagatttttcagaatttttcagcaacagattttacacacaattcagaaggaagaaagaacagatgagtttgggaatcaggagaccagatgtcaagactggactacatctttatattcatttccagatttaaagttctatgttgtattttatttgatgcaaagcaataaaatattcctccctcctgtga

SEQ ID NO: 34225 - DNA, 440 bp, Homo sapiens
aaatgaataatataaacataggaatttgtgaaatagaaaagcaaaagaacaatagagactatcaatataatgaaaaaatggaaaaactatagacaaatctctggtaagactgatcaggaaaaatgaaaacaaaaatgagaaatcagaagtgagtccgagtgtagaggctcatgcctgtaatcctagcactttgtgaggctgaggcagaaggatcacttgagcccaaggagttgaggctgtggtgagccatggtggctccactgcacgccagcctgggcaagggagcctgtcttaaaaaaaagaacataactacaaatcagtagaaatttaaaaataacaaatactataaactgtcacacaaataaatttgaaaacagatgaaaaaatttctaataaaagataattagcccaaattattccaaaacaggaaaggtagtcag

SEQ ID NO: 34226 - DNA, 356 bp, Homo sapiens
cagaagtcattgtctttttctgggcagcccctgtggatggattcagctgcagtgaccagcacacatggtggttaatgggagttctaagagggagaggccagtgaaggtcggggctcatatgggaaaccaagtcatttcccaccaggaacgtttggcacactgacccctcacccaggcagctgatatgatggctaaagggaacaacaagtgaccacacccactcttgagagcaactgcaaattgcatgtggccacgagggtctctgtaatctgtttctgtttgctaaatgcctctctaccgggggcagttaagacactcggagagtggacaaacttggaggatgttgctcagttcca

SEQ ID NO: 34227 - DNA, 2258 bp, Homo sapiens
  misc_feature (1147)..(1147): n is a, c, g, or t
  misc_feature (1155)..(1156): n is a, c, g, or t
  misc_feature (1173)..(1173): n is a, c, g, or t
  misc_feature (1195)..(1195): n is a, c, g, or t
  misc_feature (1237)..(1237): n is a, c, g, or t
  misc_feature (1259)..(1259): n is a, c, g, or t
  misc_feature (1263)..(1263): n is a, c, g, or t
  misc_feature (1647)..(1647): n is a, c, g, or t
cacagctaactatagcctcaaactcctgggctcaagcagtcttccacctcagcctcttgagtagctgggattgcaggcatgcagcatcacatctgactaatttttttattttttgtagagattgggtcttgctgtgtggcccaggctggtctcaagctcctgggctcaatgatcctcctcctcggcctaccaaagtgctgggattataggcatgagccactgtgcccagccaatttcatgtttttgaaaaatttgtcaattgtggaataagtgggtaaaaatcctattacaacaaattgtaccaagtcttagactaactagaataggaccatttctgagccccaggaagggctgtcggaggtgctgccccacatccaggaggctctgtggtctgggccacaccttcaggaggatgtgcacctactgggagccccaggccatctctaatctcacactagattctcccacccacagatatgtggtctccctgatgaaggctggatttagtccttgttctcagcgaggtgggtattggccccacaatggccacagtacactgaccccgtaacagaggaaatctatagctcgtataattcattttcatggcaagtggctgcatttgtttttggcctcacttggtctgcttcccagaatccctaagaagggaccaaactgccaaggtgggaggatcacttaagcccaggagtttgagaccagtgtaggcaacacagcaagacctcgtctctatatttatttaaaaataaaaaagccaggcgcggtggctcacacctgtaatccagcactttgggaggccgaggcaggcagatcacaaggtcaggagatcgagaccatcctggctaacatggtgaaaccccatctctactaaaaatcaaaaaaattagccaggtgtggtggcgggcgcctatagtcccagttactcgggaggctgaggcaggagaatggcgtgaacctgggaggcggaggttgcagtgagccgagatcgcaccactgcgctccagcctaggtgaaagagcaagactccatctcaaaaaaagaaaaaaaaaaaaaaaaaaagtccaggcgcggtggcttatgcctgtaatcccagcactttgggaggccaaggcgggtggatcacctgaggtcnggagttcnngaccagcctggccaacntggtgaaatcccgtctctactnaaaatacaaaaattagctgggcatggtgttgcacgcctgtantcccagctacttgggaggctgnggcnggaagacctcttgatcccaagagacagaggctacagtgagcagagattgtgccactgcactccagcctgggcaagcgagactccgtctcaaaaaaaaaaaaaatacaaaaattagctgagcttagtggcgcatgccagtaatcccagctactcaggaggctgaggcaggagaatcatttgaacctggaggatagaggttgcagtgagccaagatcacgccactgcactccagcctgggcgacagagtgagactgtctcaggaaaaaaaaaaaaaaaaaagaaggaaccaaaatgtagtgatcaaacccttccattttataactgggaaaactcaggcctcgtgacaaggcagaaagaccccaaatggtagaaaacagctgctgnaaccccttgtgctcttgtcctcactgaggggctgaagtagctcttagagctagaggggtgttagaggtaaccccgctccagaggactgactgtagcccaaggcaagagagggagtttcctgaggaaggacccagatggtgacctcagggtgggtgaaggaggtattctttgaatttctcttggagttgggagacttgatattgtccgacctaatctgcagtgctgaatcctgtcccacaactaagggggaccaattctcatgtccttgatcctctttgaagcaccttgggcttgtctgtcccacatcatcagtggcattaagcacaagagataccatcttagcacaatccttttactctaaatgttcaggggaggggtatagcagcaaggagagggggtctctgtgatggcccaaggagatatttttgatactgaagacccaggcccccaggggaactgcaggaagcgtctagctcataggcataggcctttcagtaaaggtcacccatccagggatccaggatgtagctggttccaggtgatgaaatcttcccaccttatgactggggaatgtcaggtctagtagcaaagcaaagagaccccagatggca

SEQ ID NO: 34228 - DNA, 2112 bp, Homo sapiens
  misc_feature (1001)..(1001): n is a, c, g, or t
  misc_feature (1009)..(1010): n is a, c, g, or t
  misc_feature (1027)..(1027): n is a, c, g, or t
  misc_feature (1049)..(1049): n is a, c, g, or t
  misc_feature (1091)..(1091): n is a, c, g, or t
  misc_feature (1113)..(1113): n is a, c, g, or t
  misc_feature (1117)..(1117): n is a, c, g, or t
  misc_feature (1501)..(1501): n is a, c, g, or t
aggtggaagttgcagtgagcagagattgcaccattgcactccagcctgggcgacaagagtgagcaaaactccactgtgcccagccaatttcatgtttttgaaaaatttgtcaattgtggaataagtgggtaaaaatcctattacaacaaattgtaccaagtcttagactaactagaataggaccatttctgagccccaggaagggctgtcggaggtgctgccccacatccaggaggctctgtggtctgggccacaccttcaggaggatgtgcacctactgggagccccaggccatctctaatctcacactagattctcccacccacagatatgtggtctccctgatgaaggctggatttagtccttgttctcagcgaggtgggtattggccccacaatggccacagtacactgaccccgtaacagaggaaatctatagctcgtataattcattttcatggcaagtggctgcatttgtttttggcctcacttggtctgcttcccagaatccctaagaagggaccaaactgccaaggtgggaggatcacttaagcccaggagtttgagaccagtgtaggcaacacagcaagacctcgtctctatatttatttaaaaataaaaaagccaggcgcggtggctcacacctgtaatccagcactttgggaggccgaggcaggcagatcacaaggtcaggagatcgagaccatcctggctaacatggtgaaaccccatctctactaaaaatcaaaaaaattagccaggtgtggtggcgggcgcctatagtcccagttactcgggaggctgaggcaggagaatggcgtgaacctgggaggcggaggttgcagtgagccgagatcgcaccactgcgctccagcctaggtgaaagagcaagactccatctcaaaaaaagaaaaaaaaaaaaaaaaaaagtccaggcgcggtggcttatgcctgtaatcccagcactttgggaggccaaggcgggtggatcacctgaggtcnggagttcnngaccagcctggccaacntggtgaaatcccgtctctactnaaaatacaaaaattagctgggcatggtgttgcacgcctgtantcccagctacttgggaggctgnggcnggaagacctcttgatcccaagagacagaggctacagtgagcagagattgtgccactgcactccagcctgggcaagcgagactccgtctcaaaaaaaaaaaaaatacaaaaattagctgagcttagtggcgcatgccagtaatcccagctactcaggaggctgaggcaggagaatcatttgaacctggaggatagaggttgcagtgagccaagatcacgccactgcactccagcctgggcgacagagtgagactgtctcaggaaaaaaaaaaaaaaaaaagaaggaaccaaaatgtagtgatcaaacccttccattttataactgggaaaactcaggcctcgtgacaaggcagaaagaccccaaatggtagaaaacagctgctgnaaccccttgtgctcttgtcctcactgaggggctgaagtagctcttagagctagaggggtgttagaggtaaccccgctccagaggactgactgtagcccaaggcaagagagggagtttcctgaggaaggacccagatggtgacctcagggtgggtgaaggaggtattctttgaatttctcttggagttgggagacttgatattgtccgacctaatctgcagtgctgaatcctgtcccacaactaagggggaccaattctcatgtccttgatcctctttgaagcaccttgggcttgtctgtcccacatcatcagtggcattaagcacaagagataccatcttagcacaatccttttactctaaatgttcaggggaggggtatagcagcaaggagagggggtctctgtgatggcccaaggagatatttttgatactgaagacccaggcccccaggggaactgcaggaagcgtctagctcataggcataggcctttcagtaaaggtcacccatccagggatccaggatgtagctggttccaggtgatgaaatcttcccaccttatgactggggaatgtcaggtctagtagcaaagcaaagagaccccagatggca

SEQ ID NO: 34229 - DNA, 208 bp, Homo sapiens
acagataagagcagaagcgctcttgatggttttgtatttcttgttctgttccaccaggagctcttggtgctgagcccgagtgtttactagatgcatggaaaggaaacttcccttcctaactgaatatttttggagggagaaataatacaaaaaagtgcagttttcacttatattgtgaaatgtgaaaataaagtcatcagctttttta

SEQ ID NO: 34230 - DNA, 988 bp, Homo sapiens
ttatctaatactatgcactgagttacataccttactttttggagggtcttctaaaaccttgctataatatgagaggatcttgattttctacaactaagtaaaagataacatgctgctccattttcttaaatgatgaagggatggctttcctaacatggaacacttaacagatgactaccattatacctaaatataaaagatggtaagaactgatttccagaaggacttcaaaggattggttcggtgaaggaaacagagtatatcatgataacatactatacaattcaaggaagatatctgacttcctttcttagcagctctgctgcatgttggttcctagtgttgccattattaactgacaatcatagaatggcttctgcttgcttcacaactgaaactaggagggcggaggggaggaggtggcaagaggggtaaaggcagtagcagtaatgatggaccggttaataagagactctgagtgtgatgtaaatagtatgtttattaaacaatagagcccattggaatttttttcttccacgtattgttagatgtaaaacctgatacactaccatacagacaggtgattgactagaccttgtttatgtagttctaatgtggaatacttagagttgttatgaattacgattatccataacttttgaatctaaaaagctggctacacaacgtattttgttggaatctttttgtaataccaaatgtctacactctttgatctagagaatcacaaaattttagaaacatcactacccaggttaattgacttttttattgtttactgtccaaatacctgttacatattaatagtattctactttatatacctgtaataaactattcagggtttcttaagctggttgttgaaatgttttgtaatactgctcttcttaccttgttataggaacttttataataaacctgaaaaagtgaaacatatctttcccaaataaatagcagattatataaatga

SEQ ID NO: 34231 - DNA, 728 bp, Homo sapiens
ttatctaatactatgcactgagttacataccttactttttggagggtcttctaaaaccttgctataatatgagaggatcttgattttctacaactaagtaaaagataacatgctgctccattttcttaaatgatgaagggatggctttcctaacatggaacacttaacagatgactaccattatacctaaatataaaagatggtaagaactgatttccagaaggacttcaaaggattggttcggtgaaggaaacagagtatatcatgataacatactatacaattcaaggaagatatctgacttcctttcttagcagctctgctgcatgttggttcctagtgttgccattattaactgacaatcatagaatggcttctgcttgcttcacaactgaaactaggagggcggaggggaggaggtggcaagaggggtaaaggcagtagcagtaatgatggaccggttaataagagactctgagtgtgatgtaaatagtatgtttattaaacaatagagcccattggaatttttttcttccacgtattgttagatgtaaaacctgatacactaccatacagacaggtgattgactagaccttgtttatgtagttctaatgtggaatacttagagttgttatgaattacgattatccataacttttgaatcttactcttgatcttagaattccaaatttagaaacatacttccacggtaattgctttttatggt

SEQ ID NO: 34232 - DNA, 426 bp, Homo sapiens
  misc_feature (22)..(22): n is a, c, g, or t
  misc_feature (25)..(25): n is a, c, g, or t
cccccccccctccttggaaatnagnaatattttctttcccatccaaggtcacagatgccatgaattctattcatggatcccatgcatctctgaatcctatttaggttcagaacccctgagggaaaggaaagtttatttataaactcaactgaaaaaatgcttccggcagggcccagtggctcacgcctgtaattccagcactttgggaggtggaggtgggtggatcatctgaggtcaggagttcaagaccagcctggccaacatggtgaaaccccatctctaataaaaatacaaaaatttagctgggtgtggtggcatgcacctgtaatcccagttacttgggaggctgaggcaggagaatcgcttgaacccgggaggcagaggttgcagtgagccaagatcttgccattgcactccagcctgggc

SEQ ID NO: 34233 - DNA, 309 bp, Homo sapiens
aaatagggattgaaattctcaccctgctcacctctctgcagacattgatgagtgtggcacagagggagccaactgtggagctgaccaattctgcgtgaacactgagggctcctatgagtgccgagactgtgccaaggcctgcctaggctgcatgggggcagggccaggtcgctgtaagaagtgtagccctggctatcagcaggtgggctccaagtgtctcgatgtggatgagtgtgagacagaggtgtgtccgggagagaacaagcagtgtgaaaacaccgagggcggttatcgctgcatctgtgccga

SEQ ID NO: 34234 - DNA, 180 bp, Homo sapiens
attgtgggcatttgggaataaactaaaaatataggctatacccagtaacaggcacgtagccaaataaagtcagagttttaaagataaaacataaacttggaacataaacatgcgcagcatggcccgaacctcattccagacggagatacagaggcagctaaaagatcactgcacaatact

SEQ ID NO: 34235 - DNA, 254 bp, Homo sapiens
agacagtcaattaccacttattggagagctatagttaacagttaacgaccatatgccttgaatgagtgggcttgaggaagaaagcacagaaagggggccacatttcacatctggacagttcagagcctggcttagctgacagaagggaaatacaatagaaggtgggccttaagtggaagttagagactcacagaaagaggaacttggagccagagggagggtagaaattcaagccccagggatcttgcatgaat

SEQ ID NO: 34236 - DNA, 679 bp, Homo sapiens
tgaaaatgtgctttcagattgttttttatatgtaattcttagacacttgtcattaagaaaatagtggctggcttgtgctcagcaagaagcacactggcacgtggctttggtataggaagtggaaggcaaggacctgggtttctgacaagtgcagtcagacatacacatccatctgagagctgcttgccttgttcccgtggtaaggccatggctcccacatactggaagcatatttttgtgaactgttttcagaattgggaacatattcagtggaatgtcttaaacgctgacacatcttcctcctttgaggggaagtatattttcagaagcagctaagacatttagagccaaaattgctgataggtggttcagtcaagttggctgatggcatctgaggtcaaaaacgaagatgtgacgattgagttcttaaagaggtaactcttaaagtgggcccaagggagaaggcagcatctttggactcctaggctggatggctacccaagaatatgccattgaaggatgacacctattcagatgtgaaagttcccagagcaggcaccttgggcccactttaagagttacctctttaagaactcatcgtcacatcttagtttttgacctcagatgccatcagcccacttgactgaaccacctatcagcacttttggctggtgcatcg

SEQ ID NO: 34237 - DNA, 1732 bp, Homo sapiens
tgaaaatgtgctttcagattgttttttatatgtaattcttagacacttgtcattaagaaaatagtggctggcttgtgctcagcaagaagcacactggcacgtggctttggtataggaagtggaaggcaaggacctgggtttctgacaagtgcagtcagacatacacatccatctgagagctgcttgccttgttcccgtggtaaggccatggctcccacatactggaagcatatttttgtgaactgttttcagaattgggaacatattcagtggaatgtcttaaacgctgacacatcttcctcctttgaggggaagtatattttcagaagcagctaagacatttagagccaaaattgctgataggtggttcagtcaagttggctgatggcatctgaggtcaaaaacgaagatgtgacgattgagttcttaaagaggtaactcttaaagtgggcccaagggagaaggcagcatctttggactcctaggctggatggctacccaagaatatgccattgaaggatgacacctattcagatgtgaaagttcccagagcaggcacctttgggtcacccaccacgtgtggctttttggtgcctgcatgaaactgtgttgccccctggtgagatgcccgggtgtcctgtaagccgatttaactctgcctgaggaagaggagctgtccactccagttgcccttggctaagtttagcctaacacacagggttttgacccatagttctaaaatacacaaattttgagactacagcacttctttggaaagaggaagaatgcaaagttcagtatttcaatactttgtattttacttgaaattacccttagtagcatcttttttttcctgtctgaaagcttttgtgtggatgagaagggacatttcatttcctcccttaacaaagtgtcattctgaggttctcatgtgtgtttttggaaatagagatactggttttgtagagtttgcctttgggtatgttttctttttttcttaaatctccaaggaagagaactgactaaaatagtaggaacatgaaagtattaaatgccaattaatttgttgtagtaaagtatcttcattagcgttatactccatcatatctggtgtaaactgctcacagaaaaccctatgaaaccaaagggggaccattcaggtctaaaaagcgacaggtccgagactgggtctgtcacctgggcattttcaaagaggacattttgaagaatttgcatattcagatttttaaaatgcacttaacatacttcattacagatttcttgggtagggaggatgggataggccagggatgggatggaatcagttctgcctgggaaactaatccgaatcatttacctttctgtattaaccttggcctgtcctaaaaagagaacgactgtttcatcatgagttgctctgagttttgttaatgtttgtgttggtggattgacggttaaatgaagcatttagctggaatatgaactttgggagttttcatgttgtcctggatttctctttgtaaacctttaaaccttagcccctggttgattgtgttaaacccattatgagaatgttatttaaagttgtattataattgcaacctccactaattattcagtactgtagcagcaaagtattatttgtaagaatttggttatttttatacttatatccactctaagtctggcgttctagtcagtaaaatgatgcaataaaattaatatcattttc

SEQ ID NO: 34238 - DNA, 796 bp, Homo sapiens
  misc_feature (10)..(11): n is a, c, g, or t
  misc_feature (16)..(16): n is a, c, g, or t
  misc_feature (18)..(19): n is a, c, g, or t
cggggggggnnccttnannttctggtttgccgtctagctttgggtatgttttctttttttcttaaatctccaaggaagagaactgactaaaatagtaggaacatgaaagtattaaatgccaattaatttgttgtagtaaagtatcttcattagcgttatactccatcatatctggtgtaaactgctcacagaaaaccctatgaaaccaaagggggaccattcaggtctaaaaagcgacaggtccgagactgggtctgtcacctgggcattttcaaagaggacattttgaagaatttgcatattcagatttttaaaatgcacttaacatacttcattacagatttcttgggtagggaggatgggataggccagggatgggatggaatcagttctgcctgggaaactaatccgaatcatttacctttctgtattaaccttggcctgtcctaaaaagagaacgactgtttcatcatgagttgctctgagttttgttaatgtttgtgttggtggattgacggttaaatgaagcatttagctggaatatgaactttgggagttttcatgttgtcctggatttctctttgtaaacctttaaaccttagcccctggttgattgtgttaaacccattatgagaatgttatttaaagttgtattataattgcaacctccactaattattcagtactgtagcagcaaagtattatttgtaagaatttggttatttttatacttatatccactctaagtctggcgttctagtcagtaaaatgatgcaataaaattaatatcattttc

SEQ ID NO: 34239 - DNA, 1555 bp, Homo sapiens
tgaaaatgtgctttcagattgttttttatatgtaattcttagacacttgtcattaagaaaatagtggctggcttgtgctcagcaagaagcacactggcacgtggctttggtataggaagtggaaggcaaggacctgggtttctgacaagtgcagtcagacatacacatccatctgagagctgcttgccttgttcccgtggtaaggccatggctcccacatactggaagcatatttttgtgaactgttttcagaattgggaacatattcagtggaatgtcttaaacgctgacacatcttcctcctttgaggggaagtatattttcagaagcagctaagacatttagagccaaaattgctgataggtggttcagtcaagttggctgatggcatctgaggtcaaaaacgaagatgtgacgattgagttcttaaagaggtaactcttaaagtgggcccaagggagaaggcagcatctttggactcctaggctggatggctacccaagaatatgccattgaaggatgacacctattcagatgtgaaagttcccagagcaggcacctttgggtcacccaccacgtgtggctttttggtgcctgcatgaaactgtgttgccccctggtgagatgcccgggtgtcctgtaagccgatttaactctgcctgaggaagaggagctgtccactccagttgcccttggctaagtttagcctaacacacagggttttgacccatagttctaaaatacacaaattttgagactacagcacttctttggaaagaggaagaatgcaaagttcagtatttcaatactttgtattttacttgaaattacccttagtagcatcttttttttcctgtctgaaagcttttgtgtggatgagaagggacatttcatttcctcccttaacaaagtgtcattctgaggttctcatgtgtgtttttggaaatagagatactggttttgtagagtttgcctttgggtatgttttctttttttcttaaatctccaaggaagagaactgactaaaatagtaggaacatgaaagtattaaatgccaattaatttgttgtagtaaagtatcttcattagcgttatactccatcatatctggtgtaaactgctcacagaaaaccctatgaaaccaaagggggaccattcaggtctaaaaagcgacaggtccgagactgggtctgtcacctgggcattttcaaagagaacgactgtttcatcatgagttgctctgagttttgttaatgtttgtgttggtggattgacggttaaatgaagcatttagctggaatatgaactttgggagttttcatgttgtcctggatttctctttgtaaacctttaaaccttagcccctggttgattgtgttaaacccattatgagaatgttatttaaagttgtattataattgcaacctccactaattattcagtactgtagcagcaaagtattatttgtaagaatttggttatttttatacttatatccactctaagtctggcgttctagtcagtaaaatgatgcaataaaattaatatcattttc

SEQ ID NO: 34240 - DNA, 633 bp, Homo sapiens
atggtctatatgagcggttgaagaaatagaaaataaaatgcaaatcacaagatgtccattaaaacagtctacctttttcctttgacagccattaattcttcttaaaatgtattgagaaatattttataatagatatacaaaagggcataagctataactagaaaacactgtacaactctctcatagattaagaaatagaaaattaccgacatgggaaaaataaatcccttgtgtatcactaccacctccagaggcaatcattatcctgaatttgtcgttacaattccatggatttccttatatttttgctgcatatgtatccctaactaatatttagaatcttcacatgtgtttcatcttgagagaaacaagatttttatttctctcttattcaagaaacaagagaaacatttttgaatatttcagcagcttagttttttgtttgtctgctttttattttctaagttcaacactatgttgatgaagacccctatacaagtatgtgcagagtcagctcattaattttcactgctgcataatatattacagtctataaattagtcataatttacacatcgagtttctcctcatggattttttttatgttttgctattaaaaaaaatgctgcaatg

SEQ ID NO: 34241 - DNA, 377 bp, Homo sapiens
cacccacagagtcatctcttggaggccctggaaaagtccctgctggggagtggagggagcctgtcgctgttccagctccagggtacagctgagagactcacagttgcacatctgaagctcccagtatggtgtctgtgctgctggtggtctggaagccactagccagtcacagcagggctcagtaagacaccccaacagctccttatcctgccagcccattacccctccctacttctcccccagcaagagccagaatgacacagaaagaaaaagaagtgctctgggtatcagaatcacctgggtgacacgatacccatgttagactccaggtggataaataaactgtggactattcagagaatgtactactatatagc

SEQ ID NO: 34242 - DNA, 572 bp, Homo sapiens
gctcgacaatcgcttgaacccaggagatggaggttgcagtgagctgagatcacgccactccactccagcctaggcaacagagcgagactcctgcctcagcctcccaagtagctgagactacaggtgcgtgccacctacctggctaatttttgttttgtatttttggtagagatggggtttcactgtgttagccaggatgatctcgatctcctgaccttgtgatctgcccacctcagcctcccaaagtgctgggattacaggcatgagccattgcactcggccctaaacctagtggatacctcttaaataacgtgatcaaactgaacaataccaatgttgggacaaattaacatcacggcctcctgatatgatgcactgaagaggacatgatatcacttccatggggttcttgccaaaaatgcaaccctcccatccaatctaatcgtaagaaaccaaacaaaaccaagacaagggatattctataaaataactgactagtactcaccagaagagctgtggtcatgaaagacaaggaaagactgaggaaccaccacacactggagactaaggag

SEQ ID NO: 34243 - DNA, 229 bp, Homo sapiens
tgaacctaaaagcatgcagttttagagtaagcaggaaggtaacacttctctaatccagtcgcccgtgtgaaacttggctcatctctgaaacagcactcggctgatatcttttaagctttacaggcaccaggaggcctcggacatagggaggtgaaccatcaagtccctctgaaacatctgttcttcttggaacgcatgtatggaattctgtgtatatttctgttaaaag

SEQ ID NO: 34244 - DNA, 270 bp, Homo sapiens
gttacaatttttaattgcacaagcgatatataaagacgttttctttgcaacataaaatgataggttaagactccttatgcagataaggtttagacacttgtttaaggagcatcctggcccaccttttaaaaaatgtgtatgcattcactttatgcatcagatggtttagggaatttttttccctggggcatgggacatgtcatggggtagatggtcaggtacgtctcctctacccagctgattctctttttttttttttttttttttttg

SEQ ID NO: 34245 - DNA, 912 bp, Homo sapiens
tcaaagctaaaccataggaagactggtgtgaggaactgggagaacttagcccagatgtgaaagtttggggaagtgcatgggatggaaacgataactggcttcaaacacccagaggctgatacgtggaggaaactagcagaattcttcctaataaatgctgttccctactaagaggaatgctggccactggaggaatggcggattctgggtctgggctaagggaaaatacaagatgatcctggacatctagttgtgatagaaagctaggaagtgctcaactaatggggtcatgttgaaaagacagatggtagcatcaagggattttcactggccaaattttggggtaatttgagtatccaaaaaaaatgatgataatggatcccatgtaggagaaatgacagaacttagaaaatcatcattttgtaattctcaaagtaatagttgatgcaggcaaagatcatcagtggcagctaaaacttctgtaaaaagttgttgggaaacatcaaaagataccagctgctgttgaaaaaaaaaaaaagttgttgggaaaagttgttaaaatatcaccccacagatcagtttttaattgcaaagggggaaaatttaccatttcaatggagagacctagtggtcaccatctaaatcaagtagtcaacatgtatattatcactagtgagataagcagtacacttatgtagtagtcctaaggaaaaaaaaaaaaaaaaaaaggctgggagaatattccaggtaacaagagaccaaagaggccgggcgcgttggctcacacctgtaatcccagcattttgggaggccaaggcaggtgaatcatttgaggtcaggagttcgaggccagactggccaaaatgatggccaactccatctctactaacaattagctgggcatggtggtgc

SEQ ID NO: 34246 - DNA, 2153 bp, Homo sapiens
  misc_feature (1349)..(1349): n is a, c, g, or t
ggataattgtcccaacatcgtttacatcactgcttttccaggaacgaaatgccgtctatgttggttgtgaacgtgcatttggcacctggcagggccaaccctcatggcgtgtgcgtgaacacatccctaaaccatagtctaatttatcctatttttgtagttcatgtgagcagaatccagtgtctgtgttctcgcatctggttttcactccacgtgtttggggtgtgtgcgtatcgctgtgcatggtgtggactttctccacgtcccgtgtgcaaacgccaccccacccagaggccacgccaggacccaggcctgtgggcagtggttcccggtttgcccttgcaaggacgctgtgtcctcctgcgtgagcatccctgcctcgggtctaatcctgggagtggaaggcaggtcgtgggtgtggctgcatcctcagcttctctggatgatgcccaggaacatgcccagagccagagggcccagctgctcggctccctcacactgggctgggcacttggtcgccagccgtttggggagtgtgttctcatggtggtttcaggtgtgagtctgaccaacaaccccccgtgcccgctggacactggagttccttcctctctggcggtgtttctcatcagggttccccaccggcctactgcacgctgcgtctctcctgacctgtaggagtcccctacacctctggctgctcgactttgttggtttaatgttttgcaaatgtcttcctccattttgtggtttgccttttcattctcctaatggaacatgttgctttacagaagcatctagttttaacagagtcttgtttaagacggtgtcaacacgcactgggctggcctggtccctgaactcaggtgtgtttcctttgcaaactctagagcagagagacaagggaggaaggacagatagcggcagagtgtgtggaaatgttttccaggaaggatggctttgagtgacagcatcatttgagtgacagcagtggtaggtggtgtaatggattctgatgtggtgggggtaaggggcgcagccaagctccgattcctcctgctgggcccaaggaccaaggactgtgacaggaatgcatagtccctcctctgtcctgccagaggccagagacttgtgtccaccactctgccgggctgtcttcaggaacttgttcaggaggtgctggggtgcagggcacgtctgaaaggcatttctggacacctgctgtggcctcatacaggagagtaggtgacctggccaaggccagcacacaggacaagattaagcatccagggacccggggtcacagccctcactccattgcaggggtggggatgacagaggccagaggngatcagacaggggcagctgttgatggttctgagatgcagtttctgtctgaggggcctcctcccactcctggcctgtgcagaggggtgggtgtgtggagggaaggtgggtctgccctggtcaaacagcagaggcattgcctgttagtctcattccattccgagtgcccccagggagagtcagccaccttatgtagagaggcaaggccagaaggcagggggggcctcccctctggtgaccaacagggcctgtggtacaagcagtgccggctgctgccctctctggcctttgtctccttccagcctctccgctattagcagaggagcagaacacttgacaggtggacacaggccacccccaacccctggccctggaggaggctccacagtggcctcctagagccaggagaccggactgagctgaatctgctgctcctgacaggacctgacctcacagggggcgcctttgaggacaacctgaggtcactgcacttgcaggagggccaggacttccttcacttcagctgacggacccatggcagctgctcccagtgcatcccaggccagcaggagctttgtgagctgcaggcatggcgatggtgcgcctgttccacacccagcaggcgcaaccagagtctcgtgtgtgccgaccacaggagccaagccttttccactgtgtggactcatgtggccaaggctaggcctggtcacccaggaccctcaccacgtgaccccagccaatcgggacagttcaaggaggaggagacccctattacacaggttggaataaaatatttaaatctcgta

SEQ ID NO: 34247 - DNA, 929 bp, Homo sapiens
  misc_feature (20)..(20): n is a, c, g, or t
cgaagcgggggatgagcggncggacgtgggcggggcgtccgaggagagccaggccatgcaggccacgtgtctattatcctcccagtccacaacgctgaaccgtggctggacgaatgacctcacagggggcgcctttgaggacaacctgaggtcactgcacttgcaggagggccaggacttccttcacttcagctgacggacccatggcagctgctcccagtgcatcccaggccagcaggagctttgtgagctgcaggcatggcgatggtgcgcctgttccacacccagcaggcgcaaccagagtctcgtgtgtgccgaccacaggagccaagccttttccactgtgtggactcatgtggccaaggctaggcctggtcacccaggaccctcaccacgtgaccccagccaatcgggacagttcaaggaggaggagacccctattacacaggttggaataaaatatttaaatctcgtaaaaatgtaacccaaggctcttttagggtataaagaccattggccaccaggtcaaacacaacaacagtagtgtgttaaccccacactcctgtgtggccaggtcgtcacacacatcccgtgaagagctgtctgctaaacacacagcacggactgtcacagtcctggtcttgtggtcctggtgacctcacaagcctcacagatgcggtggcacctcccagttcttggcctgcccatgttcctgtgtccaggccccatccccacctgagagcaggccagggagccaccctaatctacaccacgcacatggcacccctgggctcctcacatagggaaagggttgctcacccaagcccttgggcctctgagtggccacacctggggctgctttggtgctgctggccgtggttctgcacctcaagccctatgagcacagcacaggtcccagagatgggtgt

SEQ ID NO: 34248 - DNA, 942 bp, Homo sapiens
ggataattgtcccaacatcgtttacatcactgcttttccaggaacgaaatgccgtctatgttggttgtgaacgtgcatttggcacctggcagggccaaccctcatggcgtgtgcgtgaacacatccctaaaccatagtctaatttatcctatttttgtagttcatgtgagcagaatccagtgtctgtgttctcgcatctggttttcactccacgtgtttggggtgtgtgcgtatcgctgtgcatggtgtggactttctccacgtcccgtgtgcaaacgccaccccacccagaggccacgccaggacccaggcctgtgggcagtggttcccggtttgcccttgcaaggacgctgtgtcctcctgcgtgagcatccctgcctcgggtctaatcctgggagtggaaggcaggtcgtgggtgtggctgcatcctcagcttctctggatgatgcccaggaacatgcccagagccagagggcccagctgctcggctccctcacactgggctgggcacttggtcgccagccgtttggggagtgtgttctcatggtggtttcaggtgtgagtctgaccaacaaccccccgtgcccgctggacactggagttccttcctctctggcggtgtttctcatcagggttccccaccggcctactgcacgctgcgtctctcctgacctgtaggagtcccctacacctctggctgctcgactttgttggtttaatgttttgcaaatgtcttcctccattttgtggtttgccttttcattctcctaatggaacatgttgctttacagaagcatctagttttaacagagtcttgtttaagacggtgtcaacacgcactgggctggcctggtccctgaactcaggtgtgtttcctttgcaaactctagagcaaaaagggaaggatcgtgaaaaagggaagatcgtgggaaagggaaggat

SEQ ID NO: 34249 - DNA, 629 bp, Homo sapiens
atccattgagcttttcatttcacttcttacatttctaggggctctgtttttttctaatctcttcttgatcatttctagcccttttcaaaaatgtactcatattatagcctacattctaccagagaggttttgtatttgcatcttctgcccttgtctgggaataccactggtcagggccaagtcaatcaaattttccactttaggagttttggggatcatacaggtagtattaattcaggccacttcaggggagatagattgagataagagtcttgctgctgttcctttgaaaaagacttatttagggtcccagctttatatagcggtccattagatctggccctgggccttaaattctctcatccattctgctatcaaaatagcgtgactagattccagggctcagcagaaaccctcaggatctccaaggtctctgctctcacatggagggtttctggttagcacctagaacgtgtttgtgggtacacaaatcccacatcagctccccggtcccagggatactggcttcttgctgctctctaaactcacaaagcttgctccacttctgggaccacaagcattctcttttctgccattgaaacaaaagacgaggggatcctctagagtcg

SEQ ID NO: 34250 - DNA, 495 bp, Homo sapiens
  misc_feature (20)..(20): n is a, c, g, or t
cgaagcgggggatgagcggncggacgtgggcggggcgtccgaggagagccaggccatgcaggccacgtgtctattatcctcccagtccacaacgctgaaccgtggctggacgaatgtttgaggtctgttttgcaacaggactttgaaggtaccatggagctgtctgttttcaatgatgccagtaaggacaagtctggggctatcattgaaaaatggagagtgaagctggaagattctggtgtccacgtgatcattggggggcacgattctccctctcctagaggcgtcggatacgctaaaaatcaagcagttgcccagagctcagggtcttacctttgctttttggattcggatgacgtcatgatgccccagcgggtgaggctgcaacacgaggctgccgttcagcacccgtcgagcttgctggttcgtggttacgtgaattacattgtgtagtttgtcctgagagaatgaaataaacgctgagatacttgtact

SEQ ID NO: 34251 - DNA, 1790 bp, Homo sapiens
  misc_feature (20)..(20): n is a, c, g, or t
cgaagcgggggatgagcggncggacgtgggcggggcgtccgaggagagccaggccatgcaggccacgtgtctattatcctcccagtccacaacgctgaaccgtggctggacgaatgtttgaggtctgttttgcaacaggactttgaaggacaagtctggggctatcattgaaaaatggagagtgaagctggaagattctggtgtccacgtgatcattggggggcacgattctccctctcctagaggcgtcggatacgctaaaaatcaagcagttgcccagagctcagggtcttacctttgctttttggattcggatgacgtcatgatgccccagcgggtgaggctgcaacacgaggctgccgttcagcacccgtcgagcatcattggttgcagagtgaggagagatccccctaactccaccgaacgatacacacgttggatcaaccagctgacgccggagcagctcctaacccaggttttcacctcaaatggccccacggtgatcatgcccacctggttctgctcgcgagcgtggttctcccacgtgggcccctttaacgagggaggtcagggcgtcccggaggacctgctgttcttctacgagcacctcaggaagggcggcggcgtcatccgcgtggaccagagtctcctgctgtatcgccaccacccacaggcggccacgcactgcgtcctcgagacgaccatctggacccaccgcgtccgcttcctggaagagcaggccctgccccgctgggcggccttcaccatctggaacgctggcaagcaggggcgccggctgtaccgcagcttgactgccggcagccagcgcaaggtggtggcattctgtgacgtggacgagaacaagatcaggaaaggcttctattgccacgaggactctcaggaaagacccaagccccgaatccccatcctgcacttccgagccgcccggccacccttcgtcatctgcgtgaagctggacctcacagggggcgcctttgaggacaacctgaggtcactgcacttgcaggagggccaggacttccttcacttcagctgacggacccatggcagctgctcccagtgcatcccaggccagcaggagctttgtgagctgcaggcatggcgatggtgcgcctgttccacacccagcaggcgcaaccagagtctcgtgtgtgccgaccacaggagccaagccttttccactgtgtggactcatgtggccaaggctaggcctggtcacccaggaccctcaccacgtgaccccagccaatcgggacagttcaaggaggaggagacccctattacacaggttggaataaaatatttaaatctcgtaaaaatgtaacccaaggctcttttagggtataaagaccattggccaccaggtcaaacacaacaacagtagtgtgttaaccccacactcctgtgtggccaggtcgtcacacacatcccgtgaagagctgtctgctaaacacacagcacggactgtcacagtcctggtcttgtggtcctggtgacctcacaagcctcacagatgcggtggcacctcccagttcttggcctgcccatgttcctgtgtccaggccccatccccacctgagagcaggccagggagccaccctaatctacaccacgcacatggcacccctgggctcctcacatagggaaagggttgctcacccaagcccttgggcctctgagtggccacacctggggctgctttggtgctgctggccgtggttctgcacctcaagccctatgagcacagcacaggtcccagagatgggtgt

SEQ ID NO: 34252 - DNA, 1336 bp, Homo sapiens
  misc_feature (20)..(20): n is a, c, g, or t
cgaagcgggggatgagcggncggacgtgggcggggcgtccgaggagagccaggccatgcaggccacgtgtctattatcctcccagtccacaacgctgaaccgtggctggacgaatgtttgaggtctgttttgcaacaggactttgaaggacaagtctggggctatcattgaaaaatggagagtgaagctggaagattctggtgtccacgtgatcattggggggcacgattctccctctcctagaggcgtcggatacgctaaaaatcaagcagttgcccagagctcagggtcttacctttgctttttggattcggatgacgtcatgatgccccagcgggtgaggctgcaacacgaggctgccgttcagcacccgtcgagcatcattggttgcagagtgaggagagatccccctaactccaccgaacgatacacacgttggatcaaccagctgacgccggagcagctcctaacccaggttttcacctcaaatggccccacggtgatcatgcccacctggttctgctcgcgagcgtggttctcccacgtgggcccctttaacgagggaggtcagggcgtcccggaggacctgctgttcttctacgagcacctcaggaagggcggcggcgtcatccgcgtggaccagagtctcctgctgtatcgccaccacccacaggcggccacgcactgcgtcctcgagacgaccatctggacccaccgcgtccgcttcctggaagagcaggccctgccccgctgggcggccttcaccatctggaacgctggcaagcaggggcgccggctgtaccgcagcttgactgccggcagccagcgcaaggtggtggcattctgtgacgtggacgagaacaagatcaggaaaggcttctattgccacgaggactctcaggaaagacccaagccccgaatccccatcctgcacttccgagccgcccggccacccttcgtcatctgcgtgaagctggacctcacagggggcgcctttgaggacaacctgaggtcactgcacttgcaggagggccaggacttccttcacttcagctgacggacccatggcagctgctcccagtgcatcccaggccagcaggagctttgtgagctgcaggcatggcgatggtgcgcctgttccacacccagcaggcgcaaccagagtctcgtgtgtgccgaccacaggagccaagccttttccactgtgtggactcatgtggccaaggctaggcctggtcacccaggaccctcaccacgtgaccccagccaatcgggacagttcaaggaggaggagacccctattacacaggttggaataaaatatttaaatctcgta

SEQ ID NO: 34253 - DNA, 1735 bp, Homo sapiens
  misc_feature (20)..(20): n is a, c, g, or t
cgaagcgggggatgagcggncggacgtgggcggggcgtccgaggagagccaggccatgcaggccacgtgtctattatcctcccagtccacaacgctgaaccgtggctggacgaatgtttgaggtctgttttgcaacaggactttgaaggacaagtctggggctatcattgaaaaatggagagtgaagctggaagattctggtgtccacgtgatcattggggggcacgattctccctctcctagaggcgtcggatacgctaaaaatcaagcagttgcccagagctcagggtcttacctttgctttttggattcggatgacgtcatgatgccccagcgggtgaggctgcaacacgaggctgccgttcagcacccgtcgagcatcattggttgcagagtgaggagagatccccctaactccaccgaacgatacacacgttggatcaaccagctgacgccggagcagctcctaacccaggttttcacctcaaatggccccacggtgatcatgcccacctggttctgctcgcgagcgtggttctcccacgtgggcccctttaacgagggaggtcagggcgtcccggaggacctgctgttcttctacgagcacctcaggaagggcggcggcgtcatccgcgtggaccagagtctcctgctgtatcgccaccacccacaggcggccacgcactgcgtcctcgagacgaccatctggacccaccgcgtccgcttcctggaagagcaggccctgccccgctgggcggccttcaccatctggaacgctggcaagcaggggcgccggctgtaccgcagcttgactgccggcagccagcgcaaggtggtggcattctgtgacgtggacgagaacaagatcaggaaaggcttctattgccacgaggactctcaggaaagacccaagccccgaatccccatcctgcacttccgagccgcccggccacccttcgtcatctgcgtgaagctggacctcacagggggcgcctttgaggacaacctgaggtcactgcacttgcaggagggccaggacttccttcacttcagctgacggacccatggcagctgctcccagtgcatcccaggccagcaggagctttgtgagctgcaggcatggcgatggtgcgcctgttccacacccatgtgtggactcatgtggccaaggctaggcctggtcacccaggaccctcaccacgtgaccccagccaatcgggacagttcaaggaggaggagacccctattacacaggttggaataaaatatttaaatctcgtaaaaatgtaacccaaggctcttttagggtataaagaccattggccaccaggtcaaacacaacaacagtagtgtgttaaccccacactcctgtgtggccaggtcgtcacacacatcccgtgaagagctgtctgctaaacacacagcacggactgtcacagtcctggtcttgtggtcctggtgacctcacaagcctcacagatgcggtggcacctcccagttcttggcctgcccatgttcctgtgtccaggccccatccccacctgagagcaggccagggagccaccctaatctacaccacgcacatggcacccctgggctcctcacatagggaaagggttgctcacccaagcccttgggcctctgagtggccacacctggggctgctttggtgctgctggccgtggttctgcacctcaagccctatgagcacagcacaggtcccagagatgggtgt

SEQ ID NO: 34254 - DNA, 1499 bp, Homo sapiens
acgtccctgttgagcctctagaccggtttctttgcaacaaaagccttttccaccggttcctggttggccggctgagcgcaggtgtagtgtgcatccggggcaggcacgcgtttctggggccccagtgatgcctctgcttctcccgccctgcagggcgtcccggaggacctgctgttcttctacgagcacctcaggaagggcggcggcgtcatccgcgtggaccagagtctcctgctgtatcgccaccacccacaggcggccacgcactgcgtcctcgaatccgggcagacagttccctccttagaactgtgaggacacagaggtctcggccacctgcctgccgcgtgccgcagcgttaagttggaaagcaggccgccgtccgaggcttgcgtctcggcccctacggacgaccatctggacccaccgcgtccgcttcctggaagagcaggccctgccccgctgggcggccttcaccatctggaacgctggcaagcaggggcgccggctgtaccgcagcttgactgccggcagccagcgcaaggtggtggcattctgtgacgtggacgagaacaagatcaggaaaggcttctattgccacgaggactctcaggaaagacccaagccccgaatccccatcctgcacttccgagccgcccggccacccttcgtcatctgcgtgaagctggacctcacagggggcgcctttgaggacaacctgaggtcactgcacttgcaggagggccaggacttccttcacttcagctgacggacccatggcagctgctcccagtgcatcccaggccagcaggagctttgtgagctgcaggcatggcgatggtgcgcctgttccacacccagcaggcgcaaccagagtctcgtgtgtgccgaccacaggagccaagccttttccactgtgtggactcatgtggccaaggctaggcctggtcacccaggaccctcaccacgtgaccccagccaatcgggacagttcaaggaggaggagacccctattacacaggttggaataaaatatttaaatctcgtaaaaatgtaacccaaggctcttttagggtataaagaccattggccaccaggtcaaacacaacaacagtagtgtgttaaccccacactcctgtgtggccaggtcgtcacacacatcccgtgaagagctgtctgctaaacacacagcacggactgtcacagtcctggtcttgtggtcctggtgacctcacaagcctcacagatgcggtggcacctcccagttcttggcctgcccatgttcctgtgtccaggccccatccccacctgagagcaggccagggagccaccctaatctacaccacgcacatggcacccctgggctcctcacatagggaaagggttgctcacccaagcccttgggcctctgagtggccacacctggggctgctttggtgctgctggccgtggttctgcacctcaagccctatgagcacagcacaggtcccagagatgggtgt

SEQ ID NO: 34255 - DNA, 2607 bp, Homo sapiens
  misc_feature (1349)..(1349): n is a, c, g, or t
ggataattgtcccaacatcgtttacatcactgcttttccaggaacgaaatgccgtctatgttggttgtgaacgtgcatttggcacctggcagggccaaccctcatggcgtgtgcgtgaacacatccctaaaccatagtctaatttatcctatttttgtagttcatgtgagcagaatccagtgtctgtgttctcgcatctggttttcactccacgtgtttggggtgtgtgcgtatcgctgtgcatggtgtggactttctccacgtcccgtgtgcaaacgccaccccacccagaggccacgccaggacccaggcctgtgggcagtggttcccggtttgcccttgcaaggacgctgtgtcctcctgcgtgagcatccctgcctcgggtctaatcctgggagtggaaggcaggtcgtgggtgtggctgcatcctcagcttctctggatgatgcccaggaacatgcccagagccagagggcccagctgctcggctccctcacactgggctgggcacttggtcgccagccgtttggggagtgtgttctcatggtggtttcaggtgtgagtctgaccaacaaccccccgtgcccgctggacactggagttccttcctctctggcggtgtttctcatcagggttccccaccggcctactgcacgctgcgtctctcctgacctgtaggagtcccctacacctctggctgctcgactttgttggtttaatgttttgcaaatgtcttcctccattttgtggtttgccttttcattctcctaatggaacatgttgctttacagaagcatctagttttaacagagtcttgtttaagacggtgtcaacacgcactgggctggcctggtccctgaactcaggtgtgtttcctttgcaaactctagagcagagagacaagggaggaaggacagatagcggcagagtgtgtggaaatgttttccaggaaggatggctttgagtgacagcatcatttgagtgacagcagtggtaggtggtgtaatggattctgatgtggtgggggtaaggggcgcagccaagctccgattcctcctgctgggcccaaggaccaaggactgtgacaggaatgcatagtccctcctctgtcctgccagaggccagagacttgtgtccaccactctgccgggctgtcttcaggaacttgttcaggaggtgctggggtgcagggcacgtctgaaaggcatttctggacacctgctgtggcctcatacaggagagtaggtgacctggccaaggccagcacacaggacaagattaagcatccagggacccggggtcacagccctcactccattgcaggggtggggatgacagaggccagaggngatcagacaggggcagctgttgatggttctgagatgcagtttctgtctgaggggcctcctcccactcctggcctgtgcagaggggtgggtgtgtggagggaaggtgggtctgccctggtcaaacagcagaggcattgcctgttagtctcattccattccgagtgcccccagggagagtcagccaccttatgtagagaggcaaggccagaaggcagggggggcctcccctctggtgaccaacagggcctgtggtacaagcagtgccggctgctgccctctctggcctttgtctccttccagcctctccgctattagcagaggagcagaacacttgacaggtggacacaggccacccccaacccctggccctggaggaggctccacagtggcctcctagagccaggagaccggactgagctgaatctgctgctcctgacaggacctgacctcacagggggcgcctttgaggacaacctgaggtcactgcacttgcaggagggccaggacttccttcacttcagctgacggacccatggcagctgctcccagtgcatcccaggccagcaggagctttgtgagctgcaggcatggcgatggtgcgcctgttccacacccagcaggcgcaaccagagtctcgtgtgtgccgaccacaggagccaagccttttccactgtgtggactcatgtggccaaggctaggcctggtcacccaggaccctcaccacgtgaccccagccaatcgggacagttcaaggaggaggagacccctattacacaggttggaataaaatatttaaatctcgtaaaaatgtaacccaaggctcttttagggtataaagaccattggccaccaggtcaaacacaacaacagtagtgtgttaaccccacactcctgtgtggccaggtcgtcacacacatcccgtgaagagctgtctgctaaacacacagcacggactgtcacagtcctggtcttgtggtcctggtgacctcacaagcctcacagatgcggtggcacctcccagttcttggcctgcccatgttcctgtgtccaggccccatccccacctgagagcaggccagggagccaccctaatctacaccacgcacatggcacccctgggctcctcacatagggaaagggttgctcacccaagcccttgggcctctgagtggccacacctggggctgctttggtgctgctggccgtggttctgcacctcaagccctatgagcacagcacaggtcccagagatgggtgt

SEQ ID NO: 34256 - DNA, 1848 bp, Homo sapiens
atccattgagcttttcatttcacttcttacatttctaggggctctgtttttttctaatctcttcttgatcatttctagcccttttcaaaaatgtactcatattatagcctacattctaccagagaggttttgtatttgcatcttctgcccttgtctgggaataccactggtcagggccaagtcaatcaaattttccactttaggagttttggggatcatacaggtagtattaattcaggccacttcaggggagatagattgagataagagtcttgctgctgttcctttgaaaaagacttatttagggtcccagctttatatagcggtccattagatctggccctgggccttaaattctctcatccattctgctatcaaaatagcgtgactagattccagggctcagcagaaaccctcaggatctccaaggtctctgctctcacatggagggtttctggttagcacctagaacgtgtttgtgggtacacaaatcccacatcagctccccggtcccagggatactggcttcttgctgctctctaaactcacaaagcttgctccacttctgggaccacaagcattctcttttctgccattggacacagtctggacctctgcccaaatgctgccccttcagagaggttttctgaacaccttctcggagtcaacacccaacatgccattccattgcccactttatctttgttcatagcactcagtgttgcctgccttgatggtgcttgcttgttcatttgctattgtctgccccagctatcatgtgagcaaggggttccttgccaaactctatcacctggaccctggtgggctccagaaacggctgctgaaagagggctttccaggccaccaggtgtctggtgagcacaagtgccccagtgatggatgggatccagtgggaaagaggcagtggccagtggagtgatccactttcctcgggttgctaagttagaccgacattaaaagaagaactgctttgccacatagtgtcactgatgggtctgggtgggtaatcgacctgcctccatgtcttaaaatgccatttatctggaatcttcttttaattgcactaagaacagttcatcatgtttttctcagaagccacttgttccttccatcctcagtgcatcccaggccagcaggagctttgtgagctgcaggcatggcgatggtgcgcctgttccacacccagcaggcgcaaccagagtctcgtgtgtgccgaccacaggagccaagccttttccactgtgtggactcatgtggccaaggctaggcctggtcacccaggaccctcaccacgtgaccccagccaatcgggacagttcaaggaggaggagacccctattacacaggttggaataaaatatttaaatctcgtaaaaatgtaacccaaggctcttttagggtataaagaccattggccaccaggtcaaacacaacaacagtagtgtgttaaccccacactcctgtgtggccaggtcgtcacacacatcccgtgaagagctgtctgctaaacacacagcacggactgtcacagtcctggtcttgtggtcctggtgacctcacaagcctcacagatgcggtggcacctcccagttcttggcctgcccatgttcctgtgtccaggccccatccccacctgagagcaggccagggagccaccctaatctacaccacgcacatggcacccctgggctcctcacatagggaaagggttgctcacccaagcccttgggcctctgagtggccacacctggggctgctttggtgctgctggccgtggttctgcacctcaagccctatgagcacagcacaggtcccagagatgggtgt

SEQ ID NO: 34257 - DNA, 526 bp, Homo sapiens
ctgccaaatctaaatgaaaaaccacccaattttgaatgcttactatatagagagcactatgctgccagttttacataaagtggatgattattaatgatgatggtaacaatagctaacatttcaacagcgtttttggtttactgtgctcctatgagactggtattaatcagctttccattttacaatagaggaaactgaagtgaggcaggttaagaaatttgtccaagttcacacaactattaaggggcagagctgggattcacacccagtcagtgtggtttgctcctcagcactctgcctttgcatgtatgttatggaggcatggaaccacacctctctgagacaatcatctatttggaaaagcaatgcatagaattaaaaacaaaaaatagactaccaagtaaatgtaaaatattgttcacattactgaaaacactagccgttacataaagtatacttgcttgaatcagatatttgaacacttaaaattgtcacatgctaagattagccaaaatctgaaaagctc

SEQ ID NO: 34258 - DNA, 503 bp, Homo sapiens
tagtcctttctccactgacttgacatatcattttaacagatactaaattctcagatatctgtgactttctggactatttgttttcattgattcatttgcctttttctgtgccaccatcacattgttttagttactgtagctttatgatattttgatcaacatttttttcttgattgagtactttgccatgaaatttagaaactagagattaaatgtaattataaaatgacagtctcacttctccattgctgcctaatggctgataagcaagatagagcatatttgaaggccaaaaaacaacctgttgaatttttaaatgatagcttgtgaacatgcttatttgtcttgattttattaatcaccaaattagtaaattgtgtctgtaacagagtaatttcccaaagctaattgttattacgtgttatttcttaaacattcttttaatgtaacaggactcttatagcaaataataaagcaattaaattatcaggtgaaacgttatt

SEQ ID NO: 34259 - DNA, 2292 bp, Homo sapiens
cgagggggagggcggagctgccggcggcccgggcgggctggcagctagagtgggtgcgatagccgcctccgcctctgcccgcctccgccgtcgcctcctccgcccgggccgttcgctgctgcgcggggagagcgaggcggggccgccggggccgccatggagcccgactcggtgattgaggacaagaccatcgagctcatgtgttctgtgccaaggtctttgtggctaggctgcgccaacctggtagagagcatgtgcgcactgagttgcctgcagagcatgcccagtgtcagatgtctccagataagtaatggaacatcatctgtgatcgtctccagaaagaggccatcagaaggaaactatcaaaaagaaaaagacttgtgtattaaatattttgaccagtggtctgaatcagatcaagtggaatttgtggaacatcttatttcacgaatgtgtcattatcagcatggacatattaactcttacctgaagcccatgttgcagcgggactttattaccgctttaccagagcaaggcttagatcacatagcagaaaacattctttcgtacctggatgccaggtctctgtgtgcagcagagctggtatgtaaagaatggcagcgagtgatctcagaaggaatgctttggaagaagctgattgaacgaatggtacgcactgatcccctatggaaaggactttcagaaagaagagggtgggatcagtacctgtttaaaaacagacccacagatggccctccaaattcattttataggtcattatacccaaagattatccaggatatagagactatagaatctaactggcggtgtggacgacacaacttgcagaggattcagtgccgctctgaaaatagtaaaggtgtctactgtttacagtacgatgatgaaaaaattatcagtggcctacgagataattctattaagatatgggataaaaccagcctggaatgtttgaaagtgttaacaggacacacaggctctgtcctctgtctgcagtatgatgagcgtgtcattgtaactggctcttcagattctacggtgagagtgtgggatgtgaacacgggtgaagttcttaacacattgatccaccacaatgaggctgtattgcacttacgcttcagcaatggactgatggtgacctgttccaaggaccgctccattgctgtgtgggacatggcttctgcgaccgacatcactttacgccgtgtcctggttggccaccgggctgccgtcaatgtagtagactttgacgacaagtacatcgtgtctgcctctggtgacaggaccatcaaagtctggagcacgagcacctgtgaatttgttcgtactctcaatgggcacaagcggggcattgcctgtctccagtacagggatcgcctggttgttagtggatcatcagataataccattaggctctgggatattgaatgtggtgcctgtttaagagtcctagagggacatgaagaattggtccgatgcatccggtttgataacaagaggattgtcagtggggcctatgatgggaaaattaaagtttgggacttgcaagctgctcttgaccctcgagccccagcaagcacattgtgtttgcgcacattggtggaacattctggacgtgtgtttcggctccagtttgatgagtttcagatcatcagcagctcccatgatgacactattttgatttgggatttcttaaatgtgcctcccagtgcccagaatgagacccattccccctccagaacatacacttacatctctagataacagtctgcactttcacccgtttccgggttttctagtcttgaactactggctacgtggctaccaaatgcctaagggagttcgttcacagctgagttatgaagctggaattggttctagacgctgggtagatgcaaagcagcctaactcttcaagtaccgacatttctcacctctgattccggctctcctttgagaaggagaccttagcttccccggcttgcaagtagaacagaagcccgtttccttccctcatcagtgaaaaaatctaatgtttcaaatgtaaattgttcatagaaaaggaacatagaatctgttttacagaagtaaatcgaccgtcaagagaagacttggcctctaatttatattgctttgcactttggtttgatattaagaaacagcattcttcttcagtgaaattttgggtgccaaacacctacccagaatgtccagggctttcattttcaaaagttagcattctccttttgaccgtccaagtcattatgaattc

SEQ ID NO: 34260 - DNA, 2252 bp, Homo sapiens
cgagggggagggcggagctgccggcggcccgggcgggctggcagctagagtgggtgcgatagccgcctccgcctctgcccgcctccgccgtcgcctcctccgcccgggccgttcgctgctgcgcggggagagcgaggcggggccgccggggccgccatggagcccgactcggtgattgaggacaagaccatcgagctcataacacttcagttctggaagatcaagatgaagataagtccccaaagaaaaatactccttggcagataagtaatggaacatcatctgtgatcgtctccagaaagaggccatcagaaggaaactatcaaaaagaaaaagacttgtgtattaaatattttgaccagtggtctgaatcagatcaagtggaatttgtggaacatcttatttcacgaatgtgtcattatcagcatggacatattaactcttacctgaagcccatgttgcagcgggactttattaccgctttaccagagcaaggcttagatcacatagcagaaaacattctttcgtacctggatgccaggtctctgtgtgcagcagagctggtatgtaaagaatggcagcgagtgatctcagaaggaatgctttggaagaagctgattgaacgaatggtacgcactgatcccctatggaaaggactttcagaaagaagagggtgggatcagtacctgtttaaaaacagacccacagatggccctccaaattcattttataggtcattatacccaaagattatccaggatatagagactatagaatctaactggcggtgtggacgacacaacttgcagaggattcagtgccgctctgaaaatagtaaaggtgtctactgtttacagtacgatgatgaaaaaattatcagtggcctacgagataattctattaagatatgggataaaaccagcctggaatgtttgaaagtgttaacaggacacacaggctctgtcctctgtctgcagtatgatgagcgtgtcattgtaactggctcttcagattctacggtgagagtgtgggatgtgaacacgggtgaagttcttaacacattgatccaccacaatgaggctgtattgcacttacgcttcagcaatggactgatggtgacctgttccaaggaccgctccattgctgtgtgggacatggcttctgcgaccgacatcactttacgccgtgtcctggttggccaccgggctgccgtcaatgtagtagactttgacgacaagtacatcgtgtctgcctctggtgacaggaccatcaaagtctggagcacgagcacctgtgaatttgttcgtactctcaatgggcacaagcggggcattgcctgtctccagtacagggatcgcctggttgttagtggatcatcagataataccattaggctctgggatattgaatgtggtgcctgtttaagagtcctagagggacatgaagaattggtccgatgcatccggtttgataacaagaggattgtcagtggggcctatgatgggaaaattaaagtttgggacttgcaagctgctcttgaccctcgagccccagcaagcacattgtgtttgcgcacattggtggaacattctggacgtgtgtttcggctccagtttgatgagtttcagatcatcagcagctcccatgatgacactattttgatttgggatttcttaaatgtgcctcccagtgcccagaatgagacccattccccctccagaacatacacttacatctctagataacagtctgcactttcacccgtttccgggttttctagtcttgaactactggctacgtggctaccaaatgcctaagggagttcgttcacagctgagttatgaagctggaattggttctagacgctgggtagatgcaaagcagcctaactcttcaagtaccgacatttctcacctctgattccggctctcctttgagaaggagaccttagcttccccggcttgcaagtagaacagaagcccgtttccttccctcatcagtgaaaaaatctaatgtttcaaatgtaaattgttcatagaaaaggaacatagaatctgttttacagaagtaaatcgaccgtcaagagaagacttggcctctaatttatattgctttgcactttggtttgatattaagaaacagcattcttcttcagtgaaattttgggtgccaaacacctacccagaatgtccagggctttcattttcaaaagttagcattctccttttgaccgtccaagtcattatgaattc

SEQ ID NO: 34261 - DNA, 2188 bp, Homo sapiens
cgagggggagggcggagctgccggcggcccgggcgggctggcagctagagtgggtgcgatagccgcctccgcctctgcccgcctccgccgtcgcctcctccgcccgggccgttcgctgctgcgcggggagagcgaggcggggccgccggggccgccatggagcccgactcggtgattgaggacaagaccatcgagctcaataagtaatggaacatcatctgtgatcgtctccagaaagaggccatcagaaggaaactatcaaaaagaaaaagacttgtgtattaaatattttgaccagtggtctgaatcagatcaagtggaatttgtggaacatcttatttcacgaatgtgtcattatcagcatggacatattaactcttacctgaagcccatgttgcagcgggactttattaccgctttaccagagcaaggcttagatcacatagcagaaaacattctttcgtacctggatgccaggtctctgtgtgcagcagagctggtatgtaaagaatggcagcgagtgatctcagaaggaatgctttggaagaagctgattgaacgaatggtacgcactgatcccctatggaaaggactttcagaaagaagagggtgggatcagtacctgtttaaaaacagacccacagatggccctccaaattcattttataggtcattatacccaaagattatccaggatatagagactatagaatctaactggcggtgtggacgacacaacttgcagaggattcagtgccgctctgaaaatagtaaaggtgtctactgtttacagtacgatgatgaaaaaattatcagtggcctacgagataattctattaagatatgggataaaaccagcctggaatgtttgaaagtgttaacaggacacacaggctctgtcctctgtctgcagtatgatgagcgtgtcattgtaactggctcttcagattctacggtgagagtgtgggatgtgaacacgggtgaagttcttaacacattgatccaccacaatgaggctgtattgcacttacgcttcagcaatggactgatggtgacctgttccaaggaccgctccattgctgtgtgggacatggcttctgcgaccgacatcactttacgccgtgtcctggttggccaccgggctgccgtcaatgtagtagactttgacgacaagtacatcgtgtctgcctctggtgacaggaccatcaaagtctggagcacgagcacctgtgaatttgttcgtactctcaatgggcacaagcggggcattgcctgtctccagtacagggatcgcctggttgttagtggatcatcagataataccattaggctctgggatattgaatgtggtgcctgtttaagagtcctagagggacatgaagaattggtccgatgcatccggtttgataacaagaggattgtcagtggggcctatgatgggaaaattaaagtttgggacttgcaagctgctcttgaccctcgagccccagcaagcacattgtgtttgcgcacattggtggaacattctggacgtgtgtttcggctccagtttgatgagtttcagatcatcagcagctcccatgatgacactattttgatttgggatttcttaaatgtgcctcccagtgcccagaatgagacccattccccctccagaacatacacttacatctctagataacagtctgcactttcacccgtttccgggttttctagtcttgaactactggctacgtggctaccaaatgcctaagggagttcgttcacagctgagttatgaagctggaattggttctagacgctgggtagatgcaaagcagcctaactcttcaagtaccgacatttctcacctctgattccggctctcctttgagaaggagaccttagcttccccggcttgcaagtagaacagaagcccgtttccttccctcatcagtgaaaaaatctaatgtttcaaatgtaaattgttcatagaaaaggaacatagaatctgttttacagaagtaaatcgaccgtcaagagaagacttggcctctaatttatattgctttgcactttggtttgatattaagaaacagcattcttcttcagtgaaattttgggtgccaaacacctacccagaatgtccagggctttcattttcaaaagttagcattctccttttgaccgtccaagtcattatgaattc

SEQ ID NO: 34262 - DNA, 310 bp, Homo sapiens
aaaaggggagtttccctgcacaagcttctctctctttgcttgctgccattgcacgtaagatgtgacctgctcctccttgccttctgccgtgattatgaggcctccccagccatgtggaactaacacttcagttctggaagatcaagatgaagataagtccccaaagaaaaatactccttggcagataagtaatggaacatcatctgtgatcgtctccagaaagaggccatcagaaggaaactatcaaaaagaaaaagacttgtgtattaaatattttgaccagtggtctgaatcagatcaagtggaattt

SEQ ID NO: 34263 - DNA, 338 bp, Homo sapiens
tgaggattcagactaattctgtcctctaattcatttgataatctatcactgtgactaaaatataatggagatgacagatgcttatggataactattttgtgatattcatgtccctgagttggtatcagcaaattgctttttattagtagctaaataatactttggttcttccacgaaatgattaatctaagtagagccaaatgtggacttgcctgtgatgcagagcaacgaggtaatggaaagctcaggacttctcattatggtcttatttgtaccatgactctgcaactcttttccaaatatcagttatttgagccctctatgttcttgttattggt

SEQ ID NO: 34264 - DNA, 370 bp, Homo sapiens
ggcttgatggcatgcacgtgtgatcccagcaatctggggggctgaggcaggggaattgcttgacctagggaggtggaggttgcagtgagccaagatggcaccactgcactccagcctgggcaacagagcgagactccgtctcaaaaaacaacaacaagaacaacaacaaaaaaagcattatagccttgagtacgactttgtgctgaattctgtgggtctcagggatccccaacacaacatcaaatttgagaacatcctgagcaggtaggtaccttatgaagattttgatctctttcctactatgatctttctctgacatcatgagaatgctcagcaaaatgataatttaatctgttgtattctagataca

SEQ ID NO: 34265 - DNA, 381 bp, Homo sapiens
ctcccccatatttcagtctgaatgagtgacatcagattttattaaattgtacaagccagaaacttgataatcattttgaattgttttatttatccctcatgtccaatcaattgtcaagttatatcagtttcacctctagtattctccaaagttttttatatacatgggtattactttaggttaagctaagtcagtctgtgttgctataacaaaatacctaaaactgggtaatttataatgaacagagactcatttcttacagtctggaagctggaaagtccaatatcaacgtgccagcatcttgcgagggctttcttgttgtgacatcatatggcggaaagtgagagggcaggagagagcaagaagggactgaacttgccc

SEQ ID NO: 34266 - DNA, 221 bp, Homo sapiens
attatttccctgtggaatgagaaaatgctgtttataaaattgcccataagtacattttactttattaatacagtacaaagtaaatatacacctttgttaatgtcaatttgtagctggtagttactgatagttggtatatgggttcaaggcagaggttgcagtgagctgagatcatgccactgcacactccagcctaagcaacagagtgagactccatctca

SEQ ID NO: 34267 - DNA, 306 bp, Homo sapiens
tgtgctgggcagtcaattgcatatgtggaatttaatatatgataactctggttccctgtcaaaaagacagttgagtgcctagtacatcaggaacctaaaggaacctttgtcgtgagccacagggatgaggactagtctctaggtactaggtgttttgcttctattaataattatcctgatgtctgctgacagagcatggacctcagttttaggttctacctaccctctgcatacagacctgaaagtgattttacctcttccgttctcatgttccctaaagcatgggttagatgatacttatttcag

SEQ ID NO: 34268 - DNA, 139 bp, Homo sapiens
agacaggcggtatccttccatacccttccttggctcccaggacccacacctgttaaacatatgatgtgtctcatatgtggattctacccaagatcctacagaggaaagatttgctgggactgaggtacggtcctaaaga

SEQ ID NO: 34269 - DNA, 386 bp, Homo sapiens
ccttaattaccctccaaaggcaccaagtccaaatgccatcatacagggattggggtttcaacataggaattttgggaggatacaagcattcagtctatagtggtacaaaatcttggaatggtaaatttatgacctatagactccaccctttccttcttccaccacagctgatggtactaattgatcatggcaacttttcctttctgaactgaatggtgatcatacaaatctttgtgacccagcattttgagcaagcactaatgatagctcagtgctgacaggaagctctgccctctcctgtctgctctatgatgacaatgcctctatcagtcaattaactgatgacaaaatatgatacatttggtaataatcttggaggagctgag

SEQ ID NO: 34270 - DNA, 905 bp, Homo sapiens
ggggtttcaccgtgttagccaggacggtctcgatctcctgatctcgtgatctgcccgcttcggcctcccagagtgctgggattacaggcgtgagccaccgcgccctgcccacatcaaaaggttttaaatgcatcaagtggtataatgtcaccaaaaatcatttagtttatttttgtgtcctatgatctgtgagatgatgattcctaaatttacatttctagcccaggcctctcttctcagctctagagttatagacaggcatgccctgtttttttggcttcccaaatggtatgttttttgacaaatcaaaggtttgtggcaagcctgttgagccccatctgttgacaccattttttcaacagcatgttctcactttgtatctgtgtgtcacattttggtaattgttgtaatatttcagagcttttcattattattttatctgttatggtgattcatgatcattgatctttgatattactattgtaattgttttggcgtgccatgaactgtgcccacgtaagatggtgagcttaattgataaatgtatgttctgtctgctctacctactggctggtctcctatcttcctccctcctcctcaagcctccttctttcttgggacacagcaatattgaaattaggccaattaaaaaccttacagtgggacaggcgcagtggctaatgcctgtaatcccaacactttaggaggctgaggtgggcagatcactttgaggtcaggagtttgggactagcctggccagcatggtgaaaccatatctccaccaaaagtacaaaaaatagccaggtgtggtggcgggcacctgtagtcccaactacactccagcctggacaacagagggagactgttttaaaaaaaaacagaggcaggaggattgcctgaacctg

SEQ ID NO: 34271 - DNA, 538 bp, Homo sapiens
cagataaggccagaggaatagaaaagtatgctggcttaatttacattgttaataatatattatggaggaagtcaggttagtaaaatgtatgttgattgatgacttatactcattgtagaactgtgctttcattcataatacagtttgcttccaccatttgcatatcccacttcattgttagctaagtgtgtaaatttggatttaaatttaggtgtcaaaagcaaaaattcatgagtagtgatataactgtggactaaaatatagccactaaaaatctttgttttctttttaagattatttgatgacatagttgcatgctcgtactatgttgttgggtacaagggctaggttacagagtagaaaatgtatcatctgagttttgtgtaaaaaaaatttacatgtgtttgttctttttgggttgtggtgtgtgtgtacttacgcgaatgagaaaaaaggatagaaataaatggataagatattcagtgtttctggacagttttcaggttgtttatagtgaacattttaaatcagaaaaaca

SEQ ID NO: 34272 - DNA, 396 bp, Homo sapiens
tttttttgtatttttagtagagatggggtttcaccatgttggtcaggctggtctcgaatattcagctttgcccgtatattacacactttttattgctgggaacaataccatactgtgctgaactgaaaatttaacaggcagtatctacctacattctaacctttccatgtttaagtttctattggtgagtctgctttttgattgattagttctccaatttgctcaataagccccagtgttattttcaagtacattacagaggcttgagagaatttgtgtcagctcctaggtcttttcccttattgtggtatgtgccaggtaacagtattacctcctggagatgatcctgtgtttattaatccattgttcaaaactacattgtaagctatgcttgct

SEQ ID NO: 34273 - DNA, 340 bp, Homo sapiens
atatttaatttacttaaagctgtcatgcccaccaccctcccatagtgaaaaaccaaagaaaaggctaggcccagtggctcatgcctgtaatcccaacactttggggagccgaggtgggcagatcacttgagatcaggagtttgagaccagcctggccaacatggtgaaacctgtttctactaaaaatacaaaaattagctaagcttggtggtgcgcacctataatcctagctcctcgggaggctgaagcaggaggattgcttgaacctgagaggcagagtttgcagtgagccgagatagtgccactgcacttaagccttggtgacagggcaagactgtga

SEQ ID NO: 34274 - DNA, 406 bp, Homo sapiens
gttatcaatgacaatggtgcccgaaacttcattagcaattttaatttcgcctgggtcctgtggtcctgtgatctcgccctgcctccacttgccttgtgatattctattaccctgttaagtacttgatgtctgtcacccacacctatttgcacactccctccccttttgaaaatccctaataaaaacttgctggtttttgtggcttgtggggcatcacagatcctaccaacgtgtgatgtctcccccagatgcccagctttaaaatttctctcttttgtacactgtccctttatttctcaagccagccgacacttaggaaaatagaaaagaacctacgtgattatcggggcaggtcccccagtaagagtgagaccttgtctcaaaaacaaacagacaataattatgt

SEQ ID NO: 34275 - DNA, 381 bp, Homo sapiens
aaaaatatttttttttagcaaacagaactagcaggttcagtgttaccacacagctatagggttaaaattaacgtagtaatctaagcctatattttaaagggtttttcttctttcagtatgcacaatatatttcttgagtgatgtgagtttttagtagcattcaaaaaaaaatacttgcaaaaattctaccaaactagattttctgtcatctgccacccagctttcaatgtattcctgacactgaaatctgctggccagccgtctgacagatttcacccataggtagattccctattgttactgccactagttgggaaagtattattagtcataagcaatgcagaatcagagtcagtcttgccaagaactggaaccagaaag

SEQ ID NO: 34276 - DNA, 133 bp, Homo sapiens
cctgtattttaaaatgctttatttaaaagagaaattttattattaaaaggaacttggtttatattgaaataattattctaagaatattctggcatcaataataagaaatatggacatggtggatccatcccaa

SEQ ID NO: 34277 - DNA, 559 bp, Homo sapiens
cgctagtcatcacatggtaacaagtgacataaaatcctagtgatttacattaataaaggttcacttctttttcatgatacacaacagctagggtcagctccagctctattccatgtcttcattccagccttcgggctaaaggagcagctcttttctagaatatgctcttcttgtggtggctgtgggacataggaaatagaaccacatgatagttcttaaaccctctgcttgaacgtgtccatagcacttttgcatgtatttcattgactaacacaagttcaatggccaatgctgacataaacaggacatggaagtataatccccctacacaaaggtcaggaaataactgaggaacaatacgacaatctgccacatcaagtatctgaaatataccatatttttaatagtatatatagaatactgtatatctatgcagtatatatagaataccatatatccatgcagtatatatagaataatacaactggatctataatatgtgtatttatgtgtggagagatagatagatggaaacagatcgtgaagacagaaaaaaaga

SEQ ID NO: 34278 - DNA, 399 bp, Homo sapiens
aaaccttcaaatagttgggcgctaaacaacacacttgtaggtgattcgtgggtcaaagaagacctaagataaataaaaattgacattgagctgaattaacatacatatgacaacctacacatatacatacataacatatacatacatattactacaatataccacactttgtgggaaacagataaagcagtgctaaaagggaaatttgcagtagtaaacaaatacattggagaagaaaagtctcacataaataatctaagcttctaccacaaaaacctggcaaaaaagaagagcaaaataaacccaaagtaagcagaaggaagatacaataaagagcagaaatcaatgaaattaaaaatccgttagaagatcttaaatgttgtgtaaaatttagccaag

SEQ ID NO: 34279 - DNA, 811 bp, Homo sapiens
atgaaaacaatggctagaagcttcctatttccaggtgccccagaatcactggcatcagaaacctgctctaggcagcaagccttttgcaggatgctgttcctcaggagctgagaaagatttttctgtgccattttgaagtcctgaggctggttctctcaccagctttgtgctatgctggctgtgcctctaagccctttctggcttaatgtgtaatgtcttttacttttctgtttgtttgtttgttttttccttctaagcttttataagttttataaaaagtatctgtatgactattgggacttctcttttagttgtcaacggtgcctaaaaggactctcctcattccacctcccagcttttactctgtgtcaagagggtgtcaaacacatgctctacactagatcatgttccttttaaaaatcaaatgcacatagtaaagtagggggagaataactatgtaacggatgccaggctacacatcaggcaagggatttctatgtaaaggtatctattacttatatagaatacctagcacacctctaggtcttttgcatatttttattgttaatccttattgcagtccagcgtgtcggatattatggtcctgattgtgtccaggaaataagcttttcaacagcttatatactttgcctaagatcatacagcttgtatgtagcttgctggaaattttgaattcaggtttcttttctttttctttttctctcttctttaaaaaaaaaacctacagctttacagttgatattctttctattattattttattgctttctttatacacagttgacttcct

SEQ ID NO: 34280 - DNA, 599 bp, Homo sapiens
gcttaaaagtttcagtggcatagtcctactgtccttgtctgagctttaggcccatttgttttacctactcagtgtttatattgtgatgtcttactgcatttcaaactggacttgtccaacatgatcccgttctctttctagtactgtacacatcttgtcagcaagtgtatgcttctgtacagggtgaagtctgattctcatttgtgtcttcaatcactagagcagttgctggcatgtagtgggcattcagtaagtgcttattcattgcatgcattgaaaaataattgaaaggtttctcagagaccactgaggtttcttttaatggtgacataatcttttcttctgtgtcctcaagtatctgcttagtttttgctagattaggaatttgttacctcttaaggcagtccattctgtttttcaattatttctgatagtttttcctcacacacagttgcttctttgcatctccccatcatatatcttttggtgtgtacactcaggagttacacaggacaaacataattcctcttctgtaggatgatcttgcgaatacttgaagttggttgttacccactctaaccccacagttgtctgtttta

SEQ ID NO: 34281 - DNA, 438 bp, Homo sapiens
  misc_feature (349)..(349): n is a, c, g, or t
  misc_feature (417)..(417): n is a, c, g, or t
  misc_feature (430)..(430): n is a, c, g, or t
gtaattgaaacttggttctaagtttccctcttgtcccttcctgtttaatgcagtcagctgtcctcgaatttattttttggtggtactttgaatcagccccctgtgtgagaattcaacaaaaacgcaactgatacaaagcatctgcactgagtgctgcaggaggcttctcacatgctttgggatatcttcagggaaatacgctcttaatagaaactgagaatttaagaaagtctgcctgggcggaggacacctgcacttgttaccctgagttgattcctggaaacttcgggacccctgggtatttaacagagggacttcagtggggagctcctgggtcaggagggacttnggatgtttgttcatttacatttctaagttgaggactgttcccacattcatcttaggggaaaatgggtnggcccctgttccnttaaaagg

SEQ ID NO: 34282 - DNA, 308 bp, Homo sapiens
aaaaatagttacatcttttaattgcatgaacactgtctatatttaacatgtccaactatttaaatgacctaatattttatatttgccaatgcaagcatagcaactgtcaggcaacaagtactttttttttgtatttttagtagagtcagggtttcgcaatgttggccagactggtcttgaactcctgacctcaggtgatccacctgcctcggcctcccaaaatgctgggattacaggcttgagcaccacgcccagctccactctattttttaatatccctgggtagggcccagaaaaaaaggtcgacg

SEQ ID NO: 34283 - DNA, 286 bp, Homo sapiens
gatacctactgttctatgccacagcacttaatgtcagtgttctatggcatggcacttaatgtcagttttccaccccatctgtgaacgtgtattcaatcattatactgtatttagcctgagaatgaatatggaaaagaaaacaacactttcttcaggctttttgcaactttttaaaagcaaaacaggctccaattccccctcccaggagttttgtttgtatccaaagagaggacatgctcattgccatggaatccttaaaggactgagagggaagtgatctgtggca

SEQ ID NO: 34284 - DNA, 229 bp, Homo sapiens
aatcaaccagaaactaaaaccaagctcttcataagtgcatatgtgtaatctatagtgaaaaaatgcaataaataaaacaaattcatctctgctcattattcctggcagttcttaaagagtacatgatccatattttaacaaagtttaaatgtcaacattggtttcaaatttaattactattaattaccacatcaccaccaccataaaaaagtattcttgaattgcagtt

SEQ ID NO: 34285 - DNA, 538 bp, Homo sapiens
  misc_feature (521)..(521): n is a, c, g, or t
caaagctgtgggcaagattgaagttagaaatacacaaaactctaggttaagaagaaggcaatggagagtttggctcctgcaaagtaaaggaaactaaaagggctcacagtgggacagggatcaggagccaggttcatagcttgaaaccaggcactatagtgagattcccgtgttcatgaaggaaggctgaaaaaatgctaccaacagctgccaggaacaagaacttatatagaactgttgataaatagaagcaaaagaaaacaggcaaggattgctggcaagatggccaaataggaacagctctggtctgcagctcccagcaagatcctcgcagaaggcagatgatttctgcatgtccaactgaggtacctggttcatctcattgggactggttggacagtgggtgcagcccatggaaggcgagccgaagcagggtggggggtcacctcacctgggaagcacaaagggtcagggaatgtttccccctacccaggggaagccatgagggactgagccccttntagtttcctttactttg

SEQ ID NO: 34286 - DNA, 461 bp, Homo sapiens
ctcccaagtaggagggactacaggtgcccatcaccacacccagctaaaccttgggttatttccataaactacttgtgtttcagatatttggaatattttccaagaacattttaaaaaataaagaatgatcctgtatgaaattactaggactattttgatgtgctgtttctcttgtttttatttttgacactgcaaaagatgtaactaaaggtatttaaattaaatcacgaataaaaactagatttttcctttgcctccatcttgctcaaatctgtttatccttttcagaaattagcagttttcccatgtcctgaagctgatttgtctcagaaatgtagatagctaataggctcatccactaaggaagagaattttgttttgttttgttttgagacagagtcttgctccgtcacccaggctggagttcaggtacagtggcagggtctcagctcactgcaacc

SEQ ID NO: 34287 - DNA, 250 bp, Homo sapiens
ttacttttacaccataaactccagctgcctcattacctcactcaagacaaaaagatcactggaaagaaatgtaaaagctttcaaggtactgttttctctgaagggtttgggactttccactttttggagttttttttttttatagtagtaactgatgcatcagatactatattaggtaaagaattataagaagaacataaaaaacgtgaaactctcagatgagagttctctagtagaaaattgttagctg

SEQ ID NO: 34288 - DNA, 999 bp, Homo sapiens
  misc_feature (307)..(307): n is a, c, g, or t
atggtgaactccacccaccgtgggatgcacacttctctgcacctctggaaccgcagcagttacagactgcacagcaatgccagtgagtcccttggaaaaggctactctgatggagggtgctacgagcaactttttgtctctcctgaggtgtttgtgactctgggtgtcatcagcttgttggagaatatcttagtgattgtggcaatagccaagaacaagaatctgcattcacccatgtactttttcatctgcagcttggctgtggctgatatgctggtgagcgtttcaaatggatcagaaaccattntcatcaccctattaaacagtacagatacggatgcacagagtttcacagtgaatattgataatgtcattgactcggtgatctgtagctccttgcttgcatccatttgcagcctgctttcaattgcagtggacaggtactttactatcttctatgctctccagtaccataacattatgacagttaagcgggttgggatcatcataagttgtatctgggcagcttgcacggtttcaggcattttgttcatcatttactcagatagtagtgctgtcatcatctgcctcatcaccatgttcttcaccatgctggctctcatggcttctctctatgtccacatgttcctgatggccaggcttcacattaagaggattgctgtcctccccggcactggtgccatccgccaaggtgccaatatgaagggagcgattaccttgaccatcctgattggcgtctttgttgtctgctgggccccattcttcctccacttaatattctacatctcttgtcctcagaatccatattgtgtgtgcttcatgtctcactttaacttgtatctcatactgatcatgtgtaattcaatcatcgatcctctgatttatgcactccggagtcaagaactgaggaaaaccttcaaagagatcatctgttgctatcccctgggaggcctttgtgacttgtctagcagatattaa

SEQ ID NO: 34289 - DNA, 929 bp, Homo sapiens
agctggtacatccatcaccactgacgggcctggcctggaaacctggtttgtcccctgtcttgatggcctacgagaggccaagttccactgggctgggaaaagtcactttgtctgtcttgttcacctggagcctgacacaccgtaggtactgagtacaaatagcttgatttggctaggcttggctgcagggggacgtgcctaaaagacattccgggcatttgcacttgggaaacttgcctcaccttcaggcttgtggggcctctctatgcccagtgagtccaggcagtcctagcaagtactcaggagagcaggggtgggtgtgacagaggctggctctggattgggggacaacagaaccagagtaactcctcgcctgttgctgctttgcaatgaatttcctttacctttctggaacacaagctgctgtgaaccaaactgatatcaagtgattagctcaccgggccttggttgcttttcaaagatccccttcagccccctgccagagtcactgccccataatcaccatgtcagaagggaccctagggcattcgtgtcctatttatcaatcttcagcaccacctctaagatctctgagagagggtggatcagcctctgtgtaaacaaaaagctgttaggacttgttgcctctcaaggtggactattctgttttctgccaggacactgccattcatgcattgtcagatatttattaaacagcagcaaagtgccagccaatttgtcctggaggaattcatagcctcatggggcaaaagtaaataaacagcttattacaattcaaaaaaaaaaagggggggctctaaattcccgggggccaaattacgtccccgtttgtaaagggccaaggggttaaaaagacgcgcgtaacacgatgggacggcctggttgggacccttggggatggcacccca

SEQ ID NO: 34290 - DNA, 3373 bp, Homo sapiens
tgggggaggacgaggggcgcgtggttttcccatctcatccctggaggaggggctggagcatccccggcagccaatcagggacaggctgggggggggaccgctttgaagaagtttgggggaaaaaagtttggaaaagtttctataataacgagggggcttctggagggaggcggcagcgacggaggagggggcttctcagagaaagggagggagggagccacccgggtgaagatacagcagcctcctgaactcccccctcccacccaggccgggacctgggggctcctgccggatccatgggggcggccagctgcgaggatgaggagctggaatttaagctggtgttcggggaggaaaaggaggcccccccgctgggcgcggggggattgggggaagaactggactcagaggatgccccgccatgctgccgtctggccttgggagagccccctccctatggcgctgcacctatcggtattccccgacctccaccccctcggcctggcatgcattcgccaccgccgcgaccagccccctcacctggcacctgggagagccagcccgccaggtcggtgaggctgggaggaccaggagggggtgctgggggtgctgggggtggccgtgttctcgagtgtcccagcatccgcatcacctccatctctcccacgccggagccgccagcagcgctggaggacaaccctgatgcctggggggacggctctcctagagattaccccccaccagaaggctttgggggctacagagaagcaggggcccagggtgggggggccttcttcagcccaagccctggcagcagcagcctgtcctcgtggagcttcttctccgatgcctctgacgaggcagccctgtatgcagcctgcgacgaggtggagtctgagctaaatgaggcggcctcccgctttggcctgggctccccgctgccctcgccccgggcctcccctcggccatggacccccgaagatccctggagcctgtatggtccaagccccggaggccgagggccagaggatagctggctactcctcagtgctcctgggcccaccccagcctccccgcggcctgcctctccatgtggcaagcggcgctattccagctcgggaaccccatcttcagcctccccagctctgtcccgccgtggcagcctgggggaagaggggtctgagccacctccaccacccccattgcctctggcccgggacccgggctcccctggtccctttgactatgtgggggccccaccagctgagagcatccctcagaagacacggcggacttccagcgagcaggcagtggctctgcctcggtctgaggagcctgcctcatgcaatgggaagctgcccttgggagcagaggagtctgtggctcctccaggaggttcccggaaggaggtggctggcatggactacctggcagtgccctccccactcgcttggtccaaggcccggattgggggacacagccctatcttcaggacctctgccctacccccactggactggcctctgcccagccaatatgagcagctggagctgaggatcgaggtacagcctagagcccaccaccgggcccactatgagacagaaggcagccgtggagctgtcaaagctgcccctggcggtcaccccgtagtcaagctcctaggctacagtgagaagccactgaccctacagatgttcatcggcactgcagatgaaaggaacctgcggcctcatgccttctatcaggtgcaccgtatcacaggcaagatggtggccacggccagctatgaagccgtagtcagtggcaccaaggtgttggagatgactctgctgcctgagaacaacatggcggccaacattgactgcgcgggaatcctgaagcttcggaattcagacattgagcttcggaagggtgagacggacatcgggcgcaaaaacacacgtgtacggctggtgttccgggtacacgtgccccagggcggcgggaaggtcgtctcagtacaggcagcatcggtgcccatcgagtgctcccagcgctcagcccaggagctgccccaggtggaggcctacagccccagtgcctgctctgtgagaggaggcgaggaactggtactgaccggctccaacttcctgccagactccaaggtggtgttcattgagaggggtcctgatgggaagctgcaatgggaggaggaggccacagtgaaccgactgcagagcaacgaggtgacgctgaccctgactgtccccgagtacagcaacaagagggtttcccggccagtccaggtctacttttatgtctccaatgggcggaggaaacgcagtcctacccagagtttcaggtttctgcctgtgatctgcaaagaggagcccctaccggactcatctctgcggggtttcccttcagcatcggcaaccccctttggcactgacatggacttctcaccacccaggcccccctacccctcctatccccatgaagaccctgcttgcgaaactccttacctatcagaaggcttcggctatggcatgccccctctgtacccccagacggggcccccaccatcctacagaccgggcctgcggatgttccctgagactaggggtaccacaggttgtgcccaaccacctgcagtttccttccttccccgccccttccctagtgacccgtatggagggcggggctcctctttccccctggggctgccattctctccgccagccccctttcggccgcctcctcttcctgcatccccaccgcttgaaggccccttcccttcccagagtgatgtgcatcccctacctgctgagggatacaataaggtagggccaggctatggccctggggagggggctccggagcaggagaaatccaggggtggctacagcagcggcttccgagacagtgtccctatccagggtatcacgctggaggaagtgagtgagatcattggccgagacctgagtggcttccctgcacctcctggagaagagcctcctgcctgaaccacgtgaactgtcatcacctggcaaccccagccccagcctcagccctgccccctttccctccttcctggagtggtggctacagaagcttggggccaaccctggctcctctttccccagcttctgtctgtctcactgtcttccctcccctcccccagctgaggtgtggccctcaggcctggtgctgccttggagggctgggggaaggagtgtgtggaggagggaggagggtgaagactgaggctaggtgccagaatggactggagtgaaggcgtgtctagagtgtgggctggctgttgtgctggaaagctggggacaggttgatggtaataaactgctcaatgaccagtgaaaaaaaaaaccagagc

SEQ ID NO: 34291 - DNA, 3056 bp, Homo sapiens
ggccacggttgcgatggcaactggggctcctgccagcgccgtttgggggtttgggaaccgctgctaattgggttcatgtaactggactcagaggatgccccgccatgctgccgtctggccttgggagagccccctccctatggcgctgcacctatcggtattccccgacctccaccccctcggcctggcatgcattcgccaccgccgcgaccagccccctcacctggcacctgggagagccagcccgccaggtcggtgaggctgggaggaccaggagggggtgctgggggtgctgggggtggccgtgttctcgagtgtcccagcatccgcatcacctccatctctcccacgccggagccgccagcagcgctggaggacaaccctgatgcctggggggacggctctcctagagattaccccccaccagaaggctttgggggctacagagaagcaggggcccagggtgggggggccttcttcagcccaagccctggcagcagcagcctgtcctcgtggagcttcttctccgatgcctctgacgaggcagccctgtatgcagcctgcgacgaggtggagtctgagctaaatgaggcggcctcccgctttggcctgggctccccgctgccctcgccccgggcctcccctcggccatggacccccgaagatccctggagcctgtatggtccaagccccggaggccgagggccagaggatagctggctactcctcagtgctcctgggcccaccccagcctccccgcggcctgcctctccatgtggcaagcggcgctattccagctcgggaaccccatcttcagcctccccagctctgtcccgccgtggcagcctgggggaagaggggtctgagccacctccaccacccccattgcctctggcccgggacccgggctcccctggtccctttgactatgtgggggccccaccagctgagagcatccctcagaagacacggcggacttccagcgagcaggcagtggctctgcctcggtctgaggagcctgcctcatgcaatgggaagctgcccttgggagcagaggagtctgtggctcctccaggaggttcccggaaggaggtggctggcatggactacctggcagtgccctccccactcgcttggtccaaggcccggattgggggacacagccctatcttcaggacctctgccctacccccactggactggcctctgcccagccaatatgagcagctggagctgaggatcgaggtacagcctagagcccaccaccgggcccactatgagacagaaggcagccgtggagctgtcaaagctgcccctggcggtcaccccgtagtcaagctcctaggctacagtgagaagccactgaccctacagatgttcatcggcactgcagatgaaaggaacctgcggcctcatgccttctatcaggtgcaccgtatcacaggcaagatggtggccacggccagctatgaagccgtagtcagtggcaccaaggtgttggagatgactctgctgcctgagaacaacatggcggccaacattgactgcgcgggaatcctgaagcttcggaattcagacattgagcttcggaagggtgagacggacatcgggcgcaaaaacacacgtgtacggctggtgttccgggtacacgtgccccagggcggcgggaaggtcgtctcagtacaggcagcatcggtgcccatcgagtgctcccagcgctcagcccaggagctgccccaggtggaggcctacagccccagtgcctgctctgtgagaggaggcgaggaactggtactgaccggctccaacttcctgccagactccaaggtggtgttcattgagaggggtcctgatgggaagctgcaatgggaggaggaggccacagtgaaccgactgcagagcaacgaggtgacgctgaccctgactgtccccgagtacagcaacaagagggtttcccggccagtccaggtctacttttatgtctccaatgggcggaggaaacgcagtcctacccagagtttcaggtttctgcctgtgatctgcaaagaggagcccctaccggactcatctctgcggggtttcccttcagcatcggcaaccccctttggcactgacatggacttctcaccacccaggcccccctacccctcctatccccatgaagaccctgcttgcgaaactccttacctatcagaaggcttcggctatggcatgccccctctgtacccccagacggggcccccaccatcctacagaccgggcctgcggatgttccctgagactaggggtaccacaggttgtgcccaaccacctgcagtttccttccttccccgccccttccctagtgacccgtatggagggcggggctcctctttccccctggggctgccattctctccgccagccccctttcggccgcctcctcttcctgcatccccaccgcttgaaggccccttcccttcccagagtgatgtgcatcccctacctgctgagggatacaataaggtagggccaggctatggccctggggagggggctccggagcaggagaaatccaggggtggctacagcagcggcttccgagacagtgtccctatccagggtatcacgctggaggaagtgagtgagatcattggccgagacctgagtggcttccctgcacctcctggagaagagcctcctgcctgaaccacgtgaactgtcatcacctggcaaccccagccccagcctcagccctgccccctttccctccttcctggagtggtggctacagaagcttggggccaaccctggctcctctttccccagcttctgtctgtctcactgtcttccctcccctcccccagctgaggtgtggccctcaggcctggtgctgccttggagggctgggggaaggagtgtgtggaggagggaggagggtgaagactgaggctaggtgccagaatggactggagtgaaggcgtgtctagagtgtgggctggctgttgtgctggaaagctggggacaggttgatggtaataaactgctcaatgaccagtgaaaaaaaaaaccagagc

SEQ ID NO: 34292 - DNA, 4132 bp, Homo sapiens
tgggggaggacgaggggcgcgtggttttcccatctcatccctggaggaggggctggagcatccccggcagccaatcagggacaggctgggggggggaccgctttgaagaagtttgggggaaaaaagtttggaaaagtttctataataacgagggggcttctggagggaggcggcagcgacggaggagggggcttctcagagaaagggagggagggagccacccgggtgaagatacagcagcctcctgaactcccccctcccacccaggccgggacctgggggctcctgccggatccatgggggcggccagctgcgaggatgaggagctggaatttaagctggtgttcggggaggaaaaggaggcccccccgctgggcgcggggggattgggggaagaactggactcagaggatgccccgccatgctgccgtctggccttgggagagccccctccctatggcgctgcacctatcggtattccccgacctccaccccctcggcctggcatgcattcgccaccgccgcgaccagccccctcacctggcacctgggagagccagcccgccaggtcggtgaggctgggaggaccaggagggggtgctgggggtgctgggggtggccgtgttctcgagtgtcccagcatccgcatcacctccatctctcccacgccggagccgccagcagcgctggaggacaaccctgatgcctggggggacggctctcctagagattaccccccaccagaaggctttgggggctacagagaagcaggggcccagggtgggggggccttcttcagcccaagccctggcagcagcagcctgtcctcgtggagcttcttctccgatgcctctgacgaggcagccctgtatgcagcctgcgacgaggtggagtctgagctaaatgaggcggcctcccgctttggcctgggctccccgctgccctcgccccgggcctcccctcggccatggacccccgaagatccctggagcctgtatggtccaagccccggaggccgagggccagaggatagctggctactcctcagtgctcctgggcccaccccagcctccccgcggcctgcctctccatgtggcaagcggcgctattccagctcgggaaccccatcttcagcctccccagctctgtcccgccgtggcagcctgggggaagaggggtctgagccacctccaccacccccattgcctctggcccgggacccgggctcccctggtccctttgactatgtgggggccccaccagctgagagcatccctcagaagacacggcggacttccagcgagcaggcagtggctctgcctcggtctgaggagcctgcctcatgcaatgggaagctgcccttgggagcagaggagtctgtggctcctccaggaggttcccggaaggaggtggctggcatggactacctggcagtgccctccccactcgcttggtccaaggcccggattgggggacacagccctatcttcaggacctctgccctacccccactggactggcctctgcccagccaatatgagcagctggagctgaggatcgaggtacagcctagagcccaccaccgggcccactatgagacagaaggcagccgtggagctgtcaaagctgcccctggcggtcaccccgtagtcaagctcctaggctacagtgagaagccactgaccctacagatgttcatcggcactgcagatgaaaggaacctgcggcctcatgccttctatcaggtgcaccgtatcacaggcaagatggtggccacggccagctatgaagccgtagtcagtggcaccaaggtgttggagatgactctgctgcctgagaacaacatggcggccaacattgactgcgcgggaatcctgaagcttcggaattcagacattgagcttcggaagggtgagacggacatcgggcgcaaaaacacacgtgtacggctggtgttccgggtacacgtgccccagggcggcgggaaggtcgtctcagtacaggcagcatcggtgcccatcgagtgctcccagcgctcagcccaggagctgccccaggtggaggcctacagccccagtgcctgctctgtgagaggaggcgaggaactggtactgaccggctccaacttcctgccagactccaaggtggtgttcattgagaggggtcctgatgggaagctgcaatgggaggaggaggccacagtgaaccgactgcagagcaacgaggtgacgctgaccctgactgtccccgagtacagcaacaagagggtttcccggccagtccaggtctacttttatgtctccaatgggcggaggaaacgcagtcctacccagagtttcaggtttctgcctgtgatctgcaaagaggagcccctaccggactcatctctgcggggtttcccttcagcatcggcaaccccctttggcactgacatggacttctcaccacccaggcccccctacccctcctatccccatgaagaccctgcttgcgaaactccttacctatcagaaggcttcggctatggcatgccccctctgtacccccagacggggcccccaccatcctacagaccgggcctgcggatgttccctgagactaggggtaccacaggttgtgcccaaccacctgcagtttccttccttccccgccccttccctagtgacccgtatggagggcggggctcctctttccccctggggctgccattctctccgccagccccctttcggccgcctcctcttcctgcatccccaccgcttgaaggccccttcccttcccagagtgatgtgcatcccctacctgctgagggatacaataaggtagggccaggctatggccctggggagggggctccggagcaggagaaatccaggggtggctacagcagcggcttccgagacagtgtccctatccagggtatcacgctggaggaaggtgggtgtgggactgggggctgtgagtgtgagtgtgtgcaagagattgctctgcatgtttgctgagggctggagctgggcttttcagagatcgggcatccctggtctctcagggccagttggaggttcccaggaggcatgttcttgatgcctgtggctgcctgaatccaattaactgaattctgaagagtgcatggggtaactgtctcagcctttctcctgtctctgcctctgtcctctgctccaaatcataaaatctcagagctagaagcactttcaagatcattccatccagcgcattcaatttgcaagtttaggcgttgagttccagagagggatggtagcttgctgaggtcccagtcaagcacacttgccattgcctcagctttcccctaaacacggtgtctgtggtcagggttggtgaggaggagctttcctgttttgcctctccttcttcccattggctacacccatctctggccctgctgataccgattcccctgacatttcaggctaagccagcaggaaagggctaggacgggtgcctgggagcccacatggagggagttgggcaagatttgattcggagcaggtgtcaagacgtgttggggaaactgaggcccagtggaatagaagccagtagaggaggaatctagaggcctcctagattaaggcctgcctggaatggattgggggtgggtctttggaaaaggaggggacccacctctagcccagtctctcaactgcccctcctttacagtgagtgagatcattggccgagacctgagtggcttccctgcacctcctggagaagagcctcctgcctgaaccacgtgaactgtcatcacctggcaaccccagccccagcctcagccctgccccctttccctccttcctggagtggtggctacagaagcttggggccaaccctggctcctctttccccagcttctgtctgtctcactgtcttccctcccctcccccagctgaggtgtggccctcaggcctggtgctgccttggagggctgggggaaggagtgtgtggaggagggaggagggtgaagactgaggctaggtgccagaatggactggagtgaaggcgtgtctagagtgtgggctggctgttgtgctggaaagctggggacaggttgatggtaataaactgctcaatgaccagtgaaaaaaaaaaccagagc

SEQ ID NO: 34293 - DNA, 3473 bp, Homo sapiens
tgggggaggacgaggggcgcgtggttttcccatctcatccctggaggaggggctggagcatccccggcagccaatcagggacaggctgggggggggaccgctttgaagaagtttgggggaaaaaagtttggaaaagtttctataataacgagggggcttctggagggaggcggcagcgacggaggagggggcttctcagagaaagggagggagggagccacccgggtgaagatacagcagcctcctgaactcccccctcccacccaggccgggacctgggggctcctgccggatccatgggggcggccagctgcgaggatgaggagctggagcctgtatggtccaagccccggaggccgagggccagaggatagctggctactcctcagtgctcctgggcccaccccagcctccccgcggcctgcctctccatgtggcaagcggcgctattccagctcgggaaccccatcttcagcctccccagctctgtcccgccgtggcagcctgggggaagaggggtctgagccacctccaccacccccattgcctctggcccgggacccgggctcccctggtccctttgactatgtgggggccccaccagctgagagcatccctcagaagacacggcggacttccagcgagcaggcagtggctctgcctcggtctgaggagcctgcctcatgcaatgggaagctgcccttgggagcagaggagtctgtggctcctccaggaggttcccggaaggaggtggctggcatggactacctggcagtgccctccccactcgcttggtccaaggcccggattgggggacacagccctatcttcaggacctctgccctacccccactggactggcctctgcccagccaatatgagcagctggagctgaggatcgaggtacagcctagagcccaccaccgggcccactatgagacagaaggcagccgtggagctgtcaaagctgcccctggcggtcaccccgtagtcaagctcctaggctacagtgagaagccactgaccctacagatgttcatcggcactgcagatgaaaggaacctgcggcctcatgccttctatcaggtgcaccgtatcacaggcaagatggtggccacggccagctatgaagccgtagtcagtggcaccaaggtgttggagatgactctgctgcctgagaacaacatggcggccaacattgactgcgcgggaatcctgaagcttcggaattcagacattgagcttcggaagggtgagacggacatcgggcgcaaaaacacacgtgtacggctggtgttccgggtacacgtgccccagggcggcgggaaggtcgtctcagtacaggcagcatcggtgcccatcgagtgctcccagcgctcagcccaggagctgccccaggtggaggcctacagccccagtgcctgctctgtgagaggaggcgaggaactggtactgaccggctccaacttcctgccagactccaaggtggtgttcattgagaggggtcctgatgggaagctgcaatgggaggaggaggccacagtgaaccgactgcagagcaacgaggtgacgctgaccctgactgtccccgagtacagcaacaagagggtttcccggccagtccaggtctacttttatgtctccaatgggcggaggaaacgcagtcctacccagagtttcaggtttctgcctgtgatctgcaaagaggagcccctaccggactcatctctgcggggtttcccttcagcatcggcaaccccctttggcactgacatggacttctcaccacccaggcccccctacccctcctatccccatgaagaccctgcttgcgaaactccttacctatcagaaggcttcggctatggcatgccccctctgtacccccagacggggcccccaccatcctacagaccgggcctgcggatgttccctgagactaggggtaccacaggttgtgcccaaccacctgcagtttccttccttccccgccccttccctagtgacccgtatggagggcggggctcctctttccccctggggctgccattctctccgccagccccctttcggccgcctcctcttcctgcatccccaccgcttgaaggccccttcccttcccagagtgatgtgcatcccctacctgctgagggatacaataaggtagggccaggctatggccctggggagggggctccggagcaggagaaatccaggggtggctacagcagcggcttccgagacagtgtccctatccagggtatcacgctggaggaaggtgggtgtgggactgggggctgtgagtgtgagtgtgtgcaagagattgctctgcatgtttgctgagggctggagctgggcttttcagagatcgggcatccctggtctctcagggccagttggaggttcccaggaggcatgttcttgatgcctgtggctgcctgaatccaattaactgaattctgaagagtgcatggggtaactgtctcagcctttctcctgtctctgcctctgtcctctgctccaaatcataaaatctcagagctagaagcactttcaagatcattccatccagcgcattcaatttgcaagtttaggcgttgagttccagagagggatggtagcttgctgaggtcccagtcaagcacacttgccattgcctcagctttcccctaaacacggtgtctgtggtcagggttggtgaggaggagctttcctgttttgcctctccttcttcccattggctacacccatctctggccctgctgataccgattcccctgacatttcaggctaagccagcaggaaagggctaggacgggtgcctgggagcccacatggagggagttgggcaagatttgattcggagcaggtgtcaagacgtgttggggaaactgaggcccagtggaatagaagccagtagaggaggaatctagaggcctcctagattaaggcctgcctggaatggattgggggtgggtctttggaaaaggaggggacccacctctagcccagtctctcaactgcccctcctttacagtgagtgagatcattggccgagacctgagtggcttccctgcacctcctggagaagagcctcctgcctgaaccacgtgaactgtcatcacctggcaaccccagccccagcctcagccctgccccctttccctccttcctggagtggtggctacagaagcttggggccaaccctggctcctctttccccagcttctgtctgtctcactgtcttccctcccctcccccagctgaggtgtggccctcaggcctggtgctgccttggagggctgggggaaggagtgtgtggaggagggaggagggtgaagactgaggctaggtgccagaatggactggagtgaaggcgtgtctagagtgtgggctggctgttgtgctggaaagctggggacaggttgatggtaataaactgctcaatgaccagtgaaaaaaaaaaccagagc

SEQ ID NO: 34294 - DNA, 2531 bp, Homo sapiens
aaaggatgagacggtggggatttcaatgaggtggccgctctctccctctgccagctcctaggctacagtgagaagccactgaccctacagatgttcatcggcactgcagatgaaaggaacctgcggcctcatgccttctatcaggtgcaccgtatcacaggcaagatggtggccacggccagctatgaagccgtagtcagtggcaccaaggtgttggagatgactctgctgcctgagaacaacatggcggccaacattgactgcgcgggaatcctgaagcttcggaattcagacattgagcttcggaagggtgagacggacatcgggcgcaaaaacacacgtgtacggctggtgttccgggtacacgtgccccagggcggcgggaaggtcgtctcagtacaggcagcatcggtgcccatcgagtgctcccagcgctcagcccaggagctgccccaggtggaggcctacagccccagtgcctgctctgtgagaggaggcgaggaactggtactgaccggctccaacttcctgccagactccaaggtggtgttcattgagaggggtcctgatgggaagctgcaatgggaggaggaggccacagtgaaccgactgcagagcaacgaggtgacgctgaccctgactgtccccgagtacagcaacaagagggtttcccggccagtccaggtctacttttatgtctccaatgggcggaggaaacgcagtcctacccagagtttcaggtttctgcctgtgatctgcaaagaggagcccctaccggactcatctctgcggggtttcccttcagcatcggcaaccccctttggcactgacatggacttctcaccacccaggcccccctacccctcctatccccatgaagaccctgcttgcgaaactccttacctatcagaaggcttcggctatggcatgccccctctgtacccccagacggggcccccaccatcctacagaccgggcctgcggatgttccctgagactaggggtaccacaggttgtgcccaaccacctgcagtttccttccttccccgccccttccctagtgacccgtatggagggcggggctcctctttccccctggggctgccattctctccgccagccccctttcggccgcctcctcttcctgcatccccaccgcttgaaggccccttcccttcccagagtgatgtgcatcccctacctgctgagggatacaataaggtagggccaggctatggccctggggagggggctccggagcaggagaaatccaggggtggctacagcagcggcttccgagacagtgtccctatccagggtatcacgctggaggaaggtgggtgtgggactgggggctgtgagtgtgagtgtgtgcaagagattgctctgcatgtttgctgagggctggagctgggcttttcagagatcgggcatccctggtctctcagggccagttggaggttcccaggaggcatgttcttgatgcctgtggctgcctgaatccaattaactgaattctgaagagtgcatggggtaactgtctcagcctttctcctgtctctgcctctgtcctctgctccaaatcataaaatctcagagctagaagcactttcaagatcattccatccagcgcattcaatttgcaagtttaggcgttgagttccagagagggatggtagcttgctgaggtcccagtcaagcacacttgccattgcctcagctttcccctaaacacggtgtctgtggtcagggttggtgaggaggagctttcctgttttgcctctccttcttcccattggctacacccatctctggccctgctgataccgattcccctgacatttcaggctaagccagcaggaaagggctaggacgggtgcctgggagcccacatggagggagttgggcaagatttgattcggagcaggtgtcaagacgtgttggggaaactgaggcccagtggaatagaagccagtagaggaggaatctagaggcctcctagattaaggcctgcctggaatggattgggggtgggtctttggaaaaggaggggacccacctctagcccagtctctcaactgcccctcctttacagtgagtgagatcattggccgagacctgagtggcttccctgcacctcctggagaagagcctcctgcctgaaccacgtgaactgtcatcacctggcaaccccagccccagcctcagccctgccccctttccctccttcctggagtggtggctacagaagcttggggccaaccctggctcctctttccccagcttctgtctgtctcactgtcttccctcccctcccccagctgaggtgtggccctcaggcctggtgctgccttggagggctgggggaaggagtgtgtggaggagggaggagggtgaagactgaggctaggtgccagaatggactggagtgaaggcgtgtctagagtgtgggctggctgttgtgctggaaagctggggacaggttgatggtaataaactgctcaatgaccagtgaaaaaaaaaaccagagc

SEQ ID NO: 34295 - DNA, 2307 bp, Homo sapiens
ctgtttaaccctctctctgctctgggagcggccccttacatggtgtatgtgactccatggatattactggtttatttgtgtgtctactgctgaggagggctccctcagagccctgtggcagttttcccaaagagggtggggacagaggaggccacccctccatgcccagcccagccagtcctcttccttgcactgctctgcagcccagcgctcagcccaggagctgccccaggtggaggcctacagccccagtgcctgctctgtgagaggaggcgaggaactggtactgaccggctccaacttcctgccagactccaaggtggtgttcattgagaggggtcctgatgggaagctgcaatgggaggaggaggccacagtgaaccgactgcagagcaacgaggtgacgctgaccctgactgtccccgagtacagcaacaagagggtttcccggccagtccaggtctacttttatgtctccaatgggcggaggaaacgcagtcctacccagagtttcaggtttctgcctgtgatctgcaaagaggagcccctaccggactcatctctgcggggtttcccttcagcatcggcaaccccctttggcactgacatggacttctcaccacccaggcccccctacccctcctatccccatgaagaccctgcttgcgaaactccttacctatcagaaggcttcggctatggcatgccccctctgtacccccagacggggcccccaccatcctacagaccgggcctgcggatgttccctgagactaggggtaccacaggttgtgcccaaccacctgcagtttccttccttccccgccccttccctagtgacccgtatggagggcggggctcctctttccccctggggctgccattctctccgccagccccctttcggccgcctcctcttcctgcatccccaccgcttgaaggccccttcccttcccagagtgatgtgcatcccctacctgctgagggatacaataaggtagggccaggctatggccctggggagggggctccggagcaggagaaatccaggggtggctacagcagcggcttccgagacagtgtccctatccagggtatcacgctggaggaaggtgggtgtgggactgggggctgtgagtgtgagtgtgtgcaagagattgctctgcatgtttgctgagggctggagctgggcttttcagagatcgggcatccctggtctctcagggccagttggaggttcccaggaggcatgttcttgatgcctgtggctgcctgaatccaattaactgaattctgaagagtgcatggggtaactgtctcagcctttctcctgtctctgcctctgtcctctgctccaaatcataaaatctcagagctagaagcactttcaagatcattccatccagcgcattcaatttgcaagtttaggcgttgagttccagagagggatggtagcttgctgaggtcccagtcaagcacacttgccattgcctcagctttcccctaaacacggtgtctgtggtcagggttggtgaggaggagctttcctgttttgcctctccttcttcccattggctacacccatctctggccctgctgataccgattcccctgacatttcaggctaagccagcaggaaagggctaggacgggtgcctgggagcccacatggagggagttgggcaagatttgattcggagcaggtgtcaagacgtgttggggaaactgaggcccagtggaatagaagccagtagaggaggaatctagaggcctcctagattaaggcctgcctggaatggattgggggtgggtctttggaaaaggaggggacccacctctagcccagtctctcaactgcccctcctttacagtgagtgagatcattggccgagacctgagtggcttccctgcacctcctggagaagagcctcctgcctgaaccacgtgaactgtcatcacctggcaaccccagccccagcctcagccctgccccctttccctccttcctggagtggtggctacagaagcttggggccaaccctggctcctctttccccagcttctgtctgtctcactgtcttccctcccctcccccagctgaggtgtggccctcaggcctggtgctgccttggagggctgggggaaggagtgtgtggaggagggaggagggtgaagactgaggctaggtgccagaatggactggagtgaaggcgtgtctagagtgtgggctggctgttgtgctggaaagctggggacaggttgatggtaataaactgctcaatgaccagtgaaaaaaaaaaccagagc

SEQ ID NO: 34296 - DNA, 3040 bp, Homo sapiens
tgggggaggacgaggggcgcgtggttttcccatctcatccctggaggaggggctggagcatccccggcagccaatcagggacaggctgggggggggaccgctttgaagaagtttgggggaaaaaagtttggaaaagtttctataataacgagggggcttctggagggaggcggcagcgacggaggagggggcttctcagagaaagggagggagggagccacccgggtgaagatacagcagcctcctgaactcccccctcccacccaggccgggacctgggggctcctgccggatccatgggggcggccagctgcgaggatgaggagctggaatttaagctggtgttcggggaggaaaaggaggcccccccgctgggcgcggggggattgggggaagaactggactcagaggatgccccgccatgctgccgtctggccttgggagagccccctccctatggcgctgcacctatcggtattccccgacctccaccccctcggcctggcatgcattcgccaccgccgcgaccagccccctcacctggcacctgggagagccagcccgccaggtcggtgaggctgggaggaccaggagggggtgctgggggtgctgggggtggccgtgttctcgagtgtcccagcatccgcatcacctccatctctcccacgccggagccgccagcagcgctggaggacaaccctgatgcctggggggacggctctcctagagattaccccccaccagaaggctttgggggctacagagaagcaggggcccagggtgggggggccttcttcagcccaagccctggcagcagcagcctgtcctcgtggagcttcttctccgatgcctctgacgaggcagccctgtatgcagcctgcgacgaggtggagtctgagctaaatgaggcggcctcccgctttggcctgggctccccgctgccctcgccccgggcctcccctcggccatggacccccgaagatccctggagcctgtatggtccaagccccggaggccgagggccagaggatagctggctactcctcagtgctcctgggcccaccccagcctccccgcggcctgcctctccatgtggcaagcggcgctattccagctcgggaaccccatcttcagcctccccagctctgtcccgccgtggcagcctgggggaagaggggtctgagccacctccaccacccccattgcctctggcccgggacccgggctcccctggtccctttgactatgtgggggccccaccagctgagagcatccctcagaagacacggcggacttccagcgagcaggcagtggctctgcctcggtctgaggagcctgcctcatgcaatgggaagctgcccttgggagcagaggagtctgtggctcctccaggaggttcccggaaggaggtggctggcatggactacctggcagtgccctccccactcgcttggtccaaggcccggattgggggacacagccctatcttcaggacctctgccctacccccactggactggcctctgcccagccaatatgagcagctggagctgaggatcgaggtacagcctagagcccaccaccgggcccactatgagacagaaggcagccgtggagctgtcaaagctgcccctggcggtcaccccgtagtcaagctcctaggctacagtgagaagccactgaccctacagatgttcatcggcactgcagatgaaaggaacctgcggcctcatgccttctatcaggtgcaccgtatcacaggcaagatggtggccacggccagctatgaagccgtagtcagtggcaccaaggtgttggagatgactctgctgcctgagaacaacatggcggccaacattgactgcgcgggaatcctgaagcttcggaattcagacattgagcttcggaagggtgagacggacatcgggcgcaaaaacacacgtgtacggctggtgttccgggtacacgtgccccagggcggcgggaaggtcgtctcagtacaggcagcatcggtgcccatcgagtgctcccagcgctcagcccaggagctgccccaggtggaggcctacagccccagtgcctgctctgtgagaggaggcgaggaactggtactgaccggctccaacttcctgccagactccaaggtggtgttcattgagaggggtcctgatgggaagctgcaatgggaggaggaggccacagtgaaccgactgcagagcaacgaggtgacgctgaccctgactgtccccgagtacagcaacaagagggtttcccggccagtccaggtctacttttatgtctccaatgggcggaggaaacgcagtcctacccagagtttcaggtttctgcctgtgatctgcaaagaggagcccctaccggactcatctctgcggggtttcccttcagcatcggcaaccccctttggcactgacatggacttctcaccacccaggcccccctacccctcctatccccatgaagaccctgcttgcgaaactccttacctatcagaaggcttcggctatggcatgccccctctgtacccccagacggggcccccaccatcctacagaccgggcctgcggatgttccctgagactagggtgagtgagatcattggccgagacctgagtggcttccctgcacctcctggagaagagcctcctgcctgaaccacgtgaactgtcatcacctggcaaccccagccccagcctcagccctgccccctttccctccttcctggagtggtggctacagaagcttggggccaaccctggctcctctttccccagcttctgtctgtctcactgtcttccctcccctcccccagctgaggtgtggccctcaggcctggtgctgccttggagggctgggggaaggagtgtgtggaggagggaggagggtgaagactgaggctaggtgccagaatggactggagtgaaggcgtgtctagagtgtgggctggctgttgtgctggaaagctggggacaggttgatggtaataaactgctcaatgaccagtgaaaaaaaaaaccagagc

SEQ ID NO: 34297 - DNA, 3862 bp, Homo sapiens
tgggggaggacgaggggcgcgtggttttcccatctcatccctggaggaggggctggagcatccccggcagccaatcagggacaggctgggggggggaccgctttgaagaagtttgggggaaaaaagtttggaaaagtttctataataacgagggggcttctggagggaggcggcagcgacggaggagggggcttctcagagaaagggagggagggagccacccgggtgaagatacagcagcctcctgaactcccccctcccacccaggccgggacctgggggctcctgccggatccatgggggcggccagctgcgaggatgaggagctggaatttaagctggtgttcggggaggaaaaggaggcccccccgctgggcgcggggggattgggggaagaactggactcagaggatgccccgccatgctgccgtctggccttgggagagccccctccctatggcgctgcacctatcggtattccccgacctccaccccctcggcctggcatgcattcgccaccgccgcgaccagccccctcacctggcacctgggagagccagcccgccaggtcggtgaggctgggaggaccaggagggggtgctgggggtgctgggggtggccgtgttctcgagtgtcccagcatccgcatcacctccatctctcccacgccggagccgccagcagcgctggaggacaaccctgatgcctggggggacggctctcctagagattaccccccaccagaaggctttgggggctacagagaagcaggggcccagggtgggggggccttcttcagcccaagccctggcagcagcagcctgtcctcgtggagcttcttctccgatgcctctgacgaggcagccctgtatgcagcctgcgacgaggtggagtctgagctaaatgaggcggcctcccgctttggcctgggctccccgctgccctcgccccgggcctcccctcggccatggacccccgaagatccctggagcctgtatggtccaagccccggaggccgagggccagaggatagctggctactcctcagtgctcctgggcccaccccagcctccccgcggcctgcctctccatgtggcaagcggcgctattccagctcgggaaccccatcttcagcctccccagctctgtcccgccgtggcagcctgggggaagaggggtctgagccacctccaccacccccattgcctctggcccgggacccgggctcccctggtccctttgactatgtgggggccccaccagctgagagcatccctcagaagacacggcggacttccagcgagcaggcagtggctctgcctcggtctgaggagcctgcctcatgcaatgggaagctgcccttgggagcagaggagtctgtggctcctccaggaggttcccggaaggaggtggctggcatggactacctggcagtgccctccccactcgcttggtccaaggcccggattgggggacacagccctatcttcaggacctctgccctacccccactggactggcctctgcccagccaatatgagcagctggagctgaggatcgaggtacagcctagagcccaccaccgggcccactatgagacagaaggcagccgtggagctgtcaaagctgcccctggcggtcaccccgtagtcaagctcctaggctacagtgagaagccactgaccctacagatgttcatcggcactgcagatgaaaggaacctgcggcctcatgccttctatcaggtgcaccgtatcacaggcaagatggtggccacggccagctatgaagccgtagtcagtggcaccaaggtgttggagatgactctgctgcctgagaacaacatggcggccaacattgactgcgcgggaatcctgaagcttcggaattcagacattgagcttcggaagggtgagacggacatcgggcgcaaaaacacacgtgtacggctggtgttccgggtacacgtgccccagggcggcgggaaggtcgtctcagtacaggcagcatcggtgcccatcgagtgctcccagcgctcagcccaggagctgccccaggtggaggcctacagccccagtgcctgctctgtgagaggaggcgaggaactggtactgaccggctccaacttcctgccagactccaaggtggtgttcattgagaggggtcctgatgggaagctgcaatgggaggaggaggccacagtgaaccgactgcagagcaacgaggtgacgctgaccctgactgtccccgagtacagcaacaagagggtttcccggccagtccaggtctacttttatgtctccaatgggcggaggaaacgcagtcctacccagagtttcaggtttctgcctgtgatctgcaaagaggagcccctaccggactcatctctgcggggtttcccttcagcatcggcaaccccctttggcactgacatggacttctcaccacccaggcccccctacccctcctatccccatgaagaccctgcttgcgaaactccttacctatcagaaggcttcggctatggcatgccccctctgtacccccagacggggcccccaccatcctacagaccgggcctgcggatgttccctgagactaggggtaccacaggttgtgcccaaccacctgcagtttccttccttccccgccccttccctagtgacccgtatggagggcggggctcctctttccccctggggctgccattctctccgccagccccctttcggccgcctcctcttcctgcatccccaccgcttgaaggccccttcccttcccagagtgatgtgcatcccctacctgctgagggatacaataaggtagggccaggctatggccctggggagggggctccggagcaggagaaatccaggggtggctacagcagcggcttccgagacagtgtccctatccagggtatcacgctggaggaaggtgggtgtgggactgggggctgtgagtgtgagtgtgtgcaagagattgctctgcatgtttgctgagggctggagctgggcttttcagagatcgggcatccctggtctctcagggccagttggaggttcccaggaggcatgttcttgatgcctgtggctgcctgaatccaattaactgaattctgaagagtgcatggggtaactgtctcagcctttctcctgtctctgcctctgtcctctgctccaaatcataaaatctcagagctagaagcactttcaagatcattccatccagcgcattcaatttgcaagtttaggcgttgagttccagagagggatggtagcttgctgaggtcccagtcaagcacacttgccattgcctcagctttcccctaaacacggtgtctgtggtcagggttggtgaggaggagctttcctgttttgcctctccttcttcccattggctacacccatctctggccctgctgataccgattcccctgacatttcaggctaagccagcaggaaagggctaggacgggtgcctgggagcccacatggagggagttgggcaagatttgattcggagcaggtgtcaagacgtgttggggaaactgaggcccagtggaatagaagccagtagaggaggaatctagaggcctcctagattaaggcctgcctggaatggattgggggtgggtctttggaaaaggaggggacccacctctagcccagtctctcaactgcccctcctttacagtgagtgagatcattggccgagacctgagtggcttccctgcacctcctggagaagagcctcctgcctgaaccacgtgaactgtcatcactggctgttgtgctggaaagctggggacaggttgatggtaataaactgctcaatgaccagtgaaaaaaaaaaccagagc

SEQ ID NO: 34298 - DNA, 2788 bp, Homo sapiens
tgggggaggacgaggggcgcgtggttttcccatctcatccctggaggaggggctggagcatccccggcagccaatcagggacaggctgggggggggaccgctttgaagaagtttgggggaaaaaagtttggaaaagtttctataataacgagggggcttctggagggaggcggcagcgacggaggagggggcttctcagagaaagggagggagggagccacccgggtgaagatacagcagcctcctgaactcccccctcccacccaggccgggacctgggggctcctgccggatccatgggggcggccagctgcgaggatgaggagctggaatttaagctggtgttcggggaggaaaaggaggcccccccgctgggcgcggggggattgggggaagaactggactcagaggatgccccgccatgctgccgtctggccttgggagagccccctccctatggcgctgcacctatcggtattccccgacctccaccccctcggcctggcatgcattcgccaccgccgcgaccagccccctcacctggcacctgggagagccagcccgccaggtcggtgaggctgggaggaccaggagggggtgctgggggtgctgggggtggccgtgttctcgagtgtcccagcatccgcatcacctccatctctcccacgccggagccgccagcagcgctggaggacaaccctgatgcctggggggacggctctcctagagattaccccccaccagaaggctttgggggctacagagaagcaggggcccagggtgggggggccttcttcagcccaagccctggcagcagcagcctgtcctcgtggagcttcttctccgatgcctctgacgaggcagccctgtatgcagcctgcgacgaggtggagtctgagctaaatgaggcggcctcccgctttggcctgggctccccgctgccctcgccccgggcctcccctcggccatggacccccgaagatccctggagcctgtatggtccaagccccggaggccgagggccagaggatagctggctactcctcagtgctcctgggcccaccccagcctccccgcggcctgcctctccatgtggcaagcggcgctattccagctcgggaaccccatcttcagcctccccagctctgtcccgccgtggcagcctgggggaagaggggtctgagccacctccaccacccccattgcctctggcccgggacccgggctcccctggtccctttgactatgtgggggccccaccagctgagagcatccctcagaagacacggcggacttccagcgagcaggcagtggctctgcctcggtctgaggagcctgcctcatgcaatgggaagctgcccttgggagcagaggagtctgtggctcctccaggaggttcccggaaggaggtggctggcatggactacctggcagtgccctccccactcgcttggtccaaggcccggattgggggacacagccctatcttcaggacctctgccctacccccactggactggcctctgcccagccaatatgagcagctggagctgaggatcgaggtacagcctagagcccaccaccgggcccactatgagacagaaggcagccgtggagctgtcaaagctgcccctggcggtcaccccgtagtcaagctcctaggctacagtgagaagccactgaccctacagatgttcatcggcactgcagatgaaaggaacctgcggcctcatgccttctatcaggtgcaccgtatcacaggcaagatggtggccacggccagctatgaagccgtagtcagtggcaccaaggtgttggagatgactctgctgcctgagaacaacatggcggccaacattgactgcgcgggaatcctgaagcttcggaattcagacattgagcttcggaagggtgagacggacatcgggcgcaaaaacacacgtgtacggctggtgttccgggtacacgtgccccagggcggcgggaaggtcgtctcagtacaggcagcatcggtgcccatcgagtgctcccagcgctcagcccaggagctgccccaggtggaggcctacagccccagtgcctgctctgtgagaggaggcgaggaactggtactgaccggctccaacttcctgccagactccaaggtggtgttcattgagaggggtcctgatgggaagctgcaatgggaggaggaggccacagtgaaccgactgcagagcaacgaggtgacgctgaccctgactgtccccgagtacagcaacaagagggtttcccggccagtccaggtctacttttatgtctccaatgggcggaggaaacgcagtcctacccagagtttcaggtttctgcctgtgagtgagatcattggccgagacctgagtggcttccctgcacctcctggagaagagcctcctgcctgaaccacgtgaactgtcatcacctggcaaccccagccccagcctcagccctgccccctttccctccttcctggagtggtggctacagaagcttggggccaaccctggctcctctttccccagcttctgtctgtctcactgtcttccctcccctcccccagctgaggtgtggccctcaggcctggtgctgccttggagggctgggggaaggagtgtgtggaggagggaggagggtgaagactgaggctaggtgccagaatggactggagtgaaggcgtgtctagagtgtgggctggctgttgtgctggaaagctggggacaggttgatggtaataaactgctcaatgaccagtgaaaaaaaaaaccagagc

SEQ ID NO: 34299 - DNA, 2607 bp, Homo sapiens
tgggggaggacgaggggcgcgtggttttcccatctcatccctggaggaggggctggagcatccccggcagccaatcagggacaggctgggggggggaccgctttgaagaagtttgggggaaaaaagtttggaaaagtttctataataacgagggggcttctggagggaggcggcagcgacggaggagggggcttctcagagaaagggagggagggagccacccgggtgaagatacagcagcctcctgaactcccccctcccacccaggccgggacctgggggctcctgccggatccatgggggcggccagctgcgaggatgaggagctggaatttaagctggtgttcggggaggaaaaggaggcccccccgctgggcgcggggggattgggggaagaactggactcagaggatgccccgccatgctgccgtctggccttgggagagccccctccctatggcgctgcacctatcggtattccccgacctccaccccctcggcctggcatgcattcgccaccgccgcgaccagccccctcacctggcacctgggagagccagcccgccaggtcggtgaggctgggaggaccaggagggggtgctgggggtgctgggggtggccgtgttctcgagtgtcccagcatccgcatcacctccatctctcccacgccggagccgccagcagcgctggaggacaaccctgatgcctggggggacggctctcctagagattaccccccaccagaaggctttgggggctacagagaagcaggggcccagggtgggggggccttcttcagcccaagccctggcagcagcagcctgtcctcgtggagcttcttctccgatgcctctgacgaggcagccctgtatgcagcctgcgacgaggtggagtctgagctaaatgaggcggcctcccgctttggcctgggctccccgctgccctcgccccgggcctcccctcggccatggacccccgaagatccctggagcctgtatggtccaagccccggaggccgagggccagaggatagctggctactcctcagtgctcctgggcccaccccagcctccccgcggcctgcctctccatgtggcaagcggcgctattccagctcgggaaccccatcttcagcctccccagctctgtcccgccgtggcagcctgggggaagaggggtctgagccacctccaccacccccattgcctctggcccgggacccgggctcccctggtccctttgactatgtgggggccccaccagctgagagcatccctcagaagacacggcggacttccagcgagcaggcagtggctctgcctcggtctgaggagcctgcctcatgcaatgggaagctgcccttgggagcagaggagtctgtggctcctccaggaggttcccggaaggaggtggctggcatggactacctggcagtgccctccccactcgcttggtccaaggcccggattgggggacacagccctatcttcaggacctctgccctacccccactggactggcctctgcccagccaatatgagcagctggagctgaggatcgaggtacagcctagagcccaccaccgggcccactatgagacagaaggcagccgtggagctgtcaaagctgcccctggcggtcaccccgtagtcaagctcctaggctacagtgagaagccactgaccctacagatgttcatcggcactgcagatgaaaggaacctgcggcctcatgccttctatcaggtgcaccgtatcacaggcaagatggtggccacggccagctatgaagccgtagtcagtggcaccaaggtgttggagatgactctgctgcctgagaacaacatggcggccaacattgactgcgcgggaatcctgaagcttcggaattcagacattgagcttcggaagggtgagacggacatcgggcgcaaaaacacacgtgtacggctggtgttccgggtacacgtgccccagggcggcgggaaggtcgtctcagtacaggcagcatcggtgcccatcgagtgctcccagcgctcagcccaggagctgccccaggtggaggcctacagccccagtgcctgctctgtgagaggaggcgaggaactggtactgaccggctccaacttcctgccagactccaaggtggtgttcattgagaggggtcctgatgggaagctgcaatgggaggaggaggccacagtgaaccgactgcagagcaacgagagcctcctgcctgaaccacgtgaactgtcatcacctggcaaccccagccccagcctcagccctgccccctttccctccttcctggagtggtggctacagaagcttggggccaaccctggctcctctttccccagcttctgtctgtctcactgtcttccctcccctcccccagctgaggtgtggccctcaggcctggtgctgccttggagggctgggggaaggagtgtgtggaggagggaggagggtgaagactgaggctaggtgccagaatggactggagtgaaggcgtgtctagagtgtgggctggctgttgtgctggaaagctggggacaggttgatggtaataaactgctcaatgaccagtgaaaaaaaaaaccagagc

SEQ ID NO: 34300 - DNA, 1662 bp, Homo sapiens
tgggggaggacgaggggcgcgtggttttcccatctcatccctggaggaggggctggagcatccccggcagccaatcagggacaggctgggggggggaccgctttgaagaagtttgggggaaaaaagtttggaaaagtttctataataacgagggggcttctggagggaggcggcagcgacggaggagggggcttctcagagaaagggagggagggagccacccgggtgaagatacagcagcctcctgaactcccccctcccacccaggccgggacctgggggctcctgccggatccatgggggcggccagctgcgaggatgaggagctggaatttaagctggtgttcggggaggaaaaggaggcccccccgctgggcgcggggggattgggggaagaactggactcagaggatgccccgccatgctgccgtctggccttgggagagccccctccctatggcgctgcacctatcggtattccccgacctccaccccctcggcctggcatgcattcgccaccgccgcgaccagccccctcacctggcacctgggagagccagcccgccaggtcggtgaggctgggaggaccaggagggggtgctgggggtgctgggggtggccgtgttctcgagtgtcccagcatccgcatcacctccatctctcccacgccggagccgccagcagcgctggaggacaaccctgatgcctggggggacggctctcctagagattaccccccaccagaaggctttgggggctacagagaagcaggggcccagggtgggggggccttcttcagcccaagccctggcagcagcagcctgtcctcgtggagcttcttctccgatgcctctgacgaggcagccctgtatgcagcctgcgacgaggtggagtctgagctaaatgaggcggcctcccgctttggcctgggctccccgctgccctcgccccgggcctcccctcggccatggacccccgaagatccctggagcctgtatggtccaagccccggaggccgagggccagaggatagctggctactcctcagtgctcctgggcccaccccagcctccccgcggcctgcctctccatgtggcaagcggcgctattccagctcgggaaccccatcttcagcctccccagctctgtcccgccgtggcagcctgggggaagaggggtctgagccacctccaccacccccattgcctctggcccgggacccgggctcccctggtccctttgactatgtgggggccccaccagctgagagcatccctcagaagacacggcggacttccagcgagcaggcagtggctctgcctcggtctgaggagcctgcctcatgcaatgggaagctgcccttgggagcagaggagtctgtggctcctccaggaggttcccggaaggaggtggactgccattcatgcattgtcagatatttattaaacagcagcaaagtgccagccaatttgtcctggaggaattcatagcctcatggggcaaaagtaaataaacagcttattacaattcaaaaaaaaaaagggggggctctaaattcccgggggccaaattacgtccccgtttgtaaagggccaaggggttaaaaagacgcgcgtaacacgatgggacggcctggttgggacccttggggatggcacccca

SEQ ID NO: 34301 - DNA, 590 bp, Homo sapiens
atgaactttgcctttcggccggaaccgccatcttccagtaattcgccaaaatgacgaacacaaagggaaagaggagaggcacccgatatatgttctctaggccttttagaaaacatggagttgttcctttggccacatatatgcgaatctataagaaaggtgatattgtagacatcaagggaatgggtactgttcaaaaaggaatgccccacaagtgttaccatggcaaaactggaagagtctacaatgttacccagcatgctgttggcattgttgtaaacaaacaagttaagggcaagattcttgccaagagaattaatgtgcgtattgagcacattaagcactctaagagccgagatagcttcctgaaacgtgtgaaggaaaatgatcagaaaaagaaagaagccaaagagaaaggtacctgggttcaactaaagcgccagcctgctccacccagagaagcacactttgtgagaaccaatgggaaggagcctgagctgctggaacctattccctatgaattcatggcataataggtgttaaaaaaaaaaataaaggacctctgggctacaaaaaaaaaaaaaaaaaaa

SEQ ID NO: 34302 - DNA, 719 bp, Homo sapiens
  misc_feature (611)..(611): n is a, c, g, or t
  misc_feature (616)..(617): n is a, c, g, or t
  misc_feature (620)..(620): n is a, c, g, or t
  misc_feature (622)..(622): n is a, c, g, or t
atgaactttgcctttcggccggaaccgccatcttccagtaattcgccaaaatgacgaacacaaagggaaagaggagaggcacccgatatatgttctctaggccttttagaaaacatggagttgttcctttggccacatatatgcgaatctataagaaaggtgatattgtagacatcaagggaatgggtactgttcaaaaaggaatgccccacaagtgttaccatggcaaaactggaagagtctacaatgttacccagcatgctgttggcattgttgtaaacaaacaagttaagggcaagattcttgccaagagaattaatgtgcgtattgagcacattaagcactctaagagccgagatagcttcctgaaacgtgtgaaggaaaatgatcagaaaaagaaagaagccaaagagaaaggtacctgggttcaactaaagcgccagcctgctccacccagagaagcacactttgtgagaaccaatgggaaggagcctgagctgctggaacctattccctatgaattcatggcataataggtgttaaaaaaaaaaataaaggacctctgggctacaaaaaaaaaaaaaaaaaaaaaaaaaaaatgttcgggggcnacggnnccngnaaaaggttcaaaccccctcgggggggacgggcccccaggtagggaaccgggccaagcgggcccaaggaaccggaagacacggcgggtcccccgaaaa

SEQ ID NO: 34303 - DNA, 445 bp, Homo sapiens
gccgcctactactactaaattcgcggccgcgtcgacaattgatgtggtaatattaaatagcatttactgtgttataccaagacatatatgtttatagagaggaaacataaagaaagtgcaaggggcatgaatgtacatggcatatatccttgaatgctgagtagtgtggtgtcaccagacaatgggttatgtggggaagactgctgagaggtgccaaagggatttgtatatgaagcaaagcggcttgggggttgggcttcattttacaggcctccaacatataaggcaaaacttattgaatggtaaatgagtatagcaaggatgaattttattgtatgtaaattatacctcagtgaacctgacctttaaaagaaagaaaacaatgaggttgaagaatggattttggaagctaacaattcagaagtgtttggtgactttggcaaaa

SEQ ID NO: 34304 - DNA, 368 bp, Homo sapiens
aaaaaggaaattagaaaagcagcagggtgtttaactgtttagctatattctagctggggtcagcaatcactaggctaataagcagtggacttgtgtcaaaataatttttagatattgaattcagtttgtaaaggagaaaagcttgctttctcgcccttcagaaatgtaattagactgtgtaagtaagtagctgtctttctctaggtattttttctctctagagtaaaacatttagagtcaaaacaagtgagctgttattgttttttttttaagttaggaaacatgatagatatccttaatatggaacaattcagagttcatatgacaccatctttcatttttatcagaactaaaaactgaggttttgt

SEQ ID NO: 34305 - DNA, 1151 bp, Homo sapiens
ttaagtggtctgcccttccactgaaagtgtagctttttgacagtctcagccatataaacaggatctcagtttcatccttccatccatccattagaggcacaaggtctcatctcttttccttttgggcattaaaaccaaagttcatacattattgagacaggccgactctgctaaggcagcctgtttggcctttaagttttattgcttattttttgagtatgtatttatttttttgattattattattttttttttgagctttaagccttcaagtttcctttttattcttgacccctagacatttcctttgcttgtggactcgggtatttgtttttaggtaatattttttttccctatgacacagccctcaggagatcctgagaacatgtgccctcatttttaggtaattttaattaggaagggttttaggttgtctgatctgccttgttgctagaaacagaaattctcctattgattgatttttcaaaccacttcttagtggcctctacaactactccagtcaggtcaagaatggctctcacattgccaagtcagtgggtatttttagtcttcatcttagatgacctttatgcacatttgtctttgtctaggaacttctgttggaaacatcttctattttaatgttattttaaatttttttgcttttgtaacattatgcttagcatgtgtgtccaactctttgacaatttctttttagttttctggtggcttccctttatccaaatttagtattgaaattcctcgagccgctgcttttctcactccataattctggccagaatttggtacttaaaatattttgtctaaaatattacaatagctacttaagtcatctccctgactccactctgttgtctttcagggcgtcgtccacactgtagccaaagtgatcttataaaaacataattctaatcatggcactcttctgcttaaaaatgttttaatggctttccgttaggttaaaatttaaaagtcctttgtagcctgtgagactctacatgagttgactccctagcttcatctttgagcatcttatttctttacttattataccatcagttagagttgattgttatataatccacagaagtgaattctgtccgatttaagcaaaaaaaaaaaaaaaaaaa

SEQ ID NO: 34306 - DNA, 443 bp, Homo sapiens
gacagacatagtactcatcctcagaggagattatgactagagaggattaattagcaaagtaaccaatatctttaagaaatttctttattaaatctcttttgactcatttgttcattcatttggccattcgacaagtgcgtactatgctgacagaggcctgataaactattgacacattttggaaaatgcaaatttactcatgttttaagtctgggagcatgaagtgggagaagtaagagatgaaactgaagagaaaggcataaacaagatcatggtgaccctatgggtcttacaaaagaactgggactttctcttcaggcatcagtaaggcattgaatgcctgaaatggtcagatatttattctagtaaaattactatggaggcaatgtcaagactaaatttgaagggtacaggctacaaacaggaagactacttagtttttg

SEQ ID NO: 34307 - DNA, 286 bp, Homo sapiens
gacattacgtatttagccctagtacacagtcactgagtgatggggtcaggactcaaacccaaatccattggggttctcgtgactgtgttgcgttaccctgggatagagaaagaaaaagaagggcatgcaggccttagaactctactttttgccccctgagatgcatgtgaatggagtttgacaataagtgatttaacaatgataaattacgggcagagctgggaatttcatatggggaactggggttgagaaataataaatccttacctagtcttttcaacaaagt

SEQ ID NO: 34308 - DNA, 724 bp, Homo sapiens
agacatatgggatactataaagccaccacatatttgaatcatttgggtcccagaagacagagaacaaaaggattggaaaactcatctatttttttgttattaaataatagatgaaaacttcccaaatctatcaaatgatttagatatccagaaacaggaggctccaagatccgcaaacatatacaatgcaagaaagtcttctccttggcacattatagtcaaactatctaaagtcaaagacagaattctgaaaaaggcaagagaaaagtgcctagtcagttgtaaagaaaaccttatcaggctaatagtgaatttctcagcagaaaccttacaagccaggaaagaatgatacattcaaagtactgaatgaaaaaaatgctatccaagggatactatatctagcaaaaatattctttgtaactgaaggagaaataaagtcttccccagaaattgcttaagggagtcctaatcctgggagcaaaatgactacatttaccatcatgaaaacttatgaatgtgtaaaacctgctaataaagcaatcacacaaaggaataagggaaagtaattaaatggtacctgtacggaaaaccaccaaaccaaaattagaaaaaataagtgaaaaagaaaggaatgaagagtatataaaaccagaaaacaataacaatataataggaacaaaacctcacatgttaataataatcttgaatgtggaaggattgaatt

SEQ ID NO: 34309 - DNA, 338 bp, Homo sapiens
gtagagaaggggtttcaccatgttggcgaagatgatctcgatctcctgacctagtgatccgcccacctccgcctcccaaagtgctgggattacaggcataagccaccgtgccttgctggaaatttaaggcttttgtatttgtttttaccttctaagttctaggaaatgcttagcatgtattttccaaaacagtgtgtgggcaggtaggaggaagatttaaccacttactattagagctgtggttctaatttgctatcgttactaagtcagaaatatattttatctcttttgttctaaatgcagacccaaaggtttatgttcttttaaaaaaaaaaatt

SEQ ID NO: 34310 - DNA, 1284 bp, Homo sapiens
tttaggaggctgaggtgggaggattgcttgaagccaggagtttgcagcaagcttaggcaacatggctagactctgtctatattaaaaaaaacaaaaggccgcgcgcggtggctcacatctttggatgtgagcactttgggaggccgaggtgggtggatcacgaggtcagaagattgagaccagcctggctaatatggtgaaaccctgtctctactaatgatacaaaaattagctggtcatggtatggtggtgtgtgcctgtagtcccagctactcgggaggctgaggcagaagaatcacttgaacccgggagacggaggttgcagtgagctgagatcgtgctactgcacgtcagcctattcaacagagtgggactctgttttaaaaaaaataaaaaaaaaatagcaccactgcactccagcccacggtgacagagtgagactctgagtcttaaaaaaaaaaaaaaaaaaggaggttgaatacagtattaaggttggattcagggaacagttcgaggctggagacaaacatttgagaatcatgagcttattgatgataaagccatgagactggatgagattatgttgaaagtgagtgtgtgtggagaaaataaggctcctacactgggtcttgaagcactccaatatttaaagatttaactgaaagattaaaggcgatgaggaagtatcagcaggaagattggcatggagagaccactgggataggagaaaaccaagggagtggtgctctggaggcaaaggaagaagatgttttaagttggaaggatggattatctaatgttcaaggagcattgaatttagctatatggagcccactggaggacgtcgataacagtagtttggtagagaaaaagccttacttgagaaagttcaagggagaaaggggaagaggaattacagacaactccttcaagggattttgatacaaaagggagcacagaaatagaatgttcagacggggagaaactgagattaagaaagtttaattttttatttatgtatttttttttaagatggagtctcactctgtcacccaggttggagtgcagtggtgcgatcttggctcactgaaacctccacttctggggttcaactgattcccttgcctcagcctcccgagtagctgggattacaggcatgcaccaccacacctggctaattttttatttttagtagagacgaggtttcaccatgttggtcaggcttgtctcaaactcctgacctcaagtgatctgcctgcctctgcccctcaaagtgctgggatt

SEQ ID NO: 34311 - DNA, 270 bp, Homo sapiens
gtctgtaaaaacaggctatgggccatagtttgctaatccctattttatatcatgatagaagtctagattgtaggggtccttttatcaaaattatagagaaatgatatgggcatttcaacgtgtgtaactgtacctaaaaatacagaattgaaaattaataataaccaccaccaaattagggatgtgagaaatgggtgaaggtatagatgaaaaaatacaggatagtgatgattgttgaaggtgagttttggacacataaatgttatacta

SEQ ID NO: 34312 - DNA, 4400 bp, Homo sapiens
  misc_feature (3406)..(3406): n is a, c, g, or t
attatgttcgtgtgatggatatggggcttttggagttaaccataactgcagtgaagtctgattctgatggagagcaaactgagccccgctttgagttacactgttccagcgatgttgtccatatcagaacgtgctcagactcttgtgctgcgttaatgaatctcattcagtacattgcaagctatggtgacttgcagacacctaacaaggcagatatgaagcctggagcctttcaaagaaggtctaaggtagattccagtggtcgatcatcctcacgtggtccagtacttcctgaagcagatcaacaaatgttacgagatctgatgagtgatgctatggaggagatcgacatgcaacaaggcacctcgtcagtaaaaccacaggctaatggtgttttggatgaaaaatctcaaattcaggagccatgttgttcagacctcttcctgtttcctgacgagagtgggaatgtatcccaggagtccggccccacctatgcctcattctctcaccatttcatcagtgatgcaatgacaggtgtgcccactgagaatgatgacttttgcattctttttgcaccaaaagcagccatgcaggagaaggaagaagaaccagttataaaaatcatggttgatgatgcaattgtgataagagacaattatttcagtctgcccgttaataagaccgatacgagcaaagcccccttacactttcccattcctgtgattcgctatgtggtgaaggaggtctctcttgtctggcatctttatggaggaaaggattttggaacagtccctcccacttctccggctaaaagttatattagtccccacagttcgccttctcacacacccacgagacatggacgtaatacagtatgtgggggaaaaggaaggaaccatgactttttaatggaaatacagctaagcaaggtgaagtttcagcatgaagtctacccgccatgcaaacctgattgtgattccagcctctcagaacacccagtctcccggcaggtgttcattgttcaggatcttgagattcgagatcgtttggcaacatcacaaatgaataaatttttatacctgtattgcagtaaagaaatgcctcgaaaagctcactccaacatgttgacagtgaaagccttacacgtgtgtccagaatctggcaggtccccacaggagtgctgcttgagagtgtcgctgatgccgctccgcctcaatattgaccaggatgctttgttcttcctgaaggatttcttcacaagtctttctgcagaagtagagcttcaaatgactccagatccagaagttaaaaagtctcctggagctgatgtcacctgcagtttgccaaggcatttgagtacctcaaaggagccaaatctggttatttctttctctgggccaaaacagccttcccaaaatgatagtgccaattcagtggaagtggttaatggcatggaagagaagaacttctctgctgaagaagcatcttttagggatcagcctgtgttttttagagaatttagattcacgtcagaagttcccattcgacttgattatcatggcaaacatgtatcaatggatcagggtacgctagctgggattttgattggtctggctcagttaaactgctctgaactaaagctcaagaggctttcctatcgacatggtttactaggcgttgacaaattattctcatatgcaatcactgagtggcttaatgacattaagaagaaccagctaccaggaatcctgggaggtgttggacctatgcattcactagtacaattagtacaaggcctaaaggacttggtctggctcccaatagagcagtaccggaaggatggccgcattgtcagagggtttcagagaggcgctgcttcctttggtacctcgacagcgatggctgctctagaactcacaaacagaatggttcaaaccatacaggcagctgcagagactgcttatgatatggtgtctcctggtaccctttctatcgagcccaagaagaccaaaaggtttcctcatcaccggttagcccaccagccagtagacctgagggaaggtgtggccaaggcctacagtgttgtgaaagagggaatcacagacacggctcagaccatttatgaaactgcggctcgagaacacgagagcagaggggtgactggtgccgtgggcgaggttctgcgccagattcctccggcagtggtgaaacctctgattgttgccacagaagcaacgtcaaacgtgctgggtggcatgagaaaccaaattaggccagatgtccggcaagacgagtcacagaaatggcgccacggggatgactgatggcttggaactgacagtgtgaagataaggagagtggaaccaggagctcagagtcctgacagcagcttcagaggaagctcgtttaattttattgtgctcatctcaggaacaaaagcattttttagttaaataatttaacatcaaaacaacatgcaaccaaaaacttctgacatttatagttgatacttgcctatagaaatgtttggtggctggtgtcaaaggtccttaaagcatttgctgccaagttagtggaaggctcacttttgttaagatgactgtaattctccttgttaccgacgagagatcattggaagctgccttctaacactttgtgtagctctgtggagttggattttcttaaggtttaaaaagaatcacagcttcggaacttttaactgaaaatgagagacagaagccacaggggaagcaaagcaaataggattttcaatataaatatcagtgtggaaaaataacctattctgttgaatttagtgttcatgcacttgagaacaacattatttccatttactccgaaaatccttctgtgggggtttgagaaagtgaatgttgcagacatgttctgttgtgttgcactttatcctgtgtttatgtgtatgtgtttttagattaattcaagttgtgtgctatatttcttgtataatttacaaagttacacaaaatataaagagcagtaaacttgtctgaaagtttttggcaaaggaaggtaacttcaatgtaatagcttcctttaagagtacaggaaaatgcattctgtaatgaagtggggcccatgtaattgtttatattttcagttttaagcaggtatagtgcaggcttgttaggaatgtgtggaagggaagattggaagtgatttttcctcttttaaaagtaaacaaaattcttcaaatatgccctagttaactatttcagcataccatttttacttggttaacagtgtacattttgataacctatcaggaatgaataaagtatttttatttaaaggtgatattgttttatgcttccatgaatattttgcttttcttagagcatattcatagatgcagtactgtgatttaccncaagataattgggaacactttctcaaaatcgattttggttaatatcaggtaaatcattacctaggagtaagagggaaattgttgtcaattcctgactttagattgatccagcagaaagaaaaggtggaactttgtatatatccactgttgaaagttgcatgacctgacttcctgttttctaaagttgggggaatattattgaacttcaatttcagaactgcatttcaatttggggcttggaaaatgtagttaaatcaatttcgttctctaaattttctaagcaggaaagcaatgtaaaccaaaaatcaaaatgtttagaatttataaaaatggggttatatagcttttaattttagtttcctttttactgccaaaaaacttaaaaagacaacagcgtaaccacctgtttaagcaccgtgggaccatctcttattcgggtagagcctggtcctggcgacacactaacaggaaggcgtgctgtgttaccgggaaggcgcctctggctgtggggtgcgttctgaccaccccgctcagatgccagcattttccatttgcccttaaggaaacttgctatgtgtgttaacccagttatgattagtcaaactggaaaacacttgatcaaacttaaaattgtaaaatctgtctaacttttaaatatactttccacagttgtacttaagttcaattaactacagtatagagaaaaataattattctcttctttgcacccggagttgcaaacaaattaagtttacaaatctcatttaaacatatatctttgtaatgtaatctccgcggttctttctttgttctaccctcctgcacctgttgtcgatgtaatcattttgggaacagaaacgttgtgtctcaaaaagattcgttgtcagttcagccaagatgttctttacctgagattctggaaagatgtttatctatatcggaacacttctacattattaaatgtccttaagctttttcttttataaaaaaatct

SEQ ID NO: 34313 - DNA, 3086 bp, Homo sapiens
  misc_feature (2092)..(2092): n is a, c, g, or t
attatgctcatccattcttatgctcatctcatccttatgctcatccctccttatgctcatccctccttatgctcatccctccttatgctcatccctccttatgctcatccctccttatgctcatccctccttatgctcatccctccttatgctcatccctccttatgttcatccctccattatgctcatccctccttagagaatttagattcacgtcagaagttcccattcgacttgattatcatggcaaacatgtatcaatggatcagggtacgctagctgggattttgattggtctggctcagttaaactgctctgaactaaagctcaagaggctttcctatcgacatggtttactaggcgttgacaaattattctcatatgcaatcactgagtggcttaatgacattaagaagaaccagctaccaggaatcctgggaggtgttggacctatgcattcactagtacaattagtacaaggcctaaaggacttggtctggctcccaatagagcagtaccggaaggatggccgcattgtcagagggtttcagagaggcgctgcttcctttggtacctcgacagcgatggctgctctagaactcacaaacagaatggttcaaaccatacaggcagctgcagagactgcttatgatatggtgtctcctggtaccctttctatcgagcccaagaagaccaaaaggtttcctcatcaccggttagcccaccagccagtagacctgagggaaggtgtggccaaggcctacagtgttgtgaaagagggaatcacagacacggctcagaccatttatgaaactgcggctcgagaacacgagagcagaggggtgactggtgccgtgggcgaggttctgcgccagattcctccggcagtggtgaaacctctgattgttgccacagaagcaacgtcaaacgtgctgggtggcatgagaaaccaaattaggccagatgtccggcaagacgagtcacagaaatggcgccacggggatgactgatggcttggaactgacagtgtgaagataaggagagtggaaccaggagctcagagtcctgacagcagcttcagaggaagctcgtttaattttattgtgctcatctcaggaacaaaagcattttttagttaaataatttaacatcaaaacaacatgcaaccaaaaacttctgacatttatagttgatacttgcctatagaaatgtttggtggctggtgtcaaaggtccttaaagcatttgctgccaagttagtggaaggctcacttttgttaagatgactgtaattctccttgttaccgacgagagatcattggaagctgccttctaacactttgtgtagctctgtggagttggattttcttaaggtttaaaaagaatcacagcttcggaacttttaactgaaaatgagagacagaagccacaggggaagcaaagcaaataggattttcaatataaatatcagtgtggaaaaataacctattctgttgaatttagtgttcatgcacttgagaacaacattatttccatttactccgaaaatccttctgtgggggtttgagaaagtgaatgttgcagacatgttctgttgtgttgcactttatcctgtgtttatgtgtatgtgtttttagattaattcaagttgtgtgctatatttcttgtataatttacaaagttacacaaaatataaagagcagtaaacttgtctgaaagtttttggcaaaggaaggtaacttcaatgtaatagcttcctttaagagtacaggaaaatgcattctgtaatgaagtggggcccatgtaattgtttatattttcagttttaagcaggtatagtgcaggcttgttaggaatgtgtggaagggaagattggaagtgatttttcctcttttaaaagtaaacaaaattcttcaaatatgccctagttaactatttcagcataccatttttacttggttaacagtgtacattttgataacctatcaggaatgaataaagtatttttatttaaaggtgatattgttttatgcttccatgaatattttgcttttcttagagcatattcatagatgcagtactgtgatttaccncaagataattgggaacactttctcaaaatcgattttggttaatatcaggtaaatcattacctaggagtaagagggaaattgttgtcaattcctgactttagattgatccagcagaaagaaaaggtggaactttgtatatatccactgttgaaagttgcatgacctgacttcctgttttctaaagttgggggaatattattgaacttcaatttcagaactgcatttcaatttggggcttggaaaatgtagttaaatcaatttcgttctctaaattttctaagcaggaaagcaatgtaaaccaaaaatcaaaatgtttagaatttataaaaatggggttatatagcttttaattttagtttcctttttactgccaaaaaacttaaaaagacaacagcgtaaccacctgtttaagcaccgtgggaccatctcttattcgggtagagcctggtcctggcgacacactaacaggaaggcgtgctgtgttaccgggaaggcgcctctggctgtggggtgcgttctgaccaccccgctcagatgccagcattttccatttgcccttaaggaaacttgctatgtgtgttaacccagttatgattagtcaaactggaaaacacttgatcaaacttaaaattgtaaaatctgtctaacttttaaatatactttccacagttgtacttaagttcaattaactacagtatagagaaaaataattattctcttctttgcacccggagttgcaaacaaattaagtttacaaatctcatttaaacatatatctttgtaatgtaatctccgcggttctttctttgttctaccctcctgcacctgttgtcgatgtaatcattttgggaacagaaacgttgtgtctcaaaaagattcgttgtcagttcagccaagatgttctttacctgagattctggaaagatgtttatctatatcggaacacttctacattattaaatgtccttaagctttttcttttataaaaaaatct

SEQ ID NO: 34314 - DNA, 3446 bp, Homo sapiens
attatgttcgtgtgatggatatggggcttttggagttaaccataactgcagtgaagtctgattctgatggagagcaaactgagccccgctttgagttacactgttccagcgatgttgtccatatcagaacgtgctcagactcttgtgctgcgttaatgaatctcattcagtacattgcaagctatggtgacttgcagacacctaacaaggcagatatgaagcctggagcctttcaaagaaggtctaaggtagattccagtggtcgatcatcctcacgtggtccagtacttcctgaagcagatcaacaaatgttacgagatctgatgagtgatgctatggaggagatcgacatgcaacaaggcacctcgtcagtaaaaccacaggctaatggtgttttggatgaaaaatctcaaattcaggagccatgttgttcagacctcttcctgtttcctgacgagagtgggaatgtatcccaggagtccggccccacctatgcctcattctctcaccatttcatcagtgatgcaatgacaggtgtgcccactgagaatgatgacttttgcattctttttgcaccaaaagcagccatgcaggagaaggaagaagaaccagttataaaaatcatggttgatgatgcaattgtgataagagacaattatttcagtctgcccgttaataagaccgatacgagcaaagcccccttacactttcccattcctgtgattcgctatgtggtgaaggaggtctctcttgtctggcatctttatggaggaaaggattttggaacagtccctcccacttctccggctaaaagttatattagtccccacagttcgccttctcacacacccacgagacatggacgtaatacagtatgtgggggaaaaggaaggaaccatgactttttaatggaaatacagctaagcaaggtgaagtttcagcatgaagtctacccgccatgcaaacctgattgtgattccagcctctcagaacacccagtctcccggcaggtgttcattgttcaggatcttgagattcgagatcgtttggcaacatcacaaatgaataaatttttatacctgtattgcagtaaagaaatgcctcgaaaagctcactccaacatgttgacagtgaaagccttacacgtgtgtccagaatctggcaggtccccacaggagtgctgcttgagagtgtcgctgatgccgctccgcctcaatattgaccaggatgctttgttcttcctgaaggatttcttcacaagtctttctgcagaagtagagcttcaaatgactccagatccagaagttaaaaagtctcctggagctgatgtcacctgcagtttgccaaggcatttgagtacctcaaaggagccaaatctggttatttctttctctgggccaaaacagccttcccaaaatgatagtgccaattcagtggaagtggttaatggcatggaagagaagaacttctctgctgaagaagcatcttttagggatcagcctgtgttttttagagaatttagattcacgtcagaagttcccattcgacttgattatcatggcaaacatgtatcaatggatcagggtacgctagctgggattttgattggtctggctcagttaaactgctctgaactaaagctcaagaggctttcctatcgacatggtttactaggcgttgacaaattattctcatatgcaatcactgagtggcttaatgacattaagaagaaccagctaccaggaatcctgggaggtgttggacctatgcattcactagtacaattagtacaaggcctaaaggacttggtctggctcccaatagagcagtaccggaaggatggccgcattgtcagagggtttcagagaggcgctgcttcctttggtacctcgacagcgatggctgctctagaactcacaaacagaatggttcaaaccatacaggcagctgcagagactgcttatgatatggtgtctcctggtaccctttctatcgagcccaagaagaccaaaaggtttcctcatcaccggttagcccaccagccagtagacctgagggaaggtgtggccaaggcctacagtgttgtgaaagagggaatcacagacacggctcagaccatttatgaaactgcggctcgagaacacgagagcagaggggtgactggtgccgtgggcgaggttctgcgccagattcctccggcagtggtgaaacctctgattgttgccacagaagcaacgtcaaacgtgctgggtggcatgagaaaccaaattaggccagatgtccggcaagacgagtcacagaaatggcgccacggggatgactgatggcttggaactgacagtgtgaagataaggagagtggaaccaggagctcagagtcctgacagcagcttcagaggaagctcgtttaattttattgtgctcatctcaggaacaaaagcattttttagttaaataatttaacatcaaaacaacatgcaaccaaaaacttctgacatttatagttgatacttgcctatagaaatgtttggtggctggtgtcaaaggtccttaaagcatttgctgccaagttagtggaaggctcacttttgttaagatgactgtaattctccttgttaccgacgagagatcattggaagctgccttctaacactttgtgtagctctgtggagttggattttcttaaggtttaaaaagaatcacagcttcggaacttttaactgaaaatgagagacagaagccacaggggaagcaaagcaaataggattttcaatataaatatcagtgtggaaaaataacctattctgttgaatttagtgttcatgcacttgagaacaacattatttccatttactccgaaaatccttctgtgggggtttgagaaagtgaatgttgcagacatgttctgttgtgttgcactttatcctgtgtttatgtgtatgtgtttttagattaattcaagttgtgtgctatatttcttgtataatttacaaagttacacaaaatataaagagcagtaaacttgtctgaaagtttttggcaaaggaaggtaacttcaatgtaatagcttcctttaagagtacaggaaaatgcattctgtaatgaagtggggcccatgtaattgtttatattttcagttttaagcaggtatagtgcaggcttgttaggaatgtgtggaagggaagattggaagtgatttttcctcttttaaaagtaaacaaaattcttcaaatatgccctagttaactatttcagcataccatttttacttggttaacagtgtacattttgataacctatcaggaatgaataaagtatttttatgtagaaatggcggtcgctcggtcccgctgaggaggcgaagccggcggagtgtctgtgtgccggtctgcagcaccgcccccgcttcccgcacgccgcctctcacgccgacttcccttcctctgc

SEQ ID NO: 34315 - DNA, 2254 bp, Homo sapiens
attatgttcgtgtgatggatatggggcttttggagttaaccataactgcagtgaagtctgattctgatggagagcaaactgagccccgctttgagttacactgttccagcgatgttgtccatatcagaacgtgctcagactcttgtgctgcgttaatgaatctcattcagtacattgcaagctatggtgacttgcagacacctaacaaggcagatatgaagcctggagcctttcaaagaaggtctaaggtagattccagtggtcgatcatcctcacgtggtccagtacttcctgaagcagatcaacaaatgttacgagatctgatgagtgatgctatggaggagatcgacatgcaacaaggcacctcgtcagtaaaaccacaggctaatggtgttttggatgaaaaatctcaaattcaggagccatgttgttcagacctcttcctgtttcctgacgagagtgggaatgtatcccaggagtccggccccacctatgcctcattctctcaccatttcatcagtgatgcaatgacaggtgtgcccactgagaatgatgacttttgcattctttttgcaccaaaagcagccatgcaggagaaggaagaagaaccagttataaaaatcatggttgatgatgcaattgtgataagagacaattatttcagtctgcccgttaataagaccgatacgagcaaagcccccttacactttcccattcctgtgattcgctatgtggtgaaggaggtctctcttgtctggcatctttatggaggaaaggattttggaacagtccctcccacttctccggctaaaagttatattagtccccacagttcgccttctcacacacccacgagacatggacgtaatacagtatgtgggggaaaaggaaggaaccatgactttttaatggaaatacagctaagcaaggtgaagtttcagcatgaagtctacccgccatgcaaacctgattgtgattccagcctctcagaacacccagtctcccggcaggtgttcattgttcaggatcttgagattcgagatcgtttggcaacatcacaaatgaataaatttttatacctgtattgcagtaaagaaatgcctcgaaaagctcactccaacatgttgacagtgaaagccttacacgtgtgtccagaatctggcaggtccccacaggagtgctgcttgagagtgtcgctgatgccgctccgcctcaatattgaccaggatgctttgttcttcctgaaggatttcttcacaagtctttctgcagaagtagagcttcaaatgactccagatccagaagttaaaaagtctcctggagctgatgtcacctgcagtttgccaaggcatttgagtacctcaaaggagccaaatctggttatttctttctctgggccaaaacagccttcccaaaatgatagtgccaattcagtggaagtggttaatggcatggaagagaagaacttctctgctgaagaagcatcttttagggatcagcctgtgttttttagagaatttagattcacgtcagaagttcccattcgacttgattatcatggcaaacatgtatcaatggatcagggtacgctagctgggattttgattggtctggctcagttaaactgctctgaactaaagctcaagaggctttcctatcgacatggtttactaggcgttgacaaattattctcatatgcaatcactgagtggcttaatgacattaagaagaaccagctaccaggaatcctgggaggtgttggacctatgcattcactagtacaattagtacaaggcctaaaggacttggtctggctcccaatagagcagtaccggaaggatggccgcattgtcagagggtttcagagaggcgctgcttcctttggtacctcgacagcgatggctgctctagaactcacaaacagaatggttcaaaccatacaggcagctgcagagactgcttatgatatggtgtctcctggtaccctttctatcgagcccaagaagaccaaaaggtttcctcatcaccggttagcccaccagccagtagacctgagggaaggtgtggccaaggcctacagtgttgtgaaagaggtaactgaatacttgggtggacacatcagaacccttctgtgcgctttcccaactttcacctaaagagcatttaatggcttaaatgtattctgtagaaatccctgggagcagaatggcaactgccactaataacatgtgcccatatctgtgtgaggtgatgg

SEQ ID NO: 34316 - DNA, 1969 bp, Homo sapiens
attatgttcgtgtgatggatatggggcttttggagttaaccataactgcagtgaagtctgattctgatggagagcaaactgagccccgctttgagttacactgttccagcgatgttgtccatatcagaacgtgctcagactcttgtgctgcgttaatgaatctcattcagtacattgcaagctatggtgacttgcagacacctaacaaggcagatatgaagcctggagcctttcaaagaaggtctaaggtagattccagtggtcgatcatcctcacgtggtccagtacttcctgaagcagatcaacaaatgttacgagatctgatgagtgatgctatggaggagatcgacatgcaacaaggcacctcgtcagtaaaaccacaggctaatggtgttttggatgaaaaatctcaaattcaggagccatgttgttcagacctcttcctgtttcctgacgagagtgggaatgtatcccaggagtccggccccacctatgcctcattctctcaccatttcatcagtgatgcaatgacaggtgtgcccactgagaatgatgacttttgcattctttttgcaccaaaagcagccatgcaggagaaggaagaagaaccagttataaaaatcatggttgatgatgcaattgtgataagagacaattatttcagtctgcccgttaataagaccgatacgagcaaagcccccttacactttcccattcctgtgattcgctatgtggtgaaggaggtctctcttgtctggcatctttatggaggaaaggattttggaacagtccctcccacttctccggctaaaagttatattagtccccacagttcgccttctcacacacccacgagacatggacgtaatacagtatgtgggggaaaaggaaggaaccatgactttttaatggaaatacagctaagcaaggtgaagtttcagcatgaagtctacccgccatgcaaacctgattgtgattccagcctctcagaacacccagtctcccggcaggtgttcattgttcaggatcttgagattcgagatcgtttggcaacatcacaaatgaataaatttttatacctgtattgcagtaaagaaatgcctcgaaaagctcactccaacatgttgacagtgaaagccttacacgtgtgtccagaatctggcaggtccccacaggagtgctgcttgagagtgtcgctgatgccgctccgcctcaatattgaccaggatgctttgttcttcctgaaggatttcttcacaagtctttctgcagaagtagagcttcaaatgactccagatccagaagttaaaaagtctcctggagctgatgtcacctgcagtttgccaaggcatttgagtacctcaaaggagccaaatctggttatttctttctctgggccaaaacagccttcccaaaatgatagtgccaattcagtggaagtggttaatggcatggaagagaagaacttctctgctgaagaagcatcttttagggatcagcctgtgttttttagagaatttagattcacgtcagaagttcccattcgacttgattatcatggcaaacatgtatcaatggatcagggtacgctagctgggattttgattggtctggctcagttaaactgctctgaactaaagctcaagaggctttcctatcgacatggtttactaggcgttgacaaattattctcatatgcaatcactgagtggcttaatgacattaagaagaaccagctaccaggaatcctgggaggtgttggacctatgcattcactagtacaattagtacaaggcctaaaggacttggtctggctcccaatagagcagtaccggaaggatggccgcattgtcagagggtttcagagaggcgctgcttcctttggtacctcgacagcgatggctgctctagaactcacaaacagaatggttcaaaccatacaggtatctttttagactgccttagtcta

SEQ ID NO: 34317 - DNA, 1749 bp, Homo sapiens
attatgttcgtgtgatggatatggggcttttggagttaaccataactgcagtgaagtctgattctgatggagagcaaactgagccccgctttgagttacactgttccagcgatgttgtccatatcagaacgtgctcagactcttgtgctgcgttaatgaatctcattcagtacattgcaagctatggtgacttgcagacacctaacaaggcagatatgaagcctggagcctttcaaagaaggtctaaggtagattccagtggtcgatcatcctcacgtggtccagtacttcctgaagcagatcaacaaatgttacgagatctgatgagtgatgctatggaggagatcgacatgcaacaaggcacctcgtcagtaaaaccacaggctaatggtgttttggatgaaaaatctcaaattcaggagccatgttgttcagacctcttcctgtttcctgacgagagtgggaatgtatcccaggagtccggccccacctatgcctcattctctcaccatttcatcagtgatgcaatgacaggtgtgcccactgagaatgatgacttttgcattctttttgcaccaaaagcagccatgcaggagaaggaagaagaaccagttataaaaatcatggttgatgatgcaattgtgataagagacaattatttcagtctgcccgttaataagaccgatacgagcaaagcccccttacactttcccattcctgtgattcgctatgtggtgaaggaggtctctcttgtctggcatctttatggaggaaaggattttggaacagtccctcccacttctccggctaaaagttatattagtccccacagttcgccttctcacacacccacgagacatggacgtaatacagtatgtgggggaaaaggaaggaaccatgactttttaatggaaatacagctaagcaaggtgaagtttcagcatgaagtctacccgccatgcaaacctgattgtgattccagcctctcagaacacccagtctcccggcaggtgttcattgttcaggatcttgagattcgagatcgtttggcaacatcacaaatgaataaatttttatacctgtattgcagtaaagaaatgcctcgaaaagctcactccaacatgttgacagtgaaagccttacacgtgtgtccagaatctggcaggtccccacaggagtgctgcttgagagtgtcgctgatgccgctccgcctcaatattgaccaggatgctttgttcttcctgaaggatttcttcacaagtctttctgcagaagtagagcttcaaatgactccagatccagaagttaaaaagtctcctggagctgatgtcacctgcagtttgccaaggcatttgagtacctcaaaggagccaaatctggttatttctttctctgggccaaaacagccttcccaaaatgatagtgccaattcagtggaagtggttaatggcatggaagagaagaacttctctgctgaagaagcatcttttagggatcagcctgtgttttttaggcgcagtggactttggtgagatggcttaggatgtaaccaccaacattaattctgtgggaaaactgtgtttcaagttccaaacattgtttgcagccaacttttggaagccagatcattttgttagatgtgtaccatcagtgtacaaccagccctctatatctggaattctacatctgagattcaaccaaaatattaattaaaaaaggcaataaaaataatacaaattaaaaatacaa

SEQ ID NO: 34318 - DNA, 332 bp, Homo sapiens
gagaaaggagagtattggagggcactggcccgacagccaagtggagctgagtattcaggggatgggcgtgacctggggtctgaggcttctggtagtgattggtgtaaatatagcatctccattttgttgtaggcgcagtggactttggtgagatggcttaggatgtaaccaccaacattaattctgtgggaaaactgtgtttcaagttccaaacattgtttgcagccaacttttggaagccagatcattttgttagatgtgtaccatcagtgtacaaccagccctctatatctggaattctacatctgagattcaaccaaaatattaattaa

SEQ ID NO: 34319 - DNA, 808 bp, Homo sapiens
aatgcaacggggatggtgcagcctctctgatggggtttttgggaagatacaaatagataatataagtgcctggcatgatgtctggcatgtagtaaatgctcgatacatgtggatttctttcccttgttgaggggtggggaccacacgggagtaggaagcagttggggaggggtcagcagcctgtccctgcccctgccctcagctgagctcgggctcacgtgagagccctctgcccaatggggctgcgtctccaggtacagggccctgccagtcccatgctggctacttgcagcacccctctctcacccctagggaagcgctgcgaaggcagctgatggctgcagaacaggaggatgacgtggagggtgtgtgcaagcctctgtcctgcggctgggagatcacagacaccctgtgcgtgggccctgtcttcaccccagcgagcatcatgtgagtgggcctcgttccccccggagaatcccagcggggcctcagagatgcatctgggagaggtggggaagatggcaggcaagggtacccttggccaggactctggtgcccaccctgccacccccgcgctccacctgcagtgtttctgccctgtaaataggaccagtcttacactcgctgtagttcaagtatgcaacataaatcctgttccttccagctgtgtctgcctcctctgcagtgcaaggggcctggtcagccaggtgtgggggtgttcttggggtctcctttggtctccttcccacctttgtaaatataatgcaaataaataaatatttaggtttttaaaaactgaaaaggaatc

SEQ ID NO: 34320 - DNA, 2124 bp, Homo sapiens
ggcggggcctgggcggggttatataagccagcggcgggcggaaggcggggcgtgggggtctgtggctgctgggctggcggggcgcaggccgcgggacccgagcccggggaagcgagagagcggaggcgccgaggatccgattcactccctggggagacctatgggccgaagccgtgtaaatgcgttttaagcagaggcctcggctccgcaactgccactcctcctcggggtgttgcacaagtttcgaggtcaccggcgaccccccctagcagcgcgcctggctctggcccccgcgaaggaggacggagtttgtgtgttgcatactttctaaggcggcggctgcagcagcggctccatccagcccgtcagctcctcctgcaaggcatggctggctacctgagtgaatcggactttgtgatggtggaggagggcttcagtacccgagacctgctgaaggaactcactctgggggcctcacaggccaccacggacgaggtagctgccttcttcgtggctgacctgggtgccatagtgaggaagcacttttgctttctgaagtgcctgccacgagtccggcccttttatgctgtcaagtgcaacagcagcccaggtgtgctgaaggttctggcccagctggggctgggctttagctgtgccaacaaggcagagatggagttggtccagcatattggaatccctgccagtaagatcatctgcgccaacccctgtaagcaaattgcacagatcaaatatgctgccaagcatgggatccagctgctgagctttgacaatgagatggagctggcaaaggtggtaaagagccaccccagtgccaagatggttctgtgcattgctaccgatgactcccactccctgagctgcctgagcctaaagtttggagtgtcactgaaatcctgcagacacctgcttgaaaatgcgaagaagcaccatgtggaggtggtgggtgtgagttttcacattggcagtggctgtcctgaccctcaggcctatgctcagtccatcgcagacgcccggctcgtgtttgaaatgggcaccgagctgggtcacaagatgcacgttctggaccttggtggtggcttccctggcacagaaggggccaaagtgagatttgaagagattgcttccgtgatcaactcagccttggacctgtacttcccagagggctgtggcgtggacatctttgctgagctggggcgctactacgtgacctcggccttcactgtggcagtcagcatcattgccaagaaggaggttctgctagaccagcctggcagggaggaggaaaatggttccacctccaagaccatcgtgtaccaccttgatgagggcgtgtatgggatcttcaactcagtcctgtttgacaacatctgccctacccccatcctgcagaagaaaccatccacggagcagcccctgtacagcagcagcctgtggggcccggcggttgatggctgtgattgcgtggctgagggcctgtggctgccgcaactacacgtaggggactggctggtctttgacaacatgggcgcctacactgtgggcatgggttcccccttttgggggacccaggcctgccacatcacctatgccatgtcccgggtggcctgggaagcgctgcgaaggcagctgatggctgcagaacaggaggatgacgtggagggtgtgtgcaagcctctgtcctgcggctgggagatcacagacaccctgtgcgtgggccctgtcttcaccccagcgagcatcatgtgagtgggcctcgttccccccggagaatcccagcggggcctcagagatgcatctgggagaggtggggaagatggcaggcaagggtacccttggccaggactctggtgcccaccctgccacccccgcgctccacctgcagtgtttctgccctgtaaataggaccagtcttacactcgctgtagttcaagtatgcaacataaatcctgttccttccagctgtgtctgcctcctctgcagtgcaaggggcctggtcagccaggtgtgggggtgttcttggggtctcctttggtctccttcccacctttgtaaatataatgcaaataaataaatatttaggtttttaaaaactgaaaaggaatc

SEQ ID NO: 34321 - DNA, 831 bp, Homo sapiens
  misc_feature (789)..(789): n is a, c, g, or t
  misc_feature (795)..(795): n is a, c, g, or t
ggcggggcctgggcggggttatataagccagcggcgggcggaaggcggggcgtgggggtctgtggctgctgggctggcggggcgcaggccgcgggacccgagcccggggaagcgagagagcggaggcgccgaggatccgattcactccctggggagacctatgggccgaagccgtgtaaatgcgttttaagcagaggcctcggctccgcaactgccactcctcctcggggtgttgcacaagtttcgaggtcaccggcgaccccccctagcagcgcgcctggctctggcccccgcgaaggaggacggagtttggcagagatggagttggtccagcatattggaatccctgccagtaagatcatctgcgccaacccctgtaagcaaattgcacagatcaaatatgctgccaagcatgggatccagctgctgagctttgacaatgagatggagctggcaaaggtggtaaagagccaccccagtgccaagatggttctgtgcattgctaccgatgactcccactccctgagctgcctgagcctaaagtttggagtgtcactgaaatcctgcagacacctgcttgaaaatgcgaagaagcaccatgtggaggtggtgggtgtgagttttcacattggcagtggctgtcctgaccctcaggcctatgctcagtccatcgcagacgcccggctcgtgtttgaaatgggcaccgagctgggtcacaagatgcacgttctggaccttggtggtggcttccctggcacagaaggggccaaagtgagatttgaagagatngcttcngtgatcaagctcagactctccgggatcctctagact

SEQ ID NO: 34322 - DNA, 447 bp, Homo sapiens
ttgttttgtaacctgctttttccatttatatggggtgtagctctttccatgccattaactgatctttgacaacatgcttttgtattttaaccaatctaactctagtggttggctatttggtttcctctttttgagcactgtgaatatatgttgaggtttcagctctgtggtaaattcctggaagtagaaacagttcatatacagtgggtttttctgtaataacaggggaacaggaatacataaaacattcctcctagcctgtggaacccagcccagggcctccagcaattttaatgggcatctttgagaggataaagaaaaccagacatcattttatcttccgcatagcaatgccgtcagtttgttaattcatttaccagttgatggacaatggagttgttgctcacgagcctgggctgtgaagtgggactctgtaacaaaaaaaag

SEQ ID NO: 34323 - DNA, 2184 bp, Homo sapiens
ggcggggcctgggcggggttatataagccagcggcgggcggaaggcggggcgtgggggtctgtggctgctgggctggcggggcgcaggccgcgggacccgagcccggggaagcgagagagcggaggcgccgaggatccgattcactccctggggagacctatgggccgaagccgtgtaaatgcgttttaagcagaggcctcggctccgcaactgccactcctcctcggggtgttgcacaagtttcgaggtcaccggcgaccccccctagcagcgcgcctggctctggcccccgcgaaggaggacggagtttgtgtgttgcatactttctaaggcggcggctgcagcagcggctccatccagcccgtcagctcctcctgcaaggcatggctggctacctgagtgaatcggactttgtgatggtggaggagggcttcagtacccgagacctgctgaaggaactcactctgggggcctcacaggccaccacggacgaggtagctgccttcttcgtggctgacctgggtgccatagtgaggaagcacttttgctttctgaagtgcctgccacgagtccggcccttttatgctgtcaagtgcaacagcagcccaggtgtgctgaaggttctggcccagctggggctgggctttagctgtgccaacaaggcagagatggagttggtccagcatattggaatccctgccagtaagatcatctgcgccaacccctgtaagcaaattgcacagatcaaatatgctgccaagcatgggatccagctgctgagctttgacaatgagatggagctggcaaaggtggtaaagagccaccccagtgccaagatggttctgtgcattgctaccgatgactcccactccctgagctgcctgagcctaaagtttggagtgtcactgaaatcctgcagacacctgcttgaaaatgcgaagaagcaccatgtggaggtggtgggtgtgagttttcacattggcagtggctgtcctgaccctcaggcctatgctcagtccatcgcagacgcccggctcgtgtttgaaatgggcaccgagctgggtcacaagatgcacgttctggaccttggtggtggcttccctggcacagaaggggccaaagtgagatttgaagagattgcttccgtgatcaactcagccttggacctgtacttcccagagggctgtggcgtggacatctttgctgagctggggcgctactacgtgacctcggccttcactgtggcagtcagcatcattgccaagaaggaggttctgctagaccagcctggcagggaggccccactaccaccccctcacattgctacttgtgctgcctctgaaccctcccctcctgcagaggaaaatggttccacctccaagaccatcgtgtaccaccttgatgagggcgtgtatgggatcttcaactcagtcctgtttgacaacatctgccctacccccatcctgcagaagaaaccatccacggagcagcccctgtacagcagcagcctgtggggcccggcggttgatggctgtgattgcgtggctgagggcctgtggctgccgcaactacacgtaggggactggctggtctttgacaacatgggcgcctacactgtgggcatgggttcccccttttgggggacccaggcctgccacatcacctatgccatgtcccgggtggcctgggaagcgctgcgaaggcagctgatggctgcagaacaggaggatgacgtggagggtgtgtgcaagcctctgtcctgcggctgggagatcacagacaccctgtgcgtgggccctgtcttcaccccagcgagcatcatgtgagtgggcctcgttccccccggagaatcccagcggggcctcagagatgcatctgggagaggtggggaagatggcaggcaagggtacccttggccaggactctggtgcccaccctgccacccccgcgctccacctgcagtgtttctgccctgtaaataggaccagtcttacactcgctgtagttcaagtatgcaacataaatcctgttccttccagctgtgtctgcctcctctgcagtgcaaggggcctggtcagccaggtgtgggggtgttcttggggtctcctttggtctccttcccacctttgtaaatataatgcaaataaataaatatttaggtttttaaaaactgaaaaggaatc

SEQ ID NO: 34324 - DNA, 2217 bp, Homo sapiens
ggcggggcctgggcggggttatataagccagcggcgggcggaaggcggggcgtgggggtctgtggctgctgggctggcggggcgcaggccgcgggacccgagcccggggaagcgagagagcggaggcgccgaggatccgattcactccctggggagacctatgggccgaagccgtgtaaatgcgttttaaggcgagtgcggaaagtggcctggggagcctcggggagcggacgccctccgccctggtgctgacctgcctccctgccccttctgcctcctgtcagcagaggcctcggctccgcaactgccactcctcctcggggtgttgcacaagtttcgaggtcaccggcgaccccccctagcagcgcgcctggctctggcccccgcgaaggaggacggagtttgtgtgttgcatactttctaaggcggcggctgcagcagcggctccatccagcccgtcagctcctcctgcaaggcatggctggctacctgagtgaatcggactttgtgatggtggaggagggcttcagtacccgagacctgctgaaggaactcactctgggggcctcacaggccaccacggacgaggtagctgccttcttcgtggctgacctgggtgccatagtgaggaagcacttttgctttctgaagtgcctgccacgagtccggcccttttatgctgtcaagtgcaacagcagcccaggtgtgctgaaggttctggcccagctggggctgggctttagctgtgccaacaaggcagagatggagttggtccagcatattggaatccctgccagtaagatcatctgcgccaacccctgtaagcaaattgcacagatcaaatatgctgccaagcatgggatccagctgctgagctttgacaatgagatggagctggcaaaggtggtaaagagccaccccagtgccaagatggttctgtgcattgctaccgatgactcccactccctgagctgcctgagcctaaagtttggagtgtcactgaaatcctgcagacacctgcttgaaaatgcgaagaagcaccatgtggaggtggtgggtgtgagttttcacattggcagtggctgtcctgaccctcaggcctatgctcagtccatcgcagacgcccggctcgtgtttgaaatgggcaccgagctgggtcacaagatgcacgttctggaccttggtggtggcttccctggcacagaaggggccaaagtgagatttgaagagattgcttccgtgatcaactcagccttggacctgtacttcccagagggctgtggcgtggacatctttgctgagctggggcgctactacgtgacctcggccttcactgtggcagtcagcatcattgccaagaaggaggttctgctagaccagcctggcagggaggaggaaaatggttccacctccaagaccatcgtgtaccaccttgatgagggcgtgtatgggatcttcaactcagtcctgtttgacaacatctgccctacccccatcctgcagaagaaaccatccacggagcagcccctgtacagcagcagcctgtggggcccggcggttgatggctgtgattgcgtggctgagggcctgtggctgccgcaactacacgtaggggactggctggtctttgacaacatgggcgcctacactgtgggcatgggttcccccttttgggggacccaggcctgccacatcacctatgccatgtcccgggtggcctgggaagcgctgcgaaggcagctgatggctgcagaacaggaggatgacgtggagggtgtgtgcaagcctctgtcctgcggctgggagatcacagacaccctgtgcgtgggccctgtcttcaccccagcgagcatcatgtgagtgggcctcgttccccccggagaatcccagcggggcctcagagatgcatctgggagaggtggggaagatggcaggcaagggtacccttggccaggactctggtgcccaccctgccacccccgcgctccacctgcagtgtttctgccctgtaaataggaccagtcttacactcgctgtagttcaagtatgcaacataaatcctgttccttccagctgtgtctgcctcctctgcagtgcaaggggcctggtcagccaggtgtgggggtgttcttggggtctcctttggtctccttcccacctttgtaaatataatgcaaataaataaatatttaggtttttaaaaactgaaaaggaatc

SEQ ID NO: 34325 - DNA, 2336 bp, Homo sapiens
ggcggggcctgggcggggttatataagccagcggcgggcggaaggcggggcgtgggggtctgtggctgctgggctggcggggcgcaggccgcgggacccgagcccggggaagcgagagagcggaggcgccgaggatccgattcactccctggggagacctatgggccgaagccgtgtaaatgcgttttaagcagaggcctcggctccgcaactgccactcctcctcggggtgttgcacaagtttcgaggtcaccggcgaccccccctagcagcgcgcctggctctggcccccgcgaaggaggacggagtttggagcttgcggcccccacccaccgcgtggcgtccccaggcacgcctagaattctagcacctcaggatcagtccagcccccatttacaattggggaaactgcggctccgaaagggtcagagggtacccgaggtcaagcagtagagagcggactcgaacttaagctcttgctcttaggctgagacgccttgatgtggccaccggctaccctctagtgtgttgcatactttctaaggcggcggctgcagcagcggctccatccagcccgtcagctcctcctgcaaggcatggctggctacctgagtgaatcggactttgtgatggtggaggagggcttcagtacccgagacctgctgaaggaactcactctgggggcctcacaggccaccacggacgaggtagctgccttcttcgtggctgacctgggtgccatagtgaggaagcacttttgctttctgaagtgcctgccacgagtccggcccttttatgctgtcaagtgcaacagcagcccaggtgtgctgaaggttctggcccagctggggctgggctttagctgtgccaacaaggcagagatggagttggtccagcatattggaatccctgccagtaagatcatctgcgccaacccctgtaagcaaattgcacagatcaaatatgctgccaagcatgggatccagctgctgagctttgacaatgagatggagctggcaaaggtggtaaagagccaccccagtgccaagatggttctgtgcattgctaccgatgactcccactccctgagctgcctgagcctaaagtttggagtgtcactgaaatcctgcagacacctgcttgaaaatgcgaagaagcaccatgtggaggtggtgggtgtgagttttcacattggcagtggctgtcctgaccctcaggcctatgctcagtccatcgcagacgcccggctcgtgtttgaaatgggcaccgagctgggtcacaagatgcacgttctggaccttggtggtggcttccctggcacagaaggggccaaagtgagatttgaagagattgcttccgtgatcaactcagccttggacctgtacttcccagagggctgtggcgtggacatctttgctgagctggggcgctactacgtgacctcggccttcactgtggcagtcagcatcattgccaagaaggaggttctgctagaccagcctggcagggaggaggaaaatggttccacctccaagaccatcgtgtaccaccttgatgagggcgtgtatgggatcttcaactcagtcctgtttgacaacatctgccctacccccatcctgcagaagaaaccatccacggagcagcccctgtacagcagcagcctgtggggcccggcggttgatggctgtgattgcgtggctgagggcctgtggctgccgcaactacacgtaggggactggctggtctttgacaacatgggcgcctacactgtgggcatgggttcccccttttgggggacccaggcctgccacatcacctatgccatgtcccgggtggcctgggaagcgctgcgaaggcagctgatggctgcagaacaggaggatgacgtggagggtgtgtgcaagcctctgtcctgcggctgggagatcacagacaccctgtgcgtgggccctgtcttcaccccagcgagcatcatgtgagtgggcctcgttccccccggagaatcccagcggggcctcagagatgcatctgggagaggtggggaagatggcaggcaagggtacccttggccaggactctggtgcccaccctgccacccccgcgctccacctgcagtgtttctgccctgtaaataggaccagtcttacactcgctgtagttcaagtatgcaacataaatcctgttccttccagctgtgtctgcctcctctgcagtgcaaggggcctggtcagccaggtgtgggggtgttcttggggtctcctttggtctccttcccacctttgtaaatataatgcaaataaataaatatttaggtttttaaaaactgaaaaggaatc

SEQ ID NO: 34326 - DNA, 2161 bp, Homo sapiens
ggcggggcctgggcggggttatataagccagcggcgggcggaaggcggggcgtgggggtctgtggctgctgggctggcggggcgcaggccgcgggacccgagcccggggaagcgagagagcggaggcgccgaggatccgattcactccctggggagacctatgggccgaagccgtgtaaatgcgttttaagcagaggcctcggctccgcaactgccactcctcctcggggtgttgcacaagtttcgaggtcaccggcgaccccccctagcagcgcgcctggctctggcccccgcgaaggaggacggagtttgtgtgttgcatactttctaaggcggcggctgcagcagcggctccatccagcccgtcagctcctcctgcaaggcatggctggctacctgagtgaatcggactttgtgatggtggaggagggcttcagtacccgagacctgctgaaggaactcactctgggggcctcacaggccaccacggacgaggtagctgccttcttcgtggctgacctgggtgccatagtgaggaagcacttttgctttctgaagtgcctgccacgagtccggcccttttatgctgtcaagtgcaacagcagcccaggtgtgctgaaggttctggcccagctggggctgggctttagctgtgccaacaaggcagagatggagttggtccagcatattggaatccctgccagtaagatcatctgcgccaacccctgtaagcaaattgcacagatcaaatatgctgccaagcatgggatccagctgctgagctttgacaatgagatggagctggcaaaggtggtaaagagccaccccagtgccaaggtttgtccagcagaggggcactgcgtgtctcatcaggatggttctgtgcattgctaccgatgactcccactccctgagctgcctgagcctaaagtttggagtgtcactgaaatcctgcagacacctgcttgaaaatgcgaagaagcaccatgtggaggtggtgggtgtgagttttcacattggcagtggctgtcctgaccctcaggcctatgctcagtccatcgcagacgcccggctcgtgtttgaaatgggcaccgagctgggtcacaagatgcacgttctggaccttggtggtggcttccctggcacagaaggggccaaagtgagatttgaagagattgcttccgtgatcaactcagccttggacctgtacttcccagagggctgtggcgtggacatctttgctgagctggggcgctactacgtgacctcggccttcactgtggcagtcagcatcattgccaagaaggaggttctgctagaccagcctggcagggaggaggaaaatggttccacctccaagaccatcgtgtaccaccttgatgagggcgtgtatgggatcttcaactcagtcctgtttgacaacatctgccctacccccatcctgcagaagaaaccatccacggagcagcccctgtacagcagcagcctgtggggcccggcggttgatggctgtgattgcgtggctgagggcctgtggctgccgcaactacacgtaggggactggctggtctttgacaacatgggcgcctacactgtgggcatgggttcccccttttgggggacccaggcctgccacatcacctatgccatgtcccgggtggcctgggaagcgctgcgaaggcagctgatggctgcagaacaggaggatgacgtggagggtgtgtgcaagcctctgtcctgcggctgggagatcacagacaccctgtgcgtgggccctgtcttcaccccagcgagcatcatgtgagtgggcctcgttccccccggagaatcccagcggggcctcagagatgcatctgggagaggtggggaagatggcaggcaagggtacccttggccaggactctggtgcccaccctgccacccccgcgctccacctgcagtgtttctgccctgtaaataggaccagtcttacactcgctgtagttcaagtatgcaacataaatcctgttccttccagctgtgtctgcctcctctgcagtgcaaggggcctggtcagccaggtgtgggggtgttcttggggtctcctttggtctccttcccacctttgtaaatataatgcaaataaataaatatttaggtttttaaaaactgaaaaggaatc

SEQ ID NO: 34327 - DNA, 2204 bp, Homo sapiens
ggcggggcctgggcggggttatataagccagcggcgggcggaaggcggggcgtgggggtctgtggctgctgggctggcggggcgcaggccgcgggacccgagcccggggaagcgagagagcggaggcgccgaggatccgattcactccctggggagacctatgggccgaagccgtgtaaatgcgttttaagcagaggcctcggctccgcaactgccactcctcctcggggtgttgcacaagtttcgaggtcaccggcgaccccccctagcagcgcgcctggctctggcccccgcgaaggaggacggagtttgtgtgttgcatactttctaaggcggcggctgcagcagcggctccatccagcccgtcagctcctcctgcaaggcatggctggctacctgagtgaatcggactttgtgatggtggaggagggcttcagtacccgagacctgctgaaggaactcactctgggggcctcacaggccaccacggcagattttctattttctttctccatgcccctgcattgcaccttgtagaaactgccatctaacatctgctgaatggacttgacgaggtagctgccttcttcgtggctgacctgggtgccatagtgaggaagcacttttgctttctgaagtgcctgccacgagtccggcccttttatgctgtcaagtgcaacagcagcccaggtgtgctgaaggttctggcccagctggggctgggctttagctgtgccaacaaggcagagatggagttggtccagcatattggaatccctgccagtaagatcatctgcgccaacccctgtaagcaaattgcacagatcaaatatgctgccaagcatgggatccagctgctgagctttgacaatgagatggagctggcaaaggtggtaaagagccaccccagtgccaagatggttctgtgcattgctaccgatgactcccactccctgagctgcctgagcctaaagtttggagtgtcactgaaatcctgcagacacctgcttgaaaatgcgaagaagcaccatgtggaggtggtgggtgtgagttttcacattggcagtggctgtcctgaccctcaggcctatgctcagtccatcgcagacgcccggctcgtgtttgaaatgggcaccgagctgggtcacaagatgcacgttctggaccttggtggtggcttccctggcacagaaggggccaaagtgagatttgaagagattgcttccgtgatcaactcagccttggacctgtacttcccagagggctgtggcgtggacatctttgctgagctggggcgctactacgtgacctcggccttcactgtggcagtcagcatcattgccaagaaggaggttctgctagaccagcctggcagggaggaggaaaatggttccacctccaagaccatcgtgtaccaccttgatgagggcgtgtatgggatcttcaactcagtcctgtttgacaacatctgccctacccccatcctgcagaagaaaccatccacggagcagcccctgtacagcagcagcctgtggggcccggcggttgatggctgtgattgcgtggctgagggcctgtggctgccgcaactacacgtaggggactggctggtctttgacaacatgggcgcctacactgtgggcatgggttcccccttttgggggacccaggcctgccacatcacctatgccatgtcccgggtggcctgggaagcgctgcgaaggcagctgatggctgcagaacaggaggatgacgtggagggtgtgtgcaagcctctgtcctgcggctgggagatcacagacaccctgtgcgtgggccctgtcttcaccccagcgagcatcatgtgagtgggcctcgttccccccggagaatcccagcggggcctcagagatgcatctgggagaggtggggaagatggcaggcaagggtacccttggccaggactctggtgcccaccctgccacccccgcgctccacctgcagtgtttctgccctgtaaataggaccagtcttacactcgctgtagttcaagtatgcaacataaatcctgttccttccagctgtgtctgcctcctctgcagtgcaaggggcctggtcagccaggtgtgggggtgttcttggggtctcctttggtctccttcccacctttgtaaatataatgcaaataaataaatatttaggtttttaaaaactgaaaaggaatc

SEQ ID NO: 34328 - DNA, 2249 bp, Homo sapiens
ggcggggcctgggcggggttatataagccagcggcgggcggaaggcggggcgtgggggtctgtggctgctgggctggcggggcgcaggccgcgggacccgagcccggggaagcgagagagcggaggcgccgaggatccgattcactccctggggagacctatgggccgaagccgtgtaaatgcgttttaagcagaggcctcggctccgcaactgccactcctcctcggggtgttgcacaagtttcgaggtcaccggcgaccccccctagcagcgcgcctggctctggcccccgcgaaggaggacggagtttgtgtgttgcatactttctaaggcggcggctgcagcagcggctccatccagcccgtcagctcctcctgcaaggcatggctggctacctgagtgaatcggactttgtgatggtggaggagggcttcagtacccgagacctgctgaaggaactcactctgggggcctcacaggccaccacgtcattccttgcttctcatcagtgttgcctttcctgatcgccccaggcagattttctattttctttctccatgcccctgcattgcaccttgtagaaactgccatctaacatctgctgaatggacttgacgaggtagctgccttcttcgtggctgacctgggtgccatagtgaggaagcacttttgctttctgaagtgcctgccacgagtccggcccttttatgctgtcaagtgcaacagcagcccaggtgtgctgaaggttctggcccagctggggctgggctttagctgtgccaacaaggcagagatggagttggtccagcatattggaatccctgccagtaagatcatctgcgccaacccctgtaagcaaattgcacagatcaaatatgctgccaagcatgggatccagctgctgagctttgacaatgagatggagctggcaaaggtggtaaagagccaccccagtgccaagatggttctgtgcattgctaccgatgactcccactccctgagctgcctgagcctaaagtttggagtgtcactgaaatcctgcagacacctgcttgaaaatgcgaagaagcaccatgtggaggtggtgggtgtgagttttcacattggcagtggctgtcctgaccctcaggcctatgctcagtccatcgcagacgcccggctcgtgtttgaaatgggcaccgagctgggtcacaagatgcacgttctggaccttggtggtggcttccctggcacagaaggggccaaagtgagatttgaagagattgcttccgtgatcaactcagccttggacctgtacttcccagagggctgtggcgtggacatctttgctgagctggggcgctactacgtgacctcggccttcactgtggcagtcagcatcattgccaagaaggaggttctgctagaccagcctggcagggaggaggaaaatggttccacctccaagaccatcgtgtaccaccttgatgagggcgtgtatgggatcttcaactcagtcctgtttgacaacatctgccctacccccatcctgcagaagaaaccatccacggagcagcccctgtacagcagcagcctgtggggcccggcggttgatggctgtgattgcgtggctgagggcctgtggctgccgcaactacacgtaggggactggctggtctttgacaacatgggcgcctacactgtgggcatgggttcccccttttgggggacccaggcctgccacatcacctatgccatgtcccgggtggcctgggaagcgctgcgaaggcagctgatggctgcagaacaggaggatgacgtggagggtgtgtgcaagcctctgtcctgcggctgggagatcacagacaccctgtgcgtgggccctgtcttcaccccagcgagcatcatgtgagtgggcctcgttccccccggagaatcccagcggggcctcagagatgcatctgggagaggtggggaagatggcaggcaagggtacccttggccaggactctggtgcccaccctgccacccccgcgctccacctgcagtgtttctgccctgtaaataggaccagtcttacactcgctgtagttcaagtatgcaacataaatcctgttccttccagctgtgtctgcctcctctgcagtgcaaggggcctggtcagccaggtgtgggggtgttcttggggtctcctttggtctccttcccacctttgtaaatataatgcaaataaataaatatttaggtttttaaaaactgaaaaggaatc

SEQ ID NO: 34329 - DNA, 1473 bp, Homo sapiens
ggcggggcctgggcggggttatataagccagcggcgggcggaaggcggggcgtgggggtctgtggctgctgggctggcggggcgcaggccgcgggacccgagcccggggaagcgagagagcggaggcgccgaggatccgattcactccctggggagacctatgggccgaagccgtgtaaatgcgttttaagcagaggcctcggctccgcaactgccactcctcctcggggtgttgcacaagtttcgaggtcaccggcgaccccccctagcagcgcgcctggctctggcccccgcgaaggaggacggagtttgtgtgttgcatactttctaaggcggcggctgcagcagcggctccatccagcccgtcagctcctcctgcaaggcatggctggctacctgagtgaatcggactttgtgatggtggaggagggcttcagtacccgagacctgctgaaggaactcactctgggggcctcacaggccaccacggacgaggtagctgccttcttcgtggctgacctgggtgccatagtgaggaagcacttttgctttctgaagtgcctgccacgagtccggcccttttatgctgtcaagtgcaacagcagcccaggtgtgctgaaggttctggcccagctggggctgggctttagctgtgccaacaaggcagagatggagttggtccagcatattggaatccctgccagtaagatcatctgcgccaacccctgtaagcaaattgcacagatcaaatatgctgccaagcatgggatccagctgctgagctttgacaatgagatggagctggcaaaggtggtaaagagccaccccagtgccaagatggttctgtgcattgctaccgatgactcccactccctgagctgcctgagcctaaagtttggagtgtcactgaaatcctgcagacacctgcttgaaaatgcgaagaagcaccatgtggaggtggtgggtgtgagttttcacattggcagtggctgtcctgaccctcaggcctatgctcagtccatcgcagacgcccggctcgtgtttgaaatgggcaccgagctgggtcacaagatgcacgttctggaccttggtggtggcttccctggcacagaaggggccaaagtgagatttgaagagattgcttccgtgatcaactcagccttggacctgtacttcccagagggctgtggcgtggacatctttgctgagctggggcgctactacgtgacctcggccttcactgtggcagtcagcatcattgccaagaaggaggttctgctagaccagcctggcagggaggaggaaaatggttccacctccaagaccatcgtgtaccaccttgatgagggcgtgtatgggatcttcaactcagtcctgtttgacaacatctgccctacccccatcctgcagaagtctaagaaccactcaccctgctacatgtctctagagtccattcatttcattgccgtgtag

SEQ ID NO: 34330 - DNA, 1950 bp, Homo sapiens
ggcggggcctgggcggggttatataagccagcggcgggcggaaggcggggcgtgggggtctgtggctgctgggctggcggggcgcaggccgcgggacccgagcccggggaagcgagagagcggaggcgccgaggatccgattcactccctggggagacctatgggccgaagccgtgtaaatgcgttttaagcagaggcctcggctccgcaactgccactcctcctcggggtgttgcacaagtttcgaggtcaccggcgaccccccctagcagcgcgcctggctctggcccccgcgaaggaggacggagtttgtgtgttgcatactttctaaggcggcggctgcagcagcggctccatccagcccgtcagctcctcctgcaaggcatggctggctacctgagtgaatcggactttgtgatggtggaggagggcttcagtacccgagacctgctgaaggaactcactctgggggcctcacaggccaccacggcagagatggagttggtccagcatattggaatccctgccagtaagatcatctgcgccaacccctgtaagcaaattgcacagatcaaatatgctgccaagcatgggatccagctgctgagctttgacaatgagatggagctggcaaaggtggtaaagagccaccccagtgccaagatggttctgtgcattgctaccgatgactcccactccctgagctgcctgagcctaaagtttggagtgtcactgaaatcctgcagacacctgcttgaaaatgcgaagaagcaccatgtggaggtggtgggtgtgagttttcacattggcagtggctgtcctgaccctcaggcctatgctcagtccatcgcagacgcccggctcgtgtttgaaatgggcaccgagctgggtcacaagatgcacgttctggaccttggtggtggcttccctggcacagaaggggccaaagtgagatttgaagagattgcttccgtgatcaactcagccttggacctgtacttcccagagggctgtggcgtggacatctttgctgagctggggcgctactacgtgacctcggccttcactgtggcagtcagcatcattgccaagaaggaggttctgctagaccagcctggcagggaggaggaaaatggttccacctccaagaccatcgtgtaccaccttgatgagggcgtgtatgggatcttcaactcagtcctgtttgacaacatctgccctacccccatcctgcagaagaaaccatccacggagcagcccctgtacagcagcagcctgtggggcccggcggttgatggctgtgattgcgtggctgagggcctgtggctgccgcaactacacgtaggggactggctggtctttgacaacatgggcgcctacactgtgggcatgggttcccccttttgggggacccaggcctgccacatcacctatgccatgtcccgggtggcctgggaagcgctgcgaaggcagctgatggctgcagaacaggaggatgacgtggagggtgtgtgcaagcctctgtcctgcggctgggagatcacagacaccctgtgcgtgggccctgtcttcaccccagcgagcatcatgtgagtgggcctcgttccccccggagaatcccagcggggcctcagagatgcatctgggagaggtggggaagatggcaggcaagggtacccttggccaggactctggtgcccaccctgccacccccgcgctccacctgcagtgtttctgccctgtaaataggaccagtcttacactcgctgtagttcaagtatgcaacataaatcctgttccttccagctgtgtctgcctcctctgcagtgcaaggggcctggtcagccaggtgtgggggtgttcttggggtctcctttggtctccttcccacctttgtaaatataatgcaaataaataaatatttaggtttttaaaaactgaaaaggaatc

SEQ ID NO: 34331 - DNA, 1947 bp, Homo sapiens
ggcggggcctgggcggggttatataagccagcggcgggcggaaggcggggcgtgggggtctgtggctgctgggctggcggggcgcaggccgcgggacccgagcccggggaagcgagagagcggaggcgccgaggatccgattcactccctggggagacctatgggccgaagccgtgtaaatgcgttttaagcagaggcctcggctccgcaactgccactcctcctcggggtgttgcacaagtttcgaggtcaccggcgaccccccctagcagcgcgcctggctctggcccccgcgaaggaggacggagtttggacgaggtagctgccttcttcgtggctgacctgggtgccatagtgaggaagcacttttgctttctgaagtgcctgccacgagtccggcccttttatgctgtcaagtgcaacagcagcccaggtgtgctgaaggttctggcccagctggggctgggctttagctgtgccaacaaggcagagatggagttggtccagcatattggaatccctgccagtaagatcatctgcgccaacccctgtaagcaaattgcacagatcaaatatgctgccaagcatgggatccagctgctgagctttgacaatgagatggagctggcaaaggtggtaaagagccaccccagtgccaagatggttctgtgcattgctaccgatgactcccactccctgagctgcctgagcctaaagtttggagtgtcactgaaatcctgcagacacctgcttgaaaatgcgaagaagcaccatgtggaggtggtgggtgtgagttttcacattggcagtggctgtcctgaccctcaggcctatgctcagtccatcgcagacgcccggctcgtgtttgaaatgggcaccgagctgggtcacaagatgcacgttctggaccttggtggtggcttccctggcacagaaggggccaaagtgagatttgaagagattgcttccgtgatcaactcagccttggacctgtacttcccagagggctgtggcgtggacatctttgctgagctggggcgctactacgtgacctcggccttcactgtggcagtcagcatcattgccaagaaggaggttctgctagaccagcctggcagggaggaggaaaatggttccacctccaagaccatcgtgtaccaccttgatgagggcgtgtatgggatcttcaactcagtcctgtttgacaacatctgccctacccccatcctgcagaagaaaccatccacggagcagcccctgtacagcagcagcctgtggggcccggcggttgatggctgtgattgcgtggctgagggcctgtggctgccgcaactacacgtaggggactggctggtctttgacaacatgggcgcctacactgtgggcatgggttcccccttttgggggacccaggcctgccacatcacctatgccatgtcccgggtggcctgggaagcgctgcgaaggcagctgatggctgcagaacaggaggatgacgtggagggtgtgtgcaagcctctgtcctgcggctgggagatcacagacaccctgtgcgtgggccctgtcttcaccccagcgagcatcatgtgagtgggcctcgttccccccggagaatcccagcggggcctcagagatgcatctgggagaggtggggaagatggcaggcaagggtacccttggccaggactctggtgcccaccctgccacccccgcgctccacctgcagtgtttctgccctgtaaataggaccagtcttacactcgctgtagttcaagtatgcaacataaatcctgttccttccagctgtgtctgcctcctctgcagtgcaaggggcctggtcagccaggtgtgggggtgttcttggggtctcctttggtctccttcccacctttgtaaatataatgcaaataaataaatatttaggtttttaaaaactgaaaaggaatc

SEQ ID NO: 34332 - DNA, 1600 bp, Homo sapiens
ggcggggcctgggcggggttatataagccagcggcgggcggaaggcggggcgtgggggtctgtggctgctgggctggcggggcgcaggccgcgggacccgagcccggggaagcgagagagcggaggcgccgaggatccgattcactccctggggagacctatgggccgaagccgtgtaaatgcgttttaagcagaggcctcggctccgcaactgccactcctcctcggggtgttgcacaagtttcgaggtcaccggcgaccccccctagcagcgcgcctggctctggcccccgcgaaggaggacggagtttggatggttctgtgcattgctaccgatgactcccactccctgagctgcctgagcctaaagtttggagtgtcactgaaatcctgcagacacctgcttgaaaatgcgaagaagcaccatgtggaggtggtgggtgtgagttttcacattggcagtggctgtcctgaccctcaggcctatgctcagtccatcgcagacgcccggctcgtgtttgaaatgggcaccgagctgggtcacaagatgcacgttctggaccttggtggtggcttccctggcacagaaggggccaaagtgagatttgaagagattgcttccgtgatcaactcagccttggacctgtacttcccagagggctgtggcgtggacatctttgctgagctggggcgctactacgtgacctcggccttcactgtggcagtcagcatcattgccaagaaggaggttctgctagaccagcctggcagggaggaggaaaatggttccacctccaagaccatcgtgtaccaccttgatgagggcgtgtatgggatcttcaactcagtcctgtttgacaacatctgccctacccccatcctgcagaagaaaccatccacggagcagcccctgtacagcagcagcctgtggggcccggcggttgatggctgtgattgcgtggctgagggcctgtggctgccgcaactacacgtaggggactggctggtctttgacaacatgggcgcctacactgtgggcatgggttcccccttttgggggacccaggcctgccacatcacctatgccatgtcccgggtggcctgggaagcgctgcgaaggcagctgatggctgcagaacaggaggatgacgtggagggtgtgtgcaagcctctgtcctgcggctgggagatcacagacaccctgtgcgtgggccctgtcttcaccccagcgagcatcatgtgagtgggcctcgttccccccggagaatcccagcggggcctcagagatgcatctgggagaggtggggaagatggcaggcaagggtacccttggccaggactctggtgcccaccctgccacccccgcgctccacctgcagtgtttctgccctgtaaataggaccagtcttacactcgctgtagttcaagtatgcaacataaatcctgttccttccagctgtgtctgcctcctctgcagtgcaaggggcctggtcagccaggtgtgggggtgttcttggggtctcctttggtctccttcccacctttgtaaatataatgcaaataaataaatatttaggtttttaaaaactgaaaaggaatc

SEQ ID NO: 34333 - DNA, 1510 bp, Homo sapiens
ggcggggcctgggcggggttatataagccagcggcgggcggaaggcggggcgtgggggtctgtggctgctgggctggcggggcgcaggccgcgggacccgagcccggggaagcgagagagcggaggcgccgaggatccgattcactccctggggagacctatgggccgaagccgtgtaaatgcgttttaagcagaggcctcggctccgcaactgccactcctcctcggggtgttgcacaagtttcgaggtcaccggcgaccccccctagcagcgcgcctggctctggcccccgcgaaggaggacggagtttgtgtgttgcatactttctaaggcggcggctgcagcagcggctccatccagcccgtcagctcctcctgcaaggcatggctggctacctgagtgaatcggactttgtgatggtggaggagggcttcagtacccgagacctgctgaaggaactcactctgggggcctcacaggccaccacggacgaggtagctgccttcttcgtggctgacctgggtgccatagtgaggaagcacttttgctttctgaagtgcctgccacgagtccggcccttttatgctgtcaagtgcaacagcagcccaggtgtgctgaaggttctggcccagctggggctgggctttagctgtgccaacaaggcagagatggagttggtccagcatattggaatccctgccagtaagatcatctgcgccaacccctgtaagcaaattgcacagatcaaatatgctgccaagcatgggatccagctgctgagctttgacaatgagatggagctggcaaaggtggtaaagagccaccccagtgccaaggtttgtccagcagaggggcactgcgtgtctcatcaggatggttctgtgcattgctaccgatgactcccactccctgagctgcctgagcctaaagtttggagtgtcactgaaatcctgcagacacctgcttgaaaatgcgaagaagcaccatgtggaggtggtgggtgtgagttttcacattggcagtggctgtcctgaccctcaggcctatgctcagtccatcgcagacgcccggctcgtgtttgaaatgggcaccgagctgggtcacaagatgcacgttctggaccttggtggtggcttccctggcacagaaggggccaaagtgagatttgaagagattgcttccgtgatcaactcagccttggacctgtacttcccagagggctgtggcgtggacatctttgctgagctggggcgctactacgtgacctcggccttcactgtggcagtcagcatcattgccaagaaggaggttctgctagaccagcctggcagggaggaggaaaatggttccacctccaagaccatcgtgtaccaccttgatgagggcgtgtatgggatcttcaactcagtcctgtttgacaacatctgccctacccccatcctgcagaagtctaagaaccactcaccctgctacatgtctctagagtccattcatttcattgccgtgtag

SEQ ID NO: 34334 - DNA, 1182 bp, Homo sapiens
  misc_feature (1140)..(1140): n is a, c, g, or t
  misc_feature (1146)..(1146): n is a, c, g, or t
ggcggggcctgggcggggttatataagccagcggcgggcggaaggcggggcgtgggggtctgtggctgctgggctggcggggcgcaggccgcgggacccgagcccggggaagcgagagagcggaggcgccgaggatccgattcactccctggggagacctatgggccgaagccgtgtaaatgcgttttaagcagaggcctcggctccgcaactgccactcctcctcggggtgttgcacaagtttcgaggtcaccggcgaccccccctagcagcgcgcctggctctggcccccgcgaaggaggacggagtttgtgtgttgcatactttctaaggcggcggctgcagcagcggctccatccagcccgtcagctcctcctgcaaggcatggctggctacctgagtgaatcggactttgtgatggtggaggagggcttcagtacccgagacctgctgaaggaactcactctgggggcctcacaggccaccacggacgaggtagctgccttcttcgtggctgacctgggtgccatagtgaggaagcacttttgctttctgaagtgcctgccacgagtccggcccttttatgctgtcaagtgcaacagcagcccaggtgtgctgaaggttctggcccagctggggctgggctttagctgtgccaacaaggcagagatggagttggtccagcatattggaatccctgccagtaagatcatctgcgccaacccctgtaagcaaattgcacagatcaaatatgctgccaagcatgggatccagctgctgagctttgacaatgagatggagctggcaaaggtggtaaagagccaccccagtgccaagatggttctgtgcattgctaccgatgactcccactccctgagctgcctgagcctaaagtttggagtgtcactgaaatcctgcagacacctgcttgaaaatgcgaagaagcaccatgtggaggtggtgggtgtgagttttcacattggcagtggctgtcctgaccctcaggcctatgctcagtccatcgcagacgcccggctcgtgtttgaaatgggcaccgagctgggtcacaagatgcacgttctggaccttggtggtggcttccctggcacagaaggggccaaagtgagatttgaagagatngcttcngtgatcaagctcagactctccgggatcctctagact

SEQ ID NO: 34335 - DNA, 1412 bp, Homo sapiens
ggcggggcctgggcggggttatataagccagcggcgggcggaaggcggggcgtgggggtctgtggctgctgggctggcggggcgcaggccgcgggacccgagcccggggaagcgagagagcggaggcgccgaggatccgattcactccctggggagacctatgggccgaagccgtgtaaatgcgttttaagcagaggcctcggctccgcaactgccactcctcctcggggtgttgcacaagtttcgaggtcaccggcgaccccccctagcagcgcgcctggctctggcccccgcgaaggaggacggagtttgtgtgttgcatactttctaaggcggcggctgcagcagcggctccatccagcccgtcagctcctcctgcaaggcatggctggctacctgagtgaatcggactttgtgatggtggaggagggcttcagtacccgagacctgctgaaggaactcactctgggggcctcacaggccaccacggacgaggtagctgccttcttcgtggctgacctgggtgccatagtgaggaagcacttttgctttctgaagtgcctgccacgagtccggcccttttatgctgtcaagtgcaacagcagcccaggtgtgctgaaggttctggcccagctggggctgggctttagctgtgccaacaaggcagagatggagttggtccagcatattggaatccctgccagtaagatcatctgcgccaacccctgtaagcaaattgcacagatcaaatatgctgccaagcatgggatccagctgctgagctttgacaatgagatggagctggcaaaggtggtaaagagccaccccagtgccaagatggttctgtgcattgctaccgatgactcccactccctgagctgcctgagcctaaagtttggagtgtcactgaaatcctgcagacacctgcttgaaaatgcgaagaagcaccatgtggaggtggtgggtgtgagttttcacattggcagtggctgtcctgaccctcaggcctatgctcagtccatcgcagacgcccggctcgtgtttgaaatgggcaccgagctgggtcacaagatgcacgttctggaccttggtggtggcttccctggcacagaaggggccaaagtgagatttgaagagattgcttccgtgatcaactcagccttggacctgtacttcccagagggctgtggcgtggacatctttgctgagctggggcgctactacgtgacctcggccttcactgtggcagtcagcatcattgccaagaaggaggttctgctagaccagcctggcagggagggtaggtgccaggtgggcagtggagccctgttctcccctgaagcttcagatagtggttggctgagcaggatctggttttagacccagtggcagaggatgggggaatctggaga

SEQ ID NO: 34336 - DNA, 999 bp, Homo sapiens
ggcggggcctgggcggggttatataagccagcggcgggcggaaggcggggcgtgggggtctgtggctgctgggctggcggggcgcaggccgcgggacccgagcccggggaagcgagagagcggaggcgccgaggatccgattcactccctggggagacctatgggccgaagccgtgtaaatgcgttttaagcagaggcctcggctccgcaactgccactcctcctcggggtgttgcacaagtttcgaggtcaccggcgaccccccctagcagcgcgcctggctctggcccccgcgaaggaggacggagtttgtgtgttgcatactttctaaggcggcggctgcagcagcggctccatccagcccgtcagctcctcctgcaaggcatggctggctacctgagtgaatcggactttgtgatggtggaggagggcttcagtacccgagacctgctgaaggaactcactctgggggcctcacaggccaccacggacgaggtagctgccttcttcgtggctgacctgggtgccatagtgaggaagcacttttgctttctgaagtgcctgccacgagtccggcccttttatgctgtcaagtgcaacagcagcccaggtgtgctgaaggttctggcccagctggggctgggctttagctgtgccaacaagattgcttccgtgatcaactcagccttggacctgtacttcccagagggctgtggcgtggacatctttgctgagctggggcgctactacgtgacctcggccttcactgtggcagtcagcatcattgccaagaaggaggttctgctagaccagcctggcagggaggaggaaaatggttccacctccaagaccatcgtgtaccaccttgatgagggcgtgtatgggatcttcaactcagtcctgtttgacaacatctgccctacccccatcctgcagaagtctaagaaccactcaccctgctacatgtctctagagtccattcatttcattgccgtgtag

SEQ ID NO: 34337 - DNA, 372 bp, Homo sapiens
acaagcacgaggctctctacccagctctgtccccctcctaccttcttggccagctgtccacagttatcagctggggccttagcagctgccaaatccttcttccggaaatcaaagcagctttcaagaaatagacttggagctgtagcaagtcttcagcataaagcccacatttcaaacacataattgtctccccattctcctcctaccagattgcttccgtgatcaactcagccttggacctgtacttcccagagggctgtggcgtggacatctttgctgagctggggcgctactacgtgacctcggccttcactgtggcagtcagcatcattgccaagaaggaggttctgctagaccagcctggcagggagg

SEQ ID NO: 34338 - DNA, 877 bp, Homo sapiens
tcctttcctgctgccccctctccctcaccgcccacatctaggcattaccaagctctgtgaattctgcctccttaaataagcctccagtgtgcttatgtggaacctcgctttctagttcagtcttcctctctccaaaggccccctgatctcccggtctcatgccaccccctccaaaggtatcatagtcctgttcaaaatctgaatttggcaattctccactgcctacaggatcaagtcagagcttccctgcctccatagccccattcccagctttccccacagtatatattatgctccttcggagctgaatgactcaatttgcatttcccaatgatgctgtgtgcccaatgatgctattaccatgcctttgcccaggctgttccttctgcctgcagcatccttctctcagcctctcccctctttacccctttctagtcattccttgcttctcatcagtgttgcctttcctgatcgccccaggcagattttctattttctttctccatgcccctgcattgcaccttgtagaaactgccatctaacatctgctgaatggacttgtaagtacttaaggggttccttttcttccagacccaagctccttcagaacaacagtactgtttggtcatctctgtcccttagcataacgtttggcaccaagtgggcatgagtaaaaaagtgttgcatgaaagggaaactgagtcccagggaagcaactctggaagggtcccttccacatttaagtaatgtggtctcacccacagcctcatacatgtttggcctttagcacatctacaatgaacagttgtccatagggataggttgcagtgtcagtgggactagcttaaggcttcattgagcacctgtgtttggaagg

SEQ ID NO: 34339 - DNA, 718 bp, Homo sapiens
tgaaccctcccctcctgcagaggaaaatggttccacctccaagaccatcgtgtaccaccttgatgagggcgtgtatgggatcttcaactcagtcctgtttgacaacatctgccctacccccatcctgcagaaggtgagcttaccccacgtgggcctgttttcagttgtgtgtgtgtatttcaataacatttgttgtgtttttatctaatttttaaaaagtcaaacatatttattgtcgataatagacaacaaggatgacgaaggttatcacccataatcccaccacactctttgagcattacatattttaaaaaatgccttatacttttttcatgacattggaatcatattgttttgtaacctgctttttccatttatatggggtgtagctctttccatgccattaactgatctttgacaacatgcttttgtattttaaccaatctaactctagtggttggctatttggtttcctctttttgagcactgtgaatatatgttgaggtttcagctctgtggtaaattcctggaagtagaaacagttcatatacagtgggtttttctgtaataacaggggaacaggaatacataaaacattcctcctagcctgtggaacccagcccagggcctccagcaattttaatgggcatctttgagaggataaagaaaaccagacatcattttatcttcccctctccattgtgtcttcctatctctc

SEQ ID NO: 34340 - DNA, 1001 bp, Homo sapiens
  misc_feature (6)..(6): n is a, c, g, or t
  misc_feature (8)..(8): n is a, c, g, or t
  misc_feature (10)..(10): n is a, c, g, or t
  misc_feature (18)..(18): n is a, c, g, or t
  misc_feature (23)..(23): n is a, c, g, or t
cctcgncnanttcggcanaggtnagagagctgcagacttagacaggcactgagttctgggtcacaggagtaggacttctcaggatgtctctgaggaaacctttaatgatctgggcccagtacttgttccagcctctcctctagtggtagagagtttttttttctattcccactccttaaatacagttgattttcaacagccccgcccagcccccttcccctccccaaggcagggaggatttgttttacttccttcaacaatttaaggcctttgattccaggagagatagggagagaaagatccagataggggttgtgtgcttttccagcagggagctgccccctttccaaggaactccatctcaagagagggttttcttagtatctttcacagttgtttttttctggaacatgtggacaaggtctttggagacaagcctacaagtggatgcaagttctccttgtgtctgcaggtcacaggagttatgtattttctggttagcctgattctttaaatattttagctaaattctatttatttgcccagcagcgtctacttcaggtcagcaagttcttactttccatctgtctttggaggtgcctgcctttccttagattttaggttagtttgttgctctacaaccttagctaaatgatgaaagtattactttctaatattttattgttgtgaactcattgtgaggtgatctgaaacttaaataatgaaccactacactttgaatatagaattgaatcaggtattgaacccataaggactcaagcagattagccagtctgtccacctgttctattcatagcacttggccactgggggacactcgcaaactgagaagttgtataccttttctagagaagacacatcttgttgagactacttgtaagaagtgggaagaatgatttctgatctctttagagtagtgacatcacaaatagttggattttacaattcttgttttcaagtgcccttgatacatctttaaa

SEQ ID NO: 34341 - DNA, 363 bp, Homo sapiens
ggcctacctgcagggtcttactcttgttttctcatccctttctttttcatatacttcctgtgaaaagccatgattatgaatctgtgtttttatgagatggctaatcccagggttaccatgtgcagctgcacaggttgtgcactgcacaactccaggaagcactcttcaccctaggttacagaactgatgataccccatgtgttgtgcagtacattaaccatggtgcaacccctgacacatttatgatttgtacacactaaagattgagcaactttctttcgggattccttgaccgcattcgcttggtgtctttgggattaatgacgtgtccctaataaatgaatatttcagacatattatgca

SEQ ID NO: 34342 - DNA, 469 bp, Homo sapiens
ctttgctttctatgtatatggatatatgtgtaagatacatacattacatatatataaaactaggagctgctgtaccattgcatcctttccaaacactcccctttccatgtttgcaaaacttctgccttgtttattccattgcttttagttgattaaagtgggtggattagaaaagtatcttttcggccgggtgcggtggctcacgcctgtaatcccagctctttgggaggctgaggcaggtggatcacgaggtcaggagatcgagaccatcctggctaatatggtgaaaccccgtctctactaaaaatacaaaaaattagccaggcgtggtggcaggcgcctgtagtcccagctacttgggaggctgaggcaggagaatgacataaacccgggaggcggaagttgcagtgagctgagatcgcgccactgcactccagcctgggcgacagagcaagactccgtctcaaaa

SEQ ID NO: 34343 - DNA, 514 bp, Homo sapiens
tatggcctggttatacagactttagcaaagttctgctatgctaaaagtttctgacgaattcgcattttagaagttccctgtattttctgatgacagtgaactttttctcagtttttctgaactatgtcactttattttgggatattaaaacatgataaaagagtaaaatgtttctgactaaaattagttagagatgtatagtcagacagaccgacagacatatagacagtggcagaataatgtttatgcatgtgtatgtaatcaaaccagagttcgagcaattttaaacctaattatctcagagcctaatctaatttctgtttatttcattagctcttaatctttccagatatgataggatgaatgctatgtaatggattctttttaattatccggagacagtgaaaattagagctagagagcctagtcatcaagtttgcccgttggaatgggtaacttgaaagcctgtgtagaaaagccaggacattcagattcatctccctggcctcccagt

SEQ ID NO: 34344 - DNA, 253 bp, Homo sapiens
cggaggctgagggggagtgaagcagaggatgctggaatcaggagcccagaaactgagaggatggggttggactagaaggtctgtaggtgacagcaaccaagaggagcaaagagtggtataaggaggtagtacaggctacaagaggattccaatggtgtgaaagcagcaacgcagaccaaacagatgagggacaggcattgtaaagggcagagttttctttctttctgttttttttctcttttctaggtagaag

SEQ ID NO: 34345 - DNA, 2968 bp, Homo sapiens
ttttttttttttttttgaggaactgcattgccacaaagacacttgtcatcgctgctctgttaatttgaaaagaaaaagcaaaacccaggaaattggtattttacagtcacctgggggtgaatatcctttttgtttttttctatttaaaaattcctgctgccttccaagtcaagattcatcaggattcgctgaagatctgattcttaaaaagccttcgtcacattttaacgcatcgctgttagacacttttacaggctcacacagatgggctgagcagggacgagcaaaacctaacagaataatgggtttcagaaagttcatttgacgatttgaaggaactggattggatttacctttggcacaaatgcagattgcgggggatgggaaggtgaaaaatcaaaggttggaaggaaatatctgggaaggtagaaaaaggaaatttgagaattgattggctatagtgtgctgtcagcgggtggatgtcgtttttttcttctttttttccttttttttcttctgctacaggaagtgatttgcagtgctcaccgagcctttgttgagaagggtctcctctcagagtgagtcatgcttttgctgtgagcagccccaagcagctgggcgctccatcagaggcaactatgacttttgcaaagcaaacgtgcaaccccaagcagcggtctcccgggccggggctgcgcggcgccgctgtgctggcttttaacggtgggagggcaccatcctcttgctctgctctcgttctccagaaggctgtcccggggcccccactctccgtcccgctccggggacagtggctcgcctgctatgcgcggcagcccgcgccggggccggcaccagcagcgcccgggcggatgcagcgagcccacggaggggcatgcttccacgcaccaagtataaccgcttcaggaatgactcggtgacatcggtcgatgaccttctccacagcctgtcggtgagcggcggcggaggcaaggtttcggcggcgcgcgcgaccccggcggcggctccctacttggtgtccggcgaggcgctgcgcaaggcgcccgacgatgggcccggcagcctgggccacctgctccacaaggtgtcccacctgaaactctccagctcgggcctccgcggcctgtcgtcggccgcccgggagcgggcgggcgcgcggctctcgggcagctgcagcgcgcccagcctggccgccccggacggcagtgcgccctcggcgccccgcgccccggccatgagcgccgccaggaagggccggcccggcgacgagccgctgcccaggccccctcggggggcgccgcacgccagcgaccaggtgctggggcccggagtcacctacgtggtcaagtacttggggtgcattgaagttctgcgctcaatgaggtctcttgacttcagtacaagaacacaaattaccagggaagccatcagccgcgtctgtgaagctgtgcctggtgcgaagggagccttcaagaagagaaagcctccaagcaaaatgctgtccagcatcttgggaaagagcaacctccagtttgcgggaatgagcatctctctgaccatctccacggccagtctgaacctgcgaactccggactccaaacagatcatagcgaatcaccacatgcggtccatctccttcgcctctgggggagacccggacacaactgactatgttgcatatgtggctaaggaccctgttaatcgcagagcttgtcacattttggaatgctgtgatgggctggcccaggatgtcatcggctccatcggacaagcctttgagctccggtttaagcaatatttacagtgtcctaccaagattcccgctctccatgatcgaatgcagagtctggatgagccatggacggaagaggagggagatggctcagaccacccatactacaacagcatcccaagcaagatgcctcctccagggggctttcttgatactagactgaaacccagaccccatgctcctgacacagcccagtttgcaggaaaagagcagacttattaccagggaagacacttaggagacacttttggcgaagactggcagcaaacacctttaaggcaagggtcctcggacatctacagcacgccagaagggaaactgcacgtggcccccacgggagaagcacccacctacgtcaacactcagcagatcccaccacaggcctggccggctgcggtcagcagtgctgagagcagcccaaggaaagacctctttgacatgaaaccttttgaagatgctctcaagaaccagcccttggggcccgtgttaagcaaggcagcctccgtggagtgcatcagccctgtgtcacctagagccccagatgccaagatgctggaggaactgcaagccgagacttggtaccaaggagagatgagcaggaaggaggcagaggggctgctggagaaagacggagacttcctggtcaggaagagcaccaccaacccgggctcctttgtcctcacgggcatgcacaatggccaggccaagcacctgctgctcgtggacccagaaggcacgatccggacaaaggacagagtctttgacagtatcagccacctcatcaaccaccacctagaaagcagcctgcccattgtctctgcagggagtgagctgtgtctccagcagccagtggagaggaagcagtgacctggccagcactgctcccagcactgcgcaccaggtcaggaggacctggagtggactagaatcggggctgctggaactgggacagctgcctgtggctcagagccttcttcaaaagcttcaaaaggaaggcttcctttaaggtcaagtttcataaacttggttctgaatttctcatatgcatattaaaggtgtacatacctatacatcctgtacaaattatccctctatatttatattttttaagactaagaaagatgtaagactaatgttctgtgctgtatgtttttaatg

SEQ ID NO: 34346 - DNA, 2709 bp, Homo sapiens
ttttttttttttttttgaggaactgcattgccacaaagacacttgtcatcgctgctctgttaatttgaaaagaaaaagcaaaacccaggaaattggtattttacagtcacctgggggtgaatatcctttttgtttttttctatttaaaaattcctgctgccttccaagtcaagattcatcaggattcgctgaagatctgattcttaaaaagccttcgtcacattttaacgcatcgctgttagacacttttacaggctcacacagatgggctgagcagggacgagcaaaacctaacagaataatgggtttcagaaagttcatttgacgatttgaaggaactggattggatttacctttggcacaaatgcagattgcgggggatgggaaggtgaaaaatcaaaggttggaaggaaatatctgggaaggtagaaaaaggaaatttgagaattgattggctatagtgtgctgtcagcgggtggatgtcgtttttttcttctttttttccttttttttcttctgctacaggaagtgatttgcagtgctcaccgagcctttgttgagaagggtctcctctcagagtgagtcatgcttttgctgtgagcagccccaagcagctgggcgctccatcagaggcaactatgacttttgcaaagcaaacgtgcaaccccaagcagcggtctcccgggccggggctgcgcggcgccgctgtgctggcttttaacggtgggagggcaccatcctcttgctctgctctcgttctccagaaggctgtcccggggcccccactctccgtcccgctccggggacagtggctcgcctgctatgcgcggcagcccgcgccggggccggcaccagcagcgcccgggcggatgcagcgagcccacggaggggcatgcttccacgcaccaagtataaccgcttcaggaatgactcggtgacatcggtcgatgaccttctccacagcctgtcggtgagcggcggcggaggcaaggtttcggcggcgcgcgcgaccccggcggcggctccctacttggtgtccggcgaggcgctgcgcaaggcgcccgacgatgggcccggcagcctgggccacctgctccacaaggtgtcccacctgaaactctccagctcgggcctccgcggcctgtcgtcggccgcccgggagcgggcgggcgcgcggctctcgggcagctgcagcgcgcccagcctggccgccccggacggcagtgcgccctcggcgccccgcgccccggccatgagcgccgccaggaagggccggcccggcgacgagccgctgcccaggccccctcggggggcgccgcacgccagcgaccaggtgctggggcccggagtcacctacgtggtcaagtacttggggtgcattgaagttctgcgctcaatgaggtctcttgacttcagtacaagaacacaaattaccagggaagccatcagccgcgtctgtgaagctgtgcctggtgcgaagggagccttcaagaagagaaagcctccaagcaaaatgctgtccagcatcttgggaaagagcaacctccagtttgcgggaatgagcatctctctgaccatctccacggccagtctgaacctgcgaactccggactccaaacagatcatagcgaatcaccacatgcggtccatctccttcgcctctgggggagacccggacacaactgactatgttgcatatgtggctaaggaccctgttaatcgcagagcttgtcacattttggaatgctgtgatgggctggcccaggatgtcatcggctccatcggacaagcctttgagctccggtttaagcaatatttacagtgtcctaccaagattcccgctctccatgatcgaatgcagagtctggatgagccatggacggaagaggagggagatggctcagaccacccatactacaacagcatcccaagcaagatgcctcctccagggggctttcttgatactagactgaaacccagaccccatgctcctgacacagcccagtttgcaggaaaagagcagacttattaccagggaagacacttaggagacacttttggcgaagactggcagcaaacacctttaaggcaagggtcctcggacatctacagcacgccagaagggaaactgcacgtggcccccacgggagaagcacccacctacgtcaacactcagcagatcccaccacaggcctggccggctgcggtcagcagtgctgagagcagcccaaggaaagacctctttgacatgaaaccttttgaagatgctctcaagaaccagcccttggggcccgtgttaagcaaggcagcctccgtggagtgcatcagccctgtgtcacctagagccccagatgccaagatgctggaggaactgcaagccgagacttggtaccaaggagagatgagcaggaaggaggcagaggggctgctggagaaagacggagacttcctggtcaggaagagcaccaccaacccgggctcctttgtcctcacgggcatgcacaatggccaggccaagcacctgctgctcgtggacccagaaggcacgagaagtaactcctactgatgttggccatccctggcactacagctgtatctgaataatcccgtaggtttggctgaatttttcatcttcccgtcaagaaagacattcatctttacctggggcatagtccaagaattgctaagtttaataaatgcagttaaatc

SEQ ID NO: 34347 - DNA, 424 bp, Homo sapiens
aacgcagggacagacaactcctgtcatcaggccagagccaggagccaggagccagtggtcagggccccacacaagttttaaaacttttagaattatggcctaggctgaaagccttgacttttatgtcctttaaagtaaataaatacagaaactgagagcattttccttacaaacacatttctagtagacaaggaagtacaggctcctaggcttttaatatttatcttgaatgcttatctcgaaaagttgaatcactgaggattttgttctaaggctgtaaaatgtgatgatcagtaaatgaaacccccattgctaagtctcttgttttcccgtttagagaagtaactcctactgatgttggccatccctggcactacagctgtatctgaataatcccgtaggtttggctgaatttttcatcttc

SEQ ID NO: 34348 - DNA, 942 bp, Homo sapiens
  misc_feature (856)..(856): n is a, c, g, or t
  misc_feature (862)..(862): n is a, c, g, or t
cccaggaagctgtttatggccaaaatgatatacaccacaaagtattatctctgaacttcagtgaatgtcatactaaaattcgtcatgtggatgctcatgcaaccttgagtgatggagtagttgtccaggtcatgggtttgctgtctaacagtggacaaccagaaagaaagtttatgcaaaccttgttctggctcctgaaggatctgttccaaataaattttatgttcacaatgatatgtttcgttatgaagatgaagtgtttggtgattctgagcctgaacttgatgaagaatcagaagatgaagtagaagaggaacaagaagaaagacaaccatctcctgaacctgtgcaagaaaatgctaacagtggttactatgaagctcaccctgtgactaatggcatagaggagcctttggaagaatcctctcatgaacctgaacctgagccagaatctgaaacaaagactgaagagctgaaaccacaagtggaggagaagaacttagaagaactagaggagaaatctactactcctcctccggcagaacctgtttctctgccacaagaaccaccaaagccaagagtcgaagctaaaccagaagttcaatctcagccacctcgtgtgcgtgaacaacgacctagagaacgacctggttttcctcctagaggaccaagaccaggcagaggagatatggaacagaatgactctgacaaccgtagaataattcgctatccagatagtcatcaactttttgtggtaacttgccacatgatattggtgaaaatgagctaaggaattcttcatgagtttgaaacgtgtggaacttcgcatcaataccaggtgtgggggaagctccanttggtnggggttggggcctggaccggccaactctcttggcccgctttgtggggggcgcctgggggaaccgtcgccgtcgacccgcg

SEQ ID NO: 34349 - DNA, 644 bp, Homo sapiens
cccaggaagctgtttatggccaaaatgatatacaccacaaagtattatctctgaacttcagtgaatgtcatactaaaattcgtcatgtggatgctcatgcaaccttgagtgatggagtagttgtccaggtcatgggtttgctgtctaacagtggacaaccagaaagaaagtttatgcaaaccttgttctggctcctgaaggatctgttccaaataaattttatgttcacaatgatatgtttcgttatgaagatgaagtgtttggtgattctgagcctgaacttgatgaagaatcagaagatgaagtagaagaggaacaagaagaaagacaaccatctcctgaacctgtgcaagaaaatgctaacagtggttactatgaagctcaccctgtgactaatggcatagaggagcctttggaagaatcctctcatgaacctgaacctgagccagaatctgaaacaaagactgaagagctgaaaccacaagtggaggagaagaacttagaagaactagaggagaaatctactactcctcctccggcagaacctgtttctctgccacaagaaccaccaaaggctttctcctgggcttcagtgaccagtaaaaacctgcctcctagtggtactgtttcttcctctggaattc

SEQ ID NO: 34350 - DNA, 520 bp, Homo sapiens
agtgacagagtaggtgcttttaaaattttcttgaataatgaatgcgatatttggacgataatcactaaacccaacatacttattttcttattttattcatcaagctttatatgaagatgaaagattccctgacagaaatgagccattgatctagtgagacatatatttgtatgtatattctctctcttagtaactattaatatgtctcagatcttttgtagtgtgtattttatctacagtgtaatttttaaaaaatgcttttctattactaatatatgtagatcagtaattgaacagactaatgtgttattttatatttcatatatttgcacagtatcttatgaacagatttaaacctaatgattttactcattgatacttgtgtgggatttactatccagtccagtgcttatttgccaagagctgttcagcctatgcttgaaaccattctaatgaaggagaaccctcaggcagtttattctgcctttgggaggcctctgattattttaaaaaaaaaaag

SEQ ID NO: 34351 - DNA, 502 bp, Homo sapiens
gccctcatctgtggactgggggtactgtgaagattaagtgttaagacactaaagaaccctgggagggtgggacatgcgtaagcactggctcagcctcccactgtcgtgccgcttctgccagaccagtgcgcctgcagatctaacccagaggcatcaggagcagatgcaggggccacagggcagcagccacgatgaaccaccatctctttccaccgcttcgtgcctcgggcccctggcgtttcttttgtcctgccttcattggttgctgtgctctcacaggcctggatccaggctaccgaggctaggatgaggcctgtaaccccacactaccatgtggcaaacagccagaacaccgcaagagacgtaagtcaagccacactggctgggagctaattttgcattgttaaaaagcaggataacacagaaaatagaacggacaggaaagctttcacattgtgcaaatgtgaactggtgattagaaggttcatttcaatcagtttgc

SEQ ID NO: 34352 - DNA, 650 bp, Homo sapiens
gccctcatctgtggactgggggtactgtgaagattaagtgttaagacactaaagaaccctgggagggtgggacatgcgtaagcactggctcagcctcccactgtcgtgccgcttctgccagaccagtgcgcctgcagatctaacccagaggcatcaggagcagatgcaggggccacagggcagcagccacgatgaaccaccatctctttccaccgcttcgtgcctcgggcccctggcgtttcttttgtcctgccttcattggttgctgtgctctcacaggcctggatccaggctaccgaggctaggatgaggcctgtaaccccacactaccatgtggcaaacagccagaacaccgcaagagacgtaagtcaagccacactggctgggagctaattttgcattgttaaaaagcaggataacacagaaaatagaacggacaggaaagctttcacattgtgcaatttacttggatctggaagaaacattttaaatctacaaaattactgtcaaacccaataggcaggattgaaaaggagttagaaattataaacaaataaaccaacaaagtcgggggtaacaaccccaaccaaagatatcagaaactggatgaagatggcttaaaggcacattaaaaaaaaatccaaaaaaac

SEQ ID NO: 34353 - DNA, 422 bp, Homo sapiens
  misc_feature (3)..(5): n is a, c, g, or t
  misc_feature (10)..(10): n is a, c, g, or t
ttnnntatgntttacgcacctcatctggcaaagtagaattgtaatacctgctgtcatagacttcccaaaaagagagagtgcgttgagaggttggctttataattatatcataatggctggaaataaatgtaatgtcctctatacatttcctccttggaaaaatggggatttaggagggtaagaaaaatagttacatttagcagatgccctctccataaaactcttcacatttaattctcacagcattgactgtagattgatgtcataatctttagttcacagtatcagaaactgaggctcagtgagattacattgctgtatacattttagtggaaaaaagcttgagcctgcattcatactctgatatatctgactgtaagtgttcttcctattattctacccacatccaagtctgttcttct

SEQ ID NO: 34354 - DNA, 607 bp, Homo sapiens
acctcaggactgcagagagtttctaccatcaagaaggccctcaccagatgtggctttaaataaattttcaggtattttgttataagcaacagaaaataggctaagacaggtgccatgagtgagagtgaacctccagagtttatgatcatttgatacctaggagctgtgttggacttgacatagccaaaccttgatcagactgttgatggcctacatgtgatgtaggaaatatatgggacattgtgtgattgtctttaatcaaaccataaagctagaccacactgctttaggcctagacagaatttcctccaaagggaatatgttgccactgtcagattcaatgtatgaacaggaaatgaagacctaggaggcaggccttaccttgactatgaatgaagaaaaagtactcctttcagtatctggagctggtgaaaaatttggccttgaactccaccttgtggacagatgtggagatgctataaacacttccagtggttggaaggtgagctgtctgaagccaagtgaaggcagaaaaggaagacagacaggagagtcaacttggtaggagactctgggatgcgtctgtgcctgaatagttgtaattata

SEQ ID NO: 34355 - DNA, 405 bp, Homo sapiens
ttcctaatgatacaaattagggtggagaagggaaaagtgtcatcatggtgctgtttctgcagctgctccttctcttgttctgttaaagaggaagttgtcagcacccaacagtaacaattaagttcatgttagaagccactggttgaaatccatgtagaagacctttgcctaatttaacatggcagtgggagactggtatctggcagagaatgaaagaggatgcgttattgcaaagtgggaattttgagattatctaccaaacaatttgaaaaagtccctattggtctttgatgccccaagctcccatttttgcataagttttactttgttactattgtgcgtgtgtatgtatgtgtatacacttaagtgtaaatatctgacagctacgataaagaaaattgagaa

SEQ ID NO: 34356 - DNA, 292 bp, Homo sapiens
actctcaaaagaccctggagtacatcagaggtgagtacaatagcaatcttttcctctgtagaggacaggggaggagtcccttcatggctgcaaactctggatgagggctggggattgagggcttcccagagagcatcacaagaagttgtcctaccactcttaaaggcatcagaagcagttctgggattgcttggcgttggcaccacaagtgtccttcagccattcctggaagaggtcttcagttttcttcagcaccagaaactggccaaggacaacataggctttgtcaaag

SEQ ID NO: 34357 - DNA, 371 bp, Homo sapiens
acacacacacacgcatgcatgcacacaccatgcaggtgacttccccaggaactagtgccagcacccctgctgcagagggggatatcaaggctaaatggaagagaggggtgacttgcctgggagcacagggcaaagccaggacagcaaaccaggcctcctggtgctaccccaccagctgccctcacagggtggaaggtacagccatagtgggtgcctgcattgccctcccctcacctgggcccagccatgctaccccaagctcagccctgtgaccagctctcccagagctgaacattcgggctcaacccctatacctgagccttttttgctgcctccaaaacagcctcatctgcagttgcttgaaatagaaa

SEQ ID NO: 34358 - DNA, 402 bp, Homo sapiens
ctgaagactccagtttgggatgagaaaataggtccatgctaaagtcagaaaggatggaactagtgtgggcctttaaactcaaaactaaccagccaaagctcccttccaaggcagagcctcactttgaggagaaagtgctgggaatagaaacaaaatttagtaggacggagacagtagggacaaaggaaggagaaggtccagataaaatttagaagggatcatggttaaattcccatacacagttattattgaaaaaagggaataaggaatagaacttctctacagatagtgaaagtatatcaggccagacgtggtggctcatgtctgtaatcccagtgctttgggaggccaagatgggtggattgcttgagccaaggagttgagaccagcctgaacaacgtg

SEQ ID NO: 34359 - DNA, 791 bp, Homo sapiens
gttgttcatcatcttctgagaaatatgctcatcctaaacttctctaccataagagaacgaaaaaacatggctcaagcactcaattgacactgttttcagtctagaattttgctttgctttaatctaccccactctcagcataataacagataagatatgctgtggatgcacacacaagaagtggtaattctaatattgtgggcatttgggaataaactaaaaatataggctatacccagtaacaggcacgtagccaaataaagtcagagttttaaagataaaacataaacttggaacataaacatgcgcagcatggcccgaacctcattccagacggagatacagaggcagctaaaagatcactgcacaatactgccaagaataaactaattacaatagattgaaagagaaaatactagatcttttacttaattaatctgcttattgtactggatttttcccctctatcactggcttattctattattttaaatgaattgtgttttttgctttttgttcctttagtattttaaggtccatttactcatttgcaaaatgatgatactcgttggtcttaccaactttgctaaagataaggaaaatggtataaaccctccggtggaagggaagggagtatttagtcaaatgagaagtatccttggccaggcacagtggctcatgcctgtaataccagcactttgggaagccgaagtgggaggactgcttgaggccaggaactcgagagcagcctggacaacatagcaagacctcatctctactaaaaaaaaaaa

SEQ ID NO: 34360 - DNA, 384 bp, Homo sapiens
gatggaaactattgatgggtcattaacatttgaaacatattagtatattcagtaaaaatactgacaaaggacgcaaatctatgtcccccttgaaaaaaattatgcagccaggcatggtggttcacacctgtaatcccagtactttgggagaccgaggtgggaggatcacttgaggccaggagttcgagaccagcctggccaacatagtaaaaccccatctctactaaaaatacaaaaattagctgggtgtggtggcagacacctatagttccagctactgtggggctgaggcatgacatttgcttgaacccaggaggcagaggctgcagtgagctgagactgtactactccactccatcctgggccacagagcaagactgtctc

SEQ ID NO: 34361 - DNA, 234 bp, Homo sapiens
gcaaaagactatagctactgcttcagttccttcttccaaatgtcatatgaaatgcctcttaggggtctatactaacccagaactgtgcaggagagagaaatctgggaaacacagttccagcttagctaggttgacttgctataagtcaaccacacctagtctcactaagcccatttgtcatgtgtggcccactcagactgaaagaatctttgttggttcactgttttataaggg

SEQ ID NO: 34362 - DNA, 237 bp, Homo sapiens
acccttggacacccacactcttctcacaccctcacacacacactctgcaccactcgcctagccccggccacgctcatgtcaggattctgaagacctcgagcacacacagacacgcacctggtcacgtgcactttcacacatacacttggcaccagggtggcagcagcggaggtgactgagaagcctgcttttcacagagaatcagaacccagcgggggctttagccacaaaaaaaga

SEQ ID NO: 34363 - DNA, 224 bp, Homo sapiens
gtgtgaagaagggagtaatcttggagtcaaagagaagcatgtcaagtcccaaggcagggaagaaaatatcctgtttgtcatccctaaatagactagaaatatctattgcacagaattattctccaaatcagcaacttccaaacatcttctaggatggcaagaaagggtaaaaggagaaaccaaaagaacaaggtcctgaatttattacagtgcagaaggattag

SEQ ID NO: 34364 - DNA, 244 bp, Homo sapiens
ttgtagttaaccagtaagaaagagaccataatggagaaagaacacactgactgtgtttcacagactgttgccctcatctccacttgtgttaaagaaggtaaattagttcccctccagattaacttcagcgtcagctgtggtgctttcctgacacttcttaacatttgaacagtaccacattctgtccgttttatcgttgtctcttctcataccctgtatttgccaattctgtactcatgcccag

SEQ ID NO: 34365 - DNA, 372 bp, Homo sapiens
tgccaccatgcctagctaattcttgtattcttttccagaagacagggtcctaacctatattacgtggtctcaaactccctggactcaagtggttctccccacctcggcctccccaaaatgtcgggattgcaggcaagagccactgaacctggcctccatgttctttatacgtaaaattagagggtttaattagggcagcaattctctaacattaatggtcatcacaattacctggagtgctgttaaaacacagattactgggcgcagatttgataatttatgattcagtgggtctggagtggagccctagagtatgggcttctaacaatttcccaaatgatgctgatggtaactacaccctgagaactattc

SEQ ID NO: 34366 - DNA, 756 bp, Homo sapiens
tacgtattatataactgcaaatgggagtgcttagtactgtcagttttaaaaacagaaaacctctaaagctcttaccacgagcctttctagcaaggcagggcagtctgagaaaaactactctgagaagagaactaacagtggttataaaactgctttaaaatcattgccagaatgtgaagatactgaaaaagttttcttgtagatcggagaactgataagaaagaaacataaaagtgtccacatgacatggagtttctgtagaaggcaaaaatgaatcatggtacccattggtgattgggtggtgaagggcaccagaagagaaagcagaaaatttagggtcttaaaacaccaccaccaaaaaaagaataaatcaaaggactcataccctctcgccaccaccaaaaaaaaagaagaaagaaaaggaaaggaaattcagtaaagaaatgggactttggtgcattgtcaaaagaaggtaaccctgaattaagaatcttttaagctaatcctaatctacaaaatgaatggaatgaaactagaccattataaacttactagaagaaaacagatttgataacactttagttgatggtaccctctcccccagaaacaaccataaaacagaagaaactgacaacactgtagattgaattagtttgtctgttcagactacatctgggagtatagaaaaacaccttgaataagatactcaaatgttaaaaacaaatggacagaaaaccggtgttggggataaatcac

SEQ ID NO: 34367 - DNA, 5851 bp, Homo sapiens
ggcgcggaggaggaggcggcggcgtcggtggcggcggcgacggcggcgcggaggcgaaggcagcggcgggcagccgaagcagtggctctcggagggggaacaaagagcagcgactaaggcggcagaggagcggcggcggtggcggcgctgcagcagcgggcgggactggtatggtggttccacagggcagaccccgctgcactcacagggaggaggaggcggcagcggcggaggaaggcggcgcaccccgagaggcatgcccaaagaaaaatacgagccccctgaccctcggaggatgtatacaattatgtcttctgaggaagcagcaaatggaaagaaatcccactgggcagagcttgaaataagtggaaaagtaagaagcttaagcgcatctttgtggtcactaactcacctgacagctttgcatttgagtgacaattccctgtcccgaattccttcagacattgccaagcttcacaatctggtgtatttggacctgtcatctaataaaattcgtagcttacccgcagaactcggaaacatggtatcactcagggagctccatttaaataacaacctgttacgagttctaccttttgagctgggaaaactgtttcagttgcagactttaggcctgaaaggaaatccccttacccaggatatattgaacctttatcaggaaccagatggaacaagacggctgctgaactatttgcttgataatttgtcaggtactgcaaaaagaattacaacagaacaaccacctccaaggtcttggattatgttacaagaaccagataggacaaggccaactgccttgttttctgtcatgtgctataatgttctttgtgataaatatgcgacccggcagttatacggctactgtccatcatgggcgctaaactgggactacaggaaaaaggccattattcaagaaatcttgagctgcaatgctgatatcgtaagtcttcaggaggttgaaacggaacagtattacagtttttttctggtagagctgaaagaacgtggctataatggattcttcagtcctaagtctagagctaggacaatgtcagaacaagaaaggaaacatgttgatggctgtgcaatattcttcaagacagaaaaatttactttggttcagaaacacactgttgaatttaatcagctagccatggcaaattctgaggggtctgaagctatgctgaacagagtcatgacaaaagataacattggggttgcagtactgctagaacttcggaaggaatcgattgaaatgccgtctggaaagccacatcttggaacagaaaaacaacttattcttgtggctaacgcccacatgcattgggaccctgaatactctgatgtgaagttggtacaaactatgatgttcctctcagaagtgaagaacattattgataaagcctctcgcaacctcaaatccagtgttttgggagaatttggaactattccacttgtgttatgtgcagatcttaattctttgccagactctggtgttgtagaatatttgagcacaggtggagtagaaacaaatcacaaagactttaaggagttgaggtataatgaaagtctcacaaacttcagctgtcatgggaagaatggaaccaccaatggaaggatcactcatggtttcaagttacagagtgcctatgagagtggcctgatgccttacacgaattacacatttgatttcaagggtataatagactacattttctattctaaacctcagctgaacaccttaggcatcctgggccctctggaccaccactggctggttgagaataacatcagtggctgcccgcaccccctcatcccctctgaccacttctcactttttgcacaactggagctcttactgcctttcctgccccaagtcaacggcatccaccttcctggcaggaggtagtcaagcaccttcagaggacagccttgattcacttgtaaacttgtgaaaatctgaacataggggagtgaggtatggccactgaggatttttgcttgcttaagaatgatttggactttcaatctgattatttgataaggatatagtatgaaagccaggtgctagcaacagacaaattctgagcccaatatgctttatactgctagacagggattggtgtgtttgcacctgtctttcatttgtcataagagattttcctatttcttctacccaatagaatattttcatgcctggaaataggaaaatgtgtgaacagcgtattctcttcacacagaaatctgtagcactgcttttttgaggccagtagcaacatccagagatcattcttccatactttactccctcctttttcagacttgtttgtaaagtacagaatctgaatttagcctttatgattgtatatgatccacagaagacctgatttatgaaattttgtactaaaatcatttggaaatgattgtattgtaaactgaggctaaatttttttttaaacctgtttcatgtgttataaaggccagcttgtaaaagaagctgcaacagactttctctgctcatgatttgcactcttagggttttgttagcccttttgtactactttctttttaaattgagaacatggttctttacatataaatctgcttcaaccttaggatgttttcagaccagaggcaacttattcatgaatttttatgaaaactatctactaggacagataagctgaacagtgatgatctgtagacatttatggactgaatgtaatggttgatatatgtacattctgatatttttaaatctttaactttttaaagttaaaaacctacagctgcttaggtccagcttcttaactctttttgagacacttcctgtcctatctccactgtgcctgcctaaatttgttctcaccaagcactgcctgtgcatgcagagaaaatctgtgcatcctcttttatatttttaaaatactgtttaacatttgtgagaattttatgaaaatgcttttgtatgagctgtggctttttcccattgtgaagcattgaatatcacattttggaacatgttatagggtgagtccctggatctttgctcaccagatccaagcactgcttctcggtgtcattgcagtgtgctgcttgtcacccagaatactactatcatgtgaattctttttgtcgtcagtgtcttttccttagtctttttgttgttgttgttgttgttgttttaatcattccttttttaagaagaagtaattttccatttatgaagcagtatgaattagatgtattttcaaaacaggtccctaagacaattcttcagatcatttttaaaatgactaagtcattttagtatgtcaagcaagataaaaattacatcataccgtctattttgcccatagtgccatttagagatgaaaaccagctttaactttgcaaagtgaacatgtacatggtctgctctcatttattcattcttctctcaaaagtcaaatgaatgcagagggagcttggtcaaactgcttttgtttcaactgcaggcaggggagcaaaaggacgccatgtgagcattaggaaaaaaaatactcactcttactaacaatttttatacagaaaatgagtcattttggaaatgattcttatgttttttttttttctccttttagaaaattctccaaaaggttttgatgttgaatcttggtcttggacctgttttttcctttgagggttttttgttttttgttttttctaggatttcattgtgatgttttggttttgttttttgctttttgtttaagttgtgctgacaccaaacacatccagtttataatcagtacattggaaagctggtattgatgtagaaccagtgcataactttttatggggttttgttattggtttttttttgtaaagtgtgaataaaaggtatgtttactcatttttcctgaacactgtgttggtaatgtgcatcatgacaatttccagtgaaggtgagctggagctggttggactaatgagactgaggaagcagcttttcctacgatctgcattatgtaatcacaggtccagagagctttatggaagcgggagaggaggagcacttactcatgttgtatttgttaatggaggatgtcatcttttcatagatgctggaactagagtgcacttgttagatgctaaaggtttgagctttacacaaaatgtcttcatctgtatttgttattgtctacaatatatttgaatttggggcagcatattaagatgtaatggcctgttatgtcttgaaaatacttgttttgcctcttccaggcatactgcattctgtggatcagtttgaacagcttctccaccttatttggacagtgataaattgaaccaagagtgtagatttacaagtgtaaccttcaaaagaggaagaactatttggggtctgtaggtaatgaacagtcacaccaaaatagactatgatgcttttgttaagaaaggtttcatgttttagatattttccgtgtcctaaataattttcaataatctataatccctaaaatgcaataaaaactagtatgttttcacggtgtatattttttttcaaaaattctgtaacaaatatatttaatgtgttgccataatgtcatttcagtatttttgctggataaatccattttagaaatgtcttacaaaaagtttagggcatgttttctgttttaaagaccagaagtttgaaggcacccaaatccttgtcgccaatctcctgaagtacagctttaccatattagtggtcattatttatgctttgagagtttcaatattgttcgtcaagttaacttatggcataatttaagctaaagttgtagaaatgaattgttgagtgcaactttcatagtcccaaagataggcagagaacatctccagaaatgtgtgtgtgtgtgtgtgtgtgtgtgtgtgtgtgtgtgtttaatatgatttagtgacaaccaggaaaacttacttgggattattagcactttcaaacttagggacattattaaattggatggaatgcacttctaaatgtttaaattaaaatttcaaagctctttcgagattcaggttctcaataataatattcaagttttagagtttcactttgtactatttaaatttatggaactagtttccatactgacttgtaaggttttggggtcatatataaggactaaagccaagctaggcaaaacaatgacagcaccgttttttcagtgaagctctcagaatgtccagtacagatgttgcagataattccaagaactccttcagcaggtgttcttcaccattcgtaaacagtattttaagatgttcactttgctcttctttttggttacatacattttaataactggtatgttgaagtagtgtctaaaagtatctagtctttattcacagtacattatattgtgtgatgcactggactaactcttgtttaccattcatgtaacaaaacccagcacattatctgcactataagctcaaagaatgtcacatccgcccagacagctctttgatgagggtgatgggaactgaataaaccatacggactggcagtaacaagggcttttactgttctgttcagtggaaccttcttggtcaaattgtaattagctagcattatatttatatacagggtcttttttctttaccgatgtattttcctactcatagccaaccaataaattcagtatctgtttcaaatattttagaagtgtagtttgtatagctgtagtactgaggtttgaggaaaaataaatgttgatcagcagaccacgtattttgcagggtgactgtgacatgctatgcggaaatggtgtcttggcatgctttattggactgctgctgt

SEQ ID NO: 34368 - DNA, 5832 bp, Homo sapiens
ggcgcggaggaggaggcggcggcgtcggtggcggcggcgacggcggcgcggaggcgaaggcagcggcgggcagccgaagcagtggctctcggagggggaacaaagagcagcgactaaggcggcagaggagcggcggcggtggcggcgctgcagcagcgggcgggactggtatggtggttccacagggcagaccccgctgcactcacagggaggaggaggcggcagcggcggaggaaggcggcgcaccccgagaggcatgcccaaagaaaaatacgagccccctgaccctcggaggatgtatacaattatgtcttctgaggaagcagcaaatggaaagaaatcccactgggcagagcttgaaataagtggaaaagtaagaagcttaagcgcatctttgtggtcactaactcacctgacagctttgcatttgagtgacaattccctgtcccgaattccttcagacattgccaagcttcacaatctggtgtatttggacctgtcatctaataaaattcgtagcttacccgcagaactcggaaacatggtatcactcagggagctccatttaaataacaacctgttacgagttctaccttttgagctgggaaaactgtttcagttgcagactttaggcctgaaaggaaatccccttacccaggatatattgaacctttatcaggaaccagatggaacaagacggctgctgaactatttgcttgataatttgtcaggtactgcaaaaagaattacaacagaacaaccacctccaaggtcttggattatgttacaagaaccagataggacaaggccaactgccttgttttctgtcatgtgctataatgttctttgtgataaatatgcgacccggcagttatacggctactgtccatcatgggcgctaaactgggactacaggaaaaaggccattattcaagaaatcttgagctgcaatgctgatatcgtaagtcttcaggaggttgaaacggaacagtattacagtttttttctggtagagctgaaagaacgtggctataatggattcttcagtcctaagtctagagctaggacaatgtcagaacaagaaaggaaacatgttgatggctgtgcaatattcttcaagacagaaaaatttactttggttcagaaacacactgttgaatttaatcagctagccatggcaaattctgaggggtctgaagctatgctgaacagagtcatgacaaaagataacattggggttgcagtactgctagaacttcggaaggaatcgattgaaatgccgtctggaaagccacatcttggaacagaaaaacaacttattcttgtggctaacgcccacatgcattgggaccctgaatactctgatgtgaagttggtacaaactatgatgttcctctcagaagtgaagaacattattgataaagcctctcgcaacctcaaatccagtgttttgggagaatttggaactattccacttgtgttatgtgcagatcttaattctttgccagactctggtgttgtagaatatttgagcacaggtggagtagaaacaaatcacaaagactttaaggagttgaggtataatgaaagtctcacaaacttcagctgtcatgggaagaatggaaccaccaatggaaggatcactcatggtttcaagttacagagtgcctatgagagtggcctgatgccttacacgaattacacatttgatttcaagggtataatagactacattttctattctaaacctcagctgaacaccttaggcatcctgggccctctggaccaccactggctggttgagaataacatcagtggctgcccgcaccccctcatcccctctgaccacttctcactttttgcacaactggagctcttactgcctttcctgccccaagtcaacggcatccaccttcctggcaggaggtagtcaagcaccttcagaggacagccttgattcacttgtaaacttgtgaaaatctgaacataggggagtgaggtatggccactgaggatttttgcttgcttaagaatgatttggactttcaatctgattatttgataaggatatagtatgaaagccaggtgctagcaacagacaaattctgagcccaatatgctttatactgctagacagggattggtgtgtttgcacctgtctttcatttgtcataagagattttcctatttcttctacccaatagaatattttcatgcctggaaataggaaaatgtgtgaacagcgtattctcttcacacagaaatctgtagcactgcttttttgaggccagtagcaacatccagagatcattcttccatactttactccctcctttttcagacttgtttgtaaagtacagaatctgaatttagcctttatgattgtatatgatccacagaagacctgatttatgaaattttgtactaaaatcatttggaaatgattgtattgtaaactgaggctaaatttttttttaaacctgtttcatgtgttataaaggccagcttgtaaaagaagctgcaacagactttctctgctcatgatttgcactcttagggttttgttagcccttttgtactactttctttttaaattgagaacatggttctttacatataaatctgcttcaaccttaggatgttttcagaccagaggcaacttattcatgaatttttatgaaaactatctactaggacagataagctgaacagtgatgatctgtagacatttatggactgaatgtaatggttgatatatgtacattctgatatttttaaatctttaactttttaaagttaaaaacctacagctgcttaggtccagcttcttaactctttttgagacacttcctgtcctatctccactgtgcctgcctaaatttgttctcaccaagcactgcctgtgcatgcagagaaaatctgtgcatcctcttttatatttttaaaatactgtttaacatttgtgagaattttatgaaaatgcttttgtatgagctgtggctttttcccattgtgaagcattgaatatcacattttggaacatgttatagggtgagtccctggatctttgctcaccagatccaagcactgcttctcggtgtcattgcagtgtgctgcttgtcacccagaatactactatcatgtgaattctttttgtcgtcagtgtcttttccttagtctttttgttgttgttgttgttgttgttttaatcattccttttttaagaagaagtaattttccatttatgaagcagtatgaattagatgtattttcaaaacaggtccctaagacaattcttcagatcatttttaaaatgactaagtcattttagtatgtcaagcaagataaaaattacatcataccgtctattttgcccatagtgccatttagagatgaaaaccagctttaactttgcaaagtgaacatgtacatggtctgctctcatttattcattcttctctcaaaagtcaaatgaatgcagagggagcttggtcaaactgcttttgtttcaactgcaggcaggggagcaaaaggacgccatgtgagcattaggaaaaaaaatactcactcttactaacaatttttatacagaaaatgagtcattttggaaatgattcttatgttttttttttttctccttttagaaaattctccaaaaggttttgatgttgaatcttggtcttggacctgttttttcctttgagggttttttgttttttgttttttctaggatttcattgtgatgttttggttttgttttttgctttttgtttaagttgtgctgacaccaaacacatccagtttataatcagtacattggaaagctggtattgatgtagaaccagtgcataactttttatggggttttgttattggtttttttttgtaaagtgtgaataaaaggtatgtttactcatttttcctgaacactgtgttggtaatgtgcatcatgacaatttccagtgaaggtgagctggagctggttggactaatgagactgaggaagcagcttttcctacgatctgcattatgtaatcacaggtccagagagctttatggaagcgggagaggaggagcacttactcatgttgtatttgttaatggaggatgtcatcttttcatagatgctggaactagagtgcacttgttagatgctaaaggtttgagctttacacaaaatgtcttcatctgtatttgttattgtctacaatatatttgaatttggggcagcatattaagatgtaatggcctgttatgtcttgaaaatacttgttttgcctcttccaggcatactgcattctgtggatcagtttgaacagcttctccaccttatttggacagtgataaattgaaccaagagtgtagatttacaagtgtaaccttcaaaagaggaagaactatttggggtctgtaggtaatgaacagtcacaccaaaatagactatgatgcttttgttaagaaaggtttcatgttttagatattttccgtgtcctaaataattttcaataatctataatccctaaaatgcaataaaaactagtatgttttcacggtgtatattttttttcaaaaattctgtaacaaatatatttaatgtgttgccataatgtcatttcagtatttttgctggataaatccattttagaaatgtcttacaaaaagtttagggcatgttttctgttttaaagaccagaagtttgaaggcacccaaatccttgtcgccaatctcctgaagtacagctttaccatattagtggtcattatttatgctttgagagtttcaatattgttcgtcaagttaacttatggcataatttaagctaaagttgtagaaatgaattgttgagtgcaactttcatagtcccaaagataggcagagaacatctccagaaatgtgtgtgtgtgtgtgtgtgtgtgtgtgtgtgtgtgtgtttaatatgatttagtgacaaccaggaaaacttacttgggattattagcactttcaaacttagggacattattaaattggatggaatgcacttctaaatgtttaaattaaaatttcaaagctctttcgagattcaggttctcaataataatattcaagttttagagtttcactttgtactatttaaatttatggaactagtttccatactgacttgtaaggttttggggtcatatataaggactaaagccaagctaggcaaaacaatgacagcaccgttttttcagtgaagctctcagaatgtccagtacagatgttgcagataattccaagaactccttcagcaggtgttcttcaccattcgtaaacagtattttaagatgttcactttgctcttctttttggttacatacattttaataactggtatgttgaagtagtgtctaaaagtatctagtctttattcacagtacattatattgtgtgatgcactggactaactcttgtttaccattcatgtaacaaaacccagcacattatctgcactataagctcaaagaatgtcacatccgcccagacagctctttgatgagggtgatgggaactgaataaaccatacggactggcagtaacaagggcttttactgttctgttcagtggaaccttcttggtcaaattgtaattagctagcattatatttatatacagggtcttttttctttaccgatgtattttcctactcatagccaaccaataaattcagtatctgtttcaaatattttagaagtgtagtttgtatagctgtagtactgaggtttgaggaaaaataaatgttgatcagcagaccacgtatttagacgggccatatatgggaatggtgtaacctatggattctttgctgt

SEQ ID NO: 34369 - DNA, 5595 bp, Homo sapiens
gctttcatccttcccttcactgtttcctctgcccacccactctcccagtcacctgcctgccccgttcgtgttttgctcactcttgtttgttataaccatctgtattattgaaagtgttggcaaggcagggtcagatatagagcactgctagtgcatttctgattgacatcagcccattaacattatgttttgaatgtgtatatagaacatggtatgaatcatttttacttatatcagaaactgaaaaaacaatattttctatagtctgacatcttactagtaactataacatagttatggatgatctgataattttgatacattttaaaattttgaaacattttattacttagtttcattttacttatttcaaaaatatttccaggaaatccccttacccaggatatattgaacctttatcaggaaccagatggaacaagacggctgctgaactatttgcttgataatttgtcaggtactgcaaaaagaattacaacagaacaaccacctccaaggtcttggattatgttacaagaaccagataggacaaggccaactgccttgttttctgtcatgtgctataatgttctttgtgataaatatgcgacccggcagttatacggctactgtccatcatgggcgctaaactgggactacaggaaaaaggccattattcaagaaatcttgagctgcaatgctgatatcgtaagtcttcaggaggttgaaacggaacagtattacagtttttttctggtagagctgaaagaacgtggctataatggattcttcagtcctaagtctagagctaggacaatgtcagaacaagaaaggaaacatgttgatggctgtgcaatattcttcaagacagaaaaatttactttggttcagaaacacactgttgaatttaatcagctagccatggcaaattctgaggggtctgaagctatgctgaacagagtcatgacaaaagataacattggggttgcagtactgctagaacttcggaaggaatcgattgaaatgccgtctggaaagccacatcttggaacagaaaaacaacttattcttgtggctaacgcccacatgcattgggaccctgaatactctgatgtgaagttggtacaaactatgatgttcctctcagaagtgaagaacattattgataaagcctctcgcaacctcaaatccagtgttttgggagaatttggaactattccacttgtgttatgtgcagatcttaattctttgccagactctggtgttgtagaatatttgagcacaggtggagtagaaacaaatcacaaagactttaaggagttgaggtataatgaaagtctcacaaacttcagctgtcatgggaagaatggaaccaccaatggaaggatcactcatggtttcaagttacagagtgcctatgagagtggcctgatgccttacacgaattacacatttgatttcaagggtataatagactacattttctattctaaacctcagctgaacaccttaggcatcctgggccctctggaccaccactggctggttgagaataacatcagtggctgcccgcaccccctcatcccctctgaccacttctcactttttgcacaactggagctcttactgcctttcctgccccaagtcaacggcatccaccttcctggcaggaggtagtcaagcaccttcagaggacagccttgattcacttgtaaacttgtgaaaatctgaacataggggagtgaggtatggccactgaggatttttgcttgcttaagaatgatttggactttcaatctgattatttgataaggatatagtatgaaagccaggtgctagcaacagacaaattctgagcccaatatgctttatactgctagacagggattggtgtgtttgcacctgtctttcatttgtcataagagattttcctatttcttctacccaatagaatattttcatgcctggaaataggaaaatgtgtgaacagcgtattctcttcacacagaaatctgtagcactgcttttttgaggccagtagcaacatccagagatcattcttccatactttactccctcctttttcagacttgtttgtaaagtacagaatctgaatttagcctttatgattgtatatgatccacagaagacctgatttatgaaattttgtactaaaatcatttggaaatgattgtattgtaaactgaggctaaatttttttttaaacctgtttcatgtgttataaaggccagcttgtaaaagaagctgcaacagactttctctgctcatgatttgcactcttagggttttgttagcccttttgtactactttctttttaaattgagaacatggttctttacatataaatctgcttcaaccttaggatgttttcagaccagaggcaacttattcatgaatttttatgaaaactatctactaggacagataagctgaacagtgatgatctgtagacatttatggactgaatgtaatggttgatatatgtacattctgatatttttaaatctttaactttttaaagttaaaaacctacagctgcttaggtccagcttcttaactctttttgagacacttcctgtcctatctccactgtgcctgcctaaatttgttctcaccaagcactgcctgtgcatgcagagaaaatctgtgcatcctcttttatatttttaaaatactgtttaacatttgtgagaattttatgaaaatgcttttgtatgagctgtggctttttcccattgtgaagcattgaatatcacattttggaacatgttatagggtgagtccctggatctttgctcaccagatccaagcactgcttctcggtgtcattgcagtgtgctgcttgtcacccagaatactactatcatgtgaattctttttgtcgtcagtgtcttttccttagtctttttgttgttgttgttgttgttgttttaatcattccttttttaagaagaagtaattttccatttatgaagcagtatgaattagatgtattttcaaaacaggtccctaagacaattcttcagatcatttttaaaatgactaagtcattttagtatgtcaagcaagataaaaattacatcataccgtctattttgcccatagtgccatttagagatgaaaaccagctttaactttgcaaagtgaacatgtacatggtctgctctcatttattcattcttctctcaaaagtcaaatgaatgcagagggagcttggtcaaactgcttttgtttcaactgcaggcaggggagcaaaaggacgccatgtgagcattaggaaaaaaaatactcactcttactaacaatttttatacagaaaatgagtcattttggaaatgattcttatgttttttttttttctccttttagaaaattctccaaaaggttttgatgttgaatcttggtcttggacctgttttttcctttgagggttttttgttttttgttttttctaggatttcattgtgatgttttggttttgttttttgctttttgtttaagttgtgctgacaccaaacacatccagtttataatcagtacattggaaagctggtattgatgtagaaccagtgcataactttttatggggttttgttattggtttttttttgtaaagtgtgaataaaaggtatgtttactcatttttcctgaacactgtgttggtaatgtgcatcatgacaatttccagtgaaggtgagctggagctggttggactaatgagactgaggaagcagcttttcctacgatctgcattatgtaatcacaggtccagagagctttatggaagcgggagaggaggagcacttactcatgttgtatttgttaatggaggatgtcatcttttcatagatgctggaactagagtgcacttgttagatgctaaaggtttgagctttacacaaaatgtcttcatctgtatttgttattgtctacaatatatttgaatttggggcagcatattaagatgtaatggcctgttatgtcttgaaaatacttgttttgcctcttccaggcatactgcattctgtggatcagtttgaacagcttctccaccttatttggacagtgataaattgaaccaagagtgtagatttacaagtgtaaccttcaaaagaggaagaactatttggggtctgtaggtaatgaacagtcacaccaaaatagactatgatgcttttgttaagaaaggtttcatgttttagatattttccgtgtcctaaataattttcaataatctataatccctaaaatgcaataaaaactagtatgttttcacggtgtatattttttttcaaaaattctgtaacaaatatatttaatgtgttgccataatgtcatttcagtatttttgctggataaatccattttagaaatgtcttacaaaaagtttagggcatgttttctgttttaaagaccagaagtttgaaggcacccaaatccttgtcgccaatctcctgaagtacagctttaccatattagtggtcattatttatgctttgagagtttcaatattgttcgtcaagttaacttatggcataatttaagctaaagttgtagaaatgaattgttgagtgcaactttcatagtcccaaagataggcagagaacatctccagaaatgtgtgtgtgtgtgtgtgtgtgtgtgtgtgtgtgtgtgtttaatatgatttagtgacaaccaggaaaacttacttgggattattagcactttcaaacttagggacattattaaattggatggaatgcacttctaaatgtttaaattaaaatttcaaagctctttcgagattcaggttctcaataataatattcaagttttagagtttcactttgtactatttaaatttatggaactagtttccatactgacttgtaaggttttggggtcatatataaggactaaagccaagctaggcaaaacaatgacagcaccgttttttcagtgaagctctcagaatgtccagtacagatgttgcagataattccaagaactccttcagcaggtgttcttcaccattcgtaaacagtattttaagatgttcactttgctcttctttttggttacatacattttaataactggtatgttgaagtagtgtctaaaagtatctagtctttattcacagtacattatattgtgtgatgcactggactaactcttgtttaccattcatgtaacaaaacccagcacattatctgcactataagctcaaagaatgtcacatccgcccagacagctctttgatgagggtgatgggaactgaataaaccatacggactggcagtaacaagggcttttactgttctgttcagtggaaccttcttggtcaaattgtaattagctagcattatatttatatacagggtcttttttctttaccgatgtattttcctactcatagccaaccaataaattcagtatctgtttcaaatattttagaagtgtagtttgtatagctgtagtactgaggtttgaggaaaaataaatgttgatcagcagaccacgtattttgcagggtgactgtgacatgctatgcggaaatggtgtcttggcatgctttattggactgctgctgt

SEQ ID NO: 34370 - DNA, 4693 bp, Homo sapiens
ggcgcggaggaggaggcggcggcgtcggtggcggcggcgacggcggcgcggaggcgaaggcagcggcgggcagccgaagcagtggctctcggagggggaacaaagagcagcgactaaggcggcagaggagcggcggcggtggcggcgctgcagcagcgggcgggactggtatggtggttccacagggcagaccccgctgcactcacagggaggaggaggcggcagcggcggaggaaggcggcgcaccccgagaggcatgcccaaagaaaaatacgagccccctgaccctcggaggatgtatacaattatgtcttctgaggaagcagcaaatggaaagaaatcccactgggcagagcttgaaataagtggaaaagtaagaagcttaagcgcatctttgtggtcactaactcacctgacagctttgcatttgagtgacaattccctgtcccgaattccttcagacattgccaagcttcacaatctggtgtatttggacctgtcatctaataaaattcgtagcttacccgcagaactcggaaacatggtatcactcagggagctccatttaaataacaacctgttacgagttctaccttttgagctgggaaaactgtttcagttgcagactttaggcctgaaaggaaatccccttacccaggatatattgaacctttatcaggaaccagatggaacaagacggctgctgaactatttgcttgataatttgtcaggtactgcaaaaagaattacaacagaacaaccacctccaaggtcttggattatgttacaagaaccagataggacaaggccaactgccttgttttctgtcatgtgctataatgttctttgtgataaatatgcgacccggcagttatacggctactgtccatcatgggcgctaaactgggactacaggaaaaaggccattattcaagaaatcttgagctgcaatgctgatatcgtaagtcttcaggaggttgaaacggaacagtattacagtttttttctggtagagctgaaagaacgtggctataatggattcttcagtcctaagtctagagctaggacaatgtcagaacaagaaaggaaacatgttgatggctgtgcaatattcttcaagacagaaaaatttactttggttcagaaacacactgttgaatttaatcagctagccatggcaaattctgaggggtctgaagctatgctgaacagagtcatgacaaaagataacattggggttgcagtactgctagaacttcggaaggaatcgattgaaatgccgtctggaaagccacatcttggaacagaaaaacaacttattcttgtggctaacgcccacatgcattgggaccctgaatactctgatgtgaagttggtacaaactatgatgttcctctcagaagtgaagaacattattgataaagcctctcgcaacctcaaatccagtgttttgggagaatttggaactattccacttgtgttatgtgcagatcttaattctttgccagactctggtgttgtagaatatttgagcacaggtggagtagaaacaaatcacaaagactttaaggagttgaggtataatgaaagtctcacaaacttcagctgtcatgggaagaatggaaccaccaatggaaggatcactcatggtttcaagttacagagtgcctatgagagtggcctgatgccttacacgaattacacatttgatttcaagggtataatagactacattttctattctaaacctcagctgaacaccttaggcatcctgggccctctggaccaccactggctggttgagaataacatcagtggctgcccgcaccccctcatcccctctgaccacttctcactttttgcacaactggagctcttactgcctttcctgccccaagtcaacggcatccaccttcctggcaggaggtagtcaagcaccttcagaggacagccttgattcacttgtaaacttgtgaaaatctgaacataggggagtgaggtatggccactgaggatttttgcttgcttaagaatgatttggactttcaatctgattatttgataaggatatagtatgaaagccaggtgctagcaacagacaaattctgagcccaatatgctttatactgctagacagggattggtgtgtttgcacctgtctttcatttgtcataagagattttcctatttcttctacccaatagaatattttcatgcctggaaataggaaaatgtgtgaacagcgtattctcttcacacagaaatctgtagcactgcttttttgaggccagtagcaacatccagagatcattcttccatactttactccctcctttttcagacttgtttgtaaagtacagaatctgaatttagcctttatgattgtatatgatccacagaagacctgatttatgaaattttgtactaaaatcatttggaaatgattgtattgtaaactgaggctaaatttttttttaaacctgtttcatgtgttataaaggccagcttgtaaaagaagctgcaacagactttctctgctcatgatttgcactcttagggttttgttagcccttttgtactactttctttttaaattgagaacatggttctttacatataaatctgcttcaaccttaggatgttttcagaccagaggcaacttattcatgaatttttatgaaaactatctactaggacagataagctgaacagtgatgatctgtagacatttatggactgaatgtaatggttgatatatgtacattctgatatttttaaatctttaactttttaaagttaaaaacctacagctgcttaggtccagcttcttaactctttttgagacacttcctgtcctatctccactgtgcctgcctaaatttgttctcaccaagcactgcctgtgcatgcagagaaaatctgtgcatcctcttttatatttttaaaatactgtttaacatttgtgagaattttatgaaaatgcttttgtatgagctgtggctttttcccattgtgaagcattgaatatcacattttggaacatgttatagggtgagtccctggatctttgctcaccagatccaagcactgcttctcggtgtcattgcagtgtgctgcttgtcacccagaatactactatcatgtgaattctttttgtcgtcagtgtcttttccttagtctttttgttgttgttgttgttgttgttttaatcattccttttttaagaagaagtaattttccatttatgaagcagtatgaattagatgtattttcaaaacaggtccctaagacaattcttcagatcatttttaaaatgactaagtcattttagtatgtcaagcaagataaaaattacatcataccgtctattttgcccatagtgccatttagagatgaaaaccagctttaactttgcaaagtgaacatgtacatggtctgctctcatttattcattcttctctcaaaagtcaaatgaatgcagagggagcttggtcaaactgcttttgtttcaactgcaggcaggggagcaaaaggacgccatgtgagcattaggaaaaaaaatactcactcttactaacaatttttatacagaaaatgagtcattttggaaatgattcttatgttttttttttttctccttttagaaaattctccaaaaggttttgatgttgaatcttggtcttggacctgttttttcctttgagggttttttgttttttgttttttctaggatttcattgtgatgttttggttttgttttttgctttttgtttaagttgtgctgacaccaaacacatccagtttataatcagtacattggaaagctggtattgatgtagaaccagtgcataactttttatggggttttgttattggtttttttttgtaaagtgtgaataaaaggtatgtttactcatttttcctgaacactgtgttggtaatgtgcatcatgacaatttccagtgaaggtgagctggagctggttggactaatgagactgaggaagcagcttttcctacgatctgcattatgtaatcacaggtccagagagctttatggaagcgggagaggaggagcacttactcatgttgtatttgttaatggaggatgtcatcttttcatagatgctggaactagagtgcacttgttagatgctaaaggtttgagctttacacaaaatgtcttcatctgtatttgttattgtctacaatatatttgaatttggggcagcatattaagatgtaatggcctgttatgtcttgaaaatacttgttttgcctcttccaggcatactgcattctgtggatcagtttgaacagcttctccaccttatttggacagtgataaattgaaccaagagtgtagatttacaagtgtaaccttcaaaagaggaagaactatttggggtctgtaggtaatgaacagtcacaccaaaatagactatgatgcttttgttaagaaaggtttcatgttttagatattttccgtgtcctaaataattttcaataatctataatccctaaaatgcaataaaaactagtatgttttcacggtgtatattttttttcaaaaattctgtaacaaatatatttaatgtgttgccataaaaaaaaatatcaatataaattatcaacttttcttccctcatcccttctttcctttctccattcaatcttttactaacttatatagg

SEQ ID NO: 34371 - DNA, 5798 bp, Homo sapiens
ggcgcggaggaggaggcggcggcgtcggtggcggcggcgacggcggcgcggaggcgaaggcagcggcgggcagccgaagcagtggctctcggagggggaacaaagagcagcgactaaggcggcagaggagcggcggcggtggcggcgctgcagcagcgggcgggactggtatggtggttccacagggcagaccccgctgcactcacagggaggaggaggcggcagcggcggaggaaggcggcgcaccccgagaggcatgcccaaagaaaaatacgagccccctgaccctcggaggatgtatacaattatgtcttctgaggaagcagcaaatggaaagaaatcccactgggcagagcttgaaataagtggaaaagtaagaagcttaagcgcatctttgtggtcactaactcacctgacagctttgcatttgagtgacaattccctgtcccgaattccttcagacattgccaagcttcacaatctggtgtatttggacctgtcatctaataaaattcgtagcttacccgcagaactcggaaacatggtatcactcagggagctccatttaaataacaacctgttacgagttctaccttttgagctgggaaaactgtttcagttgcagactttaggcctgaaaggaaatccccttacccaggatatattgaacctttatcaggaaccagatggaacaagacggctgctgaactatttgcttgataatttgtcaggtactgcaaaaagaattacaacagaacaaccacctccaaggtcttggattatgttacaagaaccagataggacaaggccaactgccttgttttctgtcatgtgctataatgttctttgtgataaatatgcgacccggcagttatacggctactgtccatcatgggcgctaaactgggactacaggaaaaaggccattattcaagaaatcttgagctgcaatgctgatatcgtaagtcttcaggaggttgaaacggaacagtattacagtttttttctggtagagctgaaagaacgtggctataatggattcttcagtcctaagtctagagctaggacaatgtcagaacaagaaaggaaacatgttgatggctgtgcaatattcttcaagacagaaaaatttactttggttcagaaacacactgttgaatttaatcagctagccatggcaaattctgaggggtctgaagctatgctgaacagagtcatgacaaaagataacattggggttgcagtactgctagaacttcggaaggaatcgattgaaatgccgtctggaaagccacatcttggaacagaaaaacaacttattcttgtggctaacgcccacatgcattgggaccctgaatactctgatgtgaagttggtacaaactatgatgttcctctcagaagtgaagaacattattgataaagcctctcgcaacctcaaatccagtgttttgggagaatttggaactattccacttgtgttatgtgcagatcttaattctttgccagactctggtgttgtagaatatttgagcacaggtggagtagaaacaaatcacaaagactttaaggagttgaggtataatgaaagtctcacaaacttcagctgtcatgggaagaatggaaccaccaatggaaggatcactcatggtttcaagttacagagtgcctatgagagtggcctgatgccttacacgaattacacatttgatttcaagggtataatagactacattttctattctaaacctcagctgaacaccttaggcatcctgggccctctggaccaccactggctggttgagaataacatcagtggctgcccgcaccccctcatcccctctgaccacttctcactttttgcacaactggagctcttactgcctttcctgccccaagtcaacggcatccaccttcctggcaggaggtagtcaagcaccttcagaggacagccttgattcacttgtaaacttgtgaaaatctgaacataggggagtgaggtatggccactgaggatttttgcttgcttaagaatgatttggactttcaatctgattatttgataaggatatagtatgaaagccaggtgctagcaacagacaaattctgagcccaatatgctttatactgctagacagggattggtgtgtttgcacctgtctttcatttgtcataagagattttcctatttcttctacccaatagaatattttcatgcctggaaataggaaaatgtgtgaacagcgtattctcttcacacagaaatctgtagcactgcttttttgaggccagtagcaacatccagagatcattcttccatactttactccctcctttttcagacttgtttgtaaagtacagaatctgaatttagcctttatgattgtatatgatccacagaagacctgatttatgaaattttgtactaaaatcatttggaaatgattgtattgtaaactgaggctaaatttttttttaaacctgtttcatgtgttataaaggccagcttgtaaaagaagctgcaacagactttctctgctcatgatttgcactcttagggttttgttagcccttttgtactactttctttttaaattgagaacatggttctttacatataaatctgcttcaaccttaggatgttttcagaccagaggcaacttattcatgaatttttatgaaaactatctactaggacagataagctgaacagtgatgatctgtagacatttatggactgaatgtaatggttgatatatgtacattctgatatttttaaatctttaactttttaaagttaaaaacctacagctgcttaggtccagcttcttaactctttttgagacacttcctgtcctatctccactgtgcctgcctaaatttgttctcaccaagcactgcctgtgcatgcagagaaaatctgtgcatcctcttttatatttttaaaatactgtttaacatttgtgagaattttatgaaaatgcttttgtatgagctgtggctttttcccattgtgaagcattgaatatcacattttggaacatgttatagggtgagtccctggatctttgctcaccagatccaagcactgcttctcggtgtcattgcagtgtgctgcttgtcacccagaatactactatcatgtgaattctttttgtcgtcagtgtcttttccttagtctttttgttgttgttgttgttgttgttttaatcattccttttttaagaagaagtaattttccatttatgaagcagtatgaattagatgtattttcaaaacaggtccctaagacaattcttcagatcatttttaaaatgactaagtcattttagtatgtcaagcaagataaaaattacatcataccgtctattttgcccatagtgccatttagagatgaaaaccagctttaactttgcaaagtgaacatgtacatggtctgctctcatttattcattcttctctcaaaagtcaaatgaatgcagagggagcttggtcaaactgcttttgtttcaactgcaggcaggggagcaaaaggacgccatgtgagcattaggaaaaaaaatactcactcttactaacaatttttatacagaaaatgagtcattttggaaatgattcttatgttttttttttttctccttttagaaaattctccaaaaggttttgatgttgaatcttggtcttggacctgttttttcctttgagggttttttgttttttgttttttctaggatttcattgtgatgttttggttttgttttttgctttttgtttaagttgtgctgacaccaaacacatccagtttataatcagtacattggaaagctggtattgatgtagaaccagtgcataactttttatggggttttgttattggtttttttttgtaaagtgtgaataaaaatttccagtgaaggtgagctggagctggttggactaatgagactgaggaagcagcttttcctacgatctgcattatgtaatcacaggtccagagagctttatggaagcgggagaggaggagcacttactcatgttgtatttgttaatggaggatgtcatcttttcatagatgctggaactagagtgcacttgttagatgctaaaggtttgagctttacacaaaatgtcttcatctgtatttgttattgtctacaatatatttgaatttggggcagcatattaagatgtaatggcctgttatgtcttgaaaatacttgttttgcctcttccaggcatactgcattctgtggatcagtttgaacagcttctccaccttatttggacagtgataaattgaaccaagagtgtagatttacaagtgtaaccttcaaaagaggaagaactatttggggtctgtaggtaatgaacagtcacaccaaaatagactatgatgcttttgttaagaaaggtttcatgttttagatattttccgtgtcctaaataattttcaataatctataatccctaaaatgcaataaaaactagtatgttttcacggtgtatattttttttcaaaaattctgtaacaaatatatttaatgtgttgccataatgtcatttcagtatttttgctggataaatccattttagaaatgtcttacaaaaagtttagggcatgttttctgttttaaagaccagaagtttgaaggcacccaaatccttgtcgccaatctcctgaagtacagctttaccatattagtggtcattatttatgctttgagagtttcaatattgttcgtcaagttaacttatggcataatttaagctaaagttgtagaaatgaattgttgagtgcaactttcatagtcccaaagataggcagagaacatctccagaaatgtgtgtgtgtgtgtgtgtgtgtgtgtgtgtgtgtgtgtttaatatgatttagtgacaaccaggaaaacttacttgggattattagcactttcaaacttagggacattattaaattggatggaatgcacttctaaatgtttaaattaaaatttcaaagctctttcgagattcaggttctcaataataatattcaagttttagagtttcactttgtactatttaaatttatggaactagtttccatactgacttgtaaggttttggggtcatatataaggactaaagccaagctaggcaaaacaatgacagcaccgttttttcagtgaagctctcagaatgtccagtacagatgttgcagataattccaagaactccttcagcaggtgttcttcaccattcgtaaacagtattttaagatgttcactttgctcttctttttggttacatacattttaataactggtatgttgaagtagtgtctaaaagtatctagtctttattcacagtacattatattgtgtgatgcactggactaactcttgtttaccattcatgtaacaaaacccagcacattatctgcactataagctcaaagaatgtcacatccgcccagacagctctttgatgagggtgatgggaactgaataaaccatacggactggcagtaacaagggcttttactgttctgttcagtggaaccttcttggtcaaattgtaattagctagcattatatttatatacagggtcttttttctttaccgatgtattttcctactcatagccaaccaataaattcagtatctgtttcaaatattttagaagtgtagtttgtatagctgtagtactgaggtttgaggaaaaataaatgttgatcagcagaccacgtattttgcagggtgactgtgacatgctatgcggaaatggtgtcttggcatgctttattggactgctgctgt

SEQ ID NO: 34372 - DNA, 4525 bp, Homo sapiens
ggcgcggaggaggaggcggcggcgtcggtggcggcggcgacggcggcgcggaggcgaaggcagcggcgggcagccgaagcagtggctctcggagggggaacaaagagcagcgactaaggcggcagaggagcggcggcggtggcggcgctgcagcagcgggcgggactggtatggtggttccacagggcagaccccgctgcactcacagggaggaggaggcggcagcggcggaggaaggcggcgcaccccgagaggcatgcccaaagaaaaatacgagccccctgaccctcggaggatgtatacaattatgtcttctgaggaagcagcaaatggaaagaaatcccactgggcagagcttgaaataagtggaaaagtaagaagcttaagcgcatctttgtggtcactaactcacctgacagctttgcatttgagtgacaattccctgtcccgaattccttcagacattgccaagcttcacaatctggtgtatttggacctgtcatctaataaaattcgtagcttacccgcagaactcggaaacatggtatcactcagggagctccatttaaataacaacctgttacgagttctaccttttgagctgggaaaactgtttcagttgcagactttaggcctgaaaggaaatccccttacccaggatatattgaacctttatcaggaaccagatggaacaagacggctgctgaactatttgcttgataatttgtcaggtactgcaaaaagaattacaacagaacaaccacctccaaggtcttggattatgttacaagaaccagataggacaaggccaactgccttgttttctgtcatgtgctataatgttctttgtgataaatatgcgacccggcagttatacggctactgtccatcatgggcgctaaactgggactacaggaaaaaggccattattcaagaaatcttgagctgcaatgctgatatcgtaagtcttcaggaggttgaaacggaacagtattacagtttttttctggtagagctgaaagaacgtggctataatggattcttcagtcctaagtctagagctaggacaatgtcagaacaagaaaggaaacatgttgatggctgtgcaatattcttcaagacagaaaaatttactttggttcagaaacacactgttgaatttaatcagctagccatggcaaattctgaggggtctgaagctatgctgaacagagtcatgacaaaagataacattggggttgcagtactgctagaacttcggaaggaatcgattgaaatgccgtctggaaagccacatcttggaacagaaaaacaacttattcttgtggctaacgcccacatgcattgggaccctgaatactctgatgtgaagttggtacaaactatgatgttcctctcagaagtgaagaacattattgataaagcctctcgcaacctcaaatccagtgttttgggagaatttggaactattccacttgtgttatgtgcagatcttaattctttgccagactctggtgttgtagaatatttgagcacaggtggagtagaaacaaatcacaaagactttaaggagttgaggtataatgaaagtctcacaaacttcagctgtcatgggaagaatggaaccaccaatggaaggatcactcatggtttcaagttacagagtgcctatgagagtggcctgatgccttacacgaattacacatttgatttcaagggtataatagactacattttctattctaaacctcagctgaacaccttaggcatcctgggccctctggaccaccactggctggttgagaataacatcagtggctgcccgcaccccctcatcccctctgaccacttctcactttttgcacaactggagctcttactgcctttcctgccccaagtcaacggcatccaccttcctggcaggaggtagtcaagcaccttcagaggacagccttgattcacttgtaaacttgtgaaaatctgaacataggggagtgaggtatggccactgaggatttttgcttgcttaagaatgatttggactttcaatctgattatttgataaggatatagtatgaaagccaggtgctagcaacagacaaattctgagcccaatatgctttatactgctagacagggattggtgtgtttgcacctgtctttcatttgtcataagagattttcctatttcttctacccaatagaatattttcatgcctggaaataggaaaatgtgtgaacagcgtattctcttcacacagaaatctgtagcactgcttttttgaggccagtagcaacatccagagatcattcttccatactttactccctcctttttcagacttgtttgtaaagtacagaatctgaatttagcctttatgattgtatatgatccacagaagacctgatttatgaaattttgtactaaaatcatttggaaatgattgtattgtaaactgaggctaaatttttttttaaacctgtttcatgtgttataaaggccagcttgtaaaagaagctgcaacagactttctctgctcatgatttgcactcttagggttttgttagcccttttgtactactttctttttaaattgagaacatggttctttacatataaatctgcttcaaccttaggatgttttcagaccagaggcaacttattcatgaatttttatgaaaactatctactaggacagataagctgaacagtgatgatctgtagacatttatggactgaatgtaatggttgatatatgtacattctgatatttttaaatctttaactttttaaagttaaaaacctacagctgcttaggtccagcttcttaactctttttgagacacttcctgtcctatctccactgtgcctgcctaaatttgttctcaccaagcactgcctgtgcatgcagagaaaatctgtgcatcctcttttatatttttaaaatactgtttaacatttgtgagaattttatgaaaatgcttttgtatgagctgtggctttttcccattgtgaagcattgaatatcacattttggaacatgttatagggtgagtccctggatctttgctcaccagatccaagcactgcttctcggtgtcattgcagtgtgctgcttgtcacccagaatactactatcatgtgaattctttttgtcgtcagtgtcttttccttagtctttttgttgttgttgttgttgttgttttaatcattccttttttaagaagaagtaattttccatttatgaagcagtatgaattagatgtattttcaaaacaggtccctaagacaattcttcagatcatttttaaaatgactaagtcattttagtatgtcaagcaagataaaaattacatcataccgtctattttgcccatagtgccatttagagatgaaaaccagctttaactttgcaaagtgaacatgtacatggtctgctctcatttattcattcttctctcaaaagtcaaatgaatgcagagggagcttggtcaaactgcttttgtttcaactgcaggcaggggagcaaaaggacgccatgtgagcattaggaaaaaaaatactcactcttactaacaatttttatacagaaaatgagtcattttggaaatgattcttatgttttttttttttctccttttagaaaattctccaaaaggttttgatgttgaatcttggtcttggacctgttttttcctttgagggttttttgttttttgttttttctaggatttcattgtgatgttttggttttgttttttgctttttgtttaagttgtgctgacaccaaacacatccagtttataatcagtacattggaaagctggtattgatgtagaaccagtgcataactttttatggggttttgttattggtttttttttgtaaagtgtgaataaaaatttccagtgaaggtgagctggagctggttggactaatgagactgaggaagcagcttttcctacgatctgcattatgtaatcacaggtccagagagctttatggaagcgggagaggaggagcacttactcatgttgtatttgttaatggaggatgtcatcttttcatagatgctggaactagagtgcacttgttagatgctaaaggtttgagctttacacaaaatgtcttcatctgtatttgttattgtctacaatatatttgaatttggggcagcatattaagatgtaatggcctgttatgtcttgaaaatacttgttttgcctcttccaggcatactgcattctgtggatcagtttgaacagcttctccaccttatttggacagtgataaattgaaccaagagtgtagatttacaagtgtaaccttcaaaagaggaagaactatttggggtctgtaggtaatgaacagtcacaccaaaatagactatgatgcttttgttaagaaaggtttcatgttttagatattttccgtgtcctaaataattttcaataatctataatccctaaaatgcaataaaaactagtatgttttcaaaaaaaaaaagtcgacgcggccgcgaat

SEQ ID NO: 34373 - DNA, 2106 bp, Homo sapiens
ggcgcggaggaggaggcggcggcgtcggtggcggcggcgacggcggcgcggaggcgaaggcagcggcgggcagccgaagcagtggctctcggagggggaacaaagagcagcgactaaggcggcagaggagcggcggcggtggcggcgctgcagcagcgggcgggactggtatggtggttccacagggcagaccccgctgcactcacagggaggaggaggcggcagcggcggaggaaggcggcgcaccccgagaggcatgcccaaagaaaaatacgagccccctgaccctcggaggatgtatacaattatgtcttctgaggaagcagcaaatggaaagaaatcccactgggcagagcttgaaataagtggaaaagtaagaagcttaagcgcatctttgtggtcactaactcacctgacagctttgcatttgagtgacaattccctgtcccgaattccttcagacattgccaagcttcacaatctggtgtatttggacctgtcatctaataaaattcgtagcttacccgcagaactcggaaacatggtatcactcagggagctccatttaaataacaacctgttacgagttctaccttttgagctgggaaaactgtttcagttgcagactttaggcctgaaaggaaatccccttacccaggatatattgaacctttatcaggaaccagatggaacaagacggctgctgaactatttgcttgataatttgtcaggtactgcaaaaagaattacaacagaacaaccacctccaaggtcttggattatgttacaagaaccagataggacaaggccaactgccttgttttctgtcatgtgctataatgttctttgtgataaatatgcgacccggcagttatacggctactgtccatcatgggcgctaaactgggactacaggaaaaaggccattattcaagaaatcttgagctgcaatgctgatatcgtaagtcttcaggaggttgaaacggaacagtattacagtttttttctggtagagctgaaagaacgtggctataatggattcttcagtcctaagtctagagctaggacaatgtcagaacaagaaaggaaacatgttgatggctgtgcaatattcttcaagacagaaaaatttactttggttcagaaacacactgttgaatttaatcagctagccatggcaaattctgaggggtctgaagctatgctgaacagagtcatgacaaaagataacattggggttgcagtactgctagaacttcggaaggaatcgattgaaatgccgtctggaaagccacatcttggaacagaaaaacaacttattcttgtggctaacgcccacatgcattgggaccctgaatactctgatgtgaagttggtacaaactatgatgttcctctcagaagtgaagaacattattgataaagcctctcgcaacctcaaatccagtgttttgggagaatttggaactattccacttgtgttatgtgcagatcttaattctttgccagactctggtaagaaaataatgtgattttatgtagaatattttttgacataagatgatttagtaatgttttgtttctgatcattccaaattaagtccaaataaaaattcagtttgtaatggcagctatgagcaggttttaaacatcatgttggggtggaggggccattttgaagatgaaacgatattatggaaacttgaggagaaggatgttaatcatcttgaataaacacataagcaataacgtgaaataactctttaaagaacgtatgtagttccattttattactccaaagtcagagataattatggttattaagacagcctctttgggattccagcgtgtggtaatataatcatagtttaaatttgagttaaaattatagaatctcaattttgcatgtatttataacttgattagaaaaatacacctcaggtggaaaatgagctcctttatttgcacacatatcagtcaagcgattttgacaaagagcaaggatcttgatttttattaaaatgtagaatacagaaagcctgatctggagcgctctttccgtggatagtatacaataaacagtagcccttgtaataacaaactgttt

SEQ ID NO: 34374 - DNA, 743 bp, Homo sapiens
ttatgcagctgttacgagctcttttgagtcgttaacgaaatgatcattttagttctcttttaagaattcacatggtaggctgctttatcatttccactttcttaaatgtgtagtagaccccatgtgtactagaccagtgatactcagtgtggtctgtgacctggtgccagtttgcaaactgtcttgccagtctgcagtgagattaatacagcagttgaggaattttatatgtctgttaaatctaatactttttaaaaattgggtcttacattttgtccttttcccccattatttcattttctctagtaatttgtttcttgtattctctggcagtttttttttttaaaccacatgttatttaagaaacgcagtactagacattgaaatataacgtaacattttttcattcttaggtgcttatgttcctagaaactatgttgttgattttaactgttaaaggctaacatatttttctgacttcctggaatttttacatcaacagggagctccatttaaataacaacctgttacgagttctaccttttgagctgggaaaactgtttcagttgcagactttaggcctgaaaggtatgacttccatatttgtacttcttatggtttgtgtatatgtctttgaatctaaagaagccaagaagctttctgctaggggattcttttaaagactcattttcccccagacttcatcagtttcttagctatatcgcaatggttttatcttctct

SEQ ID NO: 34375 - DNA, 274 bp, Homo sapiens
caatgaaaacgaggggggcgcggaggaggaggcggcggcgtcggtggcggcggcgacggcggcgcggaggcgaaggcagcggcgggcgcagcgaggagggcgaggccgggggccgagagggcgggagggcgtagtggcggcccgtcggggcggctgaggcgggcagccgaagcagtggctctcggagggggaacaaagagcagcgactaaggcggcagaggagcggcggcggtggcggcgctgcagcagcgggcgggactggtatggtggttcc

SEQ ID NO: 34376 - DNA, 6253 bp, Homo sapiens
ggcgcggaggaggaggcggcggcgtcggtggcggcggcgacggcggcgcggaggcgaaggcagcggcgggcagccgaagcagtggctctcggagggggaacaaagagcagcgactaaggcggcagaggagcggcggcggtggcggcgctgcagcagcgggcgggactggtatggtggttccacagggcagaccccgctgcactcacagggaggaggaggcggcagcggcggaggaaggcggcgcaccccgagagcactaatcgctattttctttggaaacttcctttgattctttacctccttcaccttccccgaagagcctgctaaccaacacctgtggccttctgtttttaactgttgttgccattgacagcgttgtgaatggtcatctcgctcgagctctttggatttgttgttactgtgcatgcccaaagaaaaatacgagccccctgaccctcggaggatgtatacaattatgtcttctgaggaagcagcaaatggaaagaaatcccactgggcagagcttgaaataagtggaaaagtaagaagcttaagcgcatctttgtggtcactaactcacctgacagctttgcatttgagtgacaattccctgtcccgaattccttcagacattgccaagcttcacaatctggtgtatttggacctgtcatctaataaaattcgtagcttacccgcagaactcggaaacatggtatcactcagggagctccatttaaataacaacctgttacgagttctaccttttgagctgggaaaactgtttcagttgcagactttaggcctgaaaggaaatccccttacccaggatatattgaacctttatcaggaaccagatggaacaagacggctgctgaactatttgcttgataatttgtcaggtactgcaaaaagaattacaacagaacaaccacctccaaggtcttggattatgttacaagaaccagataggacaaggccaactgccttgttttctgtcatgtgctataatgttctttgtgataaatatgcgacccggcagttatacggctactgtccatcatgggcgctaaactgggactacaggaaaaaggccattattcaagaaatcttgagctgcaatgctgatatcgtaagtcttcaggaggttgaaacggaacagtattacagtttttttctggtagagctgaaagaacgtggctataatggattcttcagtcctaagtctagagctaggacaatgtcagaacaagaaaggaaacatgttgatggctgtgcaatattcttcaagacagaaaaatttactttggttcagaaacacactgttgaatttaatcagctagccatggcaaattctgaggggtctgaagctatgctgaacagagtcatgacaaaagataacattggggttgcagtactgctagaacttcggaaggaatcgattgaaatgccgtctggaaagccacatcttggaacagaaaaacaacttattcttgtggctaacgcccacatgcattgggaccctgaatactctgatgtgaagttggtacaaactatgatgttcctctcagaagtgaagaacattattgataaagcctctcgcaacctcaaatccagtgttttgggagaatttggaactattccacttgtgttatgtgcagatcttaattctttgccagactctggtgttgtagaatatttgagcacaggtggagtagaaacaaatcacaaagactttaaggagttgaggtataatgaaagtctcacaaacttcagctgtcatgggaagaatggaaccaccaatggaaggatcactcatggtttcaagttacagagtgcctatgagagtggcctgatgccttacacgaattacacatttgatttcaagggtataatagactacattttctattctaaacctcagctgaacaccttaggcatcctgggccctctggaccaccactggctggttgagaataacatcagtggctgcccgcaccccctcatcccctctgaccacttctcactttttgcacaactggagctcttactgcctttcctgccccaagtcaacggcatccaccttcctggcaggaggtagtcaagcaccttcagaggacagccttgattcacttgtaaacttgtgaaaatctgaacataggggagtgaggtatggccactgaggatttttgcttgcttaagaatgatttggactttcaatctgattatttgataaggatatagtatgaaagccaggtgctagcaacagacaaattctgagcccaatatgctttatactgctagacagggattggtgtgtttgcacctgtctttcatttgtcataagagattttcctatttcttctacccaatagaatattttcatgcctggaaataggaaaatgtgtgaacagcgtattctcttcacacagaaatctgtagcactgcttttttgaggccagtagcaacatccagagatcattcttccatactttactccctcctttttcagacttgtttgtaaagtacagaatctgaatttagcctttatgattgtatatgatccacagaagacctgatttatgaaattttgtactaaaatcatttggaaatgattgtattgtaaactgaggctaaatttttttttaaacctgtttcatgtgttataaaggccagcttgtaaaagaagctgcaacagactttctctgctcatgatttgcactcttagggttttgttagcccttttgtactactttctttttaaattgagaacatggttctttacatataaatctgcttcaaccttaggatgttttcagaccagaggcaacttattcatgaatttttatgaaaactatctactaggacagataagctgaacagtgatgatctgtagacatttatggactgaatgtaatggttgatatatgtacattctgatatttttaaatctttaactttttaaagttaaaaacctacagctgcttaggtccagcttcttaactctttttgagacacttcctgtcctatctccactgtgcctgcctaaatttgttctcaccaagcactgcctgtgcatgcagagaaaatctgtgcatcctcttttatatttttaaaatactgtttaacatttgtgagaattttatgaaaatgcttttgtatgagctgtggctttttcccattgtgaagcattgaatatcacattttggaacatgttatagggtgagtccctggatctttgctcaccagatccaagcactgcttctcggtgtcattgcagtgtgctgcttgtcacccagaatactactatcatgtgaattctttttgtcgtcagtgtcttttccttagtctttttgttgttgttgttgttgttgttttaatcattccttttttaagaagaagtaattttccatttatgaagcagtatgaattagatgtattttcaaaacaggtccctaagacaattcttcagatcatttttaaaatgactaagtcattttagtatgtcaagcaagataaaaattacatcataccgtctattttgcccatagtgccatttagagatgaaaaccagctttaactttgcaaagtgaacatgtacatggtctgctctcatttattcattcttctctcaaaagtcaaatgaatgcagagggagcttggtcaaactgcttttgtttcaactgcaggcaggggagcaaaaggacgccatgtgagcattaggaaaaaaaatactcactcttactaacaatttttatacagaaaatgagtcattttggaaatgattcttatgttttttttttttctccttttagaaaattctccaaaaggttttgatgttgaatcttggtcttggacctgttttttcctttgagggttttttgttttttgttttttctaggatttcattgtgatgttttggttttgttttttgctttttgtttaagttgtgctgacaccaaacacatccagtttataatcagtacattggaaagctggtattgatgtagaaccagtgcataactttttatggggttttgttattggtttttttttgtaaagtgtgaataaaaggtatgtttactcatttttcctgaacactgtgttggtaatgtgcatcatgacaatttccagtgaaggtgagctggagctggttggactaatgagactgaggaagcagcttttcctacgatctgcattatgtaatcacaggtccagagagctttatggaagcgggagaggaggagcacttactcatgttgtatttgttaatggaggatgtcatcttttcatagatgctggaactagagtgcacttgttagatgctaaaggtttgagctttacacaaaatgtcttcatctgtatttgttattgtctacaatatatttgaatttggggcagcatattaagatgtaatggcctgttatgtcttgaaaatacttgttttgcctcttccaggcatactgcattctgtggatcagtttgaacagcttctccaccttatttggacagtgataaattgaaccaagagtgtagatttacaagtgtaaccttcaaaagaggaagaactatttggggtctgtaggtaatgaacagtcacaccaaaatagactatgatgcttttgttaagaaaggtttcatgttttagatattttccgtgtcctaaataattttcaataatctataatccctaaaatgcaataaaaactagtatgttttcacggtgtatattttttttcaaaaattctgtaacaaatatatttaatgtgttgccataatgtcatttcagtatttttgctggataaatccattttagaaatgtcttacaaaaagtttagggcatgttttctgttttaaagaccagaagtttgaaggcacccaaatccttgtcgccaatctcctgaagtacagctttaccatattagtggtcattatttatgctttgagagtttcaatattgttcgtcaagttaacttatggcataatttaagctaaagttgtagaaatgaattgttgagtgcaactttcatagtcccaaagataggcagagaacatctccagaaatgtgtgtgtgtgtgtgtgtgtgtgtgtgtgtgtgtgtgtttaatatgatttagtgacaaccaggaaaacttacttgggattattagcactttcaaacttagggacattattaaattggatggaatgcacttctaaatgtttaaattaaaatttcaaagctctttcgagattcaggttctcaataataatattcaagttttagagtttcactttgtactatttaaatttatggaactagtttccatactgacttgtaaggttttggggtcatatataaggactaaagccaagctaggcaaaacaatgacagcaccgttttttcagtgaagctctcagaatgtccagtacagatgttgcagataattccaagaactccttcagcaggtgttcttcaccattcgtaaacagtattttaagatgttcactttgctcttctttttggttacatacattttaataactggtatgttgaagtagtgtctaaaagtatctagtctttattcacagtacattatattgtgtgatgcactggactaactcttgtttaccattcatgtaacaaaacccagcacattatctgcactataagctcaaagaatgtcacatccgcccagacagctctttgatgagggtgatgggaactgaataaaccatacggactggcagtaacaagggcttttactgttctgttcagtggaaccttcttggtcaaattgtaattagctagcattatatttatatacagggtcttttttctttaccgatgtattttcctactcatagccaaccaataaattcagtatctgtttcaaatattttagaagtgtagtttgtatagctgtagtactgaggtttgaggaaaaataaatgttgatcagcagaccacgtatttaaaattctgaatcttctgggacagggttgtaactcagccttccaaagggaagagtgcagggggacggggccatgatatggggaaatggtgtaaactaatgtatttctttattggctgttattctgtataacactcatatctttgccaaagttcaattttatatttaggcaactgatggtccttttgcatttaggattttcgttgttgttaccttatacctcatgatataaggaatgggctcatgtgtcttccgtcttttggaaggaggttgacatattttaaataaatgcttttaaatac

SEQ ID NO: 34377 - DNA, 5599 bp, Homo sapiens
ggctgatctagagtatccccgtagtcccaccagacctcggaggatgtatacaattatgtcttctgaggaagcagcaaatggaaagaaatcccactgggcagagcttgaaataagtggaaaagtaagaagcttaagcgcatctttgtggtcactaactcacctgacagctttgcatttgagtgacaattccctgtcccgaattccttcagacattgccaagcttcacaatctggtgtatttggacctgtcatctaataaaattcgtagcttacccgcagaactcggaaacatggtatcactcagggagctccatttaaataacaacctgttacgagttctaccttttgagctgggaaaactgtttcagttgcagactttaggcctgaaaggaaatccccttacccaggatatattgaacctttatcaggaaccagatggaacaagacggctgctgaactatttgcttgataatttgtcaggtactgcaaaaagaattacaacagaacaaccacctccaaggtcttggattatgttacaagaaccagataggacaaggccaactgccttgttttctgtcatgtgctataatgttctttgtgataaatatgcgacccggcagttatacggctactgtccatcatgggcgctaaactgggactacaggaaaaaggccattattcaagaaatcttgagctgcaatgctgatatcgtaagtcttcaggaggttgaaacggaacagtattacagtttttttctggtagagctgaaagaacgtggctataatggattcttcagtcctaagtctagagctaggacaatgtcagaacaagaaaggaaacatgttgatggctgtgcaatattcttcaagacagaaaaatttactttggttcagaaacacactgttgaatttaatcagctagccatggcaaattctgaggggtctgaagctatgctgaacagagtcatgacaaaagataacattggggttgcagtactgctagaacttcggaaggaatcgattgaaatgccgtctggaaagccacatcttggaacagaaaaacaacttattcttgtggctaacgcccacatgcattgggaccctgaatactctgatgtgaagttggtacaaactatgatgttcctctcagaagtgaagaacattattgataaagcctctcgcaacctcaaatccagtgttttgggagaatttggaactattccacttgtgttatgtgcagatcttaattctttgccagactctggtgttgtagaatatttgagcacaggtggagtagaaacaaatcacaaagactttaaggagttgaggtataatgaaagtctcacaaacttcagctgtcatgggaagaatggaaccaccaatggaaggatcactcatggtttcaagttacagagtgcctatgagagtggcctgatgccttacacgaattacacatttgatttcaagggtataatagactacattttctattctaaacctcagctgaacaccttaggcatcctgggccctctggaccaccactggctggttgagaataacatcagtggctgcccgcaccccctcatcccctctgaccacttctcactttttgcacaactggagctcttactgcctttcctgccccaagtcaacggcatccaccttcctggcaggaggtagtcaagcaccttcagaggacagccttgattcacttgtaaacttgtgaaaatctgaacataggggagtgaggtatggccactgaggatttttgcttgcttaagaatgatttggactttcaatctgattatttgataaggatatagtatgaaagccaggtgctagcaacagacaaattctgagcccaatatgctttatactgctagacagggattggtgtgtttgcacctgtctttcatttgtcataagagattttcctatttcttctacccaatagaatattttcatgcctggaaataggaaaatgtgtgaacagcgtattctcttcacacagaaatctgtagcactgcttttttgaggccagtagcaacatccagagatcattcttccatactttactccctcctttttcagacttgtttgtaaagtacagaatctgaatttagcctttatgattgtatatgatccacagaagacctgatttatgaaattttgtactaaaatcatttggaaatgattgtattgtaaactgaggctaaatttttttttaaacctgtttcatgtgttataaaggccagcttgtaaaagaagctgcaacagactttctctgctcatgatttgcactcttagggttttgttagcccttttgtactactttctttttaaattgagaacatggttctttacatataaatctgcttcaaccttaggatgttttcagaccagaggcaacttattcatgaatttttatgaaaactatctactaggacagataagctgaacagtgatgatctgtagacatttatggactgaatgtaatggttgatatatgtacattctgatatttttaaatctttaactttttaaagttaaaaacctacagctgcttaggtccagcttcttaactctttttgagacacttcctgtcctatctccactgtgcctgcctaaatttgttctcaccaagcactgcctgtgcatgcagagaaaatctgtgcatcctcttttatatttttaaaatactgtttaacatttgtgagaattttatgaaaatgcttttgtatgagctgtggctttttcccattgtgaagcattgaatatcacattttggaacatgttatagggtgagtccctggatctttgctcaccagatccaagcactgcttctcggtgtcattgcagtgtgctgcttgtcacccagaatactactatcatgtgaattctttttgtcgtcagtgtcttttccttagtctttttgttgttgttgttgttgttgttttaatcattccttttttaagaagaagtaattttccatttatgaagcagtatgaattagatgtattttcaaaacaggtccctaagacaattcttcagatcatttttaaaatgactaagtcattttagtatgtcaagcaagataaaaattacatcataccgtctattttgcccatagtgccatttagagatgaaaaccagctttaactttgcaaagtgaacatgtacatggtctgctctcatttattcattcttctctcaaaagtcaaatgaatgcagagggagcttggtcaaactgcttttgtttcaactgcaggcaggggagcaaaaggacgccatgtgagcattaggaaaaaaaatactcactcttactaacaatttttatacagaaaatgagtcattttggaaatgattcttatgttttttttttttctccttttagaaaattctccaaaaggttttgatgttgaatcttggtcttggacctgttttttcctttgagggttttttgttttttgttttttctaggatttcattgtgatgttttggttttgttttttgctttttgtttaagttgtgctgacaccaaacacatccagtttataatcagtacattggaaagctggtattgatgtagaaccagtgcataactttttatggggttttgttattggtttttttttgtaaagtgtgaataaaaggtatgtttactcatttttcctgaacactgtgttggtaatgtgcatcatgacaatttccagtgaaggtgagctggagctggttggactaatgagactgaggaagcagcttttcctacgatctgcattatgtaatcacaggtccagagagctttatggaagcgggagaggaggagcacttactcatgttgtatttgttaatggaggatgtcatcttttcatagatgctggaactagagtgcacttgttagatgctaaaggtttgagctttacacaaaatgtcttcatctgtatttgttattgtctacaatatatttgaatttggggcagcatattaagatgtaatggcctgttatgtcttgaaaatacttgttttgcctcttccaggcatactgcattctgtggatcagtttgaacagcttctccaccttatttggacagtgataaattgaaccaagagtgtagatttacaagtgtaaccttcaaaagaggaagaactatttggggtctgtaggtaatgaacagtcacaccaaaatagactatgatgcttttgttaagaaaggtttcatgttttagatattttccgtgtcctaaataattttcaataatctataatccctaaaatgcaataaaaactagtatgttttcacggtgtatattttttttcaaaaattctgtaacaaatatatttaatgtgttgccataatgtcatttcagtatttttgctggataaatccattttagaaatgtcttacaaaaagtttagggcatgttttctgttttaaagaccagaagtttgaaggcacccaaatccttgtcgccaatctcctgaagtacagctttaccatattagtggtcattatttatgctttgagagtttcaatattgttcgtcaagttaacttatggcataatttaagctaaagttgtagaaatgaattgttgagtgcaactttcatagtcccaaagataggcagagaacatctccagaaatgtgtgtgtgtgtgtgtgtgtgtgtgtgtgtgtgtgtgtttaatatgatttagtgacaaccaggaaaacttacttgggattattagcactttcaaacttagggacattattaaattggatggaatgcacttctaaatgtttaaattaaaatttcaaagctctttcgagattcaggttctcaataataatattcaagttttagagtttcactttgtactatttaaatttatggaactagtttccatactgacttgtaaggttttggggtcatatataaggactaaagccaagctaggcaaaacaatgacagcaccgttttttcagtgaagctctcagaatgtccagtacagatgttgcagataattccaagaactccttcagcaggtgttcttcaccattcgtaaacagtattttaagatgttcactttgctcttctttttggttacatacattttaataactggtatgttgaagtagtgtctaaaagtatctagtctttattcacagtacattatattgtgtgatgcactggactaactcttgtttaccattcatgtaacaaaacccagcacattatctgcactataagctcaaagaatgtcacatccgcccagacagctctttgatgagggtgatgggaactgaataaaccatacggactggcagtaacaagggcttttactgttctgttcagtggaaccttcttggtcaaattgtaattagctagcattatatttatatacagggtcttttttctttaccgatgtattttcctactcatagccaaccaataaattcagtatctgtttcaaatattttagaagtgtagtttgtatagctgtagtactgaggtttgaggaaaaataaatgttgatcagcagaccacgtattttgcagggtgactgtgacatgctatgcggaaatggtgtcttggcatgctttattggactgctgctgt

SEQ ID NO: 34378 - DNA, 5846 bp, Homo sapiens
ggcgcggaggaggaggcggcggcgtcggtggcggcggcgacggcggcgcggaggcgaaggcagcggcgggcagccgaagcagtggctctcggagggggaacaaagagcagcgactaaggcggcagaggagcggcggcggtggcggcgctgcagcagcgggcgggactggtatggtggttccacagggcagaccccgctgcactcacagggaggaggaggcggcagcggcggaggaaggcggcgcaccccgagaggcatgcccaaagaaaaatacgagccccctgaccctcggaggatgtatacaattatgtcttctgaggaagcagcaaatggaaagaaatcccactgggcagagcttgaaataagtggaaaagtaagaagcttaagcgcatctttgtggtcactaactcacctgacagctttgcatttgagtgacaattccctgtcccgaattccttcagacattgccaagcttcacaatctggtgtatttggacctgtcatctaataaaattcgtagcttacccgcagaactcggaaacatggtatcactcaggaaatccccttacccaggatatattgaacctttatcaggaaccagatggaacaagacggctgctgaactatttgcttgataatttgtcaggtactgcaaaaagaagtaagtggttatttgtttaaacctttttattaggaagacgtgtaagaatattgcttaattctgtattttctattcaactagttacaacagaacaaccacctccaaggtcttggattatgttacaagaaccagataggacaaggccaactgccttgttttctgtcatgtgctataatgttctttgtgataaatatgcgacccggcagttatacggctactgtccatcatgggcgctaaactgggactacaggaaaaaggccattattcaagaaatcttgagctgcaatgctgatatcgtaagtcttcaggaggttgaaacggaacagtattacagtttttttctggtagagctgaaagaacgtggctataatggattcttcagtcctaagtctagagctaggacaatgtcagaacaagaaaggaaacatgttgatggctgtgcaatattcttcaagacagaaaaatttactttggttcagaaacacactgttgaatttaatcagctagccatggcaaattctgaggggtctgaagctatgctgaacagagtcatgacaaaagataacattggggttgcagtactgctagaacttcggaaggaatcgattgaaatgccgtctggaaagccacatcttggaacagaaaaacaacttattcttgtggctaacgcccacatgcattgggaccctgaatactctgatgtgaagttggtacaaactatgatgttcctctcagaagtgaagaacattattgataaagcctctcgcaacctcaaatccagtgttttgggagaatttggaactattccacttgtgttatgtgcagatcttaattctttgccagactctggtgttgtagaatatttgagcacaggtggagtagaaacaaatcacaaagactttaaggagttgaggtataatgaaagtctcacaaacttcagctgtcatgggaagaatggaaccaccaatggaaggatcactcatggtttcaagttacagagtgcctatgagagtggcctgatgccttacacgaattacacatttgatttcaagggtataatagactacattttctattctaaacctcagctgaacaccttaggcatcctgggccctctggaccaccactggctggttgagaataacatcagtggctgcccgcaccccctcatcccctctgaccacttctcactttttgcacaactggagctcttactgcctttcctgccccaagtcaacggcatccaccttcctggcaggaggtagtcaagcaccttcagaggacagccttgattcacttgtaaacttgtgaaaatctgaacataggggagtgaggtatggccactgaggatttttgcttgcttaagaatgatttggactttcaatctgattatttgataaggatatagtatgaaagccaggtgctagcaacagacaaattctgagcccaatatgctttatactgctagacagggattggtgtgtttgcacctgtctttcatttgtcataagagattttcctatttcttctacccaatagaatattttcatgcctggaaataggaaaatgtgtgaacagcgtattctcttcacacagaaatctgtagcactgcttttttgaggccagtagcaacatccagagatcattcttccatactttactccctcctttttcagacttgtttgtaaagtacagaatctgaatttagcctttatgattgtatatgatccacagaagacctgatttatgaaattttgtactaaaatcatttggaaatgattgtattgtaaactgaggctaaatttttttttaaacctgtttcatgtgttataaaggccagcttgtaaaagaagctgcaacagactttctctgctcatgatttgcactcttagggttttgttagcccttttgtactactttctttttaaattgagaacatggttctttacatataaatctgcttcaaccttaggatgttttcagaccagaggcaacttattcatgaatttttatgaaaactatctactaggacagataagctgaacagtgatgatctgtagacatttatggactgaatgtaatggttgatatatgtacattctgatatttttaaatctttaactttttaaagttaaaaacctacagctgcttaggtccagcttcttaactctttttgagacacttcctgtcctatctccactgtgcctgcctaaatttgttctcaccaagcactgcctgtgcatgcagagaaaatctgtgcatcctcttttatatttttaaaatactgtttaacatttgtgagaattttatgaaaatgcttttgtatgagctgtggctttttcccattgtgaagcattgaatatcacattttggaacatgttatagggtgagtccctggatctttgctcaccagatccaagcactgcttctcggtgtcattgcagtgtgctgcttgtcacccagaatactactatcatgtgaattctttttgtcgtcagtgtcttttccttagtctttttgttgttgttgttgttgttgttttaatcattccttttttaagaagaagtaattttccatttatgaagcagtatgaattagatgtattttcaaaacaggtccctaagacaattcttcagatcatttttaaaatgactaagtcattttagtatgtcaagcaagataaaaattacatcataccgtctattttgcccatagtgccatttagagatgaaaaccagctttaactttgcaaagtgaacatgtacatggtctgctctcatttattcattcttctctcaaaagtcaaatgaatgcagagggagcttggtcaaactgcttttgtttcaactgcaggcaggggagcaaaaggacgccatgtgagcattaggaaaaaaaatactcactcttactaacaatttttatacagaaaatgagtcattttggaaatgattcttatgttttttttttttctccttttagaaaattctccaaaaggttttgatgttgaatcttggtcttggacctgttttttcctttgagggttttttgttttttgttttttctaggatttcattgtgatgttttggttttgttttttgctttttgtttaagttgtgctgacaccaaacacatccagtttataatcagtacattggaaagctggtattgatgtagaaccagtgcataactttttatggggttttgttattggtttttttttgtaaagtgtgaataaaaggtatgtttactcatttttcctgaacactgtgttggtaatgtgcatcatgacaatttccagtgaaggtgagctggagctggttggactaatgagactgaggaagcagcttttcctacgatctgcattatgtaatcacaggtccagagagctttatggaagcgggagaggaggagcacttactcatgttgtatttgttaatggaggatgtcatcttttcatagatgctggaactagagtgcacttgttagatgctaaaggtttgagctttacacaaaatgtcttcatctgtatttgttattgtctacaatatatttgaatttggggcagcatattaagatgtaatggcctgttatgtcttgaaaatacttgttttgcctcttccaggcatactgcattctgtggatcagtttgaacagcttctccaccttatttggacagtgataaattgaaccaagagtgtagatttacaagtgtaaccttcaaaagaggaagaactatttggggtctgtaggtaatgaacagtcacaccaaaatagactatgatgcttttgttaagaaaggtttcatgttttagatattttccgtgtcctaaataattttcaataatctataatccctaaaatgcaataaaaactagtatgttttcacggtgtatattttttttcaaaaattctgtaacaaatatatttaatgtgttgccataatgtcatttcagtatttttgctggataaatccattttagaaatgtcttacaaaaagtttagggcatgttttctgttttaaagaccagaagtttgaaggcacccaaatccttgtcgccaatctcctgaagtacagctttaccatattagtggtcattatttatgctttgagagtttcaatattgttcgtcaagttaacttatggcataatttaagctaaagttgtagaaatgaattgttgagtgcaactttcatagtcccaaagataggcagagaacatctccagaaatgtgtgtgtgtgtgtgtgtgtgtgtgtgtgtgtgtgtgtttaatatgatttagtgacaaccaggaaaacttacttgggattattagcactttcaaacttagggacattattaaattggatggaatgcacttctaaatgtttaaattaaaatttcaaagctctttcgagattcaggttctcaataataatattcaagttttagagtttcactttgtactatttaaatttatggaactagtttccatactgacttgtaaggttttggggtcatatataaggactaaagccaagctaggcaaaacaatgacagcaccgttttttcagtgaagctctcagaatgtccagtacagatgttgcagataattccaagaactccttcagcaggtgttcttcaccattcgtaaacagtattttaagatgttcactttgctcttctttttggttacatacattttaataactggtatgttgaagtagtgtctaaaagtatctagtctttattcacagtacattatattgtgtgatgcactggactaactcttgtttaccattcatgtaacaaaacccagcacattatctgcactataagctcaaagaatgtcacatccgcccagacagctctttgatgagggtgatgggaactgaataaaccatacggactggcagtaacaagggcttttactgttctgttcagtggaaccttcttggtcaaattgtaattagctagcattatatttatatacagggtcttttttctttaccgatgtattttcctactcatagccaaccaataaattcagtatctgtttcaaatattttagaagtgtagtttgtatagctgtagtactgaggtttgaggaaaaataaatgttgatcagcagaccacgtattttgcagggtgactgtgacatgctatgcggaaatggtgtcttggcatgctttattggactgctgctgt

SEQ ID NO: 34379 - DNA, 4578 bp, Homo sapiens
ggcgcggaggaggaggcggcggcgtcggtggcggcggcgacggcggcgcggaggcgaaggcagcggcgggcagccgaagcagtggctctcggagggggaacaaagagcagcgactaaggcggcagaggagcggcggcggtggcggcgctgcagcagcgggcgggactggtatggtggttccacagggcagaccccgctgcactcacagggaggaggaggcggcagcggcggaggaaggcggcgcaccccgagaggcatgcccaaagaaaaatacgagccccctgaccctcggaggatgtatacaattatgtcttctgaggaagcagcaaatggaaagaaatcccactgggcagagcttgaaataagtggaaaagtaagaagcttaagcgcatctttgtggtcactaactcacctgacagctttgcatttgagtgacaattccctgtcccgaattccttcagacattgccaagcttcacaatctggtgtatttggacctgtcatctaataaaattcgtagcttacccgcagaactcggaaacatggtatcactcagggagctccatttaaataacaacctgttacgagttctaccttttgagctgggaaaactgtttcagttgcagactttaggcctgaaaggaaatccccttacccaggatatattgaacctttatcaggaaccagatggaacaagacggctgctgaactatttgcttgataatttgtcaggtactgcaaaaagaattacaacagaacaaccacctccaaggtcttggattatgttacaagaaccagataggacaaggccaactgccttgttttctgtcatgtgctataatgttctttgtgataaatatgcgacccggcagttatacggctactgtccatcatgggcgctaaactgggactacaggaaaaaggccattattcaagaaatcttgagctgcaatgctgatatcgtaagtcttcaggaggttgaaacggaacagtattacagtttttttctggtagagctgaaagaacgtggctataatggattcttcagtcctaagtctagagctaggacaatgtcagaacaagaaaggaaacatgttgatggctgtgcaatattcttcaagacagaaaaatttactttggttcagaaacacactgttgaatttaatcagctagccatggcaaattctgaggggtctgaagctatgctgaacagagtcatgacaaaagataacattggggttgcagtactgctagaacttcggaaggaatcgattgaaatgccgtctggaaagccacatcttggaacagaaaaacaacttattcttgtggctaacgcccacatgcattgggaccctgaatactctgatgtgaagttggtacaaactatgatgttcctctcagaagtgaagaacattattgataaagcctctcgcaacctcaaatccagtgttttgggagaatttggaactattccacttgtgttatgtgcagatcttaattctttgccagactctggtgttgtagaatatttgagcacaggtggagtagaaacaaatcacaaagactttaaggagttgaggtataatgaaagtctcacaaacttcagctgtcatgggaagaatggaaccaccaatggaaggatcactcatggtttcaagttacagagtgcctatgagagtggcctgatgccttacacgaattacacatttgatttcaagggtataatagactacattttctattctaaacctcagctgaacaccttaggcatcctgggccctctggaccaccactggctggttgagaataacatcagtggctgcccgcaccccctcatcccctctgaccacttctcactttttgcacaactggagctcttactgcctttcctgccccaagtcaacggcatccaccttcctggcaggaggtagtcaagcaccttcagaggacagccttgattcacttgtaaacttgtgaaaatctgaacataggggagtgaggtatggccactgaggatttttgcttgcttaagaatgatttggactttcaatctgattatttgataaggatatagtatgaaagccaggtgctagcaacagacaaattctgagcccaatatgctttatactgctagacagggattggtgtgtttgcacctgtctttcatttgtcataagagattttcctatttcttctacccaatagaatattttcatgcctggaaataggaaaatgtgtgaacagcgtattctcttcacacagaaatctgtagcactgcttttttgaggccagtagcaacatccagagatcattcttccatactttactccctcctttttcagacttgtttgtaaagtacagaatctgaatttagcctttatgattgtatatgatccacagaagacctgatttatgaaattttgtactaaaatcatttggaaatgattgtattgtaaactgaggctaaatttttttttaaacctgtttcatgtgttataaaggccagcttgtaaaagaagctgcaacagactttctctgctcatgatttgcactcttagggttttgttagcccttttgtactactttctttttaaattgagaacatggttctttacatataaatctgcttcaaccttaggatgttttcagaccagaggcaacttattcatgaatttttatgaaaactatctactaggacagataagctgaacagtgatgatctgtagacatttatggactgaatgtaatggttgatatatgtacattctgatatttttaaatctttaactttttaaagttaaaaacctacagctgcttaggtccagcttcttaactctttttgagacacttcctgtcctatctccactgtgcctgcctaaatttgttctcaccaagcactgcctgtgcatgcagagaaaatctgtgcatcctcttttatatttttaaaatactgtttaacatttgtgagaattttatgaaaatgcttttgtatgagctgtggctttttcccattgtgaagcattgaatatcacattttggaacatgttatagggtgagtccctggatctttgctcaccagatccaagcactgcttctcggtgtcattgcagtgtgctgcttgtcacccagaatactactatcatgtgaattctttttgtcgtcagtgtcttttccttagtctttttgttgttgttgttgttgttgttttaatcattccttttttaagaagaagtaattttccatttatgaagcagtatgaattagatgtattttcaaaacaggtccctaagacaattcttcagatcatttttaaaatgactaagtcattttagtatgtcaagcaagataaaaattacatcataccgtctattttgcccatagtgccatttagagatgaaaaccagctttaactttgcaaagtgaacatgtacatggtctgctctcatttattcattcttctctcaaaagtcaaatgaatgcagagggagcttggtcaaactgcttttgtttcaactgcaggcaggggagcaaaaggacgccatgtgagcattaggaaaaaaaatactcactcttactaacaatttttatacagaaaatgagtcattttggaaatgattcttatgttttttttttttctccttttagaaaattctccaaaaggttttgatgttgaatcttggtcttggacctgttttttcctttgagggttttttgttttttgttttttctaggatttcattgtgatgttttggttttgttttttgctttttgtttaagttgtgctgacaccaaacacatccagtttataatcagtacattggaaagctggtattgatgtagaaccagtgcataactttttatggggttttgttattggtttttttttgtaaagtgtgaataaaaggtatgtttactcatttttcctgaacactgtgttggtaatgtgcatcatgacaatttccagtgaaggtgagctggagctggttggactaatgagactgaggaagcagcttttcctacgatctgcattatgtaatcacaggtccagagagctttatggaagcgggagaggaggagcacttactcatgttgtatttgttaatggaggatgtcatcttttcatagatgctggaactagagtgcacttgttagatgctaaaggtttgagctttacacaaaatgtcttcatctgtatttgttattgtctacaatatatttgaatttggggcagcatattaagatgtaatggcctgttatgtcttgaaaatacttgttttgcctcttccaggcatactgcattctgtggatcagtttgaacagcttctccaccttatttggacagtgataaattgaaccaagagtgtagatttacaagtgtaaccttcaaaagaggaagaactatttggggtctgtaggtaatgaacagtcacaccaaaatagactatgatgcttttgttaagaaaggtttcatgttttagatattttccgtgtcctaaataattttcaataatctataatccctaaaatgcaataaaaactagtatgttttcaaaaaaaaaaagtcgacgcggccgcgaat

SEQ ID NO: 34380 - DNA, 2201 bp, Homo sapiens
ggcgcggaggaggaggcggcggcgtcggtggcggcggcgacggcggcgcggaggcgaaggcagcggcgggcagccgaagcagtggctctcggagggggaacaaagagcagcgactaaggcggcagaggagcggcggcggtggcggcgctgcagcagcgggcgggactggtatggtggttccacagggcagaccccgctgcactcacagggaggaggaggcggcagcggcggaggaaggcggcgcaccccgagaggcatgcccaaagaaaaatacgagccccctgaccctcggaggatgtatacaattatgtcttctgaggaagcagcaaatggaaagaaatcccactgggcagagcttgaaataagtggaaaagtaagaagcttaagcgcatctttgtggtcactaactcacctgacagctttgcatttgagtgacaattccctgtcccgaattccttcagacattgccaagcttcacaatctggtgtatttggacctgtcatctaataaaattcgtagcttacccgcagaactcggaaacatggtatcactcagggagctccatttaaataacaacctgttacgagttctaccttttgagctgggaaaactgtttcagttgcagactttaggcctgaaaggaaatccccttacccaggatatattgaacctttatcaggaaccagatggaacaagacggctgctgaactatttgcttgataatttgtcaggtactgcaaaaagaattacaacagaacaaccacctccaaggtcttggattatgttacaagaaccagataggacaaggccaactgccttgttttctgtcatgtgctataatgttctttgtgataaatatgcgacccggcagttatacggctactgtccatcatgggcgctaaactgggactacaggaaaaaggccattattcaagaaatcttgagctgcaatgctgatatcgtaagtcttcaggaggttgaaacggaacagtattacagtttttttctggtagagctgaaagaacgtggctataatggattcttcagtcctaagtctagagctaggacaatgtcagaacaagaaaggaaacatgttgatggctgtgcaatattcttcaagacagaaaaatttactttggttcagaaacacactgttgaatttaatcagctagccatggcaaattctgaggggtctgaagctatgctgaacagagtcatgacaaaagataacattggggttgcagtactgctagaacttcggaaggaatcgattgaaatgccgtctggaaagccacatcttggaacagaaaaacaacttattcttgtggctaacgcccacatgcattgggaccctgaatactctgatgtgaagttggtacaaactatgatgttcctctcagaagtgaagaacattattgataaagcctctcgcaacctcaaatccagtgttttgggagaatttggaactattccacttgtgttatgtgcagatcttaattctttgccagactctggtgttgtagaatatttgagcacaggtggagtagaaacaaatcacaaagactttaaggagttgaggtataatgaaagtctcacaaacttcagctgtcatgggaagaatggaaccaccaatggaaggatcactcatggtttcaagttacagagtgcctatgagagtggcctgatgccttacacgaattacacatttgatttcaagggtataatagactacattttctattctaaacctcagctgaacaccttaggcatcctgggccctctggaccaccactggctggttgagaataacatcagtggctgcccgcaccccctcatcccctctgaccacttctcactttttgcacaactggagctcttactgcctttcctgccccaagtcaacggcatccaccttcctggcaggaggcatactgcattctgtggatcagtttgaacagcttctccaccttatttggacagtgataaattgaaccaagagtgtagatttacaagtgtaaccttcaaaagaggaagaactatttggggtctgtaggtaatgaacagtcacaccaaaatagactatgatgcttttgttaagaaaggtttcatgttttagatattttccgtgtcctaaataattttcaataatctataatccctaaaatgcaaaaagtgtgcgggatcctgtagagtgaccaaca

SEQ ID NO: 34381 - DNA, 289 bp, Homo sapiens
tttttttttttgaaaattgcacgtgcttggtcttcttgtatcacacatttttatttattgctatgtaacaaactaccattaatttagcagcacaaaattacacacatttattattttacaatttctgtgaggaatctgggcatgccttattttgggtctcccaaagtgtcatcaaagtttttatctgagtttgaggtcttcttccaaactcattgtggttgttggcagaatctggctctgtgaagttgtagcactgagaccctcatttcctaggtaacacctacagtgc

SEQ ID NO: 34382 - DNA, 1970 bp, Homo sapiens
ggcatgaggggagatttgggtgcttttctttccgtggcgcctcttcattttgtaaactgctgcttaatggaacaagagcccagcattgtcccggcctatcccccaggtgcagtcacacagtaggtacagtcctggacttcattctcagcaggaggggcaacaagaactcctcaggaggtaaccacgatgtcgctccctggctaggtgctgggaagcccaattaggatagttgtgagtgctctctggggtctgaaagtgttctgtttctcccttgggattagaagagtgcttgcaaggcgtctttttgggtgatggccattgctgagctgtgctgtgctgtgccggtgactgacaggttcctctcctctaacccagccaggccctcatggacgagagtgcactcaggtgtactgcacccccttccatcctcactgcagccctgagctgggtggggcagcatgtgggagtgagccaggaagatggggcacaggggcttcccggggactgcagggcaggcggcagcagggagggcatcgggaggaggtgagctcctgtggacttccatcagctcctcctcgaacccgcatctgcaccgtgcgtgccttggccaggccaggacttgggagcgcctggctcttccttctgagcctggcagggtgctgctgtaggagatggcctccccctggatctggctccttccccacctgaagcttcactcccagggcagagcccatgtctgtaggctccgcctgcatgaagaacagagggcagagtgagcacagacagcctggggtcagaggggaagtgtccggcaactgtgaactttgtcactgacatcatcccaaagagaaagggctgaatagtcccatctccacttttggagtctttttcaaagcgtgggtaacctccaggtgcctcctaggatgtgtggtatgtggctgtgtggcaaacgcggcctgggaacaagtgttactctgtgaggagcagttcagtgggagaaggccatttccctgcaggagtcatacagaaagctacgctgaaagtcaaatgagggagctggccttggtccacatactcagcgagcatgcaggagaggtgttcgcaggcgcactgagtggctggctttggtgttagagtgagtgacatcgcgatctgactgaggtgctccctcactcctgccacaggaaaatccatgaataacgttgagaagcccctggagtttcgagaggctactagaagccatggtccttggaacaacgtggccactgtgagccgaaggaaaccgggtgactcggggtaccggctacagagggctctcccctcttcaggaattcccaggcagggctgttgagcctcgggatgcagtgtccttgagtctcgaggtgtcgaggagaggctggaggaggacgtgggttctgcgttcctggttggtgcgctgtcacccctcttcacggaatccacccagactggtcctcagccttgtggtagcacaaatgaatgcagtaaaaatgcttgttggcctcaactgtgacttgtaccagcgttcacagaatactgcactgaacctcaaatcttgttattataaaattctaagaatgtcagaaatcagaagagttttagaaatcaagtgtttattccactaaaggacctttttttgatttaaaaaagttctcagccgggtgcagtggctcacacctatcatcctagcacttggggaggtggaggcaggaagattgcttagtctaggagttcaagaccagcctgggcaatgtagtgagacccccatgtctacaatcaatcagtcaacacaaaaatacataaataaataaggttctcatattggctgggcacggtggctcacacctgtaaccccagcactttgagaggttgaggcagaggggttgcttgaggttaggagtttgagatcatcctgggcaatgtagtgagaccccatctctacaaaaaaaaaa

SEQ ID NO: 34383 - DNA, 354 bp, Homo sapiens
tgggagacaaggtcttgctatgttgcccaggctggccttaaactcctgggctcaagcagtgatcctcttgcctcagtctcccaagtaactgggattacagaatcacatcactacacctggctaaaacttttattcttcttaaataattagactcataggaagttgcaaaaatagtatgtatatgtactacaggttgaatatccctaatctgaaaatccagaatgctccaaaatctgaaactttctgagcactgatatgacacccaaagtaaatgctcactggaacattttggaattcaaatttttgaatcagggatgctcaaccagtatgtattctggaaatattccaaaattt

SEQ ID NO: 34384 - DNA, 468 bp, Homo sapiens
ggcacgagctgggcgtgtgcttggtatcgttccctcagaacactcagtggtcctggtttcagtaagggtttgggatcacatacaacttggatttgaatgttaattttgcccattaaaaattgagccgcctttgacaaattactccatccatctcacacctgaacctcagtttttcttctgttaattggggcccagctgggctgttgtgaggacctgatgttaaaaatgtaaaaagtggtcaccctggtacttgggcatataatggaccctaaacaaacagtctccatgattgtggttttgagcaggttattttatctcttcaggtttccatctgcttacttttgtttttttcgagacacggtcttgctgtgtcgcccaagctggaagtccagtggtattgatgatggctcactgcagcctcgacctcccaggctcaagggatccttctgcctcagcctcccgagcagc

SEQ ID NO: 34385 - DNA, 432 bp, Homo sapiens
ttgtcttttgccacttcatggtctttttggttataatctttttggtatataaactcatttggcctgtttgatgagcccattttacatctctggttgttgagataccaatttctcagtagttattcatgaagcaccaacgtcttggttattttcacgagacccatttgtgcctgtatagaaattatctgaatcttgctaatacggacatatctttggcttgataagtggtggagctgttttcttttccattctacaatgttgttagtcttttaatacaaaaagaccataaagagaatcttaagaaatgcccccaaagtaggatttgttttctgaccacacattttctgatgacgctgcaatagaaactaaaagttaatttcaaaagattaaacagaaaacttcacttcttggtggttaaaagttaaacactta

SEQ ID NO: 34386 - DNA, 776 bp, Homo sapiens
attcctcaatttccaggatacaattttgatgcctcactttctttatctgagaagtggggatagatatatacctcctttctaaggtaaacgtgagactttagtgaagaagcatgtatgtaatactatccagagtgtctataaataaatgcttaataaatagtagcaaatattattttagataatgtttgacgaagcaaaatgatttagatagcaaatagttgaatgtaaaggtaattaactttatctggtttaactgttcttcaagtggatttgattaatgacctatgcttgccatttattgctttgtaatccttgctgtagtaaccttccacttttattgataatgtttattagcaacagagtgagcctccatctcaacaaataaataaataaataaataaataaataaatatataaataggagtcaatagagctgcaacatagaggcatgtgatgagcttgaagcaaggtaggcggggtctggttatagaaggaccagtagacatacaagaatttgggactgcattatcatgacattttggctttatttccaaagaccctgtgtcttaggagatcgcaaactttagagtatccattttattttgaaactggtaattggcacacttcttaatgccatgattcaaatatctctcattgcacaaagactcattttaaaaatattcagaagtggtgtgttaacttggtgaatttctgtttttttttttttttttttttgattagctgtattatctctgaagaaattgcaacctgaaaaa

SEQ ID NO: 34387 - DNA, 494 bp, Homo sapiens
gctgcctaacaaattatcccaaagtttagctgcttaaaacaataaatgtgttatctcttactgtttctgagggtcattaatctgatagcagcttagctgggtagttctagcatagggctctcacaaggttgtagtcaagatgtcatttggagctgcagttatctttcagggctcacctgggactgtgggaaatccactttcaaactcactcacatagttgttggcagtacagccctggctggtgtgttagagactttagttccttacaacgtgggcctctccataagcttctgtaacatgtcaacctacttcttgcaggacgaatgatctgaaaggcatagggaatgaatgaataaatgaatacccaagacagaagttgtcttttttataacctaatcttggaagtgatttgctattacttgagctgttagttactggtcatgcaggctgacctagtacactgtgggagaggactgcacaaggaggcatgaata

SEQ ID NO: 34388 - DNA, 420 bp, Homo sapiens
cgagttaggcacaggggatacaaccaggttacttgaagccaacacaagaagaatagaatcagtggatctctctctctctctctctctctctcacacacacacacacacacacacaaacacacacacagaggaaaagaaaagaaccaatagaaaatttgactcaaataatccttttagccatatctaagtaatattaaagtaagatatgcattactggttttacctccaagttaggaaaactctttaaagatggactatcaaagtctttttcttatgatttggtaggatggtgtgtgattttaaggaatccaaagtctagcagtagatatttagtattaaggtaatgtcccacttactagaatgtcagtgtttttccaagtttccacattctcatcacatagattgaattaggtttaaaaa

SEQ ID NO: 34389 - DNA, 570 bp, Homo sapiens
aaaaccatgtataaattactcagggactctgggtcttaatttctcatttgtgaaatgagagagagatctcaattgaattgagtactatttatttttaaagtctatgattctttgaaattacaaaaaatctattaaactagagaattactttgtaattcacaaaaccctttcaaaatacttaattccaaagttatccatagaacaacaccagggtgattactgcacagtattgtaaatggaataagtatggagattgggctgaaaaatcattcaacaaatactttagttgtctcttccttgttctcatcatagagtacagcatgtgcacactcataacctggactgtatagcatagctactgttgtggaaactgaattttaacaccaaagatagaagtctttgagtgatttggccaccttttcagtcttaaaataaaatggcttaatagcattgctgggcactgtggcacgagcctgtagttttggctgctggggagggtgagactggaggatcttctgagcccaggagttcaagttcctctgggcacatagtgagatgctgtctctaaga

SEQ ID NO: 34390 - DNA, 586 bp, Homo sapiens
taaattttatctttttccttaaaagaaatctgtatttctatcaggacattctggatgtccccagttttactggtagtctttcattgtgtgtatattaagttctttgtttttatcacctgtataggttagtatatccatgactcccgtcaactttctaaatgttcgctgggtgcagtggctcatgcctgtaatcccagcactttgggaggctgaggcggctggatcacctgaggtcagtagttcgagaccagtctggccaacatggtgaaaccccgtgtctactaaaaataaaaaaaaaattagctggatatggtgggtcatgcctgtaatcctagctactcgggaggctgaggttggagaatcgcttgaacccaggaggcggaagttgcagtgagctgagatcgcgccgctgcactctagcctgggtgacagagtatgtctctgtctcaaaaaaaaaaaaaaagttgctaaacatttctaataccataaggatccctgctgttgccagccgttttaaaactacatccatcgtcttcttggcaaccttccatctctttttcgtatgtgacagcgtcttgctctgccg

SEQ ID NO: 34391 - DNA, 271 bp, Homo sapiens
aaataggaggtagccaatttccctttgtcattagcaggttgctaaataataagtatctacacagctctttcttcatgctctgtatttaaagtatcaagtaaaataaagtcaatttagttttttaacttggcaaagcactgataaataagactatagacatcttttatagaaatgagagataaatatttacggttgaaagaatgtttatgacatttgtgggtcgattaatgtgaatttaaaaaataactataaactatcagaataaaatttc

SEQ ID NO: 34392 - DNA, 393 bp, Homo sapiens
acgtgttatatgtttctgttgataaatatgtattacctcaataaatgtgttctgcttatgtttctctaatgatttttttataaaatataatgaaatatgtatataaataaaacaccattataataataactttggtttcagagtaccacatgtgtaactaatgtaaacatagtttgttctgtaccatagaggattttataatattttgtaaaaaataaagctgtgtaaattcagaaagatactttttctatatttacatttctcttcaattttcattaagtttctcttttttcccaatttgataactcagaaataacatgtctttgacttttaaaagttctcttttataatcaaaatatggtaattctttggcagcatgtaaccaaaaaaaaa

SEQ ID NO: 34393 - DNA, 1577 bp, Homo sapiens
gctggaatttgctttgtactagtgatttgaaaaataattttctggataacgaatttccatactaaagcatcagtcaccaccaattccttattaagttaattctccttagtaactttggtgttaaagtggtaactatctgaacccaaaataaatttgtgaagagtaatttattcattctaaaaagaaattttcttacattgctagaaaagaatagtatctactaatcttattcccatactttatgaagggtgattatttagagagttttaaaagaaattaacagaacatttaaaagtgtgttctttgttgtttgtttttaaataggcaaatgaatctaacctgacatcttttttccccttgctagaaatattgagctgaatgaattacattccgaaaatgtaatgaatagtacacattttgaatgaaaactcaaagttttctagtttttaatatcttgtctggagagtgtatccactacttgaaaaatactgcagttgaattattgatattttcacctttactcttcaaagtaaagctgaaatcagaaattggaatcatattcagcaaatgtaatttctggtgggtaattttcttttttctttttaaggctattcaccatgctcttctgaattttggttggctaaaatttgagaatacagaattcccacgtttcctgcctaccctgttcattcttggttatgtccagagtggcattatttgtctttttctgtttttcattttcttttataagagaggcccaggcagatctcaaactcctgggctcaagtaatccacctgcctcagcctcccaaagtgctgggattacagtcatgagccaccactcccggccttattcatctttttttaaatacattatttctgaaattatattctatggctgattactgttatctttacaactcatcttatttgggttttcagaaagtttcaaaagattaaagttttcccaactaacaaggtaagttgccatgaactaaacatgtccccctcaaaattcatatgttcaaatcctaatccccagtgtgatgatatcagaagatggggcctttggtatatgattaggtcaggaaagtggagccctcatgaatgggattagtgccgttagaaaagggatcccagagagcgctcacctgttttccatgtgaggatacaatgagaagtcagcagtctgcaacctggaagagagcctcaccagaacctaaccatactggcaccttgatctcggacttccagcctccagaactgtgagaaatttctgttgtttataagccactcagtctatggtacattgttatagtagcctatattgactaagatagagtagatttgttttgattcttccttccgtctgttctccaaactcttaaaataagttactcccttcatgccatatcccacatcacttgcttgtataccgtgtaaatattttatatatacctgcctggcatcagtttgtgctgattttgtaaattttgaatgtgtttgttttagattttaagcataacattatggcacatatcttaataactttttatggttacaatattctggttaaa

SEQ ID NO: 34394 - DNA, 1227 bp, Homo sapiens
aaaaataaaaaacaacaacaaaatttccattggtttccagatgaggaaacagattcttaaaaagacaaacatctctccaaggtcacggtcggtgagcaagaacttggagactctgattcccagtttctgaccccctggtcaatttctatcaaatggccgaaaggactacaggatagacttatacagatctagagggttgttagccaggtgtggtggttggcacctgtaatcccagctacttggggggcagagacaggagaattgcttgaacctgggaggcagaggttgcagtgagtcaagattgcaccatttcctgggcgacgagtgaaactctgtctcaaaagaaaaaaacaaaaacatatgttatataaatttgaaagagctaataaaaatcaaatggccacaatcttcttgggaagtagattggcttaccaaaacatcaatattcattaagaatttaagtgaggtgggattacagtcatgagccaccactcccggccttattcatctttttttaaatacattatttctgaaattatattctatggctgattactgttatctttacaactcatcttatttgggttttcagaaagtttcaaaagattaaagttttcccaactaacaaggtaagttgccatgaactaaacatgtccccctcaaaattcatatgttcaaatcctaatccccagtgtgatgatatcagaagatggggcctttggtatatgattaggtcaggaaagtggagccctcatgaatgggattagtgccgttagaaaagggatcccagagagcgctcacctgttttccatgtgaggatacaatgagaagtcagcagtctgcaacctggaagagagcctcaccagaacctaaccatactggcaccttgatctcggacttccagcctccagaactgtgagaaatttctgttgtttataagccactcagtctatggtacattgttatagtagcctatattgactaagatagagtagatttgttttgattcttccttccgtctgttctccaaactcttaaaataagttactcccttcatgccatatcccacatcacttgcttgtataccgtgtaaatattttatatatacctgcctggcatcagtttgtgctgattttgtaaattttgaatgtgtttgttttagattttaagcataacattatggcacatatcttaataactttttatggttacaatattctggttaaa

SEQ ID NO: 34395 - DNA, 367 bp, Homo sapiens
ggaagagggcccaaaaagagataacagacactgaaatcatcacatattcctttagaaaggcacagtgagcacgctcattttttttccattttagacaaataatgcatgataagtataaatgtgtcatgagcacactgttttctctgtagaaataacaaaggccctggatacagtagaatgtctggccttacttttctgtaaactgcggccactttgtcctttatctgtgtggttaatttctatgaactgctggacagctgatttgaccgaggcttcttggctctgcaccgggtgataattctacctgggcagcaggccacgcgtgagagcagcttccccgaacctctctcatcccctcagtttgggc

SEQ ID NO: 34396 - DNA, 532 bp, Homo sapiens
ttgtattattatctgcaacttttcagaagagccataccagaccctcatatgcccagcacaggatccactcatgcacacctgtctagggccttgtctttatgattttctgtcacctggcttctcagccatgcctccaaccaagctatcctcaaataaagactaaccatgcacaaaaagtgaaaaattacacaagacctactcaaggtctgaaatggaaagtgcagctggtgattctgagtagtatattttatgaattgatgagcagggaatttctaggtatcacagagcaatcagcagctgaggagagagcgacaaaaccaggactctgacagggctttttggaaacttaatttttggagcaatcagcagctgaggagagagctaccaaaccaggaccctgacagggctttttggaaacttaattttttattgtcaaattatacagacaaaaatgaaagtaaaggtagtgaggagtaccacacacctttacttagaaggataaataaaggacacctttgtagggagaaaaaaa

SEQ ID NO: 34397 - DNA, 1043 bp, Homo sapiens
ccaccgcacccagcctgaaggtgactcttaagaatgagatttatgaactccatacagttgtagatttcagtttttaaatagtctggggttttatttttcttttcaaaatatctaatagacttagcaatcaatttagaacaaatatttggcccttaatatatctttagtgagggaagtagcttttatttcctgcttgtttaggttttctgttggtacataaaaacaaaattgctgtctcagactgaatctacttgaatctaggaaggcacatctcatccctattgtggtttttagggacacttttctctttcccagagatgagaggaccaattcaggacagaagagccctcgtgaataccaacgtgctagctcaggttcccttctttcctccatcagagctattggtagggttttaaggtcgtgtgtgcatcatgcttccaatgtcaagagatttcctcaaacagcctgtttactagatgaattttccagctggtgaaatacatgagctttgttgttttcctggtcttccaatagcctgtcattattgttagatattatggcacctgttgttgaatgtaggttcccttacagccctggtctagatgatcctagatggggtgagacatatgcaagccattggtatgtgcataagcagttgcaatgaaccttaggctgacttggtagtaggcatttgtctttctgttcatgcattgaataaacatttttaagaaccatctatgtgccaggctttgtgctaggcactgacagtagagagatgaagacatagtccttgcacttaaggaattcatactccagatgtctggagttaagaaatacatatttcagccaggcatggtggctcacgcctggaatcccagcactttcagaagctgaggcagaattgcttgaggccaagagtttaggactagcctggtcagcatggccggaccccgtctctataaaaaaatgtaaaaattagtcaagtcttgtggctcgcacttgtagacacaattactcaggatgctgaggcaagaggattttgc

SEQ ID NO: 34398 - DNA, 422 bp, Homo sapiens
gagacaaggtcttgctctgtcacccaggctggagtgcagtggtgtgacttcggctcactgcaacctccacctccagggttcaagtggtttttgtacctcagcctctggagtagctgggtctacaggcgcataccaccatgcttggctaatttttgtattttttgtagagacagggtttcactgtgttgcccaggcgggtctcaaactcctggcctcaagtgatctgcccaacttggcctcccaaagtgctgagattaaaagtgtgagccaccacacccagccggttctctgtaacttaaatgaggagaaaattacctgggccttgagaaacaacttttatcctggacctcttttgtctagctgaaaaatctaaatttttctggctccccctgctggtcgctcctgggcagttgcgtacaagt

SEQ ID NO: 34399 - DNA, 736 bp, Homo sapiens
agtttttctcaaaatggcatgtgtgcatgaaattctacaggcatatggggtcgtgatctgctaatctccagttattatacaaaactacagatacttgaaaacagaaccaaataaaaattctagcagaagaagacaatatatgaaatttaataattcatttcctgggaatgacagcagaaaggtgatgacagaggaaagagccaataaaatttgaagacagactactttgaaaagggactttccagctatcagtacactatctcacaattacccttgaaccagaagacaatgaatgatttgctaaacagatggcatagtctatgacatgcatcatatgtgtgagcaatcacagaaggtatgacttttctcatgaaatattttcagacaaatattttaagttaatctaacattcactaaatctacctactgattttaggtagattttctttctccaaatatacatttttaaataaaaattttcattgtattgcattgtattttattggttatcaacagcaccatgttcttagtttttttaaaaaaaatgtttaatgagttgtaatatttgtgtctttaagcaaggggttccctcatttttcctgtcttttctggcttgatttgaagttattcctgggtatcaatattctacacacattgtctactgcttacctccaacacagcagttttcactgtcatgtaattatttgtttgctcatcgctcttccccatgaccatc

SEQ ID NO: 34400 - DNA, 440 bp, Homo sapiens
tgggcaacaagagtgaaactccatctcaaaaaataaatagacaaataaaataaaataaaagattttttttaaagttagcaacttgtaaaaatgtttcagtaggaaagttcctgtgatgagactgtgatgccttgatggtcaacatcagcttgttggcttttaccccagataagccttttgactttttaccccagataacagccattgactgtccacgattgtcatcatgcagctatatttgtcataagcatcatgtgcttggatacattatgtcataagcataaatgtcctagagtaaattgtacacgagttgcattatgtgctagatgtctatccaaaggaatactctggcaattcatttggcaaagtaataattttgtgtgcatgtgcaagtatataccaatttatgcaataaaaatttttgaagtatgaaaaaaaaa

SEQ ID NO: 34401 - DNA, 461 bp, Homo sapiens
atcaaaaggaagctcaggtgggtcacaaaaataacatgaatttcaaataagtagaaatagggaaatataagcttataattactagttatgcaaatacaatttagaaggatgattgatgttcaaacataatcagggcctcagcttccttatatgtaaaatgatatactcctatttaatatgtaagggtgtcaggaggactaaatcaaacacaatacaagaaatgcctacactgtatctgctcaataaatgtgagttaccttctcttcctttcccattgaaatcataattgatcatatttttaatataattcataatttttccaacactcaacacagtaaacaattagtaaactgaagtacagagaattagacagctatgaaaaagtaaaaaagaataccaggaatgtaagtcagaaactacaaattcctgtgtaacactctacatattaagccaggcatatg

SEQ ID NO: 34402 - DNA, 787 bp, Homo sapiens
gagtgggaacggggaatgactaagtgaatgtaagatttgcttttagggaaatgttctaaacttagattctggtgatgattgtataactctaaatacactaaattgttttgaattgtacacctaaaacagatgaagagtaactttcatagtatgtaaactatatctcagtaaagctgcttaaaaaaataaccagcatgtgcgagggggaaatgggggaagagcagagtcgggtgatgcagggtctcataggctcgtcatattaagaggtgtctttttcctcaaagcaatggaaaatcatgaaaagattttagtaagggataaatggtagtgatgatgtgatcacatttgcattctaaagaacagcatgaccaatgtgtgcaaaacaacctagaattagaggtagaatgagtagatatttttttctatgctcaccaggtccctaactcctgagttgtcatatgactcaaatgtcaatgagtgatttacccgtttacctgcatttgtttatccattaccccttcttcctgaaacaccacaaggaattctggaaacagggatgatgtcttatttaactttgtattctcagcacccaacacttggtctggaattcaacaggctttcaactaatgtttacacaatgaatgatgttgaaaggagcaaagaggccgggtgcagtggctcatgcctgtaatcccagcactttgggaggccgaggcagtcagatcacctgaggtcgggagttcgagaccagcctgaccaacatagagaaaccctgcctctactaaaa

SEQ ID NO: 34403 - DNA, 863 bp, Homo sapiens
gcgagtttattgggcttgttttctgttttctagggagtaggttagtggaaaagaaaaagggccgaattcactcccacgacctctacagccgcccctgaggggaagcggtcagcgtaagtcccggatccccgctccggagccgcctcgtgggagcggggcaaggagatccaggaggggtctcgaatctgccatggcgaaccggcgagtggggcgaggctgctgggaagtgagcccgaccgagcggaggccgcccgcggggctgcggggccccgcggccgaggaggaggcgtcttccccgccggtcctgtctctcagccacttctgcaggtctcctttcctttgcttcggggacgttctcctgggagcctcacggacgctgtctctggccctagacaaccctaacgaggaggtggcagaagtgaagatctcccacttcccggccgcggacctgggcttcagtgtgtcgcagcgctgtttcgtgttgcagcctaaagagaaaattgttatttctgttaactggacaccactcaaagaaggccgagtaagagagattatgacatttcttgtaaatgatgttctgaaacaccaagctatattactaggaaatgcagaagagcagaaaaagaaaaagaggagtctttgggataccattaaaaagaagaaaatttcagcctctacaagtcacaacagaagggtttcaaatattcagaatgttaataaaacatttagtgtttcccaaaaagttgacagagttaggagcccactacaagcttgtgaaaacttggctatgaatgaaggcggtcccccaacagaaaacaattctttaatacttgaagaaaataaaatacccatatcacctatta

SEQ ID NO: 34404 - DNA, 318 bp, Homo sapiens
gcctttcaaaaggtgagctgtacagtccggcaaccactagccacatgtgattattgagcatctgactgtggcttgtctgaactgagatgtgctgtaagtgtaaaatgcacgctggattttaaagatttagaacaaaaggaatgtaaaatatctcaatcataaatttttatattgatttcatgttgaaatgacaatatttctgatatactgggttaaataaaatgtattaaagttatttttgcttttcctaatgaggctaactagacaattgaagttatacatgtggctcacatatttctataggacagtgctggtcta

SEQ ID NO: 34405 - DNA, 430 bp, Homo sapiens
gcgctgaagaagtcctggatggagagacaggtggtcttacatgtggctgtgagtggcctgtccttcagagaggctttaggaatctctaggtacaagggaaagataacatccccttgggctgcagtccaggttcattcaacaagggaagaaaactggaaaacatctgatgtctgttttaccagagttgttactattacttttactattattgttttttgtttttttgttttttttttgagacgaagttttgctcttgttgccattgcactccagcctgggtgacagaatgagaccctgtctccaaaaataaataaataaataaataaataaataaataaataaaagtttcccatgtgcatgtgtgcacatatgtgtgtacacttatggacatttggggacacctcctgcaccccgcagtggtgcagttatt

SEQ ID NO: 34406 - DNA, 373 bp, Homo sapiens
aagcatgcctagtaaggactccatcatcaagtgtatccatgggtacatgggatttggctcacgtagaccctaatgatgtaagttgattgcatgagaagtttgctttcaatcaagttgcatgttttctgattaaacccaatgacccacttgcaaatctattgcttcctatcctatgactctgagctctgctgacttaagagattttggtacccaagggaagaatacttctttggtactcaaggaagaataccctgaatcggagactgagcctgtcacctggactttcggagcttttcttttccctatgtgtgtataaagggagttacagtcttgattagggtaatcaaccaccctgtcaaggggaaatatggtt

SEQ ID NO: 34407 - DNA, 151 bp, Homo sapiens
caatcaaaagaattacaattgctactaggaaacactaaatctgaggattctgtcatgactatgtatagctggttagaaaaatctttgctgaattgaatggctttctcattacagatggccttgtttacactgtacttagagttctgtgtgc

SEQ ID NO: 34408 - DNA, 440 bp, Homo sapiens
gcggagattgtgccattgcatttcagcctgggcaacaagagcgaaacctgaaactctgtctcaaaaaaaagaaagagaaagattctctgatcagtttgggacatgttatgtttaggttgccttcaggtcatctaaatgatgatatttagaaggtagatggaagtaaggccctaaagtccagaaaaaaagtgtgagatacaggtgagctggaggatggtgtggaagccaattgaaattatgtatataaagggaaggaggatactttttctaatgtttgcgttagcataagaaagatgctgataaattatatttagtggtccttcattaatattcatgaagtgaagggcttgccatgggtgaagcatttgattgttctgcctggcatccagagatacataatacataatttcctacattcaaaagttgtacagcaggaaaaa

SEQ ID NO: 34409 - DNA, 1109 bp, Homo sapiens
tcaaatatgaataaaggaatcctccatgagaaattaacaataagacttagtaatgcatttaaaaaatagtacttcctgaccaagtagggtttatctcaatattgaaaggttagtttacttttagaatttatcagtaaatgtgtcatattggcatattaaaaaagaaaatgggattatatataaggatgatgttactagttataaaaagagagggaggccaggcatggtggctcacgcctgtaaccccaacactttcggaggccaagcagggtggattgtttgagctcaggagtttgagatcggcctggccaatatggcaaaaccttgtctctactaaaaatacaaaaaatagctgggcatggtgatgcatgcctgtagtcccagctacttgggaggctgaggcatgaggctctctggagcccaggaggcggaggttgcagtgagccaagatcgtgtcactgcactccagactaggtgacagagtgagaacctgtatcaaaaaaaaaaaaagagagagagagggagaaacctatgaaatttaacaaccatttctgctaaaatctctcagtaaacacagaatagataggaacttccctaacttgataaagtgtatctaccagaaacctatagcaacctgcatatgaaagagggatttaaaaaatttccatcaaagtctcagaacaagcagagaaggactattctacattcccttggatgtgctagccaaagcaatgagatatacaacaacaacacagagcgcaataaagattggggtaaattcagcattatttgcagtcaatattatgacttagaccaggagtaggcaaactttttctgttaaggagcagataataagtattttagggattgtaggccagaagacatctgtgacaattactcagttttgccctaataacataacagaactaagatccattatatctgtagtaaaatatataaatatgcttaattcatgtattttaaagattttcagagtgaattataaggcaaaacctaatgctctgtgttgtggaagagaaacagaaacaaactgactcaggaaagttaaaataaaaggatggacaaatgtgaataaaaagaaagcaggt

SEQ ID NO: 34410 - DNA, 463 bp, Homo sapiens
catacactgcattacaggtgggtgtcgacttccacctccagcctgtgagatgcctgcagggagccatcctgagtcctccgaattgacacagtgtctttggggtaggaatttcccagtgaatgcttacttaaatgaattcaaaaagagaaaacatttccatggaagaggaaacaggaaattccaacagatcagcaacagttggagtgctaacctgtcactggaatgggaaaaaaaatgctgtcgttgacacatcttttccttgtttttgacacaaattagaaacaccacctggaacacagctgtgactagataaacaagtgaaacattctttggtgtggtgaggggaaaacaaatttctcaaaggacacgcaccatggtgtatgagaggacactggagcccagccagcatctgacatgctgaattcaaagtgcaggtgaaagtaggacaactgattcacaagct

SEQ ID NO: 34411 - DNA, 302 bp, Homo sapiens
agttcattattcctgtaaaccaggggttgacaaactttctgagaagggcctgatactttctctctcagggtcttttttttgctatttgcctcttttaaaaaacaactttataaaaaaagttaaaaaccatttctcagcaatgtaaaaactctacttagcaggggggctgtacatcacagccaaggaacaccagatctggcccagaggccatcatttgcagagatacctcctgtagacagttgttcctgcttcatgtgagactgtgtcaatatgctaatatgctgataaaccaaagttctaag

SEQ ID NO: 34412 - DNA, 672 bp, Homo sapiens
  misc_feature (1)..(1): n is a, c, g, or t
ngttgtcataaagagttaagagtatatattctaaaactacagggatctaggttcaaattccaacttattcacttactagctctgtgacgttggccatgttacttaatctctctaatcctattttctcatctacaaagtggggataaataatagtcttttcctcataaggtcagaggaagattacctgaaagaatgcctaaatgcccagctaatgtcagtgacacttcccattatcttgtcacagggtctgttatcactgtaggcaaagtggggtggtatcattgcctgcccagtcccgagggctttgggcttgcagaaagaagaggaggcagttcccttcttcccaggatctcagttctttatcttagattcccaagagagctcagcctaggaagttttcttagactagctggggtctccaggacaaaggttgtattcactagggtagaacaaataaaataaaataaatacaaattaaaaaaagaaaaggaatgacgggtgggaagatggcagggaaacctcccacactgttactcagcactgtgccttctgctcttggggttcctggttctccttacaaactggagaaaagagactgatagacaaaggctaaagcaagaaatctgggatgggaaagggggaaagaaagaaaacagggaggtggtagatgaa

SEQ ID NO: 34413 - DNA, 711 bp, Homo sapiens
gggcaatatcagctatagcccttctatataaaactgttggagagatagtcatggggtcctctcccttactgccttcattccgtattcagttgagctacttctgaattcccatcataactcaacacttgtctttcaatagattaacttcctattaggtcttaattttattatcctctaatgttaccatctcgttgcagtaatcctaaccttgccactctctctctctctctcttttttagacagggtcttgctctgtcacccaggctggactgcagtggtgtgttcacagctcactgctgccttgacctcctgggctcagttaatctgcctgcctcagcctcccgagtagctgggactacaggcttgcaccactgcacctggctaatttttatattttttgtagagacagggcttaccatgttgcccaggctggtctcaaactcctgggctcaagcggtctgcccaccttgagtggcacttgtggatctctagtgcctttttaagcatccctatacatccaggtagttagtatttgtttgcctctacctggagagaatgacggtatacttggactgtgatgttacagggatatacagtgccccacttacttttcccaaatactgaaatatgaatttagcagaccacaaagtgctaggattataggcatgagccactgcaccaggcctggccagtcttctgataagacctctc

SEQ ID NO: 34414 - DNA, 403 bp, Homo sapiens
ttcatcattctgcaaatcagcaagactcacttcaaacagaagacccttgagaccatcagatgcaatttgggttccttgggtcctggcgaccaagtctttccagtatttcttatattgaacatagcaggtgctttcacatcatactgatctttcttagagaatggaccaactactttcttcttaactccctttttgccacctttcataaggcacttgttcttaacaaccgccatggtgctgcttggagtaccaaaaggctaaattttatatttttggtagagacgggatttcaggatgttggccaagctgctcttgaactcctgatgtcaggtgatctgcccgcctctgcctcccaaagtgctgggattacaagtgtggaccactgcacccagctgttatttat

SEQ ID NO: 34415 - DNA, 2119 bp, Homo sapiens
caggagagggctctactctgagctcctattttccaaggctccgggccgcgctcggcgctggcctgctgccccggcgggtccgccggccggaggggggagtcacaggaagagccctccacaaaaggaggcctcggcggatcaggacagctgcaggtgggtgtgcagactggtgagctgccagcaggggcccagacgcgccaggcctggagatggctggaaactgctcctgggaggcccatcccggcaacaggaacaagatgtgccctggcctgagcgaggccccggaactctacagccggggcttcctgaccatcgagcagatcgcgatgctgccgcctccggccgtcatgaactacatcttcctgctcctctgcctgtgtggcctggtgggcaacgggctggtcctctggtttttcggcttctccatcaagaggaaccccttctccatctacttcctgcacctggccagcgccgatgtgggctacctcttcagcaaggcggtgttctccatcctgaacacggggggcttcctgggcacgtttgccgactacatccgcagcgtgtgccgggtcctggggctctgcatgttccttaccggcgtgagcctcctgccggccgtcagcgccgagcgctgcgcctcggtcatcttccccgcctggtactggcgccggcggcccaagcgcctgtcggccgtggtgtgcgccctgctgtgggtcctgtccctcctggtcacctgcctgcacaactacttctgcgtgttcctgggccgcggggcccccggcgcggcctgcaggcacatggacatcttcctgggcatcctcctgttcctgctctgctgcccgctcatggtgctgccctgcctggccctcatcctgcacgtggagtgccgggcccgacggcgccacgctctgccaagctcaaccacgtcatcctggccatggtctccgtcttcctggtgtcctccatctacttagggatcgactggttcctcttctgggtcttccagatcccggcccccttccccgagtacgtcactgacctgtgcatctgcatcaacagcagcgccaagccatcgtctacttcctggccgggagggacaagtcgcagcggctgtgggagccgctcagggtggtcttccagcgggccctgcgggacggcgctgagctgggggaggccgggggcagcacgcccaacacagtcaccatggagatgcagtgtcccccggggaacgcctcctgagactccagcgcctggaggaggcaggggcaggaagcggcctccaagacccttcgccttgggacaggaatgggcacctgcttctgagtccatacaggagaagaaagatctgtttcctctcctcgggcctccttctccctgggctggggactccaggggtggctgggagactgggcagccaccagcaaacagaccctgtggcccctgcccggctcccccacccattctgctcccctagagacctcttgtacagaagttgcccccaggtggtggggcccctccttgccctaggctggttggtaaaagagaggaggtcaacacccagcctagccacctctgcctcttgggtcagccctccttgactgtgtcccagccagcaccaggccagcagcctcatccctgccattcagggctgttccagagattcgatcctcttaaggcattatcagtgagcaaatgtgaaggaaatggtgtctggaagaaagttctggttcacatgccttgtagctaagtctttctgcaaacaacctcccttccccccgtcgagtcatttggtgactttgatggggggatttctggttatgtcaaggctctggagacaggaagggcctttggccgccttgggtagttgacctgccttttctgactccgggacgagccagtcctaggctgcctccgggagcacttgaggtatcccgcaggccatgaggacccactgggcagctcctggacagcctcttggctccagcccccacccgaaagtggacactggctccgccctggccacctggggactggcactgtggtgcacagtggcccaatgtggccaacggaagttttataaaagacaaaatgtatatcaataaacattttataacttgca

SEQ ID NO: 34416 - DNA, 1802 bp, Homo sapiens
caggagagggctctactctgagctcctattttccaaggctccgggccgcgctcggcgctggcctgctgccccggcgggtccgccggccggaggggggagtcacaggaagagccctccacaaaaggaggcctcggcggatcaggacagctgcaggtgggtgtgcagactggtgagctgccagcaggggcccagacgcgccaggcctggagatggctggaaactgctcctgggaggcccatcccggcaacaggaacaagatgtgccctggcctgagcgaggccccggaactctacagccggggcttcctgaccatcgagcagatcgcgatgctgccgcctccggccgtcatgaactacatcttcctgctcctctgcctgtgtggcctggtgggcaacgggctggtcctctggtttttcggcttctccatcaagaggaaccccttctccatctacttcctgcacctggccagcgccgatgtgggctacctcttcagcaaggcggtgttctccatcctgaacacggggggcttcctgggcacgtttgccgactacatccgcagcgtgtgccgggtcctggggctctgcatgttccttaccggcgtgagcctcctgccggccgtcagcgccgagcgctgcgcctcggtcatcttccccgcctggtactggcgccggcggcccaagcgcctgtcggccgtggtgtgcgccctgctgtgggtcctgtccctcctggtcacctgcctgcacaactacttctgcgtgttcctgggccgcggggcccccggcgcggcctgcaggcacatggacatcttcctgggcatcctcctgttcctgctctgctgcccgctcatggtgctgccctgcctggccctcatcctgcacgtggagtgccgggcccgacggcgccacgctctgccaagctcaaccacgtcatcctggccatggtctccgtcttcctggtgtcctccatctacttagggatcgactggttcctcttctgggtcttccagatcccggcccccttccccgagtacgtcactgacctgtgcatctgcatcaacagcagcgccaagccatcgtctacttcctggccgggagggacaagtcgcagcggctgtgggagccgctcagggtggtcttccagcgggccctgcgggacggcgctgagctgggggaggccgggggcagcacgcccaacacagtcaccatggagatgcagtgtcccccggggaacgcctcctgagactccagcgcctggaggaggcaggggcaggaagcggcctccaagacccttcgccttgggacaggaatgggcacctgcttctgagtccatacaggagaagaaagatctgtttcctctcctcgggcctccttctccctgggctggggactccaggggtggctgggagactgggcagccaccagcaaacagaccctgtggcccctgcccggctcccccacccattctgctcccctagagacctcttgtacagaagttgcccccaggtggtggggcccctccttgccctaggctgccttttctgactccgggacgagccagtcctaggctgcctccgggagcacttgaggtatcccgcaggccatgaggacccactgggcagctcctggacagcctcttggctccagcccccacccgaaagtggacactggctccgccctggccacctggggactggcactgtggtgcacagtggcccaatgtggccaacggaagttttataaaagacaaaatgtatatcaataaacattttataacttgcagccaggaaggcttcatgcccacag

SEQ ID NO: 34417 - DNA, 2143 bp, Homo sapiens
caggagagggctctactctgagctcctattttccaaggctccgggccgcgctcggcgctggcctgctgccccggcgggtccgccggccggaggggggagtcacaggaagagccctccacaaaaggaggcctcggcggatcaggacagctgcaggtgggtgtgcagactggtgagctgccagcaggggcccagacgcgccaggcctggagatggctggaaactgctcctgggaggcccatcccggcaacaggaacaagatgtgccctggcctgagcgaggccccggaactctacagccggggcttcctgaccatcgagcagatcgcgatgctgccgcctccggccgtcatgaactacatcttcctgctcctctgcctgtgtggcctggtgggcaacgggctggtcctctggtttttcggcttctccatcaagaggaaccccttctccatctacttcctgcacctggccagcgccgatgtgggctacctcttcagcaaggcggtgttctccatcctgaacacggggggcttcctgggcacgtttgccgactacatccgcagcgtgtgccgggtcctggggctctgcatgttccttaccggcgtgagcctcctgccggccgtcagcgccgagcgctgcgcctcggtcatcttccccgcctggtactggcgccggcggcccaagcgcctgtcggccgtggtgtgcgccctgctgtgggtcctgtccctcctggtcacctgcctgcacaactacttctgcgtgttcctgggccgcggggcccccggcgcggcctgcaggcacatggacatcttcctgggcatcctcctgttcctgctctgctgcccgctcatggtgctgccctgcctggccctcatcctgcacgtggagtgccgggcccgacggcgccacgctctgccaagctcaaccacgtcatcctggccatggtctccgtcttcctggtgtcctccatctacttagggatcgactggttcctcttctgggtcttccagatcccggcccccttccccgagtacgtcactgacctgtgcatctgcatcaacagcagcgccaagccatcgtctacttcctggccgggagggacaagtcgcagcggctgtgggagccgctcagggtggtcttccagcgggccctgcgggacggcgctgagctgggggaggccgggggcagcacgcccaacacagtcaccatggagatgcagtgtcccccggggaacgcctcctgagactccagcgcctggaggaggcaggggcaggaagcggcctccaagacccttcgccttgggacaggaatgggcacctgcttctgagtccatacaggagaagaaagatctgtttcctctcctcgggcctccttctccctgggctggggactccaggggtggctgggagactgggcagccaccagcaaacagaccctgtggcccctgcccggctcccccacccattctgctcccctagagacctcttgtacagaagttgcccccaggtggtggggcccctccttgccctaggctggttggtaaaagagaggaggtcaacacccagcctagccacctctgcctcttgggtcagccctccttgactgtgtcccagccagcaccaggccagcagcctcatccctgccattcagggctgttccagagattcgatcctcttaaggcattatcagtgagcaaatgtgaaggaaatggtgtctggaagaaagttctggttcacatgccttgtagctaagtctttctgcaaacaacctcccttccccccgtcgagtcatttggtgactttgatggggggatttctggttatgtcaaggctctggagacaggaagggcctttggccgccttgggtagttgacctgccttttctgactccgggacgagccagtcctaggctgcctccgggagcacttgaggtatcccgcaggccatgaggacccactgggcagctcctggacagcctcttggctccagcccccacccgaaagtggacactggctccgccctggccacctggggactggcactgtggtgcacagtggcccaatgtggccaacggaagttttataaaagacaaaatgtatatcaataaacattttataacttgcagccaggaaggcttcatgcccacag

SEQ ID NO: 34418 - DNA, 2156 bp, Homo sapiens
caggagagggctctactctgagctcctattttccaaggctccgggccgcgctcggcgctggcctgctgccccggcgggtccgccggccggaggggggagtcacaggaagagccctccacaaaaggaggcctcggcggatcaggacagctgcaggtgggtgtgcagactggtgagctgccagcaggggcccagacgcgccaggcctggagatggctggaaactgctcctgggaggcccatcccggcaacaggaacaagatgtgccctggcctgagcgaggccccggaactctacagccggggcttcctgaccatcgagcagatcgcgatgctgccgcctccggccgtcatgaactacatcttcctgctcctctgcctgtgtggcctggtgggcaacgggctggtcctctggtttttcggcttctccatcaagaggaaccccttctccatctacttcctgcacctggccagcgccgatgtgggctacctcttcagcaaggcggtgttctccatcctgaacacggggggcttcctgggcacgtttgccgactacatccgcagcgtgtgccgggtcctggggctctgcatgttccttaccggcgtgagcctcctgccggccgtcagcgccgagcgctgcgcctcggtcatcttccccgcctggtactggcgccggcggcccaagcgcctgtcggccgtggtgtgcgccctgctgtgggtcctgtccctcctggtcacctgcctgcacaactacttctgcgtgttcctgggccgcggggcccccggcgcggcctgcaggcacatggacatcttcctgggcatcctcctgttcctgctctgctgcccgctcatggtgctgccctgcctggccctcatcctgcacgtggagtgccgggcccgacggcgccacgctctgccaagctcaaccacgtcatcctggccatggtctccgtcttcctggtgtcctccatctacttagggatcgactggttcctcttctgggtcttccagatcccggcccccttccccgagtacgtcactgacctgtgcatctgcatcaacagcagcgccaagccatcgtctacttcctggccgggagggacaagtcgcagcggctgtgggagccgctcagggtggtcttccagcgggccctgcgggacggcgctgagctgggggaggccgggggcagcacgcccaacacagtcaccatggagatgcagtgtcccccggggaacgcctcctgagactccagcgcctggaggaggcaggggcaggaagcggcctccaagacccttcgccttgggacaggaatgggcacctgcttctgagtccatacaggagaagaaagatctgtttcctctcctcgggcctccttctccctgggctggggactccaggggtggctgggagactgggcagccaccagcaaacagaccctgtggcccctgcccggctcccccacccattctgctcccctagagacctcttgtacagaagttgcccccaggtggtggggcccctccttgccctaggctggttggtaaaagagaggaggtcaacacccagcctagccacctctgcctcttgggtcagccctccttgactgtgtcccagccagcaccaggccagcagcctcatccctgccattcagggctgttccagagattcgatcctcttaaggcattatcagtgagcaaatgtgaaggaaatggtgtctggaagaaagttctggttcacatgccttgtagctaagtctttctgcaaacaacctcccttccccccgtcgagtcatttggtgactttgatggggggatttctggttatgtcaaggctctggagacaggaagggcctttggccgccttgggtagttgacctgccttttctgactccgggacgagccagtcctaggctgcctccgggagcacttgaggtatcccgcaggccatgaggacccactgggcagctcctggacagcctcttggctccagcccccacccgaaagtggacactggctccgccctggccacctggggactggcactgtggtgcacagtggcccaatgtggccaacggaagttttataaaagacaaaatgtatatcaataaacattttataacttgcaaaaaaaaaacaaaaagggcggggccgctctaagaggt

SEQ ID NO: 34419 - DNA, 302 bp, Homo sapiens
tataattccatttatatgaaatgcccagaataggcaaatctatacagatagaaagtagattagtggttgccaggggatgggaaaaaagggtaacagtgagtgactgataatgggtatggggtttctttttgagatgatgaaaatgttttaaaattagatagtagagatggttgcacagccttgtgaatattctagaaaacactgaatagtataatttaaaacattttatgccttatgagttatatctcaaaaaacccaaaatgcacacctatgtatgtgtggacaagaagcatgaatgaata

SEQ ID NO: 34420 - DNA, 483 bp, Homo sapiens
cgtgtgtgcccattacatggcgagatccttgaagacagagactcattccccgtctgcctcccaccaccttgaacactcccaactcctaaagtgccaacacaggtttaatttgccgaattaaatcttcagttctgctgattctgctgagtacattcctctgctacaaagctaatggttccaaaacaaaatgattaagtatttgaatcctggagcatcaacactgccttttaaaatacagcaaagtctaaactagtccagctgaaacatctgtgagcttcagttccaatgagggagtccagggagttagaaactggaagagcaccttttttcagtggccgggaagatggcggacattcagactgagcgtgcctaccaaaagcagccgaccatctttcaaaacaagaagagggtcctgctgggagaaactggcaaggagaagctcccgcggtactacaagaacattggtctgggcttcaagacacc

SEQ ID NO: 34421 - DNA, 382 bp, Homo sapiens
tgaagaaatgaagaaaacaaggaatttacatctaaaaagactggcttttaattctcacattttaatgcatgatatggtttggctgtgtctccacccaaatttcatcttgaattgtagctcccataattctctcgtgttgtgggaggcacctagtgggagataattgaatcataggggtgttttcccccatattgttctcatggtagtgaataagtctcacaatatctgatggttttgtaatgggaaatcccttttgcttggctctctgattctgtcttatctgctgccacatgagatgtggctttcgctttccaccatgattgtgaggcctcccagccacgtagaacagtgactccattaaacctctttcctttgtaaattg

SEQ ID NO: 34422 - DNA, 334 bp, Homo sapiens
acaagattggccgaactggctctcaggctcccggctcactcatgctcatcctgtcactacaggaccttaaagaaaagttttaaagtgatttttaacttttttccagaaaaaaactatattctccccttccttgagtgtgctggccaagtgtgatggcctgtatgattcgagccgcgccagcgcttccttcccggctcccttccctgctgcgccaaggtcacccagccacgtggcattctcttacctcatggcaggcagcactgcgatcttatcagagctcacatttgcagccttcgtgaactggattttgaaagttaaaacagttaaaaaaaaa

SEQ ID NO: 34423 - DNA, 281 bp, Homo sapiens
gcggccgcctactactactatctactgctcgaattcaagcttctaacggatgtacggggacatgcctctgtgagcgatgacggagcaacagctctccagcacgtgaagctctccagacagctgttcgtgagaagccagacagaggcctggggtctcagtccagatttctggggagtggggtgtccaagcgtgggccacgctgctgggagccacctagggaagcaggtcgcctgtttctatagtgacggtaataaaccaagtcaattttctatagtgaaaat

SEQ ID NO: 34424 - DNA, 428 bp, Homo sapiens
gaccgcactgacaggaaaccttccgtcgtgagggagcacttcccaggggccgcagggacgacactctccagggaggccccagcaaccacaccatcttcttgctgtgagaggtcaggtccgcaaaggcttctgaagaagaggaagggcgagtaggggcacctggacgctgatggtggccaggatgctcagctggccaggagggcagcacctgctggggacggtggccctgccttcatgcccaggacaccagctgggtccagctagcagccactgggaatcagaggaatggggcaagttgcccagggtgggggtgcctagccaggtgcagtccccgccccgcctagtcctcggcgtcacgcaatgctcacctcgcctcttccccactaacatcccagactttaaaattcagtaaatcagatgtacaccga

SEQ ID NO: 34425 - DNA, 2377 bp, Homo sapiens
agccccgagcgagcggagcgagcgagcgagttgccgagcgcgccccgtccctcgcgcgcgatgctcccctggacggcgctcggcctggccctgagcttgcggctggcgctggcgcggagcggcgcggagcgcggtccaccagcatcagccccccgaggggacctgatgttcctgctggacagctcagccagcgtctctcactacgagttctcccgggttcgggagtttgtggggcagctggtggctccactgcccctgggcaccggggccctgcgtgccagtctggtgcacgtgggcagtcggccatacaccgagttccccttcggccagcacagctcgggtgaggctgcccaggatgcggtgcgtgcttctgcccagcgcatgggtgacacccacactggcctggcgctggtctatgccaaggaacagctgtttgctgaagcatcaggtgcccggccaggggtgcccaaagtgctggtgtgggtgacagatggcggctccagcgaccctgtgggcccccccatgcaggagctcaaggacctgggcgtcaccgtgttcattgtcagcaccggccgaggcaacttcctggagctgtcagccgctgcctcagcccctgccgagaagcacctgcactttgtggacgtggatgacctgcacatcattgtccaagagctgaggggctccattctcgacgcgatgcggccgcagcagctccatgccacggagatcacgtccagcggcttccgcctggcctggccacccctgctgaccgcagactcgggctactatgtgctggagctggtgcccagcgcccagccgggggctgcaagacgccagcagctgccagggaacgccacggactggatctgggccggcctcgacccggacacggactacgacgtggcgctagtgcctgagtccaacgtgcgcctcctgaggccccagatcctgcgggtgcgcacgcggcccggtgaggcagggccgggggcttcgggcccggagtcgggggctgggccggcccccacgcagctcgccgccctccccgccccagaggaggccgggccagagcgcatcgtcatctcccacgcccggccgcgcagcctccgcgtgagttgggccccagcgctgggctcagccgcggcgctcggctaccacgtgcagttcgggccgctgcggggcggggaggcgcagcgggtggaggtgcccgcgggccgcaactgcaccacgctgcagggcctggcgccgggcaccgcctacctggtgaccgtgaccgccgccttccgctcgggccgcgagagcgcgctgtccgccaaggcctgcacgcccgacggcccgcgcccgcgcccacgccccgtgccccgcgccccgaccccggggaccgccagccgtgagccgtaagccggcgtccccgcccagccgagagggccggcgcctacctgagggcccctgtgtcccgaacccggagcggaggcgcccaacccggcagacgggtgcaggcccggcctttccccacgcggactccgcgcgaccccggccctctccctgcggccgcagggcttccccgcctggcgcctgccctccagggctggggcctcgcctggcgggaccccgcagcagccccggccccatccccgcccagagccgggcgtcgtgtgggtccgtgggtgataattgagagcgtcagacccaggactgttcagggaggagccccggtcagactcccacgtgtgaagaccgggccccaagtggcaagggctggcctggggcgggcagcttgggtcctggacgttgataggaagcggaaggggaatcgcgggaagctggcccaggtcaggtccgcaaaggcttctgaagaagaggaagggcgagtaggggcacctggacgctgatggtggccaggatgctcagctggccaggagggcagcacctgctggggacggtggccctgccttcatgcccaggacaccagctgggtccagctagcagccactgggaatcagaggaatggggcagagctgggcattcaggaccttgaggacacgtgaccccacccgcccaccgccactatcaggccccgggaccgcactgacaggaaaccttccgtcgtgagggagcacttcccaggggccgcagggacgacactctccagggaggccccagcaaccacaccatcttcttgctgtgagaggtctcaccccgggctacctcctgtcactactcactgccctggggtccgtgggcaagttgcccagggtgggggtgcctagccaggtgcagtccccgccccgcctagtcctcggcgtcacgcaatgctcacctcgcctcttccccactaacatcccagactttaaaattcagtaaatcagatgtacaccga

SEQ ID NO: 34426 - DNA, 2873 bp, Homo sapiens
tgctgcttccttttttaggcaaagtcgagtgctggccgtccgcacggccccgcggtgtctcacctgcctgaaagggaggaaggaagcctgtggagccccatccgttctcccgcggcgcatcctccaggagagggtggggaaggaggagacatcctggcagacacccccccacgtcccccacctcccagctctgagctgaggaggccctggaagagggccatggctactccgagggagggccggggtagggttctcctgtccaggggacactgctggcccagccccacccaagcaggggaaatctgccctgggagccactgtccctcaggacgccccctgcaaccagccacctctcgtctgggcctcaccaagaccccaagactcaagagctcctgtctcaccagtgggaccctccagtcctgctgggggtgtgtcctgggtcctggagtctgggcccctcactgggtagggtatatgggtaacaggcccagtgtggtcccactggacagggcctcaaccaaccatctcccactcccatgcctcttcctccaagaagcccaggtggcgtgggtgcttcgagtctctctcgaattcctgtcttctgtcccctttcaagccactgtgtccttgtccaccagcatcagccccccgaggggacctgatgttcctgctggacagctcagccagcgtctctcactacgagttctcccgggttcgggagtttgtggggcagctggtggctccactgcccctgggcaccggggccctgcgtgccagtctggtgcacgtgggcagtcggccatacaccgagttccccttcggccagcacagctcgggtgaggctgcccaggatgcggtgcgtgcttctgcccagcgcatgggtgacacccacactggcctggcgctggtctatgccaaggaacagctgtttgctgaagcatcaggtgcccggccaggggtgcccaaagtgctggtgtgggtgacagatggcggctccagcgaccctgtgggcccccccatgcaggagctcaaggacctgggcgtcaccgtgttcattgtcagcaccggccgaggcaacttcctggagctgtcagccgctgcctcagcccctgccgagaagcacctgcactttgtggacgtggatgacctgcacatcattgtccaagagctgaggggctccattctcgacgcgatgcggccgcagcagctccatgccacggagatcacgtccagcggcttccgcctggcctggccacccctgctgaccgcagactcgggctactatgtgctggagctggtgcccagcgcccagccgggggctgcaagacgccagcagctgccagggaacgccacggactggatctgggccggcctcgacccggacacggactacgacgtggcgctagtgcctgagtccaacgtgcgcctcctgaggccccagatcctgcgggtgcgcacgcggcccggtgaggcagggccgggggcttcgggcccggagtcgggggctgggccggcccccacgcagctcgccgccctccccgccccagaggaggccgggccagagcgcatcgtcatctcccacgcccggccgcgcagcctccgcgtgagttgggccccagcgctgggctcagccgcggcgctcggctaccacgtgcagttcgggccgctgcggggcggggaggcgcagcgggtggaggtgcccgcgggccgcaactgcaccacgctgcagggcctggcgccgggcaccgcctacctggtgaccgtgaccgccgccttccgctcgggccgcgagagcgcgctgtccgccaaggcctgcacgcccgacggcccgcgcccgcgcccacgccccgtgccccgcgccccgaccccggggaccgccagccgtgagccgtaagccggcgtccccgcccagccgagagggccggcgcctacctgagggcccctgtgtcccgaacccggagcggaggcgcccaacccggcagacgggtgcaggcccggcctttccccacgcggactccgcgcgaccccggccctctccctgcggccgcagggcttccccgcctggcgcctgccctccagggctggggcctcgcctggcgggaccccgcagcagccccggccccatccccgcccagagccgggcgtcgtgtgggtccgtgggtgataattgagagcgtcagacccaggactgttcagggaggagccccggtcagactcccacgtgtgaagaccgggccccaagtggcaagggctggcctggggcgggcagcttgggtcctggacgttgataggaagcggaaggggaatcgcgggaagctggcccaggtcaggtccgcaaaggcttctgaagaagaggaagggcgagtaggggcacctggacgctgatggtggccaggatgctcagctggccaggagggcagcacctgctggggacggtggccctgccttcatgcccaggacaccagctgggtccagctagcagccactgggaatcagaggaatggggcagagctgggcattcaggaccttgaggacacgtgaccccacccgcccaccgccactatcaggccccgggaccgcactgacaggaaaccttccgtcgtgagggagcacttcccaggggccgcagggacgacactctccagggaggccccagcaaccacaccatcttcttgctgtgagaggtctcaccccgggctacctcctgtcactactcactgccctggggtccgtgggcaagttgcccagggtgggggtgcctagccaggtgcagtccccgccccgcctagtcctcggcgtcacgcaatgctcacctcgcctcttccccactaacatcccagactttaaaattcagtaaatcagatgtacaccga

SEQ ID NO: 34427 - DNA, 1982 bp, Homo sapiens
agccccgagcgagcggagcgagcgagcgagttgccgagcgcgccccgtccctcgcgcgcgatgctcccctggacggcgctcggcctggccctgagcttgcggctggcgctggcgcggagcggcgcggagcgcggagctcaaggacctgggcgtcaccgtgttcattgtcagcaccggccgaggcaacttcctggagctgtcagccgctgcctcagcccctgccgagaagcacctgcactttgtggacgtggatgacctgcacatcattgtccaagagctgaggggctccattctcgacgcgatgcggccgcagcagctccatgccacggagatcacgtccagcggcttccgcctggcctggccacccctgctgaccgcagactcgggctactatgtgctggagctggtgcccagcgcccagccgggggctgcaagacgccagcagctgccagggaacgccacggactggatctgggccggcctcgacccggacacggactacgacgtggcgctagtgcctgagtccaacgtgcgcctcctgaggccccagatcctgcgggtgcgcacgcggcccggtgaggcagggccgggggcttcgggcccggagtcgggggctgggccggcccccacgcagctcgccgccctccccgccccagaggaggccgggccagagcgcatcgtcatctcccacgcccggccgcgcagcctccgcgtgagttgggccccagcgctgggctcagccgcggcgctcggctaccacgtgcagttcgggccgctgcggggcggggaggcgcagcgggtggaggtgcccgcgggccgcaactgcaccacgctgcagggcctggcgccgggcaccgcctacctggtgaccgtgaccgccgccttccgctcgggccgcgagagcgcgctgtccgccaaggcctgcacgcccgacggcccgcgcccgcgcccacgccccgtgccccgcgccccgaccccggggaccgccagccgtgagccgtaagccggcgtccccgcccagccgagagggccggcgcctacctgagggcccctgtgtcccgaacccggagcggaggcgcccaacccggcagacgggtgcaggcccggcctttccccacgcggactccgcgcgaccccggccctctccctgcggccgcagggcttccccgcctggcgcctgccctccagggctggggcctcgcctggcgggaccccgcagcagccccggccccatccccgcccagagccgggcgtcgtgtgggtccgtgggtgataattgagagcgtcagacccaggactgttcagggaggagccccggtcagactcccacgtgtgaagaccgggccccaagtggcaagggctggcctggggcgggcagcttgggtcctggacgttgataggaagcggaaggggaatcgcgggaagctggcccaggtcaggtccgcaaaggcttctgaagaagaggaagggcgagtaggggcacctggacgctgatggtggccaggatgctcagctggccaggagggcagcacctgctggggacggtggccctgccttcatgcccaggacaccagctgggtccagctagcagccactgggaatcagaggaatggggcagagctgggcattcaggaccttgaggacacgtgaccccacccgcccaccgccactatcaggccccgggaccgcactgacaggaaaccttccgtcgtgagggagcacttcccaggggccgcagggacgacactctccagggaggccccagcaaccacaccatcttcttgctgtgagaggtctcaccccgggctacctcctgtcactactcactgccctggggtccgtgggcaagttgcccagggtgggggtgcctagccaggtgcagtccccgccccgcctagtcctcggcgtcacgcaatgctcacctcgcctcttccccactaacatcccagactttaaaattcagtaaatcagatgtacaccga

SEQ ID NO: 34428 - DNA, 4497 bp, Homo sapiens
agccccgagcgagcggagcgagcgagcgagttgccgagcgcgccccgtccctcgcgcgcgatgctcccctggacggcgctcggcctggccctgagcttgcggctggcgctggcgcggagcggcgcggagcgcggtccaccagcatcagccccccgaggggacctgatgttcctgctggacagctcagccagcgtctctcactacgagttctcccgggttcgggagtttgtggggcagctggtggctccactgcccctgggcaccggggccctgcgtgccagtctggtgcacgtgggcagtcggccatacaccgagttccccttcggccagcacagctcgggtgaggctgcccaggatgcggtgcgtgcttctgcccagcgcatgggtgacacccacactggcctggcgctggtctatgccaaggaacagctgtttgctgaagcatcaggtgcccggccaggggtgcccaaagtgctggtgtgggtgacagatggcggctccagcgaccctgtgggcccccccatgcaggagctcaaggacctgggcgtcaccgtgttcattgtcagcaccggccgaggcaacttcctggagctgtcagccgctgcctcagcccctgccgagaagcacctgcactttgtggacgtggatgacctgcacatcattgtccaagagctgaggggctccattctcgacgcgatgcggccgcagcagctccatgccacggagatcacgtccagcggcttccgcctggcctggccacccctgctgaccgcagactcgggctactatgtgctggagctggtgcccagcgcccagccgggggctgcaagacgccagcagctgccagggaacgccacggactggatctgggccggcctcgacccggacacggactacgacgtggcgctagtgcctgagtccaacgtgcgcctcctgaggccccagatcctgcgggtgcgcacgcggcccggtgaggcagggccgggggcttcgggcccggagtcgggggctgggccggcccccacgcagctcgccgccctccccgccccagaggaggccgggccagagcgcatcgtcatctcccacgcccggccgcgcagcctccgcgtgagttgggccccagcgctgggctcagccgcggcgctcggctaccacgtgcagttcgggccgctgcggggcggggaggcgcagcgggtggaggtgcccgcgggccgcaactgcaccacgctgcagggcctggcgccgggcaccgcctacctggtgaccgtgaccgccgccttccgctcgggccgcgagagcgcgctgtccgccaaggcctgcacgcccgacggcccgcgcccgcgcccacgccccgtgccccgcgccccgaccccggggaccgccagccgtgagccgtaagccggcgtccccgcccagccgagagggccggcgcctacctgagggcccctgtgtcccgaacccggagcggaggcgcccaacccggcagacgggtgcaggcccggcctttccccacgcggactccgcgcgaccccggccctctccctgcggccgcagggcttccccgcctggcgcctgccctccagggctggggcctcgcctggcgggaccccgcagcagccccggccccatccccgcccagagccgggcgtcgtgtgggtccgtgggtgataattgagagcgtcagacccaggactgttcagggaggagccccggtcagactcccacgtgtgaagaccgggccccaagtggcaagggctggcctggggcgggcagcttgggtcctggacgttgataggaagcggaaggggaatcgcgggaagctggcccaggtcaggtccgcaaaggcttctgaagaagaggaagggcgagtaggggcacctggacgctgatggtggccaggatgctcagctggccaggagggcagcacctgctggggacggtggccctgccttcatgcccaggacaccagctgggtccagctagcagccactgggaatcagaggaatggggcagagctgggcattcaggaccttgaggacacgtgaccccacccgcccaccgccactatcaggccccgggaccgcactgacaggaaaccttccgtcgtgagggagcacttcccaggggccgcagggacgacactctccagggaggccccagcaaccacaccatcttcttgctgtgagaggtctcaccccgggctacctcctgtcactactcactgccctggggtccgtgggcaagttgcccagggtgggggtgcctagccaggtgcagtccccgccccgcctagtcctcggcgtcacgcaatgctcacctcgcctcttccccactaacatcccagactttaaaattcagtaaatcagatgtacaccgagcctgcagtctcgctaggatgctttactcctccacaaacagcagccgccgacaggacagcttgtgaacgtctccgccttttggggtgtccggggagaggaggtggagctgtcccctcccagtgtcaggcctccttggtcctcatgtgcaccttttattcagagagcttgggcccccttcctttggagctgggcccagggcaggtggctggaatgcagaggacaagggggctggggcctctgcagggccattcccaccgcagtctctgccacggcccggagccctgggcccagggccacgcgggctccctctgctggcaaagccacaccctgcaccgcatggggtccactgcccctttccccacgtggactctgcgtgaccccaggaactgcagcattgaggtggtctcagtccctccctcaggtctggtgggcattgtgccaggggccaccttcgggacagctggccttggcaccgtctcccaagaacccagctctgtgcatcccgtggccccaccagaaacccaaggccacaccgcccaccagctgggtgtggtcaccattcatggagggccggctggggccaggctcaccacgcagagtttgccctccggtgtgatgatgcatgagacacagtaggcccccctgcctgtgtgtgcagggggtgtctgtgggggggccctgctggctggactttgggtttctcctgagctccccttagcccccaagtcaggccacggaggcctgagtaggacccatgggctgtgtgtgtcactgcaggtggcgtgctcacaactgcactgctggtcggcaggtggccagggttgcaggcccgggcctcgggccccacctcctctggaggggtaggatctccttcgtgcagcccctgccccctaccctgttctccggagtgttggcagatctgagcccacggtcacgtgagaggagatgcctcttgcacactgagcccaggcccagctcacggagcaccctgcaggtggcagcggggcaccaggggctcattcctggtggcctcagtggcttctgtggacgactcagactcacatgagaagctgggaggagctccagctctgcaatcccgagagggcagagcgggggccctggccacaaccctgctccccacatacccgtctggcagaggctctgcctcccctctgcccatctctgcacaccaaggctgagcacagcacaaggcctcacggagagggtgaaaaggcactgccgtctccatctcagtgccaaggaatgcccctttcagaagccctcgtctgagaagtgctgccccttatgtagccccaggcattttaaaatctttgaatctgcaccaagtctcagaacagctctggccccggagtgctccgtccaggccgctgtgaaccggctgtccccgcgtctcctccacctcccctgacacaatcctggccccgactcagtccacccagggtgcagtgcagaggctgatacccgccaggacttccttgccaagggcccggccacgtcacaaggccactgcacgcttttcgacatgcacctggaaatcgggaagggccatgctgcagttgcttctagttgagacgagaagagcgacaaggttgtgatccacgtggcaggtgttcagaaggctgggggcgggcagcgctggggagagccctgggtacttcgaggagaccccgaagggaggctgctcccacacctgcgccagtttccaccctctctgtgagcagggctgcggtcacctcccacatctgaagagaaccaacctgaggatttcacgctggctgcgtgccagaccagtccctgacaggttgtgcgaggcccttcgctggacagcccattgctggccactggacggagaggcagagggggctgaaattcgggcccatgcctctgtgagcgatgacggagcaacagctctccagcacgtgaagctctccagacagctgttcgtgagaagccagacagaggcctggggtctcagtccagatttctggggagtggggtgtccaagcgtgggccacgctgctgggagccacctagggaagcaggtcgcctgtttctatagtgacggtaataaaccaagtcaattttctatagtgaaaat

SEQ ID NO: 34429 - DNA, 1872 bp, Homo sapiens
aacccatatacggctaggtggaggcgcgtggtgtaatcggccgaggcgtgttcattgtcagcaccggccgaggcaacttcctggagctgtcagccgctgcctcagcccctgccgagaagcacctgcactttgtggacgtggatgacctgcacatcattgtccaagagctgaggggctccattctcgacgcgatgcggccgcagcagctccatgccacggagatcacgtccagcggcttccgcctggcctggccacccctgctgaccgcagactcgggctactatgtgctggagctggtgcccagcgcccagccgggggctgcaagacgccagcagctgccagggaacgccacggactggatctgggccggcctcgacccggacacggactacgacgtggcgctagtgcctgagtccaacgtgcgcctcctgaggccccagatcctgcgggtgcgcacgcggcccggtgaggcagggccgggggcttcgggcccggagtcgggggctgggccggcccccacgcagctcgccgccctccccgccccagaggaggccgggccagagcgcatcgtcatctcccacgcccggccgcgcagcctccgcgtgagttgggccccagcgctgggctcagccgcggcgctcggctaccacgtgcagttcgggccgctgcggggcggggaggcgcagcgggtggaggtgcccgcgggccgcaactgcaccacgctgcagggcctggcgccgggcaccgcctacctggtgaccgtgaccgccgccttccgctcgggccgcgagagcgcgctgtccgccaaggcctgcacgcccgacggcccgcgcccgcgcccacgccccgtgccccgcgccccgaccccggggaccgccagccgtgagccgtaagccggcgtccccgcccagccgagagggccggcgcctacctgagggcccctgtgtcccgaacccggagcggaggcgcccaacccggcagacgggtgcaggcccggcctttccccacgcggactccgcgcgaccccggccctctccctgcggccgcagggcttccccgcctggcgcctgccctccagggctggggcctcgcctggcgggaccccgcagcagccccggccccatccccgcccagagccgggcgtcgtgtgggtccgtgggtgataattgagagcgtcagacccaggactgttcagggaggagccccggtcagactcccacgtgtgaagaccgggccccaagtggcaagggctggcctggggcgggcagcttgggtcctggacgttgataggaagcggaaggggaatcgcgggaagctggcccaggtcaggtccgcaaaggcttctgaagaagaggaagggcgagtaggggcacctggacgctgatggtggccaggatgctcagctggccaggagggcagcacctgctggggacggtggccctgccttcatgcccaggacaccagctgggtccagctagcagccactgggaatcagaggaatggggcagagctgggcattcaggaccttgaggacacgtgaccccacccgcccaccgccactatcaggccccgggaccgcactgacaggaaaccttccgtcgtgagggagcacttcccaggggccgcagggacgacactctccagggaggccccagcaaccacaccatcttcttgctgtgagaggtctcaccccgggctacctcctgtcactactcactgccctggggtccgtgggcaagttgcccagggtgggggtgcctagccaggtgcagtccccgccccgcctagtcctcggcgtcacgcaatgctcacctcgcctcttccccactaacatcccagactttaaaattcagtaaatcagatgtacaccga

SEQ ID NO: 34430 - DNA, 2129 bp, Homo sapiens
ctgcccctgtggtctcccatctcctagctgcagctcagagagccgggctgacctcagaccccggcctggccactcaggctggggctggtcctctgctctcaggcaccaccgtggactctgccgtctttgaggacctttgtcctggtcactgatctggccactgcacctctccacaaaggactgggtttggggctaagggaggcaggggcgcttctgacagggcctgagggggctgcaccctttcctccgtcctcccccagccaaggcacgttctgagaatccccagcatctgcggggcatggctccagcagctccttggccgcggggccccgtctttcctagtggggcctccaatctccagatcttccccatcagccagggccgccctccagcagcggaggaggaactgaccgctgttccctgaccccctgcaccacccacagacgcgatgcggccgcagcagctccatgccacggagatcacgtccagcggcttccgcctggcctggccacccctgctgaccgcagactcgggctactatgtgctggagctggtgcccagcgcccagccgggggctgcaagacgccagcagctgccagggaacgccacggactggatctgggccggcctcgacccggacacggactacgacgtggcgctagtgcctgagtccaacgtgcgcctcctgaggccccagatcctgcgggtgcgcacgcggcccggtgaggcagggccgggggcttcgggcccggagtcgggggctgggccggcccccacgcagctcgccgccctccccgccccagaggaggccgggccagagcgcatcgtcatctcccacgcccggccgcgcagcctccgcgtgagttgggccccagcgctgggctcagccgcggcgctcggctaccacgtgcagttcgggccgctgcggggcggggaggcgcagcgggtggaggtgcccgcgggccgcaactgcaccacgctgcagggcctggcgccgggcaccgcctacctggtgaccgtgaccgccgccttccgctcgggccgcgagagcgcgctgtccgccaaggcctgcacgcccgacggcccgcgcccgcgcccacgccccgtgccccgcgccccgaccccggggaccgccagccgtgagccgtaagccggcgtccccgcccagccgagagggccggcgcctacctgagggcccctgtgtcccgaacccggagcggaggcgcccaacccggcagacgggtgcaggcccggcctttccccacgcggactccgcgcgaccccggccctctccctgcggccgcagggcttccccgcctggcgcctgccctccagggctggggcctcgcctggcgggaccccgcagcagccccggccccatccccgcccagagccgggcgtcgtgtgggtccgtgggtgataattgagagcgtcagacccaggactgttcagggaggagccccggtcagactcccacgtgtgaagaccgggccccaagtggcaagggctggcctggggcgggcagcttgggtcctggacgttgataggaagcggaaggggaatcgcgggaagctggcccaggtcaggtccgcaaaggcttctgaagaagaggaagggcgagtaggggcacctggacgctgatggtggccaggatgctcagctggccaggagggcagcacctgctggggacggtggccctgccttcatgcccaggacaccagctgggtccagctagcagccactgggaatcagaggaatggggcagagctgggcattcaggaccttgaggacacgtgaccccacccgcccaccgccactatcaggccccgggaccgcactgacaggaaaccttccgtcgtgagggagcacttcccaggggccgcagggacgacactctccagggaggccccagcaaccacaccatcttcttgctgtgagaggtctcaccccgggctacctcctgtcactactcactgccctggggtccgtgggcaagttgcccagggtgggggtgcctagccaggtgcagtccccgccccgcctagtcctcggcgtcacgcaatgctcacctcgcctcttccccactaacatcccagactttaaaattcagtaaatcagatgtacaccga

SEQ ID NO: 34431 - DNA, 2299 bp, Homo sapiens
agccccgagcgagcggagcgagcgagcgagttgccgagcgcgccccgtccctcgcgcgcgatgctcccctggacggcgctcggcctggccctgagcttgcggctggcgctggcgcggagcggcgcggagcgcggtccaccagcatcagccccccgaggggacctgatgttcctgctggacagctcagccagcgtctctcactacgagttctcccgggttcgggagtttgtggggcagctggtggctccactgcccctgggcaccggggccctgcgtgccagtctggtgcacgtgggcagtcggccatacaccgagttccccttcggccagcacagctcgggtgaggctgcccaggatgcggtgcgtgcttctgcccagcgcatgggtgacacccacactggcctggcgctggtctatgccaaggaacagctgtttgctgaagcatcaggtgcccggccaggggtgcccaaagtgctggtgtgggtgacagatggcggctccagcgaccctgtgggcccccccatgcaggagctcaaggacctgggcgtcaccgtgttcattgtcagcaccggccgaggcaacttcctggagctgtcagccgctgcctcagcccctgccgagaagcacctgcactttgtggacgtggatgacctgcacatcattgtccaagagctgaggggctccattctcgacgcgatgcggccgcagcagctccatgccacggagatcacgtccagcggcttccgcctggcctggccacccctgctgaccgcagactcgggctactatgtgctggagctggtgcccagcgcccagccgggggctgcaagacgccagcagctgccagggaacgccacggactggatctgggccggcctcgacccggacacggactacgacgtggcgctagtgcctgagtccaacgtgcgcctcgcctggcgggaccccgcagcagccccggccccatccccgcccagagccgggcgtcgtgtgggtccgtgggtgataattgagagcgtcagacccaggactgttcagggaggagccccggtcagactcccacgtgtgaagaccgggccccaagtggcaagggctggcctggggcgggcagcttgggtcctggacgttgataggaagcggaaggggaatcgcgggaagctggcgccgggcaccgcctacctggtgaccgtgaccgccgccttccgctcgggccgcgagagcgcgctgtccgccaaggcctgcacgcccgacggcccgcgcccgcgcccacgccccgtgccccgcgccccgaccccggggaccgccagccgtgagccgtaagccggcgtccccgcccagccgagagggccggcgcctacctgagggcccctgtgtcccgaacccggagcggaggcgcccaacccggcagacgggtgcaggcccggcctttccccacgcggactccgcgcgaccccggccctctccctgcggccgcagggcttccccgcctggcgcctgccctccagggctggggcctcgcctggcgggaccccgcagcagccccggccccatccccgcccagagccgggcgtcgtgtgggtccgtgggtgataattgagagcgtcagacccaggactgttcagggaggagccccggtcagactcccacgtgtgaagaccgggccccaagtggcaagggctggcctggggcgggcagcttgggtcctggacgttgataggaagcggaaggggaatcgcgggaagctggcccaggtcaggtccgcaaaggcttctgaagaagaggaagggcgagtaggggcacctggacgctgatggtggccaggatgctcagctggccaggagggcagcacctgctggggacggtggccctgccttcatgcccaggacaccagctgggtccagctagcagccactgggaatcagaggaatggggcagagctgggcattcaggaccttgaggacacgtgaccccacccgcccaccgccactatcaggccccgggaccgcactgacaggaaaccttccgtcgtgagggagcacttcccaggggccgcagggacgacactctccagggaggccccagcaaccacaccatcttcttgctgtgagaggtctcaccccgggctacctcctgtcactactcactgccctggggtccgtgggcaagttgcccagggtgggggtgcctagccaggtgcagtccccgccccgcctagtcctcggcgtcacgcaatgctcacctcgcctcttccccactaacatcccagactttaaaattcagtaaatcagatgtacaccga

SEQ ID NO: 34432 - DNA, 1135 bp, Homo sapiens
caagaattcgacacgaggcgggcacgaggcgccgccttccgctcgggccgcgagagcgcgctgtccgccaaggcctgcacgcccgacggcccgcgcccgcgcccacgccccgtgccccgcgccccgaccccggggaccgccagccgtgagccgtaagccggcgtccccgcccagccgagagggccggcgcctacctgagggcccctgtgtcccgaacccggagcggaggcgcccaacccggcagacgggtgcaggcccggcctttccccacgcggactccgcgcgaccccggccctctccctgcggccgcagggcttccccgcctggcgcctgccctccagggctggggcctcgcctggcgggaccccgcagcagccccggccccatccccgcccagagccgggcgtcgtgtgggtccgtgggtgataattgagagcgtcagacccaggactgttcagggaggagccccggtcagactcccacgtgtgaagaccgggccccaagtggcaagggctggcctggggcgggcagcttgggtcctggacgttgataggaagcggaaggggaatcgcgggaagctggcccaggtcaggtccgcaaaggcttctgaagaagaggaagggcgagtaggggcacctggacgctgatggtggccaggatgctcagctggccaggagggcagcacctgctggggacggtggccctgccttcatgcccaggacaccagctgggtccagctagcagccactgggaatcagaggaatggggcagagctgggcattcaggaccttgaggacacgtgaccccacccgcccaccgccactatcaggccccgggaccgcactgacaggaaaccttccgtcgtgagggagcacttcccaggggccgcagggacgacactctccagggaggccccagcaaccacaccatcttcttgctgtgagaggtctcaccccgggctacctcctgtcactactcactgccctggggtccgtgggcaagttgcccagggtgggggtgcctagccaggtgcagtccccgccccgcctagtcctcggcgtcacgcaatgctcacctcgcctcttccccactaacatcccagactttaaaattcagtaaatcagatgtacaccga

SEQ ID NO: 34433 - DNA, 4267 bp, Homo sapiens
agccccgagcgagcggagcgagcgagcgagttgccgagcgcgccccgtccctcgcgcgcgatgctcccctggacggcgctcggcctggccctgagcttgcggctggcgctggcgcggagcggcgcggagcgcggtccaccagcatcagccccccgaggggacctgatgttcctgctggacagctcagccagcgtctctcactacgagttctcccgggttcgggagtttgtggggcagctggtggctccactgcccctgggcaccggggccctgcgtgccagtctggtgcacgtgggcagtcggccatacaccgagttccccttcggccagcacagctcgggtgaggctgcccaggatgcggtgcgtgcttctgcccagcgcatgggtgacacccacactggcctggcgctggtctatgccaaggaacagctgtttgctgaagcatcaggtgcccggccaggggtgcccaaagtgctggtgtgggtgacagatggcggctccagcgaccctgtgggcccccccatgcaggagctcaaggacctgggcgtcaccgtgttcattgtcagcaccggccgaggcaacttcctggagctgtcagccgctgcctcagcccctgccgagaagcacctgcactttgtggacgtggatgacctgcacatcattgtccaagagctgaggggctccattctcgacgcgatgcggccgcagcagctccatgccacggagatcacgtccagcggcttccgcctggcctggccacccctgctgaccgcagactcgggctactatgtgctggagctggtgcccagcgcccagccgggggctgcaagacgccagcagctgccagggaacgccacggactggatctgggccggcctcgacccggacacggactacgacgtggcgctagtgcctgagtccaacgtgcgcctcctgaggccccagatcctgcgggtgcgcacgcggcccggtgaggcagggccgggggcttcgggcccggagtcgggggctgggccggcccccacgcagctcgccgccctccccgccccagaggaggccgggccagagcgcatcgtcatctcccacgcccggccgcgcagcctccgcgtgagttgggccccagcgctgggctcagccgcggcgctcggctaccacgtgcagttcgggccgctgcggggcggggaggcgcagcgggtggaggtgcccgcgggccgcaactgcaccacgctgcagggcctggcgccgggcaccgcctacctggtgaccgtgaccgccgccttccgctcgggccgcgagagcgcgctgtccgccaaggcctgcacgcccgacggcccgcgcccgcgcccacgccccgtgccccgcgccccgaccccggggaccgccagccgtgagccgtaagccggcgtccccgcccagccgagagggccggcgcctacctgagggcccctgtgtcccgaacccggagcggaggcgcccaacccggcagacgggtgcaggcccggcctttccccacgcggactccgcgcgaccccggccctctccctgcggccgcagggcttccccgcctggcgcctgccctccagggctggggcctcgcctggcgggaccccgcagcagccccggccccatccccgcccagagccgggcgtcgtgtgggtccgtgggtgataattgagagcgtcagacccaggactgttcagggaggagccccggtcagactcccacgtgtgaagaccgggccccaagtggcaagggctggcctggggcgggcagcttgggtcctggacgttgataggaagcggaaggggaatcgcgggaagctggcccaggtcaggtccgcaaaggcttctgaagaagaggaagggcgagtaggggcacctggacgctgatggtggccaggatgctcagctggccaggagggcagcacctgctggggacggtggccctgccttcatgcccaggacaccagctgggtccagctagcagccactgggaatcagaggaatggggcaagttgcccagggtgggggtgcctagccaggtgcagtccccgccccgcctagtcctcggcgtcacgcaatgctcacctcgcctcttccccactaacatcccagactttaaaattcagtaaatcagatgtacaccgagcctgcagtctcgctaggatgctttactcctccacaaacagcagccgccgacaggacagcttgtgaacgtctccgccttttggggtgtccggggagaggaggtggagctgtcccctcccagtgtcaggcctccttggtcctcatgtgcaccttttattcagagagcttgggcccccttcctttggagctgggcccagggcaggtggctggaatgcagaggacaagggggctggggcctctgcagggccattcccaccgcagtctctgccacggcccggagccctgggcccagggccacgcgggctccctctgctggcaaagccacaccctgcaccgcatggggtccactgcccctttccccacgtggactctgcgtgaccccaggaactgcagcattgaggtggtctcagtccctccctcaggtctggtgggcattgtgccaggggccaccttcgggacagctggccttggcaccgtctcccaagaacccagctctgtgcatcccgtggccccaccagaaacccaaggccacaccgcccaccagctgggtgtggtcaccattcatggagggccggctggggccaggctcaccacgcagagtttgccctccggtgtgatgatgcatgagacacagtaggcccccctgcctgtgtgtgcagggggtgtctgtgggggggccctgctggctggactttgggtttctcctgagctccccttagcccccaagtcaggccacggaggcctgagtaggacccatgggctgtgtgtgtcactgcaggtggcgtgctcacaactgcactgctggtcggcaggtggccagggttgcaggcccgggcctcgggccccacctcctctggaggggtaggatctccttcgtgcagcccctgccccctaccctgttctccggagtgttggcagatctgagcccacggtcacgtgagaggagatgcctcttgcacactgagcccaggcccagctcacggagcaccctgcaggtggcagcggggcaccaggggctcattcctggtggcctcagtggcttctgtggacgactcagactcacatgagaagctgggaggagctccagctctgcaatcccgagagggcagagcgggggccctggccacaaccctgctccccacatacccgtctggcagaggctctgcctcccctctgcccatctctgcacaccaaggctgagcacagcacaaggcctcacggagagggtgaaaaggcactgccgtctccatctcagtgccaaggaatgcccctttcagaagccctcgtctgagaagtgctgccccttatgtagccccaggcattttaaaatctttgaatctgcaccaagtctcagaacagctctggccccggagtgctccgtccaggccgctgtgaaccggctgtccccgcgtctcctccacctcccctgacacaatcctggccccgactcagtccacccagggtgcagtgcagaggctgatacccgccaggacttccttgccaagggcccggccacgtcacaaggccactgcacgcttttcgacatgcacctggaaatcgggaagggccatgctgcagttgcttctagttgagacgagaagagcgacaaggttgtgatccacgtggcaggtgttcagaaggctgggggcgggcagcgctggggagagccctgggtacttcgaggagaccccgaagggaggctgctcccacacctgcgccagtttccaccctctctgtgagcagggctgcggtcacctcccacatctgaagagaaccaacctgaggatttcacgctggctgcgtgccagaccagtccctgacaggttgtgcgaggcccttcgctggacagcccattgctggccactggacggagaggcagagggggctgaaattcgggcccatgcctctgtgagcgatgacggagcaacagctctccagcacgtgaagctctccagacagctgttcgtgagaagccagacagaggcctggggtctcagtccagatttctggggagtggggtgtccaagcgtgggccacgctgctgggagccacctagggaagcaggtcgcctgtttctatagtgacggtaataaaccaagtcaattttctatagtgaaaat

SEQ ID NO: 34434 - DNA, 2024 bp, Homo sapiens
agccccgagcgagcggagcgagcgagcgagttgccgagcgcgccccgtccctcgcgcgcgatgctcccctggacggcgctcggcctggccctgagcttgcggctggcgctggcgcggagcggcgcggagcgcggtccaccagcatcagccccccgaggggacctgatgttcctgctggacagctcagccagcgtctctcactacgagttctcccgggttcgggagtttgtggggcagctggtggctccactgcccctgggcaccggggccctgcgtgccagtctggtgcacgtgggcagtcggccatacaccgagttccccttcggccagcacagctcgggtgaggctgcccaggatgcggtgcgtgcttctgcccagcgcatgggtgacacccacactggcctggcgctggtctatgccaaggaacagctgtttgctgaagcatcaggtgcccggccaggggtgcccaaagtgctggtgtgggtgacagatggcggctccagcgaccctgtgggcccccccatgcaggagctcaaggacctgggcgtcaccgtgttcattgtcagcaccggccgaggcaacttcctggagctgtcagccgctgcctcagcccctgccgagaagcacctgcactttgtggacgtggatgacctgcacatcattgtccaagagctgaggggctccattctcgacgcgatgcggccgcagcagctccatgccacggagatcacgtccagcggcttccgcctggcctggccacccctgctgaccgcagactcgggctactatgtgctggagctggtgcccagcgcccagccgggggctgcaagacgccagcagctgccagggaacgccacggactggatctgggccggcctcgacccggacacggactacgacgtggcgctagtgcctgagtccaacgtgcgcctcctgaggccccagatcctgcgggtgcgcacgcggcccggtgaggcagggccgggggcttcgggcccggagtcgggggctgggccggcccccacgcagctcgccgccctccccgccccagaggaggccgggccagagcgcatcgtcatctcccacgcccggccgcgcagcctccgcgtgagttgggccccagcgctgggctcagccgcggcgctcggctaccacgtgcagttcgggccgctgcggggcggggaggcgcagcgggtggaggtgcccgcgggccgcaactgcaccacgctgcagggcctggcgccgggcaccgcctacctggtgaccgtgaccgccgccttccgctcgggccgcgagagcgcgctgtccgccaaggcctgcacgcccgacggcccgcgcccgcgcccacgccccgtgccccgcgccccgaccccggggaccgccagccgtgagccgtaagccggcgtccccgcccagccgagagggccggcgcctacctgagggcccctgtgtcccgaacccggagcggaggcgcccaacccggcagacgggtgcaggcccggcctttccccacgcggactccgcgcgaccccggccctctccctgcggccgcagggcttccccgcctggcgcctgccctccagggctggggcctcgcctggcgggaccccgcagcagccccggccccatccccgcccagagccgggcgtcgtgtgggtccgtgggtgataattgagagcgtcagacccaggactgttcagggaggagccccggtcagactcccacgtgtgaagaccgggccccaagtggcaagggctggcctggggcgggcagcttgggtcctggacgttgataggaagcggaaggggaatcgcgggaagctggcccaggtcaggtccgcaaaggcttctgaagaagaggaagggcgagtaggggcacctggacgctgatggtggccaggatgctcagctggccaggagtgcagtccccgccccgcctagtcctcggcgtcacgcaatgctcacctcgcctcttccccactaacatcccagactttaaaattcagtaaatcagatgtacaccga

SEQ ID NO: 34435 - DNA, 1239 bp, Homo sapiens
agccccgagcgagcggagcgagcgagcgagttgccgagcgcgccccgtccctcgcgcgcgatgctcccctggacggcgctcggcctggccctgagcttgcggctggcgctggcgcggagcggcgcggagcgcggtccaccagcatcagccccccgaggggacctgatgttcctgctggacagctcagccagcgtctctcactacgagttctcccgggttcgggagtttgtggggcagctggtggctccactgcccctgggcaccggggccctgcgtgccagtctggtgcacgtgggcagtcggccatacaccgagttccccttcggccagcacagctcgggtgaggctgcccaggatgcggtgcgtgcttctgcccagcgcatgggtgacacccacactggcctggcgctggtctatgccaaggaacagctgtttgctgaagcatcaggtgcccggccaggggtgcccaaagtgctggtgtgggtgacagatggcggctccagcgaccctgtgggcccccccatgcaggagctcaaggacctgggcgtcaccgtgttcattgtcagcaccggccgaggcaacttcctggagctgtcagccgctgcctcagcccctgccgagaagcacctgcactttgtggacgtggatgacctgcacatcattgtccaagagctgaggggctccattctcgacgcgatgcggccgcagcagctccatgccacggagatcacgtccagcggcttccgcctggcctggccacccctgctgaccgcagactcggggcagcacctgctggggacggtggccctgccttcatgcccaggacaccagctgggtccagctagcagccactgggaatcagaggaatggggcagagctgggcattcaggaccttgaggacacgtgaccccacccgcccaccgccactatcaggccccgggaccgcactgacaggaaaccttccgtcgtgagggagcacttcccaggggccgcagggacgacactctccagggaggccccagcaaccacaccatcttcttgctgtgagaggtctcaccccgggctacctcctgtcactactcactgccctggggtccgtgggcaagttgcccagggtgggggtgcctagccaggtgcagtccccgccccgcctagtcctcggcgtcacgcaatgctcacctcgcctcttccccactaacatcccagactttaaaattcagtaaatcagatgtacaccga

SEQ ID NO: 34436 - DNA, 2725 bp, Homo sapiens
agccccgagcgagcggagcgagcgagcgagttgccgagcgcgccccgtccctcgcgcgcgatgctcccctggacggcgctcggcctggccctgagcttgcggctggcgctggcgcggagcggcgcggagcgcggtccaccagcatcagccccccgaggggacctgatgttcctgctggacagctcagccagcgtctctcactacgagttctcccgggttcgggagtttgtggggcagctggtggctccactgcccctgggcaccggggccctgcgtgccagtctggtgcacgtgggcagtcggccatacaccgagttccccttcggccagcacagctcgggtgaggctgcccaggatgcggtgcgtgcttctgcccagcgcatgggtgacacccacactggcctggcgctggtctatgccaaggaacagctgtttgctgaagcatcaggtgcccggccaggggtgcccaaagtgctggtgtgggtgacagatggcggctccagcgaccctgtgggcccccccatgcaggagctcaaggacctgggcgtcaccgtgttcattgtcagcaccggccgaggcaacttcctggagctgtcagccgctgcctcagcccctgccgagaagcacctgcactttgtggacgtggatgacctgcacatcattgtccaagagctgaggggctccattctcgacgcgatgcggccgcagcagctccatgccacggagatcacgtccagcggcttccgcctggcctggccacccctgctgaccgcagactcgggctactatgtgctggagctggtgcccagcgcccagccgggggctgcaagacgccagcagctgccagggaacgccacggactggatctgggccggcctcgacccggacacggactacgacgtggcgctagtgcctgagtccaacgtgcgcctcctgaggccccagatcctgcgggtgcgcacgcggcccggtgaggcagggccgggggcttcgggcccggagtcgggggctgggccggcccccacgcagctcgccgccctccccgccccagaggaggccgggccagagcgcatcgtcatctcccacgcccggccgcgcagcctccgcgtgagttgggccccagcgctgggctcagccgcggcgctcggctaccacgtgcagttcgggccgctgcggggcggggaggcgcagcgggtggaggtgcccgcgggccgcaactgcaccacgctgcagggcctggcgccgggcaccgcctacctggtgaccgtgaccgccgccttccgctcgggccgcgagagcgcgctgtccgccaaggcctgcacgcccgacggcccgcgcccgcgcccacgccccgtgccccgcgccccgaccccggggaccgccagccgtgagccgtaagccggcgtccccgcccagccgagagggccggcgcctacctgagggcccctgtgtcccgaacccggagcggaggcgcccaacccggcagacgggtgcaggcccggcctttccccacgcggactccgcgcgaccccggccctctccctgcggccgcagggcttccccgcctggcgcctgccctccagggctggggcctcgcctggcgggaccccgcagcagccccggccccatccccgcccagagccgggcgtcgtgtgggtccgtgggtgataattgagagcgtcagacccaggactgttcagggaggagccccggtcagactcccacgtgtgaagaccgggccccaagtggcaagggctggcctggggcgggcagcttgggtcctggacgttgataggaagcggaaggggaatcgcgggaagctggcccaggtcaggtccgcaaaggcttctgaagaagaggaagggcgagtaggggcacctggacgctgatggtggccaggatgctcagctggccaggagggcagcacctgctggggacggtggccctgccttcatgcccaggacaccagctgggtccagctagcagccactgggaatcagaggaatggggcagagctgggcattcaggaccttgaggacacgtgaccccacccgcccaccgccactatcaggccccgggaccgcactgacaggaaaccttccgtcgtgagggagcacttcccaggggccgcagggacgacactctccagggaggccccagcaaccacaccatcttcttgctgtgagaggtctcaccccgggctacctcctgtcactactcactgccctggggtccgtgggcaagttgcccagggtgggggtgcctagccaggtgcagtccccgccccgcctagtcctcggcgtcacgcaatgctcacctcgcctcttccccactaacatcccagactttaaaattcagtaaatcagatgtacaccgaaaaaaaaaaaaaaaaaggaaaaaaaaaaaaaaaaaaaaaaaaaaagcaagttggaggggcgacagccgacacgacgaaagaaaagttcatcagaccaccagtcgacgtgggagcgcgcgaccacacaagatgaagatagcacaacatcgaccacacggtgtgacccaaagagaaagcaaccgggacaccaaaaaacgaggggggagtcacccaccaaaagaaacaaacgccgaggggaaccacgagaggtatgcgaaccaacaccaccgaagagatagtaggcgcacaaacggcggatacaaaccaaggagaccacaagagaccgattgataaatacccccgcgtgta

SEQ ID NO: 34437 - DNA, 1756 bp, Homo sapiens
agccccgagcgagcggagcgagcgagcgagttgccgagcgcgccccgtccctcgcgcgcgatgctcccctggacggcgctcggcctggccctgagcttgcggctggcgctggcgcggagcggcgcggagcgcggtccaccagcatcagccccccgaggggacctgatgttcctgctggacagctcagccagcgtctctcactacgagttctcccgggttcgggagtttgtggggcagctggtggctccactgcccctgggcaccggggccctgcgtgccagtctggtgcacgtgggcagtcggccatacaccgagttccccttcggccagcacagctcgggtgaggctgcccaggatgcggtgcgtgcttctgcccagcgcatgggtgacacccacactggcctggcgctggtctatgccaaggaacagctgtttgctgaagcatcaggtgcccggccaggggtgcccaaagtgctggtgtgggtgacagatggcggctccacgctgggctcagccgcggcgctcggctaccacgtgcagttcgggccgctgcggggcggggaggcgcagcgggtggaggtgcccgcgggccgcaactgcaccacgctgcagggcctggcgccgggcaccgcctacctggtgaccgtgaccgccgccttccgctcgggccgcgagagcgcgctgtccgccaaggcctgcacgcccgacggcccgcgcccgcgcccacgccccgtgccccgcgccccgaccccggggaccgccagccgtgagccgtaagccggcgtccccgcccagccgagagggccggcgcctacctgagggcccctgtgtcccgaacccggagcggaggcgcccaacccggcagacgggtgcaggcccggcctttccccacgcggactccgcgcgaccccggccctctccctgcggccgcagggcttccccgcctggcgcctgccctccagggctggggcctcgcctggcgggaccccgcagcagccccggccccatccccgcccagagccgggcgtcgtgtgggtccgtgggtgataattgagagcgtcagacccaggactgttcagggaggagccccggtcagactcccacgtgtgaagaccgggccccaagtggcaagggctggcctggggcgggcagcttgggtcctggacgttgataggaagcggaaggggaatcgcgggaagctggcccaggtcaggtccgcaaaggcttctgaagaagaggaagggcgagtaggggcacctggacgctgatggtggccaggatgctcagctggccaggagggcagcacctgctggggacggtggccctgccttcatgcccaggacaccagctgggtccagctagcagccactgggaatcagaggaatggggcagagctgggcattcaggaccttgaggacacgtgaccccacccgcccaccgccactatcaggccccgggaccgcactgacaggaaaccttccgtcgtgagggagcacttcccaggggccgcagggacgacactctccagggaggccccagcaaccacaccatcttcttgctgtgagaggtctcaccccgggctacctcctgtcactactcactgccctggggtccgtgggcaagttgcccagggtgggggtgcctagccaggtgcagtccccgccccgcctagtcctcggcgtcacgcaatgctcacctcgcctcttccccactaacatcccagactttaaaattcagtaaatcagatgtacaccga

SEQ ID NO: 34438 - DNA, 2147 bp, Homo sapiens
agccccgagcgagcggagcgagcgagcgagttgccgagcgcgccccgtccctcgcgcgcgatgctcccctggacggcgctcggcctggccctgagcttgcggctggcgctggcgcggagcggcgcggagcgcggtccaccagcatcagccccccgaggggacctgatgttcctgctggacagctcagccagcgtctctcactacgagttctcccgggttcgggagtttgtggggcagctggtggctccactgcccctgggcaccggggccctgcgtgccagtctggtgcacgtgggcagtcggccatacaccgagttccccttcggccagcacagctcgggtgaggctgcccaggatgcggtgcgtgcttctgcccagcgcatgggtgacacccacactggcctggcgctggtctatgccaaggaacagctgtttgctgaagcatcaggtgcccggccaggggtgcccaaagtgctggtgtgggtgacagatggcggctccagcgaccctgtgggcccccccatgcaggagctcaaggacctgggcgtcaccgtgttcattgtcagcaccggccgaggcaacttcctggagctgtcagccgctgcctcagcccctgccgagaagcacctgcactttgtggacgtggatgacctgcacatcattgtccaagagctgaggggctccattctcgacgcgatgcggccgcagcagctccatgccacggagatcacgtccagcggcttccgcctggcctggccacccctgctgaccgcagactcgggctactatgtgctggagctggtgcccagcgcccagccgggggctgcaagacgccagcagctgccagggaacgccacggactggatctgggccggcctcgacccggacacggactacgacgtggcgctagtgcctgagtccaacgtgcgcctcctgaggccccagatcctgcgggtgcgcacgcggcccggtgaggcagggccgggggcttcgggcccggagtcgggggctgggccggcccccacgcagctcgccgccctccccgccccagaggaggccgggccagagcgcatcgtcatctcccacgcccggccgcgcagcctccgcgtgagttgggccccagcgctgggctcagccgcggcgctcggctaccacgtgcagttcgggccgctgcggggcggggaggcgcagcgggtggaggtgcccgcgggccgcaactgcaccacgctgcagggcctggcgccgggcaccgcctacctggtgaccgtgaccgccgccttccgctcgggccgcgagagcgcgctgtccgccaaggcctgcacgcccgacggcccgcgcccgcgcccacgccccgtgccccgcgccccgaccccggggaccgccagccgtgagccgtaagccggcgtccccgcccagccgagagggccggcgcctacctgagggcccctgtgtcccgaacccggagcggaggcgcccaacccggcagacgggtgcaggcccggcctttccccacgcggactccgcgcgaccccggccctctccctgcggccgcagggcttccccgcctggcgcctgccctccagggctggggcctcgcctggcgggaccccgcagcagccccggccccatccccgcccagagccgggcgtcgtgtgggtccgtgggtgataattgagagcgtcagacccaggactgttcagggaggagccccggtcagactcccacgtgtgaagaccgggccccaagtggcaagggctggcctggggcgggcagcttgggtcctggacgttgataggaagcggaaggggaatcgcgggaagctggcccaggtcaggtccgcaaaggcttctgaagaagaggaagggcgagtaggggcacctggacgctgatggtggccaggatgctcagctggccaggagggcagcacctgctggggacggtggccctgccttcatgcccaggacaccagctgggtccagctagcagccactgggaatcagaggaatggggcaagttgcccagggtgggggtgcctagccaggtgcagtccccgccccgcctagtcctcggcgtcacgcaatgctcacctcgcctcttccccactaacatcccagactttaaaattcagtaaatcagatgtacaccga

SEQ ID NO: 34439 - DNA, 624 bp, Homo sapiens
tttaactcttcagagacagggtgatgataatttctgtttagcatttataagatgactcactattagtagtcctatccccatattatttaagctctaaatttcctgtggaaatttagacttggaatatagacttggaaaacccctcaagcgttgcttctcaatgtgctctccatattttctaagagatgcttcttactaagcatatattttattgactaacagcataactatatacacagaataacaaacaccatttatactgtattacttaggatcctttttatggtccttttatcgtttttaattataccacttatctttctaatattttcctatggtgacagattttaatgtagagtatattcagcggggtggcttgagagatcctctgattttcaagaattctgatggactcggaataaagtaagtgttttcagcctggctggatgtagttgcaaaatggcctcgttacacccagggcaataaacagtggtggtattgataacccaaaacaatagtaattgaaaataatttcccactttgttttaaaagtatatgcttttcttttgatacacaagtgtttcatattagaggtaaatgagaaaatatagatgaaccaaaaaa

SEQ ID NO: 34440 - DNA, 562 bp, Homo sapiens
agcaactgtttgctcccttttcctggtcgctctgaccctctctggatactgggttgatccacggaaaaaccgaagacgacgtttgggatttaattattcctctcagctttggaatcttttacttctcacttggacaagaactcaagagcagaatctccgtgttgcaatctggttcctaaggaggaagaggaaggcagccctggagtggtttctttacagtaatttcaacagaagagtgagagatggaacccgaagaagaaaggattcgttacagccagagattgtagagacggggttggctggtcttgaactcgtgacctcaggtgatcctcccgcctccgcctcccaaggtgttgggattacagccgtgagccactgcatctggcctgtctgttcatttcataaacatctgagagggtctttgctacaggacttcaggagcactagcatcgatggtggcagatgaaaaagcagatttttttcccctgaagctctttaataatggcaaaagttaaaaagtgttttctctgtagtcctgaatttactgaatgtattcccttcc

SEQ ID NO: 34441 - DNA, 659 bp, Homo sapiens
caggaagccgcggctgagctgaagggctcgagaaggagcccagagcgctgcacgctgctccctctgggtagtctgaagggtcagagctggactgccctgccctatgtgctctgggagattccagaatattcaagtaaatccggattttcccagaggcagaatatctaactccttcaggagaacttccagtacagaaaacaaaacaaagacgctggggaaacttcaccaagagcctcggcagctccagagcgacgggaaacgaaagattttgctggaggagcttgccaacagcgatcccaagttagccctcactggagttcctatagtacagtggccaaaaagggataagtgtggaatggaaaagagaagaaaggggccgggcatggtggctcacacctgtaatcccagcactttgggaggcccaggcaggtggatcacctgaggtcaggagttcaagaccagcctggccaacatggtgaaacaccgtctgtaccaaaaatacaaaaattaagccaggcgtggtggcatgcgcctataatcccagctacttgcaaggctggggcaggagaatcacttgaacccaggaggcagaggttgcagtgagccgagatcgcaccattgcacttcagcctgggggacaagagcgaaactgtctcaaa

SEQ ID NO: 34442 - DNA, 359 bp, Homo sapiens
tctggtctctgagccaggtagttgtgggacaaagagggcttttgtttagcattttgaaggaaagacggctacaggaattgaatggcagaggaaagctgtgtgtatgtgagcactgtcattatgtccactttcccgacaggttgcaataaattgacagaccagaccctgatctacctacggcgcattgccaacgtcaccttgatcgaccttcgaggatgcaagcagatcactcgaaaagcctgcgagcacttcatctcagacttgtccatcaacagcctctactgcctgtctgacgagaagctgatacagaagatcagctaagacacacccgtactggcccgcacatccgtactggcccg

SEQ ID NO: 34443 - DNA, 299 bp, Homo sapiens
tagcaggcaagaggaagggttacttttatggaaggaaaagattttaatgtagagtatattcagcggggtggcttgagagatcctctgattttcaagaattctgatggactcggaataaaaatgccggatccagacttcactgtgaatgatgtcaaaatgtgtgtggacgacgtttgggattcaattattcctctcagctttggaatctttacttctcacttgacaagactcagagcagatctccgtgttgcctctggttcctaaggaggagaggaagcagcctggagtgttctacagta

SEQ ID NO: 34444 - DNA, 293 bp, Homo sapiens
agcttacagtcctttgatgtgggaagccatagactctgagcattgggggtttagcctttatccagctaaaatattgcctgttgatgttatctatctattttctcttgttatacaatgccatttgcatgcacttatcccccagtcctcccaccctgtgagtcattctctcctatattagaagtaatctttttattagggcaggagtattgttggatttttttgcctaacggcctcttcctccttcttctatcccttggtttaaatttaattaaaaatagtacaatagaaatcct

SEQ ID NO: 34445 - DNA, 6482 bp, Homo sapiens
gtactgaactgggaaagacagcagagcaacagctcaaaatctcgcgtcattctagaagtcaagccaggcacaagggctcatcgggcaaccccaggatggggagaggccaagacaggcgggtcactcgcgcctgcaaccccaggacggggggaggccgagcgggtcactttgaaccctcggaaatccaagagtctgagacctacctaggctacatggggagaccttgtgtctaccaaatatatgctattgaaacttctgaaactaggtttagaagtttcaagagcagaatctccgtgttgcaatctggttcctaaggaggaagaggaaggcagccctggagtggtttctttacagtaatttcaacagaagagtgagagatggaacccgaagaagaaaggattcgttacagccagagattgcgtggtaccatgcgacgacgctatgaagatgatggcatttcagatgatgaaattgaaggaaaaagaacttttgacttggaagagaaactgcacaccaacaaatataatgccaattttgttacttttatggaaggaaaagattttaatgtagagtatattcagcggggtggcttgagagatcctctgattttcaagaattctgatggactcggaataaaaatgccggatccagacttcactgtgaatgatgtcaaaatgtgtgtggggagtcgtcgcatggtggatgtcatggacgtgaacacacagaaaggcattgaaatgaccatggctcagtggacacgctactatgagaccccagaggaggagcgagagaaactctataatgtcatcagcctcgagtttagccacaccaggctggagaatatggtgcagaggccctccacggtggatttcattgactgggtagacaacatgtggccaaggcacttgaaggaaagccagactgaatcaacaaatgccatcttggagatgcagtaccctaaagtgcagaagtactgtctaatgagtgttcgaggctgctatactgacttccatgtggactttggtggtacctctgtttggtatcacatccatcaagggggaaaggtcttctggctcatcccccctacagcccacaacctggagctgtacgagaattggctgctgtcagggaaacagggagacatctttctgggtgaccgggtatcagattgtcagcgcattgagctcaagcagggctataccttcgtcattccctcaggctggattcatgctgtgtatactcctacagacacattagtgtttgggggcaattttttgcatagcttcaacatccctatgcagttaaaaatatacaacattgaagatcggacacgggttccaaataagtttcgctatccattctactatgagatgtgttggtatgtgttggagcgctatgtgtactgcataaccaaccgttcccacctaaccaaggaatttcagaaagagtccctcagcatggatttggagttaaatgggttggagtctgggaatggggatgaggaagcagtggatcgagaaccccgacgcttgagcagcaggcgttctgtcctcactagccctgtagcgaatggagtcaacctggattatgatggactgggcaaaacctgccgaagtcttccaagtctgaagaaaactttggctggggactcatcttctgactgtagccggggctcccacaatggacaagtgtgggatccccagtgtgctccccgaaaggacaggcaagtgcatctgacccattttgagcttgaaggccttcgctgccttgtagataagttggagtctctgccactgcacaagaaatgtgtccccacagggatagaagatgaagatgctctcattgctgatgtaaagattttgctggaggagcttgccaacagcgatcccaagttagccctcactggagttcctatagtacagtggccaaaaagggataagcttaaattccccactcggccaaaggtgcgggttcctaccatccccattacgaagcctcacactatgaaaccagctccacggttaacacctgtgaggccagctgctgcctccccgattgtgtcaggagccagacggagacgagtgcgatgtcgaaaatgcaaagcctgtgtgcaaggagagtgtggtgtttgccactactgcagagacatgaagaagtttggggggcctggacgcatgaagcagtcctgtgtcctccgacagtgcttggcacccagactgcctcactcagtcacatgttccctctgtggagaggtggatcagaatgaagagacacaagactttgagaagaaactcatggaatgctgtatctgcaatgagattgttcatcctggctgcctccagatggacggagaggggttgcttaacgaagaattgccaaattgctgggaatgtccaaagtgctaccaggaggacagctcggagaaagcccagaagcggaaaatggaagagagtgacgaagaagctgtgcaagccaaagtcctgcggcccctgcggagctgcgatgagcctctcacgcccccgcctcattcacccacttccatgctgcagctcatccatgacccggtttccccccggggtatggtgactcggtcatcccctggggctggccccagcgaccaccacagtgccagccgcgatgagcgcttcaaacggcggcagttgctgcggctgcaggccacagagcgcaccatggtacgggaaaaggagaacaatcccagcggcaaaaaggagctgtctgaagttgagaaagccaagatccggggatcgtacctcactgtcacgctacagaggcccaccaaagagctccacgggacatccattgtgcccaagctgcaggccatcacggcctcctctgccaaccttcgccattccccccgtgtgctagtgcagcactgcccagcccgaaccccccagcgtggggatgaggaggggctggggggagaggaggaggaagaggaggaggaggaggaggaagatgacagtgcagaggaggggggtgcagccaggctgaatggccggggcagttgggctcaggatggagacgaaagctggatgcagcgggaggtctggatgtctgtcttccgctacctcagccgcagagaactttgtgaatgtatgcgagtgtgcaagacgtggtataaatggtgctgcgacaagagactttggacaaaaattgacttgagtaggtgtaaggccattgtgccccaggccctcagtggcatcatcaagaggcagccagtcagccttgacctcagttggaccaacatctctaaaaagcaactgacatggctcgtcaataggctgccaggactgaaagacctcctcctagcaggctgctcctggtctgcagtctctgccctcagcacctccagctgcccccttctcaggacccttgatcttcggtgggcagtaggaatcaaggaccctcaaattcgggacttgcttactccaccggctgataaaccaggtcaggacaatcgcagcaagctccggaacatgaccgacttccggctggcaggccttgacatcacagatgccacgcttcgcctcataattcgccacatgcccctcctgtctcgactcgacctcagtcactgcagccaccttacagatcagtcctccaatctactcactgctgtcgggtcttccactcgctactctctcacagagctcaatatggcaggttgcaataaattgacagaccagaccctgatctacctacggcgcattgccaacgtcaccttgatcgaccttcgaggatgcaagcagatcactcgaaaagcctgcgagcacttcatctcagacttgtccatcaacagcctctactgcctgtctgacgagaagctgatacagaagatcagctaagacacacccagcccagattcaacaggaaaccgatcttcccctgactccccaccgaggagagcctctcctcgaccctgcacgggctctgaggccagcgtcacactccctctctgctctcctgtcccttgagcccttcctctacaggtggggcagagagggtggtggacaccaggcttatctgcctgctcctctccctcctaaggaaaagggagtagcagattgatctgaggggaaagcacaggctgtgctgtcgaggcgcctgctcgcttactcgcctgccaggaggccgggctctcagtttggggtgtttgtgcaaccttcatctgcactgggccctgtgcccctcctccccatccatggtccccagcagtgcctggttctgagcaaactcccagggaagaaaacggccctgtctccatggccaggttcttgtggtgtccagtgcgcgtctctcctccatcacactctcccggcttgcgcaggaggggccagcagccccaggagtcccagacccgtgccgatcacactggtgctgttgagatctcccaaacctcacgtccttaactgtgctctccctcctttcctctcccttgagcttggttctgcccagcactcgtgcttgttcacataattaggtttcccaccccagcctacccgacttacttgctagtctctatgaggtccttattgcacttattggggttgaagctcttcagaggagctggaactgtctaccccagggacacacccatttcgttgctacccaagtggattctgagacaggcaccatctccttgttccccctctctcttttgcctcccactgactgcccttttccatgtgtcttcattctgcctgaagaaggctttcccaggatgcacgtcctcagagggagcagcctatctcccccaagctggaggcggcagaggactgggccaagccccaacctgcctcccagccaggctcctccaggcctctggtttagcggagccccctgagcccaggcctgtgtctagccccagtggctcactgaactttcagggcagtcagggggtcctgcttagaagccagtcaccagccctctgcctgcagccatggaagggggtgtgcacgtgcctctgtgtgtgtggctgagtgtattctgcgcgtgtgtgtggagggagggagggaggggagcatggtgtctcccgctccaccgccctttgttgagccccatcagctgcccccttttactttgcattgaacggcctgtccaaagatcctctctctagggcagcagagagctttttgcactttaaaaaaaaaaagaaagaaagaaaggtcggaatttcttttgggtcaatatttttaagtgtgtgaggagatgctcagtagcagcagcctatggcaagagcttataaatgattgatgcaaatttgcactctgctccccctctgtaaggatactgatagcacaacctcttccccccaccccgccccgccttttggtcgtccatccctgtccctttctggccctcttcctgtagcccagtctcaggctttcctcttcctgaagccctacagagttagggaatggagcccaggcaccaggggtctaaagtgtgagccactgagaagagagacgccaactgcacccttgccacttccaaagcaatagaggcagagtggtcccctctttgccacctaggccagttttgaccctggcattaactggccttagaagaaactggatcctggtagggggtggcattttgtttgtttcttccaatctgctgaatcttttgactgcaccttacaaacagcagtctgctcccatgaccctctgcccacttccattggtctccaggccccaataatctggggttgaaactttgaggaaatgccagtgacttattccagagtgcctcagttaggggaacttctctgtaaagaaccctgggtattgagcaaaaaccttattatcgttaatgacctataattggaagcttcctgcctttttctttggttgctcctgtggaaaatactgaaaagattactttgttttattttgttgtctttttataaaaggggaggtggagagaccccttcagagcagggattgtgccgggagagtgcctctgactttgggacatttcatccacagaaatttccaagccaatggtttcttttgggttttggtttttatgtttgttttttggggtttggaaaaacatgcatttttaccgtgcacgtaaattggtcagcagaaaagggagcccagaaaaggcagcagatggaccatgcccttgctgggttttccttttctttgggactgtgaggggaaatggtttttagaggtgagggttggtccatgtggaggaaagaagtgtctctgttgggggacagaggaacctggggagtccatcgcatgtcctacaatctgctcttagacacggccttgccaggagagcctgccctcagactgcaggaccagaacccctgcctccatctttccaagcaccggggcgaaaaaccacaaaggaaaggaagaaaatttatatatatataatataaaatcacttggtgattaaaaaaataactgctccataaataaaactcctaaagtcacttatgttta

SEQ ID NO: 34446 - DNA, 6756 bp, Homo sapiens
agcaactgtttgctcccttttcctggtcgctctgaccctctctggatactgggttgatccacggaaaaaccgaagacgacgtttgggatttaattattcctctcagctttggaatcttttacttctcacttggacaagaactcaagagcagaatctccgtgttgcaatctggttcctaaggaggaagaggaaggcagccctggagtggtttctttacagtaatttcaacagaagagtgagagatggaacccgaagaagaaaggattcgttacagccagagattgcgtggtaccatgcgacgacgctatgaagatgatggcatttcagatgatgaaattgaaggaaaaagaacttttgacttggaagagaaactgcacaccaacaaatataatgccaattttgttacttttatggaaggaaaagattttaatgtagagtatattcagcggggtggcttgagagatcctctgattttcaagaattctgatggactcggaataaaaatgccggatccagacttcactgtgaatgatgtcaaaatgtgtgtggggagtcgtcgcatggtggatgtcatggacgtgaacacacagaaaggcattgaaatgaccatggctcagtggacacgctactatgagaccccagaggaggagcgagagaaactctataatgtcatcagcctcgagtttagccacaccaggctggagaatatggtgcagaggccctccacggtggatttcattgactgggtagacaacatgtggccaaggcacttgaaggaaagccagactgaatcaacaaatgccatcttggagatgcagtaccctaaagtgcagaagtaagtgatgcgccctgcatcttcctccgtgtgctgtgggagaccaaagcaatagcaaggattggcttctcccttacgagctttgctctgtgtcttgaatgattaaaaagatgaattatttaaagatgagactttacagttccacaaggaagagtgtatgtgagcataccatagcacacaaccacacagttaaaggaaaaaaaacttacattttagtcaatacggtagaaaaaaaaaaaacctttttctgataatgtgatgacttgaaaatgcattgctttttctccttctggaacttaagattaagtggaagataaagggagtatataagaggagagtatggcattttggtggggcagatgtacttttttccatcagtacactaatgctgctgctttttttgggtcaggtactgtctaatgagtgttcgaggctgctatactgacttccatgtggactttggtggtacctctgtttggtatcacatccatcaagggggaaaggtcttctggctcatcccccctacagcccacaacctggagctgtacgagaattggctgctgtcagggaaacagggagacatctttctgggtgaccgggtatcagattgtcagcgcattgagctcaagcagggctataccttcgtcattccctcaggctggattcatgctgtgtatactcctacagacacattagtgtttgggggcaattttttgcatagcttcaacatccctatgcagttaaaaatatacaacattgaagatcggacacgggttccaaataagtttcgctatccattctactatgagatgtgttggtatgtgttggagcgctatgtgtactgcataaccaaccgttcccacctaaccaaggaatttcagaaagagtccctcagcatggatttggagttaaatgggttggagtctgggaatggggatgaggaagcagtggatcgagaaccccgacgcttgagcagcaggcgttctgtcctcactagccctgtagcgaatggagtcaacctggattatgatggactgggcaaaacctgccgaagtcttccaagtctgaagaaaactttggctggggactcatcttctgactgtagccggggctcccacaatggacaagtgtgggatccccagtgtgctccccgaaaggacaggcaagtgcatctgacccattttgagcttgaaggccttcgctgccttgtagataagttggagtctctgccactgcacaagaaatgtgtccccacagggatagaagatgaagatgctctcattgctgatgtaaagattttgctggaggagcttgccaacagcgatcccaagttagccctcactggagttcctatagtacagtggccaaaaagggataagcttaaattccccactcggccaaaggtgcgggttcctaccatccccattacgaagcctcacactatgaaaccagctccacggttaacacctgtgaggccagctgctgcctccccgattgtgtcaggagccagacggagacgagtgcgatgtcgaaaatgcaaagcctgtgtgcaaggagagtgtggtgtttgccactactgcagagacatgaagaagtttggggggcctggacgcatgaagcagtcctgtgtcctccgacagtgcttggcacccagactgcctcactcagtcacatgttccctctgtggagaggtggatcagaatgaagagacacaagactttgagaagaaactcatggaatgctgtatctgcaatgagattgttcatcctggctgcctccagatggacggagaggggttgcttaacgaagaattgccaaattgctgggaatgtccaaagtgctaccaggaggacagctcggagaaagcccagaagcggaaaatggaagagagtgacgaagaagctgtgcaagccaaagtcctgcggcccctgcggagctgcgatgagcctctcacgcccccgcctcattcacccacttccatgctgcagctcatccatgacccggtttccccccggggtatggtgactcggtcatcccctggggctggccccagcgaccaccacagtgccagccgcgatgagcgcttcaaacggcggcagttgctgcggctgcaggccacagagcgcaccatggtacgggaaaaggagaacaatcccagcggcaaaaaggagctgtctgaagttgagaaagccaagatccggggatcgtacctcactgtcacgctacagaggcccaccaaagagctccacgggacatccattgtgcccaagctgcaggccatcacggcctcctctgccaaccttcgccattccccccgtgtgctagtgcagcactgcccagcccgaaccccccagcgtggggatgaggaggggctggggggagaggaggaggaagaggaggaggaggaggaggaagatgacagtgcagaggaggggggtgcagccaggctgaatggccggggcagttgggctcaggatggagacgaaagctggatgcagcgggaggtctggatgtctgtcttccgctacctcagccgcagagaactttgtgaatgtatgcgagtgtgcaagacgtggtataaatggtgctgcgacaagagactttggacaaaaattgacttgagtaggtgtaaggccattgtgccccaggccctcagtggcatcatcaagaggcagccagtcagccttgacctcagttggaccaacatctctaaaaagcaactgacatggctcgtcaataggctgccaggactgaaagacctcctcctagcaggctgctcctggtctgcagtctctgccctcagcacctccagctgcccccttctcaggacccttgatcttcggtgggcagtaggaatcaaggaccctcaaattcgggacttgcttactccaccggctgataaaccaggtcaggacaatcgcagcaagctccggaacatgaccgacttccggctggcaggccttgacatcacagatgccacgcttcgcctcataattcgccacatgcccctcctgtctcgactcgacctcagtcactgcagccaccttacagatcagtcctccaatctactcactgctgtcgggtcttccactcgctactctctcacagagctcaatatggcaggttgcaataaattgacagaccagaccctgatctacctacggcgcattgccaacgtcaccttgatcgaccttcgaggatgcaagcagatcactcgaaaagcctgcgagcacttcatctcagacttgtccatcaacagcctctactgcctgtctgacgagaagctgatacagaagatcagctaagacacacccagcccagattcaacaggaaaccgatcttcccctgactccccaccgaggagagcctctcctcgaccctgcacgggctctgaggccagcgtcacactccctctctgctctcctgtcccttgagcccttcctctacaggtggggcagagagggtggtggacaccaggcttatctgcctgctcctctccctcctaaggaaaagggagtagcagattgatctgaggggaaagcacaggctgtgctgtcgaggcgcctgctcgcttactcgcctgccaggaggccgggctctcagtttggggtgtttgtgcaaccttcatctgcactgggccctgtgcccctcctccccatccatggtccccagcagtgcctggttctgagcaaactcccagggaagaaaacggccctgtctccatggccaggttcttgtggtgtccagtgcgcgtctctcctccatcacactctcccggcttgcgcaggaggggccagcagccccaggagtcccagacccgtgccgatcacactggtgctgttgagatctcccaaacctcacgtccttaactgtgctctccctcctttcctctcccttgagcttggttctgcccagcactcgtgcttgttcacataattaggtttcccaccccagcctacccgacttacttgctagtctctatgaggtccttattgcacttattggggttgaagctcttcagaggagctggaactgtctaccccagggacacacccatttcgttgctacccaagtggattctgagacaggcaccatctccttgttccccctctctcttttgcctcccactgactgcccttttccatgtgtcttcattctgcctgaagaaggctttcccaggatgcacgtcctcagagggagcagcctatctcccccaagctggaggcggcagaggactgggccaagccccaacctgcctcccagccaggctcctccaggcctctggtttagcggagccccctgagcccaggcctgtgtctagccccagtggctcactgaactttcagggcagtcagggggtcctgcttagaagccagtcaccagccctctgcctgcagccatggaagggggtgtgcacgtgcctctgtgtgtgtggctgagtgtattctgcgcgtgtgtgtggagggagggagggaggggagcatggtgtctcccgctccaccgccctttgttgagccccatcagctgcccccttttactttgcattgaacggcctgtccaaagatcctctctctagggcagcagagagctttttgcactttaaaaaaaaaaagaaagaaagaaaggtcggaatttcttttgggtcaatatttttaagtgtgtgaggagatgctcagtagcagcagcctatggcaagagcttataaatgattgatgcaaatttgcactctgctccccctctgtaaggatactgatagcacaacctcttccccccaccccgccccgccttttggtcgtccatccctgtccctttctggccctcttcctgtagcccagtctcaggctttcctcttcctgaagccctacagagttagggaatggagcccaggcaccaggggtctaaagtgtgagccactgagaagagagacgccaactgcacccttgccacttccaaagcaatagaggcagagtggtcccctctttgccacctaggccagttttgaccctggcattaactggccttagaagaaactggatcctggtagggggtggcattttgtttgtttcttccaatctgctgaatcttttgactgcaccttacaaacagcagtctgctcccatgaccctctgcccacttccattggtctccaggccccaataatctggggttgaaactttgaggaaatgccagtgacttattccagagtgcctcagttaggggaacttctctgtaaagaaccctgggtattgagcaaaaaccttattatcgttaatgacctataattggaagcttcctgcctttttctttggttgctcctgtggaaaatactgaaaagattactttgttttattttgttgtctttttataaaaggggaggtggagagaccccttcagagcagggattgtgccgggagagtgcctctgactttgggacatttcatccacagaaatttccaagccaatggtttcttttgggttttggtttttatgtttgttttttggggtttggaaaaacatgcatttttaccgtgcacgtaaattggtcagcagaaaagggagcccagaaaaggcagcagatggaccatgcccttgctgggttttccttttctttgggactgtgaggggaaatggtttttagaggtgagggttggtccatgtggaggaaagaagtgtctctgttgggggacagaggaacctggggagtccatcgcatgtcctacaatctgctcttagacacggccttgccaggagagcctgccctcagactgcaggaccagaacccctgcctccatctttccaagcaccggggcgaaaaaccacaaaggaaaggaagaaaatttatatatatataatataaaatcacttggtgattaaaaaaataactgctccataaataaaactcctaaagtcacttatgttta

SEQ ID NO: 34447 - DNA, 6899 bp, Homo sapiens
gtactgaactgggaaagacagcagagcaacagctcaaaatctcgcgtcattctagaagtcaagccaggcacaagggctcatcgggcaaccccaggatggggagaggccaagacaggcgggtcactcgcgcctgcaaccccaggacggggggaggccgagcgggtcactttgaaccctcggaaatccaagagtctgagacctacctaggctacatggggagaccttgtgtctaccaaatatatgctattgaaacttctgaaactaggtttagaagtttcaagagcagaatctccgtgttgcaatctggttcctaaggaggaagaggaaggcagccctggagtggtttctttacagtaatttcaacagaagagtgagagatggaacccgaagaagaaaggattcgttacagccagagattgcgtggtaccatgcgacgacgctatgaagatgatggcatttcagatgatgaaattgaaggaaaaagaacttttgacttggaagagaaactgcacaccaacaaatataatgccaattttgttacttttatggaaggaaaagattttaatgtagagtatattcagcggggtggcttgagagatcctctgattttcaagaattctgatggactcggaataaaaatgccggatccagacttcactgtgaatgatgtcaaaatgtgtgtggggagtcgtcgcatggtggatgtcatggacgtgaacacacagaaaggcattgaaatgaccatggctcagtggacacgctactatgagaccccagaggaggagcgagagaaactctataatgtcatcagcctcgagtttagccacaccaggctggagaatatggtgcagaggccctccacggtggatttcattgactgggtagacaacatgtggccaaggcacttgaaggaaagccagactgaatcaacaaatgccatcttggagatgcagtaccctaaagtgcagaagtactgtctaatgagtgttcgaggctgctatactgacttccatgtggactttggtggtacctctgtttggtatcacatccatcaagggggaaaggtcttctggctcatcccccctacagcccacaacctggagctgtacgagaattggctgctgtcagggaaacagggagacatctttctgggtgaccgggtatcagattgtcagcgcattgagctcaagcagggctataccttcgtcattccctcaggctggattcatgctgtgtatactcctacagacacattagtgtttgggggcaattttttgcatagcttcaacatccctatgcagttaaaaatatacaacattgaagatcggacacgggttccaaataagtttcgctatccattctactatgagatgtgttggtatgtgttggagcgctatgtgtactgcataaccaaccgttcccacctaaccaaggaatttcagaaagagtccctcagcatggatttggagttaaatgggttggagtctgggaatggggatgaggaagcagtggatcgagaaccccgacgcttgagcagcaggcgttctgtcctcactagccctgtagcgaatggagtcaacctggattatgatggactgggcaaaacctgccgaagtcttccaagtctgaagaaaactttggctggggactcatcttctgactgtagccggggctcccacaatggacaagtgtgggatccccagtgtgctccccgaaaggacaggcaagtgcatctgacccattttgagcttgaaggccttcgctgccttgtagataagttggagtctctgccactgcacaagaaatgtgtccccacagggatagaagatgaagatgctctcattgctgatgtaaagattttgctggaggagcttgccaacagcgatcccaagttagccctcactggagttcctatagtacagtggccaaaaagggataagcttaaattccccactcggccaaaggtgcgggttcctaccatccccattacgaagcctcacactatgaaaccagctccacggttaacacctgtgaggccagctgctgcctccccgattgtgtcaggagccagacggagacgagtgcgatgtcgaaaatgcaaagcctgtgtgcaaggagagtgtggtgtttgccactactgcagagacatgaagaagtttggggggcctggacgcatgaagcagtcctgtgtcctccgacagtgcttggcacccagactgcctcactcagtcacatgttccctctgtggagaggtggatcagaatgaagagacacaagactttgagaagaaactcatggaatgctgtatctgcaatgagattgttcatcctggctgcctccagatggacggagaggggttgcttaacgaagaattgccaaattgctgggaatgtccaaagtgctaccaggaggacagctcggagaaagcccagaagcggaaaatggaagagagtgacgaagaagctgtgcaagccaaagtcctgcggcccctgcggagctgcgatgagcctctcacgcccccgcctcattcacccacttccatgctgcagctcatccatgacccggtttccccccggggtatggtgactcggtcatcccctggggctggccccagcgaccaccacagtgccagccgcgatgagcgcttcaaacggcggcagttgctgcggctgcaggccacagagcgcaccatggtacgggaaaaggagaacaatcccagcggcaaaaaggagctgtctgaagttgagaaagccaagatccggggatcgtacctcactgtcacgctacagaggcccaccaaagagctccacgggacatccattgtgcccaagctgcaggccatcacggcctcctctgccaaccttcgccattccccccgtgtgctagtgcagcactgcccagcccgaaccccccagcgtggggatgaggaggggctggggggagaggaggaggaagaggaggaggaggaggaggaagatgacagtgcagaggaggggggtgcagccaggctgaatggccggggcagttgggctcaggatggagacgaaagctggatgcagcgggaggtctggatgtctgtcttccgctacctcagccgcagagaactttgtgaatgtatgcgagtgtgcaagacgtggtataaatggtgctgcgacaagagactttggacaaaaattgacttgagtaggtgtaaggccattgtgccccaggccctcagtggcatcatcaagaggcagccagtcagccttgacctcagttggaccaacatctctaaaaagcaactgacatggctcgtcaataggctgccaggactgaaagacctcctcctagcaggctgctcctggtctgcagtctctgccctcagcacctccagctgcccccttctcaggacccttgatcttcggtgggcagtaggaatcaaggaccctcaaattcgggacttgcttactccaccggctgataaaccaggtcaggacaatcgcagcaagctccggaacatgaccgacttccggctggcaggccttgacatcacagatgccacgcttcgcctcataattcgccacatgcccctcctgtctcgactcgacctcagtcactgcagccaccttacagatcagtcctccaatctactcactgctgtcgggtcttccactcgctactctctcacagagctcaatatggcaggttgcaataaattgacagaccagaccctgatctacctacggcgcattgccaacgtcaccttgatcgaccttcgaggatgcaagcagatcactcgaaaagcctgcgagcacttcatctcagacttgtccatcaacagcctctactgcctgtctgacgagaagctgatacagaagatcagctaagacacacccagcccagattcaacaggaaaccgatcttcccctgactccccaccgaggagagcctctcctcgaccctgcacgggctctgaggccagcgtcacactccctctctgctctcctgtcccttgagcccttcctctacaggtggggcagagagggtggtggacaccaggcttatctgcctgctcctctccctcctaaggaaaagggagtagcagattgatctgaggggaaagcacaggctgtgctgtcgaggcgcctgctcgcttactcgcctgccaggaggccgggctctcagtttggggtgtttgtgcaaccttcatctgcactgggccctgtgcccctcctccccatccatggtccccagcagtgcctggttctgagcaaactcccagggaagaaaacggccctgtctccatggccaggttcttgtggtgtccagtgcgcgtctctcctccatcacactctcccggcttgcgcaggaggggccagcagccccaggagtcccagacccgtgccgatcacactggtgctgttgagatctcccaaacctcacgtccttaactgtgctctccctcctttcctctcccttgagcttggttctgcccagcactcgtgcttgttcacataattaggtttcccaccccagcctacccgacttacttgctagtctctatgaggtccttattgcacttattggggttgaagctcttcagaggagctggaactgtctaccccagggacacacccatttcgttgctacccaagtggattctgagacaggcaccatctccttgttccccctctctcttttgcctcccactgactgcccttttccatgtgtcttcattctgcctgaagaaggctttcccaggatgcacgtcctcagagggagcagcctatctcccccaagctggaggcggcagaggactgggccaagccccaacctgcctcccagccaggctcctccaggcctctggtttagcggagccccctgagcccaggcctgtgtctagccccagtggctcactgaactttcagggcagtcagggggtcctgcttagaagccagtcaccagccctctgcctgcagccatggaagggggtgtgcacgtgcctctgtgtgtgtggctgagtgtattctgcgcgtgtgtgtggagggagggagggaggggagcatggtgtctcccgctccaccgccctttgttgagccccatcagctgcccccttttactttgcattgaacggcctgtccaaagatcctctctctagggcagcagagagctttttgcactttaaaaaaaaaaagaaagaaagaaaggtcggaatttcttttgggtcaatatttttaagtgtgtgaggagatgctcagtagcagcagcctatggcaagagcttataaatgattgatgcaaatttgcactctgctccccctctgtaaggatactgatagcacaacctcttccccccaccccgccccgccttttggtcgtccatccctgtccctttctggccctcttcctgtagcccagtctcaggctttcctcttcctgaagccctacagagttagggaatggagcccaggcaccaggggtctaaagtgtgagccactgagaagagagacgccaactgcacccttgccacttccaaagcaatagaggcagagtggtcccctctttgccacctaggccagttttgaccctggcattaactggccttagaagaaactggatcctggtagggggtggcattttgtttgtttcttccaatctgctgaatcttttgactgcaccttacaaacagcagtctgctcccatgaccctctgcccacttccattggtctccaggccccaataatctggggttgaaactttgaggaaatgccagtgacttattccagagtgcctcagttaggggaacttctctgtaaagaaccctgggtattgagcaaaaaccttattatcgttaatgacctataattggaagcttcctgcctttttctttggttgctcctgtggaaaatactgaaaagattactttgttttattttgttgtctttttataaaaggggaggtggagagaccccttcagagcagggattgtgccgggagagtgcctctgactttgggacatttcatccacagaaatttccaagccaatggtttcttttgggttttggtttttatgtttgttttttggggtttggaaaaacatgcatttttaccgtgcacgtaaattggtcagcagaaaagggagcccagaaaaggcagcagatggaccatgcccttgctgggttttccttttctttgggactgtgaggggaaatggtttttagaggtgagggttggtccatgtggaggaaagaagtgtctctgttgggggacagaggaacctggggagtccatcgcatgtcctacaatctgctcttagacacggccttgccaggagagcctgccctcagactgcaggaccagaacccctgcctccatctttccaagcaccggggcgaaaaaccacaaaggaaaggaagaaaatttatatatatataatataaaatcacttggtgattaaaaaaataactgctccataaataaaactcctaaagtcacttatgtttaaagggtttggttgtgttttttgtttttcggagaaatattgtaaatatatatttttttgttgctgatttagagtcaatctccaatgttgtgctaaaaagtttaaattaaatgtaagcattaaggggataagtcttatgctatctcagttgacacattgaggttattttgggccagagaaggaggaagctagttggactttgttttgttttccaaaagttctccactattggttttagagagagcaaggacatctttcctctgacacgtgggaatgggtgatatttgtgtaataaaatttttaaaagacaaaaaaagaaatagcctccaatgggaaatattttaatttaggttttgtttttgtttgggggtttttgtttttttaaaaaaataaaaaggctttaaaaacaaaaaataaac

SEQ ID NO: 34448 - DNA, 5690 bp, Homo sapiens
agcgggtcgtggagctggatactggctatgatgtggcctcgatcgctctacaatagccacaccaggctggagaatatggtgcagaggccctccacggtggatttcattgactgggtagacaacatgtggccaaggcacttgaaggaaagccagactgaatcaacaaatgccatcttggagatgcagtaccctaaagtgcagaagtactgtctaatgagtgttcgaggctgctatactgacttccatgtggactttggtggtacctctgtttggtatcacatccatcaagggggaaagcccacaacctggagctgtacgagaattggctgctgtcagggaaacagggagacatctttctgggtgaccgggtatcagattgtcagcgcattgagctcaagcagggctataccttcgtcattccctcaggctggattcatgctgtgtatactcctacagacacattagtgtttgggggcaattttttgcatagcttcaacatccctatgcagttaaaaatatacaacattgaagatcggacacgggttccaaataagtttcgctatccattctactatgagatgtgttggtatgtgttggagcgctatgtgtactgcataaccaaccgttcccacctaaccaaggaatttcagaaagagtccctcagcatggatttggagttaaatgggttggagtctgggaatggggatgaggaagcagtggatcgagaaccccgacgcttgagcagcaggcgttctgtcctcactagccctgtagcgaatggagtcaacctggattatgatggactgggcaaaacctgccgaagtcttccaagtctgaagaaaactttggctggggactcatcttctgactgtagccggggctcccacaatggacaagtgtgggatccccagtgtgctccccgaaaggacaggcaagtgcatctgacccattttgagcttgaaggccttcgctgccttgtagataagttggagtctctgccactgcacaagaaatgtgtccccacagggatagaagatgaagatgctctcattgctgatgtaaagattttgctggaggagcttgccaacagcgatcccaagttagccctcactggagttcctatagtacagtggccaaaaagggataagcttaaattccccactcggccaaaggtgcgggttcctaccatccccattacgaagcctcacactatgaaaccagctccacggttaacacctgtgaggccagctgctgcctccccgattgtgtcaggagccagacggagacgagtgcgatgtcgaaaatgcaaagcctgtgtgcaaggagagtgtggtgtttgccactactgcagagacatgaagaagtttggggggcctggacgcatgaagcagtcctgtgtcctccgacagtgcttggcacccagactgcctcactcagtcacatgttccctctgtggagaggtggatcagaatgaagagacacaagactttgagaagaaactcatggaatgctgtatctgcaatgagattgttcatcctggctgcctccagatggacggagaggggttgcttaacgaagaattgccaaattgctgggaatgtccaaagtgctaccaggaggacagctcggagaaagcccagaagcggaaaatggaagagagtgacgaagaagctgtgcaagccaaagtcctgcggcccctgcggagctgcgatgagcctctcacgcccccgcctcattcacccacttccatgctgcagctcatccatgacccggtttccccccggggtatggtgactcggtcatcccctggggctggccccagcgaccaccacagtgccagccgcgatgagcgcttcaaacggcggcagttgctgcggctgcaggccacagagcgcaccatggtacgggaaaaggagaacaatcccagcggcaaaaaggagctgtctgaagttgagaaagccaagatccggggatcgtacctcactgtcacgctacagaggcccaccaaagagctccacgggacatccattgtgcccaagctgcaggccatcacggcctcctctgccaaccttcgccattccccccgtgtgctagtgcagcactgcccagcccgaaccccccagcgtggggatgaggaggggctggggggagaggaggaggaagaggaggaggaggaggaggaagatgacagtgcagaggaggggggtgcagccaggctgaatggccggggcagttgggctcaggatggagacgaaagctggatgcagcgggaggtctggatgtctgtcttccgctacctcagccgcagagaactttgtgaatgtatgcgagtgtgcaagacgtggtataaatggtgctgcgacaagagactttggacaaaaattgacttgagtaggtgtaaggccattgtgccccaggccctcagtggcatcatcaagaggcagccagtcagccttgacctcagttggaccaacatctctaaaaagcaactgacatggctcgtcaataggctgccaggactgaaagacctcctcctagcaggctgctcctggtctgcagtctctgccctcagcacctccagctgcccccttctcaggacccttgatcttcggtgggcagtaggaatcaaggaccctcaaattcgggacttgcttactccaccggctgataaaccaggtcaggacaatcgcagcaagctccggaacatgaccgacttccggctggcaggccttgacatcacagatgccacgcttcgcctcataattcgccacatgcccctcctgtctcgactcgacctcagtcactgcagccaccttacagatcagtcctccaatctactcactgctgtcgggtcttccactcgctactctctcacagagctcaatatggcaggttgcaataaattgacagaccagaccctgatctacctacggcgcattgccaacgtcaccttgatcgaccttcgaggatgcaagcagatcactcgaaaagcctgcgagcacttcatctcagacttgtccatcaacagcctctactgcctgtctgacgagaagctgatacagaagatcagctaagacacacccagcccagattcaacaggaaaccgatcttcccctgactccccaccgaggagagcctctcctcgaccctgcacgggctctgaggccagcgtcacactccctctctgctctcctgtcccttgagcccttcctctacaggtggggcagagagggtggtggacaccaggcttatctgcctgctcctctccctcctaaggaaaagggagtagcagattgatctgaggggaaagcacaggctgtgctgtcgaggcgcctgctcgcttactcgcctgccaggaggccgggctctcagtttggggtgtttgtgcaaccttcatctgcactgggccctgtgcccctcctccccatccatggtccccagcagtgcctggttctgagcaaactcccagggaagaaaacggccctgtctccatggccaggttcttgtggtgtccagtgcgcgtctctcctccatcacactctcccggcttgcgcaggaggggccagcagccccaggagtcccagacccgtgccgatcacactggtgctgttgagatctcccaaacctcacgtccttaactgtgctctccctcctttcctctcccttgagcttggttctgcccagcactcgtgcttgttcacataattaggtttcccaccccagcctacccgacttacttgctagtctctatgaggtccttattgcacttattggggttgaagctcttcagaggagctggaactgtctaccccagggacacacccatttcgttgctacccaagtggattctgagacaggcaccatctccttgttccccctctctcttttgcctcccactgactgcccttttccatgtgtcttcattctgcctgaagaaggctttcccaggatgcacgtcctcagagggagcagcctatctcccccaagctggaggcggcagaggactgggccaagccccaacctgcctcccagccaggctcctccaggcctctggtttagcggagccccctgagcccaggcctgtgtctagccccagtggctcactgaactttcagggcagtcagggggtcctgcttagaagccagtcaccagccctctgcctgcagccatggaagggggtgtgcacgtgcctctgtgtgtgtggctgagtgtattctgcgcgtgtgtgtggagggagggagggaggggagcatggtgtctcccgctccaccgccctttgttgagccccatcagctgcccccttttactttgcattgaacggcctgtccaaagatcctctctctagggcagcagagagctttttgcactttaaaaaaaaaaagaaagaaagaaaggtcggaatttcttttgggtcaatatttttaagtgtgtgaggagatgctcagtagcagcagcctatggcaagagcttataaatgattgatgcaaatttgcactctgctccccctctgtaaggatactgatagcacaacctcttccccccaccccgccccgccttttggtcgtccatccctgtccctttctggccctcttcctgtagcccagtctcaggctttcctcttcctgaagccctacagagttagggaatggagcccaggcaccaggggtctaaagtgtgagccactgagaagagagacgccaactgcacccttgccacttccaaagcaatagaggcagagtggtcccctctttgccacctaggccagttttgaccctggcattaactggccttagaagaaactggatcctggtagggggtggcattttgtttgtttcttccaatctgctgaatcttttgactgcaccttacaaacagcagtctgctcccatgaccctctgcccacttccattggtctccaggccccaataatctggggttgaaactttgaggaaatgccagtgacttattccagagtgcctcagttaggggaacttctctgtaaagaaccctgggtattgagcaaaaaccttattatcgttaatgacctataattggaagcttcctgcctttttctttggttgctcctgtggaaaatactgaaaagattactttgttttattttgttgtctttttataaaaggggaggtggagagaccccttcagagcagggattgtgccgggagagtgcctctgactttgggacatttcatccacagaaatttccaagccaatggtttcttttgggttttggtttttatgtttgttttttggggtttggaaaaacatgcatttttaccgtgcacgtaaattggtcagcagaaaagggagcccagaaaaggcagcagatggaccatgcccttgctgggttttccttttctttgggactgtgaggggaaatggtttttagaggtgagggttggtccatgtggaggaaagaagtgtctctgttgggggacagaggaacctggggagtccatcgcatgtcctacaatctgctcttagacacggccttgccaggagagcctgccctcagactgcaggaccagaacccctgcctccatctttccaagcaccggggcgaaaaaccacaaaggaaaggaagaaaatttatatatatataatataaaatcacttggtgattaaaaaaataactgctccataaataaaactcctaaagtcacttatgttta

SEQ ID NO: 34449 - DNA, 5422 bp, Homo sapiens
gaggtctgcttgagcccaggagtttgagaccatcctgacctcaagtgatccacccgtctgggcctcccaagtaccctttatcttcagtgattgtttctcaagaccaacgttttctaagttgatggttctgcttaagtttttgcttcagatgccaagctgggtttgcaggttgactggtgagagtatttcctgggttaatgattacagtaattccatttgttgtactctctttccttgaaaatcgtcatcttttctctattttattcctctgtaggttccaaataagtttcgctatccattctactatgagatgtgttggtatgtgttggagcgctatgtgtactgcataaccaaccgttcccacctaaccaaggaatttcagaaagagtccctcagcatggatttggagttaaatgggttggagtctgggaatggggatgaggaagcagtggatcgagaaccccgacgcttgagcagcaggcgttctgtcctcactagccctgtagcgaatggagtcaacctggattatgatggactgggcaaaacctgccgaagtcttccaagtctgaagaaaactttggctggggactcatcttctgactgtagccggggctcccacaatggacaagtgtgggatccccagtgtgctccccgaaaggacaggcaagtgcatctgacccattttgagcttgaaggccttcgctgccttgtagataagttggagtctctgccactgcacaagaaatgtgtccccacagggatagaagatgaagatgctctcattgctgatgtaaagattttgctggaggagcttgccaacagcgatcccaagttagccctcactggagttcctatagtacagtggccaaaaagggataagcttaaattccccactcggccaaaggtgcgggttcctaccatccccattacgaagcctcacactatgaaaccagctccacggttaacacctgtgaggccagctgctgcctccccgattgtgtcaggagccagacggagacgagtgcgatgtcgaaaatgcaaagcctgtgtgcaaggagagtgtggtgtttgccactactgcagagacatgaagaagtttggggggcctggacgcatgaagcagtcctgtgtcctccgacagtgcttggcacccagactgcctcactcagtcacatgttccctctgtggagaggtggatcagaatgaagagacacaagactttgagaagaaactcatggaatgctgtatctgcaatgagattgttcatcctggctgcctccagatggacggagaggggttgcttaacgaagaattgccaaattgctgggaatgtccaaagtgctaccaggaggacagctcggagaaagcccagaagcggaaaatggaagagagtgacgaagaagctgtgcaagccaaagtcctgcggcccctgcggagctgcgatgagcctctcacgcccccgcctcattcacccacttccatgctgcagctcatccatgacccggtttccccccggggtatggtgactcggtcatcccctggggctggccccagcgaccaccacagtgccagccgcgatgagcgcttcaaacggcggcagttgctgcggctgcaggccacagagcgcaccatggtacgggaaaaggagaacaatcccagcggcaaaaaggagctgtctgaagttgagaaagccaagatccggggatcgtacctcactgtcacgctacagaggcccaccaaagagctccacgggacatccattgtgcccaagctgcaggccatcacggcctcctctgccaaccttcgccattccccccgtgtgctagtgcagcactgcccagcccgaaccccccagcgtggggatgaggaggggctggggggagaggaggaggaagaggaggaggaggaggaggaagatgacagtgcagaggaggggggtgcagccaggctgaatggccggggcagttgggctcaggatggagacgaaagctggatgcagcgggaggtctggatgtctgtcttccgctacctcagccgcagagaactttgtgaatgtatgcgagtgtgcaagacgtggtataaatggtgctgcgacaagagactttggacaaaaattgacttgagtaggtgtaaggccattgtgccccaggccctcagtggcatcatcaagaggcagccagtcagccttgacctcagttggaccaacatctctaaaaagcaactgacatggctcgtcaataggctgccaggactgaaagacctcctcctagcaggctgctcctggtctgcagtctctgccctcagcacctccagctgcccccttctcaggacccttgatcttcggtgggcagtaggaatcaaggaccctcaaattcgggacttgcttactccaccggctgataaaccaggtcaggacaatcgcagcaagctccggaacatgaccgacttccggctggcaggccttgacatcacagatgccacgcttcgcctcataattcgccacatgcccctcctgtctcgactcgacctcagtcactgcagccaccttacagatcagtcctccaatctactcactgctgtcgggtcttccactcgctactctctcacagagctcaatatggcaggttgcaataaattgacagaccagaccctgatctacctacggcgcattgccaacgtcaccttgatcgaccttcgaggatgcaagcagatcactcgaaaagcctgcgagcacttcatctcagacttgtccatcaacagcctctactgcctgtctgacgagaagctgatacagaagatcagctaagacacacccagcccagattcaacaggaaaccgatcttcccctgactccccaccgaggagagcctctcctcgaccctgcacgggctctgaggccagcgtcacactccctctctgctctcctgtcccttgagcccttcctctacaggtggggcagagagggtggtggacaccaggcttatctgcctgctcctctccctcctaaggaaaagggagtagcagattgatctgaggggaaagcacaggctgtgctgtcgaggcgcctgctcgcttactcgcctgccaggaggccgggctctcagtttggggtgtttgtgcaaccttcatctgcactgggccctgtgcccctcctccccatccatggtccccagcagtgcctggttctgagcaaactcccagggaagaaaacggccctgtctccatggccaggttcttgtggtgtccagtgcgcgtctctcctccatcacactctcccggcttgcgcaggaggggccagcagccccaggagtcccagacccgtgccgatcacactggtgctgttgagatctcccaaacctcacgtccttaactgtgctctccctcctttcctctcccttgagcttggttctgcccagcactcgtgcttgttcacataattaggtttcccaccccagcctacccgacttacttgctagtctctatgaggtccttattgcacttattggggttgaagctcttcagaggagctggaactgtctaccccagggacacacccatttcgttgctacccaagtggattctgagacaggcaccatctccttgttccccctctctcttttgcctcccactgactgcccttttccatgtgtcttcattctgcctgaagaaggctttcccaggatgcacgtcctcagagggagcagcctatctcccccaagctggaggcggcagaggactgggccaagccccaacctgcctcccagccaggctcctccaggcctctggtttagcggagccccctgagcccaggcctgtgtctagccccagtggctcactgaactttcagggcagtcagggggtcctgcttagaagccagtcaccagccctctgcctgcagccatggaagggggtgtgcacgtgcctctgtgtgtgtggctgagtgtattctgcgcgtgtgtgtggagggagggagggaggggagcatggtgtctcccgctccaccgccctttgttgagccccatcagctgcccccttttactttgcattgaacggcctgtccaaagatcctctctctagggcagcagagagctttttgcactttaaaaaaaaaaagaaagaaagaaaggtcggaatttcttttgggtcaatatttttaagtgtgtgaggagatgctcagtagcagcagcctatggcaagagcttataaatgattgatgcaaatttgcactctgctccccctctgtaaggatactgatagcacaacctcttccccccaccccgccccgccttttggtcgtccatccctgtccctttctggccctcttcctgtagcccagtctcaggctttcctcttcctgaagccctacagagttagggaatggagcccaggcaccaggggtctaaagtgtgagccactgagaagagagacgccaactgcacccttgccacttccaaagcaatagaggcagagtggtcccctctttgccacctaggccagttttgaccctggcattaactggccttagaagaaactggatcctggtagggggtggcattttgtttgtttcttccaatctgctgaatcttttgactgcaccttacaaacagcagtctgctcccatgaccctctgcccacttccattggtctccaggccccaataatctggggttgaaactttgaggaaatgccagtgacttattccagagtgcctcagttaggggaacttctctgtaaagaaccctgggtattgagcaaaaaccttattatcgttaatgacctataattggaagcttcctgcctttttctttggttgctcctgtggaaaatactgaaaagattactttgttttattttgttgtctttttataaaaggggaggtggagagaccccttcagagcagggattgtgccgggagagtgcctctgactttgggacatttcatccacagaaatttccaagccaatggtttcttttgggttttggtttttatgtttgttttttggggtttggaaaaacatgcatttttaccgtgcacgtaaattggtcagcagaaaagggagcccagaaaaggcagcagatggaccatgcccttgctgggttttccttttctttgggactgtgaggggaaatggtttttagaggtgagggttggtccatgtggaggaaagaagtgtctctgttgggggacagaggaacctggggagtccatcgcatgtcctacaatctgctcttagacacggccttgccaggagagcctgccctcagactgcaggaccagaacccctgcctccatctttccaagcaccggggcgaaaaaccacaaaggaaaggaagaaaatttatatatatataatataaaatcacttggtgattaaaaaaataactgctccataaataaaactcctaaagtcacttatgttta

SEQ ID NO: 34450 - DNA, 5251 bp, Homo sapiens
gccattgataatacatacacaagatgagttgtgtgtcaataaaatttattctagaaacaagcagtgggcagatctggccatagtgggccaagccccaggctaggtatgctaccatgtaatcttctaccctatccagtcttaaagcaacctgatatatttgacctcactgctttctctttccagcttaaattccccactcggccaaaggtgcgggttcctaccatccccattacgaagcctcacactatgaaaccagctccacggttaacacctgtgaggccagctgctgcctccccgattgtgtcaggagccagacggagacgagtgcgatgtcgaaaatgcaaagcctgtgtgcaaggagagtgtggtgtttgccactactgcagagacatgaagaagtttggggggcctggacgcatgaagcagtcctgtgtcctccgacagtgcttggcagtgagtgatctgctgggtaaagaattttggggaggggtggcagtgccaaaggaactgaaatacatatagtgtagagttaaagagacttcagagttggaaagaaaaggtttatactctctttttggctttattttgtaccttttttccccaggtttagatagaaggtatctagtactaaaaatccgatttaatctttaggctttacctaattttcaaacaagagattagcatttgaagggcaaatcattgctttctttcccctcttcaggtagattagaaaggaccggggaggccaagtataggccaactgaaaataaactagtctctggtgcccaggtggttgagtcctcctcttccccagtcatttttcctacccaaaacctccgttctctccaccctgcctccatgcttccaggtgtttagtagagaattataggacccaaatctcccatcttcagtttaagggaaactgaaatgataaagatctgagtcagttctcttggattctatctttgtcctcttgtagcccagactgcctcactcagtcacatgttccctctgtggagaggtggatcagaatgaagagacacaagactttgagaagaaactcatggaatgctgtatctgcaatgagattgttcatcctggctgcctccagatggacggagaggggttgcttaacgaagaattgccaaattgctgggaatgtccaaagtgctaccaggaggacagctcggagaaagcccagaagcggaaaatggaagagagtgacgaagaagctgtgcaagccaaagtcctgcggcccctgcggagctgcgatgagcctctcacgcccccgcctcattcacccacttccatgctgcagctcatccatgacccggtttccccccggggtatggtgactcggtcatcccctggggctggccccagcgaccaccacagtgccagccgcgatgagcgcttcaaacggcggcagttgctgcggctgcaggccacagagcgcaccatggtacgggaaaaggagaacaatcccagcggcaaaaaggagctgtctgaagttgagaaagccaagatccggggatcgtacctcactgtcacgctacagaggcccaccaaagagctccacgggacatccattgtgcccaagctgcaggccatcacggcctcctctgccaaccttcgccattccccccgtgtgctagtgcagcactgcccagcccgaaccccccagcgtggggatgaggaggggctggggggagaggaggaggaagaggaggaggaggaggaggaagatgacagtgcagaggaggggggtgcagccaggctgaatggccggggcagttgggctcaggatggagacgaaagctggatgcagcgggaggtctggatgtctgtcttccgctacctcagccgcagagaactttgtgaatgtatgcgagtgtgcaagacgtggtataaatggtgctgcgacaagagactttggacaaaaattgacttgagtaggtgtaaggccattgtgccccaggccctcagtggcatcatcaagaggcagccagtcagccttgacctcagttggaccaacatctctaaaaagcaactgacatggctcgtcaataggctgccaggactgaaagacctcctcctagcaggctgctcctggtctgcagtctctgccctcagcacctccagctgcccccttctcaggacccttgatcttcggtgggcagtaggaatcaaggaccctcaaattcgggacttgcttactccaccggctgataaaccaggtcaggacaatcgcagcaagctccggaacatgaccgacttccggctggcaggccttgacatcacagatgccacgcttcgcctcataattcgccacatgcccctcctgtctcgactcgacctcagtcactgcagccaccttacagatcagtcctccaatctactcactgctgtcgggtcttccactcgctactctctcacagagctcaatatggcaggttgcaataaattgacagaccagaccctgatctacctacggcgcattgccaacgtcaccttgatcgaccttcgaggatgcaagcagatcactcgaaaagcctgcgagcacttcatctcagacttgtccatcaacagcctctactgcctgtctgacgagaagctgatacagaagatcagctaagacacacccagcccagattcaacaggaaaccgatcttcccctgactccccaccgaggagagcctctcctcgaccctgcacgggctctgaggccagcgtcacactccctctctgctctcctgtcccttgagcccttcctctacaggtggggcagagagggtggtggacaccaggcttatctgcctgctcctctccctcctaaggaaaagggagtagcagattgatctgaggggaaagcacaggctgtgctgtcgaggcgcctgctcgcttactcgcctgccaggaggccgggctctcagtttggggtgtttgtgcaaccttcatctgcactgggccctgtgcccctcctccccatccatggtccccagcagtgcctggttctgagcaaactcccagggaagaaaacggccctgtctccatggccaggttcttgtggtgtccagtgcgcgtctctcctccatcacactctcccggcttgcgcaggaggggccagcagccccaggagtcccagacccgtgccgatcacactggtgctgttgagatctcccaaacctcacgtccttaactgtgctctccctcctttcctctcccttgagcttggttctgcccagcactcgtgcttgttcacataattaggtttcccaccccagcctacccgacttacttgctagtctctatgaggtccttattgcacttattggggttgaagctcttcagaggagctggaactgtctaccccagggacacacccatttcgttgctacccaagtggattctgagacaggcaccatctccttgttccccctctctcttttgcctcccactgactgcccttttccatgtgtcttcattctgcctgaagaaggctttcccaggatgcacgtcctcagagggagcagcctatctcccccaagctggaggcggcagaggactgggccaagccccaacctgcctcccagccaggctcctccaggcctctggtttagcggagccccctgagcccaggcctgtgtctagccccagtggctcactgaactttcagggcagtcagggggtcctgcttagaagccagtcaccagccctctgcctgcagccatggaagggggtgtgcacgtgcctctgtgtgtgtggctgagtgtattctgcgcgtgtgtgtggagggagggagggaggggagcatggtgtctcccgctccaccgccctttgttgagccccatcagctgcccccttttactttgcattgaacggcctgtccaaagatcctctctctagggcagcagagagctttttgcactttaaaaaaaaaaagaaagaaagaaaggtcggaatttcttttgggtcaatatttttaagtgtgtgaggagatgctcagtagcagcagcctatggcaagagcttataaatgattgatgcaaatttgcactctgctccccctctgtaaggatactgatagcacaacctcttccccccaccccgccccgccttttggtcgtccatccctgtccctttctggccctcttcctgtagcccagtctcaggctttcctcttcctgaagccctacagagttagggaatggagcccaggcaccaggggtctaaagtgtgagccactgagaagagagacgccaactgcacccttgccacttccaaagcaatagaggcagagtggtcccctctttgccacctaggccagttttgaccctggcattaactggccttagaagaaactggatcctggtagggggtggcattttgtttgtttcttccaatctgctgaatcttttgactgcaccttacaaacagcagtctgctcccatgaccctctgcccacttccattggtctccaggccccaataatctggggttgaaactttgaggaaatgccagtgacttattccagagtgcctcagttaggggaacttctctgtaaagaaccctgggtattgagcaaaaaccttattatcgttaatgacctataattggaagcttcctgcctttttctttggttgctcctgtggaaaatactgaaaagattactttgttttattttgttgtctttttataaaaggggaggtggagagaccccttcagagcagggattgtgccgggagagtgcctctgactttgggacatttcatccacagaaatttccaagccaatggtttcttttgggttttggtttttatgtttgttttttggggtttggaaaaacatgcatttttaccgtgcacgtaaattggtcagcagaaaagggagcccagaaaaggcagcagatggaccatgcccttgctgggttttccttttctttgggactgtgaggggaaatggtttttagaggtgagggttggtccatgtggaggaaagaagtgtctctgttgggggacagaggaacctggggagtccatcgcatgtcctacaatctgctcttagacacggccttgccaggagagcctgccctcagactgcaggaccagaacccctgcctccatctttccaagcaccggggcgaaaaaccacaaaggaaaggaagaaaatttatatatatataatataaaatcacttggtgattaaaaaaataactgctccataaataaaactcctaaagtcacttatgttta

SEQ ID NO: 34451 - DNA, 6828 bp, Homo sapiens
gtactgaactgggaaagacagcagagcaacagctcaaaatctcgcgtcattctagaagtcaagccaggcacaagggctcatcgggcaaccccaggatggggagaggccaagacaggcgggtcactcgcgcctgcaaccccaggacggggggaggccgagcgggtcactttgaaccctcggaaatccaagagtctgagacctacctaggctacatggggagaccttgtgtctaccaaatatatgctattgaaacttctgaaactaggtttagaagtttcaagagcagaatctccgtgttgcaatctggttcctaaggaggaagaggaaggcagccctggagtggtttctttacagtaatttcaacagaagagtgagagatggaacccgaagaagaaaggattcgttacagccagagattgcgtggtaccatgcgacgacgctatgaagatgatggcatttcagatgatgaaattgaaggaaaaagaacttttgacttggaagagaaactgcacaccaacaaatataatgccaattttgttacttttatggaaggaaaagattttaatgtagagtatattcagcggggtggcttgagagatcctctgattttcaagaattctgatggactcggaataaaaatgccggatccagacttcactgtgaatgatgtcaaaatgtgtgtggggagtcgtcgcatggtggatgtcatggacgtgaacacacagaaaggcattgaaatgaccatggctcagtggacacgctactatgagaccccagaggaggagcgagagaaactctataatgtcatcagcctcgagtttagccacaccaggctggagaatatggtgcagaggccctccacggtggatttcattgactgggtagacaacatgtggccaaggcacttgaaggaaagccagactgaatcaacaaatgccatcttggagatgcagtaccctaaagtgcagaagtactgtctaatgagtgttcgaggctgctatactgacttccatgtggactttggtggtacctctgtttggtatcacatccatcaagggggaaaggtcttctggctcatcccccctacagcccacaacctggagctgtacgagaattggctgctgtcagggaaacagggagacatctttctgggtgaccgggtatcagattgtcagcgcattgagctcaagcagggctataccttcgtcattccctcaggctggattcatgctgtgtatactcctacagacacattagtgtttgggggcaattttttgcatagcttcaacatccctatgcagttaaaaatatacaacattgaagatcggacacgggttccaaataagtttcgctatccattctactatgagatgtgttggtatgtgttggagcgctatgtgtactgcataaccaaccgttcccacctaaccaaggaatttcagaaagagtccctcagcatggatttggagttaaatgggttggagtctgggaatggggatgaggaagcagtggatcgagaaccccgacgcttgagcagcaggcgttctgtcctcactagccctgtagcgaatggagtcaacctggattatgatggactgggcaaaacctgccgaagtcttccaagtctgaagaaaactttggctggggactcatcttctgactgtagccggggctcccacaatggacaagtgtgggatccccagtgtgctccccgaaaggacaggcaagtgcatctgacccattttgagcttgaaggccttcgctgccttgtagataagttggagtctctgccactgcacaagaaatgtgtccccacagggatagaagatgaagatgctctcattgctgatgtaaagattttgctggaggagcttgccaacagcgatcccaagttagccctcactggagttcctatagtacagtggccaaaaagggataagcttaaattccccactcggccaaaggtgcgggttcctaccatccccattacgaagcctcacactatgaaaccagctccacggttaacacctgtgaggccagctgctgcctccccgattgtgtcaggagccagacggagacgagtgcgatgtcgaaaatgcaaagcctgtgtgcaaggagagtgtggtgtttgccactactgcagagacatgaagaagtttggggggcctggacgcatgaagcagtcctgtgtcctccgacagtgcttggcacccagactgcctcactcagtcacatgttccctctgtggagaggtggatcagaatgaagagacacaagactttgagaagaaactcatggaatgctgtatctgcaatgagattgttcatcctggctgcctccagatggacggagaggggttgcttaacgaagaattgccaaattgctgggaatgtccaaagtgctaccaggaggacagctcggagaaagcccagaagcggaaaatggaagagagtgacgaagaagctgtgcaagccaaagtcctgcggcccctgcggagctgcgatgagcctctcacgcccccgcctcattcacccacttccatgctgcagctcatccatgacccggtttccccccggggtatggtgactcggtcatcccctggggctggccccagcgaccaccacagtgccagccgcgatgagcgcttcaaacggcggcagttgctgcggctgcaggccacagagcgcaccatggtacgggaaaaggagaacaatcccagcggcaaaaaggagctgtctgaagttgagaaagccaagatccggggatcgtacctcactgtcacgctacagaggcccaccaaagagctccacgggacatccattgtgcccaagctgcaggccatcacggcctcctctgccaaccttcgccattccccccgtgtgctagtgcagcactgcccagcccgaaccccccagcgtggggatgaggaggggctggggggagaggaggaggaagaggaggaggaggaggaggaagatgacagtgcagaggaggggggtgcagccaggctgaatggccggggcagttgggctcaggatggagacgaaagctggatgcagcgggaggtctggatgtctgtcttccgctacctcagccgcagagaactttgtgaatgtatgcgagtgtgcaagacgtggtataaatggtgctgcgacaagagactttggacaaaaattgacttgagtaggtgtaaggccattgtgccccaggccctcagtggcatcatcaagaggcagccagtcagccttgacctcagttggaccaacatctctaaaaagcaactgacatggctcgtcaataggctgccaggactgaaagacctcctcctagcaggctgctcctggtctgcagtctctgccctcagcacctccagctgcccccttctcaggacccttgatcttcggtgggcagtaggaatcaaggaccctcaaattcgggacttgcttactccaccggctgataaaccaggtcaggacaatcgcagcaagctccggaacatgaccgacttccggctggcaggccttgacatcacagatgccacgcttcgcctcataattcgccacatgcccctcctgtctcgactcgacctcagtcactgcagccaccttacagatcagtcctccaatctactcactgctgtcgggtcttccactcgctactctctcacagagctcaatatggcaggttgcaataaattgacagaccagaccctgatctacctacggcgcattgccaacgtcaccttgatcgaccttcgaggatgcaagcagatcactcgaaaagcctgcgagcacttcatctcagacttgtccatcaacagcctctactgcctgtctgacgagaagctgatacagaagatcagctaagacacacccagcccagattcaacaggaaaccgatcttcccctgactccccaccgaggagagcctctcctcgaccctgcacgggctctgaggccagcgtcacactccctctctgctctcctgtcccttgagcccttcctctacaggtggggcagagagggtggtggacaccaggcttatctgcctgctcctctccctcctaaggaaaagggagtagcagattgatctgaggggaaagcacaggctgtgctgtcgaggcgcctgctcgcttactcgcctgccaggaggccgggctctcagtttggggtgtttgtgcaaccttcatctgcactgggccctgtgcccctcctccccatccatggtccccagcagtgcctggttctgagcaaactcccagggaagaaaacggccctgtctccatggccaggttcttgtggtgtccagtgcgcgtctctcctccatcacactctcccggcttgcgcaggaggggccagcagccccaggagtcccagacccgtgccgatcacactggtgctgttgagatctcccaaacctcacgtccttaactgtgctctccctcctttcctctcccttgagcttggttctgcccagcactcgtgcttgttcacataattaggtttcccaccccagcctacccgacttacttgctagtctctatgaggtccttattgcacttattggggttgaagctcttcagaggagctggaactgtctaccccagggacacacccatttcgttgctacccaagtggattctgagacaggcaccatctccttgttccccctctctcttttgcctcccactgactgcccttttccatgtgtcttcattctgcctgaagaaggctttcccaggatgcacgtcctcagagggagcagcctatctcccccaagctggaggcggcagaggactgggccaagccccaacctgcctcccagccaggctcctccaggcctctggtttagcggagccccctgagcccaggcctgtgtctagccccagtggctcactgaactttcagggcagtcagggggtcctgcttagaagccagtcaccagccctctgcctgcagccatggaagggggtgtgcacgtgcctctgtgtgtgtggctgagtgtattctgcgcgtgtgtgtggagggagggagggaggggagcatggtgtctcccgctccaccgccctttgttgagccccatcagctgcccccttttactttgcattgaacggcctgtccaaagatcctctctctagggcagcagagagctttttgcactttaaaaaaaaaaagaaagaaagaaaggtcggaatttcttttgggtcaatatttttaagtgtgtgaggagatgctcagtagcagcagcctatggcaagagcttataaatgattgatgcaaatttgcactctgctccccctctgtaaggatactgatagcacaacctcttccccccaccccgccccgccttttggtcgtccatccctgtccctttctggccctcttcctgtagcccagtctcaggctttcctcttcctgaagccctacagagttagggaatggagcccaggcaccaggggtctaaagtgtgagccactgagaagagagacgccaactgcacccttgccacttccaaagcaatagaggcagagtggtcccctctttgccacctaggccagttttgaccctggcattaactggccttagaagaaactggatcctggtagggggtggcattttgtttgtttcttccaatctgctgaatcttttgactgcaccttacaaacagcagtctgctcccatgaccctctgcccacttccattggtctccaggccccaataatctggggttgaaactttgaggaaatgccagtgacttattccagagtgcctcagttaggggaacttctctgtaaagaaccctgggtattgagcaaaaaccttattatcgttaatgacctataattggaagcttcctgcctttttctttggttgctcctgtggaaaatactgaaaagattactttgttttattttgttgtctttttataaaaggggaggtggagagaccccttcagagcagggattgtgccgggagagtgcctctgactttgggacatttcatccacagaaatttccaagccaatggtttcttttgggttttggtttttatgtttgttttttggggtttggaaaaacatgcatttttaccgtgcacgtaaattggtcagcagaaaagggagcccagaaaaggcagcagatggaccatgcccttgctgggttttccttttctttgggactgtgaggggaaatggtttttagaggtgagggttggtccatgtggaggaaagaagtgtctctgttgggggacagaggaacctggggagtccatcgcatgtcctacaatctgctcttagacacggccttgccaggagagcctgccctcagactgcaggaccagaacccctgcctccatctttccaagcaccggggcgaaaaaccacaaaggaaaggaagaaaatttatatatatataatataaaatcacttggtgattaaaaaaataactgctccataaataaaactcctaaagtcacttatgtttaaagggtttggttgtgttttttgtttttcggagaaatattgtaaatatatatttttttgttgctgatttagagtcaatctccaatgttgtgctaaaaagtttaaattaaatgtaagcattaaggggataagtcttatgctatctcagttgacacattgaggttattttgggccagagaaggaggaagctagttggactttgttttgttttccaaaagttctccactattggttttagagagagcaaggacatctttcctctgacacgtgggaatgggtgatatttgtgtaataaaatttttaaaagacaaaaaaagaaaagcggccgctcgttgtcgcgcggccgcg

SEQ ID NO: 34452 - DNA, 3707 bp, Homo sapiens
ctgactcaaggactcaggcgtgtagtggcatcatcaagaggcagccagtcagccttgacctcagttggaccaacatctctaaaaagcaactgacatggctcgtcaataggctgccaggactgaaagacctcctcctagcaggctgctcctggtctgcagtctctgccctcagcacctccagctgcccccttctcaggacccttgatcttcggtgggcagtaggaatcaaggaccctcaaattcgggacttgcttactccaccggctgataaaccaggtcaggacaatcgcagcaagctccggaacatgaccgacttccggctggcaggccttgacatcacagatgccacgcttcgcctcataattcgccacatgcccctcctgtctcgactcgacctcagtcactgcagccaccttacagatcagtcctccaatctactcactgctgtcgggtcttccactcgctactctctcacagagctcaatatggcaggttgcaataaattgacagaccagaccctgatctacctacggcgcattgccaacgtcaccttgatcgaccttcgaggatgcaagcagatcactcgaaaagcctgcgagcacttcatctcagacttgtccatcaacagcctctactgcctgtctgacgagaagctgatacagaagatcagctaagacacacccagcccagattcaacaggaaaccgatcttcccctgactccccaccgaggagagcctctcctcgaccctgcacgggctctgaggccagcgtcacactccctctctgctctcctgtcccttgagcccttcctctacaggtggggcagagagggtggtggacaccaggcttatctgcctgctcctctccctcctaaggaaaagggagtagcagattgatctgaggggaaagcacaggctgtgctgtcgaggcgcctgctcgcttactcgcctgccaggaggccgggctctcagtttggggtgtttgtgcaaccttcatctgcactgggccctgtgcccctcctccccatccatggtccccagcagtgcctggttctgagcaaactcccagggaagaaaacggccctgtctccatggccaggttcttgtggtgtccagtgcgcgtctctcctccatcacactctcccggcttgcgcaggaggggccagcagccccaggagtcccagacccgtgccgatcacactggtgctgttgagatctcccaaacctcacgtccttaactgtgctctccctcctttcctctcccttgagcttggttctgcccagcactcgtgcttgttcacataattaggtttcccaccccagcctacccgacttacttgctagtctctatgaggtccttattgcacttattggggttgaagctcttcagaggagctggaactgtctaccccagggacacacccatttcgttgctacccaagtggattctgagacaggcaccatctccttgttccccctctctcttttgcctcccactgactgcccttttccatgtgtcttcattctgcctgaagaaggctttcccaggatgcacgtcctcagagggagcagcctatctcccccaagctggaggcggcagaggactgggccaagccccaacctgcctcccagccaggctcctccaggcctctggtttagcggagccccctgagcccaggcctgtgtctagccccagtggctcactgaactttcagggcagtcagggggtcctgcttagaagccagtcaccagccctctgcctgcagccatggaagggggtgtgcacgtgcctctgtgtgtgtggctgagtgtattctgcgcgtgtgtgtggagggagggagggaggggagcatggtgtctcccgctccaccgccctttgttgagccccatcagctgcccccttttactttgcattgaacggcctgtccaaagatcctctctctagggcagcagagagctttttgcactttaaaaaaaaaaagaaagaaagaaaggtcggaatttcttttgggtcaatatttttaagtgtgtgaggagatgctcagtagcagcagcctatggcaagagcttataaatgattgatgcaaatttgcactctgctccccctctgtaaggatactgatagcacaacctcttccccccaccccgccccgccttttggtcgtccatccctgtccctttctggccctcttcctgtagcccagtctcaggctttcctcttcctgaagccctacagagttagggaatggagcccaggcaccaggggtctaaagtgtgagccactgagaagagagacgccaactgcacccttgccacttccaaagcaatagaggcagagtggtcccctctttgccacctaggccagttttgaccctggcattaactggccttagaagaaactggatcctggtagggggtggcattttgtttgtttcttccaatctgctgaatcttttgactgcaccttacaaacagcagtctgctcccatgaccctctgcccacttccattggtctccaggccccaataatctggggttgaaactttgaggaaatgccagtgacttattccagagtgcctcagttaggggaacttctctgtaaagaaccctgggtattgagcaaaaaccttattatcgttaatgacctataattggaagcttcctgcctttttctttggttgctcctgtggaaaatactgaaaagattactttgttttattttgttgtctttttataaaaggggaggtggagagaccccttcagagcagggattgtgccgggagagtgcctctgactttgggacatttcatccacagaaatttccaagccaatggtttcttttgggttttggtttttatgtttgttttttggggtttggaaaaacatgcatttttaccgtgcacgtaaattggtcagcagaaaagggagcccagaaaaggcagcagatggaccatgcccttgctgggttttccttttctttgggactgtgaggggaaatggtttttagaggtgagggttggtccatgtggaggaaagaagtgtctctgttgggggacagaggaacctggggagtccatcgcatgtcctacaatctgctcttagacacggccttgccaggagagcctgccctcagactgcaggaccagaacccctgcctccatctttccaagcaccggggcgaaaaaccacaaaggaaaggaagaaaatttatatatatataatataaaatcacttggtgattaaaaaaataactgctccataaataaaactcctaaagtcacttatgtttaaagggtttggttgtgttttttgtttttcggagaaatattgtaaatatatatttttttgttgctgatttagagtcaatctccaatgttgtgctaaaaagtttaaattaaatgtaagcattaaggggataagtcttatgctatctcagttgacacattgaggttattttgggccagagaaggaggaagctagttggactttgttttgttttccaaaagttctccactattggttttagagagagcaaggacatctttcctctgacacgtgggaatgggtgatatttgtgtaataaaatttttaaaagacaaaaaaagaaatagcctccaatgggaaatattttaatttaggttttgtttttgtttgggggtttttgtttttttaaaaaaataaaaaggctttaaaaacaaaaaataaac

SEQ ID NO: 34453 - DNA, 6495 bp, Homo sapiens
agcaactgtttgctcccttttcctggtcgctctgaccctctctggatactgggttgatccacggaaaaaccgaagacgacgtttgggatttaattattcctctcagctttggaatcttttacttctcacttggacaagaactcaagagcagaatctccgtgttgcaatctggttcctaaggaggaagaggaaggcagccctggagtggtttctttacagtaatttcaacagaagagtgagagatggaacccgaagaagaaaggattcgttacagccagagattgcgtggtaccatgcgacgacgctatgaagatgatggcatttcagatgatgaaattgaaggaaaaagaacttttgacttggaagagaaactgcacaccaacaaatataatgccaattttgttacttttatggaaggaaaagattttaatgtagagtatattcagcggggtggcttgagagatcctctgattttcaagaattctgatggactcggaataaaaatgccggatccagacttcactgtgaatgatgtcaaaatgtgtgtggggagtcgtcgcatggtggatgtcatggacgtgaacacacagaaaggcattgaaatgaccatggctcagtggacacgctactatgagaccccagaggaggagcgagagaaactctataatgtcatcagcctcgagtttagccacaccaggctggagaatatggtgcagaggccctccacggtggatttcattgactgggtagacaacatgtggccaaggcacttgaaggaaagccagactgaatcaacaaatgccatcttggagatgcagtaccctaaagtgcagaagtaagtgatgcgccctgcatcttcctccgtgtgctgtgggagaccaaagcaatagcaaggattggcttctcccttacgagctttgctctgtgtcttgaatgattaaaaagatgaattatttaaagatgagactttacagttccacaaggaagagtgtatgtgagcataccatagcacacaaccacacagttaaaggaaaaaaaacttacattttagtcaatacggtagaaaaaaaaaaaacctttttctgataatgtgatgacttgaaaatgcattgctttttctccttctggaacttaagattaagtggaagataaagggagtatataagaggagagtatggcattttggtggggcagatgtacttttttccatcagtacactaatgctgctgctttttttgggtcaggtactgtctaatgagtgttcgaggctgctatactgacttccatgtggactttggtggtacctctgtttggtatcacatccatcaagggggaaaggtcttctggctcatcccccctacagcccacaacctggagctgtacgagaattggctgctgtcagggaaacagggagacatctttctgggtgaccgggtatcagattgtcagcgcattgagctcaagcagggctataccttcgtcattccctcaggctggattcatgctgtgtatactcctacagacacattagtgtttgggggcaattttttgcatagcttcaacatccctatgcagttaaaaatatacaacattgaagatcggacacgggttccaaataagtttcgctatccattctactatgagatgtgttggtatgtgttggagcgctatgtgtactgcataaccaaccgttcccacctaaccaaggaatttcagaaagagtccctcagcatggatttggagttaaatgggttggagtctgggaatggggatgaggaagcagtggatcgagaaccccgacgcttgagcagcaggcgttctgtcctcactagccctgtagcgaatggagtcaacctggattatgatggactgggcaaaacctgccgaagtcttccaagtctgaagaaaactttggctggggactcatcttctgactgtagccggggctcccacaatggacaagtgtgggatccccagtgtgctccccgaaaggacaggcaagtgcatctgacccattttgagcttgaaggccttcgctgccttgtagataagttggagtctctgccactgcacaagaaatgtgtccccacagggatagaagatgaagatgctctcattgctgatgtaaagattttgctggaggagcttgccaacagcgatcccaagttagccctcactggagttcctatagtacagtggccaaaaagggataagcttaaattccccactcggccaaaggtgcgggttcctaccatccccattacgaagcctcacactatgaaaccagctccacggttaacacctgtgaggccagctgctgcctccccgattgtgtcaggagccagacggagacgagtgcgatgtcgaaaatgcaaagcctgtgtgcaaggagagtgtggtgtttgccactactgcagagacatgaagaagtttggggggcctggacgcatgaagcagtcctgtgtcctccgacagtgcttggcacccagactgcctcactcagtcacatgttccctctgtggagaggtggatcagaatgaagagacacaagactttgagaagaaactcatggaatgctgtatctgcaatgagattgttcatcctggctgcctccagatggacggagaggggttgcttaacgaagaattgccaaattgctgggaatgtccaaagtgctaccaggaggacagctcggagaaagcccagaagcggaaaatggaagagagtgacgaagaagctgtgcaagccaaagtcctgcggcccctgcggagctgcgatgagcctctcacgcccccgcctcattcacccacttccatgctgcagctcatccatgacccggtttccccccggggtatggtgactcggtcatcccctggggctggccccagcgaccaccacagtgccagccgcgatgagcgcttcaaacggcggcagttgctgcggctgcaggccacagagcgcaccatggtacgggaaaaggagaacaatcccagcggcaaaaaggagctgtctgaagttgagaaagccaagatccggggatcgtacctcactgtcacgctacagaggcccaccaaagagctccacgggacatccattgtgcccaagctgcaggccatcacggcctcctctgccaaccttcgccattccccccgtgtgctagtgcagcactgcccagcccgaaccccccagcgtggggatgaggaggggctggggggagaggaggaggaagaggaggaggaggaggaggaagatgacagtgcagaggaggggggtgcagccaggctgaatggccggggcagttgggctcaggatggagacgaaagctggatgcagcgggaggtctggatgtctgtcttccgctacctcagccgcagagaactttgtgaatgtatgcgagtgtgcaagacgtggtataaatggtgctgcgacaagagactttggacaaaaattgacttgagtaggtgtaaggccattgtgccccaggccctcagtggcatcatcaagaggcagccagtcagccttgacctcagttggaccaacatctctaaaaagcaactgacatggctcgtcaataggctgccaggactgaaagacctcctcctagcaggctgctcctggtctgcagtctctgccctcagcacctccagctgcccccttctcaggacccttgatcttcggtgggcagtaggaatcaaggaccctcaaattcgggacttgcttactccaccggctgataaaccaggtcaggacaatcgcagcaagctccggaacatgaccgacttccggctggcaggccttgacatcacagatgccacgcttcgcctcataattcgccacatgcccctcctgtctcgactcgacctcagtcactgcagccaccttacagatcagtcctccaatctactcactgctgtcgggtcttccactcgctactctctcacagagctcaatatggcaggttgcaataaattgacagaccagaccctgatctacctacggcgcattgccaacgtcaccttgatcgaccttcgaggatgcaagcagatcactcgaaaagcctgcgagcacttcatctcagacttgtccatcaacagcctctactgcctgtctgacgagaagctgatacagaagatcagctaagacacacccagcccagattcaacaggaaaccgatcttcccctgactccccaccgaggagagcctctcctcgaccctgcacgggctctgaggccagcgtcacactccctctctgctctcctgtcccttgagcccttcctctacaggtggggcagagagggtggtggacaccaggcttatctgcctgctcctctccctcctaaggaaaagggagtagcagattgatctgaggggaaagcacaggctgtgctgtcgaggcgcctgctcgcttactcgcctgccaggaggccgggctctcagtttggggtgtttgtgcaaccttcatctgcactgggccctgtgcccctcctccccatccatggtccccagcagtgcctggttctgagcaaactcccagggaagaaaacggccctgtctccatggccaggttcttgtggtgtccagtgcgcgtctctcgagtgtattctgcgcgtgtgtgtggagggagggagggaggggagcatggtgtctcccgctccaccgccctttgttgagccccatcagctgcccccttttactttgcattgaacggcctgtccaaagatcctctctctagggcagcagagagctttttgcactttaaaaaaaaaaagaaagaaagaaaggtcggaatttcttttgggtcaatatttttaagtgtgtgaggagatgctcagtagcagcagcctatggcaagagcttataaatgattgatgcaaatttgcactctgctccccctctgtaaggatactgatagcacaacctcttccccccaccccgccccgccttttggtcgtccatccctgtccctttctggccctcttcctgtagcccagtctcaggctttcctcttcctgaagccctacagagttagggaatggagcccaggcaccaggggtctaaagtgtgagccactgagaagagagacgccaactgcacccttgccacttccaaagcaatagaggcagagtggtcccctctttgccacctaggccagttttgaccctggcattaactggccttagaagaaactggatcctggtagggggtggcattttgtttgtttcttccaatctgctgaatcttttgactgcaccttacaaacagcagtctgctcccatgaccctctgcccacttccattggtctccaggccccaataatctggggttgaaactttgaggaaatgccagtgacttattccagagtgcctcagttaggggaacttctctgtaaagaaccctgggtattgagcaaaaaccttattatcgttaatgacctataattggaagcttcctgcctttttctttggttgctcctgtggaaaatactgaaaagattactttgttttattttgttgtctttttataaaaggggaggtggagagaccccttcagagcagggattgtgccgggagagtgcctctgactttgggacatttcatccacagaaatttccaagccaatggtttcttttgggttttggtttttatgtttgttttttggggtttggaaaaacatgcatttttaccgtgcacgtaaattggtcagcagaaaagggagcccagaaaaggcagcagatggaccatgcccttgctgggttttccttttctttgggactgtgaggggaaatggtttttagaggtgagggttggtccatgtggaggaaagaagtgtctctgttgggggacagaggaacctggggagtccatcgcatgtcctacaatctgctcttagacacggccttgccaggagagcctgccctcagactgcaggaccagaacccctgcctccatctttccaagcaccggggcgaaaaaccacaaaggaaaggaagaaaatttatatatatataatataaaatcacttggtgattaaaaaaataactgctccataaataaaactcctaaagtcacttatgtttaaagggtttggttgtgttttttgtttttcggagaaatattgtaaatatatatttttttgttgctgatttagagtcaatctccaatgttgtgctaaaaagtttaaattaaatgtaagcattaaggggataagtcttatgctatctcagttgacacattgaggttattttgggccagagaaggaggaagctagttggactttgttttgttttccaaaagttctccactattggttttagagagagcaaggacatctttcctctgacacgtgggaatgggtgatatttgtgtaataaaatttttaaaagacaaaaaaagaaatagcctccaatgggaaatattttaatttaggttttgtttttgtttgggggtttttgtttttttaaaaaaataaaaaggctttaaaaacaaaaaataaac

SEQ ID NO: 34454 - DNA, 1222 bp, Homo sapiens
tctagttgacctctagttagatctagttgaccaggccccaataatctggggttgaaactttgaggaaatgccagtgacttattccagagtgcctcagttaggggaacttctctgtaaagaaccctgggtattgagcaaaaaccttattatcgttaatgacctataattggaagcttcctgcctttttctttggttgctcctgtggaaaatactgaaaagattactttgttttattttgttgtctttttataaaaggggaggtggagagaccccttcagagcagggattgtgccgggagagtgcctctgactttgggacatttcatccacagaaatttccaagccaatggtttcttttgggttttggtttttatgtttgttttttggggtttggaaaaacatgcatttttaccgtgcacgtaaattggtcagcagaaaagggagcccagaaaaggcagcagatggaccatgcccttgctgggttttccttttctttgggactgtgaggggaaatggtttttagaggtgagggttggtccatgtggaggaaagaagtgtctctgttgggggacagaggaacctggggagtccatcgcatgtcctacaatctgctcttagacacggccttgccaggagagcctgccctcagactgcaggaccagaacccctgcctccatctttccaagcaccggggcgaaaaaccacaaaggaaaggaagaaaatttatatatatataatataaaatcacttggtgattaaaaaaataactgctccataaataaaactcctaaagtcacttatgtttaaagggtttggttgtgttttttgtttttcggagaaatattgtaaatatatatttttttgttgctgatttagagtcaatctccaatgttgtgctaaaaagtttaaattaaatgtaagcattaaggggataagtcttatgctatctcagttgacacattgaggttattttgggccagagaaggaggaagctagttggactttgttttgttttccaaaagttctccactattggttttagagagagcaaggacatctttcctctgacacgtgggaatgggtgatatttgtgtaataaaatttttaaaagacaaaaaaagaaatagcctccaatgggaaatattttaatttaggttttgtttttgtttgggggtttttgtttttttaaaaaaataaaaaggctttaaaaacaaaaaataaac

SEQ ID NO: 34455 - DNA, 3470 bp, Homo sapiens
agcaactgtttgctcccttttcctggtcgctctgaccctctctggatactgggttgatccacggaaaaaccgaagacgacgtttgggatttaattattcctctcagctttggaatcttttacttctcacttggacaagaactcaagagcagaatctccgtgttgcaatctggttcctaaggaggaagaggaaggcagccctggagtggtttctttacagtaatttcaacagaagagtgagagatggaacccgaagaagaaaggattcgttacagccagagattgcgtggtaccatgcgacgacgctatgaagatgatggcatttcagatgatgaaattgaaggaaaaagaacttttgacttggaagagaaactgcacaccaacaaatataatgccaattttgttacttttatggaaggaaaagattttaatgtagagtatattcagcggggtggcttgagagatcctctgattttcaagaattctgatggactcggaataaaaatgccggatccagacttcactgtgaatgatgtcaaaatgtgtgtggggagtcgtcgcatggtggatgtcatggacgtgaacacacagaaaggcattgaaatgaccatggctcagtggacacgctactatgagaccccagaggaggagcgagagaaactctataatgtcatcagcctcgagtttagccacaccaggctggagaatatggtgcagaggccctccacggtggatttcattgactgggtagacaacatgtggccaaggcacttgaaggaaagccagactgaatcaacaaatgccatcttggagatgcagtaccctaaagtgcagaagtaagtgatgcgccctgcatcttcctccgtgtgctgtgggagaccaaagcaatagcaaggattggcttctcccttacgagctttgctctgtgtcttgaatgattaaaaagatgaattatttaaagatgagactttacagttccacaaggaagagtgtatgtgagcataccatagcacacaaccacacagttaaaggaaaaaaaacttacattttagtcaatacggtagaaaaaaaaaaaacctttttctgataatgtgatgacttgaaaatgcattgctttttctccttctggaacttaagattaagtggaagataaagggagtatataagaggagagtatggcattttggtggggcagatgtacttttttccatcagtacactaatgctgctgctttttttgggtcaggtactgtctaatgagtgttcgaggctgctatactgacttccatgtggactttggtggtacctctgtttggtatcacatccatcaagggggaaaggtcttctggctcatcccccctacagcccacaacctggagctgtacgagaattggctgctgtcagggaaacagggagacatctttctgggtgaccgggtatcagattgtcagcgcattgagctcaagcagggctataccttcgtcattccctcaggctggattcatgctgtgtatactcctacagacacattagtgtttgggggcaattttttgcatagcttcaacatccctatgcagttaaaaatatacaacattgaagatcggacacgggttccaaataagtttcgctatccattctactatgagatgtgttggtatgtgttggagcgctatgtgtactgcataaccaaccgttcccacctaaccaaggaatttcagaaagagtccctcagcatggatttggagttaaatgggttggagtctgggaatggggatgaggaagcagtggatcgagaaccccgacgcttgagcagcaggcgttctgtcctcactagccctgtagcgaatggagtcaacctggattatgatggactgggcaaaacctgccgaagtcttccaagtctgaagaaaactttggctggggactcatcttctgactgtagccggggctcccacaatggacaagtgtgggatccccagtgtgctccccgaaaggacaggcaagtgcatctgacccattttgagcttgaaggccttcgctgccttgtagataagttggagtctctgccactgcacaagaaatgtgtccccacagggatagaagatgaagatgctctcattgctgatgtaaagattttgctggaggagcttgccaacagcgatcccaagttagccctcactggagttcctatagtacagtggccaaaaagggataagcttaaattccccactcggccaaaggtgcgggttcctaccatccccattacgaagcctcacactatgaaaccagctccacggttaacacctgtgaggccagctgctgcctccccgattgtgtcaggagccagacggagacgagtgcgatgtcgaaaatgcaaagcctgtgtgcaaggagagtgtggtgtttgccactactgcagagacatgaagaagtttggggggcctggacgcatgaagcagtcctgtgtcctccgacagtgcttggcacccagactgcctcactcagtcacatgttccctctgtggagaggtggatcagaatgaagagacacaagactttgagaagaaactcatggaatgctgtatctgcaatgagattgttcatcctggctgcctccagatggacggagaggggttgcttaacgaagaattgccaaattgctgggaatgtccaaagtgctaccaggaggacagctcggagaaagcccagaagcggaaaatggaagagagtgacgaagaagctgtgcaagccaaagtcctgcggcccctgcggagctgcgatgagcctctcacgcccccgcctcattcacccacttccatgctgcagctcatccatgacccggtttccccccggggtatggtgactcggtcatcccctggggctggccccagcgaccaccacagtgccagccgcgatgagcgcttcaaacggcggcagttgctgcggctgcaggccacagagcgcaccatggtacgggaaaaggagaacaatcccagcggcaaaaaggagctgtctgaagttgagaaagccaagatccggggatcgtacctcactgtcacgctacagaggcccaccaaagagctccacgggacatccattgtgcccaagctgcaggccatcacggcctcctctgccaaccttcgccattccccccgtgtgctagtgcagcactgcccagcccgaaccccccagcgtggggatgaggaggggctggggggagaggaggaggaagaggaggaggaggaggaggaagatgacagtgcagaggaggggggtgcagccaggctgaatggccggggcagttgggctcaggatggagacgaaagctggatgcagcgggaggtctggatgtctgtcttccgctacctcagccgcagagaactttgtgaatgtatgcgagtgtgcaagacgtggtataaatggtctgcgacaagagactttgacacgggacacgaataacagggccgagctga

SEQ ID NO: 34456 - DNA, 1166 bp, Homo sapiens
  misc_feature (1146)..(1146): n is a, c, g, or t
  misc_feature (1149)..(1149): n is a, c, g, or t
agcaactgtttgctcccttttcctggtcgctctgaccctctctggatactgggttgatccacggaaaaaccgaagacgacgtttgggatttaattattcctctcagctttggaatcttttacttctcacttggacaagaactcaagagcagaatctccgtgttgcaatctggttcctaaggaggaagaggaaggcagccctggagtggtttctttacagtaatttcaacagaagagtgagagatggaacccgaagaagaaaggattcgttacagccagagattgcgtggtaccatgcgacgacgctatgaagatgatggcatttcagatgatgaaattgaaggaaaaagaacttttgacttggaagagaaactgcacaccaacaaatataatgccaattttgttacttttatggaaggaaaagattttaatgtagagtatattcagcggggtggcttgagagatcctctgattttcaagaattctgatggactcggaataaaaatgccggatccagacttcactgtgaatgatgtcaaaatgtgtgtggggagtcgtcgcatggtggatgtcatggacgtgaacacacagaaaggcattgaaatgaccatggctcagtggacacgctactatgagaccccagaggaggagcgagagaaactctataatgtcatcagcctcgagtttagccacaccaggctggagaatatggtgcagaggccctccacggtggatttcattgactgggtagacaacatgtggccaaggcacttgaaggaaagccagactgaatcaacaaatgccatcttggagatgcagtaccctaaagtgcagaagtactgtctaatgagtgttcgaggctgctatactgacttccatgtggactttggtggtacctctgtttggtatcacatccatcaagggggaaaggtcttctggctcatcccccctacagcccacaacctggagctgtacgagaattggctgctgtcagggaaacagggagacatctttctgggtgaccgggtatcagattgtcagcgcattgagctcaagcagggctataccttcgtcattccctcaggctggattcatgctgtgtatactcctacagacacattagtgtttgggggcaaatctacctggncgnatcctcggatcacctca

SEQ ID NO: 34457 - DNA, 649 bp, Homo sapiens
gttccaaataagtttcgctatccattctactatgagatgtgttggtatgtgttggagcgctatgtgtactgcataaccaaccgttcccacctaaccaaggaatttcagaaagagtccctcagcatgggtaagtattctgcctataggagctttgaagacaccgcttaggtctgagggtgaggcccgaaatactcagtaggctgtcactcaatatgttcttggttttttaattcatctacttggaagtaccaaattcatcactggaattgaataccagttacctacccagatgtgagttaatggccaaatgaaatactctggatctgatctttgtctgagttgctattacttagctcctcaagaaggatgatcaagccggacacgctggttcacgcctgtaatcctagcactttgggaggccaaggtgggcgaatggcttgagcccaggagttaagaccagcctgggaaacatggcaaaaccccatctctacagaaactacagaaaattgggtaggcatggtggctcgagtcccagctgctcaggaggctgaggtgggaggatcactggaacccaggaggttgaggctgcagtgagccgaagatcatgccactgcactctagcctgggcgacagagtgaaaccctgttgc

SEQ ID NO: 34458 - DNA, 224 bp, Homo sapiens
ggagttggagaccagcctgggccgactctgagggaatgaccccctctccaacgtgacctttcttctctctggtcccctgagagcaagggaggtccaccctgtcggttcagagggtttggaagaaaggaagcactgatgttgcttttctgggcctgttttgcagaagcggaaaatggaagagagtgacgaagaagctgtgcaagccaaagtcctgcggcccctgc

SEQ ID NO: 34459 - DNA, 686 bp, Homo sapiens
ggacccaaatctcccatcttcagtttaagggaaactgaaatgataaagatctgagtcagttctcttggattctatctttgtcctcttgtagcccagactgcctcactcagtcacatgttccctctgtggagaggtggatcagaatgaagagacacaagactttgagaagaaactcatggaatgctgtatctgcaatgagattgttcatcctggctgcctccaggtgaggagagctatgaggggttcctgaagtctcagctaatggagtgagtgacacaacagaatgggacacttgtgatgggagtgccagcatccctactgtaggccatcagctctgtggtcacataatgcagtggtctaacatcagcccttgattcatatatgtacaatgtgtcaggcactgcgttagaccctgaggatagaacagtacacaaaatagacccagttcctgtcctcatggagcttagaatctggactctggattgggtatgtagagttcccaggccataatggaactgcatggtgtgttttgggatgcctcaagcctttaggcatctctgatacatacttcagtgtacctctggatattagttcctaagggagagtgaggataataatatcagataacatttaatgagtgctgagtctgtatcagactcagtgcagagctaaatagctttaaaaaa

SEQ ID NO: 34460 - DNA, 396 bp, Homo sapiens
aaattatctttgaccccaacctttcccttggagcccaagtgtttcctccttctatttaaaggtggatttcattgactgggtagacaacatgtggccaaggcacttgaaggaaagccagactgaatcaacaaatgccatcttggagatgcagtaccctaaagtgcagaagtaagtgatgcgccctgcatcttcctccgtgtgctgtgggagaccaaagcaatagcaaggattggcttctcccttacgagctttgctctgtgtcttgaatgattaaaaagatgaattatttaaagatgagactttacagttccacaaggaagagtgtatgtgagcataccatagcacacaaccacacagttaaaggaaaaaaaacttacattttagtcaatacggtag

SEQ ID NO: 34461 - DNA, 523 bp, Homo sapiens
gaccctctttggtcctgtttttattgtgaatttatatctctaggctcaaagaattagcaagggtaaaattcatagaggacccagtggctcattgaaacttcattatattctgtggattctgagaatatcagctatcttgagagaaagaaaagatccataaggcaaggaaaatagcaactgagtttgaaagtagcactttgcacatgtagggaaatctatgaccacttgtaggtaggcatgaaaaagtgcatgatttcatcagtatgttcctttctttcctagcgtggtaccatgcgacgacgctatgaagatgatggcatttcagatgatgaaattgaaggaaaaagaacttttgacttggaagagaaactgcacaccaacaaatataatgccaattttgttacttttatggaaggaaaaggtcagtattgttttggttccagcttacagtcctttgatgtgggaagccatagactctgagcattgggggtttagcctttatccagctaaaatattgcctgtt

SEQ ID NO: 34462 - DNA, 213 bp, Homo sapiens
aaagctggatgcagcgggaggtctggatgtctgtcttccgctacctcagccgcagagaactttgtgaatgtatgcgagtgtgcaagacgtggtataaatggtgagcagggattcagggggtcaggaattaggggtatgggagtaggtggcaggttttccatatgagaacagcatgcaccttggcatctgaaagcctgtggggtcttatgagga

SEQ ID NO: 34463 - DNA, 6677 bp, Homo sapiens
tttaactcttcagagacagggtgatgataatttctgtttagcatttataagatgactcactattagtagtcctatccccatattatttaagctctaaatttcctgtggaaatttagacttggaatatagacttggaaaacccctcaagcgttgcttctcaatgtgctctccatattttctaagagatgcttcttactaagcatatattttattgactaacagcataactatatacacagaataacaaacaccatttatactgtattacttaggatcctttttatggtccttttatcgtttttaattataccacttatctttctaatattttcctatggtgacagattttaatgtagagtatattcagcggggtggcttgagagatcctctgattttcaagaattctgatggactcggaataaaaatgccggatccagacttcactgtgaatgatgtcaaaatgtgtgtggggagtcgtcgcatggtggatgtcatggacgtgaacacacagaaaggcattgaaatgaccatggctcagtggacacgctactatgagaccccagaggaggagcgagagaaactctataatgtcatcagcctcgagtttagccacaccaggctggagaatatggtgcagaggccctccacggtggatttcattgactgggtagacaacatgtggccaaggcacttgaaggaaagccagactgaatcaacaaatgccatcttggagatgcagtaccctaaagtgcagaagtaagtgatgcgccctgcatcttcctccgtgtgctgtgggagaccaaagcaatagcaaggattggcttctcccttacgagctttgctctgtgtcttgaatgattaaaaagatgaattatttaaagatgagactttacagttccacaaggaagagtgtatgtgagcataccatagcacacaaccacacagttaaaggaaaaaaaacttacattttagtcaatacggtagaaaaaaaaaaaacctttttctgataatgtgatgacttgaaaatgcattgctttttctccttctggaacttaagattaagtggaagataaagggagtatataagaggagagtatggcattttggtggggcagatgtacttttttccatcagtacactaatgctgctgctttttttgggtcaggtactgtctaatgagtgttcgaggctgctatactgacttccatgtggactttggtggtacctctgtttggtatcacatccatcaagggggaaaggtcttctggctcatcccccctacagcccacaacctggagctgtacgagaattggctgctgtcagggaaacagggagacatctttctgggtgaccgggtatcagattgtcagcgcattgagctcaagcagggctataccttcgtcattccctcaggctggattcatgctgtgtatactcctacagacacattagtgtttgggggcaattttttgcatagcttcaacatccctatgcagttaaaaatatacaacattgaagatcggacacgggttccaaataagtttcgctatccattctactatgagatgtgttggtatgtgttggagcgctatgtgtactgcataaccaaccgttcccacctaaccaaggaatttcagaaagagtccctcagcatggatttggagttaaatgggttggagtctgggaatggggatgaggaagcagtggatcgagaaccccgacgcttgagcagcaggcgttctgtcctcactagccctgtagcgaatggagtcaacctggattatgatggactgggcaaaacctgccgaagtcttccaagtctgaagaaaactttggctggggactcatcttctgactgtagccggggctcccacaatggacaagtgtgggatccccagtgtgctccccgaaaggacaggcaagtgcatctgacccattttgagcttgaaggccttcgctgccttgtagataagttggagtctctgccactgcacaagaaatgtgtccccacagggatagaagatgaagatgctctcattgctgatgtaaagattttgctggaggagcttgccaacagcgatcccaagttagccctcactggagttcctatagtacagtggccaaaaagggataagcttaaattccccactcggccaaaggtgcgggttcctaccatccccattacgaagcctcacactatgaaaccagctccacggttaacacctgtgaggccagctgctgcctccccgattgtgtcaggagccagacggagacgagtgcgatgtcgaaaatgcaaagcctgtgtgcaaggagagtgtggtgtttgccactactgcagagacatgaagaagtttggggggcctggacgcatgaagcagtcctgtgtcctccgacagtgcttggcacccagactgcctcactcagtcacatgttccctctgtggagaggtggatcagaatgaagagacacaagactttgagaagaaactcatggaatgctgtatctgcaatgagattgttcatcctggctgcctccagatggacggagaggggttgcttaacgaagaattgccaaattgctgggaatgtccaaagtgctaccaggaggacagctcggagaaagcccagaagcggaaaatggaagagagtgacgaagaagctgtgcaagccaaagtcctgcggcccctgcggagctgcgatgagcctctcacgcccccgcctcattcacccacttccatgctgcagctcatccatgacccggtttccccccggggtatggtgactcggtcatcccctggggctggccccagcgaccaccacagtgccagccgcgatgagcgcttcaaacggcggcagttgctgcggctgcaggccacagagcgcaccatggtacgggaaaaggagaacaatcccagcggcaaaaaggagctgtctgaagttgagaaagccaagatccggggatcgtacctcactgtcacgctacagaggcccaccaaagagctccacgggacatccattgtgcccaagctgcaggccatcacggcctcctctgccaaccttcgccattccccccgtgtgctagtgcagcactgcccagcccgaaccccccagcgtggggatgaggaggggctggggggagaggaggaggaagaggaggaggaggaggaggaagatgacagtgcagaggaggggggtgcagccaggctgaatggccggggcagttgggctcaggatggagacgaaagctggatgcagcgggaggtctggatgtctgtcttccgctacctcagccgcagagaactttgtgaatgtatgcgagtgtgcaagacgtggtataaatggtgctgcgacaagagactttggacaaaaattgacttgagtaggtgtaaggccattgtgccccaggccctcagtggcatcatcaagaggcagccagtcagccttgacctcagttggaccaacatctctaaaaagcaactgacatggctcgtcaataggctgccaggactgaaagacctcctcctagcaggctgctcctggtctgcagtctctgccctcagcacctccagctgcccccttctcaggacccttgatcttcggtgggcagtaggaatcaaggaccctcaaattcgggacttgcttactccaccggctgataaaccaggtcaggacaatcgcagcaagctccggaacatgaccgacttccggctggcaggccttgacatcacagatgccacgcttcgcctcataattcgccacatgcccctcctgtctcgactcgacctcagtcactgcagccaccttacagatcagtcctccaatctactcactgctgtcgggtcttccactcgctactctctcacagagctcaatatggcaggttgcaataaattgacagaccagaccctgatctacctacggcgcattgccaacgtcaccttgatcgaccttcgaggatgcaagcagatcactcgaaaagcctgcgagcacttcatctcagacttgtccatcaacagcctctactgcctgtctgacgagaagctgatacagaagatcagctaagacacacccagcccagattcaacaggaaaccgatcttcccctgactccccaccgaggagagcctctcctcgaccctgcacgggctctgaggccagcgtcacactccctctctgctctcctgtcccttgagcccttcctctacaggtggggcagagagggtggtggacaccaggcttatctgcctgctcctctccctcctaaggaaaagggagtagcagattgatctgaggggaaagcacaggctgtgctgtcgaggcgcctgctcgcttactcgcctgccaggaggccgggctctcagtttggggtgtttgtgcaaccttcatctgcactgggccctgtgcccctcctccccatccatggtccccagcagtgcctggttctgagcaaactcccagggaagaaaacggccctgtctccatggccaggttcttgtggtgtccagtgcgcgtctctcctccatcacactctcccggcttgcgcaggaggggccagcagccccaggagtcccagacccgtgccgatcacactggtgctgttgagatctcccaaacctcacgtccttaactgtgctctccctcctttcctctcccttgagcttggttctgcccagcactcgtgcttgttcacataattaggtttcccaccccagcctacccgacttacttgctagtctctatgaggtccttattgcacttattggggttgaagctcttcagaggagctggaactgtctaccccagggacacacccatttcgttgctacccaagtggattctgagacaggcaccatctccttgttccccctctctcttttgcctcccactgactgcccttttccatgtgtcttcattctgcctgaagaaggctttcccaggatgcacgtcctcagagggagcagcctatctcccccaagctggaggcggcagaggactgggccaagccccaacctgcctcccagccaggctcctccaggcctctggtttagcggagccccctgagcccaggcctgtgtctagccccagtggctcactgaactttcagggcagtcagggggtcctgcttagaagccagtcaccagccctctgcctgcagccatggaagggggtgtgcacgtgcctctgtgtgtgtggctgagtgtattctgcgcgtgtgtgtggagggagggagggaggggagcatggtgtctcccgctccaccgccctttgttgagccccatcagctgcccccttttactttgcattgaacggcctgtccaaagatcctctctctagggcagcagagagctttttgcactttaaaaaaaaaaagaaagaaagaaaggtcggaatttcttttgggtcaatatttttaagtgtgtgaggagatgctcagtagcagcagcctatggcaagagcttataaatgattgatgcaaatttgcactctgctccccctctgtaaggatactgatagcacaacctcttccccccaccccgccccgccttttggtcgtccatccctgtccctttctggccctcttcctgtagcccagtctcaggctttcctcttcctgaagccctacagagttagggaatggagcccaggcaccaggggtctaaagtgtgagccactgagaagagagacgccaactgcacccttgccacttccaaagcaatagaggcagagtggtcccctctttgccacctaggccagttttgaccctggcattaactggccttagaagaaactggatcctggtagggggtggcattttgtttgtttcttccaatctgctgaatcttttgactgcaccttacaaacagcagtctgctcccatgaccctctgcccacttccattggtctccaggccccaataatctggggttgaaactttgaggaaatgccagtgacttattccagagtgcctcagttaggggaacttctctgtaaagaaccctgggtattgagcaaaaaccttattatcgttaatgacctataattggaagcttcctgcctttttctttggttgctcctgtggaaaatactgaaaagattactttgttttattttgttgtctttttataaaaggggaggtggagagaccccttcagagcagggattgtgccgggagagtgcctctgactttgggacatttcatccacagaaatttccaagccaatggtttcttttgggttttggtttttatgtttgttttttggggtttggaaaaacatgcatttttaccgtgcacgtaaattggtcagcagaaaagggagcccagaaaaggcagcagatggaccatgcccttgctgggttttccttttctttgggactgtgaggggaaatggtttttagaggtgagggttggtccatgtggaggaaagaagtgtctctgttgggggacagaggaacctggggagtccatcgcatgtcctacaatctgctcttagacacggccttgccaggagagcctgccctcagactgcaggaccagaacccctgcctccatctttccaagcaccggggcgaaaaaccacaaaggaaaggaagaaaatttatatatatataatataaaatcacttggtgattaaaaaaataactgctccataaataaaactcctaaagtcacttatgttta

SEQ ID NO: 34464 - DNA, 6416 bp, Homo sapiens
agcagttgctctaagccacagtggttcaggtaaggaggagcgcagtctccgtgcgtcagaggagacctcgattgtctctgtgcattgagggccctggtgagtctactgggtttcgagggccctcgaaacccagttcaagaattctgatggactcggaataaaaatgccggatccagacttcactgtgaatgatgtcaaaatgtgtgtggggagtcgtcgcatggtggatgtcatggacgtgaacacacagaaaggcattgaaatgaccatggctcagtggacacgctactatgagaccccagaggaggagcgagagaaactctataatgtcatcagcctcgagtttagccacaccaggctggagaatatggtgcagaggccctccacggtggatttcattgactgggtagacaacatgtggccaaggcacttgaaggaaagccagactgaatcaacaaatgccatcttggagatgcagtaccctaaagtgcagaagtaagtgatgcgccctgcatcttcctccgtgtgctgtgggagaccaaagcaatagcaaggattggcttctcccttacgagctttgctctgtgtcttgaatgattaaaaagatgaattatttaaagatgagactttacagttccacaaggaagagtgtatgtgagcataccatagcacacaaccacacagttaaaggaaaaaaaacttacattttagtcaatacggtagaaaaaaaaaaaacctttttctgataatgtgatgacttgaaaatgcattgctttttctccttctggaacttaagattaagtggaagataaagggagtatataagaggagagtatggcattttggtggggcagatgtacttttttccatcagtacactaatgctgctgctttttttgggtcaggtactgtctaatgagtgttcgaggctgctatactgacttccatgtggactttggtggtacctctgtttggtatcacatccatcaagggggaaaggtcttctggctcatcccccctacagcccacaacctggagctgtacgagaattggctgctgtcagggaaacagggagacatctttctgggtgaccgggtatcagattgtcagcgcattgagctcaagcagggctataccttcgtcattccctcaggctggattcatgctgtgtatactcctacagacacattagtgtttgggggcaattttttgcatagcttcaacatccctatgcagttaaaaatatacaacattgaagatcggacacgggttccaaataagtttcgctatccattctactatgagatgtgttggtatgtgttggagcgctatgtgtactgcataaccaaccgttcccacctaaccaaggaatttcagaaagagtccctcagcatggatttggagttaaatgggttggagtctgggaatggggatgaggaagcagtggatcgagaaccccgacgcttgagcagcaggcgttctgtcctcactagccctgtagcgaatggagtcaacctggattatgatggactgggcaaaacctgccgaagtcttccaagtctgaagaaaactttggctggggactcatcttctgactgtagccggggctcccacaatggacaagtgtgggatccccagtgtgctccccgaaaggacaggcaagtgcatctgacccattttgagcttgaaggccttcgctgccttgtagataagttggagtctctgccactgcacaagaaatgtgtccccacagggatagaagatgaagatgctctcattgctgatgtaaagattttgctggaggagcttgccaacagcgatcccaagttagccctcactggagttcctatagtacagtggccaaaaagggataagcttaaattccccactcggccaaaggtgcgggttcctaccatccccattacgaagcctcacactatgaaaccagctccacggttaacacctgtgaggccagctgctgcctccccgattgtgtcaggagccagacggagacgagtgcgatgtcgaaaatgcaaagcctgtgtgcaaggagagtgtggtgtttgccactactgcagagacatgaagaagtttggggggcctggacgcatgaagcagtcctgtgtcctccgacagtgcttggcacccagactgcctcactcagtcacatgttccctctgtggagaggtggatcagaatgaagagacacaagactttgagaagaaactcatggaatgctgtatctgcaatgagattgttcatcctggctgcctccagatggacggagaggggttgcttaacgaagaattgccaaattgctgggaatgtccaaagtgctaccaggaggacagctcggagaaagcccagaagcggaaaatggaagagagtgacgaagaagctgtgcaagccaaagtcctgcggcccctgcggagctgcgatgagcctctcacgcccccgcctcattcacccacttccatgctgcagctcatccatgacccggtttccccccggggtatggtgactcggtcatcccctggggctggccccagcgaccaccacagtgccagccgcgatgagcgcttcaaacggcggcagttgctgcggctgcaggccacagagcgcaccatggtacgggaaaaggagaacaatcccagcggcaaaaaggagctgtctgaagttgagaaagccaagatccggggatcgtacctcactgtcacgctacagaggcccaccaaagagctccacgggacatccattgtgcccaagctgcaggccatcacggcctcctctgccaaccttcgccattccccccgtgtgctagtgcagcactgcccagcccgaaccccccagcgtggggatgaggaggggctggggggagaggaggaggaagaggaggaggaggaggaggaagatgacagtgcagaggaggggggtgcagccaggctgaatggccggggcagttgggctcaggatggagacgaaagctggatgcagcgggaggtctggatgtctgtcttccgctacctcagccgcagagaactttgtgaatgtatgcgagtgtgcaagacgtggtataaatggtgctgcgacaagagactttggacaaaaattgacttgagtaggtgtaaggccattgtgccccaggccctcagtggcatcatcaagaggcagccagtcagccttgacctcagttggaccaacatctctaaaaagcaactgacatggctcgtcaataggctgccaggactgaaagacctcctcctagcaggctgctcctggtctgcagtctctgccctcagcacctccagctgcccccttctcaggacccttgatcttcggtgggcagtaggaatcaaggaccctcaaattcgggacttgcttactccaccggctgataaaccaggtcaggacaatcgcagcaagctccggaacatgaccgacttccggctggcaggccttgacatcacagatgccacgcttcgcctcataattcgccacatgcccctcctgtctcgactcgacctcagtcactgcagccaccttacagatcagtcctccaatctactcactgctgtcgggtcttccactcgctactctctcacagagctcaatatggcaggttgcaataaattgacagaccagaccctgatctacctacggcgcattgccaacgtcaccttgatcgaccttcgaggatgcaagcagatcactcgaaaagcctgcgagcacttcatctcagacttgtccatcaacagcctctactgcctgtctgacgagaagctgatacagaagatcagctaagacacacccagcccagattcaacaggaaaccgatcttcccctgactccccaccgaggagagcctctcctcgaccctgcacgggctctgaggccagcgtcacactccctctctgctctcctgtcccttgagcccttcctctacaggtggggcagagagggtggtggacaccaggcttatctgcctgctcctctccctcctaaggaaaagggagtagcagattgatctgaggggaaagcacaggctgtgctgtcgaggcgcctgctcgcttactcgcctgccaggaggccgggctctcagtttggggtgtttgtgcaaccttcatctgcactgggccctgtgcccctcctccccatccatggtccccagcagtgcctggttctgagcaaactcccagggaagaaaacggccctgtctccatggccaggttcttgtggtgtccagtgcgcgtctctcctccatcacactctcccggcttgcgcaggaggggccagcagccccaggagtcccagacccgtgccgatcacactggtgctgttgagatctcccaaacctcacgtccttaactgtgctctccctcctttcctctcccttgagcttggttctgcccagcactcgtgcttgttcacataattaggtttcccaccccagcctacccgacttacttgctagtctctatgaggtccttattgcacttattggggttgaagctcttcagaggagctggaactgtctaccccagggacacacccatttcgttgctacccaagtggattctgagacaggcaccatctccttgttccccctctctcttttgcctcccactgactgcccttttccatgtgtcttcattctgcctgaagaaggctttcccaggatgcacgtcctcagagggagcagcctatctcccccaagctggaggcggcagaggactgggccaagccccaacctgcctcccagccaggctcctccaggcctctggtttagcggagccccctgagcccaggcctgtgtctagccccagtggctcactgaactttcagggcagtcagggggtcctgcttagaagccagtcaccagccctctgcctgcagccatggaagggggtgtgcacgtgcctctgtgtgtgtggctgagtgtattctgcgcgtgtgtgtggagggagggagggaggggagcatggtgtctcccgctccaccgccctttgttgagccccatcagctgcccccttttactttgcattgaacggcctgtccaaagatcctctctctagggcagcagagagctttttgcactttaaaaaaaaaaagaaagaaagaaaggtcggaatttcttttgggtcaatatttttaagtgtgtgaggagatgctcagtagcagcagcctatggcaagagcttataaatgattgatgcaaatttgcactctgctccccctctgtaaggatactgatagcacaacctcttccccccaccccgccccgccttttggtcgtccatccctgtccctttctggccctcttcctgtagcccagtctcaggctttcctcttcctgaagccctacagagttagggaatggagcccaggcaccaggggtctaaagtgtgagccactgagaagagagacgccaactgcacccttgccacttccaaagcaatagaggcagagtggtcccctctttgccacctaggccagttttgaccctggcattaactggccttagaagaaactggatcctggtagggggtggcattttgtttgtttcttccaatctgctgaatcttttgactgcaccttacaaacagcagtctgctcccatgaccctctgcccacttccattggtctccaggccccaataatctggggttgaaactttgaggaaatgccagtgacttattccagagtgcctcagttaggggaacttctctgtaaagaaccctgggtattgagcaaaaaccttattatcgttaatgacctataattggaagcttcctgcctttttctttggttgctcctgtggaaaatactgaaaagattactttgttttattttgttgtctttttataaaaggggaggtggagagaccccttcagagcagggattgtgccgggagagtgcctctgactttgggacatttcatccacagaaatttccaagccaatggtttcttttgggttttggtttttatgtttgttttttggggtttggaaaaacatgcatttttaccgtgcacgtaaattggtcagcagaaaagggagcccagaaaaggcagcagatggaccatgcccttgctgggttttccttttctttgggactgtgaggggaaatggtttttagaggtgagggttggtccatgtggaggaaagaagtgtctctgttgggggacagaggaacctggggagtccatcgcatgtcctacaatctgctcttagacacggccttgccaggagagcctgccctcagactgcaggaccagaacccctgcctccatctttccaagcaccggggcgaaaaaccacaaaggaaaggaagaaaatttatatatatataatataaaatcacttggtgattaaaaaaataactgctccataaataaaactcctaaagtcacttatgttta

SEQ ID NO: 34465 - DNA, 6662 bp, Homo sapiens
taaaggcagcaaatagtgaccaaacgaatgtttttaggcaaatacattggtgaaggcctccttcagtcaaaagttttgctcttgttgcccaggctggaatgcaatggcacgatcttggctcactgcaacctccacctcccaggttcaagcgattctcctgcgtcagcctcctgagtagctgggattacagcgtggtaccatgcgacgacgctatgaagatgatggcatttcagatgatgaaattgaaggaaaaagaacttttgacttggaagagaaactgcacaccaacaaatataatgccaattttgttacttttatggaaggaaaagattttaatgtagagtatattcagcggggtggcttgagagatcctctgattttcaagaattctgatggactcggaataaaaatgccggatccagacttcactgtgaatgatgtcaaaatgtgtgtggggagtcgtcgcatggtggatgtcatggacgtgaacacacagaaaggcattgaaatgaccatggctcagtggacacgctactatgagaccccagaggaggagcgagagaaactctataatgtcatcagcctcgagtttagccacaccaggctggagaatatggtgcagaggccctccacggtggatttcattgactgggtagacaacatgtggccaaggcacttgaaggaaagccagactgaatcaacaaatgccatcttggagatgcagtaccctaaagtgcagaagtaagtgatgcgccctgcatcttcctccgtgtgctgtgggagaccaaagcaatagcaaggattggcttctcccttacgagctttgctctgtgtcttgaatgattaaaaagatgaattatttaaagatgagactttacagttccacaaggaagagtgtatgtgagcataccatagcacacaaccacacagttaaaggaaaaaaaacttacattttagtcaatacggtagaaaaaaaaaaaacctttttctgataatgtgatgacttgaaaatgcattgctttttctccttctggaacttaagattaagtggaagataaagggagtatataagaggagagtatggcattttggtggggcagatgtacttttttccatcagtacactaatgctgctgctttttttgggtcaggtactgtctaatgagtgttcgaggctgctatactgacttccatgtggactttggtggtacctctgtttggtatcacatccatcaagggggaaaggtcttctggctcatcccccctacagcccacaacctggagctgtacgagaattggctgctgtcagggaaacagggagacatctttctgggtgaccgggtatcagattgtcagcgcattgagctcaagcagggctataccttcgtcattccctcaggctggattcatgctgtgtatactcctacagacacattagtgtttgggggcaattttttgcatagcttcaacatccctatgcagttaaaaatatacaacattgaagatcggacacgggttccaaataagtttcgctatccattctactatgagatgtgttggtatgtgttggagcgctatgtgtactgcataaccaaccgttcccacctaaccaaggaatttcagaaagagtccctcagcatggatttggagttaaatgggttggagtctgggaatggggatgaggaagcagtggatcgagaaccccgacgcttgagcagcaggcgttctgtcctcactagccctgtagcgaatggagtcaacctggattatgatggactgggcaaaacctgccgaagtcttccaagtctgaagaaaactttggctggggactcatcttctgactgtagccggggctcccacaatggacaagtgtgggatccccagtgtgctccccgaaaggacaggcaagtgcatctgacccattttgagcttgaaggccttcgctgccttgtagataagttggagtctctgccactgcacaagaaatgtgtccccacagggatagaagatgaagatgctctcattgctgatgtaaagattttgctggaggagcttgccaacagcgatcccaagttagccctcactggagttcctatagtacagtggccaaaaagggataagcttaaattccccactcggccaaaggtgcgggttcctaccatccccattacgaagcctcacactatgaaaccagctccacggttaacacctgtgaggccagctgctgcctccccgattgtgtcaggagccagacggagacgagtgcgatgtcgaaaatgcaaagcctgtgtgcaaggagagtgtggtgtttgccactactgcagagacatgaagaagtttggggggcctggacgcatgaagcagtcctgtgtcctccgacagtgcttggcacccagactgcctcactcagtcacatgttccctctgtggagaggtggatcagaatgaagagacacaagactttgagaagaaactcatggaatgctgtatctgcaatgagattgttcatcctggctgcctccagatggacggagaggggttgcttaacgaagaattgccaaattgctgggaatgtccaaagtgctaccaggaggacagctcggagaaagcccagaagcggaaaatggaagagagtgacgaagaagctgtgcaagccaaagtcctgcggcccctgcggagctgcgatgagcctctcacgcccccgcctcattcacccacttccatgctgcagctcatccatgacccggtttccccccggggtatggtgactcggtcatcccctggggctggccccagcgaccaccacagtgccagccgcgatgagcgcttcaaacggcggcagttgctgcggctgcaggccacagagcgcaccatggtacgggaaaaggagaacaatcccagcggcaaaaaggagctgtctgaagttgagaaagccaagatccggggatcgtacctcactgtcacgctacagaggcccaccaaagagctccacgggacatccattgtgcccaagctgcaggccatcacggcctcctctgccaaccttcgccattccccccgtgtgctagtgcagcactgcccagcccgaaccccccagcgtggggatgaggaggggctggggggagaggaggaggaagaggaggaggaggaggaggaagatgacagtgcagaggaggggggtgcagccaggctgaatggccggggcagttgggctcaggatggagacgaaagctggatgcagcgggaggtctggatgtctgtcttccgctacctcagccgcagagaactttgtgaatgtatgcgagtgtgcaagacgtggtataaatggtgctgcgacaagagactttggacaaaaattgacttgagtaggtgtaaggccattgtgccccaggccctcagtggcatcatcaagaggcagccagtcagccttgacctcagttggaccaacatctctaaaaagcaactgacatggctcgtcaataggctgccaggactgaaagacctcctcctagcaggctgctcctggtctgcagtctctgccctcagcacctccagctgcccccttctcaggacccttgatcttcggtgggcagtaggaatcaaggaccctcaaattcgggacttgcttactccaccggctgataaaccaggtcaggacaatcgcagcaagctccggaacatgaccgacttccggctggcaggccttgacatcacagatgccacgcttcgcctcataattcgccacatgcccctcctgtctcgactcgacctcagtcactgcagccaccttacagatcagtcctccaatctactcactgctgtcgggtcttccactcgctactctctcacagagctcaatatggcaggttgcaataaattgacagaccagaccctgatctacctacggcgcattgccaacgtcaccttgatcgaccttcgaggatgcaagcagatcactcgaaaagcctgcgagcacttcatctcagacttgtccatcaacagcctctactgcctgtctgacgagaagctgatacagaagatcagctaagacacacccagcccagattcaacaggaaaccgatcttcccctgactccccaccgaggagagcctctcctcgaccctgcacgggctctgaggccagcgtcacactccctctctgctctcctgtcccttgagcccttcctctacaggtggggcagagagggtggtggacaccaggcttatctgcctgctcctctccctcctaaggaaaagggagtagcagattgatctgaggggaaagcacaggctgtgctgtcgaggcgcctgctcgcttactcgcctgccaggaggccgggctctcagtttggggtgtttgtgcaaccttcatctgcactgggccctgtgcccctcctccccatccatggtccccagcagtgcctggttctgagcaaactcccagggaagaaaacggccctgtctccatggccaggttcttgtggtgtccagtgcgcgtctctcctccatcacactctcccggcttgcgcaggaggggccagcagccccaggagtcccagacccgtgccgatcacactggtgctgttgagatctcccaaacctcacgtccttaactgtgctctccctcctttcctctcccttgagcttggttctgcccagcactcgtgcttgttcacataattaggtttcccaccccagcctacccgacttacttgctagtctctatgaggtccttattgcacttattggggttgaagctcttcagaggagctggaactgtctaccccagggacacacccatttcgttgctacccaagtggattctgagacaggcaccatctccttgttccccctctctcttttgcctcccactgactgcccttttccatgtgtcttcattctgcctgaagaaggctttcccaggatgcacgtcctcagagggagcagcctatctcccccaagctggaggcggcagaggactgggccaagccccaacctgcctcccagccaggctcctccaggcctctggtttagcggagccccctgagcccaggcctgtgtctagccccagtggctcactgaactttcagggcagtcagggggtcctgcttagaagccagtcaccagccctctgcctgcagccatggaagggggtgtgcacgtgcctctgtgtgtgtggctgagtgtattctgcgcgtgtgtgtggagggagggagggaggggagcatggtgtctcccgctccaccgccctttgttgagccccatcagctgcccccttttactttgcattgaacggcctgtccaaagatcctctctctagggcagcagagagctttttgcactttaaaaaaaaaaagaaagaaagaaaggtcggaatttcttttgggtcaatatttttaagtgtgtgaggagatgctcagtagcagcagcctatggcaagagcttataaatgattgatgcaaatttgcactctgctccccctctgtaaggatactgatagcacaacctcttccccccaccccgccccgccttttggtcgtccatccctgtccctttctggccctcttcctgtagcccagtctcaggctttcctcttcctgaagccctacagagttagggaatggagcccaggcaccaggggtctaaagtgtgagccactgagaagagagacgccaactgcacccttgccacttccaaagcaatagaggcagagtggtcccctctttgccacctaggccagttttgaccctggcattaactggccttagaagaaactggatcctggtagggggtggcattttgtttgtttcttccaatctgctgaatcttttgactgcaccttacaaacagcagtctgctcccatgaccctctgcccacttccattggtctccaggccccaataatctggggttgaaactttgaggaaatgccagtgacttattccagagtgcctcagttaggggaacttctctgtaaagaaccctgggtattgagcaaaaaccttattatcgttaatgacctataattggaagcttcctgcctttttctttggttgctcctgtggaaaatactgaaaagattactttgttttattttgttgtctttttataaaaggggaggtggagagaccccttcagagcagggattgtgccgggagagtgcctctgactttgggacatttcatccacagaaatttccaagccaatggtttcttttgggttttggtttttatgtttgttttttggggtttggaaaaacatgcatttttaccgtgcacgtaaattggtcagcagaaaagggagcccagaaaaggcagcagatggaccatgcccttgctgggttttccttttctttgggactgtgaggggaaatggtttttagaggtgagggttggtccatgtggaggaaagaagtgtctctgttgggggacagaggaacctggggagtccatcgcatgtcctacaatctgctcttagacacggccttgccaggagagcctgccctcagactgcaggaccagaacccctgcctccatctttccaagcaccggggcgaaaaaccacaaaggaaaggaagaaaatttatatatatataatataaaatcacttggtgattaaaaaaataactgctccataaataaaactcctaaagtcacttatgttta

SEQ ID NO: 34466 - DNA, 7282 bp, Homo sapiens
agcaactgtttgctcccttttcctggtcgctctgaccctctctggatactgggttgatccacggaaaaaccgaagacgacgtttgggatttaattattcctctcagctttggaatcttttacttctcacttggacaagaactcaagagcagaatctccgtgttgcaatctggttcctaaggaggaagaggaaggcagccctggagtggtttctttacagtaatttcaacagaagagtgagagatggaacccgaagaagaaaggattcgttacagccagagattgcgtggtaccatgcgacgacgctatgaagatgatggcatttcagatgatgaaattgaaggaaaaagaacttttgacttggaagagaaactgcacaccaacaaatataatgccaattttgttacttttatggaaggaaaagattttaatgtagagtatattcagcggggtggcttgagagatcctctgattttcaagaattctgatggactcggaataaaaatgccggatccagacttcactgtgaatgatgtcaaaatgtgtgtggggagtcgtcgcatggtggatgtcatggacgtgaacacacagaaaggcattgaaatgaccatggctcagtggacacgctactatgagaccccagaggaggagcgagagaaactctataatgtcatcagcctcgagtttagccacaccaggctggagaatatggtgcagaggccctccacggtggatttcattgactgggtagacaacatgtggccaaggcacttgaaggaaagccagactgaatcaacaaatgccatcttggagatgcagtaccctaaagtgcagaagtaagtgatgcgccctgcatcttcctccgtgtgctgtgggagaccaaagcaatagcaaggattggcttctcccttacgagctttgctctgtgtcttgaatgattaaaaagatgaattatttaaagatgagactttacagttccacaaggaagagtgtatgtgagcataccatagcacacaaccacacagttaaaggaaaaaaaacttacattttagtcaatacggtagaaaaaaaaaaaacctttttctgataatgtgatgacttgaaaatgcattgctttttctccttctggaacttaagattaagtggaagataaagggagtatataagaggagagtatggcattttggtggggcagatgtacttttttccatcagtacactaatgctgctgctttttttgggtcaggtactgtctaatgagtgttcgaggctgctatactgacttccatgtggactttggtggtacctctgtttggtatcacatccatcaagggggaaaggtcttctggctcatcccccctacagcccacaacctggagctgtacgagaattggctgctgtcagggaaacagggagacatctttctgggtgaccgggtatcagattgtcagcgcattgagctcaagcagggctataccttcgtcattccctcaggctggattcatgctgtgtatactcctacagacacattagtgtttgggggcaattttttgcatagcttcaacatccctatgcagttaaaaatatacaacattgaagatcggacacgggttccaaataagtttcgctatccattctactatgagatgtgttggtatgtgttggagcgctatgtgtactgcataaccaaccgttcccacctaaccaaggaatttcagaaagagtccctcagcatggatttggagttaaatgggttggagtctgggaatggggatgaggaagcagtggatcgagaaccccgacgcttgagcagcaggcgttctgtcctcactagccctgtagcgaatggagtcaacctggattatgatggactgggcaaaacctgccgaagtcttccaagtctgaagaaaactttggctggggactcatcttctgactgtagccggggctcccacaatggacaagtgtgggatccccagtgtgctccccgaaaggacaggcaagtgcatctgacccattttgagcttgaaggccttcgctgccttgtagataagttggagtctctgccactgcacaagaaatgtgtccccacagggatagaagatgaagatgctctcattgctgatgtaaagattttgctggaggagcttgccaacagcgatcccaagttagccctcactggagttcctatagtacagtggccaaaaagggataagcttaaattccccactcggccaaaggtgcgggttcctaccatccccattacgaagcctcacactatgaaaccagctccacggttaacacctgtgaggccagctgctgcctccccgattgtgtcaggagccagacggagacgagtgcgatgtcgaaaatgcaaagcctgtgtgcaaggagagtgtggtgtttgccactactgcagagacatgaagaagtttggggggcctggacgcatgaagcagtcctgtgtcctccgacagtgcttggcagtgagtgatctgctgggtaaagaattttggggaggggtggcagtgccaaaggaactgaaatacatatagtgtagagttaaagagacttcagagttggaaagaaaaggtttatactctctttttggctttattttgtaccttttttccccaggtttagatagaaggtatctagtactaaaaatccgatttaatctttaggctttacctaattttcaaacaagagattagcatttgaagggcaaatcattgctttctttcccctcttcaggtagattagaaaggaccggggaggccaagtataggccaactgaaaataaactagtctctggtgcccaggtggttgagtcctcctcttccccagtcatttttcctacccaaaacctccgttctctccaccctgcctccatgcttccaggtgtttagtagagaattataggacccaaatctcccatcttcagtttaagggaaactgaaatgataaagatctgagtcagttctcttggattctatctttgtcctcttgtagcccagactgcctcactcagtcacatgttccctctgtggagaggtggatcagaatgaagagacacaagactttgagaagaaactcatggaatgctgtatctgcaatgagattgttcatcctggctgcctccagatggacggagaggggttgcttaacgaagaattgccaaattgctgggaatgtccaaagtgctaccaggaggacagctcggagaaagcccagaagcggaaaatggaagagagtgacgaagaagctgtgcaagccaaagtcctgcggcccctgcggagctgcgatgagcctctcacgcccccgcctcattcacccacttccatgctgcagctcatccatgacccggtttccccccggggtatggtgactcggtcatcccctggggctggccccagcgaccaccacagtgccagccgcgatgagcgcttcaaacggcggcagttgctgcggctgcaggccacagagcgcaccatggtacgggaaaaggagaacaatcccagcggcaaaaaggagctgtctgaagttgagaaagccaagatccggggatcgtacctcactgtcacgctacagaggcccaccaaagagctccacgggacatccattgtgcccaagctgcaggccatcacggcctcctctgccaaccttcgccattccccccgtgtgctagtgcagcactgcccagcccgaaccccccagcgtggggatgaggaggggctggggggagaggaggaggaagaggaggaggaggaggaggaagatgacagtgcagaggaggggggtgcagccaggctgaatggccggggcagttgggctcaggatggagacgaaagctggatgcagcgggaggtctggatgtctgtcttccgctacctcagccgcagagaactttgtgaatgtatgcgagtgtgcaagacgtggtataaatggtgctgcgacaagagactttggacaaaaattgacttgagtaggtgtaaggccattgtgccccaggccctcagtggcatcatcaagaggcagccagtcagccttgacctcagttggaccaacatctctaaaaagcaactgacatggctcgtcaataggctgccaggactgaaagacctcctcctagcaggctgctcctggtctgcagtctctgccctcagcacctccagctgcccccttctcaggacccttgatcttcggtgggcagtaggaatcaaggaccctcaaattcgggacttgcttactccaccggctgataaaccaggtcaggacaatcgcagcaagctccggaacatgaccgacttccggctggcaggccttgacatcacagatgccacgcttcgcctcataattcgccacatgcccctcctgtctcgactcgacctcagtcactgcagccaccttacagatcagtcctccaatctactcactgctgtcgggtcttccactcgctactctctcacagagctcaatatggcaggttgcaataaattgacagaccagaccctgatctacctacggcgcattgccaacgtcaccttgatcgaccttcgaggatgcaagcagatcactcgaaaagcctgcgagcacttcatctcagacttgtccatcaacagcctctactgcctgtctgacgagaagctgatacagaagatcagctaagacacacccagcccagattcaacaggaaaccgatcttcccctgactccccaccgaggagagcctctcctcgaccctgcacgggctctgaggccagcgtcacactccctctctgctctcctgtcccttgagcccttcctctacaggtggggcagagagggtggtggacaccaggcttatctgcctgctcctctccctcctaaggaaaagggagtagcagattgatctgaggggaaagcacaggctgtgctgtcgaggcgcctgctcgcttactcgcctgccaggaggccgggctctcagtttggggtgtttgtgcaaccttcatctgcactgggccctgtgcccctcctccccatccatggtccccagcagtgcctggttctgagcaaactcccagggaagaaaacggccctgtctccatggccaggttcttgtggtgtccagtgcgcgtctctcctccatcacactctcccggcttgcgcaggaggggccagcagccccaggagtcccagacccgtgccgatcacactggtgctgttgagatctcccaaacctcacgtccttaactgtgctctccctcctttcctctcccttgagcttggttctgcccagcactcgtgcttgttcacataattaggtttcccaccccagcctacccgacttacttgctagtctctatgaggtccttattgcacttattggggttgaagctcttcagaggagctggaactgtctaccccagggacacacccatttcgttgctacccaagtggattctgagacaggcaccatctccttgttccccctctctcttttgcctcccactgactgcccttttccatgtgtcttcattctgcctgaagaaggctttcccaggatgcacgtcctcagagggagcagcctatctcccccaagctggaggcggcagaggactgggccaagccccaacctgcctcccagccaggctcctccaggcctctggtttagcggagccccctgagcccaggcctgtgtctagccccagtggctcactgaactttcagggcagtcagggggtcctgcttagaagccagtcaccagccctctgcctgcagccatggaagggggtgtgcacgtgcctctgtgtgtgtggctgagtgtattctgcgcgtgtgtgtggagggagggagggaggggagcatggtgtctcccgctccaccgccctttgttgagccccatcagctgcccccttttactttgcattgaacggcctgtccaaagatcctctctctagggcagcagagagctttttgcactttaaaaaaaaaaagaaagaaagaaaggtcggaatttcttttgggtcaatatttttaagtgtgtgaggagatgctcagtagcagcagcctatggcaagagcttataaatgattgatgcaaatttgcactctgctccccctctgtaaggatactgatagcacaacctcttccccccaccccgccccgccttttggtcgtccatccctgtccctttctggccctcttcctgtagcccagtctcaggctttcctcttcctgaagccctacagagttagggaatggagcccaggcaccaggggtctaaagtgtgagccactgagaagagagacgccaactgcacccttgccacttccaaagcaatagaggcagagtggtcccctctttgccacctaggccagttttgaccctggcattaactggccttagaagaaactggatcctggtagggggtggcattttgtttgtttcttccaatctgctgaatcttttgactgcaccttacaaacagcagtctgctcccatgaccctctgcccacttccattggtctccaggccccaataatctggggttgaaactttgaggaaatgccagtgacttattccagagtgcctcagttaggggaacttctctgtaaagaaccctgggtattgagcaaaaaccttattatcgttaatgacctataattggaagcttcctgcctttttctttggttgctcctgtggaaaatactgaaaagattactttgttttattttgttgtctttttataaaaggggaggtggagagaccccttcagagcagggattgtgccgggagagtgcctctgactttgggacatttcatccacagaaatttccaagccaatggtttcttttgggttttggtttttatgtttgttttttggggtttggaaaaacatgcatttttaccgtgcacgtaaattggtcagcagaaaagggagcccagaaaaggcagcagatggaccatgcccttgctgggttttccttttctttgggactgtgaggggaaatggtttttagaggtgagggttggtccatgtggaggaaagaagtgtctctgttgggggacagaggaacctggggagtccatcgcatgtcctacaatctgctcttagacacggccttgccaggagagcctgccctcagactgcaggaccagaacccctgcctccatctttccaagcaccggggcgaaaaaccacaaaggaaaggaagaaaatttatatatatataatataaaatcacttggtgattaaaaaaataactgctccataaataaaactcctaaagtcacttatgttta

SEQ ID NO: 34467 - DNA, 7198 bp, Homo sapiens
agcaactgtttgctcccttttcctggtcgctctgaccctctctggatactgggttgatccacggaaaaaccgaagacgacgtttgggatttaattattcctctcagctttggaatcttttacttctcacttggacaagaactcaagagcagaatctccgtgttgcaatctggttcctaaggaggaagaggaaggcagccctggagtggtttctttacagtaatttcaacagaagagtgagagatggaacccgaagaagaaaggattcgttacagccagagattgcgtggtaccatgcgacgacgctatgaagatgatggcatttcagatgatgaaattgaaggaaaaagaacttttgacttggaagagaaactgcacaccaacaaatataatgccaattttgttacttttatggaaggaaaagattttaatgtagagtatattcagcggggtggcttgagagatcctctgattttcaagaattctgatggactcggaataaaaatgccggatccagacttcactgtgaatgatgtcaaaatgtgtgtggggagtcgtcgcatggtggatgtcatggacgtgaacacacagaaaggcattgaaatgaccatggctcagtggacacgctactatgagaccccagaggaggagcgagagaaactctataatgtcatcagcctcgagtttagccacaccaggctggagaatatggtgcagaggccctccacggtggatttcattgactgggtagacaacatgtggccaaggcacttgaaggaaagccagactgaatcaacaaatgccatcttggagatgcagtaccctaaagtgcagaagtaagtgatgcgccctgcatcttcctccgtgtgctgtgggagaccaaagcaatagcaaggattggcttctcccttacgagctttgctctgtgtcttgaatgattaaaaagatgaattatttaaagatgagactttacagttccacaaggaagagtgtatgtgagcataccatagcacacaaccacacagttaaaggaaaaaaaacttacattttagtcaatacggtagaaaaaaaaaaaacctttttctgataatgtgatgacttgaaaatgcattgctttttctccttctggaacttaagattaagtggaagataaagggagtatataagaggagagtatggcattttggtggggcagatgtacttttttccatcagtacactaatgctgctgctttttttgggtcaggtactgtctaatgagtgttcgaggctgctatactgacttccatgtggactttggtggtacctctgtttggtatcacatccatcaagggggaaaggtcttctggctcatcccccctacagcccacaacctggagctgtacgagaattggctgctgtcagggaaacagggagacatctttctgggtgaccgggtatcagattgtcagcgcattgagctcaagcagggctataccttcgtcattccctcaggctggattcatgctgtgtatactcctacagacacattagtgtttgggggcaattttttgcatagcttcaacatccctatgcagttaaaaatatacaacattgaagatcggacacgggttccaaataagtttcgctatccattctactatgagatgtgttggtatgtgttggagcgctatgtgtactgcataaccaaccgttcccacctaaccaaggaatttcagaaagagtccctcagcatggatttggagttaaatgggttggagtctgggaatggggatgaggaagcagtggatcgagaaccccgacgcttgagcagcaggcgttctgtcctcactagccctgtagcgaatggagtcaacctggattatgatggactgggcaaaacctgccgaagtcttccaagtctgaagaaaactttggctggggactcatcttctgactgtagccggggctcccacaatggacaagtgtgggatccccagtgtgctccccgaaaggacaggcaagtgcatctgacccattttgagcttgaaggccttcgctgccttgtagataagttggagtctctgccactgcacaagaaatgtgtccccacagggatagaagatgaagatgctctcattgctgatgtaaagcttaaattccccactcggccaaaggtgcgggttcctaccatccccattacgaagcctcacactatgaaaccagctccacggttaacacctgtgaggccagctgctgcctccccgattgtgtcaggagccagacggagacgagtgcgatgtcgaaaatgcaaagcctgtgtgcaaggagagtgtggtgtttgccactactgcagagacatgaagaagtttggggggcctggacgcatgaagcagtcctgtgtcctccgacagtgcttggcagtgagtgatctgctgggtaaagaattttggggaggggtggcagtgccaaaggaactgaaatacatatagtgtagagttaaagagacttcagagttggaaagaaaaggtttatactctctttttggctttattttgtaccttttttccccaggtttagatagaaggtatctagtactaaaaatccgatttaatctttaggctttacctaattttcaaacaagagattagcatttgaagggcaaatcattgctttctttcccctcttcaggtagattagaaaggaccggggaggccaagtataggccaactgaaaataaactagtctctggtgcccaggtggttgagtcctcctcttccccagtcatttttcctacccaaaacctccgttctctccaccctgcctccatgcttccaggtgtttagtagagaattataggacccaaatctcccatcttcagtttaagggaaactgaaatgataaagatctgagtcagttctcttggattctatctttgtcctcttgtagcccagactgcctcactcagtcacatgttccctctgtggagaggtggatcagaatgaagagacacaagactttgagaagaaactcatggaatgctgtatctgcaatgagattgttcatcctggctgcctccagatggacggagaggggttgcttaacgaagaattgccaaattgctgggaatgtccaaagtgctaccaggaggacagctcggagaaagcccagaagcggaaaatggaagagagtgacgaagaagctgtgcaagccaaagtcctgcggcccctgcggagctgcgatgagcctctcacgcccccgcctcattcacccacttccatgctgcagctcatccatgacccggtttccccccggggtatggtgactcggtcatcccctggggctggccccagcgaccaccacagtgccagccgcgatgagcgcttcaaacggcggcagttgctgcggctgcaggccacagagcgcaccatggtacgggaaaaggagaacaatcccagcggcaaaaaggagctgtctgaagttgagaaagccaagatccggggatcgtacctcactgtcacgctacagaggcccaccaaagagctccacgggacatccattgtgcccaagctgcaggccatcacggcctcctctgccaaccttcgccattccccccgtgtgctagtgcagcactgcccagcccgaaccccccagcgtggggatgaggaggggctggggggagaggaggaggaagaggaggaggaggaggaggaagatgacagtgcagaggaggggggtgcagccaggctgaatggccggggcagttgggctcaggatggagacgaaagctggatgcagcgggaggtctggatgtctgtcttccgctacctcagccgcagagaactttgtgaatgtatgcgagtgtgcaagacgtggtataaatggtgctgcgacaagagactttggacaaaaattgacttgagtaggtgtaaggccattgtgccccaggccctcagtggcatcatcaagaggcagccagtcagccttgacctcagttggaccaacatctctaaaaagcaactgacatggctcgtcaataggctgccaggactgaaagacctcctcctagcaggctgctcctggtctgcagtctctgccctcagcacctccagctgcccccttctcaggacccttgatcttcggtgggcagtaggaatcaaggaccctcaaattcgggacttgcttactccaccggctgataaaccaggtcaggacaatcgcagcaagctccggaacatgaccgacttccggctggcaggccttgacatcacagatgccacgcttcgcctcataattcgccacatgcccctcctgtctcgactcgacctcagtcactgcagccaccttacagatcagtcctccaatctactcactgctgtcgggtcttccactcgctactctctcacagagctcaatatggcaggttgcaataaattgacagaccagaccctgatctacctacggcgcattgccaacgtcaccttgatcgaccttcgaggatgcaagcagatcactcgaaaagcctgcgagcacttcatctcagacttgtccatcaacagcctctactgcctgtctgacgagaagctgatacagaagatcagctaagacacacccagcccagattcaacaggaaaccgatcttcccctgactccccaccgaggagagcctctcctcgaccctgcacgggctctgaggccagcgtcacactccctctctgctctcctgtcccttgagcccttcctctacaggtggggcagagagggtggtggacaccaggcttatctgcctgctcctctccctcctaaggaaaagggagtagcagattgatctgaggggaaagcacaggctgtgctgtcgaggcgcctgctcgcttactcgcctgccaggaggccgggctctcagtttggggtgtttgtgcaaccttcatctgcactgggccctgtgcccctcctccccatccatggtccccagcagtgcctggttctgagcaaactcccagggaagaaaacggccctgtctccatggccaggttcttgtggtgtccagtgcgcgtctctcctccatcacactctcccggcttgcgcaggaggggccagcagccccaggagtcccagacccgtgccgatcacactggtgctgttgagatctcccaaacctcacgtccttaactgtgctctccctcctttcctctcccttgagcttggttctgcccagcactcgtgcttgttcacataattaggtttcccaccccagcctacccgacttacttgctagtctctatgaggtccttattgcacttattggggttgaagctcttcagaggagctggaactgtctaccccagggacacacccatttcgttgctacccaagtggattctgagacaggcaccatctccttgttccccctctctcttttgcctcccactgactgcccttttccatgtgtcttcattctgcctgaagaaggctttcccaggatgcacgtcctcagagggagcagcctatctcccccaagctggaggcggcagaggactgggccaagccccaacctgcctcccagccaggctcctccaggcctctggtttagcggagccccctgagcccaggcctgtgtctagccccagtggctcactgaactttcagggcagtcagggggtcctgcttagaagccagtcaccagccctctgcctgcagccatggaagggggtgtgcacgtgcctctgtgtgtgtggctgagtgtattctgcgcgtgtgtgtggagggagggagggaggggagcatggtgtctcccgctccaccgccctttgttgagccccatcagctgcccccttttactttgcattgaacggcctgtccaaagatcctctctctagggcagcagagagctttttgcactttaaaaaaaaaaagaaagaaagaaaggtcggaatttcttttgggtcaatatttttaagtgtgtgaggagatgctcagtagcagcagcctatggcaagagcttataaatgattgatgcaaatttgcactctgctccccctctgtaaggatactgatagcacaacctcttccccccaccccgccccgccttttggtcgtccatccctgtccctttctggccctcttcctgtagcccagtctcaggctttcctcttcctgaagccctacagagttagggaatggagcccaggcaccaggggtctaaagtgtgagccactgagaagagagacgccaactgcacccttgccacttccaaagcaatagaggcagagtggtcccctctttgccacctaggccagttttgaccctggcattaactggccttagaagaaactggatcctggtagggggtggcattttgtttgtttcttccaatctgctgaatcttttgactgcaccttacaaacagcagtctgctcccatgaccctctgcccacttccattggtctccaggccccaataatctggggttgaaactttgaggaaatgccagtgacttattccagagtgcctcagttaggggaacttctctgtaaagaaccctgggtattgagcaaaaaccttattatcgttaatgacctataattggaagcttcctgcctttttctttggttgctcctgtggaaaatactgaaaagattactttgttttattttgttgtctttttataaaaggggaggtggagagaccccttcagagcagggattgtgccgggagagtgcctctgactttgggacatttcatccacagaaatttccaagccaatggtttcttttgggttttggtttttatgtttgttttttggggtttggaaaaacatgcatttttaccgtgcacgtaaattggtcagcagaaaagggagcccagaaaaggcagcagatggaccatgcccttgctgggttttccttttctttgggactgtgaggggaaatggtttttagaggtgagggttggtccatgtggaggaaagaagtgtctctgttgggggacagaggaacctggggagtccatcgcatgtcctacaatctgctcttagacacggccttgccaggagagcctgccctcagactgcaggaccagaacccctgcctccatctttccaagcaccggggcgaaaaaccacaaaggaaaggaagaaaatttatatatatataatataaaatcacttggtgattaaaaaaataactgctccataaataaaactcctaaagtcacttatgttta

SEQ ID NO: 34468 - DNA, 4891 bp, Homo sapiens
caggaagccgcggctgagctgaagggctcgagaaggagcccagagcgctgcacgctgctccctctgggtagtctgaagggtcagagctggactgccctgccctatgtgctctgggagattccagaatattcaagtaaatccggattttcccagaggcagaatatctaactccttcaggagaacttccagtacagaaaacaaaacaaagacgctggggaaacttcaccaagagcctcggcagctccagagcgacgggaaacgaaagattttgctggaggagcttgccaacagcgatcccaagttagccctcactggagttcctatagtacagtggccaaaaagggataagcttaaattccccactcggccaaaggtgcgggttcctaccatccccattacgaagcctcacactatgaaaccagctccacggttaacacctgtgaggccagctgctgcctccccgattgtgtcaggagccagacggagacgagtgcgatgtcgaaaatgcaaagcctgtgtgcaaggagagtgtggtgtttgccactactgcagagacatgaagaagtttggggggcctggacgcatgaagcagtcctgtgtcctccgacagtgcttggcacccagactgcctcactcagtcacatgttccctctgtggagaggtggatcagaatgaagagacacaagactttgagaagaaactcatggaatgctgtatctgcaatgagattgttcatcctggctgcctccagatggacggagaggggttgcttaacgaagaattgccaaattgctgggaatgtccaaagtgctaccaggaggacagctcggagaaagcccagaagcggaaaatggaagagagtgacgaagaagctgtgcaagccaaagtcctgcggcccctgcggagctgcgatgagcctctcacgcccccgcctcattcacccacttccatgctgcagctcatccatgacccggtttccccccggggtatggtgactcggtcatcccctggggctggccccagcgaccaccacagtgccagccgcgatgagcgcttcaaacggcggcagttgctgcggctgcaggccacagagcgcaccatggtacgggaaaaggagaacaatcccagcggcaaaaaggagctgtctgaagttgagaaagccaagatccggggatcgtacctcactgtcacgctacagaggcccaccaaagagctccacgggacatccattgtgcccaagctgcaggccatcacggcctcctctgccaaccttcgccattccccccgtgtgctagtgcagcactgcccagcccgaaccccccagcgtggggatgaggaggggctggggggagaggaggaggaagaggaggaggaggaggaggaagatgacagtgcagaggaggggggtgcagccaggctgaatggccggggcagttgggctcaggatggagacgaaagctggatgcagcgggaggtctggatgtctgtcttccgctacctcagccgcagagaactttgtgaatgtatgcgagtgtgcaagacgtggtataaatggtgctgcgacaagagactttggacaaaaattgacttgagtaggtgtaaggccattgtgccccaggccctcagtggcatcatcaagaggcagccagtcagccttgacctcagttggaccaacatctctaaaaagcaactgacatggctcgtcaataggctgccaggactgaaagacctcctcctagcaggctgctcctggtctgcagtctctgccctcagcacctccagctgcccccttctcaggacccttgatcttcggtgggcagtaggaatcaaggaccctcaaattcgggacttgcttactccaccggctgataaaccaggtcaggacaatcgcagcaagctccggaacatgaccgacttccggctggcaggccttgacatcacagatgccacgcttcgcctcataattcgccacatgcccctcctgtctcgactcgacctcagtcactgcagccaccttacagatcagtcctccaatctactcactgctgtcgggtcttccactcgctactctctcacagagctcaatatggcaggttgcaataaattgacagaccagaccctgatctacctacggcgcattgccaacgtcaccttgatcgaccttcgaggatgcaagcagatcactcgaaaagcctgcgagcacttcatctcagacttgtccatcaacagcctctactgcctgtctgacgagaagctgatacagaagatcagctaagacacacccagcccagattcaacaggaaaccgatcttcccctgactccccaccgaggagagcctctcctcgaccctgcacgggctctgaggccagcgtcacactccctctctgctctcctgtcccttgagcccttcctctacaggtggggcagagagggtggtggacaccaggcttatctgcctgctcctctccctcctaaggaaaagggagtagcagattgatctgaggggaaagcacaggctgtgctgtcgaggcgcctgctcgcttactcgcctgccaggaggccgggctctcagtttggggtgtttgtgcaaccttcatctgcactgggccctgtgcccctcctccccatccatggtccccagcagtgcctggttctgagcaaactcccagggaagaaaacggccctgtctccatggccaggttcttgtggtgtccagtgcgcgtctctcctccatcacactctcccggcttgcgcaggaggggccagcagccccaggagtcccagacccgtgccgatcacactggtgctgttgagatctcccaaacctcacgtccttaactgtgctctccctcctttcctctcccttgagcttggttctgcccagcactcgtgcttgttcacataattaggtttcccaccccagcctacccgacttacttgctagtctctatgaggtccttattgcacttattggggttgaagctcttcagaggagctggaactgtctaccccagggacacacccatttcgttgctacccaagtggattctgagacaggcaccatctccttgttccccctctctcttttgcctcccactgactgcccttttccatgtgtcttcattctgcctgaagaaggctttcccaggatgcacgtcctcagagggagcagcctatctcccccaagctggaggcggcagaggactgggccaagccccaacctgcctcccagccaggctcctccaggcctctggtttagcggagccccctgagcccaggcctgtgtctagccccagtggctcactgaactttcagggcagtcagggggtcctgcttagaagccagtcaccagccctctgcctgcagccatggaagggggtgtgcacgtgcctctgtgtgtgtggctgagtgtattctgcgcgtgtgtgtggagggagggagggaggggagcatggtgtctcccgctccaccgccctttgttgagccccatcagctgcccccttttactttgcattgaacggcctgtccaaagatcctctctctagggcagcagagagctttttgcactttaaaaaaaaaaagaaagaaagaaaggtcggaatttcttttgggtcaatatttttaagtgtgtgaggagatgctcagtagcagcagcctatggcaagagcttataaatgattgatgcaaatttgcactctgctccccctctgtaaggatactgatagcacaacctcttccccccaccccgccccgccttttggtcgtccatccctgtccctttctggccctcttcctgtagcccagtctcaggctttcctcttcctgaagccctacagagttagggaatggagcccaggcaccaggggtctaaagtgtgagccactgagaagagagacgccaactgcacccttgccacttccaaagcaatagaggcagagtggtcccctctttgccacctaggccagttttgaccctggcattaactggccttagaagaaactggatcctggtagggggtggcattttgtttgtttcttccaatctgctgaatcttttgactgcaccttacaaacagcagtctgctcccatgaccctctgcccacttccattggtctccaggccccaataatctggggttgaaactttgaggaaatgccagtgacttattccagagtgcctcagttaggggaacttctctgtaaagaaccctgggtattgagcaaaaaccttattatcgttaatgacctataattggaagcttcctgcctttttctttggttgctcctgtggaaaatactgaaaagattactttgttttattttgttgtctttttataaaaggggaggtggagagaccccttcagagcagggattgtgccgggagagtgcctctgactttgggacatttcatccacagaaatttccaagccaatggtttcttttgggttttggtttttatgtttgttttttggggtttggaaaaacatgcatttttaccgtgcacgtaaattggtcagcagaaaagggagcccagaaaaggcagcagatggaccatgcccttgctgggttttccttttctttgggactgtgaggggaaatggtttttagaggtgagggttggtccatgtggaggaaagaagtgtctctgttgggggacagaggaacctggggagtccatcgcatgtcctacaatctgctcttagacacggccttgccaggagagcctgccctcagactgcaggaccagaacccctgcctccatctttccaagcaccggggcgaaaaaccacaaaggaaaggaagaaaatttatatatatataatataaaatcacttggtgattaaaaaaataactgctccataaataaaactcctaaagtcacttatgttta

SEQ ID NO: 34469 - DNA, 6846 bp, Homo sapiens
gtactgaactgggaaagacagcagagcaacagctcaaaatctcgcgtcattctagaagtcaagccaggcacaagggctcatcgggcaaccccaggatggggagaggccaagacaggcgggtcactcgcgcctgcaaccccaggacggggggaggccgagcgggtcactttgaaccctcggaaatccaagagtctgagacctacctaggctacatggggagaccttgtgtctaccaaatatatgctattgaaacttctgaaactaggtttagaagtttcaagagcagaatctccgtgttgcaatctggttcctaaggaggaagaggaaggcagccctggagtggtttctttacagtaatttcaacagaagagtgagagatggaacccgaagaagaaaggattcgttacagccagagattgcgtggtaccatgcgacgacgctatgaagatgatggcatttcagatgatgaaattgaaggaaaaagaacttttgacttggaagagaaactgcacaccaacaaatataatgccaattttgttacttttatggaaggaaaagattttaatgtagagtatattcagcggggtggcttgagagatcctctgattttcaagaattctgatggactcggaataaaaatgccggatccagacttcactgtgaatgatgtcaaaatgtgtgtggggagtcgtcgcatggtggatgtcatggacgtgaacacacagaaaggcattgaaatgaccatggctcagtggacacgctactatgagaccccagaggaggagcgagagaaactctataatgtcatcagcctcgagtttagccacaccaggctggagaatatggtgcagaggccctccacggtggatttcattgactgggtagacaacatgtggccaaggcacttgaaggaaagccagactgaatcaacaaatgccatcttggagatgcagtaccctaaagtgcagaagtactgtctaatgagtgttcgaggctgctatactgacttccatgtggactttggtggtacctctgtttggtatcacatccatcaagggggaaaggtcttctggctcatcccccctacagcccacaacctggagctgtacgagaattggctgctgtcagggaaacagggagacatctttctgggtgaccgggtatcagattgtcagcgcattgagctcaagcagggctataccttcgtcattccctcaggctggattcatgctgtgtatactcctacagacacattagtgtttgggggcaattttttgcatagcttcaacatccctatgcagttaaaaatatacaacattgaagatcggacacgggttccaaataagtttcgctatccattctactatgagatgtgttggtatgtgttggagcgctatgtgtactgcataaccaaccgttcccacctaaccaaggaatttcagaaagagtccctcagcatggatttggagttaaatgggttggagtctgggaatggggatgaggaagcagtggatcgagaaccccgacgcttgagcagcaggcgttctgtcctcactagccctgtagcgaatggagtcaacctggattatgatggactgggcaaaacctgccgaagtcttccaagtctgaagaaaactttggctggggactcatcttctgactgtagccggggctcccacaatggacaagtgtgggatccccagtgtgctccccgaaaggacaggcaagtgcatctgacccattttgagcttgaaggccttcgctgccttgtagataagttggagtctctgccactgcacaagaaatgtgtccccacagggatagaagatgaagatgctctcattgctgatgtaaagattttgctggaggagcttgccaacagcgatcccaagttagccctcactggagttcctatagtacagtggccaaaaagggataagcttaaattccccactcggccaaaggtgcgggttcctaccatccccattacgaagcctcacactatgaaaccagctccacggttaacacctgtgaggccagctgctgcctccccgattgtgtcaggagccagacggagacgagtgcgatgtcgaaaatgcaaagcctgtgtgcaaggagagtgtggtgtttgccactactgcagagacatgaagaagtttggggggcctggacgcatgaagcagtcctgtgtcctccgacagtgcttggcacccagactgcctcactcagtcacatgttccctctgtggagaggtggatcagaatgaagagacacaagactttgagaagaaactcatggaatgctgtatctgcaatgagattgttcatcctggctgcctccagatggacggagaggggttgcttaacgaagaattgccaaattgctgggaatgtccaaagtgctaccaggaggacagctcggagaaagcccagaagcggaaaatggaagagagtgacgaagaagctgtgcaagccaaagtcctgcggcccctgcggagctgcgatgagcctctcacgcccccgcctcattcacccacttccatgctgcagctcatccatgacccggtttccccccggggtatggtgactcggtcatcccctggggctggccccagcgaccaccacagtgccagccgcgatgagcgcttcaaacggcggcagttgctgcggctgcaggccacagagcgcaccatggtacgggaaaaggagaacaatcccagcggcaaaaaggagctgtctgaagttgagaaagccaagatccggggatcgtacctcactgtcacgctacagaggcccaccaaagagctccacgggacatccattgtgcccaagctgcaggccatcacggcctcctctgccaaccttcgccattccccccgtgtgctagtgcagcactgcccagcccgaaccccccagcgtggggatgaggaggggctggggggagaggaggaggaagaggaggaggaggaggaggaagatgacagtgcagaggaggggggtgcagccaggctgaatggccggggcagttgggctcaggatggagacgaaagctggatgcagcgggaggtctggatgtctgtcttccgctacctcagccgcagagaactttgtgaatgtatgcgagtgtgcaagacgtggtataaatggtgctgcgacaagagactttggacaaaaattgacttgagtaggtgtaaggccattgtgccccaggccctcagtggcatcatcaagaggcagccagtcagccttgacctcagttggaccaacatctctaaaaagcaactgacatggctcgtcaataggctgccaggactgaaagacctcctcctagcaggctgctcctggtctgcagtctctgccctcagcacctccagctgcccccttctcaggacccttgatcttcggtgggcagtaggaatcaaggaccctcaaattcgggacttgcttactccaccggctgataaaccaggtcaggacaatcgcagcaagctccggaacatgaccgacttccggctggcaggccttgacatcacagatgccacgcttcgcctcataattcgccacatgcccctcctgtctcgactcgacctcagtcactgcagccaccttacagatcagtcctccaatctactcactgctgtcgggtcttccactcgctactctctcacagagctcaatatggcaggttgcaataaattgacagaccagaccctgatctacctacggcgcattgccaacgtcaccttgatcgaccttcgaggatgcaagcagatcactcgaaaagcctgcgagcacttcatctcagacttgtccatcaacagcctctactgcctgtctgacgagaagctgatacagaagatcagctaagacacacccagcccagattcaacaggaaaccgatcttcccctgactccccaccgaggagagcctctcctcgaccctgcacgggctctgaggccagcgtcacactccctctctgctctcctgtcccttgagcccttcctctacaggtggggcagagagggtggtggacaccaggcttatctgcctgctcctctccctcctaaggaaaagggagtagcagattgatctgaggggaaagcacaggctgtgctgtcgaggcgcctgctcgcttactcgcctgccaggaggccgggctctcagtttggggtgtttgtgcaaccttcatctgcactgggccctgtgcccctcctccccatccatggtccccagcagtgcctggttctgagcaaactcccagggaagaaaacggccctgtctccatggccaggttcttgtggtgtccagtgcgcgtctctcctccatcacactctcccggcttgcgcaggaggggccagcagccccaggagtcccagacccgtgccgatcacactggtgctgttgagatctcccaaacctcacgtccttaactgtgctctccctcctttcctctcccttgagcttggttctgcccagcactcgtgcttgttcacataattaggtttcccaccccagcctacccgacttacttgctagtctctatgaggtccttattgcacttattggggttgaagctcttcagaggagctggaactgtctaccccagggacacacccatttcgttgctacccaagtggattctgagacaggcaccatctccttgttccccctctctcttttgcctcccactgactgcccttttccatgtgtcttcattctgcctgaagaaggctttcccaggatgcacgtcctcagagggagcagcctatctcccccaagctggaggcggcagaggactgggccaagccccaacctgcctcccagccaggctcctccaggcctctggtttagcggagccccctgagcccaggcctgtgtctagccccagtggctcactgaactttcagggcagtcagggggtcctgcttagaagccagtcaccagccctctgcctgcagccatggaagggggtgtgcacgtgcctctgtgtgtgtggctgagtgtattctgcgcgtgtgtgtggagggagggagggaggggagcatggtgtctcccgctccaccgccctttgttgagccccatcagctgcccccttttactttgcattgaacggcctgtccaaagatcctctctctagggcagcagagagctttttgcactttaaaaaaaaaaagaaagaaagaaaggtcggaatttcttttgggtcaatatttttaagtgtgtgaggagatgctcagtagcagcagcctatggcaagagcttataaatgattgatgcaaatttgcactctgctccccctctgtaaggatactgatagcacaacctcttccccccaccccgccccgccttttggtcgtccatccctgtccctttctggccctcttcctgtagcccagtctcaggctttcctcttcctgaagccctacagagttagggaatggagcccaggcaccaggggtctaaagtgtgagccactgagaagagagacgccaactgcacccttgccacttccaaagcaatagaggcagagtggtcccctctttgccacctaggccagttttgaccctggcattaactggccttagaagaaactggatcctggtagggggtggcattttgtttgtttcttccaatctgctgaatcttttgactgcaccttacaaacagcagtctgctcccatgaccctctgcccacttccattggtctccaggccccaataatctggggttgaaactttgaggaaatgccagtgacttattccagagtgcctcagttaggggaacttctctgtaaagaaccctgggtattgagcaaaaaccttattatcgttaatgacctataattggaagcttcctgcctttttctttggttgctcctgtggaaaatactgaaaagattactttgttttattttgttgtctttttataaaaggggaggtggagagaccccttcagagcagggattgtgccgggagagtgcctctgactttgggacatttcatccacagaaatttccaagccaatggtttcttttgggttttggtttttatgtttgttttttggggtttggaaaaacatgcatttttaccgtgcacgtaaattggtcagcagaaaagggagcccatgtgaggggaaatggtttttagaggtgagggttggtccatgtggaggaaagaagtgtctctgttgggggacagaggaacctggggagtccatcgcatgtcctacaatctgctcttagacacggccttgccaggagagcctgccctcagactgcaggaccagaacccctgcctccatctttccaagcaccggggcgaaaaaccacaaaggaaaggaagaaaatttatatatatataatataaaatcacttggtgattaaaaaaataactgctccataaataaaactcctaaagtcacttatgtttaaagggtttggttgtgttttttgtttttcggagaaatattgtaaatatatatttttttgttgctgatttagagtcaatctccaatgttgtgctaaaaagtttaaattaaatgtaagcattaaggggataagtcttatgctatctcagttgacacattgaggttattttgggccagagaaggaggaagctagttggactttgttttgttttccaaaagttctccactattggttttagagagagcaaggacatctttcctctgacacgtgggaatgggtgatatttgtgtaataaaatttttaaaagacaaaaaaagaaatagcctccaatgggaaatattttaatttaggttttgtttttgtttgggggtttttgtttttttaaaaaaataaaaaggctttaaaaacaaaaaataaac

SEQ ID NO: 34470 - DNA, 3158 bp, Homo sapiens
agcaactgtttgctcccttttcctggtcgctctgaccctctctggatactgggttgatccacggaaaaaccgaagacgacgtttgggatttaattattcctctcagctttggaatcttttacttctcacttggacaagaactcaagagcagaatctccgtgttgcaatctggttcctaaggaggaagaggaaggcagccctggagtggtttctttacagtaatttcaacagaagagtgagagatggaacccgaagaagaaaggattcgttacagccagagattgcgtggtaccatgcgacgacgctatgaagatgatggcatttcagatgatgaaattgaaggaaaaagaacttttgacttggaagagaaactgcacaccaacaaatataatgccaattttgttacttttatggaaggaaaagattttaatgtagagtatattcagcggggtggcttgagagatcctctgattttcaagaattctgatggactcggaataaaaatgccggatccagacttcactgtgaatgatgtcaaaatgtgtgtggggagtcgtcgcatggtggatgtcatggacgtgaacacacagaaaggcattgaaatgaccatggctcagtggacacgctactatgagacccgtgccgatcacactggtgctgttgagatctcccaaacctcacgtccttaactgtgctctccctcctttcctctcccttgagcttggttctgcccagcactcgtgcttgttcacataattaggtttcccaccccagcctacccgacttacttgctagtctctatgaggtccttattgcacttattggggttgaagctcttcagaggagctggaactgtctaccccagggacacacccatttcgttgctacccaagtggattctgagacaggcaccatctccttgttccccctctctcttttgcctcccactgactgcccttttccatgtgtcttcattctgcctgaagaaggctttcccaggatgcacgtcctcagagggagcagcctatctcccccaagctggaggcggcagaggactgggccaagccccaacctgcctcccagccaggctcctccaggcctctggtttagcggagccccctgagcccaggcctgtgtctagccccagtggctcactgaactttcagggcagtcagggggtcctgcttagaagccagtcaccagccctctgcctgcagccatggaagggggtgtgcacgtgcctctgtgtgtgtggctgagtgtattctgcgcgtgtgtgtggagggagggagggaggggagcatggtgtctcccgctccaccgccctttgttgagccccatcagctgcccccttttactttgcattgaacggcctgtccaaagatcctctctctagggcagcagagagctttttgcactttaaaaaaaaaaagaaagaaagaaaggtcggaatttcttttgggtcaatatttttaagtgtgtgaggagatgctcagtagcagcagcctatggcaagagcttataaatgattgatgcaaatttgcactctgctccccctctgtaaggatactgatagcacaacctcttccccccaccccgccccgccttttggtcgtccatccctgtccctttctggccctcttcctgtagcccagtctcaggctttcctcttcctgaagccctacagagttagggaatggagcccaggcaccaggggtctaaagtgtgagccactgagaagagagacgccaactgcacccttgccacttccaaagcaatagaggcagagtggtcccctctttgccacctaggccagttttgaccctggcattaactggccttagaagaaactggatcctggtagggggtggcattttgtttgtttcttccaatctgctgaatcttttgactgcaccttacaaacagcagtctgctcccatgaccctctgcccacttccattggtctccaggccccaataatctggggttgaaactttgaggaaatgccagtgacttattccagagtgcctcagttaggggaacttctctgtaaagaaccctgggtattgagcaaaaaccttattatcgttaatgacctataattggaagcttcctgcctttttctttggttgctcctgtggaaaatactgaaaagattactttgttttattttgttgtctttttataaaaggggaggtggagagaccccttcagagcagggattgtgccgggagagtgcctctgactttgggacatttcatccacagaaatttccaagccaatggtttcttttgggttttggtttttatgtttgttttttggggtttggaaaaacatgcatttttaccgtgcacgtaaattggtcagcagaaaagggagcccagaaaaggcagcagatggaccatgcccttgctgggttttccttttctttgggactgtgaggggaaatggtttttagaggtgagggttggtccatgtggaggaaagaagtgtctctgttgggggacagaggaacctggggagtccatcgcatgtcctacaatctgctcttagacacggccttgccaggagagcctgccctcagactgcaggaccagaacccctgcctccatctttccaagcaccggggcgaaaaaccacaaaggaaaggaagaaaatttatatatatataatataaaatcacttggtgattaaaaaaataactgctccataaataaaactcctaaagtcacttatgtttaaagggtttggttgtgttttttgtttttcggagaaatattgtaaatatatatttttttgttgctgatttagagtcaatctccaatgttgtgctaaaaagtttaaattaaatgtaagcattaaggggataagtcttatgctatctcagttgacacattgaggttattttgggccagagaaggaggaagctagttggactttgttttgttttccaaaagttctccactattggttttagagagagcaaggacatctttcctctgacacgtgggaatgggtgatatttgtgtaataaaatttttaaaagacaaaaaaagaaatagcctccaatgggaaatattttaatttaggttttgtttttgtttgggggtttttgtttttttaaaaaaataaaaaggctttaaaaacaaaaaataaac

SEQ ID NO: 34471 - DNA, 3869 bp, Homo sapiens
agcaactgtttgctcccttttcctggtcgctctgaccctctctggatactgggttgatccacggaaaaaccgaagacgacgtttgggatttaattattcctctcagctttggaatcttttacttctcacttggacaagaactcaagagcagaatctccgtgttgcaatctggttcctaaggaggaagaggaaggcagccctggagtggtttctttacagtaatttcaacagaagagtgagagatggaacccgaagaagaaaggattcgttacagccagagattgcgtggtaccatgcgacgacgctatgaagatgatggcatttcagatgatgaaattgaaggaaaaagaacttttgacttggaagagaaactgcacaccaacaaatataatgccaattttgttacttttatggaaggaaaagattttaatgtagagtatattcagcggggtggcttgagagatcctctgattttcaagaattctgatggactcggaataaaaatgccggatccagacttcactgtgaatgatgtcaaaatgtgtgtggggagtcgtcgcatggtggatgtcatggacgtgaacacacagaaaggcattgaaatgaccatggctcagtggacacgctactatgagaccccagaggaggagcgagagaaactctataatgtcatcagcctcgagtttagccacaccaggctggagaatatggtgcagaggccctccacggtggatttcattgactgggtagacaacatgtggccaaggcacttgaaggaaagccagactgaatcaacaaatgccatcttggagatgcagtaccctaaagtgcagaagtaagtgatgcgccctgcatcttcctccgtgtgctgtgggagaccaaagcaatagcaaggattggcttctcccttacgagctttgctctgtgtcttgaatgattaaaaagatgaattatttaaagatgagactttacagttccacaaggaagagtgtatgtgagcataccatagcacacaaccacacagttaaaggaaaaaaaacttacattttagtcaatacggtagaaaaaaaaaaaacctttttctgataatgtgatgacttgaaaatgcattgctttttctccttctggaacttaagattaagtggaagataaagggagtatataagaggagagtatggcattttggtggggcagatgtacttttttccatcagtacactaatgctgctgctttttttgggtcaggtactgtctaatgagtgttcgaggctgctatactgacttccatgtggactttggtggtacctctgtttggtatcacatccatcaagggggaaaggtcttctggctcatcccccctacagcccacaacctggagctgtacgagaattggctgctgtcagggaaacagggagacatctttctgggtgaccgggtatcagattgtcagcgcattgagctcaagcagggctataccttcgtcattccctcaggctggattcatgctgtgtatactcctacagacacattagtgtttgggggcaattttttgcatagcttcaacatccctatgcagttaaaaatatacaacattgaagatcggacacgggttccaaataagtttcgctatccattctactatgagatgtgttggtatgtgttggagcgctatgtgtactgcataaccaaccgttcccacctaaccaaggaatttcagaaagagtccctcagcatggatttggagttaaatgggttggagtctgggaatggggatgaggaagcagtggatcgagaaccccgacgcttgagcagcaggcgttctgtcctcactagccctgtagcgaatggagtcaacctggattatgatggactgggcaaaacctgccgaagtcttccaagtctgaagaaaactttggctggggactcatcttctgactgtagccggggctcccacaatggacaagtgtgggatccccagtgtgctccccgaaaggacaggcaagtgcatctgacccattttgagcttgaaggccttcgctgccttgtagataagttggagtctctgccactgcacaagaaatgtgtccccacagggatagaagatgaagatgctctcattgctgatgtaaagattttgctggaggagcttgccaacagcgatcccaagttagccctcactggagttcctatagtacagtggccaaaaagggataagcttaaattccccactcggccaaaggtgcgggttcctaccatccccattacgaagcctcacactatgaaaccagctccacggttaacacctgtgaggccagctgctgcctccccgattgtgtcaggagccagacggagacgagtgcgatgtcgaaaatgcaaagcctgtgtgcaaggagagtgtggtgtttgccactactgcagagacatgaagaagtttggggggcctggacgcatgaagcagtcctgtgtcctccgacagtgcttggcacccagactgcctcactcagtcacatgttccctctgtggagaggtggatcagaatgaagagacacaagactttgagaagaaactcatggaatgctgtatctgcaatgagattgttcatcctggctgcctccagatggacggagaggggttgcttaacgaagaattgccaaattgctgggaatgtccaaagtgctaccaggaggacagctcggagaaagcccagaagcggaaaatggaagagagtgacgaagaagctgtgcaagccaaagtcctgcggcccctgcggagctgcgatgagcctctcacgcccccgcctcattcacccacttccatgctgcagctcatccatgacccggtttccccccggggtatggtgactcggtcatcccctggggctggccccagcgaccaccacagtgccagccgcgatgagcgcttcaaacggcggcagttgctgcggctgcaggccacagagcgcaccatggtacgggaaaaggagaacaatcccagcggcaaaaaggagctgtctgaagttgagaaagccaagatccggggatcgtacctcactgtcacgctacagaggcccaccaaagagctccacgggacatccattgtgcccaagctgcaggccatcacggcctcctctgccaaccttcgccattccccccgtgtgctagtgcagcactgcccagcccgaaccccccagcgtggggatgaggaggggctggggggagaggaggaggaagaggaggaggaggaggaggaagatgacagtgcagaggaggggggtgcagccaggctgaatggccggggcagttgggctcaggatggagacgaaagctggatgcagcgggaggtctggatgtctgtcttccgctacctcagccgcagagaactttgtgaatgtatgcgagtgtgcaagacgtggtataaatggtgctgcgacaagagactttggacaaaaattgacttgagtaggtgtaaggccattgtgccccaggccctcagtggcatcatcaagaggcagccagtcagccttgacctcagttggaccaacatctctaaaaagcaactgacatggctcgtcaataggctgccaggactgaaagacctcctcctagcaggctgctcctggtctgcagtctctgccctcagcacctccagctgcccccttctcaggacccttgatcttcggtgggcagtaggaatcaaggaccctcaaattcgggacttgcttactccaccggctgataaaccaggtcaggacaatcgcagcaagctccggaacatgaccgacttccggctggcaggccttgacatcacagatgccacgcttcgcctcataattcgccacatagttcagcgtctgacggggatcctctaaag

SEQ ID NO: 34472 - DNA, 13670 bp, Homo sapiens
  misc_feature (1987)..(1987): n is a, c, g, or t
  misc_feature (3143)..(3143): n is a, c, g, or t
ccggcctcgcgttccctcggacggttgcccaatggcagcccaggtggcagcccgggaggcgcgagacttcagagaagccccgacccttcgcctaacctcgggggccggcctggaggcagtgggcgctgtggagctcgaggaggaggaggagaacgaggaggaggcggcggccaggagagcgcggagtttcgcccaagacgcgcgggtgcgcttcctcggcggccgcctggcgatgatgctggggttcacggaggagaaatggagccagtatttggaaagcgaggacaaccggcaggttcttggggagtttctggaaagcaccagcccggcttgccttgtgtttagcttcgccgcctcggggcgccttgcggcttcccaggagattccaagagatgcaaaccataaacttgtttttatttccaagaagattactgaaagcattggagtaaatgacttttctcaagtggttttatttggagagttacctgcgttgtctcttggacatgtatctgctttccttgatgagattttagtgccagttctttctaataagaacaaccataagtcctggtcctgttttacttcacaagatatggaatatcacatagaagtcatgaaaaagaagatgtatatttttaggggcaaaatgtctagaagaactcttctaccaattcccactgttgcaggaaagatggatctggatcagaattgttcagagaacaagccaccgtcaaatgaaaggataatacttcatgcaattgaatctgtggttattgaatggtcacatcaaatccaagaaattatagaaagagattcagtgcagcgtttgttgaatggtcttcacttgtctcctcaagcagaactagatttctggatgatgaggagagaaaatctgtcatgcatttatgatcaacttcaggcacctgttgtcctcaaaatggttaagatcctgacaactaaacaaagcagctattttcctactctgaaggacatttttctggctgtggaaaatgctcttctcgaagcccaagatgtggaactttacctgagacctctgaggagacacatccagtgtctccaggagacggaattcccacagacacgcatattaatcgctccattatttcataccatctgtctgatctggagtcattccaagttttataacaccccagctcgggttatagttttattgcaagagttttgtaatctcttcattaaccaggcaacagcttacctttcacctgaggaccttttgaggggagaaatagaagagtcactggaaaaggtgcaggtggctgttaacatcttaaagactttcaaaaactcctttttcaactatagaaaaaaattggcaagctactttatgggaagaaagctgagaccatgggatttccagtctcatctggtgttttgcagatttgacaagtttcttgatcgtttaataaaaatagaggatatatttgccaccactttggaatttgaaaagctggaaagactggaatttggtggtaccaaaggagcaattttaaatggacaagtccacgagatgagtgaagaacttatggaactctgtaaactttttaaacagagcacttatgacccatctgattgcactaacatggagtttgaaagtgattatgtggcatttaagtccaaaactctggaatttgacagaaggcttgggacaattatttgtgaagctttctttaactgcaatggcttagaagctgcatttaagcttttgaccatatttggaaattttctagagaagccagttgtcatggaaattttcagcctacattacagcacactagtgcatatgtttaatacagagctggatgtgtgtaagcaactgtataatgaacacatgaaacagattgaatgtggtcatgtagttcttaacaagaacatgccatttacctcaggaaatatgaaatgggcccagcaggttctccaacgacttcaaatgttttggtcaaacttngcatctctccgttatctatttttgggcaatcctgatcacgctttagtttatcaaaagtatgttgaaatgaccactttgcttgatcaatttgaaagtcgtatctataatgaatggaaaagtaatgtggatgaaatctgtgaattcaatttgaatcaacccttggttaaattcagtgccataaatggtcttctctgtgtcaattttgacccaaagctagtggctgtattgagagaagtgaaatatcttttgatgttgaagaaacaagacataccagattcagctttagccatcttcaagaaaaggaacactattttaaagtacattggaaatcttgaccttcttgtgcaagggtataataaactcaaacagacgctcctggaagttgaataccctctgattgaagatgagctgagggctattgacgagcagctgacagcagccacaacgtggctgacatggcaggatgactgctggggctacatcgagagggtgagggcagccacgtccgagttggagcacagagttgagcgcacacagaaaaacgtgaaggtgatccagcagaccatgaggggctgggccaggtgcgtgctacctcccaggagagagcacagacgagaggcagccttcaccttggaggacaagggtgatttgtttacaaaaaaatacaagttaatccaaggagatggctgcaagatccacaacttggtcgaggaaaataggaagctcttcaaagccaatccctctctggatacctggaaaatttatgtagaattcattgacgacattgtggtggaaggcttttttcaggctataatgcacgacttagacttctttctgaagaatacagagaaacaattgaaaccggcaccgttttttcaagcacaaatgatcttgttgcctcctgagattgtgtttaaaccttccctagacagagaggctggggatggcttctatgatcttgtagaagaaatgttatgcaatagttttagaatgtctgcccagatgaaccgaatagcaacacacctggaaattaaaaattatcagaatgatatggataacatgttaggcctggcagaggtcaggcaggagatcatgaacagagtggtgaatgtcatcaacaaagtcttagatttcagaaacaccctggagacccacncttacctctgggtggatgatcgagctgagtttatgaagcattttctcttgtatggccatgctgtgtcttccgatgaaatggatgctcatgcaaatgaagaaattcccgaacaaccaccaactcttgagcaattcaaagaacagattgacatttatgaagctttgtatgttcaaatgagcaaatttgaggactttagagtgtttgatagttggttcaaggtggacatgaagcctttcaaagtgagcttgttaaccataattaagaaatggagctggatgtttcaggagcatcttttgagatttgtcattgacagtctgaatgagctacaagaatttataaaggagacagattccggacttcagagagaattaaatgaaggtgatcatgatggtttagttgacatcatggtgcatcttctggctgtaagaagccgacagagagctactgatgaactctttgaacctctaaaagaaacgatcaccctcttggaaagctatggccagaagatgcctgagcaggtctatattcagctagaggaattacctgaaagatgggaaactaccaaaaagatcgcagcaactgtcagacatgaagtctcacctctccataatgcggaagtcactcttataaggaaaaaatgtattttgtttgacgcaaagcaggcagagttcagagagagattcagacactatgcccctcttggatttaatgcagaaaatccatacacagcgcttgataaggcaaatgaagagcttgaggccttagaagaagaaatgttgcagatgcaagaatctactcgtctttttgaagtggctcttccagagtacaaacaaatgaaacagtgtcgcaaagaaataaaattgctcaagggactgtgggatgtcattatttatgttcgaagaagcattgataattggactaaaacccagtggagacagattcatgtggaacagatggatgtagaactcagaaggtttgccaaggcgagttccataactgaaatttggtcactcaacaaggaagtccgcgtctgggatgcttacacgggcctggaaggcacagttaaggacatgacagcctccctgagggccatcacagagttacagagccctgccctcagggacaggcattggcaccagctgatgaaagctattggggtcaagtttttaataaatgaagccacaactttggcagatttgttagcactgcggttacacagagtggaagatgatgtccgaaggattgtggacaaggcggtgaaagagctggggactgagaaggttattactgaaatcagtcagacctgggcaaccatgaagttttcttacgaagttcactatcgaacaggcattccattactaaagtctgatgaacaactttttgaaactctagagcacaaccaagttcagttgcagactcttcttcaaagcaagtatgtagaatatttcattgagcaagtgttaagctggcaaaataaattaaacatagcagacttggtcatcttcacttggatggaagtccagcgaacttggtctcacctggaaagcatttttgtctgttcagaagatattcgaatccagcttgtgaaagatgctagaagatttgatggggtggatgctgaatttaaggagttaatgttcaagacagccaaagtagaaaatgtgttagaagcaacgtgcagacctaatctctatgaaaaacttaaagatttacagtccaggctttctctttgtgaaaaagctctcgctgaatacctggaaaccaagcgcatagcctttcctcgcttctatttcgtctcttctgctgatttacttgacattctctcaaaaggagctcagcctaaacaggtaacatgtcaccttgccaaacttttcgacagcattgcagatctgcagtttgaagacaatcaggatgtttctgcacacagggcagttggaatgtacagcaaagaaaaggagtatgtcccattccaagccgagtgtgaatgtgtgggccatgtggaaacatggcttctgcaacttgaacagactatgcaagaaacggtgcgtcattctataacagaagccatagtggcctacgaggaaaaacctagggaactgtggatttttgatttcccagctcaggttgcactaaccagctcacaaatatggtggaccacagatgtaggaatagccttcagtagactggaagaaggctacgaaacagccctgaaggatttccataaaaaacagatttctcagctgaatacactgattacacttttgctgggagaacttccacctggagacagacagaagatcatgacaatttgtaccatagatgtccatgccagagacgtggtggcaaaacttatttctcagaagcaagttgttgtcagtccccaagcttttacatggctgtctcaacttcgtcaccgatgggaggatacccagaaacactgctttgttaatatttgtgatgcccagttccagtacttctatgaatacttaggaaacagccctcgactagtgatcactcctctaactgacaggtgttatattaccttaactcaatcacttcatctaaccatgagtggggctcctgctggcccagctggtaccgggaaaacagagaccaccaaagacctaggacgtgcccttggcatgatggtctatgtattcaactgttcagagcaaatggactacaaatccataggcaatatctataagggattggtgcagacaggagcttggggctgctttgatgagttcaaccgaatctctgtggaagttctgtcagtggtggcagtacaagtgaaaatgattcatgatgccatcagaaacaggaagaagagatttgtatttcttggggaagctatcacactgaagccatcagttggaatatttattactatgaacccgggttatgctggtcgaaccgaattaccggaaaatctcaaagctcttttcagaccctgtgccatggtggcccctgacattgagctaatctgtgaaatcttgttagttgctgaaggttttgtggatgcgcgtgcattagcccgaaagttcattacgttgtacacgctttgcaaggagcttctctccaagcaggatcattacgactggggacttcgtgctattaagtctgtcttggttgtggctggatctctgaaacgaggagataaaaatagacccgaagatcaggtactcatgagagcattaagggatttcaatatgcccaaaatagtgactgacgacatcccagtgtttctgggcctggtcggtgacctgtttccagccctggatgtgccccggaggaggaagctgcactttgaacagatggtcaggcagtctaccctggagctccgcctgcagcctgaagagagcttcatcctcaaagttgtccagcttgaggaactgttggctgtgcggcactcggtctttgtagttggaaatgcaggcacaggaaagagtaagattttgagaacactgaaccgaacatatgttaacatgaaacagaagccggtttggaatgacttaaaccctaaagctgtgacaacagatgaactctttggtttcatacatcatgctacccgagaatggaaagatggcaagattgtttactcttattttataggtctcttctcatccattctacgagaacaagcaaatcttaagcatgatggaccaaaatggatagtcctggatggcgatattgaccccatgtggattgaatcactgaatactgtaatggatgataacaaggtgctgaccctcgccagcaatgagcgcattgcactcactcccttcatgaggcttctgtttgagatacatcacttaaggagcgcaaccccggccactgtttccagagctggtattctgtatgtgaacccacaagatctgggctggaatccgtatgtggccagttggatagacagaaggcggcatcaatcagaaaaggccaatttgactattctttttgataaatatgtccctgcatgcttggataaactgagaacaagctttaaaaccatcacttcaattcctgagagtagcctggtgcagactctatgtgttcttttggagtgcttgctgactcctgaaaatgtaccttctgacagcccaaaagaagtttatgaagtctattttgtatttgcttgtatctgggcttttggaggcaccctgctacaagatcagatttctgattatcaagctgacttcagtcggtggtggcagaaagagatgaaagcagtgaaatttccgtcgcagggaacaatctttgattattatgtggaccacaaaactaagaaattattgccctgggctgacaaaattgcccagtttactatggatccagatgtgcctctgcagacagttctcgttcacacaacagagacagctcgtcttagatatttcatggagttgttgcttgagaaaggaaaacctctaatgctagtaggaaatgcaggagtgggaaaaacagtctttgtaggtgacacattggcaagtctctctgaggattacatagtatcccgtgtgcctttcaactactacacaacatccacagctctgcaaaaaattcttgagaaacccctagagaaaaaagctggtcataactatggtcctggaggaaataaaaaattgatttattttatcgacgacatgaacatgcctgaagtggacttatatggcaccgttcagcctcataccctgatccggcagcatattgattatggacattggtatgatagacagaaggtgatgcttaaagaaatccataactgccagtatgtcgcctgcatgaatccgatggtgggcagcttcaccatcagtcccaggctacagagacatttcacagtgtttgcattcaattttccatctttggatgcactaaacaccatctatggccaaatctttagcttccatttccaacagcaagcatttgctccatcaattctcaggagtggccccactttgatccaggcaacaatagcattccatcagacaatgatgtgtaactttttacccacggctattaaattccactacatctttaatctgagagatttatcaaacgtcttccaggggattttatttgcttctcctgagtgtttaaaaggtccacttgatttaatacatctgtggcttcatgaatctgcccgtgtttatggagacaaactgatagacaaaaaagattgtgatttgtttcagagaagaatgctggaaactgcttataaatattttgaaggtatagatagtcacatgctgcttcaacagcccctcatttattgccactttgctgatagagggaaggacccacattacatgccagtgaaggactgggaagtgctgaagacgattcttacagaaacgttagacaactacaatgaactaaatgctgccatgcacctagttttgtttgaagatgccatgcaacatgtgtgtcgcatcagccggatcttacgaacccctcagggctgtgctctcttggttggagttgggggcagtggcaagcagagcttgtccaggctggcagcttaccttcgtggccttgaggtctttcagatcactctgaccgagggctatggaatccaggaacttcgggtagatcttgccaatttgtacatccgaactggagccaagaacatgcccactgtgttcctgctgacagatgcccaggttctagatgagagcttcctcgtgctgattaatgacttgctggcatcaggagaaatcccagatctgttcagcgatgaagatgtggacaagataatttctggaattcataatgaagttcatgctctgggcatggtagactccagggaaaactgttggaaattctttatggccagggtgcgactacagctcaaaatcattttgtgtttctctccagttggtcgcacgctgagagttagagctcggaagttcccagccatagttaactgcacggctattgactggtttcatgcgtggccgcaggaggctctggtctccgtcagcaggaggttcattgaggaaaccaagggaattgagccagtgcacaaagactctattagccttttcatggcacatgttcacaccactgtaaatgaaatgagtaccagatattaccagaatgagagaagacacaactataccaccccaaagagttttctagaacaaatatcactgtttaagaacctgttgaagaagaagcaaaatgaggtatccgagaaaaaagaacgcctggtgaacggcatccaaaagctaaaaaccacagcctctcaggtgggagatctaaaagccagacttgcctctcaagaagccgagctgcaactgagaaatcatgatgccgaagctctgatcacaaagatcggccttcagacggagaaagtgagccgggaaaagaccatcgctgatgctgaggagcgaaaggtgacagccattcagactgaagtgttccagaaacagagagaatgtgaagctgacttactcaaggctgagcctgcactggtggctgctacagctgcactcaatacactcaacagggtcaacctcagtgagctgaaagcctttcccaaccctcccatcgcagttaccaatgttactgcagccgtgatggtccttctggctcctcggggaagagtgcccaaagaccgaagttggaaagcagctaaagtcttcatgggaaaggttgatgattttttgcaagcattaattaactatgacaaagagcacattccagagaactgtctaaaagtggtgaatgaacactatttgaaagacccagagtttaatccaaacctgattcgaaccaaatcttttgcagcagctggcctgtgtgcctgggtcatcaacatcattaaattctatgaggtctactgtgatgtggagccaaaacgccaagcattagcccaagcaaacttagaactggctgcagctactgaaaaactagaggctatcaggaaaaagcttgtggatctggatcgaaatctgagcagactcacggcttcatttgaaaaagcaacagctgagaaagtccggtgtcaagaagaggtgaaccaaaccaacaaaaccatcaaattagctaacagacttgtcaaggaacttgaggcaaagaagattcgctggggtcaatccattaagtcctttgaagctcaagagaagacactctgtggagatgttcttctcacggcggcatttgtgtcttacgtcggacccttcacaaggcagtatcgccaggagctggtgcactgcaagtgggttccctttcttcaacagaaggtttccattccactaaccgaaggcctggacttgatatccatgttgacggatgatgctacaattgccgcctggaataacgaaggactgcccagtgacagaatgtccaccgaaaatgccgctatcctaacacactgtgagcgctggcctctggtgatagatccccagcaacagggaattaagtggatcaagaataagtatggaatggacctgaaagtcacacatttgggccagaaagggtttttgaatgccattgaaactgctttggcctttggtgatgtcatcttaattgaaaatctcgaggaaacgatagatccagtcctggatccactacttggcaggaacacaattaaaaaaggaaagtatatcaggattggagataaagaatgtgaatttaacaagaactttcgccttatccttcacacaaaattggcaaatcctcactataagccggaattacaagctcagacaactctcctcaatttcacagtcacagaagatggtctagaagcccagctgctggcagaggttgtcagtattgaaaggccagatttggagaaacttaagttggtattgacaaagcaccaaaatgattttaaaattgagctcaagtatctggaagacgatctccttttgcgcctttctgcggcagagggaagctttctggatgacaccaaactggtagagagattggaggcaacaaagaccaccgtggcagagatagagcacaaggtgattgaagccaaagaaaatgaaagaaaaatcaacgaggcccgagaatgttacagaccattggcagcaagagcatctcttctttattttgttattaatgacctccaaaaaatcaaccccctctaccaattctctttgaaggcttttaacgtgctgttccacagagcgatcgagcaggctgacaaggtggaagacatgcagggacgcatctctatcctgatggagagcatcacccacgctgtcttcctctacaccagccaggcgctgtttgagaaggacaagctcaccttcctgtcccagatggcttttcagattttgttgagaaagaaagagatagaccctcttgaattggatttcctgcttcgattcacagttgaacacactcatctgagtcccgttgacttcctaacttctcagtcatggagtgctatcaaggcaattgccgtcatggaagaatttcgaggcatagaccgagatgtggaaggatctgccaagcagtggaggaagtgggtagaatccgagtgtccagaaaaagaaaaattacctcaagaatggaagaagaaaagtttaatacagaagctgattcttctgagagcaatgcgccctgacagaatgacgtatgctctcagaaattttgtagaggaaaaactgggtgcgaagtatgtggagaggaccagattggacttagttaaagcattcgaagaaagcagcccagccacccccatattcttcatcctgtctccgggggtagatgcccttaaagacctggagattcttggcaaaagacttggctttacaattgactctggaaaattccacaatgtgtctttaggacaaggtcaggagacggtggcagaagtggccctggagaaagcttccaaaggaggacactgggtcatcctccaaaatgttcatttggtagccaagtggctaggaaccttggagaagctccttgaaagattcagccaaggaagccacagagattacagggttttcatgagtgctgagtctgcacctacaccagatgagcatatcatccctcaaggactcctggaaaattccattaagatcactaatgaacccccaacagggatgctggccaatttgcatgccgccctgtacaactttgatcaggatacacttgaaatatgctccaaggagcaggagtttaaaagcatccttttttctctctgctacttccacgcctgtgttgctgggagactgaggtttggcccccagggctggagccgaagctatccttttaatcctggagacctcaccatttgtgccagtgtcctctacaactacttagaggcaaactctaaagtcccatgggaagatctccgttatctctttggtgagatcatgtatggaggccacatcacagatgactgggatcgcaaactgtgtcgggtgtatttagaagaattcgtgaatccatctctgactgaagatgaactgatgctggcaccaggttttgctgccccaccctacctagattatgcaggctaccaccagtacatagaggagatgcttcctccagaaagcccggcactgtatggcctccacccaaatgctgaaatagaattcctgacagtgacatccaacactctcttcagaactttgctggagatgcagcccaggaatgcactcagtggtgatgaactggggcagtctacagaagaaaaggttaagaatgtcttggatgacattttggagaaacttccagaagagttcaacatggcagagataatgcaaaaaaattcaaatagaagcccatatgttcttgtttgcttccaagaatgtgagaggatgaatattctcattcgggaaatacgtatatcacttgaacaactggaccttagtttgaagggggaattggcattatctcctgctgtggaagcccagcagtttgcattgagttatgacacggtaccagacacttggagcaaactggcttatccttctacttatggcctagcccagtggttcaatgacctcctcctgcgatgccgagaactcgatacttggacacaagaccttacccttccggctgtcgtgtggctatccggcttcttcaaccctcagtccttcttaactgcaatcatgcagacgatggctcgaaaaaatgagtggcccctggataaaacgcgcttgactgctgatgttaccaaaaaaacaaaggaagattatggacacccgccaagggaaggtgcatacctccacggactcttcatggagggcgcccgctgggacacccaagcaggaaccattgttgaagcccgtctcaaggagctggcatgccctatgccggtcatctttgcaaaagccacccccgtggacagacaagaaaccaaacagacctacgagtgccctgtgtatagaaccaaactgagaggccccagctacatctggaccttcaggctgaagagcgaagagaagactgcaaaatgggttctggctggagtggctctgcttctagaagcgtaaggtaacactggcattcctctagcctctgctggagtgcagtgaggattttctagcatgttgctgcact

SEQ ID NO: 34473 - DNA, 688 bp, Homo sapiens
ccggcctcgcgttccctcggacggttgcccaatggcagcccaggtggcagcccgggaggcgcgagacttcagagaagccccgacccttcgcctaacctcgggggccggcctggaggcagtgggcgctgtggagctcgaggaggaggaggagaacgaggaggaggcggcggccaggagagcgcggagtttcgcccaagacgcgcgggtgcgcttcctcggcggccgcctggcgatgatgctggggttcacggaggagaaatggagccagtatttggaaagcgaggacaaccggcaggttcttggggagtttctggaaagcaccagcccggcttgccttgtgtttagcttcgccgcctcggggcgccttgcggcttcccaggaggtaagaggcgacgggcaaggggacctgcccatccaacaaaactacccaggggagacagcccagtcgctcccctttggattcccgcggggcgctcactcgggcactttaacaaacctggcttgaagtccccatcctgaggcccgcaggactcctccccacgtgcacccactctgcagttcagcagctgcaggttagtttcctaagtcagcagtttgtatctgaccgagaatcccgcgttgagcctgttcgaccaggataacccaagaacaccagcgctttctttagctgcttgggtgttaggcgcca

SEQ ID NO: 34474 - DNA, 1289 bp, Homo sapiens
ccggcctcgcgttccctcggacggttgcccaatggcagcccaggtggcagcccgggaggcgcgagacttcagagaagccccgacccttcgcctaacctcgggggccggcctggaggcagtgggcgctgtggagctcgaggaggaggaggagaacgaggaggaggcggcggccaggagagcgcggagtttcgcccaagacgcgcgggtgcgcttcctcggcggccgcctggcgatgatgctggggttcacggaggagaaatggagccagtatttggaaagcgaggacaaccggcaggttcttggggagtttctggaaagcaccagcccggcttgccttgtgtttagcttcgccgcctcggggcgccttgcggcttcccaggagattccaagagatgcaaaccataaacttgtttttatttccaagaagattactgaaagcattggagtaaatgacttttctcaagtggttttatttggagagttacctgcgttgtctcttggacatgtatctgctttccttgatgagattttagtgccagttctttctaataagaacaaccataagtcctggtcctgttttacttcacaagatatggaatatcacatagaagtcatgaaaaagaagatgtatatttttaggggcaaaatgtctagaagaactcttctaccaattcccactgttgcaggaaagatggatctggatcagaattgttcagagaacaagccaccgtcaaatgaaaggataatacttcatgcaattgaatctgtggttattgaatggtcacatcaaatccaagaaattatagaaagagattcagtgcagcgtttgttgaatggtcttcacttgtctcctcaagcagaactagatttctggatgatgaggagagaaaatctgtcatgcatttatgatcaacttcaggcacctgttgtcctcaaaatggttaagatcctgacaactaaacaaagcagctattttcctactctgaaggacatttttctggctgtggaaaatggtaagactcttgttcctcagcctggcatcaatatcaccatctgctcatgatccagcccctgcctgctcggccttgatatttacccttccgccatgtttgtggagtgattgctcatggctcttctaatgataaattcatctcaccctttgtactatattctccacccatactaaactacttttagtttatctggtatatagtagtacctgccaaaatggctccagattgaaattttaattagaatgtttgtggaggagtgaggccttcattcggagt

SEQ ID NO: 34475 - DNA, 13458 bp, Homo sapiens
  misc_feature (1775)..(1775): n is a, c, g, or t
  misc_feature (2931)..(2931): n is a, c, g, or t
ccggcctcgcgttccctcggacggttgcccaatggcagcccaggtggcagcccgggaggcgcgagacttcagagaagccccgacccttcgcctaacctcgggggccggcctggaggcagtgggcgctgtggagctcgaggaggaggaggagaacgaggaggaggcggcggccaggagagcgcggagtttcgcccaagacgcgcgggtgcgcttcctcggcggccgcctggcgatgatgctggggttcacggaggagaaatggagccagtatttggaaagcgaggacaaccggcaggttcttggggagtttctggaaagcaccagcccggcttgccttgtgtttagcttcgccgcctcggggcgccttgcggcttcccaggagattccaagagatgcaaaccataaacttgtttttatttccaagaagattactgaaagcattggagtaaatgacttttctcaagtggttttatttggagagttacctgcgttgtctcttggacatgtatctgctttccttgatgagattttagtgccagttctttctaataagaacaaccataagtcctggtcctgttttacttcacaagatatggaatatcacatagaagtcatgaaaaagaagatgtatatttttaggggcaaaatgtctagaagaactcttctaccaattcccactgttgcaggaaagatggatctggatcagaattgttcagagaacaagccaccgtcaaatgaaaggataatacttcatgcaattgaatctgtggttattgaatggtcacatcaaatccaagaaattatagaaagagattcagtgcagcgtttgttgaatggtcttcacttgtctcctcaagcagaactagatttctggatgatgaggagagaaaatctgtcatgcatttatgatcaacttcaggcacctgttgtcctcaaaatggttaagatcctgacaactaaacaaagcagctattttcctactctgaaggacatttttctggctgtggaaaatggcaacagcttacctttcacctgaggaccttttgaggggagaaatagaagagtcactggaaaaggtgcaggtggctgttaacatcttaaagactttcaaaaactcctttttcaactatagaaaaaaattggcaagctactttatgggaagaaagctgagaccatgggatttccagtctcatctggtgttttgcagatttgacaagtttcttgatcgtttaataaaaatagaggatatatttgccaccactttggaatttgaaaagctggaaagactggaatttggtggtaccaaaggagcaattttaaatggacaagtccacgagatgagtgaagaacttatggaactctgtaaactttttaaacagagcacttatgacccatctgattgcactaacatggagtttgaaagtgattatgtggcatttaagtccaaaactctggaatttgacagaaggcttgggacaattatttgtgaagctttctttaactgcaatggcttagaagctgcatttaagcttttgaccatatttggaaattttctagagaagccagttgtcatggaaattttcagcctacattacagcacactagtgcatatgtttaatacagagctggatgtgtgtaagcaactgtataatgaacacatgaaacagattgaatgtggtcatgtagttcttaacaagaacatgccatttacctcaggaaatatgaaatgggcccagcaggttctccaacgacttcaaatgttttggtcaaacttngcatctctccgttatctatttttgggcaatcctgatcacgctttagtttatcaaaagtatgttgaaatgaccactttgcttgatcaatttgaaagtcgtatctataatgaatggaaaagtaatgtggatgaaatctgtgaattcaatttgaatcaacccttggttaaattcagtgccataaatggtcttctctgtgtcaattttgacccaaagctagtggctgtattgagagaagtgaaatatcttttgatgttgaagaaacaagacataccagattcagctttagccatcttcaagaaaaggaacactattttaaagtacattggaaatcttgaccttcttgtgcaagggtataataaactcaaacagacgctcctggaagttgaataccctctgattgaagatgagctgagggctattgacgagcagctgacagcagccacaacgtggctgacatggcaggatgactgctggggctacatcgagagggtgagggcagccacgtccgagttggagcacagagttgagcgcacacagaaaaacgtgaaggtgatccagcagaccatgaggggctgggccaggtgcgtgctacctcccaggagagagcacagacgagaggcagccttcaccttggaggacaagggtgatttgtttacaaaaaaatacaagttaatccaaggagatggctgcaagatccacaacttggtcgaggaaaataggaagctcttcaaagccaatccctctctggatacctggaaaatttatgtagaattcattgacgacattgtggtggaaggcttttttcaggctataatgcacgacttagacttctttctgaagaatacagagaaacaattgaaaccggcaccgttttttcaagcacaaatgatcttgttgcctcctgagattgtgtttaaaccttccctagacagagaggctggggatggcttctatgatcttgtagaagaaatgttatgcaatagttttagaatgtctgcccagatgaaccgaatagcaacacacctggaaattaaaaattatcagaatgatatggataacatgttaggcctggcagaggtcaggcaggagatcatgaacagagtggtgaatgtcatcaacaaagtcttagatttcagaaacaccctggagacccacncttacctctgggtggatgatcgagctgagtttatgaagcattttctcttgtatggccatgctgtgtcttccgatgaaatggatgctcatgcaaatgaagaaattcccgaacaaccaccaactcttgagcaattcaaagaacagattgacatttatgaagctttgtatgttcaaatgagcaaatttgaggactttagagtgtttgatagttggttcaaggtggacatgaagcctttcaaagtgagcttgttaaccataattaagaaatggagctggatgtttcaggagcatcttttgagatttgtcattgacagtctgaatgagctacaagaatttataaaggagacagattccggacttcagagagaattaaatgaaggtgatcatgatggtttagttgacatcatggtgcatcttctggctgtaagaagccgacagagagctactgatgaactctttgaacctctaaaagaaacgatcaccctcttggaaagctatggccagaagatgcctgagcaggtctatattcagctagaggaattacctgaaagatgggaaactaccaaaaagatcgcagcaactgtcagacatgaagtctcacctctccataatgcggaagtcactcttataaggaaaaaatgtattttgtttgacgcaaagcaggcagagttcagagagagattcagacactatgcccctcttggatttaatgcagaaaatccatacacagcgcttgataaggcaaatgaagagcttgaggccttagaagaagaaatgttgcagatgcaagaatctactcgtctttttgaagtggctcttccagagtacaaacaaatgaaacagtgtcgcaaagaaataaaattgctcaagggactgtgggatgtcattatttatgttcgaagaagcattgataattggactaaaacccagtggagacagattcatgtggaacagatggatgtagaactcagaaggtttgccaaggcgagttccataactgaaatttggtcactcaacaaggaagtccgcgtctgggatgcttacacgggcctggaaggcacagttaaggacatgacagcctccctgagggccatcacagagttacagagccctgccctcagggacaggcattggcaccagctgatgaaagctattggggtcaagtttttaataaatgaagccacaactttggcagatttgttagcactgcggttacacagagtggaagatgatgtccgaaggattgtggacaaggcggtgaaagagctggggactgagaaggttattactgaaatcagtcagacctgggcaaccatgaagttttcttacgaagttcactatcgaacaggcattccattactaaagtctgatgaacaactttttgaaactctagagcacaaccaagttcagttgcagactcttcttcaaagcaagtatgtagaatatttcattgagcaagtgttaagctggcaaaataaattaaacatagcagacttggtcatcttcacttggatggaagtccagcgaacttggtctcacctggaaagcatttttgtctgttcagaagatattcgaatccagcttgtgaaagatgctagaagatttgatggggtggatgctgaatttaaggagttaatgttcaagacagccaaagtagaaaatgtgttagaagcaacgtgcagacctaatctctatgaaaaacttaaagatttacagtccaggctttctctttgtgaaaaagctctcgctgaatacctggaaaccaagcgcatagcctttcctcgcttctatttcgtctcttctgctgatttacttgacattctctcaaaaggagctcagcctaaacaggtaacatgtcaccttgccaaacttttcgacagcattgcagatctgcagtttgaagacaatcaggatgtttctgcacacagggcagttggaatgtacagcaaagaaaaggagtatgtcccattccaagccgagtgtgaatgtgtgggccatgtggaaacatggcttctgcaacttgaacagactatgcaagaaacggtgcgtcattctataacagaagccatagtggcctacgaggaaaaacctagggaactgtggatttttgatttcccagctcaggttgcactaaccagctcacaaatatggtggaccacagatgtaggaatagccttcagtagactggaagaaggctacgaaacagccctgaaggatttccataaaaaacagatttctcagctgaatacactgattacacttttgctgggagaacttccacctggagacagacagaagatcatgacaatttgtaccatagatgtccatgccagagacgtggtggcaaaacttatttctcagaagcaagttgttgtcagtccccaagcttttacatggctgtctcaacttcgtcaccgatgggaggatacccagaaacactgctttgttaatatttgtgatgcccagttccagtacttctatgaatacttaggaaacagccctcgactagtgatcactcctctaactgacaggtgttatattaccttaactcaatcacttcatctaaccatgagtggggctcctgctggcccagctggtaccgggaaaacagagaccaccaaagacctaggacgtgcccttggcatgatggtctatgtattcaactgttcagagcaaatggactacaaatccataggcaatatctataagggattggtgcagacaggagcttggggctgctttgatgagttcaaccgaatctctgtggaagttctgtcagtggtggcagtacaagtgaaaatgattcatgatgccatcagaaacaggaagaagagatttgtatttcttggggaagctatcacactgaagccatcagttggaatatttattactatgaacccgggttatgctggtcgaaccgaattaccggaaaatctcaaagctcttttcagaccctgtgccatggtggcccctgacattgagctaatctgtgaaatcttgttagttgctgaaggttttgtggatgcgcgtgcattagcccgaaagttcattacgttgtacacgctttgcaaggagcttctctccaagcaggatcattacgactggggacttcgtgctattaagtctgtcttggttgtggctggatctctgaaacgaggagataaaaatagacccgaagatcaggtactcatgagagcattaagggatttcaatatgcccaaaatagtgactgacgacatcccagtgtttctgggcctggtcggtgacctgtttccagccctggatgtgccccggaggaggaagctgcactttgaacagatggtcaggcagtctaccctggagctccgcctgcagcctgaagagagcttcatcctcaaagttgtccagcttgaggaactgttggctgtgcggcactcggtctttgtagttggaaatgcaggcacaggaaagagtaagattttgagaacactgaaccgaacatatgttaacatgaaacagaagccggtttggaatgacttaaaccctaaagctgtgacaacagatgaactctttggtttcatacatcatgctacccgagaatggaaagatggcaagattgtttactcttattttataggtctcttctcatccattctacgagaacaagcaaatcttaagcatgatggaccaaaatggatagtcctggatggcgatattgaccccatgtggattgaatcactgaatactgtaatggatgataacaaggtgctgaccctcgccagcaatgagcgcattgcactcactcccttcatgaggcttctgtttgagatacatcacttaaggagcgcaaccccggccactgtttccagagctggtattctgtatgtgaacccacaagatctgggctggaatccgtatgtggccagttggatagacagaaggcggcatcaatcagaaaaggccaatttgactattctttttgataaatatgtccctgcatgcttggataaactgagaacaagctttaaaaccatcacttcaattcctgagagtagcctggtgcagactctatgtgttcttttggagtgcttgctgactcctgaaaatgtaccttctgacagcccaaaagaagtttatgaagtctattttgtatttgcttgtatctgggcttttggaggcaccctgctacaagatcagatttctgattatcaagctgacttcagtcggtggtggcagaaagagatgaaagcagtgaaatttccgtcgcagggaacaatctttgattattatgtggaccacaaaactaagaaattattgccctgggctgacaaaattgcccagtttactatggatccagatgtgcctctgcagacagttctcgttcacacaacagagacagctcgtcttagatatttcatggagttgttgcttgagaaaggaaaacctctaatgctagtaggaaatgcaggagtgggaaaaacagtctttgtaggtgacacattggcaagtctctctgaggattacatagtatcccgtgtgcctttcaactactacacaacatccacagctctgcaaaaaattcttgagaaacccctagagaaaaaagctggtcataactatggtcctggaggaaataaaaaattgatttattttatcgacgacatgaacatgcctgaagtggacttatatggcaccgttcagcctcataccctgatccggcagcatattgattatggacattggtatgatagacagaaggtgatgcttaaagaaatccataactgccagtatgtcgcctgcatgaatccgatggtgggcagcttcaccatcagtcccaggctacagagacatttcacagtgtttgcattcaattttccatctttggatgcactaaacaccatctatggccaaatctttagcttccatttccaacagcaagcatttgctccatcaattctcaggagtggccccactttgatccaggcaacaatagcattccatcagacaatgatgtgtaactttttacccacggctattaaattccactacatctttaatctgagagatttatcaaacgtcttccaggggattttatttgcttctcctgagtgtttaaaaggtccacttgatttaatacatctgtggcttcatgaatctgcccgtgtttatggagacaaactgatagacaaaaaagattgtgatttgtttcagagaagaatgctggaaactgcttataaatattttgaaggtatagatagtcacatgctgcttcaacagcccctcatttattgccactttgctgatagagggaaggacccacattacatgccagtgaaggactgggaagtgctgaagacgattcttacagaaacgttagacaactacaatgaactaaatgctgccatgcacctagttttgtttgaagatgccatgcaacatgtgtgtcgcatcagccggatcttacgaacccctcagggctgtgctctcttggttggagttgggggcagtggcaagcagagcttgtccaggctggcagcttaccttcgtggccttgaggtctttcagatcactctgaccgagggctatggaatccaggaacttcgggtagatcttgccaatttgtacatccgaactggagccaagaacatgcccactgtgttcctgctgacagatgcccaggttctagatgagagcttcctcgtgctgattaatgacttgctggcatcaggagaaatcccagatctgttcagcgatgaagatgtggacaagataatttctggaattcataatgaagttcatgctctgggcatggtagactccagggaaaactgttggaaattctttatggccagggtgcgactacagctcaaaatcattttgtgtttctctccagttggtcgcacgctgagagttagagctcggaagttcccagccatagttaactgcacggctattgactggtttcatgcgtggccgcaggaggctctggtctccgtcagcaggaggttcattgaggaaaccaagggaattgagccagtgcacaaagactctattagccttttcatggcacatgttcacaccactgtaaatgaaatgagtaccagatattaccagaatgagagaagacacaactataccaccccaaagagttttctagaacaaatatcactgtttaagaacctgttgaagaagaagcaaaatgaggtatccgagaaaaaagaacgcctggtgaacggcatccaaaagctaaaaaccacagcctctcaggtgggagatctaaaagccagacttgcctctcaagaagccgagctgcaactgagaaatcatgatgccgaagctctgatcacaaagatcggccttcagacggagaaagtgagccgggaaaagaccatcgctgatgctgaggagcgaaaggtgacagccattcagactgaagtgttccagaaacagagagaatgtgaagctgacttactcaaggctgagcctgcactggtggctgctacagctgcactcaatacactcaacagggtcaacctcagtgagctgaaagcctttcccaaccctcccatcgcagttaccaatgttactgcagccgtgatggtccttctggctcctcggggaagagtgcccaaagaccgaagttggaaagcagctaaagtcttcatgggaaaggttgatgattttttgcaagcattaattaactatgacaaagagcacattccagagaactgtctaaaagtggtgaatgaacactatttgaaagacccagagtttaatccaaacctgattcgaaccaaatcttttgcagcagctggcctgtgtgcctgggtcatcaacatcattaaattctatgaggtctactgtgatgtggagccaaaacgccaagcattagcccaagcaaacttagaactggctgcagctactgaaaaactagaggctatcaggaaaaagcttgtggatctggatcgaaatctgagcagactcacggcttcatttgaaaaagcaacagctgagaaagtccggtgtcaagaagaggtgaaccaaaccaacaaaaccatcaaattagctaacagacttgtcaaggaacttgaggcaaagaagattcgctggggtcaatccattaagtcctttgaagctcaagagaagacactctgtggagatgttcttctcacggcggcatttgtgtcttacgtcggacccttcacaaggcagtatcgccaggagctggtgcactgcaagtgggttccctttcttcaacagaaggtttccattccactaaccgaaggcctggacttgatatccatgttgacggatgatgctacaattgccgcctggaataacgaaggactgcccagtgacagaatgtccaccgaaaatgccgctatcctaacacactgtgagcgctggcctctggtgatagatccccagcaacagggaattaagtggatcaagaataagtatggaatggacctgaaagtcacacatttgggccagaaagggtttttgaatgccattgaaactgctttggcctttggtgatgtcatcttaattgaaaatctcgaggaaacgatagatccagtcctggatccactacttggcaggaacacaattaaaaaaggaaagtatatcaggattggagataaagaatgtgaatttaacaagaactttcgccttatccttcacacaaaattggcaaatcctcactataagccggaattacaagctcagacaactctcctcaatttcacagtcacagaagatggtctagaagcccagctgctggcagaggttgtcagtattgaaaggccagatttggagaaacttaagttggtattgacaaagcaccaaaatgattttaaaattgagctcaagtatctggaagacgatctccttttgcgcctttctgcggcagagggaagctttctggatgacaccaaactggtagagagattggaggcaacaaagaccaccgtggcagagatagagcacaaggtgattgaagccaaagaaaatgaaagaaaaatcaacgaggcccgagaatgttacagaccattggcagcaagagcatctcttctttattttgttattaatgacctccaaaaaatcaaccccctctaccaattctctttgaaggcttttaacgtgctgttccacagagcgatcgagcaggctgacaaggtggaagacatgcagggacgcatctctatcctgatggagagcatcacccacgctgtcttcctctacaccagccaggcgctgtttgagaaggacaagctcaccttcctgtcccagatggcttttcagattttgttgagaaagaaagagatagaccctcttgaattggatttcctgcttcgattcacagttgaacacactcatctgagtcccgttgacttcctaacttctcagtcatggagtgctatcaaggcaattgccgtcatggaagaatttcgaggcatagaccgagatgtggaaggatctgccaagcagtggaggaagtgggtagaatccgagtgtccagaaaaagaaaaattacctcaagaatggaagaagaaaagtttaatacagaagctgattcttctgagagcaatgcgccctgacagaatgacgtatgctctcagaaattttgtagaggaaaaactgggtgcgaagtatgtggagaggaccagattggacttagttaaagcattcgaagaaagcagcccagccacccccatattcttcatcctgtctccgggggtagatgcccttaaagacctggagattcttggcaaaagacttggctttacaattgactctggaaaattccacaatgtgtctttaggacaaggtcaggagacggtggcagaagtggccctggagaaagcttccaaaggaggacactgggtcatcctccaaaatgttcatttggtagccaagtggctaggaaccttggagaagctccttgaaagattcagccaaggaagccacagagattacagggttttcatgagtgctgagtctgcacctacaccagatgagcatatcatccctcaaggactcctggaaaattccattaagatcactaatgaacccccaacagggatgctggccaatttgcatgccgccctgtacaactttgatcaggatacacttgaaatatgctccaaggagcaggagtttaaaagcatccttttttctctctgctacttccacgcctgtgttgctgggagactgaggtttggcccccagggctggagccgaagctatccttttaatcctggagacctcaccatttgtgccagtgtcctctacaactacttagaggcaaactctaaagtcccatgggaagatctccgttatctctttggtgagatcatgtatggaggccacatcacagatgactgggatcgcaaactgtgtcgggtgtatttagaagaattcgtgaatccatctctgactgaagatgaactgatgctggcaccaggttttgctgccccaccctacctagattatgcaggctaccaccagtacatagaggagatgcttcctccagaaagcccggcactgtatggcctccacccaaatgctgaaatagaattcctgacagtgacatccaacactctcttcagaactttgctggagatgcagcccaggaatgcactcagtggtgatgaactggggcagtctacagaagaaaaggttaagaatgtcttggatgacattttggagaaacttccagaagagttcaacatggcagagataatgcaaaaaaattcaaatagaagcccatatgttcttgtttgcttccaagaatgtgagaggatgaatattctcattcgggaaatacgtatatcacttgaacaactggaccttagtttgaagggggaattggcattatctcctgctgtggaagcccagcagtttgcattgagttatgacacggtaccagacacttggagcaaactggcttatccttctacttatggcctagcccagtggttcaatgacctcctcctgcgatgccgagaactcgatacttggacacaagaccttacccttccggctgtcgtgtggctatccggcttcttcaaccctcagtccttcttaactgcaatcatgcagacgatggctcgaaaaaatgagtggcccctggataaaacgcgcttgactgctgatgttaccaaaaaaacaaaggaagattatggacacccgccaagggaaggtgcatacctccacggactcttcatggagggcgcccgctgggacacccaagcaggaaccattgttgaagcccgtctcaaggagctggcatgccctatgccggtcatctttgcaaaagccacccccgtggacagacaagaaaccaaacagacctacgagtgccctgtgtatagaaccaaactgagaggccccagctacatctggaccttcaggctgaagagcgaagagaagactgcaaaatgggttctggctggagtggctctgcttctagaagcgtaaggtaacactggcattcctctagcctctgctggagtgcagtgaggattttctagcatgttgctgcact

SEQ ID NO: 34476 - DNA, 1479 bp, Homo sapiens
ccggcctcgcgttccctcggacggttgcccaatggcagcccaggtggcagcccgggaggcgcgagacttcagagaagccccgacccttcgcctaacctcgggggccggcctggaggcagtgggcgctgtggagctcgaggaggaggaggagaacgaggaggaggcggcggccaggagagcgcggagtttcgcccaagacgcgcgggtgcgcttcctcggcggccgcctggcgatgatgctggggttcacggaggagaaatggagccagtatttggaaagcgaggacaaccggcaggttcttggggagtttctggaaagcaccagcccggcttgccttgtgtttagcttcgccgcctcggggcgccttgcggcttcccaggaggtaagaggcgacgggcaaggggacctgcccatccaacaaaactacccaggggagacagcccagtcgctcccctttggattcccgcggggcgctcactcgggcactttaacaaacctggcttgaagtccccatcctgaggcccgcaggactcctccccacgtgcacccactctgcagttcagcagctgcagattccaagagatgcaaaccataaacttgtttttatttccaagaagattactgaaagcattggagtaaatgacttttctcaagtggttttatttggagagttacctgcgttgtctcttggacatgtatctgctttccttgatgagattttagtgccagttctttctaataagaacaaccataagtcctggtcctgttttacttcacaagatatggaatatcacatagaagtcatgaaaaagaagatgtatatttttaggggcaaaatgtctagaagaactcttctaccaattcccactgttgcaggaaagatggatctggatcagaattgttcagagaacaagccaccgtcaaatgaaaggataatacttcatgcaattgaatctgtggttattgaatggtcacatcaaatccaagaaattatagaaagagattcagtgcagcgtttgttgaatggtcttcacttgtctcctcaagcagaactagatttctggatgatgaggagagaaaatctgtcatgcatttatgatcaacttcaggcacctgttgtcctcaaaatggttaagatcctgacaactaaacaaagcagctattttcctactctgaaggacatttttctggctgtggaaaatggtaagactcttgttcctcagcctggcatcaatatcaccatctgctcatgatccagcccctgcctgctcggccttgatatttacccttccgccatgtttgtggagtgattgctcatggctcttctaatgataaattcatctcaccctttgtactatattctccacccatactaaactacttttagtttatctggtatatagtagtacctgccaaaatggctccagattgaaattttaattagaatgtttgtggaggagtgaggccttcattcggagt

SEQ ID NO: 34477 - DNA, 428 bp, Homo sapiens
aaaaaatacaaaaatttgatgtatatttttaaattaaatctatttttttgttatgtagtcatatcctttctaaccaaaaaataaaaataagaattgatgctggaggcatggtggctgaatttgaaaaaatttacttacaaaaagatacagggccgggcacggtggctcatgcctgtaatcccagcattttgggaggccaaggcgggtggatcatgcagtcaagagattgagatcatcctggctaacgtggtgaaaccctgtttctactaaaaatacaaaaattagccgggtatggtggtgggcacctgtagtcccagctccgtaggaggctgaggcaggagaatcacttgaacctgggaggcggaggttgcagtgagccaagattgtgccactgcactccagcctgggacagagagagactccgtctc

SEQ ID NO: 34478 - DNA, 865 bp, Homo sapiens
cttaagaaacatttattttactttattttggaggaaaagtcttaccctgtcacccaggttgaagtgcagtggcatgatcacagcttactgtaacctcgggctccagacttaagtgatcctactgcctcagcctcccaatgtgctgggattacagatgtgagctaccatgcctggccaatttactttaaaaagaagcatttgtttgtttgtttgtttgaaatgttatgatattttaacatacaatgcatttcatctcatgatagcattttcattgagagggcaaattttataatatccctaggatttatgtaaagttgaataaataataagttgccctacttaattgtatattgctccctcctataaataggttctgtgtgtttagaaacctctgactggaaagatataagtgcaaacttgtcactatagtctgaatgcagaaattgtggggatttttttttcatcccatatacacacattttgtgtgtattatatactagtgaacataaaattacatggtattaaaattatgaatatatactacatttttaaggaactcagtccagtggaaatactaataaacatcagtgataatgcaatgtaataaatgatatagatgaagtgtgtataacaggttcttatacagttcagaattatcctcttgcttcaacacagtgactgcttcacaagatagggtaggaaacatgatttgtgacctgtctgagaaaactcttccacatatctacaaaatttgaatttacactatggtgtatagtaatatatgttggcatacaatattattctatggataaaattaaaatgcatattctattttattctgtaattatataccataaaactattg

SEQ ID NO: 34479 - DNA, 422 bp, Homo sapiens
gcgtcgacgcctgacataaattttaataaatcagtgtgagcaaaagaaaaaaaaatgtacaataataataaaataaaaccgtagtcatttatacttcatgctgtagttctaaaataaaaattctcctttggggctggtgtggtagctcacacctgtaatcccagcactttgggagtctgaggcaggaggattgcttgagcccaggagttcgagaccatcctaggcaacatagtaagaccctgtctctacaaaaaaatgtaaaaaattagctgaacatgatgtcgcgcacctgtggtcctagctattcaggtggctgaggtggaaggactgcttgagcccggaaggtcaaggctgcagtgagccatgatcaagccatgtcactccagcctgggtgacagagtgagaccctgcctcaaaaaaaa

SEQ ID NO: 34480 - DNA, 295 bp, Homo sapiens
agaacaccaatatggcacatgtatacacatgtaacaaacctgcacgttgcgcacatgtaccctaaaacttaaagtataattaaaaaatacctacagctaagatttatattgaatagcaaagtgctgaattttttttcctaaattaagaaataagataagtagtgcattctcactactcttattgattatactattggaagttctagccaattcactaagacaagggaaggaaatgaaaagcatacagatcagaaagtaagaaataaaactgtccttatttgcaaatgcattgatt

SEQ ID NO: 34481 - DNA, 451 bp, Homo sapiens
ataaggcgacagagtggtgaggtctgtggcaaagcatgcacacctgaaagacattcaaattaagcatgagcacaaacagaacaaaaaacactgctcgccaaacaaaaatgtcctagtagactgtgggcccgctctttgcagctcttggctgacagtcaagtggagctcacggttttatggataaacttgtaaaggagtaagtacgtgcctggcggcacctttgctgggaagcagctcttcctgagtcagccgtgacagagcaggcatctcctcctggccctgccctgagtggggcctaaaaagaaaacacagggggctgggcaccatggctcatgcctgtaatcccagcactttgggaggccgaggcaggaggatcgcttgggcctaggagtttgaggccaacctgggcaacatagtgagaccctgtctctacaaaatattaaaaacaaaa

SEQ ID NO: 34482 - DNA, 245 bp, Homo sapiens
gctatttaacttgtatgttttttaataaaattcctttgatttcaataattatttactattgataaatctatttaatatttacatttcttggcacagttttatattggagattgatcgtgataggtattataccaagtaggttgtttggagatttcctttaccttctctttgttatcatgagggtttttctttataagattaaaaaagaaaaattctagaaaattaagacctcagaatttgtagta

SEQ ID NO: 34483 - DNA, 1074 bp, Homo sapiens
cccgtccttcctctcctagcctaaggcgtgcaaacagagcgccactgggaggctgaaacctttaggccgatgcttgcttgcaaggtcaggcaagctggattctggtccccacctttgcagagagaacagcgatgttgtgcgcccatttctcagatcaaggaccggcccatcttactacctccaagagtgcttttctctctaataagaaaacatctactttgaaacatctactgggcgagaccaggagtgatggctcagcctgtaattctggaatttcgggaggccgaggcaggaagattccttgagcacaggagttccagaccagcctgggcaatgtagcaagacgctgtctctatttatacaataaaatttttttaaaaaaggaaaaaaaaaaaaaaaaaaaattgtgtgtggggggatgggccctgggaaaagtttttaaaaccatttggtgggggggcgggggcccaaagggttagggaacacggggaccaacgagcagtgtacacaaggagagcaccgggcgcacaaggaccatagggcgctgggggatatacttccaccaagtttaaaagagagcgccggggggaacacccgaggttttctaaaaacaaattccaagaagagggtcacggagggcaacaaacgggcgctctatacacaggaggaatccaaaaggcggaaggctctgaaagtactaaaaaatataagcccgcggacccaggggtagaggagaaacacagcgacacacggaaggcacaaacgcaagaggcgaaagcagagccaggcgagaagaagacaagacgacaaagaacgaaaggaaacgagcaaggagcaagagaggcaaaaggaagaaggacggaacaacagaagacgaaaaaggaagcgacaacaaaagaaagagaaaagacaagagaaagggcgaaagaacaaagaaaaagaaaaaagacacaaaaagaaaagaagaaacacgagcaaaacagacaagagagggagagagaaaagaaaaaaagaagagagaaggacgagaaaggaccacgaagaagaaacggagaagagagagaggaaaaagac

SEQ ID NO: 34484 - DNA, 600 bp, Homo sapiens
cccgtccttcctctcctagcctaaggcgtgcaaacagagcgccactgggaggctgaaacctttaggccgatgcttgcttgcaaggtcaggcaagctggattctggtccccacctttgcagagagaacagcgatgttgtgcgcccatttctcagatcaaggaccggcccatcttactacctccaagagtgcttttctctctaataagaaaacatctactttgaaacatctactgggcgagaccaggagtgatggctcagcctgtaattctggaatttcgggaggccgaggcaggaagattccttgagcacaggagttccagaccagcctgggcaatgtagcaagacgctgtctctatttatacaataaaatttttttaaaaaaggaaaaaaaacaaaaaaccaaaaaagaaaaaaacagtgtgtgggtcgggcgagacatggggcccccttggaaaaagctcttattatagaaccaatctcgtgggggcggcgggggggccccagttgggttatggtacaacgtgtggcaaaagggtgtcccaaaggaaaaccgcgcgcgagaacaagggcggggttctctcccaataaaaaaaggccgag

SEQ ID NO: 34485 - DNA, 233 bp, Homo sapiens
caggatagagctctcgcccttccctttggctctcagagaggcctaagaaaattgcaacaagagcagaggttggctggtttgaaggtgtggctcatcccacattaccagagagacagttccggagtcggggatagtgctcacgggctgggactttcttctttcttccttcttctcctttttcttctttcttcctttattcctcttcttctgacagggtctcactctgtcgtcca

SEQ ID NO: 34486 - DNA, 543 bp, Homo sapiens
tcagtttgtgatgggtgagcccatacagtgggatccagctcagggtttggtgcagttggcaagatcccaagagggttttctgtgaagggtagaatgagagctgtggcttgagaagaaaccaggcagcaggggagtcccatcgtgtcagggtgtgttactctcccctgagcaccacagagaagacaccaacccctaccagctgtcacgtggccacatgttattagagtcctgctctcctaggtttttccaccctgccccccatcatttccaaggacccaatattattgaaaaagaaaaacatattgcaaaattgaaaagttgtttgctcaccttacactttggtatgtttgtacccatctgtttatgggtgtatgaggcctattggcataagaactgtgtatctgtgtatatagagtactgttgctcattttagcagggataggtggccagaggtcctctcttttggattttcctgggtttagggcttttactcagggtcctaacactggagtggaaggctggcagtgctttcccctcctgccc

SEQ ID NO: 34487 - DNA, 481 bp, Homo sapiens
tgtgccactgcacccatcctgggtgacagagcaagactccatctcaaaaaaaaaaatttagagttaggctggatgcattggctcatgcctgtaaatccctagacattgggaggctgaggccagagttgcccaggagtttgagaccgccctgacaacatattgaggccacatctgtacaaaaaaaaattttttttaaccaggcaaagtggcatgctcgtacagttttagctacgggagtctgaagtcaggtggaacacttaacccaggagtccaaggtttgtagtgggctatgattgtgccactgtacttcagcataggcagtggagtgagaccctgtctcaaaaaggaaataaggatgaggagaacatcttttttgtttttctttttttgttttaaacacttctgtaattcagcattgcaagtttgtgttcttccagacttttatttttcttacactattttaatatcttaagcttattac

SEQ ID NO: 34488 - DNA, 103 bp, Homo sapiens
agcttttgttaagttttctgaaaggtgggtgctgggaaggttgcacttctggacttcctgccttgtgactccacctggtgggaagcccccatgagtggaggtt

SEQ ID NO: 34489 - DNA, 443 bp, Homo sapiens
gacaaatagaattctcaaactccagttaaactttcagaaacgcttgaacttccttgacccaaactattgccttttctcttaatgacagtgaagtcaactccataggtagcccattaactctcaaaatcctggcctcaagtgatctccctctcttggccttccaaagcattgggattacaagcgtgagccacagtgcctggcctagcccattgattctcaacctattaactgatacttagtcatcttatctgcctgggaatgttgctcccattatagactgtcttattacgagctgatatagccaatattgcctatgactggggtgatacgcttggttttgtaaaaactgaggtaaaataggcataacaaaatttagcattttaaccatctttcagtgtatggtccagtggcattaagtacattcacgctgttgtgcccctatc

SEQ ID NO: 34490 - DNA, 422 bp, Homo sapiens
ttttttttgagatggagtctcgctctgtcacccaggctggagcacagtggtgcgatcttggctaactgcaaccttcacctcctgggttcaaacgattcttctgcctcagcctcctgaggagctcggactacaggcgtgcgccaccatgcccagctaatttttgtatttttagtagagatggggtttcaccatattggccaggctggtctcgaactcctgacctcgtgatccgcctgcctcagcctcccaaagtgctggcattataggcgtgagccaccacgccaagccagataattaatattttctaagcatctaagaaaccagtcttcatgaactccctcataaaacatagattaattcacagaaacacttacgtgtctggaaggcctacagtgaaaatatgatagagacagacagtagtc

SEQ ID NO: 34491 - DNA, 1526 bp, Homo sapiens
ggggaggtctggcctgcttttcctccctgaactggcccaatgactggctccctcacgctgaccactcctctgggctggcctcctgcactcgcgctaacagcccaggctccagggacagcctgcgttcctgggctggctgggtgcagctctcttttcaggagagaaagctctcttggaggagctggaaaggtgcccgactccagccatgctggcgctactgtgttcctgcctgctcctggcagccggtgcctcggacgcctggacgggcgaggactcggcggagcccaactctgactcggcggagtggatccgagacatgtacgccaaggtcacggagatctggcaggaggtcatgcagcggcgggacgacgacggcgcgctccacgccgcctgccaggtgcagccgtcggccacgttggacgccgcgcagccccgggtgaccggcgtcgtcctcttccggcagcttgcgccccgcgccaagctcgacgccttcttcgccctggagggcttcccgaccgagccgaacagctccagccgcgccatccacgtgcaccagttcggggacctgagccagggctgcgagtccaccgggccccactacaacccgctggccgtgccgcacccgcagcacccgggcgacttcggcaacttcgcggtccgcgacggcagcctctggaggtaccgcgccggcctggccgcctcgctcgcgggcccgcactccatcgtgggccgggccgtggtcgtccacgctggcgaggacgacctgggccgcggcggcaaccaggccagcgtggagaacgggaacgcgggccggcggctggcctgctgcgtggtgggcgtgtgcgggcccgggctctgggagcgccaggcgcgggagcactcagagcgcaagaagcggcggcgcgagagcgagtgcaaggccgcctgagcgcggcccccacccggcggcggccagggacccccgaggcccccctctgcctttgagcttctcctctgctccaacagacaccttccactctgaggtctcaccttcgcctctgctgaagtctccccgcagccctctccacccagaggtctccctataccgagacccaccatccttccatcctgaggaccgccccaaccctcggagccccccactcagtaggtctgaaggcctccatttgtaccgaaacaccccgctcacgctgacagcctcctaggctccctgaggtacctttccacccagaccctccttccccaccccataagccctgagactcccgcctttgacctgacgatcttcccccttcccgccttcaggttcctcctaggcgctcagaggccgctctggggggttgcctcgagtccccccacccctccccacccaccaccgctcccgcggcaagccagcccgtgcaacggaagccaggccaactgccccgcgtcttcagctgtttcgcatccaccgccaccccactgagagctgctcctttgggggaatgtttggcaacctttgtgttacagattaaaaattcagcaattca

SEQ ID NO: 34492 - DNA, 1296 bp, Homo sapiens
ggggaggtctggcctgcttttcctccctgaactggcccaatgactggctccctcacgctgaccactcctctgggctggcctcctgcactcgcgctaacagcccaggctccagggacagcctgcgttcctgggctggctgggtgcagctctcttttcaggagagaaagctctcttggaggagctggaaaggtgcccgactccagccatgctggcgctactgtgttcctgcctgctcctggcagccggtgcctcggacgcctggacgggcgaggactcggcggagcccaactctgactcggcggagtggatccgagacatgtacgccaaggtcacggagatctggcaggaggtcatgcagcggcgggacgacgacggcgcgctccacgccgcctgccaggtgcagccgtcggccacgttggacgccgcgcagccccgggtgaccggcgtcgtcctcttccggcagcttgcgccccgcgccaagctcgacgccttcttcgccctggagggcttcccgaccgagccgaacagctccagccgcgccatccacgtgcaccagttcggggacctgagccagggctgcgagtccaccgggccccactacaacccgctggccgtgccgcacccgcagcacccgggcgacttcggcaacttcgcggtccgcgacggcagcctctggaggtaccgcgccggcctggccgcctcgctcgcgggcccgcactccatcgtgggccgggccgtggtcgtccacgctggcgaggacgacctgggccgcggcggcaaccaggccagcgtggagaacgggaacgcgggccggcggctggcctgctgcgtggtgggcgtgtgcgggcccgggctctgggagcgccaggcgcgggagcactcagagcgcaagaagcggcggcgcgagagcgagtgcaaggccgcctgagcgcggcccccacccggcggcggccagggacccccgaggcccccctctgcctttgagcttctcctctgctccaacagacaccttccactctgaggtctcaccttcgcctctgctgaagtctccccgcagccctctccacccagaggtctccctataccgagacccaccatccttccatcctgaggaccgccccaaccctcggagccccccactcagtaggtctgaaggcctccatttgtaccgaaacaccccgctcacgctgacagcctcctaggctccctgaggtacctttccacccagaccctccttccactttaattgctgttctcatgggcaaagttaccggaatccagattccttcttgagct

SEQ ID NO: 34493 - DNA, 1984 bp, Homo sapiens
ggatccagagatttagattttttataagctttcctgccaccgaaacgggtgtttgggacctcacgaggccctgttcattcttcgtcgctgcgctccccactctgtactggatgcatttactgacgttgttgtctccgtccccagagtatgaacccccaaggtgactcatgcagctgtgggtgcccggcatacagcatggtgactggaatggatgagcacccaataaacatttgttgcaggaatgcaggaggacgggcaggccagcaagcaggctgcctggtttttcccacatgggcttttctgggaaagaagagcttctatttttggaaagggctgctatgattgagaaaagttcatggcagcaaaaaaaggacagacgtcgggagggaaacactcctagttctcccagacaacacattttttaaaaagactccttcatctctttaataataacggtaacgacaatgacaatgatgattacttatgagtgcggctagtgccagccactgtgttgtcactgggcgagtaatgatctcattggatcttcacggtgggcgtgcggggctccagggacagcctgcgttcctgggctggctgggtgcagctctcttttcaggagagaaagctctcttggaggagctggaaaggtgcccgactccagccatgctggcgctactgtgttcctgcctgctcctggcagccggtgcctcggacgcctggacgggcgaggactcggcggagcccaactctgactcggcggagtggatccgagacatgtacgccaaggtcacggagatctggcaggaggtcatgcagcggcgggacgacgacggcgcgctccacgccgcctgccaggtgcagccgtcggccacgttggacgccgcgcagccccgggtgaccggcgtcgtcctcttccggcagcttgcgccccgcgccaagctcgacgccttcttcgccctggagggcttcccgaccgagccgaacagctccagccgcgccatccacgtgcaccagttcggggacctgagccagggctgcgagtccaccgggccccactacaacccgctggccgtgccgcacccgcagcacccgggcgacttcggcaacttcgcggtccgcgacggcagcctctggaggtaccgcgccggcctggccgcctcgctcgcgggcccgcactccatcgtgggccgggccgtggtcgtccacgctggcgaggacgacctgggccgcggcggcaaccaggccagcgtggagaacgggaacgcgggccggcggctggcctgctgcgtggtgggcgtgtgcgggcccgggctctgggagcgccaggcgcgggagcactcagagcgcaagaagcggcggcgcgagagcgagtgcaaggccgcctgagcgcggcccccacccggcggcggccagggacccccgaggcccccctctgcctttgagcttctcctctgctccaacagacaccttccactctgaggtctcaccttcgcctctgctgaagtctccccgcagccctctccacccagaggtctccctataccgagacccaccatccttccatcctgaggaccgccccaaccctcggagccccccactcagtaggtctgaaggcctccatttgtaccgaaacaccccgctcacgctgacagcctcctaggctccctgaggtacctttccacccagaccctccttccccaccccataagccctgagactcccgcctttgacctgacgatcttcccccttcccgccttcaggttcctcctaggcgctcagaggccgctctggggggttgcctcgagtccccccacccctccccacccaccaccgctcccgcggcaagccagcccgtgcaacggaagccaggccaactgccccgcgtcttcagctgtttcgcatccaccgccaccccactgagagctgctcctttgggggaatgtttggcaacctttgtgttacagattaaaaattcagcaattca

SEQ ID NO: 34494 - DNA, 1436 bp, Homo sapiens
ggggaggtctggcctgcttttcctccctgaactggcccaatgactggctccctcacgctgaccactcctctgggctggcctcctgcactcgcgctaacagcccaggctccagggacagcctgcgttcctgggctggctgggtgcagctctcttttcaggagagaaagctctcttggaggagctggaaaggtgcccgactccagccatgctggcgctactgtgttcctgcctgctcctggcagccggtgcctcggacgcctggacgggcgaggactcggcggagcccaactctgactcggcggagtggatccgagacatgtacgccaaggtcacggagatctggcaggaggtcatgcagcggcgggacgacgacggcgcgctccacgccgcctgccaggtgcagccgtcggccacgttggacgccgcgcagccccgggtgaccggcgtcgtcctcttccggcagcttgcgccccgcgccaagctcgacgccttcttcgccctggagggcttcccgaccgagccgaacagctccagccgcgccatccacgtgcaccagttcggggacctgagccagggctgcgagtccaccgggccccactacaacccgctggccgtgccgcacccgcagcacccgggcgacttcggcaacttcgcggtccgcgacggcagcctctggaggtaccgcgccggcctggccgcctcgctcgcgggcccgcactccatcgtgggccgggccgtggtcgtccacgctggcgaggacgacctgggccgcggcggcaaccaggccagcgtggagaacgggaacgcgggccggcggctggcctgctgcgtggtgggcgtgtgcgggcccgggctctgggagcgccaggcgcgggagcactcagagcgcaagaagcggcggcgcgagagcgagtgcaaggccgcctgagcgcggcccccacccggcggcggccagggacccccgaggcccccctctgcctttgagcttctcctctgctccaacagacaccttccactctgaggtctcaccttcgcctctgctgaagtctccccgcagccctctccacccagaggtctccctataccgagacccaccatccttccatcctgaggaccgccccaaccctcggagccccccactcagtaggtctgaaggcctccatttgtaccgaaacaccccgctcacgctgacagcctcctaggctccctgaggttcctcctaggcgctcagaggccgctctggggggttgcctcgagtccccccacccctccccacccaccaccgctcccgcggcaagccagcccgtgcaacggaagccaggccaactgccccgcgtcttcagctgtttcgcatccaccgccaccccactgagagctgctcctttgggggaatgtttggcaacctttgtgttacagattaaaaattcagcaattca

SEQ ID NO: 34495 - DNA, 1390 bp, Homo sapiens
cgcacggccccctccagccacggggagaaagctttcttggaggagctggaaaggtgcccgactccagccatgctggcgctactgtgttcctgcctgctcctggcagccggtgcctcggacgcctggacgggcgaggactcggcggagcccaactctgactcggcggagtggatccgagacatgtacgccaaggtcacggagatctggcaggaggtcatgcagcggcgggacgacgacggcgcgctccacgccgcctgccaggtgcagccgtcggccacgttggacgccgcgcagccccgggtgaccggcgtcgtcctcttccggcagcttgcgccccgcgccaagctcgacgccttcttcgccctggagggcttcccgaccgagccgaacagctccagccgcgccatccacgtgcaccagttcggggacctgagccagggctgcgagtccaccgggccccactacaacccgctggccgtgccgcacccgcagcacccgggcgacttcggcaacttcgcggtccgcgacggcagcctctggaggtaccgcgccggcctggccgcctcgctcgcgggcccgcactccatcgtgggccgggccgtggtcgtccacgctggcgaggacgacctgggccgcggcggcaaccaggccagcgtggagaacgggaacgcgggccggcggctggcctgctgcgtggtgggcgtgtgcgggcccgggctctgggagcgccaggcgcgggagcactcagagcgcaagaagcggcggcgcgagagcgagtgcaaggccgcctgagcgcggcccccacccggcggcggccagggacccccgaggcccccctctgcctttgagcttctcctctgctccaacagacaccttccactctgaggtctcaccttcgcctctgctgaagtctccccgcagccctctccacccagaggtctccctataccgagacccaccatccttccatcctgaggaccgccccaaccctcggagccccccactcagtaggtctgaaggcctccatttgtaccgaaacaccccgctcacgctgacagcctcctaggctccctgaggtacctttccacccagaccctccttccccaccccataagccctgagactcccgcctttgacctgacgatcttcccccttcccgccttcaggttcctcctaggcgctcagaggccgctctggggggttgcctcgagtccccccacccctccccacccaccaccgctcccgcggcaagccagcccgtgcaacggaagccaggccaactgccccgcgtcttcagctgtttcgcatccaccgccaccccactgagagctgctcctttgggggaatgtttggcaacctttgtgttacagattaaaaattcagcaattca

SEQ ID NO: 34496 - DNA, 214 bp, Homo sapiens
gccaccgcgcccggccctctacaaaaaattttttaaaaattagccagatgtggtggtacgcacttgtcctcccagcttactccataggctgaggtgggaggatcgcttgagcccaagaggctgcagtgaaccatgattatgccactgcactccagcctgggcaacagagtgagactctgtctcaaaaaaaaaaaaaaaatgccggacacagtgc

SEQ ID NO: 34497 - DNA, 310 bp, Homo sapiens
agtgagaggagcatgtgggggtgaagccatctcatacagtactacccttcctaggtgtagagtgaggagatgtgccacggctgttgacccttcttaaactgcagagcgtttgatgtccagggacagttgttggggcagggtcagacttagagcttttgtcttgtgctgagatgtgctcctttttctttcctcccccttccctagctcttggacggctttgccccatcactgattggtgcacacccccttttgagaatctcagggactcagtttggtaaaagcagctggtggagatgatggagagaggagg

SEQ ID NO: 34498 - DNA, 408 bp, Homo sapiens
agacgggtggatcacctgaggtcaggctttcaagaccagcctggccaacagggtgaaaccctgtctctactaaaaatacaaaaattaccttgacgtggcatcctgtctgtaatcccagctacttgggaggctgaagcagaatcgcttgaacctgggaggcagaggttgcagtgagccgagatcacgccacggcactccagcctgggtgccagagcgagacatcatctcaaacaaacaaacaaacaaaaaagttgtcacagtataaataccaatcttagaagattctgacaattattttgaaaatgatagggaaatatcttggttttcctcttctttgcgcatggatacacatcacatattcacatcattaagcatattacaagtggagtagcaaccttatatcaaaat

SEQ ID NO: 34499 - DNA, 393 bp, Homo sapiens
acttgcaccattttacatagaattaaatattccaatcattttcactgcagaatagagacacagcccatactgagaaaggaacaaaattgtttgaagccaacagttttatactcaggcgctccccctgctgggactgtaggggtagtttccatagcaagcaattctctgcagatgttttaacatcagttgtttgattcacaccgttaaatacccactacctaaacatccctgggtatgcatcggacaggggtgtttgggaggagagtaacagtgacaattgagcctgagtccagttcttgaaatcatgacttttaatctcagtgatacctagatggtatattagaaaggcaaatagacaaatcaatatttagctgtttgtgtttttttaaacta

SEQ ID NO: 34500 - DNA, 442 bp, Homo sapiens
ctaaatgccacatgtgtggagcccacagagctgacagggtggcccatcacccgggtggggaacccactccgatacatgtgcatcacgcacctggaccacaaagactacatcttcctgctgctcatcggcttctgcatcttcgccgcgggaactgtggctgcctggctcacaggtgtgtgtgctgtgctctaccagaacacccgccacaagtcgagtgaagaagatgaggacgaggccgggactagggtggaagtcagccggcggatttttcaaacccagacgagctcggtccaggagttccctcagcttatttagttgccagagaccattatcttatgtgcctcccccaggctccctgctttctctcttgccctccccatcccaccaccttggagctgtcatagagattgaaaccttctagtaaaataaataaaatctcaaa

SEQ ID NO: 34501 - DNA, 155 bp, Homo sapiens
aagatctggtcaggtctcctgttaaaccttttgaacttaaacttttcctttctcctttttttctacatgttttactaatttgtgagtttttaatcaaatatgtatgtcattgttcttcattttatttatgcctaaatgcgtcttgtcttcacaca

SEQ ID NO: 34502 - DNA, 3920 bp, Homo sapiens
acagaagaaatagcaagtgccgagaagctggcatcagaaaaacagaggggagatttgtgtggctgcagccgagggagaccaggaagatctgcatggtgggaaggacctgatgatacagaggaattacaacacatatacttagtgtttcaatgaacaccaagataaataagtgaagagctagtccgctgtgagtctcctcagtgacacagggctggatcaccatcgacggcactttctgagtactcagtgcagcaaagaaagactacagacatctcaatggcaggggtgagaaataagaaaggctgctgactttaccatctgaggccacacatctgctgaaatggagataattaacatcactagaaacagcaagatgacaatataatgtctaagtagtgacatgtttttgcacatttccagcccctttaaatatccacacacacaggaagcacaaaaggaagcacagagatccctgggagaaatgcccggccgccatcttgggtcatcgatgagcctcgccctgtgcctggtcccgcttgtgagggaaggacattagaaaatgaattgatgtgttccttaaaggatgggcaggaaaacagatcctgttgtggatatttatttgaacgggattacagatttgaaatgaagtcacaaagtgagcattaccaatgagaggaaaacagacgagaaaatcttgatggcttcacaagacatgcaacaaacaaaatggaatactgtgatgacatgaggcagccaagctggggaggagataaccacggggcagagggtcaggattctggccctgctgcctaaactgtgcgttcataaccaaatcatttcatatttctaaccctcaaaacaaagctgttgtaatatctgatctctacggttccttctgggcccaacattctccatatatccagccacactcatttttaatatttagttcccagatctgtactgtgacctttctacactgtagaataacattactcattttgttcaaagacccttcgtgttgctgcctaatatgtagctgactgtttttcctaaggagtgttctggcccaggggatctgtgaacaggctgggaagcatctcaagatctttccagggttatacttactagcacacagcatgatcattacggagtgaattatctaatcaacatcatcctcagtgtctttgcccatactgaaattcatttcccacttttgtgcccattctcaagacctcaaaatgtcattccattaatatcacaggattaacttttttttttaacctggaagaattcaatgttacatgcagctatgggaatttaattacatattttgttttccagtgcaaagatgactaagtcctttatccctcccctttgtttgattttttttccagtataaagttaaaatgcttagccttgtactgaggctgtatacagccacagcctctccccatccctccagccttatctgtcatcaccatcaacccctcccatgcacctaaacaaaatctaacttgtaattccttgaacatgtcaggcatacattattccttctgcctgagaagctcttccttgtctcttaaatctagaatgatgtaaagttttgaataagttgactatcttacttcatgcaaagaagggacacatatgagattcatcatcacatgagacagcaaatactaaaagtgtaatttgattataagagtttagataaatatatgaaatgcaagagccacagagggaatgtttatggggcacgtttgtaagcctgggatgtgaagcaaaggcagggaacctcatagtatcttatataatatacttcatttctctatctctatcacaatatccaacaagcttttcacagaattcatgcagtgcaaatccccaaaggtaacctttatccatttcatggtgagtgcgctttagaattttggcaaatcatactggtcacttatctcaactttgagatgtgtttgtccttgtagttaattgaaagaaatagggcactcttgtgagccactttagggttcactcctggcaataaagaatttacaaagagctactcaggaccagttgttaagagctctgtgtgtgtgtgtgtgtgtgtgagtgtacatgccaaagtgtgcctctctctcttgacccattatttcagacttaaaacaagcatgttttcaaatggcactatgagctgccaatgatgtatcaccaccatatctcattattctccagtaaatgtgataataatgtcatctgttaacataaaaaaagtttgacttcacaaaagcagctggaaatggacaaccacaatatgcataaatctaactcctaccatcagctacacactgcttgacatatattgttagaagcacctcgcatttgtgggttctcttaagcaaaatacttgcattaggtctcagctggggctgtgcatcaggcggtttgagaaatattcaattctcagcagaagccagaatttgaattccctcatcttttaggaatcatttaccaggtttggagaggattcagacagctcaggtgctttcactaatgtctctgaacttctgtccctctttgtgttcatggatagtccaataaataatgttatctttgaactgatgctcataggagagaatataagaactctgagtgatatcaacattagggattcaaagaaatattagatttaagctcacactggtcaaaaggaaccaagatacaaagaactctgagctgtcatcgtccccatctctgtgagccacaaccaacagcaggacccaacgcatgtctgagatccttaaatcaaggaaaccagtgtcatgagttgaattctcctattatggatgctagcttctggccatctctggctctcctcttgacacatattagcttctagcctttgcttccacgacttttatcttttctccaacacatcgcttaccaatcctctctctgctctgttgctttggacttccccacaagaatttcaacgactctcaagtcttttcttccatccccaccactaacctgaatgcctagacccttatttttattaatttccaatagatgctgcctatgggctatattgctttagatgaacattagatatttaaagctcaagaggttcaaaatccaactcattatcttctctttctttcacctccctgctcctctccctatattactgattgcactgaacagcatggtccccaatgtagccatgcaaatgagaaacccagtggctccttgtggtacatgcatgcaagactgctgaagccagaaggatgactgattacgcctcatgggtggaggggaccactcctgggccttcgtgattgtcaggagcaagacctgagatgctccctgccttcagtgtcctctgcatctcccctttctaatgaagatccatagaatttgctacatttgagaattccaattaggaactcacatgttttatctgccctatcaattttttaaacttgctgaaaattaagttttttcaaaatctgtccttgtaaattactttttcttacagtgtcttggcatactatatcaactttgattctttgttacaacttttcttactcttttatcaccaaagtggcttttattctctttattattattattttcttttactactatattacgttgttattattttgttctctatagtatcaatttatttgatttagtttcaatttatttttattgctgacttttaaaataagtgattcggggggtgggagaacaggggagggagagcattaggacaaatacctaatgcatgtgggacttaaaacctagatgatgggttgataggtgcagcaaaccactatggcacacgtatacctgtgtaacaaacctacacattctgcacatgtatcccagaacgtaaagtaaaatttaaaaaaaagtga

SEQ ID NO: 34503 - DNA, 648 bp, Homo sapiens
  misc_feature (2)..(2): n is a, c, g, or t
  misc_feature (20)..(20): n is a, c, g, or t
  misc_feature (596)..(596): n is a, c, g, or t
  misc_feature (610)..(610): n is a, c, g, or t
  misc_feature (616)..(616): n is a, c, g, or t
gnaattcggccacgagaagnagcagagagagagagagagagagagagagagagagagagagagagagagagagagagagagagagagagagagagagagagagactcgtgccgaattcggcacgagtatggagctggagctgaagtttagcccaattgtttactagttgagtgaatgtggatgattggatgatcatttctcatctctgagcctcaggttccccatccataaaatgggatacacagtatgatctataaagtgggatatagtatgatctacttcactgggttatttgaaggatgaattgagataatttatttcaggtgcctagaacaatgcccagattagtacatttggtggaactgagaaatggcataacaccaaatttaatatatgtcagatgttactatgattatcattcaatctcatagttttgtcatggcccaatttatcctcacttgtgcctcaacaaattgaactgttaacaaaggaatctctggtcctgggtaatggctgagcaccactgagcatttccattccagttggcttcttgggtttgctagctgcaaccaaccaaggcaaccttaaaaaaaatngaaggttttaaacncttttnaaaaaaaaaaaaaaaaaaaaaaacccccgagg

SEQ ID NO: 34504 - DNA, 2035 bp, Homo sapiens
  misc_feature (1974)..(1974): n is a, c, g, or t
  misc_feature (1987)..(1987): n is a, c, g, or t
  misc_feature (1991)..(1991): n is a, c, g, or t
  misc_feature (2015)..(2015): n is a, c, g, or t
  misc_feature (2028)..(2028): n is a, c, g, or t
acagaagaaatagcaagtgccgagaagctggcatcagaaaaacagaggggagatttgtgtggctgcagccgagggagaccaggaagatctgcatggtgggaaggacctgatgatacagaggaattacaacacatatacttagtgtttcaatgaacaccaagataaataagtgaagagctagtccgctgtgagtctcctcagtgacacagggctggatcaccatcgacggcactttctgagtactcagtgcagcaaagaaagactacagacatctcaatggcaggggtgagaaataagaaaggctgctgactttaccatctgaggccacacatctgctgaaatggagataattaacatcactagaaacagcaagatgacaatataatgtctaagtagtgacatgtttttgcacatttccagcccctttaaatatccacacacacaggaagcacaaaaggaagcacagagatccctgggagaaatgcccggccgccatcttgggtcatcgatgagcctcgccctgtgcctggtcccgcttgtgagggaaggacattagaaaatgaattgatgtgttccttaaaggatgggcaggaaaacagatcctgttgtggatatttatttgaacgggattacagatttgaaatgaagtcacaaagtgagcattaccaatgagaggaaaacagacgagaaaatcttgatggcttcacaagacatgcaacaaacaaaatggaatactgtgatgacatgaggcagccaagctggggaggagataaccacggggcagagggtcaggattctggccctgctgcctaaactgtgcgttcataaccaaatcatttcatatttctaaccctcaaaacaaagctgttgtaatatctgatctctacggttccttctgggcccaacattctccatatatccagccacactcatttttaatatttagttcccagatctgtactgtgacctttctacactgtagaataacattactcattttgttcaaagacccttcgtgttgctgcctaatatgtagctgactgtttttcctaaggagtgttctggcccaggggatctgtgaacaggctgggaagcatctcaagatctttccagggttatacttactagcacacagcatgatcattacggagtgaattatctaatcaacatcatcctcagtgtctttgcccatactgaaattcatttcccacttttgtgcccattctcaagacctcaaaatgtcattccattaatatcacaggattaacttttttttttaacctggaagaattcaatgttacatgcagctatgggaatttaattacatattttgttttccagtgcaaagatgactaagtcctttatccctcccctttgtttgattttttttccagtataaagttaaaatgcttagccttgtactgaggctgtatacagccacagcctctccccatccctccagccttatctgtcatcaccatcaacccctcccatgcacctaaacaaaatctaacttgtaattccttgaacatgtcaggcatacattattccttctgcctgagaagctcttccttgtctcttaaatctagaatgatgtaaagttttgaataagttgactatcttacttcatgcaaagaagggacacatatgagattcatcatcacatgagacagcaaatactaaaagtgtaatttgattataagagtttagataaatatatgaaatgcaagagccacagagggaatgtttatggggcacgtttgtaagcctgggatgtgaagcaaaggcagggaacctcatagtatcttatataatatacttcatttctctatctctatcacaatatccaacaagcttttcacagaattcatgcagtgcaaatccccaaaggtaacctttatccatttcatggtgagtgcgctttagaattttggcaaatcatactggtcacttatctcaactttgagatggggnttggccccttggnaggnaaattggaaaagaaaaaagggggnccccccttggtgnggcccac

SEQ ID NO: 34505 - DNA, 801 bp, Homo sapiens
  misc_feature (749)..(749): n is a, c, g, or t
  misc_feature (763)..(763): n is a, c, g, or t
  misc_feature (769)..(769): n is a, c, g, or t
acagaagaaatagcaagtgccgagaagctggcatcagaaaaacagaggggagatttgtgtggctgcagccgagggagaccaggaagatctgcatggtgggaaggacctgatgatacagagtttgataggagacaattaaaggctggaaggcactggatgcctgatgatgaagtggactttcaaactggggcactactgaaacgatgggatggccagagacacaggagatcagttggagcaagctcaataacaaagtggttcaacgaggacttggaattgcatggagctggagctgaagtttagcccaattgtttactagttgagtgaatgtggatgattggatgatcatttctcatctctgagcctcaggttccccatccataaaatgggatacacagtatgatctataaagtgggatatagtatgatctacttcactgggttatttgaaggatgaattgagataatttatttcaggtgcctagaacaatgcccagattagtacatttggtggaactgagaaatggcataacaccaaatttaatatatgtcagatgttactatgattatcattcaatctcatagttttgtcatggcccaatttatcctcacttgtgcctcaacaaattgaactgttaacaaaggaatctctggtcctgggtaatggctgagcaccactgagcatttccattccagttggcttcttgggtttgctagctgcaaccaaccaaggcaaccttaaaaaaaatngaaggttttaaacncttttnaaaaaaaaaaaaaaaaaaaaaaacccccgagg

SEQ ID NO: 34506 - DNA, 361 bp, Homo sapiens
aaggacctgatgatacagaggtctgtaggccatgggaatgggtttggaattttattcaaagagctatgggaagtgactagaaggtttaaagttggggaagaggttttgtgtttctgttatatttgtgttttatacaaattactctggttgctgtgttgataggacagcagaagggtaggagcagggacaccagttaagttattgcaatggttaaggtgagaggtggtggctgggcctaggcctttttggagtgaacaagctatttgcttggcttccatgatccttctccctccactggaatggaaggtacttgatattagagatttttgtctgtttcatcactactgtaaccccaatgtct

SEQ ID NO: 34507 - DNA, 480 bp, Homo sapiens
gctgtaacaaaacaccacagaatggatgatttataaagaaaagacatttacttggctcacagttctggaggctgggaagtccaagatcaaggtgccacatatagtgagggccttcttgctgcatcataacatggtagaaggcatcacatggtgaggaagtacatgcaggagacagaaaaaagggggctgaacttcattcttttatcaggagcccactcctacgataactaaccctctcctgaaacaacagcattaatctattcatgagggcagaaccctcatgacataataacctcataaaggtgcctcctttcaaaactgttacaatggcaattaaatttcaacatgagttttggaggggacattccagatatagcatatggatcctttggaaatgacatgccccaaatgtgtctatattccacgttacaactagttctaacaaccaattatctttctgttgtcttgaaatcttctcaa

SEQ ID NO: 34508 - DNA, 363 bp, Homo sapiens
gcaattcaatgacatttagaaaatttaccaagtggtgctaccatcaccataaaccagttttagaacactttcttcatcccaataagatccttcatggacatggttacttttaataagaactctctcattaaatatcaagtgtgatcaggagagaaacatgggtttcatcaatagataactggaatattttttctttctcaaaaattcttccataactatcctttccattcccgaagaccatcctctgcttcagagcttcatgactccagttccataatactacaaaagtctcacaggtaatatgtctagggacagccaaaccattccttctaactcatggttgtatttaccttcctaaaatcc

SEQ ID NO: 34509 - DNA, 331 bp, Homo sapiens
ctaagcgtctgtatccactgatagcaatgcaacacctagtttatgatgacttgaaagaaaacaaatgcccatgaagaaaaaagctgtattttaattttatctaaatgtactttcagtcaatagttcagtaacattttcctcccaatacaatactccctctctctataaggctattcctgggagccagacaagtttaggtaataagggagttaagagagtaactgcttgcagttttaaatagacaattaactttttgcttccctcttaatgtgctaatagttgtgtctaaaaaaaaaaagtcgacgcggccgcgaatttagtagtagtagta

SEQ ID NO: 34510 - DNA, 722 bp, Homo sapiens
ggtactttaggaatcttatttagtatcatttaaattgggggaggagggaagatgttttactgctagcttcattttatttatttttatttttatttttttaagtttttttgagatggagtctcactctgttgcagtgagccgagattgtgccactgcactccagcctgggcgacagagcaagactccgtctaaaaaaaaaaaaaagatattaaaattaatgacaggaagagtttgggttcagttataatttaagggaaaaaacattgaggggcctaatctacattttgctccggatccaatgatttaatttttgggaagaaaaatccagtgattaaagtcatgcaaggagatggcctggggcttgctaaaagtcaggttgcagtttccattgcattcaagaaaatcagaaaaataaatacaacttttagaagaaactaagttttctcccattcatgtttagctattggggggtctcatacttctggacttgcttagacctatgctatctaatatggtagcctctgcccatccatatgtggccactgagaacttgaaatgtgactagtttgaattaagatgtgctgtaactaaaatacaccctggatttcaaagacttaataaataatgtaaattatctattctttcctgttgattatatattgaaatgataatattttggatatgtttgggttaaataaaatatattactaaaagtaaaaaaa

SEQ ID NO: 34511 - DNA, 988 bp, Homo sapiens
tttcaagccaggtcgacgtgaccatttaaatgttatgctatttcaaagtcttctacatctttagaaaaggacatgagggagggttagttaagtggggcaatgagaatgtagagtgtaatgtgcaaaagcaggactagcagttgctttgaagatatctggggaaggccgggcacggtggttcacgcctgtaatcccagtactttgggaggccaaggtgggcggatcacgaggtcaggagatcgagatcatcctggctaacgtgaaaccccgtctatataaaaatacaaaaaaaaaaaaaaaaaaaaaaattagccgggcgtggtggcgcgtgcctgtaatcccagctacacaggaggctgaggcaggagatttgcttgaacctgggaggcggaggttgcagtgagccgagattgtgccactgcactccagcctgggcgacagagcaagactccgtctaaaaaaaaaaaaaagatattaaaattaatgacaggaagagtttgggttcagttataatttaagggaaaaaacattgaggggcctaatctacattttgctccggatccaatgatttaatttttgggaagaaaaatccagtgattaaagtcatgcaaggagatggcctggggcttgctaaaagtcaggttgcagtttccattgcattcaagaaaatcagaaaaataaatacaacttttagaagaaactaagttttctcccattcatgtttagctattggggggtctcatacttctggacttgcttagacctatgctatctaatatggtagcctctgcccatccatatgtggccactgagaacttgaaatgtgactagtttgaattaagatgtgctgtaactaaaatacaccctggatttcaaagacttaataaataatgtaaattatctattctttcctgttgattatatattgaaatgataatattttggatatgtttgggttaaataaaatatattactaaaagtaaaaaaa

SEQ ID NO: 34512 - DNA, 447 bp, Homo sapiens
tttcaagccaggtcgacgtgaccatttaaatgttatgctatttcaaagtcttctacatctttagaaaaggacatgagggagggttagttaagtggggcaatgagaatgtagagtgtaatgtgcaaaagcaggactagcagttgctttgaagatatctggggaaggccgggcacggtggttcacgcctgtaatcccagtactttgggaggccaaggtgggcggatcacgaggtcaggagatcgagatcatcctggctaacgtgaaaccccgtctatactaaaaatacaaaaaattaaccggacgcagtggtgggcgcctgtagtcccagctactcgggaggctgaggcaggagagtggcatgaacccgggaggcggagcttgcagtgagctgagatcgcaccactgcattccagcctggacaacagagcgaaactccgtctcaaaaac

SEQ ID NO: 34513 - DNA, 569 bp, Homo sapiens
gatggatgtggtcattgccctgatttgaacattacaaattgtgtacatagatcacaacatcacaccacacctcataaatgtgcacaattgttatgcgtccaaacaataataaaaaccaaaaataaaaatgaaacacgtggaaacaggaaaaacgcctttaagaatagagtatagcaaggacttccaaaagcaagtacaggaaagggagggggatgtagctcagtggtagagcgcatgctttgcatgtatgaggccccgggttcgatccccggcatctccattgtagttttgttgctttctgtattcgttttggtccgtggttctttatcattaaagtgccatggatgtgattatcataagcattgtgattccaggcactacttggagctcagattctcacaccaggtgtgatcttcccattctgaaatctctaatgtttcaaatgcacatgagttagaagaggctgatgggagtaatcagcagaaaagtgttaaggcaaaacctgacttgatgactgaaaccacagcaaaagtgagcaggatgatcatttggggagtgtacaccacatc

SEQ ID NO: 34514 - DNA, 483 bp, Homo sapiens
gattcctctcattcttgttccattgtccccggaacatggtcccctttgcccggtgactaccaccaggcacctttcccatcatggggaaggaggagaaatgggacaggaagggctcatcccttcacataaaagccgtggtgcaccagtaagcatttaacaaccagatctctgctggggggcagggagattgattggttgcttttgccagtttccatggtgtacatattcccaccatcgccagtttcaagctaccaacatgaggtaaactgaatgtggagtctggaagggatactcacagtacaggctgggctttgctgctctggcacgtcactgttttaagagctccatctacacattgcctctttcacttccaccaacatctccagaattagacacctgtctgcaagggaggctggggaatgtagtttttcgttgacattaagtccagtggccaggtggcccagctacaaactgaaggttctt

SEQ ID NO: 34515 - DNA, 404 bp, Homo sapiens
agtcttttgagagtcgacgacttgatgtctcttttatctctaaaaacttcagtgtcctaaagacaagattactttcttacataaccacactatagttaccaaaatcaggaaattagggctggctgcggtggctcacgcctgtaatcccagtactttgggagaccaaggcaggcagatcacctgaggtccggagcctggccaggccatgagcctggccaacatggtgaaaccctgggtctactaaaaatacaaaaattagccggacgtggtagcgggtgcctatagcccaagatactcaggaggctgaggcaggagaaccgcatgaacctgggaggcggaggttgcagtgagctgagatcacaccattgcactccagcctgggtgacagagcgagactccatctg

SEQ ID NO: 34516 - DNA, 486 bp, Homo sapiens
agtttagagaggtatatacttttttatggagaaatttgtcagtgttacatgtccagtggagttgagttgggaagactgaagttatatcagtcacttcaatcaaattgttagtggtgagacatgggtttgtttgtaagtgccatgatgagctgctctatatttgtggacatgagcttttgggatgtacaatcacattttataagaaaaaatggaataatttggatggaatatactttataaaatgaagctattgaaataaccagtttatatgagaaatcagatatttcagaattgttttgtaaatgtgattgttgacacctacttgggccaccttcttggcagtaaggtgtgctaatttctgacccttttttctgtctgttatgtccctggtcatgagctggaaaaaaattctaaggtgtttcttcacaaccttctgaataatgaggtaatgatttttctccacagctgatgtatttctataaataa

SEQ ID NO: 34517 - DNA, 1272 bp, Homo sapiens
aaaggttgagtggttaaagaggattgtctagtgttattgtctaagactggttccaacacacaccttggacatctggaataagtcctgaacccctgctttagtacttttgaacaaactgattctctctgcctacaattcccatttcttactgaactgctcagtaagacccgaaaagcccattccaaatccatctcacttatgtaagaaattataagactggacttttatcaaaaggttcttttcagtttacaggttttgtgagtctgcaaataaaaatatgaccctgctgggtgtggtgactcacacctgtaatctcagcactttgagagcccgaggcaggaggatgacttgagaccagcctgttcaacatagcaaaaccccatgtctaccaaaaataaaaaatagctgggtgtggttgtttgtgcctgtagtgccagctgagatcaaaggatcccttgagcgatgatggcaccactgcactccagcttgagtgacagagtgagacgccatctctaaaaaaaattaaaatacgagcagagaagtgttattctccactgaaactttctttgctttagtgccccaaatatgttaaataccagtataaggaatgagacagataatgtcttatttcatgtttattgtgagctctcattatattatctgtaccagttttgaacctctttagttaccatcctgtttagttggtaagaaataggaggcaaaaaggtaatagtcacatttaaatgacttagtaattaaaagaactaaattattcatagttgagtcattatctgttcagatctgcagtgttcttataataataggaaacatttatgtaatactatgtgttagataatgttttacctatattaacttatcctcacaatagcactgaggtgtttttatagataggcaactaaagcaaagagaagatagtaaatataccaaaggtcatgtagctactacatggtagtactgagtgtcagagaagacaagatcaaaatctgtaatctaacatttattgagaacctactgtgtaccagccccacagctgggtgctttcattatgagttagtcatttgtctttacaactaccttatttaaaatggaagttcagcatgtaatgacttgctcagagtcacagataagtaaactgtggaatcaggatttgaacccatgcttgtcgtacttcaaggttcctgttctttctttcattttccttcagtgatcaaatctttattaaacaccttctgtgtgccacacactgtgcca

SEQ ID NO: 34518 - DNA, 133 bp, Homo sapiens
gacccacttctaatgtacatcttccacattttacctgtttctttttccggtaatggctacctgcgttgcctccaacaccattaccactacaaataatgctgcagtgaaaccattaatatctgctctttattgt

SEQ ID NO: 34519 - DNA, 978 bp, Homo sapiens
atgaattcctcatttcacctgcatttcttggatctcaacctgaatgccacagagggcaacctttcaggacccaatgtcaaaaacaagtcttcaccatgtgaagacatgggcattgctgtggaggtgtttctcactctgggtgtcatcagcctcttggagaacatcttggtcataggggccatagtgaagaacaaaaacctgcactcccccatgtacttcttcgtgtgcagcctggcagtggcggacatgctggtgagcatgtccagtgcctgggagaccatcaccatctacctactcaacaacaagcacctagtgatagcagacgcctttgtgcgccacattgacaatgtgtttgactccatgatctgcatttccgtggtggcatccatgtgcagcttactggccattgcagtggataggtacgtcaccatcttctacgccctgcgctaccaccacatcatgacggcgaggcgctcaggggccatcatcgccggcatctgggctttctgcacgggctgcggcattgtcttcatcctgtactcagaatccacctacgtcatcctgtgcctcatctccatgttcttcgctatgctgttcctcctggtgtctctgtacatacacatgttcctcctggcgcggactcacgtcaagcggatcgcggctctgcccggggccagctctgcgcggcagaggaccagcatgcagggcgcggtcaccgtcaccatgctgctgggcgtgtttaccgtgtgctgggccccgttcttccttcatctcactttaatgctttcttgccctcagaacctctactgctctcgcttcatgtctcacttcaatatgtacctcatactcatcatgtgtaattccgtgatggaccctctcatatatgccttccgcagccaagagatgcggaagacctttaaggagattatttgctgccgtggtttcaggatcgcctgcagctttcccagaagggattaa

SEQ ID NO: 34520 - DNA, 503 bp, Homo sapiens
gggaattgagaaaaagcagtaagctcaagtatccgtttcttttacacaaggaaaactcgcctttgcccaaagtgttctatgaaacaactgcacttttgaaatgatgcttcgcttcctaattggatgtgtggtttggccagaacagcctcctcagtagccctcccagagtaatccctggaaactaggttgcccgagaatctcatcccttcctccaccctgcccggccctaagccaaggcctccacctggaagagcagtgacgtaaatggcccttactgagattcatctgaaatcatcccaggcagggagggcacatttgccgcatatgaaaaaatgaacccaaagaaggggaggaaaaggtcactctttagggcaactggaggaatgaacaggaagcttttaactagtggtttcaattagcactgatattatttcctgaacagttctctagtgcatcctttttaaattgctgacaggtgtgtttgtgtttcatgacagactttt

SEQ ID NO: 34521 - DNA, 642 bp, Homo sapiens
ctttcagtctgttacttgcctttttagttcctaatgacatctttggataagcagaattttttaattttgatgaagtatagtttatcttatttttccattatatattttgtgtcttttgtatcctcactaagaaatcttttcttaccctaggttatagaaatattcatctttgttttcttctagaagctttatttatcttttggtgtatgttccatcacaaatttttgagtgtgatatgaggtaagggtagaggttcattttctccatatgtttatctagtcgttccagcactatttgttgaaagaccttactttctccattgaatgtccctggcacctccgttgaaaatcagttgcttgagggccaggtgcagtagctcacacctgtaatcccagcactttggggggatgaggcgggtggatcacgaggtcaggagttcaagaccagcctggccaatatggtgaaaccccgtctctactaaaaatacaaaaagtagccaggtatggtggtgggcacctgtaatcccagctacatgggaggccgaggcaggagaatagcttgaacctgggaggcggaggttgcagtgagctgagatcgcgccactgcactccagcctgggagacagagtgagactccacctca

SEQ ID NO: 34522 - DNA, 327 bp, Homo sapiens
cttctttgactgtgtagaataaacatgcatacagttgtctttgaagtcgttagctcacattgaaaagaaaaagtttagaagaaattaaatatataattttgggggaaaatttatctataattttagctcatagtttacaattcctatatgactgtttggaaggtatttattttagaatggatggatgttccgtattaacctgtaggaagggtttgtgaatattctgttgctctgaattattagcggtctagatctaggctggactttgagaaatatgaaataaaaaaatacctctttggagtgtggtgttgctctttaaaaaaaaaa

SEQ ID NO: 34523 - DNA, 857 bp, Homo sapiens
gtgtgtgagggggcctaaaatgggtccacatcccccatgagacgccccgcgccttggttgcgccacgaccctgtcccatttgccttcaagttttcctttgcttgagtattagtatggttgcacgacatgagattttctgaggaccactgaccaaaccatactaacagatgtggtttattcatgaccctttaagaaaaaattttagtatcatgttgattagtacttgacaaagccagtgtgaaactactattacatctaatctgccacactcttaaggtctcatatgtaaaataatggagttaaagcaggacactgaagttgcctgcagttttaaaatctataaacccaggatcttttatgaagtagtttcattttaagacatttgcccaaccttctctcaactgtcaaatcttttcaatttttaattgtgaaataattttaaacttacagaaaagtttcaatagcaaagtcttgtatattttttctcccagattctctaatgattagtattttaccacatttttcctatcatctctaaatacacacaccaacacacacagacatacatatgcactcacttttttccaaaaccatttgtgagtcagtaatacattactcctaatacttcagtactggctttccaaaacaaggctattccctcatataacaggacaaccatcatggggaaattaacattgatatatcattactatttaatccacagaactcattcaaatttctccaattgccctaatacctccaaatcattttccctcgtataaggaggtaggtaaaaatgaaaaattttcagtccgcagtccggcctgggcgacagagcgagactccgtctcaaaaaa

SEQ ID NO: 34524 - DNA, 456 bp, Homo sapiens
aataagaaaggaaaaaacactatttcttgctgaccttaaaataacgctttcacaaacaaggccatgcttttaatgctttgcgtcacatggacactatgttgcccaatgagacatgatacatctttgatagtgaactttacactaaatggacaaagtaataattatattgtactaaattatacataatggttaattgtgttgttgaaattcttcaagcagcactaacagggaccactagctggaactatttcattattctgtagagatctaggaaggaacttaaaatatagtgttccatatcttgccattttttaaaaaaccaaccagccatttttaattagaacacataacctgtttcagtctaggccttcaagttttcctttgcttgagtattagtatggttgcacgacatgagattttctgaggaccactgaccaaaccatactaacagatgtg

SEQ ID NO: 34525 - DNA, 1221 bp, Homo sapiens
gtatcaggagtctagctgctggaggatgggacagctgtgctgggtcttcagggcatttctgctgcgaatgcggctctccaggcccttcacttctattctggattttattccctccattaaggagagtttaaaaataaaagaaagcttctgagagtaaacattttgctcctaagctgaagggaatgcacagctatttagtaagtgataagtttcttattttgaggacttgactcccatttgctctcagtgaccccagggcagagccagagaagtgttccgtacccactgctgatggtttcccagagcccacactgagttgaagaacctattgttcttcttggcatccttcttatgctacttctcccatcgctcaaaggggttgcctatgctgggtgtgccctgccctaaatgcagcaccactttcaagcttagtaggaccattccaagaaaaccaggtttcttctccccataccacgttgtgcctgaagaacaagccttcccgtccttgcctgcatgtgagtcacttcttggctgtgcagcaggtccccccctccccgcgatatgctggagggtaggattctgcagcctgtgttgctctctacctggcagcagactgtgcaggagccccaacctgtcctccaattccagcattcacagctgatgagcagtgcaggagcagggcgagaggaacagagccaatgatgtgtgggttacactgaggagccaaggacagggcctcaggtctcccccttacaaggcgtggctcatggcctgcattccagagaccaacatgatagcttttaattcagctgcatgacctgtgccttttaagccataaagatacctcaagcctagcacctcttgaaatccagatgttcatattagactcgaaaaaataggctccaggcctaggtgcccaggctatgatgagtctgcttttgaaggaggtagggaatgacatcttccttggacccaaagcttaaaagtaatgtatgctttgctgaccactgtttgttaggccttaaacaacattcactgtggtggtatcaggcacactgctatgtgcatcaattatttttttgctttccaaacagaatctctggggcacaagttttacactcaagctaagtataactttgtcatttcaggtaaatatgacaagtggtggagcatgaagttttctaatttgacttaatcctaataaatttttgttacaaagta

SEQ ID NO: 34526 - DNA, 781 bp, Homo sapiens
ggatggcgttcagaggatccccgctattctcggcactcttcacgtcgggtattgggaggaggaacaacccccatgttgacttggcttcagatcagagtgggcgtggacctggatgaaaatctgaaggaggacccctcctcacaacaccaggaagcaaataacttggataaaaacatgacgaaagcagagagtgctcggctcttcagaatgtggtatagctttgaccacaagtatctgaaaccaattttaacccactctggtcctccgctgactacaacattacctgaatggtgtggtccgatttccaggctgcttaccagtcctcaagcctatggggaacagctaaaagaggatgatgtggaatgcattgtaaaccaggatgaactagccataaattaccaggagcaagcctcctcaccctgcagtcctcctgcaaggctaggtctggaccagaaagcttcaccccagacgccaggcaaggaaaacatttatgagggagacctcggcctgggaggctatgaactcaagcttgagcaaactttgggtcaatcccagttgaattaattggcatgaagagtacagatgtaatcacaagtaatgcaagactcactgaggaatacaagccaagctgatgaggcagtacaggggagaggctggaaaacatattaagagcataaattggagagaatcaaagccttgtcacatggatcctctggtgcctgaagaaatgagattttattatccctctctattatgcaaatgaatttagttttttgacagc

SEQ ID NO: 34527 - DNA, 679 bp, Homo sapiens
ggacctggatgaaaatctgaaggaggacccctcctcacaacaccaggcaagtcaaataacttggataaaaacatgacgaaagcagagagtgctcggctcttcagaatgtggtatagctttgaccacaagtatctgaaaccaattttaacccactctggtcctccgctgactacaacattacctgaatggtgtggtccgatttccaggctgcttaccagtcctcaagcctatggggaacagctaaaagaggatgatgtggaatgcattgtaaaccaggatgaactagccataaattaccaggagcaagcctcctcaccctgcagtcctcctgcaaggctaggtctggaccagaaagcttcaccccagacgccaggcaaggaaaacatttatgagggagacctcggcctgggaggctatgaactcaagcttgagcaaactttgggtcaatcccagttgaattaattggcatgaagagtacagatgtaatcacaagtaatgcaagactcactgaggaatacaagccaagctgatgaggcagtacaggggagaggctggaaaacatattaagagcataaattggagagaatcaaagccttgtcacatggatcctctggtgcctgaagaaatgagattttattatccctctctattatgcaaatgaatttagttttttgacagc

SEQ ID NO: 34528 - DNA, 1047 bp, Homo sapiens
ggatggcgttcagaggatccccgctattctcggcactcttcacgtcgggtattgggaggaggaacaacccccatgttgacttggcttcagatcagagtgggcgtggacctggatgaaaatctgaaggaggacccctcctcacaacaccaggaagcaaataacttggataaaaacatgacgaaagcagagagtgctcggctcttcagaatgtggtatagctttgaccacaagtatctgaaaccaattttaacccactctggtcctccgctgactacaacattacctgaatggtgtggtccgatttccaggctgcttaccagtcctcaagcctatggggaacagctaaaagaggatgatgtggaatgcattgtaaaccaggatgaactagccataaattaccaggagcaagcctcctcaccctgcagtcctcctgcaaggctaggtctggaccagaaagcttcaccccagacgccaggcaaggaaaacatttatgagggagacctcggcctgggaggctatgaactcaagcttgagcaaactttgggtcaatcccagttgaattaattggcatgaagagtacaaggcgtggctcatggcctgcattccagagaccaacatgatagcttttaattcagctgcatgacctgtgccttttaagccataaagatacctcaagcctagcacctcttgaaatccagatgttcatattagactcgaaaaaataggctccaggcctaggtgcccaggctatgatgagtctgcttttgaaggaggtagggaatgacatcttccttggacccaaagcttaaaagtaatgtatgctttgctgaccactgtttgttaggccttaaacaacattcactgtggtggtatcaggcacactgctatgtgcatcaattatttttttgctttccaaacagaatctctggggcacaagttttacactcaagctaagtataactttgtcatttcaggtaaatatgacaagtggtggagcatgaagttttctaatttgacttaatcctaataaatttttgttacaaagta

SEQ ID NO: 34529 - DNA, 870 bp, Homo sapiens
  misc_feature (9)..(9): n is a, c, g, or t
  misc_feature (14)..(14): n is a, c, g, or t
atctgaagnccgtnaaaattggtttcagatacttgtggtcaaagctataccacgtatctgaaaccaattttaacccactctggtcctccgctgactacaacattacctgaatggtgtggtccgatttccaggctgcttaccagtcctcaagcctatggggaacagctaaaagaggatgatgtggaatgcattgtaaaccaggatgaactagccataaattaccaggagcaagcctcctcaccctgcagtcctcctgcaaggctaggtctggaccagaaagcttcaccccagacgccaggcaaggaaaacatttatgagggagacctcggcctgggaggctatgaactcaagcttgagcaaactttgggtcaatcccagttgaattaattggcatgaagagtacaaggcgtggctcatggcctgcattccagagaccaacatgatagcttttaattcagctgcatgacctgtgccttttaagccataaagatacctcaagcctagcacctcttgaaatccagatgttcatattagactcgaaaaaataggctccaggcctaggtgcccaggctatgatgagtctgcttttgaaggaggtagggaatgacatcttccttggacccaaagcttaaaagtaatgtatgctttgctgaccactgtttgttaggccttaaacaacattcactgtggtggtatcaggcacactgctatgtgcatcaattatttttttgctttccaaacagaatctctggggcacaagttttacactcaagctaagtataactttgtcatttcaggtaaatatgacaagtggtggagcatgaagttttctaatttgacttaatcctaataaatttttgttacaaagta

SEQ ID NO: 34530 - DNA, 945 bp, Homo sapiens
ggacctggatgaaaatctgaaggaggacccctcctcacaacaccaggcaagtcaaataacttggataaaaacatgacgaaagcagagagtgctcggctcttcagaatgtggtatagctttgaccacaagtatctgaaaccaattttaacccactctggtcctccgctgactacaacattacctgaatggtgtggtccgatttccaggctgcttaccagtcctcaagcctatggggaacagctaaaagaggatgatgtggaatgcattgtaaaccaggatgaactagccataaattaccaggagcaagcctcctcaccctgcagtcctcctgcaaggctaggtctggaccagaaagcttcaccccagacgccaggcaaggaaaacatttatgagggagacctcggcctgggaggctatgaactcaagcttgagcaaactttgggtcaatcccagttgaattaattggcatgaagagtacaaggcgtggctcatggcctgcattccagagaccaacatgatagcttttaattcagctgcatgacctgtgccttttaagccataaagatacctcaagcctagcacctcttgaaatccagatgttcatattagactcgaaaaaataggctccaggcctaggtgcccaggctatgatgagtctgcttttgaaggaggtagggaatgacatcttccttggacccaaagcttaaaagtaatgtatgctttgctgaccactgtttgttaggccttaaacaacattcactgtggtggtatcaggcacactgctatgtgcatcaattatttttttgctttccaaacagaatctctggggcacaagttttacactcaagctaagtataactttgtcatttcaggtaaatatgacaagtggtggagcatgaagttttctaatttgacttaatcctaataaatttttgttacaaagta

SEQ ID NO: 34531 - DNA, 671 bp, Homo sapiens
gttcttattttggtataaatctgaggttcttttgattcaagaagacgtaggatagttttctgccaaatcttttctcagattcacattgtgtttgggttaggtcatctgacacacaagactgtctcattccttctgcagcaggggattgaccagtttttggttttgtttaacagagttggcgtggacctggatgaaaatctgaaggaggacccctcctcacaacaccaggcaagtcaaagaaaccaatgcacattatatagagatatgattgttctgttccataggctgttccatgtttgtccagcatgtgaccaaggagctatttctaaacggagcttcctctgctgataaaacaaatgagattacaataaaatacaagggaattcagggtgttgataacttctagcatatgaatgcttagaactagcatgtacttgcaagcctctctatggcagcaggaagtctggaaactttacaaagtatatgatggctcttggaatgaggcacttcatagttcaaatccctacccagcaacttgctagctagccaactcagtgaaatttacacaaagtatgtccaatgcatgttgcacaaacaacaaattgacttatttctcctggatagcttctcatttatcaggtctaaggcccaaaaaactgtctaggtgatcc

SEQ ID NO: 34532 - DNA, 1147 bp, Homo sapiens
acagaaattaggccgggcgcggtggcttatgcctgtaatcccagcactttgggatgccgaggcgggcggatcacgaggtcaggcgatcgagaccattctggctaacacagtgaaaccccgtctctactaaacatacaaaaaattatccgggcgtggtggcacgcgcctgtagtcccagctactcaggaggctgaggtgggaggatcgattgaacccaggaggcagaggttttagggagctgagatcatgccactgcactccagtctgggaggcagaccgtcttaaataagccagccagcccgtgccagatcgacagaatctagaagtgagtactaggcgactatttttagaagtcatcaagtgtttcttttgtgaagccagtgttgctgttcactgacagtgtaatggattcattcattggcactgccctgttggctgtatcaaaaggtgaaaagtgtcaccttgaaattaaggattacaggcatgagccatcacacctggtgtgcctaacccttaaatgttggtgggctcccgagttctcttaccacacatgctccctggactcttcactcctggtttctgttattgctgtatatcccagacctccgcctccagtccttgttcatctcatttggaccattgctcatgctacctattccctgctgtgaaatttcctctcctcaaatccatccactatgccaacttcagagcaactagtcactcatttacaccctttttcccaaaaggagctaaggcagttttcctgggtataaaaataccagatgatataaaatagaaggtaaggaaaaaacaaaaaaacaaaaaccaagggcaatggcctaaaatgcagcctggaagtcttatacttgatccaggtaggccccgaatctacactgtctagcagatggagcacaaagataatttccagcagttctatggggcatggtacgcagatgaagacagcacttgtacaaaaaaaagctagctattccaggactgggaccaggaccagacaaagtcccagtcccttcccatggcccttaaggctctgcagacctgggccctccctcttagcctccaagcctgtcatctgtgtaccatctcccaacatgagctgatgtcttctcacatagacacaggcactgca

SEQ ID NO: 34533 - DNA, 444 bp, Homo sapiens
tttcctttttttaaaatttgagacagcacatatagccagtttcaatgtaccacagattctatcaaggttgccagaggaattttccagcctgcaaacagtggaaggcagcaatgtatgctgggaagagtactggctatggccagataaacctgtgttcagattttagctctgccacctatcatagatttatgatacttccattaagttatttaacctctctgagccagtttttctgcctctgcaaaatggaactaataaatccccccttttagattttcaggatgagatggggttatatgccaagtaaagtgtcagctaaatcacaggtattgagtaattgctcatgagagctcctaacatagatactaagtttgaaggggcatatctagtatataaaacatctatgttgggccgggcgcggtggctcacgcctgtaatcccagc

SEQ ID NO: 34534 - DNA, 295 bp, Homo sapiens
tctcactaagccgcccaggctggtctccaaactcctgcctcaagcaatcctcacaaagggcttggcctcccaaagtgctaggattataggcatgtgccaccatgcctggcctaaaaatggattcttaaaaggaaaacaaatgcccacattaactttttagtgagaataggaaggaaaagcaaatttaatctataaactgctccatatgttacataacaatagaagcattttgcctgtaatcccagcaatttgggaggccgaggcgggaggatcacctgaggtcaggagttcgaga

SEQ ID NO: 34535 - DNA, 490 bp, Homo sapiens
ctctcctatcaatgtttggaaacattattcatgattgcttagctttttatgtgttttctgtttaacatattcaacaagaaggagctgtgctttctgtttttacatcccatagagacctgtacattgatctgtcatatattttatgtcttttaaaatcatctttttttattattgaatagatataaaagtatcttcataggccgggtgcagtgctcatgcctgtaagctcagcattttgggaggccaaggcaggcagatcatttgaacccaggagttcaagaccagctgggcaacatggtaaaaccttgtccatacaaaaaaaaagtttttaaaaattagctgggcatggtggcacttgcctgtatacccaacttctgaggaggctgaggtgggaggatcacttgagcccaacaggttgaggctgcagtaagacatgatcatgccactgcgtcccagcctagactacagagcaagaccctgtttcaaaaaa

SEQ ID NO: 34536 - DNA, 384 bp, Homo sapiens
ttttttttttttgagatggagtctcgctgtcacccaggctggagtgcaatggcacgatctcggctcactgaaacctccacctcccaggttcaagcaattcttctgcctcagcctccggagtagctgggattacaggcgtgcaccaccacaccgggctaatttttgtatttttagtagagatagggtttcaccatcttggccaggctggtcttgaactcctgacctcgtgatccacccgcctcagcctcccaaagtgctgggattacaggcacgagccactgcgcccagccaaaacaggagattcttaagccagtaatgagaaaactttttcaaacaaggtccaattttagagggggcggtggggcagggaggtggctttactga

SEQ ID NO: 34537 - DNA, 473 bp, Homo sapiens
gcaataatgccttctgtaagcatggcgtctctgtaagacttttataatgtctacttaaatgcaagcagacaaaattagttttcactttagattggaagacctttctccattgcaactttttggcctctctttttgttctgctccccaagagcaatgtaaatgttgctctttgttttgctaaaagaggaatgtttatttttacaagtaccatgccacttccatatgatctacatggtatgtgtcatgaatataatttctgtatgattggccaaatttttcacttttaattaagatgaccagacaaaaatttgaattgtaagaaaattatgggccaatttagtgcctgttgaaatgtacactggatattgaaatgttctacagagcataatgaatgaaagtaaaaaggctctatctcttttctgaagcctacttgaaaattttgctttcataacatgacattgaaaaagatacta

SEQ ID NO: 34538 - DNA, 600 bp, Homo sapiens
  misc_feature (599)..(599): n is a, c, g, or t
gaggattccccatcatcattgttgccaagtgaccccaaatattcctatcctgtctgttgtaaaaaggaaaaatcatgtcttggaagaacagcatcgccctacagatacagactaggcactttgcacatgaaacaagagtcccagaaatttctagaagcaaatctcgcattcgtgaccgccagacctacgggatgtgtaaggcacattctcaatctcatcacttgtgagagttgcattgcctagtccagcagccgtgaaggactctctgctgtttttcctctgcttcatttgacacatgagagagaagagatgaagatggaggcgggccctgccccggggacatgtatatctctctgaatgtccttgacagacagcagcagcccagcaatgcccagcccccatcctgtctgtatgcaccctggtgagcattttctacagtctcctaaacgctcccattattctgttttgcaggtgtgatgtgtggcacctcagtgttgtcatagcttctgcctcctccgtgtggagagagggcataaagacagagctgagatattatggctattccagaaaataaaatattttttgaaaccaaaaaaaana

SEQ ID NO: 34539 - DNA, 315 bp, Homo sapiens
  misc_feature (314)..(314): n is a, c, g, or t
gcggccgcctactactactactgctcgaattcaagcttctaacgatgtacggggacatgtatatctctctgaatgtccttgacagacagcagcagcccagcaatgcccagcccccatcctgtctgtatgcaccctggtgagcattttctacagtctcctaaacgctcccattattctgttttgcaggtgtgatgtgtggcacctcagtgttgtcatagcttctgcctcctccgtgtggagagagggcataaagacagagctgagatattatggctattccagaaaataaaatattttttgaaaccaaaaaaaana

SEQ ID NO: 34540 - DNA, 347 bp, Homo sapiens
gcagtatcgaatgctgtaggagtcaagaagagggcattagagagtttagaaggccactggtgggccaggcatgatggctgacgcctgtaatcccagcactttggtgggaggccaaggcgggcagatcacttgaggtcaggagttcgagaccagcctggccagcatggtgaaaccccgtctctactgaaaatacaaaacttagccaggcatgatggcgggcgcctgtaatcccagctacctgggaggctgaggcaggagaatcgcttgaacctgggaggcagaggttgctgtgagcaaggattgtgccactgcactccagcctgggtgacagagtgagactccatctc

SEQ ID NO: 34541 - DNA, 335 bp, Homo sapiens
gaactcctggggtaaagtgatccgcctgcctcagcctcccaaagtgttgggattacagggatgagatacagctactggccaggagacacattcatgctttgaaaggagacatgaatggtccttctccctcacacatttcctttgagtgtatgtgtttgtttctacccagttcatttccacatataatttgaggctaacagagccatctatatagatctgtgatgccagggagcctggggcagaagatgaaggctggaatggggtgagggtgctttaggaaggagagagggagctaagggccacagcactgcttgcagtgtctaaatgaatggccg

SEQ ID NO: 34542 - DNA, 688 bp, Homo sapiens
gtcatcacaactggggcttcagatgccccatccttgcactcccacccggcttttgttgtttactccaggaggcagctcttggaggtcacccaggatgctggcggcagcatggaggaaggggtacaatagagaggggaggcagggctccgggactgggctccgactgaaatcactgaagagcgtgggtttcctcttagtccccaagcccctctgaatatgagtttctccatcctgaaaaccactgggctgctaccaaacatttgttgagtattggaggcctggaatatatagtgaggaaaggaggaagaagggataacagtcatctgcagaggggaaccaaggtgccctgagaacctagagcctccttaggaggcaggaataggcctgggtcctgagccctctccagggctcaagctttgctagcttgcttacgagaactatggtttgtctacacagagtgtatggtagcaatgataacagtgaacacttagcccttacaatatgccttgtactgtattaaaagatttacctatatattaatttatttaacctttacaaaatactatcatccccgttttatagatgagcaaactgaaatacagagaggttaagttaaacaactgagccaagttcacactgcactccaacctggcgctccaacagagcgagactccatctcaaaaaaaaa

SEQ ID NO: 34543 - DNA, 826 bp, Homo sapiens
atcccatttataagaaatattcagaataggtaaatccatagagacaaaaggagttttgtagttgccaggagttggaggcaagaagagtttaacaggtatgcttaatggggcctcctatgcagttgacgaaaatgttttgggctagataggagtgatggttgcataacattgtactaaatgccactgaattctactctttaaaatttttagttttatgttatgtggcgtgtaccctaaaaaaaaaaatagaggtgcagtgctccagcacgggatgaggcagcgtggacaggagcatctcccaacctcagtgaagtctgagccgcgtgcctgcaacaatcccactgtggcagagaaccgcagagttccttccggtttggcagcagtcattcgcaacctcacagccctctggaaccccagcctgggggtctcagaacgccgaggcggggactgggagccgagtcggattccgagactatgggccagggttggctggattcagttacctggctgaggcctggtgagcaaaatatcccaaacctcgcgtgatctggaaggggaagccggataaatacggatctccagatgtgccagtctcgagtctatcgatatgaggtccccctagagtttctattcatcattttaaccgcatttcatcgatcttgagacacggcttttgatattttatcacctcaagataaatagtgttagatgtctaatagcagcgtttttctaagagatacatgaaacaacagtgtcagaaacgatgctgtcttccatgcgatgaaattgttgtaataggtgctcaataaatgttgacaataaaaaa

SEQ ID NO: 34544 - DNA, 2883 bp, Homo sapiens
cccggcgggccggcgcgcggccgcgtttgaatggccctgagtgggactcggcccagaagccgagggactctctaggctgccgggcgctggtcgtcagcgccgaggctgggctgaggcgccgcggtaccatgaggcgccggtacttaagagattatggcatcagaaacccacaatgttaaaaaacggaacttttgtaataagattgaggatcatttcattgatcttcctagaaaaaagatctctaatttcactaataagaacatgaaggaggttaagaaatctccaaaacagttggctgcttacataaatagaacagttggacaaactgtgaaaagcccagataaacttcgtaaagtgatctatcgcagaaagaaagttcatcatccctttccaaatccttgttacagaaaaaaacagtcccctggaagtgggggctgtgacatggcaaataaagaaaatgaactggcttgtgcaggccacctgcctgaaaaattacaccatgatagtcgaacatatttggttaactccagtgattctggttcttcacagacagaaagcccatcatcaaaatatagtgggtttttttctgaggtttctcaggaccatgaaacaatggcccaagttttgttcagcaggaatatgagattgaatgtagctttaactttctggagaaagagaagtataagtgaacttgtagcttatttgttgaggatagaagatcttggcgttgtggtagattgccttcctgtgctcaccaattgtttacaggaagaaaaacaatatatctcacttggctgctgtgttgacttgttgcctctagtaaagtcactacttaaaagcaaatttgaagaatatgttatagttggtttaaactggcttcaagcagtcattaaaaggtggtggtcagaactatcatccaaaacagaaattataaatgatggaaatattcaaattttaaaacaacaattaagtggattatgggaacaggaaaaccatcttactttggttccaggatatactggtaatatagctaaggatgtagatgcttatttattacagttacattgagagatttcatctactaaagagcatttggtttttcaaaacatccctgaactgtataatttacaaaaaaaaaagtctcgtctgagaactgtgaactgtggaagaaatcaaaactattttttcttttaaaaagccacgtaatgaaaccactaatgaaatcccagcaatctgcttcacattgaagtggaaaaatatccaaaaggagcagcttcaatttcattgaggtgaaagtgcactatgaagattgttcacctttgctgcatttgggagttatatggttatttggtaacattaagaactactggattttaatgcaatcctgcataaaaatataatttatactatgtgaaaaaataagacaggacttaccactaggaaccaccaagaccaatcatcattaacttttttaagattgtgttttattaaaaaaaaaaaacacttaaatgtgtgcagctattttcttatgttgaaaagactgaaagtttaaaacatgaaaaaaatcaatattaaacattttttgttcacactgagatactgtgtatgtaaaatgccttaattattaataagccaatgtgttatgataccaatatctgttttaaaaaactaaaaccaaccatgcttctggcatgataaaatcatggaattaaatcaggggtttacattcttgtagagtgttcttgaaacactctctgcaccatttttaaaacttgagaatagttttagtatctctgatattttttgccagaatcatcatgtcatgtatgaatgtgttatccctatctaaggaaaaaggtgaatatgtttttgtatgaatgtttaactggaaatgtccatggacttggctaatttatatttactttttattgtacatagatttctaatatttttcattcctgtatcatttaaacttccttcatttgagtaaattcactaaatatttctattttttgcttttttaaattctgattttatatgaattctaattctttttcactacatatgttttaaagagttacatacagtgatttagaatggtttacagttaatgctgatcttgtattttaaattccaacactttgtgtcactacctcctctaatggttagtatgatatgctagcagactgtatgaggtctttttttaaaataccacttttagtgtcagtgaaccaaattctggaatgtcttaacagctctaaatcttacttgtcttgaaaatgattggggtttaataccactgctggtggttcacacatcatcccatccttaatatgcctgacaggcatctgagcaaaggtttttagtaattgaatttctctgcagtagtccttcaagcacttgaatgtaaacctttagcatttattcgtttaatgactactgatacgaatctcaagcagatttcttgctcttaaaagttatgtttcactgagttctggttttgtgtagctatattttatatagctagatattcctcacagtgaacatgaattgtaataattggttatttccttaagtctttagattataataatttcagattattgcacgtctgtgatttgagaggtgagttatttaagaggccagttttcaggacatgggaatttgaattgtaaacctgttatctctgtgaaacttttaacatgataaaatataacctttctttgtgcttaaaaaaaaaaggaacaaaacacacttggggggcccggccagaaatttttaaacatcttggccccgcccgagaagagaagggctttttcagaaccgctcttgttgctttccaaaaagccggccgtctacaaacacggggggggccaaagcaag

SEQ ID NO: 34545 - DNA, 717 bp, Homo sapiens
gaaaatgttgtggtcttcttactcccagaatggcctttaatattttttttttaaaagcattctggttattatgtctgtcttcatttttatttggcataaaatgtcatcctttacattgtcttccagataatttgtaatttcccttttacttttctcttcaactcagaattaagatttttaaaattctatttatttctaattttagtggattacaatcaccaaatatagcctattaatttctgtttaaaaacttttaaaggatttcatatggttctttttcatttaagaaaataaattctttttacagaacagttggacaaactgtgaaaagcccagataaacttcgtaaagtgatctatcgcagaaagaaagttcatcatccctttccaaatccttgttacagaaaaaaacagtcccctggaagtgggggctgtgacatggcaaataaagaaaatgaactggcttgtgcaggccacctgcctgaaaaattacaccatgatagtcgaacatatttggttaactccagtgattctggttcttcacagacagaaagcccatcatcaaaatatagtgggtttttttctgaggtttctcaggaccatgaaacaatggcccaagttttgttcagcaggaatatgagattgaatgtagctttaactttctggagaaagagaagtataagtgaacgagcctcagataaagcaaagatggattcca

SEQ ID NO: 34546 - DNA, 451 bp, Homo sapiens
cccggcgggccggcgcgcggccgcgtttgaatggccctgagtgggactcggcccagaagccgagggactctctaggctgccgggcgctggtcgtcagcgccgaggctgggctgaggcgccgcggtaccatgaggcgccggtaagtgactgccgagccggtgcgagccccgcgcccgcagctgccctgccctggcagggctactccagccgggcttggccgcgccctgggcccacctgcaggccccgcggcggcctcggctcggccgggctcgcggcagcgctgccgggtcccggggcggggcggcaaggccggggcggagcccctctgccggtccctgcggggagagtcgggcagcgggcgctggggggctccaggggactgggccgggagaggcgtggaccgaacctgttgtcacttatttatcttcgggtggagtcgacagctgcacct

SEQ ID NO: 34547 - DNA, 2826 bp, Homo sapiens
cccggcgggccggcgcgcggccgcgtttgaatggccctgagtgggactcggcccagaagccgagggactctctaggctgccgggcgctggtcgtcagcgccgaggctgggctgaggcgccgcggtaccatgaggcgccggtacttaagagattatggcatcagaaacccacaatgttaaaaaacggaacttttgtaataagattgaggatcatttcattgatcttcctagaaaaaagatctctaatttcactaataagaacatgaaggaggttaagaaatctccaaaacagttggctgcttacataaatagaacagttggacaaactgtgaaaagcccagataaacttcgtaaagtgatctatcgcagaaagaaagttcatcatccctttccaaatccttgttacagaaaaaaacagtcccctggaagtgggggctgtgacatggcaaataaagaaaatgaactggcttgtgcaggccacctgcctgaaaaattacaccatgatagtcgaacatatttggttaactccagtgattctggttcttcacagacagaaagcccatcatcaaaatatagtgggtttttttctgaggtttctcaggaccatgaaacaatggcccaagttttgttcagcaggaatatgagattgaatgtagctttaactttctggagaaagagaagtataagtgaacttgtagcttatttgttgaggatagaagatcttggcgttgtggtagattgccttcctgtgctcaccaattgtttacaggaagaaaaacaatatatctcacttggctgctgtgttgacttgttgcctctagtaaagtcactacttaaaagcaaatttgaagaatatgttatagttggtttaaactggcttcaagcagtcattaaaaggtggtggtcagaactatcatccaaaacagaaattataaatgatggaaatattcaaattttaaaacaacaattaagtggattatgggaacaggaaaaccatcttactttggttccaggatatactggtaatatagctaaggatgtagatgcttatttattacagttacattgagagatttcatctactaaagagcatttggtttttcaaaacatccctgaactgtataatttacaaaaaaaaaagtctcgtctgagaactgtgaactgtggaagaaatcaaaactattttttcttttaaaaagccacgtaatgaaaccactaatgaaatcccagcaatctgcttcacattgaagtggaaaaatatccaaaaggagcagcttcaatttcattgaggtgaaagtgcactatgaagattgttcacctttgctgcatttgggagttatatggttatttggtaacattaagaactactggattttaatgcaatcctgcataaaaatataatttatactatgtgaaaaaataagacaggacttaccactaggaaccaccaagaccaatcatcattaacttttttaagattgtgttttattaaaaaaaaaaaacacttaaatgtgtgcagctattttcttatgttgaaaagactgaaagtttaaaacatgaaaaaaatcaatattaaacattttttgttcacactgagatactgtgtatgtaaaatgccttaattattaataagccaatgtgttatgataccaatatctgttttaaaaaaattcttgtagagtgttcttgaaacactctctgcaccatttttaaaacttgagaatagttttagtatctctgatattttttgccagaatcatcatgtcatgtatgaatgtgttatccctatctaaggaaaaaggtgaatatgtttttgtatgaatgtttaactggaaatgtccatggacttggctaatttatatttactttttattgtacatagatttctaatatttttcattcctgtatcatttaaacttccttcatttgagtaaattcactaaatatttctattttttgcttttttaaattctgattttatatgaattctaattctttttcactacatatgttttaaagagttacatacagtgatttagaatggtttacagttaatgctgatcttgtattttaaattccaacactttgtgtcactacctcctctaatggttagtatgatatgctagcagactgtatgaggtctttttttaaaataccacttttagtgtcagtgaaccaaattctggaatgtcttaacagctctaaatcttacttgtcttgaaaatgattggggtttaataccactgctggtggttcacacatcatcccatccttaatatgcctgacaggcatctgagcaaaggtttttagtaattgaatttctctgcagtagtccttcaagcacttgaatgtaaacctttagcatttattcgtttaatgactactgatacgaatctcaagcagatttcttgctcttaaaagttatgtttcactgagttctggttttgtgtagctatattttatatagctagatattcctcacagtgaacatgaattgtaataattggttatttccttaagtctttagattataataatttcagattattgcacgtctgtgatttgagaggtgagttatttaagaggccagttttcaggacatgggaatttgaattgtaaacctgttatctctgtgaaacttttaacatgataaaatataacctttctttgtgcttaaaaaaaaaaggaacaaaacacacttggggggcccggccagaaatttttaaacatcttggccccgcccgagaagagaagggctttttcagaaccgctcttgttgctttccaaaaagccggccgtctacaaacacggggggggccaaagcaag

SEQ ID NO: 34548 - DNA, 4994 bp, Homo sapiens
cccggcgggccggcgcgcggccgcgtttgaatggccctgagtgggactcggcccagaagccgagggactctctaggctgccgggcgctggtcgtcagcgccgaggctgggctgaggcgccgcggtaccatgaggcgccggtacttaagagattatggcatcagaaacccacaatgttaaaaaacggaacttttgtaataagattgaggatcatttcattgatcttcctagaaaaaagatctctaatttcactaataagaacatgaaggaggttaagaaatctccaaaacagttggctgcttacataaatagaacagttggacaaactgtgaaaagcccagataaacttcgtaaagtgatctatcgcagaaagaaagttcatcatccctttccaaatccttgttacagaaaaaaacagtcccctggaagtgggggctgtgacatggcaaataaagaaaatgaactggcttgtgcaggccacctgcctgaaaaattacaccatgatagtcgaacatatttggttaactccagtgattctggttcttcacagacagaaagcccatcatcaaaatatagtgggtttttttctgaggtttctcaggaccatgaaacaatggcccaagttttgttcagcaggaatatgagattgaatgtagctttaactttctggagaaagagaagtataagtgaacttgtagcttatttgttgaggatagaagatcttggcgttgtggtagattgccttcctgtgctcaccaattgtttacaggaagaaaaacaatatatctcacttggctgctgtgttgacttgttgcctctagtaaagtcactacttaaaagcaaatttgaagaatatgttatagttggtttaaactggcttcaagcagtcattaaaaggtggtggtcagaactatcatccaaaacagaaattataaatgatgggtgagtatacctttaaagataaactcatgctgaaattttcttcaggaaagcagcttgattaaactaggtaataattttatcccattatcatcagtgtatggtatttattctttttatattcagagagatactaacttaagagactgttcatttgtgaaaaccacacctggaaattgaattccagagcctactaacctcctgtatctcttcttctggcacaaccctacccttcattttagaagaaaaacacaatagtggtttaattctcatattcattatgagtaagggaggaaaaagagatgcccacagtgtaataaggaatggaggcaccctgcggggtcctttacctagacattaacctgagagtccggtgttgatgtttacacttctaaaaactgtattattactgccttgatgtgaaaattcgtgggtattctaccagagtatagccagattatcatgaaaccacagaaaaatatctcccaacagtttccttaaagtccataattttgggccaggcacggtggctgatgcctgtctgtaatcccagcactttgggaggccaagaagggcaaatcacttgagctcacaagtttgagacagcctgggcaacatgatgacatcccgtctctacaaaaaatacaaaaattagccaggcatggtggtgtgcgcctgtagtcccagctactcaggctgaggcaggaggatcgcttgagcccaggaggtggaggttgcagtaagccgagatggcaccactgcactccagcctgggcaatagagccagcccttgtctcaaaaaaaaaaaaaaaaaagccacaatttattttgtaggctctcaaaattttctacttcacaccaaggaatgtccaaatgttccaaacgcctggtcattttcttacctgctttgacaactaaataacctttaattttctttttttttttaattgaaatcaagtaagaaattttattaattttggaattgaaaaaacatcctttgttgtttccaagaattaattaaataggaggcatttggcggtattatgtggataaacctttaattttcatgactgacatgtattattctaaaagttatttgacttttttttaatttctctccacgttcccaaatgttttatttcaaatagcatcattttctcctgaaaaatacctgaaaaattttagaacagtttttattatgcatatttatgatgaaagtttgtatcttaatgtatttgctttctcatttttcttccttttttttcttttagaaatattcaaattttaaaacaacaattaagtggattatgggaacaggaaaaccatcttactttggttccaggatatactggtaatatagctaaggtcctctgcgtgtaactgtgaccttggcagcaagcacaggaattggccattgaacatgtttcatgtacagcccctgaaatgctatgctagaggatatttacagagggttttaatcagagaaaagtatttgaaaaaattttgagaatccaataaggacagcatcagaaaacaagacgaggaactcaggaaacactgggattacaggcgtgagccactgcgcctggcctatagaattcttaatgatgaaaatcttatgaacatatcaatctcctagaaagtttttgttgttgttttaggtttttagagcatacatgacgtattaccttgctctaaagggttgttgcattctgtatagaagaactaaaaaatgattgttccttatgactgaaatttgctttcaatcagaattttttttgttgtttttgttttgagactgaatctcgctctcacttcagcctggtgacagagcaagactctgtctcaaaaaaaaaagagaaagaaattgaaagaggctattgtcaagctgggctcaagtgaatatagcactgatagtaaacagcactgatagaatttctgtgaatgttagctatgaaagcagagttgtttgagcataggaaccaacacattcatttagcacttagcaaatatatattgagcacatactatgtgccaggccctgtgctgaacaaatgcagataaaagcactgaacaaggcacgtcttttaccctcaaaaggtcacaaaaggaaactaaggcaaattaagcaacaacaaaaaaaaatggattgtttatgtttgtatttactgtactgtctaatgaaatgtttttgttttatcttctaaggatgtagatgcttatttattacagttacattgagagatttcatctactaaagagcatttggtttttcaaaacatccctgaactgtataatttacaaaaaaaaaagtctcgtctgagaactgtgaactgtggaagaaatcaaaactattttttcttttaaaaagccacgtaatgaaaccactaatgaaatcccagcaatctgcttcacattgaagtggaaaaatatccaaaaggagcagcttcaatttcattgaggtgaaagtgcactatgaagattgttcacctttgctgcatttgggagttatatggttatttggtaacattaagaactactggattttaatgcaatcctgcataaaaatataatttatactatgtgaaaaaataagacaggacttaccactaggaaccaccaagaccaatcatcattaacttttttaagattgtgttttattaaaaaaaaaaaacacttaaatgtgtgcagctattttcttatgttgaaaagactgaaagtttaaaacatgaaaaaaatcaatattaaacattttttgttcacactgagatactgtgtatgtaaaatgccttaattattaataagccaatgtgttatgataccaatatctgttttaaaaaactaaaaccaaccatgcttctggcatgataaaatcatggaattaaatcaggggtttacattcttgtagagtgttcttgaaacactctctgcaccatttttaaaacttgagaatagttttagtatctctgatattttttgccagaatcatcatgtcatgtatgaatgtgttatccctatctaaggaaaaaggtgaatatgtttttgtatgaatgtttaactggaaatgtccatggacttggctaatttatatttactttttattgtacatagatttctaatatttttcattcctgtatcatttaaacttccttcatttgagtaaattcactaaatatttctattttttgcttttttaaattctgattttatatgaattctaattctttttcactacatatgttttaaagagttacatacagtgatttagaatggtttacagttaatgctgatcttgtattttaaattccaacactttgtgtcactacctcctctaatggttagtatgatatgctagcagactgtatgaggtctttttttaaaataccacttttagtgtcagtgaaccaaattctggaatgtcttaacagctctaaatcttacttgtcttgaaaatgattggggtttaataccactgctggtggttcacacatcatcccatccttaatatgcctgacaggcatctgagcaaaggtttttagtaattgaatttctctgcagtagtccttcaagcacttgaatgtaaacctttagcatttattcgtttaatgactactgatacgaatctcaagcagatttcttgctcttaaaagttatgtttcactgagttctggttttgtgtagctatattttatatagctagatattcctcacagtgaacatgaattgtaataattggttatttccttaagtctttagattataataatttcagattattgcacgtctgtgatttgagaggtgagttatttaagaggccagttttcaggacatgggaatttgaattgtaaacctgttatctctgtgaaacttttaacatgataaaatataacctttctttgtgcttaaaaaaaaaaggaacaaaacacacttggggggcccggccagaaatttttaaacatcttggccccgcccgagaagagaagggctttttcagaaccgctcttgttgctttccaaaaagccggccgtctacaaacacggggggggccaaagcaag

SEQ ID NO: 34549 - DNA, 3069 bp, Homo sapiens
cccggcgggccggcgcgcggccgcgtttgaatggccctgagtgggactcggcccagaagccgagggactctctaggctgccgggcgctggtcgtcagcgccgaggctgggctgaggcgccgcggtaccatgaggcgccgctcgccctctgtaggctgcatccactgtccagccagtcccagtgagatgaaccaggtacctcagttggaaatgcagaaatcacccgtcttctgtgttgatcaccctgggagctgcagaccggagctgttcctattataatggccatcttggaatggacttgccatctctacttcttgatgtccttggtacttaagagattatggcatcagaaacccacaatgttaaaaaacggaacttttgtaataagattgaggatcatttcattgatcttcctagaaaaaagatctctaatttcactaataagaacatgaaggaggttaagaaatctccaaaacagttggctgcttacataaatagaacagttggacaaactgtgaaaagcccagataaacttcgtaaagtgatctatcgcagaaagaaagttcatcatccctttccaaatccttgttacagaaaaaaacagtcccctggaagtgggggctgtgacatggcaaataaagaaaatgaactggcttgtgcaggccacctgcctgaaaaattacaccatgatagtcgaacatatttggttaactccagtgattctggttcttcacagacagaaagcccatcatcaaaatatagtgggtttttttctgaggtttctcaggaccatgaaacaatggcccaagttttgttcagcaggaatatgagattgaatgtagctttaactttctggagaaagagaagtataagtgaacttgtagcttatttgttgaggatagaagatcttggcgttgtggtagattgccttcctgtgctcaccaattgtttacaggaagaaaaacaatatatctcacttggctgctgtgttgacttgttgcctctagtaaagtcactacttaaaagcaaatttgaagaatatgttatagttggtttaaactggcttcaagcagtcattaaaaggtggtggtcagaactatcatccaaaacagaaattataaatgatggaaatattcaaattttaaaacaacaattaagtggattatgggaacaggaaaaccatcttactttggttccaggatatactggtaatatagctaaggatgtagatgcttatttattacagttacattgagagatttcatctactaaagagcatttggtttttcaaaacatccctgaactgtataatttacaaaaaaaaaagtctcgtctgagaactgtgaactgtggaagaaatcaaaactattttttcttttaaaaagccacgtaatgaaaccactaatgaaatcccagcaatctgcttcacattgaagtggaaaaatatccaaaaggagcagcttcaatttcattgaggtgaaagtgcactatgaagattgttcacctttgctgcatttgggagttatatggttatttggtaacattaagaactactggattttaatgcaatcctgcataaaaatataatttatactatgtgaaaaaataagacaggacttaccactaggaaccaccaagaccaatcatcattaacttttttaagattgtgttttattaaaaaaaaaaaacacttaaatgtgtgcagctattttcttatgttgaaaagactgaaagtttaaaacatgaaaaaaatcaatattaaacattttttgttcacactgagatactgtgtatgtaaaatgccttaattattaataagccaatgtgttatgataccaatatctgttttaaaaaactaaaaccaaccatgcttctggcatgataaaatcatggaattaaatcaggggtttacattcttgtagagtgttcttgaaacactctctgcaccatttttaaaacttgagaatagttttagtatctctgatattttttgccagaatcatcatgtcatgtatgaatgtgttatccctatctaaggaaaaaggtgaatatgtttttgtatgaatgtttaactggaaatgtccatggacttggctaatttatatttactttttattgtacatagatttctaatatttttcattcctgtatcatttaaacttccttcatttgagtaaattcactaaatatttctattttttgcttttttaaattctgattttatatgaattctaattctttttcactacatatgttttaaagagttacatacagtgatttagaatggtttacagttaatgctgatcttgtattttaaattccaacactttgtgtcactacctcctctaatggttagtatgatatgctagcagactgtatgaggtctttttttaaaataccacttttagtgtcagtgaaccaaattctggaatgtcttaacagctctaaatcttacttgtcttgaaaatgattggggtttaataccactgctggtggttcacacatcatcccatccttaatatgcctgacaggcatctgagcaaaggtttttagtaattgaatttctctgcagtagtccttcaagcacttgaatgtaaacctttagcatttattcgtttaatgactactgatacgaatctcaagcagatttcttgctcttaaaagttatgtttcactgagttctggttttgtgtagctatattttatatagctagatattcctcacagtgaacatgaattgtaataattggttatttccttaagtctttagattataataatttcagattattgcacgtctgtgatttgagaggtgagttatttaagaggccagttttcaggacatgggaatttgaattgtaaacctgttatctctgtgaaacttttaacatgataaaatataacctttctttgtgcttaaaaaaaaaaggaacaaaacacacttggggggcccggccagaaatttttaaacatcttggccccgcccgagaagagaagggctttttcagaaccgctcttgttgctttccaaaaagccggccgtctacaaacacggggggggccaaagcaag

SEQ ID NO: 34550 - DNA, 3304 bp, Homo sapiens
agcactctgtaaaatgggccaatcagcagcacatgggcggggtcaaataagggaataaaagctggccacctagccctagtggcaaccggctcgggtcatcttccacaccgtggaaactttgttctttccgtcttcacaataaatcttgctgttgctcactgtttgggtccgcatcacctttaagagctggaacacttgccacgaaggtcctccggcttcattcttgaattcggccagactacgaacccaccggaaggaagaaactccggacacatcggaaggaacaaactctggaccacgaacccaccagagggaagaaactctggacacaccatttttgagagctgtaacagcgtgaaggtccacgacttcattcttgagtggttataaactgttttcaccttcaagattcttgagagataactacacataccctttgccatagtgggaatgactgtgtagtagtaactggaggagaaagtttctttgtacacaactatgctttgattttcaagaggaggaatgaaattgcctcgtaaaattacagagttaaatacaatgtacttaagagattatggcatcagaaacccacaatgttaaaaaacggaacttttgtaataagattgaggatcatttcattgatcttcctagaaaaaagatctctaatttcactaataagaacatgaaggaggttaagaaatctccaaaacagttggctgcttacataaatagaacagttggacaaactgtgaaaagcccagataaacttcgtaaagtgatctatcgcagaaagaaagttcatcatccctttccaaatccttgttacagaaaaaaacagtcccctggaagtgggggctgtgacatggcaaataaagaaaatgaactggcttgtgcaggccacctgcctgaaaaattacaccatgatagtcgaacatatttggttaactccagtgattctggttcttcacagacagaaagcccatcatcaaaatatagtgggtttttttctgaggtttctcaggaccatgaaacaatggcccaagttttgttcagcaggaatatgagattgaatgtagctttaactttctggagaaagagaagtataagtgaacttgtagcttatttgttgaggatagaagatcttggcgttgtggtagattgccttcctgtgctcaccaattgtttacaggaagaaaaacaatatatctcacttggctgctgtgttgacttgttgcctctagtaaagtcactacttaaaagcaaatttgaagaatatgttatagttggtttaaactggcttcaagcagtcattaaaaggtggtggtcagaactatcatccaaaacagaaattataaatgatggaaatattcaaattttaaaacaacaattaagtggattatgggaacaggaaaaccatcttactttggttccaggatatactggtaatatagctaaggatgtagatgcttatttattacagttacattgagagatttcatctactaaagagcatttggtttttcaaaacatccctgaactgtataatttacaaaaaaaaaagtctcgtctgagaactgtgaactgtggaagaaatcaaaactattttttcttttaaaaagccacgtaatgaaaccactaatgaaatcccagcaatctgcttcacattgaagtggaaaaatatccaaaaggagcagcttcaatttcattgaggtgaaagtgcactatgaagattgttcacctttgctgcatttgggagttatatggttatttggtaacattaagaactactggattttaatgcaatcctgcataaaaatataatttatactatgtgaaaaaataagacaggacttaccactaggaaccaccaagaccaatcatcattaacttttttaagattgtgttttattaaaaaaaaaaaacacttaaatgtgtgcagctattttcttatgttgaaaagactgaaagtttaaaacatgaaaaaaatcaatattaaacattttttgttcacactgagatactgtgtatgtaaaatgccttaattattaataagccaatgtgttatgataccaatatctgttttaaaaaactaaaaccaaccatgcttctggcatgataaaatcatggaattaaatcaggggtttacattcttgtagagtgttcttgaaacactctctgcaccatttttaaaacttgagaatagttttagtatctctgatattttttgccagaatcatcatgtcatgtatgaatgtgttatccctatctaaggaaaaaggtgaatatgtttttgtatgaatgtttaactggaaatgtccatggacttggctaatttatatttactttttattgtacatagatttctaatatttttcattcctgtatcatttaaacttccttcatttgagtaaattcactaaatatttctattttttgcttttttaaattctgattttatatgaattctaattctttttcactacatatgttttaaagagttacatacagtgatttagaatggtttacagttaatgctgatcttgtattttaaattccaacactttgtgtcactacctcctctaatggttagtatgatatgctagcagactgtatgaggtctttttttaaaataccacttttagtgtcagtgaaccaaattctggaatgtcttaacagctctaaatcttacttgtcttgaaaatgattggggtttaataccactgctggtggttcacacatcatcccatccttaatatgcctgacaggcatctgagcaaaggtttttagtaattgaatttctctgcagtagtccttcaagcacttgaatgtaaacctttagcatttattcgtttaatgactactgatacgaatctcaagcagatttcttgctcttaaaagttatgtttcactgagttctggttttgtgtagctatattttatatagctagatattcctcacagtgaacatgaattgtaataattggttatttccttaagtctttagattataataatttcagattattgcacgtctgtgatttgagaggtgagttatttaagaggccagttttcaggacatgggaatttgaattgtaaacctgttatctctgtgaaacttttaacatgataaaatataacctttctttgtgcttaaaaaaaaaaggaacaaaacacacttggggggcccggccagaaatttttaaacatcttggccccgcccgagaagagaagggctttttcagaaccgctcttgttgctttccaaaaagccggccgtctacaaacacggggggggccaaagcaag

SEQ ID NO: 34551 - DNA, 3062 bp, Homo sapiens
cccggcgggccggcgcgcggccgcgtttgaatggccctgagtgggactcggcccagaagccgagggactctctaggctgccgggcgctggtcgtcagcgccgaggctgggctgaggcgccgcggtaccatgaggcgccgtggttataaactgttttcaccttcaagattcttgagagataactacacataccctttgccatagtgggaatgactgtgtagtagtaactggaggagaaagtttctttgtacacaactatgctttgattttcaagaggaggaatgaaattgcctcgtaaaattacagagttaaatacaatgtacttaagagattatggcatcagaaacccacaatgttaaaaaacggaacttttgtaataagattgaggatcatttcattgatcttcctagaaaaaagatctctaatttcactaataagaacatgaaggaggttaagaaatctccaaaacagttggctgcttacataaatagaacagttggacaaactgtgaaaagcccagataaacttcgtaaagtgatctatcgcagaaagaaagttcatcatccctttccaaatccttgttacagaaaaaaacagtcccctggaagtgggggctgtgacatggcaaataaagaaaatgaactggcttgtgcaggccacctgcctgaaaaattacaccatgatagtcgaacatatttggttaactccagtgattctggttcttcacagacagaaagcccatcatcaaaatatagtgggtttttttctgaggtttctcaggaccatgaaacaatggcccaagttttgttcagcaggaatatgagattgaatgtagctttaactttctggagaaagagaagtataagtgaacttgtagcttatttgttgaggatagaagatcttggcgttgtggtagattgccttcctgtgctcaccaattgtttacaggaagaaaaacaatatatctcacttggctgctgtgttgacttgttgcctctagtaaagtcactacttaaaagcaaatttgaagaatatgttatagttggtttaaactggcttcaagcagtcattaaaaggtggtggtcagaactatcatccaaaacagaaattataaatgatggaaatattcaaattttaaaacaacaattaagtggattatgggaacaggaaaaccatcttactttggttccaggatatactggtaatatagctaaggatgtagatgcttatttattacagttacattgagagatttcatctactaaagagcatttggtttttcaaaacatccctgaactgtataatttacaaaaaaaaaagtctcgtctgagaactgtgaactgtggaagaaatcaaaactattttttcttttaaaaagccacgtaatgaaaccactaatgaaatcccagcaatctgcttcacattgaagtggaaaaatatccaaaaggagcagcttcaatttcattgaggtgaaagtgcactatgaagattgttcacctttgctgcatttgggagttatatggttatttggtaacattaagaactactggattttaatgcaatcctgcataaaaatataatttatactatgtgaaaaaataagacaggacttaccactaggaaccaccaagaccaatcatcattaacttttttaagattgtgttttattaaaaaaaaaaaacacttaaatgtgtgcagctattttcttatgttgaaaagactgaaagtttaaaacatgaaaaaaatcaatattaaacattttttgttcacactgagatactgtgtatgtaaaatgccttaattattaataagccaatgtgttatgataccaatatctgttttaaaaaactaaaaccaaccatgcttctggcatgataaaatcatggaattaaatcaggggtttacattcttgtagagtgttcttgaaacactctctgcaccatttttaaaacttgagaatagttttagtatctctgatattttttgccagaatcatcatgtcatgtatgaatgtgttatccctatctaaggaaaaaggtgaatatgtttttgtatgaatgtttaactggaaatgtccatggacttggctaatttatatttactttttattgtacatagatttctaatatttttcattcctgtatcatttaaacttccttcatttgagtaaattcactaaatatttctattttttgcttttttaaattctgattttatatgaattctaattctttttcactacatatgttttaaagagttacatacagtgatttagaatggtttacagttaatgctgatcttgtattttaaattccaacactttgtgtcactacctcctctaatggttagtatgatatgctagcagactgtatgaggtctttttttaaaataccacttttagtgtcagtgaaccaaattctggaatgtcttaacagctctaaatcttacttgtcttgaaaatgattggggtttaataccactgctggtggttcacacatcatcccatccttaatatgcctgacaggcatctgagcaaaggtttttagtaattgaatttctctgcagtagtccttcaagcacttgaatgtaaacctttagcatttattcgtttaatgactactgatacgaatctcaagcagatttcttgctcttaaaagttatgtttcactgagttctggttttgtgtagctatattttatatagctagatattcctcacagtgaacatgaattgtaataattggttatttccttaagtctttagattataataatttcagattattgcacgtctgtgatttgagaggtgagttatttaagaggccagttttcaggacatgggaatttgaattgtaaacctgttatctctgtgaaacttttaacatgataaaatataacctttctttgtgcttaaaaaaaaaaggaacaaaacacacttggggggcccggccagaaatttttaaacatcttggccccgcccgagaagagaagggctttttcagaaccgctcttgttgctttccaaaaagccggccgtctacaaacacggggggggccaaagcaag

SEQ ID NO: 34552 - DNA, 2955 bp, Homo sapiens
cccggcgggccggcgcgcggccgcgtttgaatggccctgagtgggactcggcccagaagccgagggactctctaggctgccgggcgctggtcgtcagcgccgaggctgggctgaggcgccgcggtaccatgaggcgccgaaactatgggatgatggtgagaatttcacagcaggaaagattgggaagtttaaggatctgaacaggagttaggtacttaagagattatggcatcagaaacccacaatgttaaaaaacggaacttttgtaataagattgaggatcatttcattgatcttcctagaaaaaagatctctaatttcactaataagaacatgaaggaggttaagaaatctccaaaacagttggctgcttacataaatagaacagttggacaaactgtgaaaagcccagataaacttcgtaaagtgatctatcgcagaaagaaagttcatcatccctttccaaatccttgttacagaaaaaaacagtcccctggaagtgggggctgtgacatggcaaataaagaaaatgaactggcttgtgcaggccacctgcctgaaaaattacaccatgatagtcgaacatatttggttaactccagtgattctggttcttcacagacagaaagcccatcatcaaaatatagtgggtttttttctgaggtttctcaggaccatgaaacaatggcccaagttttgttcagcaggaatatgagattgaatgtagctttaactttctggagaaagagaagtataagtgaacttgtagcttatttgttgaggatagaagatcttggcgttgtggtagattgccttcctgtgctcaccaattgtttacaggaagaaaaacaatatatctcacttggctgctgtgttgacttgttgcctctagtaaagtcactacttaaaagcaaatttgaagaatatgttatagttggtttaaactggcttcaagcagtcattaaaaggtggtggtcagaactatcatccaaaacagaaattataaatgatggaaatattcaaattttaaaacaacaattaagtggattatgggaacaggaaaaccatcttactttggttccaggatatactggtaatatagctaaggatgtagatgcttatttattacagttacattgagagatttcatctactaaagagcatttggtttttcaaaacatccctgaactgtataatttacaaaaaaaaaagtctcgtctgagaactgtgaactgtggaagaaatcaaaactattttttcttttaaaaagccacgtaatgaaaccactaatgaaatcccagcaatctgcttcacattgaagtggaaaaatatccaaaaggagcagcttcaatttcattgaggtgaaagtgcactatgaagattgttcacctttgctgcatttgggagttatatggttatttggtaacattaagaactactggattttaatgcaatcctgcataaaaatataatttatactatgtgaaaaaataagacaggacttaccactaggaaccaccaagaccaatcatcattaacttttttaagattgtgttttattaaaaaaaaaaaacacttaaatgtgtgcagctattttcttatgttgaaaagactgaaagtttaaaacatgaaaaaaatcaatattaaacattttttgttcacactgagatactgtgtatgtaaaatgccttaattattaataagccaatgtgttatgataccaatatctgttttaaaaaactaaaaccaaccatgcttctggcatgataaaatcatggaattaaatcaggggtttacattcttgtagagtgttcttgaaacactctctgcaccatttttaaaacttgagaatagttttagtatctctgatattttttgccagaatcatcatgtcatgtatgaatgtgttatccctatctaaggaaaaaggtgaatatgtttttgtatgaatgtttaactggaaatgtccatggacttggctaatttatatttactttttattgtacatagatttctaatatttttcattcctgtatcatttaaacttccttcatttgagtaaattcactaaatatttctattttttgcttttttaaattctgattttatatgaattctaattctttttcactacatatgttttaaagagttacatacagtgatttagaatggtttacagttaatgctgatcttgtattttaaattccaacactttgtgtcactacctcctctaatggttagtatgatatgctagcagactgtatgaggtctttttttaaaataccacttttagtgtcagtgaaccaaattctggaatgtcttaacagctctaaatcttacttgtcttgaaaatgattggggtttaataccactgctggtggttcacacatcatcccatccttaatatgcctgacaggcatctgagcaaaggtttttagtaattgaatttctctgcagtagtccttcaagcacttgaatgtaaacctttagcatttattcgtttaatgactactgatacgaatctcaagcagatttcttgctcttaaaagttatgtttcactgagttctggttttgtgtagctatattttatatagctagatattcctcacagtgaacatgaattgtaataattggttatttccttaagtctttagattataataatttcagattattgcacgtctgtgatttgagaggtgagttatttaagaggccagttttcaggacatgggaatttgaattgtaaacctgttatctctgtgaaacttttaacatgataaaatataacctttctttgtgcttaaaaaaaaaaggaacaaaacacacttggggggcccggccagaaatttttaaacatcttggccccgcccgagaagagaagggctttttcagaaccgctcttgttgctttccaaaaagccggccgtctacaaacacggggggggccaaagcaag

SEQ ID NO: 34553 - DNA, 5343 bp, Homo sapiens
cccggcgggccggcgcgcggccgcgtttgaatggccctgagtgggactcggcccagaagccgagggactctctaggctgccgggcgctggtcgtcagcgccgaggctgggctgaggcgccgcggtaccatgaggcgccggtacttaagagattatggcatcagaaacccacaatgttaaaaaacggaacttttgtaataagattgaggatcatttcattgatcttcctagaaaaaagatctctaatttcactaataagaacatgaaggaggttaagaaatctccaaaacagttggctgcttacataaatagaacagttggacaaactgtgaaaagcccagataaacttcgtaaagtgatctatcgcagaaagaaagttcatcatccctttccaaatccttgttacagaaaaaaacagtcccctggaagtgggggctgtgacatggcaaataaagaaaatgaactggcttgtgcaggccacctgcctgaaaaattacaccatgatagtcgaacatatttggttaactccagtgattctggttcttcacagacagaaagcccatcatcaaaatatagtgggtttttttctgaggtttctcaggaccatgaaacaatggcccaagttttgttcagcaggaatatgagattgaatgtagctttaactttctggagaaagagaagtataagtgaacttgtagcttatttgttgaggatagaagatcttggcgttgtggtagattgccttcctgtgctcaccaattgtttacaggaagaaaaacaatatatctcacttggctgctgtgttgacttgttgcctctagtaaagtcactacttaaaagcaaatttgaagagtaagtgctaatctgaatcttgattcatttttctttttcagcatccttgattttgtgctttgtgagtacatagtagattgggctccatgagacatgcaaggtttctgttttcaagaagctaatagtacaattaggaaaagaatatgaaatgactaaaggacaattataaaagcatctctaaacaaattacatgaaatatacttttgtgtaatagatcatgaaggtaacaattttttaaaagggaagggaccaatgtgtgtgtgtgttttttgggagggaaagtatcatcttttataagaagggttcttagatgaaaacacttgaattttgtaacaaaatgtcatttcagatatgttatagttggtttaaactggcttcaagcagtcattaaaaggtggtggtcagaactatcatccaaaacagaaattataaatgatgggtgagtatacctttaaagataaactcatgctgaaattttcttcaggaaagcagcttgattaaactaggtaataattttatcccattatcatcagtgtatggtatttattctttttatattcagagagatactaacttaagagactgttcatttgtgaaaaccacacctggaaattgaattccagagcctactaacctcctgtatctcttcttctggcacaaccctacccttcattttagaagaaaaacacaatagtggtttaattctcatattcattatgagtaagggaggaaaaagagatgcccacagtgtaataaggaatggaggcaccctgcggggtcctttacctagacattaacctgagagtccggtgttgatgtttacacttctaaaaactgtattattactgccttgatgtgaaaattcgtgggtattctaccagagtatagccagattatcatgaaaccacagaaaaatatctcccaacagtttccttaaagtccataattttgggccaggcacggtggctgatgcctgtctgtaatcccagcactttgggaggccaagaagggcaaatcacttgagctcacaagtttgagacagcctgggcaacatgatgacatcccgtctctacaaaaaatacaaaaattagccaggcatggtggtgtgcgcctgtagtcccagctactcaggctgaggcaggaggatcgcttgagcccaggaggtggaggttgcagtaagccgagatggcaccactgcactccagcctgggcaatagagccagcccttgtctcaaaaaaaaaaaaaaaaaagccacaatttattttgtaggctctcaaaattttctacttcacaccaaggaatgtccaaatgttccaaacgcctggtcattttcttacctgctttgacaactaaataacctttaattttctttttttttttaattgaaatcaagtaagaaattttattaattttggaattgaaaaaacatcctttgttgtttccaagaattaattaaataggaggcatttggcggtattatgtggataaacctttaattttcatgactgacatgtattattctaaaagttatttgacttttttttaatttctctccacgttcccaaatgttttatttcaaatagcatcattttctcctgaaaaatacctgaaaaattttagaacagtttttattatgcatatttatgatgaaagtttgtatcttaatgtatttgctttctcatttttcttccttttttttcttttagaaatattcaaattttaaaacaacaattaagtggattatgggaacaggaaaaccatcttactttggttccaggatatactggtaatatagctaaggtcctctgcgtgtaactgtgaccttggcagcaagcacaggaattggccattgaacatgtttcatgtacagcccctgaaatgctatgctagaggatatttacagagggttttaatcagagaaaagtatttgaaaaaattttgagaatccaataaggacagcatcagaaaacaagacgaggaactcaggaaacactgggattacaggcgtgagccactgcgcctggcctatagaattcttaatgatgaaaatcttatgaacatatcaatctcctagaaagtttttgttgttgttttaggtttttagagcatacatgacgtattaccttgctctaaagggttgttgcattctgtatagaagaactaaaaaatgattgttccttatgactgaaatttgctttcaatcagaattttttttgttgtttttgttttgagactgaatctcgctctcacttcagcctggtgacagagcaagactctgtctcaaaaaaaaaagagaaagaaattgaaagaggctattgtcaagctgggctcaagtgaatatagcactgatagtaaacagcactgatagaatttctgtgaatgttagctatgaaagcagagttgtttgagcataggaaccaacacattcatttagcacttagcaaatatatattgagcacatactatgtgccaggccctgtgctgaacaaatgcagataaaagcactgaacaaggcacgtcttttaccctcaaaaggtcacaaaaggaaactaaggcaaattaagcaacaacaaaaaaaaatggattgtttatgtttgtatttactgtactgtctaatgaaatgtttttgttttatcttctaaggatgtagatgcttatttattacagttacattgagagatttcatctactaaagagcatttggtttttcaaaacatccctgaactgtataatttacaaaaaaaaaagtctcgtctgagaactgtgaactgtggaagaaatcaaaactattttttcttttaaaaagccacgtaatgaaaccactaatgaaatcccagcaatctgcttcacattgaagtggaaaaatatccaaaaggagcagcttcaatttcattgaggtgaaagtgcactatgaagattgttcacctttgctgcatttgggagttatatggttatttggtaacattaagaactactggattttaatgcaatcctgcataaaaatataatttatactatgtgaaaaaataagacaggacttaccactaggaaccaccaagaccaatcatcattaacttttttaagattgtgttttattaaaaaaaaaaaacacttaaatgtgtgcagctattttcttatgttgaaaagactgaaagtttaaaacatgaaaaaaatcaatattaaacattttttgttcacactgagatactgtgtatgtaaaatgccttaattattaataagccaatgtgttatgataccaatatctgttttaaaaaactaaaaccaaccatgcttctggcatgataaaatcatggaattaaatcaggggtttacattcttgtagagtgttcttgaaacactctctgcaccatttttaaaacttgagaatagttttagtatctctgatattttttgccagaatcatcatgtcatgtatgaatgtgttatccctatctaaggaaaaaggtgaatatgtttttgtatgaatgtttaactggaaatgtccatggacttggctaatttatatttactttttattgtacatagatttctaatatttttcattcctgtatcatttaaacttccttcatttgagtaaattcactaaatatttctattttttgcttttttaaattctgattttatatgaattctaattctttttcactacatatgttttaaagagttacatacagtgatttagaatggtttacagttaatgctgatcttgtattttaaattccaacactttgtgtcactacctcctctaatggttagtatgatatgctagcagactgtatgaggtctttttttaaaataccacttttagtgtcagtgaaccaaattctggaatgtcttaacagctctaaatcttacttgtcttgaaaatgattggggtttaataccactgctggtggttcacacatcatcccatccttaatatgcctgacaggcatctgagcaaaggtttttagtaattgaatttctctgcagtagtccttcaagcacttgaatgtaaacctttagcatttattcgtttaatgactactgatacgaatctcaagcagatttcttgctcttaaaagttatgtttcactgagttctggttttgtgtagctatattttatatagctagatattcctcacagtgaacatgaattgtaataattggttatttccttaagtctttagattataataatttcagattattgcacgtctgtgatttgagaggtgagttatttaagaggccagttttcaggacatgggaatttgaattgtaaacctgttatctctgtgaaacttttaacatgataaaatataacctttctttgtgcttaaaaaaaaaaggaacaaaacacacttggggggcccggccagaaatttttaaacatcttggccccgcccgagaagagaagggctttttcagaaccgctcttgttgctttccaaaaagccggccgtctacaaacacggggggggccaaagcaag

SEQ ID NO: 34554 - DNA, 4151 bp, Homo sapiens
cccggcgggccggcgcgcggccgcgtttgaatggccctgagtgggactcggcccagaagccgagggactctctaggctgccgggcgctggtcgtcagcgccgaggctgggctgaggcgccgcggtaccatgaggcgccggtacttaagagattatggcatcagaaacccacaatgttaaaaaacggaacttttgtaataagattgaggatcatttcattgatcttcctagaaaaaagatctctaatttcactaataagaacatgaaggaggttaagaaatctccaaaacagttggctgcttacataaatagaacagttggacaaactgtgaaaagcccagataaacttcgtaaagtgatctatcgcagaaagaaagttcatcatccctttccaaatccttgttacagaaaaaaacagtcccctggaagtgggggctgtgacatggcaaataaagaaaatgaactggcttgtgcaggccacctgcctgaaaaattacaccatgatagtcgaacatatttggttaactccagtgattctggttcttcacagacagaaagcccatcatcaaaatatagtgggtttttttctgaggtttctcaggaccatgaaacaatggcccaagttttgttcagcaggaatatgagattgaatgtagctttaactttctggagaaagagaagtataagtgaacttgtagcttatttgttgaggatagaagatcttggcgttgtggtagattgccttcctgtgctcaccaattgtttacaggaagaaaaacaatatatctcacttggctgctgtgttgacttgttgcctctagtaaagtcactacttaaaagcaaatttgaagaatatgttatagttggtttaaactggcttcaagcagtcattaaaaggtggtggtcagaactatcatccaaaacagaaattataaatgatgggtgagtatacctttaaagataaactcatgctgaaattttcttcaggaaagcagcttgattaaactaggtaataattttatcccattatcatcagtgtatggtatttattctttttatattcagagagatactaacttaagagactgttcatttgtgaaaaccacacctggaaattgaattccagagcctactaacctcctgtatctcttcttctggcacaaccctacccttcattttagaagaaaaacacaatagtggtttaattctcatattcattatgagtaagggaggaaaaagagatgcccacagtgtaataaggaatggaggcaccctgcggggtcctttacctagacattaacctgagagtccggtgttgatgtttacacttctaaaaactgtattattactgccttgatgtgaaaattcgtgggtattctaccagagtatagccagattatcatgaaaccacagaaaaatatctcccaacagtttccttaaagtccataattttgggccaggcacggtggctgatgcctgtctgtaatcccagcactttgggaggccaagaagggcaaatcacttgagctcacaagtttgagacagcctgggcaacatgatgacatcccgtctctacaaaaaatacaaaaattagccaggcatggtggtgtgcgcctgtagtcccagctactcaggctgaggcaggaggatcgcttgagcccaggaggtggaggttgcagtaagccgagatggcaccactgcactccagcctgggcaatagagccagcccttgtctcaaaaaaaaaaaaaaaaaagccacaatttattttgtaggctctcaaaattttctacttcacaccaaggaatgtccaaatgttccaaacgcctggtcattttcttacctgctttgacaactaaataacctttaattttctttttttttttaattgaaatcaagtaagaaattttattaattttggaattgaaaaaacatcctttgttgtttccaagaattaattaaataggaggcatttggcggtattatgtggataaacctttaattttcatgactgacatgtattattctaaaagttatttgacttttttttaatttctctccacgttcccaaatgttttatttcaaatagcatcattttctcctgaaaaatacctgaaaaattttagaacagtttttattatgcatatttatgatgaaagtttgtatcttaatgtatttgctttctcatttttcttccttttttttcttttagaaatattcaaattttaaaacaacaattaagtggattatgggaacaggaaaaccatcttactttggttccaggatatactggtaatatagctaaggatgtagatgcttatttattacagttacattgagagatttcatctactaaagagcatttggtttttcaaaacatccctgaactgtataatttacaaaaaaaaaagtctcgtctgagaactgtgaactgtggaagaaatcaaaactattttttcttttaaaaagccacgtaatgaaaccactaatgaaatcccagcaatctgcttcacattgaagtggaaaaatatccaaaaggagcagcttcaatttcattgaggtgaaagtgcactatgaagattgttcacctttgctgcatttgggagttatatggttatttggtaacattaagaactactggattttaatgcaatcctgcataaaaatataatttatactatgtgaaaaaataagacaggacttaccactaggaaccaccaagaccaatcatcattaacttttttaagattgtgttttattaaaaaaaaaaaacacttaaatgtgtgcagctattttcttatgttgaaaagactgaaagtttaaaacatgaaaaaaatcaatattaaacattttttgttcacactgagatactgtgtatgtaaaatgccttaattattaataagccaatgtgttatgataccaatatctgttttaaaaaactaaaaccaaccatgcttctggcatgataaaatcatggaattaaatcaggggtttacattcttgtagagtgttcttgaaacactctctgcaccatttttaaaacttgagaatagttttagtatctctgatattttttgccagaatcatcatgtcatgtatgaatgtgttatccctatctaaggaaaaaggtgaatatgtttttgtatgaatgtttaactggaaatgtccatggacttggctaatttatatttactttttattgtacatagatttctaatatttttcattcctgtatcatttaaacttccttcatttgagtaaattcactaaatatttctattttttgcttttttaaattctgattttatatgaattctaattctttttcactacatatgttttaaagagttacatacagtgatttagaatggtttacagttaatgctgatcttgtattttaaattccaacactttgtgtcactacctcctctaatggttagtatgatatgctagcagactgtatgaggtctttttttaaaataccacttttagtgtcagtgaaccaaattctggaatgtcttaacagctctaaatcttacttgtcttgaaaatgattggggtttaataccactgctggtggttcacacatcatcccatccttaatatgcctgacaggcatctgagcaaaggtttttagtaattgaatttctctgcagtagtccttcaagcacttgaatgtaaacctttagcatttattcgtttaatgactactgatacgaatctcaagcagatttcttgctcttaaaagttatgtttcactgagttctggttttgtgtagctatattttatatagctagatattcctcacagtgaacatgaattgtaataattggttatttccttaagtctttagattataataatttcagattattgcacgtctgtgatttgagaggtgagttatttaagaggccagttttcaggacatgggaatttgaattgtaaacctgttatctctgtgaaacttttaacatgataaaatataacctttctttgtgcttaaaaaaaaaaggaacaaaacacacttggggggcccggccagaaatttttaaacatcttggccccgcccgagaagagaagggctttttcagaaccgctcttgttgctttccaaaaagccggccgtctacaaacacggggggggccaaagcaag

SEQ ID NO: 34555 - DNA, 4819 bp, Homo sapiens
gaatgaatttctcaaaagcggtgtgaataatcataatatgaaagtaaataaggaaatcagctctctaaggcaatgctattctttttatactctcaggatagaagatcttggcgttgtggtagattgccttcctgtgctcaccaattggtaaaaacaatatttttcagaaaaaaaataagattaaaggaggtcaaattatggcccatccatatttttataacttggtatttattttagtttacaggaagaaaaacaatatatctcacttggctgctgtgttgacttgttgcctctagtaaagtcactacttaaaagcaaatttgaagagtaagtgctaatctgaatcttgattcatttttctttttcagcatccttgattttgtgctttgtgagtacatagtagattgggctccatgagacatgcaaggtttctgttttcaagaagctaatagtacaattaggaaaagaatatgaaatgactaaaggacaattataaaagcatctctaaacaaattacatgaaatatacttttgtgtaatagatcatgaaggtaacaattttttaaaagggaagggaccaatgtgtgtgtgtgttttttgggagggaaagtatcatcttttataagaagggttcttagatgaaaacacttgaattttgtaacaaaatgtcatttcagatatgttatagttggtttaaactggcttcaagcagtcattaaaaggtggtggtcagaactatcatccaaaacagaaattataaatgatgggtgagtatacctttaaagataaactcatgctgaaattttcttcaggaaagcagcttgattaaactaggtaataattttatcccattatcatcagtgtatggtatttattctttttatattcagagagatactaacttaagagactgttcatttgtgaaaaccacacctggaaattgaattccagagcctactaacctcctgtatctcttcttctggcacaaccctacccttcattttagaagaaaaacacaatagtggtttaattctcatattcattatgagtaagggaggaaaaagagatgcccacagtgtaataaggaatggaggcaccctgcggggtcctttacctagacattaacctgagagtccggtgttgatgtttacacttctaaaaactgtattattactgccttgatgtgaaaattcgtgggtattctaccagagtatagccagattatcatgaaaccacagaaaaatatctcccaacagtttccttaaagtccataattttgggccaggcacggtggctgatgcctgtctgtaatcccagcactttgggaggccaagaagggcaaatcacttgagctcacaagtttgagacagcctgggcaacatgatgacatcccgtctctacaaaaaatacaaaaattagccaggcatggtggtgtgcgcctgtagtcccagctactcaggctgaggcaggaggatcgcttgagcccaggaggtggaggttgcagtaagccgagatggcaccactgcactccagcctgggcaatagagccagcccttgtctcaaaaaaaaaaaaaaaaaagccacaatttattttgtaggctctcaaaattttctacttcacaccaaggaatgtccaaatgttccaaacgcctggtcattttcttacctgctttgacaactaaataacctttaattttctttttttttttaattgaaatcaagtaagaaattttattaattttggaattgaaaaaacatcctttgttgtttccaagaattaattaaataggaggcatttggcggtattatgtggataaacctttaattttcatgactgacatgtattattctaaaagttatttgacttttttttaatttctctccacgttcccaaatgttttatttcaaatagcatcattttctcctgaaaaatacctgaaaaattttagaacagtttttattatgcatatttatgatgaaagtttgtatcttaatgtatttgctttctcatttttcttccttttttttcttttagaaatattcaaattttaaaacaacaattaagtggattatgggaacaggaaaaccatcttactttggttccaggatatactggtaatatagctaaggtcctctgcgtgtaactgtgaccttggcagcaagcacaggaattggccattgaacatgtttcatgtacagcccctgaaatgctatgctagaggatatttacagagggttttaatcagagaaaagtatttgaaaaaattttgagaatccaataaggacagcatcagaaaacaagacgaggaactcaggaaacactgggattacaggcgtgagccactgcgcctggcctatagaattcttaatgatgaaaatcttatgaacatatcaatctcctagaaagtttttgttgttgttttaggtttttagagcatacatgacgtattaccttgctctaaagggttgttgcattctgtatagaagaactaaaaaatgattgttccttatgactgaaatttgctttcaatcagaattttttttgttgtttttgttttgagactgaatctcgctctcacttcagcctggtgacagagcaagactctgtctcaaaaaaaaaagagaaagaaattgaaagaggctattgtcaagctgggctcaagtgaatatagcactgatagtaaacagcactgatagaatttctgtgaatgttagctatgaaagcagagttgtttgagcataggaaccaacacattcatttagcacttagcaaatatatattgagcacatactatgtgccaggccctgtgctgaacaaatgcagataaaagcactgaacaaggcacgtcttttaccctcaaaaggtcacaaaaggaaactaaggcaaattaagcaacaacaaaaaaaaatggattgtttatgtttgtatttactgtactgtctaatgaaatgtttttgttttatcttctaaggatgtagatgcttatttattacagttacattgagagatttcatctactaaagagcatttggtttttcaaaacatccctgaactgtataatttacaaaaaaaaaagtctcgtctgagaactgtgaactgtggaagaaatcaaaactattttttcttttaaaaagccacgtaatgaaaccactaatgaaatcccagcaatctgcttcacattgaagtggaaaaatatccaaaaggagcagcttcaatttcattgaggtgaaagtgcactatgaagattgttcacctttgctgcatttgggagttatatggttatttggtaacattaagaactactggattttaatgcaatcctgcataaaaatataatttatactatgtgaaaaaataagacaggacttaccactaggaaccaccaagaccaatcatcattaacttttttaagattgtgttttattaaaaaaaaaaaacacttaaatgtgtgcagctattttcttatgttgaaaagactgaaagtttaaaacatgaaaaaaatcaatattaaacattttttgttcacactgagatactgtgtatgtaaaatgccttaattattaataagccaatgtgttatgataccaatatctgttttaaaaaactaaaaccaaccatgcttctggcatgataaaatcatggaattaaatcaggggtttacattcttgtagagtgttcttgaaacactctctgcaccatttttaaaacttgagaatagttttagtatctctgatattttttgccagaatcatcatgtcatgtatgaatgtgttatccctatctaaggaaaaaggtgaatatgtttttgtatgaatgtttaactggaaatgtccatggacttggctaatttatatttactttttattgtacatagatttctaatatttttcattcctgtatcatttaaacttccttcatttgagtaaattcactaaatatttctattttttgcttttttaaattctgattttatatgaattctaattctttttcactacatatgttttaaagagttacatacagtgatttagaatggtttacagttaatgctgatcttgtattttaaattccaacactttgtgtcactacctcctctaatggttagtatgatatgctagcagactgtatgaggtctttttttaaaataccacttttagtgtcagtgaaccaaattctggaatgtcttaacagctctaaatcttacttgtcttgaaaatgattggggtttaataccactgctggtggttcacacatcatcccatccttaatatgcctgacaggcatctgagcaaaggtttttagtaattgaatttctctgcagtagtccttcaagcacttgaatgtaaacctttagcatttattcgtttaatgactactgatacgaatctcaagcagatttcttgctcttaaaagttatgtttcactgagttctggttttgtgtagctatattttatatagctagatattcctcacagtgaacatgaattgtaataattggttatttccttaagtctttagattataataatttcagattattgcacgtctgtgatttgagaggtgagttatttaagaggccagttttcaggacatgggaatttgaattgtaaacctgttatctctgtgaaacttttaacatgataaaatataacctttctttgtgcttaaaaaaaaaaggaacaaaacacacttggggggcccggccagaaatttttaaacatcttggccccgcccgagaagagaagggctttttcagaaccgctcttgttgctttccaaaaagccggccgtctacaaacacggggggggccaaagcaag

SEQ ID NO: 34556 - DNA, 5289 bp, Homo sapiens
cccggcgggccggcgcgcggccgcgtttgaatggccctgagtgggactcggcccagaagccgagggactctctaggctgccgggcgctggtcgtcagcgccgaggctgggctgaggcgccgcggtaccatgaggcgccggtacttaagagattatggcatcagaaacccacaatgttaaaaaacggaacttttgtaataagattgaggatcatttcattgatcttcctagaaaaaagatctctaatttcactaataagaacatgaaggaggttaagaaatctccaaaacagttggctgcttacataaatagaacagttggacaaactgtgaaaagcccagataaacttcgtaaagtgatctatcgcagaaagaaagttcatcatccctttccaaatccttgttacagaaaaaaacagtcccctggaagtgggggctgtgacatggcaaataaagaaaatgaactggcttgtgcaggccacctgcctgaaaaattacaccatgatagtcgaacatatttggttaactccagtgattctggttcttcacagacagaaagcccatcatcaattttgttcagcaggaatatgagattgaatgtagctttaactttctggagaaagagaagtataagtgaacttgtagcttatttgttgaggatagaagatcttggcgttgtggtagattgccttcctgtgctcaccaattgtttacaggaagaaaaacaatatatctcacttggctgctgtgttgacttgttgcctctagtaaagtcactacttaaaagcaaatttgaagagtaagtgctaatctgaatcttgattcatttttctttttcagcatccttgattttgtgctttgtgagtacatagtagattgggctccatgagacatgcaaggtttctgttttcaagaagctaatagtacaattaggaaaagaatatgaaatgactaaaggacaattataaaagcatctctaaacaaattacatgaaatatacttttgtgtaatagatcatgaaggtaacaattttttaaaagggaagggaccaatgtgtgtgtgtgttttttgggagggaaagtatcatcttttataagaagggttcttagatgaaaacacttgaattttgtaacaaaatgtcatttcagatatgttatagttggtttaaactggcttcaagcagtcattaaaaggtggtggtcagaactatcatccaaaacagaaattataaatgatgggtgagtatacctttaaagataaactcatgctgaaattttcttcaggaaagcagcttgattaaactaggtaataattttatcccattatcatcagtgtatggtatttattctttttatattcagagagatactaacttaagagactgttcatttgtgaaaaccacacctggaaattgaattccagagcctactaacctcctgtatctcttcttctggcacaaccctacccttcattttagaagaaaaacacaatagtggtttaattctcatattcattatgagtaagggaggaaaaagagatgcccacagtgtaataaggaatggaggcaccctgcggggtcctttacctagacattaacctgagagtccggtgttgatgtttacacttctaaaaactgtattattactgccttgatgtgaaaattcgtgggtattctaccagagtatagccagattatcatgaaaccacagaaaaatatctcccaacagtttccttaaagtccataattttgggccaggcacggtggctgatgcctgtctgtaatcccagcactttgggaggccaagaagggcaaatcacttgagctcacaagtttgagacagcctgggcaacatgatgacatcccgtctctacaaaaaatacaaaaattagccaggcatggtggtgtgcgcctgtagtcccagctactcaggctgaggcaggaggatcgcttgagcccaggaggtggaggttgcagtaagccgagatggcaccactgcactccagcctgggcaatagagccagcccttgtctcaaaaaaaaaaaaaaaaaagccacaatttattttgtaggctctcaaaattttctacttcacaccaaggaatgtccaaatgttccaaacgcctggtcattttcttacctgctttgacaactaaataacctttaattttctttttttttttaattgaaatcaagtaagaaattttattaattttggaattgaaaaaacatcctttgttgtttccaagaattaattaaataggaggcatttggcggtattatgtggataaacctttaattttcatgactgacatgtattattctaaaagttatttgacttttttttaatttctctccacgttcccaaatgttttatttcaaatagcatcattttctcctgaaaaatacctgaaaaattttagaacagtttttattatgcatatttatgatgaaagtttgtatcttaatgtatttgctttctcatttttcttccttttttttcttttagaaatattcaaattttaaaacaacaattaagtggattatgggaacaggaaaaccatcttactttggttccaggatatactggtaatatagctaaggtcctctgcgtgtaactgtgaccttggcagcaagcacaggaattggccattgaacatgtttcatgtacagcccctgaaatgctatgctagaggatatttacagagggttttaatcagagaaaagtatttgaaaaaattttgagaatccaataaggacagcatcagaaaacaagacgaggaactcaggaaacactgggattacaggcgtgagccactgcgcctggcctatagaattcttaatgatgaaaatcttatgaacatatcaatctcctagaaagtttttgttgttgttttaggtttttagagcatacatgacgtattaccttgctctaaagggttgttgcattctgtatagaagaactaaaaaatgattgttccttatgactgaaatttgctttcaatcagaattttttttgttgtttttgttttgagactgaatctcgctctcacttcagcctggtgacagagcaagactctgtctcaaaaaaaaaagagaaagaaattgaaagaggctattgtcaagctgggctcaagtgaatatagcactgatagtaaacagcactgatagaatttctgtgaatgttagctatgaaagcagagttgtttgagcataggaaccaacacattcatttagcacttagcaaatatatattgagcacatactatgtgccaggccctgtgctgaacaaatgcagataaaagcactgaacaaggcacgtcttttaccctcaaaaggtcacaaaaggaaactaaggcaaattaagcaacaacaaaaaaaaatggattgtttatgtttgtatttactgtactgtctaatgaaatgtttttgttttatcttctaaggatgtagatgcttatttattacagttacattgagagatttcatctactaaagagcatttggtttttcaaaacatccctgaactgtataatttacaaaaaaaaaagtctcgtctgagaactgtgaactgtggaagaaatcaaaactattttttcttttaaaaagccacgtaatgaaaccactaatgaaatcccagcaatctgcttcacattgaagtggaaaaatatccaaaaggagcagcttcaatttcattgaggtgaaagtgcactatgaagattgttcacctttgctgcatttgggagttatatggttatttggtaacattaagaactactggattttaatgcaatcctgcataaaaatataatttatactatgtgaaaaaataagacaggacttaccactaggaaccaccaagaccaatcatcattaacttttttaagattgtgttttattaaaaaaaaaaaacacttaaatgtgtgcagctattttcttatgttgaaaagactgaaagtttaaaacatgaaaaaaatcaatattaaacattttttgttcacactgagatactgtgtatgtaaaatgccttaattattaataagccaatgtgttatgataccaatatctgttttaaaaaactaaaaccaaccatgcttctggcatgataaaatcatggaattaaatcaggggtttacattcttgtagagtgttcttgaaacactctctgcaccatttttaaaacttgagaatagttttagtatctctgatattttttgccagaatcatcatgtcatgtatgaatgtgttatccctatctaaggaaaaaggtgaatatgtttttgtatgaatgtttaactggaaatgtccatggacttggctaatttatatttactttttattgtacatagatttctaatatttttcattcctgtatcatttaaacttccttcatttgagtaaattcactaaatatttctattttttgcttttttaaattctgattttatatgaattctaattctttttcactacatatgttttaaagagttacatacagtgatttagaatggtttacagttaatgctgatcttgtattttaaattccaacactttgtgtcactacctcctctaatggttagtatgatatgctagcagactgtatgaggtctttttttaaaataccacttttagtgtcagtgaaccaaattctggaatgtcttaacagctctaaatcttacttgtcttgaaaatgattggggtttaataccactgctggtggttcacacatcatcccatccttaatatgcctgacaggcatctgagcaaaggtttttagtaattgaatttctctgcagtagtccttcaagcacttgaatgtaaacctttagcatttattcgtttaatgactactgatacgaatctcaagcagatttcttgctcttaaaagttatgtttcactgagttctggttttgtgtagctatattttatatagctagatattcctcacagtgaacatgaattgtaataattggttatttccttaagtctttagattataataatttcagattattgcacgtctgtgatttgagaggtgagttatttaagaggccagttttcaggacatgggaatttgaattgtaaacctgttatctctgtgaaacttttaacatgataaaatataacctttctttgtgcttaaaaaaaaaaggaacaaaacacacttggggggcccggccagaaatttttaaacatcttggccccgcccgagaagagaagggctttttcagaaccgctcttgttgctttccaaaaagccggccgtctacaaacacggggggggccaaagcaag

SEQ ID NO: 34557 - DNA, 2762 bp, Homo sapiens
gtatgctcttgcgaccactccaggcacgattggcacccttctgcagaagtaaattgccttgctgagaaagctttttgccggagtgctgattcttctttgcggcaccaagcatttgtttctaacatcaactatctactttcatttttcaggttaagaaatctccaaaacagttggctgcttacataaatagaacagttggacaaactgtgaaaagcccagataaacttcgtaaagtgatctatcgcagaaagaaagttcatcatccctttccaaatccttgttacagaaaaaaacagtcccctggaagtgggggctgtgacatggcaaataaagaaaatgaactggcttgtgcaggccacctgcctgaaaaattacaccatgatagtcgaacatatttggttaactccagtgattctggttcttcacagacagaaagcccatcatcaaaatatagtgggtttttttctgaggtttctcaggaccatgaaacaatggcccaagttttgttcagcaggaatatgagattgaatgtagctttaactttctggagaaagagaagtataagtgaacttgtagcttatttgttgaggatagaagatcttggcgttgtggtagattgccttcctgtgctcaccaattgtttacaggaagaaaaacaatatatctcacttggctgctgtgttgacttgttgcctctagtaaagtcactacttaaaagcaaatttgaagaatatgttatagttggtttaaactggcttcaagcagtcattaaaaggtggtggtcagaactatcatccaaaacagaaattataaatgatggaaatattcaaattttaaaacaacaattaagtggattatgggaacaggaaaaccatcttactttggttccaggatatactggtaatatagctaaggatgtagatgcttatttattacagttacattgagagatttcatctactaaagagcatttggtttttcaaaacatccctgaactgtataatttacaaaaaaaaaagtctcgtctgagaactgtgaactgtggaagaaatcaaaactattttttcttttaaaaagccacgtaatgaaaccactaatgaaatcccagcaatctgcttcacattgaagtggaaaaatatccaaaaggagcagcttcaatttcattgaggtgaaagtgcactatgaagattgttcacctttgctgcatttgggagttatatggttatttggtaacattaagaactactggattttaatgcaatcctgcataaaaatataatttatactatgtgaaaaaataagacaggacttaccactaggaaccaccaagaccaatcatcattaacttttttaagattgtgttttattaaaaaaaaaaaacacttaaatgtgtgcagctattttcttatgttgaaaagactgaaagtttaaaacatgaaaaaaatcaatattaaacattttttgttcacactgagatactgtgtatgtaaaatgccttaattattaataagccaatgtgttatgataccaatatctgttttaaaaaactaaaaccaaccatgcttctggcatgataaaatcatggaattaaatcaggggtttacattcttgtagagtgttcttgaaacactctctgcaccatttttaaaacttgagaatagttttagtatctctgatattttttgccagaatcatcatgtcatgtatgaatgtgttatccctatctaaggaaaaaggtgaatatgtttttgtatgaatgtttaactggaaatgtccatggacttggctaatttatatttactttttattgtacatagatttctaatatttttcattcctgtatcatttaaacttccttcatttgagtaaattcactaaatatttctattttttgcttttttaaattctgattttatatgaattctaattctttttcactacatatgttttaaagagttacatacagtgatttagaatggtttacagttaatgctgatcttgtattttaaattccaacactttgtgtcactacctcctctaatggttagtatgatatgctagcagactgtatgaggtctttttttaaaataccacttttagtgtcagtgaaccaaattctggaatgtcttaacagctctaaatcttacttgtcttgaaaatgattggggtttaataccactgctggtggttcacacatcatcccatccttaatatgcctgacaggcatctgagcaaaggtttttagtaattgaatttctctgcagtagtccttcaagcacttgaatgtaaacctttagcatttattcgtttaatgactactgatacgaatctcaagcagatttcttgctcttaaaagttatgtttcactgagttctggttttgtgtagctatattttatatagctagatattcctcacagtgaacatgaattgtaataattggttatttccttaagtctttagattataataatttcagattattgcacgtctgtgatttgagaggtgagttatttaagaggccagttttcaggacatgggaatttgaattgtaaacctgttatctctgtgaaacttttaacatgataaaatataacctttctttgtgcttaaaaaaaaaaggaacaaaacacacttggggggcccggccagaaatttttaaacatcttggccccgcccgagaagagaagggctttttcagaaccgctcttgttgctttccaaaaagccggccgtctacaaacacggggggggccaaagcaag

SEQ ID NO: 34558 - DNA, 2879 bp, Homo sapiens
gaaaatgttgtggtcttcttactcccagaatggcctttaatattttttttttaaaagcattctggttattatgtctgtcttcatttttatttggcataaaatgtcatcctttacattgtcttccagataatttgtaatttcccttttacttttctcttcaactcagaattaagatttttaaaattctatttatttctaattttagtggattacaatcaccaaatatagcctattaatttctgtttaaaaacttttaaaggatttcatatggttctttttcatttaagaaaataaattctttttacagaacagttggacaaactgtgaaaagcccagataaacttcgtaaagtgatctatcgcagaaagaaagttcatcatccctttccaaatccttgttacagaaaaaaacagtcccctggaagtgggggctgtgacatggcaaataaagaaaatgaactggcttgtgcaggccacctgcctgaaaaattacaccatgatagtcgaacatatttggttaactccagtgattctggttcttcacagacagaaagcccatcatcaaaatatagtgggtttttttctgaggtttctcaggaccatgaaacaatggcccaagttttgttcagcaggaatatgagattgaatgtagctttaactttctggagaaagagaagtataagtgaacttgtagcttatttgttgaggatagaagatcttggcgttgtggtagattgccttcctgtgctcaccaattgtttacaggaagaaaaacaatatatctcacttggctgctgtgttgacttgttgcctctagtaaagtcactacttaaaagcaaatttgaagaatatgttatagttggtttaaactggcttcaagcagtcattaaaaggtggtggtcagaactatcatccaaaacagaaattataaatgatggaaatattcaaattttaaaacaacaattaagtggattatgggaacaggaaaaccatcttactttggttccaggatatactggtaatatagctaaggatgtagatgcttatttattacagttacattgagagatttcatctactaaagagcatttggtttttcaaaacatccctgaactgtataatttacaaaaaaaaaagtctcgtctgagaactgtgaactgtggaagaaatcaaaactattttttcttttaaaaagccacgtaatgaaaccactaatgaaatcccagcaatctgcttcacattgaagtggaaaaatatccaaaaggagcagcttcaatttcattgaggtgaaagtgcactatgaagattgttcacctttgctgcatttgggagttatatggttatttggtaacattaagaactactggattttaatgcaatcctgcataaaaatataatttatactatgtgaaaaaataagacaggacttaccactaggaaccaccaagaccaatcatcattaacttttttaagattgtgttttattaaaaaaaaaaaacacttaaatgtgtgcagctattttcttatgttgaaaagactgaaagtttaaaacatgaaaaaaatcaatattaaacattttttgttcacactgagatactgtgtatgtaaaatgccttaattattaataagccaatgtgttatgataccaatatctgttttaaaaaactaaaaccaaccatgcttctggcatgataaaatcatggaattaaatcaggggtttacattcttgtagagtgttcttgaaacactctctgcaccatttttaaaacttgagaatagttttagtatctctgatattttttgccagaatcatcatgtcatgtatgaatgtgttatccctatctaaggaaaaaggtgaatatgtttttgtatgaatgtttaactggaaatgtccatggacttggctaatttatatttactttttattgtacatagatttctaatatttttcattcctgtatcatttaaacttccttcatttgagtaaattcactaaatatttctattttttgcttttttaaattctgattttatatgaattctaattctttttcactacatatgttttaaagagttacatacagtgatttagaatggtttacagttaatgctgatcttgtattttaaattccaacactttgtgtcactacctcctctaatggttagtatgatatgctagcagactgtatgaggtctttttttaaaataccacttttagtgtcagtgaaccaaattctggaatgtcttaacagctctaaatcttacttgtcttgaaaatgattggggtttaataccactgctggtggttcacacatcatcccatccttaatatgcctgacaggcatctgagcaaaggtttttagtaattgaatttctctgcagtagtccttcaagcacttgaatgtaaacctttagcatttattcgtttaatgactactgatacgaatctcaagcagatttcttgctcttaaaagttatgtttcactgagttctggttttgtgtagctatattttatatagctagatattcctcacagtgaacatgaattgtaataattggttatttccttaagtctttagattataataatttcagattattgcacgtctgtgatttgagaggtgagttatttaagaggccagttttcaggacatgggaatttgaattgtaaacctgttatctctgtgaaacttttaacatgataaaatataacctttctttgtgcttaaaaaaaaaaggaacaaaacacacttggggggcccggccagaaatttttaaacatcttggccccgcccgagaagagaagggctttttcagaaccgctcttgttgctttccaaaaagccggccgtctacaaacacggggggggccaaagcaag

SEQ ID NO: 34559 - DNA, 5063 bp, Homo sapiens
cccggcgggccggcgcgcggccgcgtttgaatggccctgagtgggactcggcccagaagccgagggactctctaggctgccgggcgctggtcgtcagcgccgaggctgggctgaggcgccgcggtaccatgaggcgccggtacttaagagattatggcatcagaaacccacaatgttaaaaaacggaacttttgtaataagattgaggatcatttcattgatcttcctagaaaaaagatctctaatttcactaataagaacatgaaggaggttaagaaatctccaaaacagttggctgcttacataaataggtttctcaggaccatgaaacaatggcccaagttttgttcagcaggaatatgagattgaatgtagctttaactttctggagaaagagaagtataagtgaacttgtagcttatttgttgaggatagaagatcttggcgttgtggtagattgccttcctgtgctcaccaattgtttacaggaagaaaaacaatatatctcacttggctgctgtgttgacttgttgcctctagtaaagtcactacttaaaagcaaatttgaagagtaagtgctaatctgaatcttgattcatttttctttttcagcatccttgattttgtgctttgtgagtacatagtagattgggctccatgagacatgcaaggtttctgttttcaagaagctaatagtacaattaggaaaagaatatgaaatgactaaaggacaattataaaagcatctctaaacaaattacatgaaatatacttttgtgtaatagatcatgaaggtaacaattttttaaaagggaagggaccaatgtgtgtgtgtgttttttgggagggaaagtatcatcttttataagaagggttcttagatgaaaacacttgaattttgtaacaaaatgtcatttcagatatgttatagttggtttaaactggcttcaagcagtcattaaaaggtggtggtcagaactatcatccaaaacagaaattataaatgatgggtgagtatacctttaaagataaactcatgctgaaattttcttcaggaaagcagcttgattaaactaggtaataattttatcccattatcatcagtgtatggtatttattctttttatattcagagagatactaacttaagagactgttcatttgtgaaaaccacacctggaaattgaattccagagcctactaacctcctgtatctcttcttctggcacaaccctacccttcattttagaagaaaaacacaatagtggtttaattctcatattcattatgagtaagggaggaaaaagagatgcccacagtgtaataaggaatggaggcaccctgcggggtcctttacctagacattaacctgagagtccggtgttgatgtttacacttctaaaaactgtattattactgccttgatgtgaaaattcgtgggtattctaccagagtatagccagattatcatgaaaccacagaaaaatatctcccaacagtttccttaaagtccataattttgggccaggcacggtggctgatgcctgtctgtaatcccagcactttgggaggccaagaagggcaaatcacttgagctcacaagtttgagacagcctgggcaacatgatgacatcccgtctctacaaaaaatacaaaaattagccaggcatggtggtgtgcgcctgtagtcccagctactcaggctgaggcaggaggatcgcttgagcccaggaggtggaggttgcagtaagccgagatggcaccactgcactccagcctgggcaatagagccagcccttgtctcaaaaaaaaaaaaaaaaaagccacaatttattttgtaggctctcaaaattttctacttcacaccaaggaatgtccaaatgttccaaacgcctggtcattttcttacctgctttgacaactaaataacctttaattttctttttttttttaattgaaatcaagtaagaaattttattaattttggaattgaaaaaacatcctttgttgtttccaagaattaattaaataggaggcatttggcggtattatgtggataaacctttaattttcatgactgacatgtattattctaaaagttatttgacttttttttaatttctctccacgttcccaaatgttttatttcaaatagcatcattttctcctgaaaaatacctgaaaaattttagaacagtttttattatgcatatttatgatgaaagtttgtatcttaatgtatttgctttctcatttttcttccttttttttcttttagaaatattcaaattttaaaacaacaattaagtggattatgggaacaggaaaaccatcttactttggttccaggatatactggtaatatagctaaggtcctctgcgtgtaactgtgaccttggcagcaagcacaggaattggccattgaacatgtttcatgtacagcccctgaaatgctatgctagaggatatttacagagggttttaatcagagaaaagtatttgaaaaaattttgagaatccaataaggacagcatcagaaaacaagacgaggaactcaggaaacactgggattacaggcgtgagccactgcgcctggcctatagaattcttaatgatgaaaatcttatgaacatatcaatctcctagaaagtttttgttgttgttttaggtttttagagcatacatgacgtattaccttgctctaaagggttgttgcattctgtatagaagaactaaaaaatgattgttccttatgactgaaatttgctttcaatcagaattttttttgttgtttttgttttgagactgaatctcgctctcacttcagcctggtgacagagcaagactctgtctcaaaaaaaaaagagaaagaaattgaaagaggctattgtcaagctgggctcaagtgaatatagcactgatagtaaacagcactgatagaatttctgtgaatgttagctatgaaagcagagttgtttgagcataggaaccaacacattcatttagcacttagcaaatatatattgagcacatactatgtgccaggccctgtgctgaacaaatgcagataaaagcactgaacaaggcacgtcttttaccctcaaaaggtcacaaaaggaaactaaggcaaattaagcaacaacaaaaaaaaatggattgtttatgtttgtatttactgtactgtctaatgaaatgtttttgttttatcttctaaggatgtagatgcttatttattacagttacattgagagatttcatctactaaagagcatttggtttttcaaaacatccctgaactgtataatttacaaaaaaaaaagtctcgtctgagaactgtgaactgtggaagaaatcaaaactattttttcttttaaaaagccacgtaatgaaaccactaatgaaatcccagcaatctgcttcacattgaagtggaaaaatatccaaaaggagcagcttcaatttcattgaggtgaaagtgcactatgaagattgttcacctttgctgcatttgggagttatatggttatttggtaacattaagaactactggattttaatgcaatcctgcataaaaatataatttatactatgtgaaaaaataagacaggacttaccactaggaaccaccaagaccaatcatcattaacttttttaagattgtgttttattaaaaaaaaaaaacacttaaatgtgtgcagctattttcttatgttgaaaagactgaaagtttaaaacatgaaaaaaatcaatattaaacattttttgttcacactgagatactgtgtatgtaaaatgccttaattattaataagccaatgtgttatgataccaatatctgttttaaaaaactaaaaccaaccatgcttctggcatgataaaatcatggaattaaatcaggggtttacattcttgtagagtgttcttgaaacactctctgcaccatttttaaaacttgagaatagttttagtatctctgatattttttgccagaatcatcatgtcatgtatgaatgtgttatccctatctaaggaaaaaggtgaatatgtttttgtatgaatgtttaactggaaatgtccatggacttggctaatttatatttactttttattgtacatagatttctaatatttttcattcctgtatcatttaaacttccttcatttgagtaaattcactaaatatttctattttttgcttttttaaattctgattttatatgaattctaattctttttcactacatatgttttaaagagttacatacagtgatttagaatggtttacagttaatgctgatcttgtattttaaattccaacactttgtgtcactacctcctctaatggttagtatgatatgctagcagactgtatgaggtctttttttaaaataccacttttagtgtcagtgaaccaaattctggaatgtcttaacagctctaaatcttacttgtcttgaaaatgattggggtttaataccactgctggtggttcacacatcatcccatccttaatatgcctgacaggcatctgagcaaaggtttttagtaattgaatttctctgcagtagtccttcaagcacttgaatgtaaacctttagcatttattcgtttaatgactactgatacgaatctcaagcagatttcttgctcttaaaagttatgtttcactgagttctggttttgtgtagctatattttatatagctagatattcctcacagtgaacatgaattgtaataattggttatttccttaagtctttagattataataatttcagattattgcacgtctgtgatttgagaggtgagttatttaagaggccagttttcaggacatgggaatttgaattgtaaacctgttatctctgtgaaacttttaacatgataaaatataacctttctttgtgcttaaaaaaaaaaggaacaaaacacacttggggggcccggccagaaatttttaaacatcttggccccgcccgagaagagaagggctttttcagaaccgctcttgttgctttccaaaaagccggccgtctacaaacacggggggggccaaagcaag

SEQ ID NO: 34560 - DNA, 2652 bp, Homo sapiens
cccggcgggccggcgcgcggccgcgtttgaatggccctgagtgggactcggcccagaagccgagggactctctaggctgccgggcgctggtcgtcagcgccgaggctgggctgaggcgccgcggtaccatgaggcgccggtacttaagagattatggcatcagaaacccacaatgttaaaaaacggaacttttgtaataagattgaggatcatttcattgatcttcctagaaaaaagatctctaatttcactaataagaacatgaaggaggttaagaaatctccaaaacagttggctgcttacataaatagaacagttggacaaactgtgaaaagcccagataaacttcgtaaagtgatctatcgcagaaagaaagttcatcatccctttccaaatccttgttacagaaaaaaacagtcccctggaagtgggggctgtgacatggcaaataaagaaaatgaactggcttgtgcaggccacctgcctgaaaaattacaccatgatagtcgaacatatttggttaactccagtgattctggttcttcacagacagaaagcccatcatcaaaatatagtgggtttttttctgaggtttctcaggaccatgaaacaatggcccaagttttgttcagcaggaatatgagattgaatgtagctttaactttctggagaaagagaagtataagtgaacttgtagcttatttgttgagaaatattcaaattttaaaacaacaattaagtggattatgggaacaggaaaaccatcttactttggttccaggatatactggtaatatagctaaggatgtagatgcttatttattacagttacattgagagatttcatctactaaagagcatttggtttttcaaaacatccctgaactgtataatttacaaaaaaaaaagtctcgtctgagaactgtgaactgtggaagaaatcaaaactattttttcttttaaaaagccacgtaatgaaaccactaatgaaatcccagcaatctgcttcacattgaagtggaaaaatatccaaaaggagcagcttcaatttcattgaggtgaaagtgcactatgaagattgttcacctttgctgcatttgggagttatatggttatttggtaacattaagaactactggattttaatgcaatcctgcataaaaatataatttatactatgtgaaaaaataagacaggacttaccactaggaaccaccaagaccaatcatcattaacttttttaagattgtgttttattaaaaaaaaaaaacacttaaatgtgtgcagctattttcttatgttgaaaagactgaaagtttaaaacatgaaaaaaatcaatattaaacattttttgttcacactgagatactgtgtatgtaaaatgccttaattattaataagccaatgtgttatgataccaatatctgttttaaaaaactaaaaccaaccatgcttctggcatgataaaatcatggaattaaatcaggggtttacattcttgtagagtgttcttgaaacactctctgcaccatttttaaaacttgagaatagttttagtatctctgatattttttgccagaatcatcatgtcatgtatgaatgtgttatccctatctaaggaaaaaggtgaatatgtttttgtatgaatgtttaactggaaatgtccatggacttggctaatttatatttactttttattgtacatagatttctaatatttttcattcctgtatcatttaaacttccttcatttgagtaaattcactaaatatttctattttttgcttttttaaattctgattttatatgaattctaattctttttcactacatatgttttaaagagttacatacagtgatttagaatggtttacagttaatgctgatcttgtattttaaattccaacactttgtgtcactacctcctctaatggttagtatgatatgctagcagactgtatgaggtctttttttaaaataccacttttagtgtcagtgaaccaaattctggaatgtcttaacagctctaaatcttacttgtcttgaaaatgattggggtttaataccactgctggtggttcacacatcatcccatccttaatatgcctgacaggcatctgagcaaaggtttttagtaattgaatttctctgcagtagtccttcaagcacttgaatgtaaacctttagcatttattcgtttaatgactactgatacgaatctcaagcagatttcttgctcttaaaagttatgtttcactgagttctggttttgtgtagctatattttatatagctagatattcctcacagtgaacatgaattgtaataattggttatttccttaagtctttagattataataatttcagattattgcacgtctgtgatttgagaggtgagttatttaagaggccagttttcaggacatgggaatttgaattgtaaacctgttatctctgtgaaacttttaacatgataaaatataacctttctttgtgcttaaaaaaaaaaggaacaaaacacacttggggggcccggccagaaatttttaaacatcttggccccgcccgagaagagaagggctttttcagaaccgctcttgttgctttccaaaaagccggccgtctacaaacacggggggggccaaagcaag

SEQ ID NO: 34561 - DNA, 1504 bp, Homo sapiens
cccggcgggccggcgcgcggccgcgtttgaatggccctgagtgggactcggcccagaagccgagggactctctaggctgccgggcgctggtcgtcagcgccgaggctgggctgaggcgccgcggtaccatgaggcgccggtacttaagagattatggcatcagaaacccacaatgttaaaaaacggaacttttgtaataagattgaggatcatttcattgatcttcctagaaaaaagatctctaatttcactaataagaacatgaaggaggttaagaaatctccaaaacagttggctgcttacataaatagaacagttggacaaactgtgaaaagcccagataaacttcgtaaagtgatctatcgcagaaagaaagttcatcatccctttccaaatccttgttacagaaaaaaacagtcccctggaagtgggggctgtgacatggcaaataaagaaaatgaactggcttgtgcaggccacctgcctgaaaaattacaccatgatagtcgaacatatttggttaactccagtgattctggttcttcacagacagaaagcccatcatcaaaatatagtgggtttttttctgaggtttctcaggaccatgaaacaatggcccaagttttgttcagcaggaatatgagattgaatgtagctttaactttctggagaaagagaagtataagtgaacttgtagcttatttgttgaggatagaagatcttggcgttgtggtagattgccttcctgtgctcaccaattgtttacaggaagaaaaacaatatatctcacttggctgctgtgttgacttgttgcctctagtaaagtcactacttaaaagcaaatttgaagaatatgttatagttggtttaaactggcttcaagcagtcattaaaaggtggtggtcagaactatcatccaaaacagaaattataaatgatggaaatattcaaattttaaaacaacaattaagtggattatgggaacaggaaaaccatcttactttggttccaggatatactggtaatatagctaaggatgtagatgcttatttattacagttacattgagagatttcatctactaaagagcatttggtttttcaaaacatccctgaactgtataatttacaaaaaaaaaagtctcgtctgagaactgtgaactgtggaagaaatcaaaactattttttcttttaaaaagccacgtaatgaaaccactaatgaaatcccagcaatctgcttcacattgaagtggaaaaatatccaaaaggagcagcttcaatttcattgaggtgaaagtgcactatgaagattgttcacctttgctgcatttgggagttatatggttatttggtaacattaagaactactggattttaatgcaatcctgcataaaaatataatttatactatgtgaaaaaataagacaggacttaccactaggaaccaccaagaccaatcatcattaacttttttaagattgcggtgtttgcgattgcggtgtttg

SEQ ID NO: 34562 - DNA, 2608 bp, Homo sapiens
aaagttcaatgcgagttccttatgatgagactttcttacaaaattaaaccatcaattaatttgtaattttttgagtatagaaattgaaagaagagggccgggcaaggtgctgggattacaggcgtgagccactgcgcctggcctatagaattcttaatgatgaaaatcttatgaacatatcaatctcctagaaagtttttgttgttgttttaggtttttagagcatacatgacgtattaccttgctctaaagggttgttgcattctgtatagaagaactaaaaaatgattgttccttatgactgaaatttgctttcaatcagaattttttttgttgtttttgttttgagactgaatctcgctctcacttcagcctggtgacagagcaagactctgtctcaaaaaaaaaagagaaagaaattgaaagaggctattgtcaagctgggctcaagtgaatatagcactgatagtaaacagcactgatagaatttctgtgaatgttagctatgaaagcagagttgtttgagcataggaaccaacacattcatttagcacttagcaaatatatattgagcacatactatgtgccaggccctgtgctgaacaaatgcagataaaagcactgaacaaggcacgtcttttaccctcaaaaggtcacaaaaggaaactaaggcaaattaagcaacaacaaaaaaaaatggattgtttatgtttgtatttactgtactgtctaatgaaatgtttttgttttatcttctaaggatgtagatgcttatttattacagttacattgagagatttcatctactaaagagcatttggtttttcaaaacatccctgaactgtataatttacaaaaaaaaaagtctcgtctgagaactgtgaactgtggaagaaatcaaaactattttttcttttaaaaagccacgtaatgaaaccactaatgaaatcccagcaatctgcttcacattgaagtggaaaaatatccaaaaggagcagcttcaatttcattgaggtgaaagtgcactatgaagattgttcacctttgctgcatttgggagttatatggttatttggtaacattaagaactactggattttaatgcaatcctgcataaaaatataatttatactatgtgaaaaaataagacaggacttaccactaggaaccaccaagaccaatcatcattaacttttttaagattgtgttttattaaaaaaaaaaaacacttaaatgtgtgcagctattttcttatgttgaaaagactgaaagtttaaaacatgaaaaaaatcaatattaaacattttttgttcacactgagatactgtgtatgtaaaatgccttaattattaataagccaatgtgttatgataccaatatctgttttaaaaaactaaaaccaaccatgcttctggcatgataaaatcatggaattaaatcaggggtttacattcttgtagagtgttcttgaaacactctctgcaccatttttaaaacttgagaatagttttagtatctctgatattttttgccagaatcatcatgtcatgtatgaatgtgttatccctatctaaggaaaaaggtgaatatgtttttgtatgaatgtttaactggaaatgtccatggacttggctaatttatatttactttttattgtacatagatttctaatatttttcattcctgtatcatttaaacttccttcatttgagtaaattcactaaatatttctattttttgcttttttaaattctgattttatatgaattctaattctttttcactacatatgttttaaagagttacatacagtgatttagaatggtttacagttaatgctgatcttgtattttaaattccaacactttgtgtcactacctcctctaatggttagtatgatatgctagcagactgtatgaggtctttttttaaaataccacttttagtgtcagtgaaccaaattctggaatgtcttaacagctctaaatcttacttgtcttgaaaatgattggggtttaataccactgctggtggttcacacatcatcccatccttaatatgcctgacaggcatctgagcaaaggtttttagtaattgaatttctctgcagtagtccttcaagcacttgaatgtaaacctttagcatttattcgtttaatgactactgatacgaatctcaagcagatttcttgctcttaaaagttatgtttcactgagttctggttttgtgtagctatattttatatagctagatattcctcacagtgaacatgaattgtaataattggttatttccttaagtctttagattataataatttcagattattgcacgtctgtgatttgagaggtgagttatttaagaggccagttttcaggacatgggaatttgaattgtaaacctgttatctctgtgaaacttttaacatgataaaatataacctttctttgtgcttaaaaaaaaaaggaacaaaacacacttggggggcccggccagaaatttttaaacatcttggccccgcccgagaagagaagggctttttcagaaccgctcttgttgctttccaaaaagccggccgtctacaaacacggggggggccaaagcaag

SEQ ID NO: 34563 - DNA, 2978 bp, Homo sapiens
cccggcgggccggcgcgcggccgcgtttgaatggccctgagtgggactcggcccagaagccgagggactctctaggctgccgggcgctggtcgtcagcgccgaggctgggctgaggcgccgcggtaccatgaggcgccggtacttaagagattatggcatcagaaacccacaatgttaaaaaacggaacttttgtaataagattgaggatcatttcattgatcttcctagaaaaaagatctctaatttcactaataagaacatgaaggaggttaagaaatctccaaaacagttggctgcttacataaatagaacagttggacaaactgtgaaaagcccagataaacttcgtaaagtgatctatcgcagaaagaaagttcatcatccctttccaaatccttgttacagaaaaaaacagtcccctggaagtgggggctgtgacatggcaaataaagaaaatgaactggcttgtgcaggccacctgcctgaaaaattacaccatgatagtcgaacatatttggttaactccagtgattctggttcttcacagacagaaagcccatcatcaaaatatagtgggtttttttctgaggtttctcaggaccatgaaacaatggcccaagttttgttcagcaggaatatgagattgaatgtagctttaactttctggagaaagagaagtataagtgaacttgtagcttatttgttgaggatagaagatcttggcgttgtggtagattgccttcctgtgctcaccaattgtttacaggaagaaaaacaatatatctcacttggctgctgtgttgacttgttgcctctagtaaagtcactacttaaaagcaaatttgaagaatatgttatagttggtttaaactggcttcaagcagtcattaaaaggtggtggtcagaactatcatccaaaacagaaattataaatgatgggtgagtatacctttaaagataaactcatgctgaaattttcttcaggaaagcagcttgattaaactaggtaataattttatcccattatcatcagtgtatggtatttattctttttatattcagagagatactaacttaagagactgttcatttgtgaaaaccacacctggaaattgaattccagagcctactaacctcctgtatctcttcttctggcacaaccctacccttcattttagaagaaaaacacaatagtggtttaattctcatattcattatgagtaagggaggaaaaagagatgcccacagtgtaataaggaatggaggcaccctgcggggtcctttacctagacattaacctgagagtccggtgttgatgtttacacttctaaaaactgtattattactgccttgatgtgaaaattcgtgggtattctaccagagtatagccagattatcatgaaaccacagaaaaatatctcccaacagtttccttaaagtccataattttgggccaggcacggtggctgatgcctgtctgtaatcccagcactttgggaggccaagaagggcaaatcacttgagctcacaagtttgagacagcctgggcaacatgatgacatcccgtctctacaaaaaatacaaaaattagccaggcatggtggtgtgcgcctgtagtcccagctactcaggctgaggcaggaggatcgcttgagcccaggaggtggaggttgcagtaagccgagatggcaccactgcactccagcctgggcaatagagccagcccttgtctcaaaaaaaaaaaaaaaaaagccacaatttattttgtaggctctcaaaattttctacttcacaccaaggaatgtccaaatgttccaaacgcctggtcattttcttacctgctttgacaactaaataacctttaattttctttttttttttaattgaaatcaagtaagaaattttattaattttggaattgaaaaaacatcctttgttgtttccaagaattaattaaataggaggcatttggcggtattatgtggataaacctttaattttcatgactgacatgtattattctaaaagttatttgacttttttttaatttctctccacgttcccaaatgttttatttcaaatagcatcattttctcctgaaaaatacctgaaaaattttagaacagtttttattatgcatatttatgatgaaagtttgtatcttaatgtatttgctttctcatttttcttccttttttttcttttagaaatattcaaattttaaaacaacaattaagtggattatgggaacaggaaaaccatcttactttggttccaggatatactggtaatatagctaaggtcctctgcgtgtaactgtgaccttggcagcaagcacaggaattggccattgaacatgtttcatgtacagcccctgaaatgctatgctagaggatatttacagagggttttaatcagagaaaagtatttgaaaaaattttgagaatccaataaggacagcatcagaaaacaagacgaggaactcaggaaacaagggataagaaacataattaaatggttttggagattaagttttacttttgctaatgttatgctttttgagaaggtaaactatttaaatcacagtgaatttgactttggtctttattgatttgtctcgtaaaggaaaaagtaaaaattgctagtttgaattttaatatttaaactccagaaaacattggtagttaggccgggcacagtggcttacgcctgtaatcctagcacttagggaggccaaggcaagcagatcacctgaggtcaggagttcgagaccagcctggttggtgaaaccccgtttctactaaaaatacaaaaaattacctgggtgtgatggcacgtgcctgtaatcccagctactcgggaggctgaggcaggagaatcacttgaacctgggaggcggaggttgtggtgagctgagatcgtgccattgcactccagtttgggcaacagagtgaaactccgtctcaaaaaaaaaaa

SEQ ID NO: 34564 - DNA, 1710 bp, Homo sapiens
cccggcgggccggcgcgcggccgcgtttgaatggccctgagtgggactcggcccagaagccgagggactctctaggctgccgggcgctggtcgtcagcgccgaggctgggctgaggcgccgcggtaccatgaggcgccggtacttaagagattatggcatcagaaacccacaatgttaaaaaacggaacttttgtaataagattgaggatcatttcattgatcttcctagaaaaaagatctctaatttcactaataagaacatgaaggaggttaagaaatctccaaaacagttggctgcttacataaatagaacagttggacaaactgtgaaaagcccagataaacttcgtaaagtgatctatcgcagaaagaaagttcatcatccctttccaaatccttgttacagaaaaaaacagtcccctggaagtgggggctgtgacatggcaaataaagaaaatgaactggcttgtgcaggccacctgcctgaaaaattacaccatgatagtcgaacatatttggttaactccagtgattctggttcttcacagacagaaagcccatcatcaaaatatagtgggtttttttctgaggtttctcaggaccatgaaacaatggcccaagttttgttcagcaggaatatgagattgaatgtagctttaactttctggagaaagagaagtataagtgaacttgtagcttatttgttgaggatagaagatcttggcgttgtggtagattgccttcctgtgctcaccaattgtttacaggaagaaaaacaatatatctcacttggctgctgtgttgacttgttgcctctagtaaagtcactacttaaaagcaaatttgaagaatatgttatagttggtttaaactggcttcaagcagtcattaaaaggtggtggtcagaactatcatccaaaacagaaattataaatgatggaaatattcaaattttaaaacaacaattaagtggattatgggaacaggaaaaccatcttactttggttccaggatatactggtaatatagctaaggtcctctgcgtgtaactgtgaccttggcagcaagcacaggaattggccattgaacatgtttcatgtacagcccctgaaatgctatgctagaggatatttacagagggttttaatcagagaaaagtatttgaaaaaattttgagaatccaataaggacagcatcagaaaacaagacgaggaactcaggaaacaagggataagaaacataattaaatggttttggagattaagttttacttttgctaatgttatgctttttgagaaggtaaactatttaaatcacagtgaatttgactttggtctttattgatttgtctcgtaaaggaaaaagtaaaaattgctagtttgaattttaatatttaaactccagaaaacattggtagttaggccgggcacagtggcttacgcctgtaatcctagcacttagggaggccaaggcaagcagatcacctgaggtcaggagttcgagaccagcctggttggtgaaaccccgtttctactaaaaatacaaaaaattacctgggtgtgatggcacgtgcctgtaatcccagctactcgggaggctgaggcaggagaatcacttgaacctgggaggcggaggttgtggtgagctgagatcgtgccattgcactccagtttgggcaacagagtgaaactccgtctcaaaaaaaaaaa

SEQ ID NO: 34565 - DNA, 1562 bp, Homo sapiens
cccggcgggccggcgcgcggccgcgtttgaatggccctgagtgggactcggcccagaagccgagggactctctaggctgccgggcgctggtcgtcagcgccgaggctgggctgaggcgccgcggtaccatgaggcgccggtacttaagagattatggcatcagaaacccacaatgttaaaaaacggaacttttgtaataagattgaggatcatttcattgatcttcctagaaaaaagatctctaatttcactaataagaacatgaaggaggttaagaaatctccaaaacagttggctgcttacataaatagaacagttggacaaactgtgaaaagcccagataaacttcgtaaagtgatctatcgcagaaagaaagttcatcatccctttccaaatccttgttacagaaaaaaacagtcccctggaagtgggggctgtgacatggcaaataaagaaaatgaactggcttgtgcaggccacctgcctgaaaaattacaccatgatagtcgaacatatttggttaactccagtgattctggttcttcacagacagaaagcccatcatcaaaatatagtgggtttttttctgaggtttctcaggaccatgaaacaatggcccaagttttgttcagcaggaatatgagattgaatgtagctttaactttctggagaaagagaagtataagtgaacttgtagcttatttgttgaggtaagtgtgaccttttatcctctttgttcaatcactttttttctgagacaagttcttgctttgtcatccaagttggagtacagtggcacaatcatggctcactgcagcctcaacctgctgagttcaagcagccctcccacctcagcctcctgagtagctgagagtacaggtgcacatcaccacacctggctattttttaaaaaaattttttggaagacatgaggtcttatgtttcccgggctggtctcgaactcctgagctcaggtgaaccttcttcattattctaaactgcctatatgtagcttcagtagagacagtatggcttaaattacattcctcacccatctaagagtaaccaaaatacagaaaacaatgttttatcagattgaacaaagctgttacctttcctgactgtcattcttacctataaaactaagagataacgatatgggaaaactaaccttctaaaaatcccttttgaggccaggtgtggcagttcttgcctataatcccagcatttgggaaggttgaggtgagagagtcccttgagcccaggagtgagagactgagcaacatagcaagactccatctctacaaaaaataaaaataataagccaggcacagtggtacgtgcttgtggtcccagatacttgggaagatcactttgaacccaggagttggaggttgcagtaagctgtgattatgcaactacattccagcctgggcaacagaatgagacccgtttcttaaaaaaaaaattactaaaaataaaaagtaaacatcccttttgagtgggaatttgaagcattactttcctcattgtattcaagtctctcagatgttaccttaggg

SEQ ID NO: 34566 - DNA, 296 bp, Homo sapiens
gctgtgacatggcaaataaagaaaatgaactggcttgtgcaggccacctgcctgaaaaattacaccatgatagtcgaacatatttggttaactccagtgattctggttcttcacagacagaaagcccatcatcaaaatatagtgggtttttttctgaggtaagtcttttctctaactcatatctagtttaactttgttcctgttataatcttgatttttttctttgccatattccactagcagaataatttgtcacctattgaatgtagacttatttgagtcatagtaactccctg

SEQ ID NO: 34567 - DNA, 1482 bp, Homo sapiens
attaaaatgctattttgggttgtcttcttttggtaacatattctgacactaagcaacatgttttacaatttagtgggatgaacctacaaattcataaatgcttctctttattttgaaggaaaaagatacttgtctgtatacgacataattgttttactcttcagaatgtgaaagttatattaatcactaaacactttaagaagtggttctggtaggatatcagtagtcagacttaattgaaaaactgtcagcgtctgttttgtatatagggattaaagaggataactttattttttcctttggaaagaataattcttttggaattttggaattttgattttcttagatgactttttagcaatttaatgataataatttctatttttcttccaaaactatggcatgttatagtagatcttactattaaagatcttttatattttaaactgtttttttcctattctgctttttgctgctctcaaagactgtgattgatgaacatcaccaaactttttttgtggcaaactgcttattttataagtagctttatataagaaaacttcttagaaaactatgtggctggttggttccatttagaaactcttaacaggtatggctttcattcctccagttgtttgcttttatagacttggagcaaaaaatatagcaaaaagtaatcatatctggctagatagccatttctctcagattcattgctataaaaatgaatctactgaggcataaaaatatgaaacatatttaattcatctcttttgtcagtttttctgggactccaatagcatttcagtgttatagagagtgacagtgacttgaatgcatgtatatgcacatagtcaattcagagcgtaataactaaaaattcagaatgacttgttttttgaaagtacttggaaattgtgctgctacttaaatattgaaggaattcagaaagttgtgtatttatcttaaaatgttccttctcacttattctactggaattgaccatgaaaaagaaaatattatgccttatttatatctaattattgactgtgcaaactgtgactcagtggatatttgtatgccccccaaaaacattttaaagctgagcaatttttaataaagatgtataaataattttgattattctcattgtagttaagttactgttagtttggtgcaatacattctttccttcctcatccttttaaaattaaatatataagatgtatgttttgttttattacattaagtgctatttttaaaaaattcattgtgtgtatatgagctaatacttgatttgtttctgtatagcatgattaaagataattgaaaattttgcacttattttaggcccttggaaatttgtattctaatactttttaagaatgtccatttattttgtacataataaattagctttgtatatgaaaatgggtttgaatcaaataaaaaaagtgatgttactttcttcaagatttgtaa

SEQ ID NO: 34568 - DNA, 882 bp, Homo sapiens
gttttttcagtgaagctctcagaatgtccagtacagatgttgcagataattccaagaactccttcagcaggtgttcttcaccattcgtaaacagtattttaagatgttcactttgctcttctttttggttacatacattttaataactggtatgttgaagtagtgtctaaaagtatctagtctttattcacagtacattatattgtgtgatgcactggactaactcttgtttaccattcatgtaacaaaacccagcacattatctgcactataagctcaaagaatgtcacatccgcccagacagctctttgatgagggtgatgggaactgaataaaccatacggactggcagtaacaagggcttttactgttctgttcagtggaaccttcttggtcaaattgtaattagctagcattatatttatatacagggtcttttttctttaccgatgtattttcctactcatagccaaccaataaattcagtatctgtttcaaatattttagaagtgtagtttgtatagctgtagtactgaggtttgaggaaaaataaatgttgatcagcagaccacgtatttaaaattctgaatcttctgggacagggttgtaactcagccttccaaagggaagagtgcagggggacggggccatgatatggggaaatggtgtaaactaatgtatttctttattggctgttattctgtataacactcatatctttgccaaagttcaattttatatttaggcaactgatggtccttttgcatttaggattttcgttgttgttaccttatacctcatgatataaggaatgggctcatgtgtcttccgtcttttggaaggaggttgacatattttaaataaatgcttttaaatacagta

SEQ ID NO: 34569 - DNA, 828 bp, Homo sapiens
gttttttcagtgaagctctcagaatgtccagtacagatgttgcagataattccaagaactccttcagcaggtgttcttcaccattcgtaaacagtattttaagatgttcactttgctcttctttttggttacatacattttaataactggtatgttgaagtagtgtctaaaagtatctagtctttattcacagtacattatattgtgtgatgcactggactaactcttgtttaccattcatgtaacacagctctttgatgagggtgatgggaactgaataaaccatacggactggcagtaacaagggcttttactgttctgttcagtggaaccttcttggtcaaattgtaattagctagcattatatttatatacagggtcttttttctttaccgatgtattttcctactcatagccaaccaataaattcagtatctgtttcaaatattttagaagtgtagtttgtatagctgtagtactgaggtttgaggaaaaataaatgttgatcagcagaccacgtatttaaaattctgaatcttctgggacagggttgtaactcagccttccaaagggaagagtgcagggggacggggccatgatatggggaaatggtgtaaactaatgtatttctttattggctgttattctgtataacactcatatctttgccaaagttcaattttatatttaggcaactgatggtccttttgcatttaggattttcgttgttgttaccttatacctcatgatataaggaatgggctcatgtgtcttccgtcttttggaaggaggttgacatattttaaataaatgcttttaaatacagta

SEQ ID NO: 34570 - DNA, 944 bp, Homo sapiens
gttttttcagtgaagctctcagaatgtccagtacagatgttgcagataattccaagaactccttcagcaggtgttcttcaccattcgtaaacagtattttaagatgttcactttgctcttctttttggttacatacattttaataactggtatgttgaagtagtgtctaaaagtatctagtctttattcacagtacattatattgtgtgatgcactggactaactcttgtttaccattcatgtaacaaaacccagcacattatctgcactataagctcaaagaatgtcacatccgcccagacagctctttgatgagggtgatgggaactgaataaaccatacggactggcagtaacaagggcttttactgttctgttcagtggaaccttcttggtcaaattgtaattagctagcattatatttatatacagggtcttttttctttaccgatgtattttcctactcatagccaaccaataaattcagtatctgtttcaaatattttagaagtgtagtttgtatagctgtagtactgaggtttgaggaaaaataaatgttgatcagcagaccacgtatttaaaattctgaatcttctgggacagggttgtaactcagccttccaaagggaagagtgcagggggacggggccatgatatggggaaatggtgtaaactaatgtatttctttattggctgttattctgtataacactcatatctttgccaaagttcaattttatatttaggcaactgatggtccttttgcatttaggattttcgttgttgttaccttatacctcatgatataaggaatgggctcatgtgtcttccgtcttttggaaggaggttgacatattttaaataaatgcttttaaatacagtagcaaacattgtgttggggttataataattcattaaatgtcttgttgcctgtaaaaaaaaata

SEQ ID NO: 34571 - DNA, 891 bp, Homo sapiens
gttttttcagtgaagctctcagaatgtccagtacagatgttgcagataattccaagaactccttcagcaggtgttcttcaccattcgtaaacagtattttaagatgttcactttgctcttctttttggttacatacattttaataactggtatgttgaagtagtgtctaaaagtatctagtctttattcacagtacattatattgtgtgatgcactggactaactcttgtttaccattcatgtaacaaaacccagcacattatctgcactataagctcaaagaatgtcacatccgcccagacagctctttgatgagggtgatgggaactgaataaaccatacggactggcagtaacaagggcttttactgttctgttcagtggaaccttcttggtcaaattgtaattagctagcattatatttatatacagggtcttttttctttaccgatgtattttcctactcatagccaaccaataaattcagtatctgtttcaaatattttagaagtgtagtttgtatagctgtagtactgaggtttgaggaaaaataaatgttgatcagcagaccacgtatttatgcagggggacggggccatgatatggggaaatggtgtaaactaatgtatttctttattggctgttattctgtataacactcatatctttgccaaagttcaattttatatttaggcaactgatggtccttttgcatttaggattttcgttgttgttaccttatacctcatgatataaggaatgggctcatgtgtcttccgtcttttggaaggaggttgacatattttaaataaatgcttttaaatacagtagcaaacattgtgttggggttataataattcattaaatgtcttgttgcctgtaaaaaaaaata

SEQ ID NO: 34572 - DNA, 430 bp, Homo sapiens
atatacgaccgagctagtaccctcgataagggcctatctgtttcaaatattttagaagtgtagtttgtatagctgtagtactgaggtttgaggaaaaataaatgttgatcagcagaccacgtatttaaaattctgaatcttctgggacagggttgtaactcagccttccaaagggaagagtgcagggggacggggccatgatatggggaaatggtgtaaactaatgtatttctttattggctgttattctgtataacactcatatctttgccaaagttcaattttatatttaggcaactgatggtccttttgcatttaggattttcgttgttgttaccttatacctcatgatataaggaatgggctcatgtgtcttccgtcttttggaaggaggttgacatattttaaataaatgcttttaaatacagta

SEQ ID NO: 34573 - DNA, 308 bp, Homo sapiens
acagatgcttcatatatacagattatcctggtaaataattggggatacacataaaaacacctgaaccaaagcatatacaaagtactagggaaagccacaagtggaaacaatagttctacctcaggaggaagaggtcaatgaaagttccatgaagaatgtagtatttgagttgggtattgaaggatgaataggagttaatgactctctaccaaactatctacagttcttagcagcaatatcctgttgtgtaccaagaatcaaaacatcccatattttctttaaaataaaagcatgacagaatcaatttt

SEQ ID NO: 34574 - DNA, 478 bp, Homo sapiens
aacttccagtttcccaagacgcaacattgaattcaatcagaggtaaagattctggactattggattaaatgaggaggcaggagctactatctcttgcagtgtgaaaccagggccggggatgaagatatggacacatctcagctttccagggatgctgtgatgtggtgaaattatgccattcattagaaggtgatactgtcatcaatgtgagaggcccaggactctgcagggcctgaagaaatcctgggcaatgagtctgagggaagtctctcagagcagctactctgagagagtaaagccgcagcctttgtggggtatgaaagcagcgttctcatggataaggcttatttgagacgaagtggaggccttgttttgtccacttaccgcaatgtccactgtccccaactgcagcatgccaacagcaaatgtgtttagtggatatgtgctttgtagctaacaagaaacagtaacatttatt

SEQ ID NO: 34575 - DNA, 743 bp, Homo sapiens
cagacgaggggcggtggtcacgcagcgctgggtccagtggtcgggggaaggcgaggattaccctcccggaggcgttgtctgcgactcggcggaggctccaacttccagtggcccggtcgggaaagatcagagcctcctaagaaatatccagaagtcaagccatggatccacctgcacgtaaagaaaaaaccaaagttaaagaatctgtcagcagagttgagaaggccaaacagaaatcagcccagcaggagctgaagcagagacaaagagcagagatctatgccctcaacagagtcatgacagaactggagcagcagcagtttgatgagttctgtaaacagatgcagcctcctggagaatgaggccccaggttcaaaccagatgggatcctgagagctttgagagggtgttgccagttttaagctgagatggcccatttggagccttacagaactagaccagaagacatttgtggataaatctgaactcacttcctgtgtgtaacttctaacttcactggttcctcccatctgaattggccacatgcttgctgaagagacttgttttcttcttctaagacagtggttttgttttttgggtttttttaaaaaaaaaaaaaaaaacacacacaaaaaacactttttctattgtttgagaaaaatcagtgtttctcatgaaactctatatcttctccaaaaatacaaataaaatactaataaaatgttcatttgctcatactttag

SEQ ID NO: 34576 - DNA, 858 bp, Homo sapiens
cagacgaggggcggtggtcacgcagcgctgggtccagtggtcgggggaaggcgaggattaccctcccggaggcgttgtctgcgactcggcggaggctccaacttccagtggcccggtcgggaaagatcagagcctcctaagaaatatccagaagtcaagccatggatccacctgcacgtaaagaaaaaaccaaagttaaagaatctgtcagcagagttgagaaggccaaacagaaatcagcccagcaggagctgaagcagagacaaagagcagagatctatgccctcaacagagtcatgacagaactggagcagcagcagtttgatgagttctgtaaacagatgcagcctcctggagaatgaggccccaggttcaaaccagatgggatcctgagagctttgagagggtgttgccagttttaagctgagatggcccatttggagccttacagaactagaccagaagacatttgtggataaatctgaactcacttcctgtgtgtaacttctaacttcactggttcctcccatctgaattggccacatgcttgctgaagagacttgttttcttcttctaagacagtggttttgttttttgggtttttttaaaaaaaaaaaaaaaaacacacacaaaaaacactttttctattgtttgagaaaaatcagtgtttctcatgaaactctatatcttctccaaaaatacaagttctcgtactagttaattggacaagttcagatttcgatttcccttgaccaattatccttgctacgtgatggattacctcttaatcgccctcccttttaactcgctgtttaggtatttgcacgcaattgggcgttcctttggcccaattccccg

SEQ ID NO: 34577 - DNA, 348 bp, Homo sapiens
gcaggtaacatttcctccccagttttcggggcagaaagtggaggcatagaaaagttaagaaaggccgggtgcagtggcccacgcctgtaatcccagcactttgggaagccgaggtaggcggatcacctgaggtcaggagtttgagaccagcctgaccaatgtggagaaaccctgtctctagtaaaaatacaaaattagcagagcgtggtggcacatgcctgtaataccagctacttgggaggcagaagcaggagaataacttgaacctgggaggtggaggttgcagtgagcttagatcgtgccattgcactccagcctaggcaacaagagtgaaactccatctcaaaa

SEQ ID NO: 34578 - DNA, 438 bp, Homo sapiens
atttttcatagtactacatttcagaaacagctacgaaaataaactaacctgacaaggagtatgcatcatctatatttttgggctccatggggcccataagggagagaagctattgtatccacagaaacatcttcttcctcccagacctggaccctatacaatcctatgcacataattttgcctatttcctttaaaaaaggtaaaatttcatgattttaaacattttatcaaaatcccagaatacctattaaaacctcacaacattcagcctgggaaagctgattgctaaaacaaaagaaaaccaaacctcacaacaaagcacttaccttatttccttatttttttccctgtctaggttagaaactccatgcagacagaaaccaatacccattatctagtgcagtgcctggcacaaggagggtcctcataaaatattaa

SEQ ID NO: 34579 - DNA, 1425 bp, Homo sapiens
  misc_feature (10)..(10): n is a, c, g, or t
aacctcgtgncatgagcatttagaaatggagaccacttctggtgaattgtcagatgtttccaatgatcccaccacatctgtctgtgtagctagtgccccaacaaaagaagcaattgacaataccctgcttgaacacaaagaaagaagtgagaatataaatcttaatgaaaagcaaattccttttcaggtgcctaatattgaaaggaactttagacagtcacagcctaaatcctatctttgccattatgaactggctgaggcccttccacaaggaaagatgaatgagacaccaactgagtggctgcgttataattcaggaatccttaacacacaaccaccattaccattcaaagaagcacatgtcagtggtcatacttttgtaacagctgagcaaatcctggctccattagctttaccagagcaagcattattgatcccactagaaaaccatgacaaattcaaaaatgtaccatgtgaggtctaccagcacattctgcagccaaacatgctggccaacaaggttaaatttacctttcctccagctgccctcccaccccctagcacacctctgcagcctttgcctttgcagcagtccttatgttctacctctgtaaccactatccatcacactgttttgcagcagcacgctgcagctgctgcagctgcagctgcagccgcagctgcaggaacctttaaagtgcttcagccacaccaacagtttctttcccaaatcccagctctcaccagaacctcattacctcagctctcagtaggaccagtaggaccgaggctttgtcctgggaaccagccaacttttgttgctcctcctcagatgccaatcattccagcttccgttcttcatcctagccatctggctttcccatctttaccccatgcactctttccttcactgctttccccacaccctactgtcatccctttgcaacctctcttctagtcatcaccataatgggaaaaaaatactcttgtgaaaactattgctatatgcgttaagtgttcatctatgtgggtacatggctatttaactggtggaaataaactggccgatacatggcgtcattggtttgaaatcatttactgtaagtgcaatgatgcaaataaatccctaagtttctgatatataatattattaaagcactgaatagtttgaaaatcaatacaatatatgctatatattaaaatgatgtcttaagagtatgtataatgtacataaaatatatttatagtactctaatttatgttgtaaagtatgctcccttggtttttcttaatctttgtgtatttgcacctatttaatgtttagacaaagctgatggcactatgttttgtatcatgttccttgaaactgtaaattcagtgaaaaatatctcttgcaataaatttttgttaactatttaagtaaat

SEQ ID NO: 34580 - DNA, 290 bp, Homo sapiens
gtctgtaagacgaaagacaaacaaaactacatactttatttcagtaaggtcatcaaaaacaagaaagtctggggaactatcatagccaagagaagcctaaggagacatgatgactaaatgtaatgtgatatcctacaacagaaaaagcactgggtgaaacctaagggaatctgaagaaacaattgactttagttaatttttaaaaatattgccaggcatggtgacatgtgcctgtagtcccagctactcaggaggctgaggttagaaggattgcttgagcctaggaattt

SEQ ID NO: 34581 - DNA, 463 bp, Homo sapiens
gattgaaacattttgtgatctttaccttttgacacatttcttaaaatgttgctatgaaaactgaaaatctgtcaattattaataattgtcagaagtctttaaaaattgataaaactatcctttataaattgctgtatacttttatatacttgaatgtgtgtttggtaaatctttaaagtttggtaattcacataattgattatgagccaaatgactccaatgtcctacaagtccttgaggagttagtgtatatatataacatatatatatataatatacacttggatgggattatttgaagcttgtctttctaggactggagattttaacctgagatctgcgggcttggaaagttggtgaacttcctaaaatagtcggggggtaaagaggggaggagcagctatgggaagagggttcatatttttcagtaattttttttttctttttttacatttttgttgtt

SEQ ID NO: 34582 - DNA, 637 bp, Homo sapiens
tggatagccatcaatacttcaaaaacattaaaagtatagactctatattatgaatattaaaaataaattttgggtcacagaaacagcatttgagaatcataaaatggatggcaaaaatagaaggatatttcagctaggcagtgggacagaaatactgatgtaaaagtagtgtgatttaaatggaatgagttgagaatctgaattcaccagttttaagttgcctgactgccgccacgtggggcatattgcttaaaacttctcttgagggtgattatatctaacccaggggacatttgggaatgtctagagacactgttgtttgtcagtattggggctgtgtgtttatgtgtgctactggcatgttgtaggtagaggcgggggatgctaatatctgcttgatgtcgtcacaatatacaggacagtattccgtccccttcttcctccctggtgggcccaattatttgtcccaaagtcagcagtgctgaggttgagaaaccctgggataatgcattctgaagtgctatacaagtgttagctaaggtgacattattagttgtagtcaaaactttatatggactataaaagtaaatttatggaatttatgttcaaggcacttaatgccggaataaaaaaaaaa

SEQ ID NO: 34583 - DNA, 370 bp, Homo sapiens
tccttaagatagattcaaactggaactgtgtcaaacagcatgggcatatttaaggctcctgatggataatggttccctgtgtagggaagcattcatctcattttactatcagtagcattgaatattttaaagtgccaatttaatacaaaatattgcgttggttcaatttacattcctttgaataataggtgacattgagccaatgtccacaatgtctatttgttacattatttttaatgtgcccagtactatattttaacttctttttagttatgcaaatgatagatgaatacatctcaaaaattttaacactatacagagccctctttgactgtctcctctctctttccctttccatccctataagtac

SEQ ID NO: 34584 - DNA, 397 bp, Homo sapiens
tccctcccagctattgaaggttcccagacctgcaggtgggccctggagttgagggtcccccacagtccgcccctccccggcttctgtccagcaaccctctttcttcactgagccctgtcccctgtccccagcacatgcttcactgagcgctgtcccctgtccccggcacacgggttccctgacttgctgtgtgttaccttctgaaggtaaatattttgtaccaccctggagtaggttgactcttgttttgtagaatcaggaagatttagcgataactggagactatctgatataaataaaattttactgtatacatgagaaatagaagtcccggtatttttaacctatagactgtatagtataactattttaatttagactgaagtgtttttagcac

SEQ ID NO: 34585 - DNA, 504 bp, Homo sapiens
ctagtatttgtttgtattagcttctttcaaaagaatttgtcaagaataacttgacctatatttagatttataaaatgtaacaatattttctatacttttactcaactgtatcatacatttttttaaatggtgattagtaactttgtactgttaaatactcatttggaattttttcatgagaggccagttcaaattacatgtatatatcaaaacaactacaatttaaggataaatgaaatacaattgtattaacttacaacaattactgaacatgtcagtacaacatgttactgaaaagttattaaggggagaatgatagggaccatgctattcacaaattattttcacgaaaataaatacttgaattaatcaatttaagtgtgtgacacttctgaatattttgttcatgtcattcatttgctatgcaaattcttcactgtgcagtgtactcctatttgtattctgataataatgagtgggttaataaagttttactgaaaaaaa

SEQ ID NO: 34586 - DNA, 698 bp, Homo sapiens
tcatttttcattaaccctaaagttctcactggcctctatgttccagtttcccttcatttgctgtgttctacaattatgaccaatgcctagccaaggtttttaatgctaactgctgtaacaaacatccccattatagtatgggctatgttcaaaatcagtgtatttctcggttctttcacagtctgttgcaggtagagtgggattcctaggcagcaagaccctaagcagtgattctagtcacaggctgcttccatcttctactggtttcatctggaaaacatgccctctgaaatggacactgaaaaagaagatagaaggcgtgtgcaaagttccacaggtcccataaccggccacagcacagaagtgatacttatcccttcctacttacattcccagaactcagtaacattcttggaagtctgggaaatgtcatcttcccagtgagcacaggaagagggaatgaaataggagttgatgaatacatagtattattgccacaactcaccctcctgtttgccacctatatttttccatttcttttatcatgcaagaaacacatttactccctctacaaagatgaaaatccaaagaaccaagcagtcattacaaccagcttacaagaccagaatttcctgataatacatgagtactccatctggtctagacatggctcttcttggtctgaggatctatgaaat

SEQ ID NO: 34587 - DNA, 678 bp, Homo sapiens
tcatttttcattaaccctaaagttctcactggcctctatgttccagtttcccttcatttgctgtgttctacaattatgaccaatgcctagccaaggtttttaatgctaactgctgtaacaaacatccccattatagtatgggctatgttcaaaatcagtgtatttctcggttctttcacagtctgttgcaggtagagtgggattcctaggcagcaagaccctaagcagtgattctagtcacaggctgcttccatcttctactggtttcatctggaaaacatgccctctgaaatggacactgaaaaagaagatagaaggcgtgtgcaaagttccacaggtcccataaccggccacagcacagaagtgatacttatcccttcctacttacattcccagaactcagtaacattcatcttcccagtgagcacaggaagagggaatgaaataggagttgatgaatacatagtattattgccacaactcaccctcctgtttgccacctatatttttccatttcttttatcatgcaagaaacacatttactccctctacaaagatgaaaatccaaagaaccaagcagtcattacaaccagcttacaagaccagaatttcctgataatacatgagtactccatctggtctagacatggctcttcttggtctgaggatctatgaaat

SEQ ID NO: 34588 - DNA, 454 bp, Homo sapiens
aaccccactgcctgccctgggtcatccttgatactcattcccttgtttctctcagtggcgggcatgacagcaacatgtcaaggccgcctaaccacagtcacagtgagagccaccagacgctggatccgggcagcaacttggggttcactgaagctttctccgtgcttttcctcacgctggcctccctatggccctgagaggtgcatgctcggcttgtttcatgggctgagtggttcagtgacttgctcgggatcacaaccaccgcacaggagcaccacacatggcctggactggttctcttccaactctaaaagcagcactcatttggttaacagtctttttcattttcaacacttctttcttttgaaggggggagcaaagcgtgatcggttgccttttataattctcgttttcaatttcaatctcttttaaaatgttgaaagagtcaaaaaaa

SEQ ID NO: 34589 - DNA, 1763 bp, Homo sapiens
catcaccagcacaccagaagctccctcctggtcctttccatcactactccctaccccaaaatgatcactatttaaacataataacctagattaattttgtctatttttattgtttagacactgtgcatttccatttatatactctcttatttctgacttttttttttcctctctggctttatttgtgagattcgtccatattgttaacatgagaatttttattttggcatagtattccatgtgaatatatgatcatttttaaattcattcttctattaatggtcattgagtagttcccaggtttaaactagtgctactgtgaacctttttgtatgtgtttggttaaacatatttctggtggatatatatgtaggaatggaattgctgggtcatagcaaatacctagatatttctgtagatattgccaaactttattccaaagtggttgtaccagtttattctccagccaggaatgtatgagaggtcccattgccccacatcctcatcaacccttgctaattttagtgtttttctttttatgattctaggggctatgtcctggtatctccttgtggttttaatttgtattttcttgataaagatgttaagatttttaatgtgtttattagccaattgtatatccattttgtgaagccacgtcaaatttcttgcatatttttctatggggttgtttctttttcttgctgatttgaaggaattatttacatacactggatacaagtcctttgttagagatgcagttggccctccttagctgagagttccacatctgcagattggaccaaccgtggctcacgcctataatcctagcactttggaaagctaagccaggcagatcacttgaggctaggagtttgagaccagcctggccaacatggcgaaacccagtctctactaaaaaatacaaaaactagctgggcatggtggcatgcacctgtagtcccagctactccagaggctgaggcatgagaatcgcttgaacccaggaggcggaggttgctctgggtgacagagtaagattccatctcaaaaaaaaaaaataaaggaaatactctggcccagtgaggtgctcatgcctgtaatcccagcactttgggaggctaaggtaggaatattgcttgaagccaggagtttaagaccagcctggtcaacattaacaaaaccctgcatattaaaaaaaaaaaagaaaaaaattaaccaggtgtggtgatgcatgtctgtaatgccagctactccacagcctgaggcagaagattgcttgagcccaggaatttgaggctgcagtgagctacaattccagcctgggtgacagagtgagaccatatctctaaataaataaataaatactcaaaaatattcaaaaaataatacaaataaaaaaactatacaggataacaactatttacatagtgttcacattgtattaggtattacaaataatctagagatgatttaaaatatgtgggagactgtgtgtatgttatatgcaaatactatgccattttatataagggacttgagcatccatggactgggtatttgccctagtcctgtgaccaattccccatgaataaagagacaactgtatatacctcatatatcttaccttgggctatatgtggcctctgcactcttttaatcgtgtctttcaatgaacagaagctccttattataatccaattaaaccttattcttttgtgattagtgctgttaaaaaaatatttgcctactctaaggtcaca

SEQ ID NO: 34590 - DNA, 1091 bp, Homo sapiens
catcaccagcacaccagaagctccctcctggtcctttccatcactactccctaccccaaaatgatcactatttaaacataataacctagattaattttgtctatttttattgtttagacactgtgcatttccatttatatactctcttatttctgacttttttttttcctctctggctttatttgtgagattcgtccatattgttaacatgagaatttttattttggcatagtattccatgtgaatatatgatcatttttaaattcattcttctattaatggtcattgagtagttcccaggtttaaactagtgctactgtgaacctttttgtatgtgtttggttaaacatatttctggtggatatatatgtaggaatggaattgctgggtcatagcaaatacctagatatttctgtagatattgccaaactttattccaaagtggttgtaccagtttattctccagccaggaatgtatgagaggtcccattgccccacatcctcatcaacccttgctaattttagtgtttttctttttatgattctaggggctatgtcctggtatctccttgtggttttaatttgtattttcttgataaagatgttaagatttttaatgtgtttattagccaattgtatatccattttgtgaagccacgtcaaatttcttgcatatttttctatggggttgtttctttttcttgctgatttgaaggaattatttacatacactggatacaagtcctttgttagagatgcagttggccctccttagctgagagttccacatctgcagattggaccaaccgtggctcacgcctataatcctagcactttggaaagctaagccaggcagatcacttgaggctaggatggtctcgatatctgacctcgtgattgccgctcatgctgtaatccaggattggaggtaaggttagatatgtgaagcagagtttagacagctggtaaataaaaaactgtttaaaaaaaggaaataccggggggggtgtggagcggatccagcggggaaagtggccgattggggggaaaccgggggggatttttatataccaaaaaaaaagggggggaaa

SEQ ID NO: 34591 - DNA, 657 bp, Homo sapiens
cgacgagatgggaactttctgaattaagcagcaattcccgcgctggttttctggggagtcctcgcctccagagctagttatgtatcaaatcccatttgcaagggttgtttgtcttgttcaaaggacaatgggtgtagccgatgtcaacagaagttgttcttcttccttcgaagagaagggatgcgccagtatggagagtgcctgcattcctgcccatccgggtactatggacaccgagccccagatatgaacagatgtgcaagatgcagaatagaaaactgtgattcttgctttagcaaagacttttgtaccaagtgcaaagtaggcttttatttgcatagaggccgttgctttgatgaatgtccagatggttttgcaccattagaagaaaccatggaatgtgtggaaggatgtgaagttggtcattggagcgaatggggaacttgtagcagaaataatcgcacatgtggatttaaatggggtctggaaaccagaacacggcaaattgttaaaaagccagtgaaagacacaataccgtgtccaaccattgctgaatccaggagatgcaagatgacaatgaggcattgtccaggagggaagagaacaccaaaggcgaaggagaagaggaacaagaaaaagaaaaggaagctgatagaa

SEQ ID NO: 34592 - DNA, 1256 bp, Homo sapiens
cggaaagtgcgcttgccacatcccttcggatcacttcgtcctcccgagagcgttctgccttctacagctcggaaagaaagaaatcttagctgtgaagtgaccgtggagaaagcgcaggaagcgacacaattggttagggaggcagagagtgtgagcgggcgcaccccttgcctggggaccgcgctcgcgggcggggacggagcatcccagtggctgcacccgccgctccgcgctcctgcctggcgtcgccaaccccgcggcggccgctggaattccagagctgccaggcgctcccagccggtctcggcaaacttttccccagcccacgtgctaaccaagcggctcgcttcccgagcccgggatggagcaccgcgcctagggaggccgcgccgcccgagacgtgcgcacggttcgtggcggagagatgctgatcgcgctgaactgaccggtgcggcccgggggtgagtggcgagtctccctctgagtcctccccagcagcgcggccggcgccggctctttgggcgaaccctccagttcctagactttgagaggcgtctctcccccgcccgaccgcccagatgcagtttcgccttttctcctttgccctcatcattctgaactgcatggattacagccactgccaaggcaaccgatggagacgcagtaagcgagctagttatgtatcaaatcccatttgcaagggttgtttgtcttgttcaaaggacaatgggtgtagccgatgtcaacagaagttgttcttcttccttcgaagagaagggatgcgccagtatggagagtgcctgcattcctgcccatccgggtactatggacaccgagccccagatatgaacagatgtgcaagatgcagaatagaaaactgtgattcttgctttagcaaagacttttgtaccaagtgcaaagtaggcttttatttgcatagaggccgttgctttgatgaatgtccagatggttttgcaccattagaagaaaccatggaatgtgtggaaggatgtgaagttggtcattggagcgaatggggaacttgtagcagaaataatcgcacatgtggatttaaatggggtctggaaaccagaacacggcaaattgttaaaaagccagtgaaagacacaataccgtgtccaaccattgctgaatccaggagatgcaagatgacaatgaggcattgtccaggagggaagagaacaccaaaggcgaaggagaagaggaacaagaaaaagaaaaggaagctgatagaa

SEQ ID NO: 34593 - DNA, 1340 bp, Homo sapiens
cggaaagtgcgcttgccacatcccttcggatcacttcgtcctcccgagagcgttctgccttctacagctcggaaagaaagaaatcttagctgtgaagtgaccgtggagaaagcgcaggaagcgacacaattggttagggaggcagagagtgtgagcgggcgcaccccttgcctggggaccgcgctcgcgggcggggacggagcatcccagtggctgcacccgccgctccgcgctcctgcctggcgtcgccaaccccgcggcggccgctggaattccagagctgccaggcgctcccagccggtctcggcaaacttttccccagcccacgtgctaaccaagcggctcgcttcccgagcccgggatggagcaccgcgcctagggaggccgcgccgcccgagacgtgcgcacggtaggcaacccacaccaaggcagccgcagctgcggcgcttgggtacaccgccgtggactccaaatggcctaagagcgttcttttagccctgcgctctcagtgcctttagagttctttcctttccccggagcgccggcacaacgcattatgccgctgggtcggagcttagggctcggcagaggttgctaattcactgattataatcaccttcctctccaactcgtccgcagctgcccgctctggattaagccgctccgcggctcgtgctaggcagttcgtggcggagagatgctgatcgcgctgaactgaccggtgcggcccgggggtgagtggcgagtctccctctgagtcctccccagcagcgcggccggcgccggctctttgggcgaaccctccagttcctagactttgagaggcgtctctcccccgcccgaccgcccagatgcagtttcgccttttctcctttgccctcatcattctgaactgcatggattacagccactgccaaggcaaccgatggagacgcagtaagcgaggatgcagaatagaaaactgtgattcttgctttagcaaagacttttgtaccaagtgcaaagtaggcttttatttgcatagaggccgttgctttgatgaatgtccagatggttttgcaccattagaagaaaccatggaatgtgtggaaggatgtgaagttggtcattggagcgaatggggaacttgtagcagaaataatcgcacatgtggatttaaatggggtctggaaaccagaacacggcaaattgttaaaaagccagtgaaagacacaataccgtgtccaaccattgctgaatccaggagatgcaagatgacaatgaggcattgtccaggagggaagagaacaccaaaggcgaaggagaagaggaacaagaaaaagaaaaggaagctgatagaa

SEQ ID NO: 34594 - DNA, 848 bp, Homo sapiens
  misc_feature (781)..(781): n is a, c, g, or t
ggagatagtgttgaagcaggttgctggcctggtggcatgattggagggaaagggcctgaatatttcctggattagtccagaatatttcctggattagtttagaaattcttcagtcccctctatcacttaggcttcctgtggattaactcgttttctctttgaaagtgtaaacatcccatgggcagggtccatcagagaacctcgacaagtgttgctctgtgtacaacctcccgggagggtgtctgtacaggtgaaatctggctgggataaatgtcaaggacatgtgtggggaaaggagagggaggaaagaaaccaacccttgctggtccttactgtgttcctgcactacacttagggctttttcatgagttaacaaagagctgctgcttatctccattttacagatgagaaaactgaggcccagaaagactcagtgatttgcccaagggtcacacagccagtgttggaaccagcatttacattcaggcctatgtgaactcaagttcagagcttttatttctccagcaggccaaggcacaaaaaattttaaaaacaacttgagtcccatcttcctgttggcatagtgtctggcagacatctttttgattcgttctgtccatctggaaacactgtggctgactctgtgttggcagctcccaggcccttggaggggaggttcaaaactcacatttttttttaacttaagagaattctggcagagtacacataaaagttgccattttaaccattttaaaatgttttatttatttaggagaccctntcttccaatatggcacgaagggaaaagacccataaagaatgtgctttttgactgggaccaccctccc

SEQ ID NO: 34595 - DNA, 493 bp, Homo sapiens
gaggcccagaaagactcagtgatttgcccaagggtcacacagccagtgttggaaccagcatttacattcaggcctatgtgaactcaagttcagagcttttatttctccagcaggccaaggcacaaaaaattttaaaaacaacttgagtcccatcttcctgttggcatagtgtctggcagacatctttttgattcgttctgtccatctggaaacactgtggctgactctgtgttggcagctcccaggcccttggaggggaggttcaaaactcacatttttttttaacttaagagaattctggcagagtacacataaaagttgccattttaaccattttaaaatgttttatttatttaggagacagtctcactctgtcacccaggctgcagtgtagtggtgcaatctcggctcactgcaacctctgcctcctgtgttcaagtgattctcctgtctcagcctcgcaagtagctgggattacaggtgtgtgccaaca

SEQ ID NO: 34596 - DNA, 936 bp, Homo sapiens
ttttgtcttatgcttccttgcactcgagtcacctacgttgtcttgctccgatatcgcccccgtgtctgctgtggaaaaatatgaattcaacctcattcccacccagcccttgcacaccggcattcaagatccatgcatgcagttgttgaaactgttttctttgggatcctatctttatgacaactggaatgattgtagatttatgacctcaaagagtagagcattccttttcctattttcccagctgctaaaatatgactgtctccattagaatttagaatccgtcttaagcttagagatggtaagagctgactggatgagtctaattctatgatttgtgagacatgcattaaaaccgtcagcagaacattctgatgatccacctacactcaaagaaaacacaattaacaccacagttaaaaccttctaatggagcccctgtcttagggatcaaggtattagaggtgctgcttcagggatggtgctacttcaaaagaactgaagttggagagacacctcccttcccaaatgcttctgcaggccactctggtgattcagaaaaccccaaccatatattcctttaccagcagcgcccacccttttccgtaactcagcttaccaaaatcagtgaaaattgagacagtgcttacccatgaaatatgtggtttttgaacaaaaaccccagaagttagttattcttataggaaactaaagatgccaccattgtaaatcataatactacagagacaaatgcacaggtctcccaaccacctcaaagtcaatacagcccatgttttctgagcacgtactgtgtgctgggcaccgtgctggacatgtgtgctgcctcatgacccgacaccaagcaagtcaccttgcccttggcaaggcaagtctcccctcatttctttcatttcagtaggacgttcatcttcaaag

SEQ ID NO: 34597 - DNA, 1692 bp, Homo sapiens
ttctaaagctactggagcacgggacacgtgtctgtacgctcctctcacaccccttactcggcagctgccccactcccgccgttgccgttgccctgagtcttccccactgttctgctgtgccagtgtgagcatctccccggcactcaagtccatgttctctccctcccgctcttcctcctgtctcttccatgctccctgttgcacgggacatcatgtgggcttgatgccgtacacagtccctgaccatggccccctactcttctccagaagtgtcacactagacaggagctgctgagtcaccaactcacctttccctagaatgtgggtttgttttttctcccccatcacttgcagaggtcttttttcaattatatgatcaagaatgagtctacaagaataccagcaccagacatagtgccaaatggccttttgtaagctgtttcgtgcccttgaggctcgcacttgtgctgggtgagcccaggaccgttagccttttcttttctaggtctggacactccggggttggttaggctagccactggggagaatacagctctggccttttttcatattttgctgcttctctttgtacagatctttccccctccacataccaaaaggaatcctaacctagttgaaatgctagttgcaattcagtttcatgagaatgctgaagtaggctgctgatttaaaattttcctcttccctgaaaatacacacacctagagaatttagggaaaggctcttagggcttgggaatcttatcttttcattccccacaaaatacctacaaagaaatgtctagtattccctcagtattcctcctcgtataggctctgaaagcaacctcattcccacccagcccttgcacaccggcattcaagatccatgcatgcagttgttgaaactgttttctttgggatcctatctttatgacaactggaatgattgtagatttatgacctcaaagagtagagcattccttttcctattttcccagctgctaaaatatgactgtctccattagaatttagaatccgtcttaagcttagagatggtaagagctgactggatgagtctaattctatgatttgtgagacatgcattaaaaccgtcagcagaacattctgatgatccacctacactcaaagaaaacacaattaacaccacagttaaaaccttctaatggagcccctgtcttagggatcaaggtattagaggtgctgcttcagggatggtgctacttcaaaagaactgaagttggagagacacctcccttcccaaatgcttctgcaggccactctggtgattcagaaaaccccaaccatatattcctttaccagcagcgcccacccttttccgtaactcagcttaccaaaatcagtgaaaattgagacagtgcttacccatgaaatatgtggtttttgaacaaaaaccccagaagttagttattcttataggaaactaaagatgccaccattgtaaatcataatactacagagacaaatgcacaggtctcccaaccacctcaaagtcaatacagcccatgttttctgagcacgtactgtgtgctgggcaccgtgctggacatgtgtgctgcctcatgacccgacaccaagcaagtcaccttgcccttggcaaggcaagtctcccctcatttctttcatttcagtaggacgttcatcttcaaag

SEQ ID NO: 34598 - DNA, 1329 bp, Homo sapiens
cttaaccttagaagttgtggagggggaaagatctgtacaaagagaagcagcaaaatatgaaaaaaggccagagctgtttcgtgcccttgaggctcgcacttgtgctgggtgagcccaggaccgttagccttttcttttctaggtctggacactccggggttggttaggctagccactggggagaatacagctctggccttttttcatattttgctgcttctctttgtacagatctttccccctccacataccaaaaggaatcctaacctagttgaaatgctagttgcaattcagtttcatgagaatgctgaagtaggctgctgatttaaaattttcctcttccctgaaaatacacacacctagagaatttagggaaaggctcttagggcttgggaatcttatcttttcattccccacaaaatacctacaaagaaatgtctagtattccctcagtattcctcctcgtataggctctgaaagcaacctcattcccacccagcccttgcacaccggcattcaagatccatgcatgcagttgttgaaactgttttctttgggatcctatctttatgacaactggaatgattgtagatttatgacctcaaagagtagagcattccttttcctattttcccagctgctaaaatatgactgtctccattagaatttagaatccgtcttaagcttagagatggtaagagctgactggatgagtctaattctatgatttgtgagacatgcattaaaaccgtcagcagaacattctgatgatccacctacactcaaagaaaacacaattaacaccacagttaaaaccttctaatggagcccctgtcttagggatcaaggtattagaggtgctgcttcagggatggtgctacttcaaaagaactgaagttggagagacacctcccttcccaaatgcttctgcaggccactctggtgattcagaaaaccccaaccatatattcctttaccagcagcgcccacccttttccgtaactcagcttaccaaaatcagtgaaaattgagacagtgcttacccatgaaatatgtggtttttgaacaaaaaccccagaagttagttattcttataggaaactaaagatgccaccattgtaaatcataatactacagagacaaatgcacaggtctcccaaccacctcaaagtcaatacagcccatgttttctgagcacgtactgtgtgctgggcaccgtgctggacatgtgtgctgcctcatgacccgacaccaagcaagtcaccttgcccttggcaaggcaagtctcccctcatttctttcatttcagtaggacgttcatcttcaaag

SEQ ID NO: 34599 - DNA, 1255 bp, Homo sapiens
tgttaaacaagtgcttgaaggcagtatgcttggtaaaagtcatcgccattctctaatcttgagtacccagggacacgatacactgcggaaggctgcagggacctctgcccaggaaagccagatgatgcatatcataaattattactcaccccatgttcccaccctcgagagacctccaaacaatcaccatgccacagtgaacattcagtaacaaaaattcagccagggttttcaccagcatgaatggcagtgattccaattaggaaaacagaaagaggagagttcagagccacctagaatggctcttgcaagatacgaaatcaaggcagcagcaacagggctgaacattcctcatccctaactctcccttcaccagtaggaaacccaggataactgcaatcaccgcaggcccatctggcctgaagttctactactagtagccctccatgggaccttcttaaggaagcatgtcaactcaggtaagggatgtaaggggatggatgaccctttgaggccaaagttggagcaaaaaacaccagatgttcctgtgcactgctcctaagagatggttctgaagaccagtttggggagaggtcaaaatactggacagaatctcagcaacatggaacctcaaactaagtgacagtcacagacaactcttccccaaagaaaataagcacagacatggtttgtggtaagcagaattataaagatgaattcccatctccctgtcagattaccagtatggtaaattaccagattacctggttatttattcaaacactaatacagttattgccttgatggaaacatacagatacaattaaaatcccaagtaccaaataaattgaccttaagacaaagactaagtaaatcacatgagccctctacaagcagagagtttttctccagctggtagcagaagccagagatttgaagcataggaagtattcaacacattattgctggcctgaaaatggaaggggccacataacgagggaaaccggtggcctctagaagcagggagcagtcccctgctgacagacagcaagccaagacctcagttctacaattgcaagacactcaattctgctaaggacaaaaatgagcttggaagtgaactctgagcttcaggtgagaacacggccaaacaacaccttgatttcagcttaaacaaagaatgcagccactccatgccagaattctgacctgtagaaatttgagctaataaatagatgttttaatagcttcatcg

SEQ ID NO: 34600 - DNA, 1463 bp, Homo sapiens
tgttaaacaagtgcttgaaggcagtatgcttggtaaaagtcatcgccattctctaatcttgagtacccagggacacgatacactgcggaaggctgcagggacctctgcccaggaaagccagaacaagccctgtgaaaaacaagctgctgtccctgctagaggcatcctgcaatccatggatgtttatcaccaagccattgttaacatgaggatccagtatctgccggaggagccccaccttctgctactattatgttcttcagatgagtagaagagagtggggagggagagagcaggaagaagaaaggaagaataatgtcttgaaattgatgatgcatatcataaattattactcaccccatgttcccaccctcgagagacctccaaacaatcaccatgccacagtgaacattcagtaacaaaaattcagccagggttttcaccagcatgaatggcagtgattccaattaggaaaacagaaagaggagagttcagagccacctagaatggctcttgcaagatacgaaatcaaggcagcagcaacagggctgaacattcctcatccctaactctcccttcaccagtaggaaacccaggataactgcaatcaccgcaggcccatctggcctgaagttctactactagtagccctccatgggaccttcttaaggaagcatgtcaactcaggtaagggatgtaaggggatggatgaccctttgaggccaaagttggagcaaaaaacaccagatgttcctgtgcactgctcctaagagatggttctgaagaccagtttggggagaggtcaaaatactggacagaatctcagcaacatggaacctcaaactaagtgacagtcacagacaactcttccccaaagaaaataagcacagacatggtttgtggtaagcagaattataaagatgaattcccatctccctgtcagattaccagtatggtaaattaccagattacctggttatttattcaaacactaatacagttattgccttgatggaaacatacagatacaattaaaatcccaagtaccaaataaattgaccttaagacaaagactaagtaaatcacatgagccctctacaagcagagagtttttctccagctggtagcagaagccagagatttgaagcataggaagtattcaacacattattgctggcctgaaaatggaaggggccacataacgagggaaaccggtggcctctagaagcagggagcagtcccctgctgacagacagcaagccaagacctcagttctacaattgcaagacactcaattctgctaaggacaaaaatgagcttggaagtgaactctgagcttcaggtgagaacacggccaaacaacaccttgatttcagcttaaacaaagaatgcagccactccatgccagaattctgacctgtagaaatttgagctaataaatagatgttttaatagcttcatcg

SEQ ID NO: 34601 - DNA, 618 bp, Homo sapiens
tcgccattctctaatcttgagtacccagggacacgatacactgcggaaggctgcagggacctctgcccaggaaagccaggtggtttccaaaaggaaaagctttgggagatagaagtcctcgttttgacctctgccctccttgtacaccaggagccagaaaaacttcatctcttttacaagaaacattgagattcctgtaaaattaagaaatcacacaatttgatggtctacattatctaaagcaaatgagacttctatttggaacaaagactaccttgttgggaaatgagtctgcaagttaaagtgttttctgggatcactctaagctccagtgtcaaggggtcaagtccttcaggaattctctgcctccactccctgtggcagagctagagtggctgccatgcttctgagctcagccagcatccagagagagagtgagatacagcctcctcttcttgaagcacccacttctaaactctgtgacagttttcttggaactctgttatgtggatctggagatgacaatgtcacagcactcccctctaagcctaaattcccccacaccgatgaactattagggtggtctgctgctgatcaaatgaaagtattccccagcta

SEQ ID NO: 34602 - DNA, 1021 bp, Homo sapiens
gggatctgtaactttctcctaaccaatacaatgtgacaaaggtgatggggtatcccttctgtaattaagtcctgttgtatggtaaagatgaaggaattttgaagatgtaattaaagcccctaacaattggatttaaataatcaaaagataaattaccctgggtggggcttacctaatcaggagagcccttaaaatgagtttagaagtcaggtacttaaagcagcagaaactctttctcttcattgctgatttttttttttacttttaatttaagttcaggggtatatatgcaggggtgtgatataggtgcctagtatcttttagttatttttcctgaccctctccctcctcccattctccatcctccagaaggcctcagtgtctgttgttcccctctatgtgtccatgtgttctcatcatttggctcccacttgcaagtgagaacatgcagtattggttctctgttcctgtgttagttttctaaggataatggtctccagcttcgtcaatgttcctgcaaaggacatgatgctgactttgaagatgcaagcttccacatctacagcctcaaggaaacaaattcagccaaccaactgagggagctttccttgtcctgcctcaagatgagatcacagtctgcccaacaccatgatttagaccttgtgacacctggtatggaagacccagttaagttctctccaaactcttgacccacagaacctgtgagaaaatatatggatattattttaaactgctaaatttgtagtaatttgttatgcagcaataaaaaaactaatgcaaggagatatcaattattgtaaaaagcttagcttttgttttaaaatatagttcaccagtagtaagttactaataagtaactaaacaaataaaagcaagccatttacaaatcaataataagagtaagtcatgaactaaagattgtaattaatcaatttctgtacgcctgtaatgaaaataaaggaggaaaagaaaatgaaagaaaagagaccagggacccgct

SEQ ID NO: 34603 - DNA, 860 bp, Homo sapiens
tgttaaacaagtgcttgaaggcagtatgcttggtaaaagtcatcgccattctctaatcttgagtacccagggacacgatacactgcggaaggctgcagggacctctgcccaggaaagccaggcttgcatgaaggaaatgatttcctatgattctgcttactgcttaaaaaaattaatcaagttttctgcctgacaagatccagtatctgccggaggagccccaccttctgctactattatgttcttcagatgagtagaagagagtggggagggagagagcaggaagaagaaaggaagaataatgtcttgaaattgttttctaaggataatggtctccagcttcgtcaatgttcctgcaaaggacatgatgctgactttgaagatgcaagcttccacatctacagcctcaaggaaacaaattcagccaaccaactgagggagctttccttgtcctgcctcaagatgagatcacagtctgcccaacaccatgatttagaccttgtgacacctggtatggaagacccagttaagttctctccaaactcttgacccacagaacctgtgagaaaatatatggatattattttaaactgctaaatttgtagtaatttgttatgcagcaataaaaaaactaatgcaaggagatatcaattattgtaaaaagcttagcttttgttttaaaatatagttcaccagtagtaagttactaataagtaactaaacaaataaaagcaagccatttacaaatcaataataagagtaagtcatgaactaaagattgtaattaatcaatttctgtacgcctgtaatgaaaataaaggaggaaaagaaaatgaaagaaaagagaccagggacccgct

SEQ ID NO: 34604 - DNA, 850 bp, Homo sapiens
tgttaaacaagtgcttgaaggcagtatgcttggtaaaagtcatcgccattctctaatcttgagtacccagggacacgatacactgcggaaggctgcagggacctctgcccaggaaagccagttttctaaggataatggtctccagcttcgtcaatgttcctgcaaaggacatgatgctgactttgaagatgcaagcttccacatctacagcctcaaggaaacaaattcagccaaccaactgagggagctttccttgtcctgcctcaagatgagatcacagtctgcccaacaccatgatttagaccttgtgacacctgagctcagatggaaaagaatggtgttactgagacccttcaagattcccagtgtaattcaataaagaaaaggcaacacaaaggggttgtatagaattcgccacattatggacccatgtcatagagagaatccacggtgcatttgttagctgcatttaaatgacaacactttcagatccaagatttatttgggataaaaatttacctggatgcaaggctattcagaatgaagattaatgatatggtttggctgtgtccccacccaaacttcatcttgaattcccacgtgttgtgagagggacctggtgggagataattgaaccatgggggcaggtctttctcatgctgttctcatgagagtgaataagtctcatgaaacctgatggttttataagggggaatttccctgcacaagctctctctctgccttttgccatccatgtaagacgtgacttggtcctccttgccttctaccatgattatgaggcctccccagccacgtggaactgtgagtccattaaacctctttcttttgt

SEQ ID NO: 34605 - DNA, 806 bp, Homo sapiens
tgttaaacaagtgcttgaaggcagtatgcttggtaaaagtcatcgccattctctaatcttgagtacccagggacacgatacactgcggaaggctgcagggacctctgcccaggaaagccaggcttgcatgaaggaaatgatttcctatgattctgcttactgcttaaaaaaattaatcaagttttctgcctgacaaggatcactctaagctccagtgtcaaggggtcaagtccttcaggaattctctgcctccactccctgtggcagagctagagtggctgccatgcttctgagctcagccagcatccagagagagagtgagatacagcctcctcttcttgaagcacccacttctaaactctgtgacagttttcttggaactctgttatgtggatctggagatgacaatgtcacagcactcccctctaagcctaaattcccccacaccgatgaactattagggataaaaatttacctggatgcaaggctattcagaatgaagattaatgatatggtttggctgtgtccccacccaaacttcatcttgaattcccacgtgttgtgagagggacctggtgggagataattgaaccatgggggcaggtctttctcatgctgttctcatgagagtgaataagtctcatgaaacctgatggttttataagggggaatttccctgcacaagctctctctctgccttttgccatccatgtaagacgtgacttggtcctccttgccttctaccatgattatgaggcctccccagccacgtggaactgtgagtccattaaacctctttcttttgt

SEQ ID NO: 34606 - DNA, 388 bp, Homo sapiens
gcccaaatgaacttcattaatgagaaaaaaagataactaatataagacaataccacttctctttattcaaataattggcagtcaattttacttggacaataactatggcctcaaatgtgatttcaggctcaacaaagcagtgcaatttaaggtctatcatgccttgttgtcatgcttcacgcagcctggaataagtaattcaataccccttacaggatcaccagctattaaaccaggataagagcttagaggcagaattacacattctatgatatattattattatataatgtattatttgtattctattattacatgtatacttcagtggcctgagttaatatttttccaccagccactaattccatactcaagagttattcatgaa

SEQ ID NO: 34607 - DNA, 748 bp, Homo sapiens
tcgccattctctaatcttgagtacccagggacacgatacactgcggaaggctgcagggacctctgcccaggaaagccaggtggtttccaaaaggaaaagctttgggagatagaagtcctcgttttgacctctgccctccttgtacaccaggagccagaaaaacttcatctcttttacaagaaacattgagattcctgtaaaattaagaaatcacacaatttgatggtctacattatctaaagcaaatgagacttctatttggaacaaagactaccttgttgggaaatgagtctgcaagttaaagtgttttctgggatcactctaagctccagtgtcaaggggtcaagtccttcaggaattctctgcctccactccctgtggcagagctagagtggctgccatgcttctgagctcagccagcatccagagagagagtgagatacagcctcctcttcttgaagcacccacttctaaactctgtgacagttttcttggaactctgttatgtggatctggagatgacaatgtcacagcactcccctctaagcctaaattcccccacaccgatgaactattaggtgagtttccttcaaatgtcatgtcttcactttatataggatagttaggatgtggtgggcggtagtgatagtcagagtttcttgtaaagccccaaagctgaagagagcaggcaagttcacccatatttttacaacagtgtcaggaagctggcagaggtgccctgtcgagc

SEQ ID NO: 34608 - DNA, 923 bp, Homo sapiens
tcgccattctctaatcttgagtacccagggacacgatacactgcggaaggctgcagggacctctgcccaggaaagccaggtggtttccaaaaggaaaagctttgggagatagaagtcctcgttttgacctctgccctccttgtacaccaggagccagaaaaacttcatctcttttacaagaaacattgagattcctgtaaaattaagaaatcacacaatttgatggtctacattatctaaagcaaatgagacttctatttggaacaaagactaccttgttgggaaatgagtctgcaagttaaagtgttttctgggatcactctaagctccagtgtcaaggggtcaagtccttcaggaattctctgcctccactccctgtggcagagctagagtggctgccatgcttctgagctcagccagcatccagagagagagtgagatacagcctcctcttcttgaagcacccacttctaaactctgtgacagttttcttggaactctgttatgtggatctggagatgacaatgtcacagcactcccctctaagcctaaattcccccacaccgatgaactattagggataaaaatttacctggatgcaaggctattcagaatgaagattaatgatatggtttggctgtgtccccacccaaacttcatcttgaattcccacgtgttgtgagagggacctggtgggagataattgaaccatgggggcaggtctttctcatgctgttctcatgagagtgaataagtctcatgaaacctgatggttttataagggggaatttccctgcacaagctctctctctgccttttgccatccatgtaagacgtgacttggtcctccttgccttctaccatgattatgaggcctccccagccacgtggaactgtgagtccattaaacctctttcttttgt

SEQ ID NO: 34609 - DNA, 1205 bp, Homo sapiens
gggatctgtaactttctcctaaccaatacaatgtgacaaaggtgatggggtatcccttctgtaattaagtcctgttgtatggtaaagatgaaggaattttgaagatgtaattaaagcccctaacaattggatttaaataatcaaaagataaattaccctgggtggggcttacctaatcaggagagcccttaaaatgagtttagaagtcaggtacttaaagcagcagaaactctttctcttcattgctgatttttttttttacttttaatttaagttcaggggtatatatgcaggggtgtgatataggtgcctagtatcttttagttatttttcctgaccctctccctcctcccattctccatcctccagaaggcctcagtgtctgttgttcccctctatgtgtccatgtgttctcatcatttggctcccacttgcaagtgagaacatgcagtattggttctctgttcctgtgttagttttctaaggataatggtctccagcttcgtcaatgttcctgcaaaggacatgatgctgactttgaagatgcaagcttccacatctacagcctcaaggaaacaaattcagccaaccaactgagggagctttccttgtcctgcctcaagatgagatcacagtctgcccaacaccatgatttagaccttgtgacacctgagctcagatggaaaagaatggtgttactgagacccttcaagattcccagtgtaattcaataaagaaaaggcaacacaaaggggttgtatagaattcgccacattatggacccatgtcatagagagaatccacggtgcatttgttagctgcatttaaatgacaacactttcagatccaagatttatttgggataaaaatttacctggatgcaaggctattcagaatgaagattaatgatatggtttggctgtgtccccacccaaacttcatcttgaattcccacgtgttgtgagagggacctggtgggagataattgaaccatgggggcaggtctttctcatgctgttctcatgagagtgaataagtctcatgaaacctgatggttttataagggggaatttccctgcacaagctctctctctgccttttgccatccatgtaagacgtgacttggtcctccttgccttctaccatgattatgaggcctccccagccacgtggaactgtgagtccattaaacctctttcttttgt

SEQ ID NO: 34610 - DNA, 865 bp, Homo sapiens
tgttaaacaagtgcttgaaggcagtatgcttggtaaaagtcatcgccattctctaatcttgagtacccagggacacgatacactgcggaaggctgcagggacctctgcccaggaaagccaggcttgcatgaaggaaatgatttcctatgattctgcttactgcttaaaaaaattaatcaagttttctgcctgacaagtggtttccaaaaggaaaagctttgggagatagaagtcctcgttttgacctctgccctccttgtacaccaggagccagaaaaacttcatctcttttacaagaaacattgagattcctgtaaaattaagaaatcacacaatttgatggtctacattatctaaagcaaatgagacttctatttggaacaaagactaccttgttgggaaatgagtctgcaagttaaagtgttttctgggatcactctaagctccagtgtcaaggggtcaagtccttcaggaattctctgcctccactccctgtggcagagctagagtggctgccatgcttctgagctcagccagcatccagagagagagtgagatacagcctcctcttcttgaagcacccacttctaaactctgtgacagttttcttggaactctgttatgtggatctggagatgacaatgtcacagcactcccctctaagcctaaattcccccacaccgatgaactattaggtgagtttccttcaaatgtcatgtcttcactttatataggatagttaggatgtggtgggcggtagtgatagtcagagtttcttgtaaagccccaaagctgaagagagcaggcaagttcacccatatttttacaacagtgtcaggaagctggcagaggtgccctgtcgagc

SEQ ID NO: 34611 - DNA, 743 bp, Homo sapiens
tcgccattctctaatcttgagtacccagggacacgatacactgcggaaggctgcagggacctctgcccaggaaagccaggatccagtatctgccggaggagccccaccttctgctactattatgttcttcagatgagtagaagagagtggggagggagagagcaggaagaagaaaggaagaataatgtcttgaaattgttttctaaggataatggtctccagcttcgtcaatgttcctgcaaaggacatgatgctgactttgaagatgcaagcttccacatctacagcctcaaggaaacaaattcagccaaccaactgagggagctttccttgtcctgcctcaagatgagatcacagtctgcccaacaccatgatttagaccttgtgacacctggtatggaagacccagttaagttctctccaaactcttgacccacagaacctgtgagaaaatatatggatattattttaaactgctaaatttgtagtaatttgttatgcagcaataaaaaaactaatgcaaggagatatcaattattgtaaaaagcttagcttttgttttaaaatatagttcaccagtagtaagttactaataagtaactaaacaaataaaagcaagccatttacaaatcaataataagagtaagtcatgaactaaagattgtaattaatcaatttctgtacgcctgtaatgaaaataaaggaggaaaagaaaatgaaagaaaagagaccagggacccgct

SEQ ID NO: 34612 - DNA, 687 bp, Homo sapiens
cataaaattccagctccaagacagataaaaatggtgtttctctttctcaggatgggtaattttattgtcattgtcatctctcgcttttttaggatccagtatctgccggaggagccccaccttctgctactattatgttcttcagatgagtagaagagagtggggagggagagagcaggaagaagaaaggaagaataatgtcttgaaattggtaaaagcgtttttgtttgcacatcctgcattattaatatttcttgtttagcataattagctaccctctcaagcttacacacaacctgcagtgtttatgccttccgatgatagctaaaccatcagcaaagcagtccaggtccctgaaggctgaatgcaggtggttctgaaggctgcaggatgcattcaaaaagcaggatacataagctttaattgttgctaaaaatacattcactagaagaatcggactccttctatctgtctggagtggataaaagccaactatggattcagtagtctaaagaaagtcgcagaagaacaaagaaaaggtagacaaatgggcccaaatgaacttcattaatgagaaaaaaagataactaatataagacaataccacttctctttattcaaataattggcagtcaattttacttggacaataactatggcctcaaatgtgatttcaggctcaacaaa

SEQ ID NO: 34613 - DNA, 597 bp, Homo sapiens
  misc_feature (160)..(160): n is a, c, g, or t
aggccgggccttggctggctgtggaagggttaaaacgcacacccagaggcagagagcagactccagagacccccctgggctaaagtgcatctccccctcagcctctgccttggttttgctgttgctccaatggttagttatacccagttaacgaagtgtntcagattcctttttctttgcttaaagcacagacttttctgtgaaatctgcttcccccattttcttgtttataaatttttaattctaataccagaggccacccgtgttcatggaaacagcggtgacctggtttccaggtgcccctctgcgcctgcccagtgagtgactgtgggtgagtcctggaacacacctcccctaaccccaatctcgtgttccgatgggtaaagagaagtggtggcacgtggcaactcctggaggcttggaaatggggtcctagaatattaatccaaagtggctgcagggtgcgccaagtccagccatcacacttaacggaggagaggccctggagagattgaatggcctgtaagctgtgatgttgaagggagaccctcaaacctggtgtatcgtagtttggatttctgaatataaagagcattt

SEQ ID NO: 34614 - DNA, 459 bp, Homo sapiens
tttttttttaatagatggagttgtccaggctggagggcagtggcatgatcttggcttactgcaacctccgcctcctgggttcaagtgattctcctgtctcaaaaaataataataataataatatcatccataatattagttgatagtctcttcataattctaaatccagcatttttcaaagcattaccaatgaaggagaacttttaagatgaagctaaatataaaaaaaaagtgaattactgcaaattactatacatagtataatttgaaattttggtaatattgtctaagacaaatcatccttttgggatagtttttttccatactgttcaaactacccttcatcctataacggcagacatggcctaatgattctcatttttaatcaacagtgttgtcagacatttcaatgattctgaacataatgttatgacattcagggccagagagcaagcattc

SEQ ID NO: 34615 - DNA, 497 bp, Homo sapiens
tatttgaagactgttaagactgattttcccatttgtttgttaacaaataacattttctatttgtaatgggcctgtggatgacttttgcccctttatatgttgggattgtttctgattatcatatgcttgcacaagcttctcatatattaatcatgtattgaacctttctcttcctctgaatatacttaaggcagcaagtgacattcatctcccatacctacaaaattttatacttggatatgctttaatttctcattttctgcatgggtcctttacattgtcatttttcttcaggtctgttctataaaatgtattcagacttttattcagagatatctccttattctggggctttttgcattaagaaacagtataatgtcatctaactcttaagaactacattgtattaatgtgcagattgaatagctgttaactcttaggttttacattggggtagtagatcagaagttcttaagaaataattgcttctatttaaa

SEQ ID NO: 34616 - DNA, 1881 bp, Homo sapiens
tgcaggaatggatgttcaacatagaaagggattgtgactgtacccctcatccaagcttgaacctaggggacatgcattctctgtggatgcagttaccctgaagtattccagaaaggctgtctacaggtgcatccatgctgagctcccatgggggaagcctcagctatgtcgatagtggatgaagaggagaagaaatcaccttctccaagacccttcatgggcaccagggctgactggctgttggggtagagccacagacgttttctgctgagccaagcattgcaactgtgcctctgctaaaagaaacttcccagaaatgggaagttctgggacttaaggcctgccatcttgtgttttttgtttcatggagtgctcccttgatgtcatgtacttcttcttcccttaggagtagaaatccctgaagtccagactactgtgaatgcaactcttatctgggtctagctgcctagtggggctgccacactccagggtggtgctgggggatgtctccaaggaatccagtgatgtgacctgtcctcaagtatcccagcagtgggtaccagcaccagttctgatggggatggcaggggagtgctgtgagattccttggtcatgaaaagccttagtgtgttggttttctcaagtactggttgtagtagtagatgaactggtcacatggacagactcaggatctcttggttagccagggtgttgcaggcaatagtgattgctgaggtcacacatgacttttctccttcctgcatgttgtcttcttctgcctgaagatgctaatctcctatgtcagttggcctccaaccagaaggtggtgcttgcaaaagagtaccagctgtggtggtggtaggatttatgctttgccttatgtacccaggggaagtactctggtgtctcaggcaattggtggggctatagagctccgaaaagtttctgttctttttattaagctaccagggtaggattgaggggcaaagccaggtgagggctgggtcaggcaagtctgtgctctagctctccatatgtgggcaaaagtagaggtcccagtggggatcagaaggcagttttctgactgctggggtatattgaaggaaaaagcacagctgcttctgctgcaccaaagagtctgcatggagaatggggagtagcaggtagcagcaagccctacgcagctttcatgcacttggcaaggcaaatctcatagccacagtgtaccactagcagcagctagctgggtttcagacagttgacactcagaactcaaaactgccccaggccattagcctttgcatggccttcaggccacatttctcttggtctccctacacagcaggggcacccctgtgctctcttatggctgcagcacacttcccacttgcccctcagttctggccaagggagcttgttcccactcatatcgtgaatctcagttgagcttctctcaacctgtgattgctgtctgagttagctggctgacttccacaaggtcccctgtgaggtaggatcagcagtggcttccctctgtccttgctggagactgggagtgcactgaaagcatgtccagtgctactccttctcatatactccccacggctcactgaatcagctttagtgctgggtagggttgagggcttcccttgtggcctggattgccaggttccccagtaggagtgcatatcctagaggtagtttatcctcctctcacactctagggacttagagttttccatctgcctcgtagtaagtttctgggttttttcctgaaaaaaaaattcacagtgtgaatctctccacactattttgtctttccaagtggtagaggcatgctcacagtgcctccaatccactctcttggggattaaaaaaaaa

SEQ ID NO: 34617 - DNA, 148 bp, Homo sapiens
acatatttgactgctggggaagtgtgaggctttgtctacgccacctgtttctggtggcgctgaaaacgggggccatgctggggaccctccctggttttggcttgttttgggttaggggctgaaatgcatattcatcaagctctgtatt

SEQ ID NO: 34618 - DNA, 707 bp, Homo sapiens
cagactttctggaaagagcaaattcttatattttacgaactctcagggaatacaaaaagagagaaagctctccaactgtttttatgagactagtagatcttcactacaagtgagcaaacacatagaaaggtagtatgagaagaaattatagatctgtctcaggaatacagaagctaaaattttcaacatcgtaggtaaaataaagggggagaaatacatcatgaccaagtagggtgtattcccagaaatttatcggaaaatctatcattgcagtgtacacgtgaaatgattgtagaagaacagcattatattcattttggattcagagaggtatttgagaaatttgaccactcaataacttagtaaagggctatttatcaaacctttggcaaacatagttaagggtgaatatttagcagccttaccattaatggtgggaacattctggggcagacccatgctcagtaattcagaaatgaggcataagaactggaaagaaagcaacgagactgattcaattgtctgtataaagaaaccagagaatgtacaacagattgttagacctaataagagttcaacaatttgaaagttgttcaaacaaaatcaacatactaagataattgtttttctatgccccagtgataaccagttgaagaatgcagtggtggaaaaaagattgatcctattcacaagagtaaaaaaaaaga

SEQ ID NO: 34619 - DNA, 317 bp, Homo sapiens
tttttttttttggagacagagtctcactctgtagcccaggctggtctcaaactcctggcctcaaatgatctgcccgcctcagcctcccaaagtgctgggattacaggcgtgagccatcgcacccaccaagaagtttaatttttaaaaaatcaaagagaaacatcagtaagcaattactatttagaaaatcatgttagccaagtgcgctggctcatgcctgtaatgccagcactttgggaggctgaggcagaagtgcttgagacgaggagtttgagaccagcctgggcatcacggtgaaaccccatctctattaaaaa

SEQ ID NO: 34620 - DNA, 234 bp, Homo sapiens
gtaatacaagccaggaatcagtggataaatgacacaccttctcattgtttggagggattgttgtaagacacattctacatagtgcttcttagggttaccagggattgagtcccagttgctgaaaatgggaatgaactcaacaaaatactctttattgacttttcctccgtccctctcactttctcatttcttcttcctgggaccactttctaaataagccacctgctactagga

SEQ ID NO: 34621 - DNA, 870 bp, Homo sapiens
atctaaatccatgtatatggattgtaaaactcaacatagtaaagataccagttatcctcacatagataaagaagtctaacaattcctatcataatcccagccaagattttttggagacaaagaaaagattattctaaaatttatatggaaaggtaagggaatcagatagctaagattttgaaaaataagaataaagggaggactgaatctacccaattgtaagacttactgtagttacggtaatcaagattgtgtagtattggtggaaggaaagagatagatacctaaatcaatagaataagatagagaactcagaaataaagccacgcaaatatgtccaacttattcctttgtttttgacacaggagattctataacttttaattaatcaactgaactgaatgggtacacatttattaaagcattttaaaagactagaacaataatcatgtcataatctacaaatatgaatgttgtttttagaatggctgctccatatccctttatttggatatattataatctaactagtactgtattattggatatttgttttctctgatttttgtaaatgttcatgttctctgcaatcaacatcctctatatatacatgtttaacgactttttaaaaatcaattctttagggaaaataatcttatagggggatttactaggtcaagggcaatgtacaatttaaaagttttttttatatgtgttgctaaattgccttccagacttgttgaacagatttaaattctcatcagcagtgtctgagattgtcatgggaaaacttttcaatgaagtaaccccaattgatctatagcactttcggttgctgagaatgtctaataaaagcaaaagaacaaatga

SEQ ID NO: 34622 - DNA, 389 bp, Homo sapiens
tcttttatcatcagtttatatactgctggtaggaaaaaaatgtaccatatttctgtgaataattttgacaaaatgccaagcatcttaaaattttttatgttctttgattttggtatttcaactttgggttgtttgccttagatttacaggcaaattttgtgaacaaagacgtttgttgtttacctctttatgctccatactttgaacagttgctgggacatggtggtcagtaaatagttgttgaactaaaaaacaattagaaataaatttgatattccacaagagggaaatgatacgtatacatgatggaatatagtacagctattacaggcgacattttaaaagaatttttaatgagattgggacattttggagaatgatcttttatc

SEQ ID NO: 34623 - DNA, 164 bp, Homo sapiens
ctggcttgccaggaaacggccaatggccgaaccttgggtacacctatgagaacatgtctgtcatacttatgaatgtcaaccaattttgtgtgtcttgcaaaaacggtcaaaaactagtgctttaaaaagcctatctatcttttacacagatctgttgatggtgt

SEQ ID NO: 34624 - DNA, 518 bp, Homo sapiens
gaaacagagaaagctgagtttaatcctagccaaaccatttagtaggattaacttttgcttaagtaggcagcgtaactttggagatgacaatacttagctgaggtagatgatatttcaaaataagtaaacacccttcccaattcctttacttacaggatttactataggatgctacaggcactaaacactcccttttccagatgcctttgtagggagagatggctatgcaaacagagctggccaataaactataaataggctgggtgtggtggctcacacctgtaatcccagcactttggtaggctgaggagggcagatcacgaggccaagagatcgagactatcctgaccaacatggtgaaaccccgtctctactaaaaatacaaaaattagctgggtgtggtggtgcatgcctgtagtcccagctactctggaggctgaggcaggagaatcgcttgaacctgggaggcggaggttgcagtgagctgagattacaccactgcactccagcctccagcc

SEQ ID NO: 34625 - DNA, 2574 bp, Homo sapiens
ggagcccaggagtatcccgaggctgcacggggtaggggtggggggcggagggcgagtcttggtcttgagctgctggggcgcggattctctttcaaagccagaaccaggcctgtcccggacccgcgtcccggggaggctgcagcgcagagcagcggggctggggccggtggggggccgtttgggacgcgcggagaggtcctgagcgcggtggctctgcgtctcctagctctgatctccaggctacccctgtgattccgcgcagaggtacctctcggaggacgccggggtcccatgggcggcgccgcgcagggcgctaggaccccgcggggagcggaggcggcctcggcccgggagcctggaggacctggccggtcgatccgcccgggctggaaaactttctttataattacttctccaggtcggagcgcgcggcttgctaggcgcgcggggccggcgctgttacccggcgtggagtcgccgattttttttcctgcgggaccgcggggccccccagactagcggagctggacgccggggcgagcacggggaggggcgcaccgagggaggagacaaacttaactctggggccgggattccgaggcgggggccgcagccctcgaggcccgaagccaccgcttcctcccccgcctccccattcaggtgggcgccaacggcgggagcgagggtgtccaggccgccgggctgccaggtccgagcacgcacagggagaactctgcccagtggttcgccgggcgctgtagtccccgggatcctagggaccgaggcggccaggccctggggccccttgagtgcggcagctaatgctctcaccgcggcgggggaaggagcttgccaccgagacccccagccacgtgcgtccctcgcattctttaccggggccggggtggcggctacggaccgtcagctgggcccagatggagtcttgggagccctcaagtgtctcctgtccttgcccgcgccgcccctcgccactggcgctgaggcctgacgccgcctgcgtcccggctagaggcgcgcttgcctacaggtgagggaagacccccttcaccgacagtggccttaggcctggcaaggcgccacgacccgcccaggagccccggagggggcacagctaaaaacaccgctggagagccccgagcttccacgacgatcgcagtaaagaagcagtttcatctgggcaacgcacactgcgctttaatcaagttcctattcaacatagtcccagtgattaatagcccaactgcttcgttttcggtccagagctcataaacaagatatttttagcttgacgcttttggacgggagggagtaaaaaccagatacgttaaataaatatcccgatgtgagccggagagctgcttgctgagccaaatgcaggacccattcatatagcattcacctgtggagggagacctggacggaaatcaaaaagcaccaagagcgatttgcgtttttttctgcggtgctaaaactaatggcttttcctacctaggaacaaagaaacgccactgtacatgcacggttcccggcctgtggagttgtgggaggaaggcgatgtctggccttttttgcacagctgctgttgcctgcccagagatcgggaactctgccccgtaggactggaagaaacctcagtaatgggaataagactttgtccaatagggggctgatgaatgtgtgggggcgacaatggcaaggagtgggactcccggcccggggttcgccaaccccaggggccacaggtcctcctacaattgaaccagaattcacccacccgggcctgccctgtgcagggtgccgagagcccagggatgcatgagagggtggctcctgcctctgggaactgggacagtgggagagacggataagttgtcacacagaggctgctgggaggaaggaggagacagaaggagtaggggatgggacttcattcattcatcaaatgcacacgaggcacaaatgggaatcaagggtggatgtgctgtgatgaagagaagtcctgccctgaacaaggtggcgctgtggaggaggcagagatcagatttgtctgcggaggtgttatggactgaactgtgtccctgccccaaattcctgtgttgaaggcctaacccccatgtgactgtatttggagataaggcttttaggaagtcattaaagtgagatgatgtcatatgggtagggtcctaatttgataggattggtggccttatcagaagaacaatgtcatgggcatgcacagaaaggaggtggccgtctgcaagcagggaagaggcccctcaccagaacctgagggtgctggcagcttggctttggccttgggcatccagcctccagaaccatgagaaataaatgtttatggtaggtctatgatggcagcctgcttggactgaaccggcggtgagacagggcttcatgcaggagcagacctttgagctgggccttgaaagctgaggcaggagaattgcttgaaccttggcgtttgaggctgaggtgagctatgatggcaccactgcactccatcctgggtgataaagcaagatcctgtctctaaga

SEQ ID NO: 34626 - DNA, 491 bp, Homo sapiens
gtcttttgacttgtaacctagtgatcactgggttataacagtgccaggtatcatgtcctcatgtaactgtgttcagggtaggaagaagaggatgggaagataaaagagagtttttatattaggagggaaatccttcctgtaagtcccctagcacactccttattatgtcctattggccagatctggatttgttggtcattcctagttgcaagggagactgggaaaagaagtgtctggcaaaagggaatgcgattcctacgcttggcttagagagctcatgatccattccttggaactgggctcatggctgcccctgttagcagggaagcagaatgaatagctgttgagtaggcagccaatggcttctgccatactcaattaatgtgtgactggaaatgagatttttatcttttgttccacactggccaagggatatggcctctgttaccatgtaatataaccctttgagacaaatacatttaagaccagaa

SEQ ID NO: 34627 - DNA, 326 bp, Homo sapiens
ttgtacatcttaagtttgaaatgcccatgagacatcttgagttgctggatagttaagtctggagttcagaaaagaaataggacaggccgggcacagtggctcacacctgtaatcccagcactttgggaggctgaggcgggcggaccacctgaggtcaggagtttgagaccagcctggccaacatgatgaaaccccgtctctgctaaaaatttaaaaattagccaggtgtggtggcacgtgcctgtaatcccagctacttgtggagctgagacaggagatcacctgaactcgggaagcggaggttgtagtgagccaagattgtgcca

SEQ ID NO: 34628 - DNA, 491 bp, Homo sapiens
gtttctcatatgctcaccctaaaaacccttagtattgtcaacctcccacatggatggaactcactaatgaggttcttaatctcacaaacacagtccatagttgaaattgtgactgtcatatgtgaacattcagccagagttgaaatggtgaaacatttctaaacccagctcctaggcaggtaaggcatcttctttctggactcagccaattggagacatgttgactctcatacctgggcttagggccacaagtacaatcatgggtccataccagcatgaaggtctcagacaagattgcactcccatgcatacagtacaaagccctcaagtaggacagagaatgttctaatagacctcaggacacaggtgagattgtgacactcataagcacacccagccaacagtaatgattgtcaccctcccacatgaacacaacacattgttgagattctgaaccccacaataaaaaaaaagtgccaaaagttgaacaa

SEQ ID NO: 34629 - DNA, 475 bp, Homo sapiens
gtgaataactcactacaactaaatacagtgaatatcgtaaacctagaataaggagtctgttagatcaatttgaaaccattcaaatcatttcaacctttgatttatatggagggatttggcaagtggctttaaaatcaaaattaaaaatagcttgggaaacagcagatggaggatatgagttgatgctttaccctatagacccaggaggcccgcctgcccttcccagacaactggccaatgaattattgggtcaactgaggacctctgccaagcgcctgttcatgcctccctcacgtgtagtaaaaggcatgaatgcgccagcccatctagtcttgagctttggtgctaaactttctggcttagtatggagttggatttctagaaatcacatattcaaatcatgggatttatgagccccattgcagataaacattggagccattgaaaaattggcaaatacctaggatcgtgtttt

SEQ ID NO: 34630 - DNA, 502 bp, Homo sapiens
gtaggattcatctgcactcacctatgcactggcctatcctccccgctgtcagtaacgtttgagttccctagatctcatctatgccatgtatacgagcatgatctccatccacgaaacggggcagggggactgggggggcactaatcagctggaattagtcatactcacgtgtactgtgccccttgacttctgttgtcatctgcctctggatccctcaaatccagttttcctttctagggcttcaactggaagcttgggattgagtttgggacaaaaaaaaaaacctcaggagggtacatggactcattaagataagtcccaggtggcccttgccagactgcagtcaacagccaggagggctgctctttcactgctttcttaccataagccaaaagctaaggtgaaaactgtggaactgaatcctcctcaaacaagggagagaacagggagtcccttagaatttgggacctgacctaggaacatgtcttccagaaaaaaaaaa

SEQ ID NO: 34631 - DNA, 369 bp, Homo sapiens
ggaaatttggtttgtttttgcataaggatttccaatagttttaccaccatttcttgaaactactatgctttctctattaaaccacatttgtgactttagttaaaatcagtcacatatatcacagggctatttctgactctcaattctgttacattgtctattagtgtatattgatgtcagtactacacttttaattactattgcttcagggtatgtcttgtaaaccaaaaataaaattataggccccccccgcccctgcacaaccaactgaatggacccatcctctcagccaagggcattccaaaattaacctgaaaaactagttcaagccatgatgggaagggggagttggacatgtctcatcacacc

SEQ ID NO: 34632 - DNA, 264 bp, Homo sapiens
tagacaaaagactctatgactttgaaaaataaaactgggtggggaaaatatttgccacatatatagttggttaccatctctcttatgtaaagatctctacaaatcagaaagtgacttttaaaaatctatcaggccaggcacagtggctggccaggtgcagtggctcacacctgtaatcctagtactttgggaggatgaggcgagcagatcacttgaggtcaggaattcgagaccagcccggcccacatggtgaaaccccgttta

SEQ ID NO: 34633 - DNA, 1298 bp, Homo sapiens
ggaggttacagtgagctgagatcgtgccactgcactccatcctggacgacagagtgagactctgtctcaaaccaatcaatcaatcaatcaatcactgtcctggccagttgcagtggctcacgcctataatcccaacacttcgggaggccaaggtgagaggataacttgaaactaggagttcaagaccagccaaggcaacatagtgaggccccatctttacaaaaatacaaaaattagctggacgtgtagtcccagctacttaggaggctgaggggcaaggattgcttgaggctgagagattgagcctgcagtgagctatgacgatgccactcgctgcattcaagtctagatgacagagcaagaccctgctcctggacatactactaagtgctttcagcatttcatgtggtcctcataaaaatcttgagggccgggcatggtggctcacgcctgtaatctcagcactttgggaggccaaggcaggtgggtcacctggggtcaggagttcgagaccagcctgaccaatatggtgaaaccccatctctactaaaaatagaaaaattagccaggtgtagtggtgtgcacctgtagtcccagctcttcaggaggctgagaaaagagaattgtttgaacctggaaggcggaggttgcagtgagccaagatcacagcactgcactgctgcctgggcgacagcgagactctatctcaaaaaaaaaaaaccccacacaaccttatgaggtagaattccattttagagacgaggaaactgggaccctcaattatgcagaatggatgagtggtaccgccaaaattcaaaccccagactcccgaactcatgctcagaactattacaacatgcagaaacaacaaatccagtcatgtgtgcattttaatttggcatagcaacaacaacacatttctcaggcaaaatggatttccagcttctcttgaaaaatcctgaaatctagtccaggaccgtggattgtatttaaaaaaattaaaaatagaagaagaaaaggccgggcatggtggctcatgcctgtaatcccaacactttgggaggctaaggcagctggatcacttgaggccaggagttcaagaccagcctggcaaacatggtgaaaccccgtctctattaaaaatacaaaaattagctgggcgtggtggcgtgcacctgtagtcccagctactcaggatcctgaggcatgagaattgcttgaacctgggaggcagaggctgcagtgagccaagacaatgccactaaatccagctggacaacagagcgagactcagtctc

SEQ ID NO: 34634 - DNA, 590 bp, Homo sapiens
tctgagacagggtctcactctgttgcccagactgagtgcagcggtcctcgacctcccggtctcaagtcattctcccgcctcagcctcccaaagtgctgggattacaggctgagccaccatgccccgccttcaagacaagaaaagccttttctagaagactcctggcctcaggcctgatctctctccttggccgcacctaaggcgcacttaaggcgatcactcacaaggagaacaagtgaaaagtcccttgggattcatccctgagtcataggggaatgatgcacaccagaaggatgctgggctctgccagtccagccccaccagcctcctggagtggccctgaggccggctctccagaccctaggacctgctcctggaggcaggggctcctggaagcgcccctgacactgctccgggtgtctcttcaaggactttcccacattctacaaagaaaccttttggggacagtcagcaacatgtaaccgatagtggaaccagggcagccctgggttaagggtggtagacacgtgccccgcgagggagatctcagactggagaagggaacggcctcctaggcagacctgtactgc

SEQ ID NO: 34635 - DNA, 404 bp, Homo sapiens
gcatgttaacatttatgagcctgttatgtttcttacatgtgtatactcatttaattctcactactattctttattattcccatttaaacagatgaggtaacttgaggttcagagagcttcaattatttgcccagagtcacagttatttgtaaaactggggctggagtccaggtcttctgattcttaatccaggggtttcattgcctcataatagtaacagtggatgtctcttcgcttcactcaaatgctcttttgataaaatatgatttgcttcttggagcttgtaaataacctttatttcacagttcctgctgatactggacaccagtctgacacttaagacacttggaagcttaaggaactttttgttataaagaaaagcagatcaaggaccatcttatgct

SEQ ID NO: 34636 - DNA, 807 bp, Homo sapiens
aattttatatcaccaagcaaaagattgataggatattatgggatgtgaattgttttggtaacaaacaaaaaaaaaaaatgagaagggagaatgaagactctaatatctgtaattttcaggtaaagtttatccctctatatcgggctttaaagagatggcaaagcctgcttgtatgactcttgtagataacaatcactgtctcattcagacttgaggagtaacggctatagtgaatattcaatgtaggttaaactgataaccctgccagtagcctggcttcacagttgcttaactcctaagagatgttcacctctgtcttaccacagttaccataaactccttgttatgaggaatggtcctactgtccaagacctaacaacctaacttcagactcttgatcataacctcctatccttttcaccgtcgctaccctcaaaacttctttatacaacctctttcttgttcaacttgtggctattcctacaaccacctgtgtggcgtggtttgcctcctcatccagcttggccccaccatcagcctttcacccactacactctcaagatcacacacacgttctgaacatccccttctcccaccgttccactgctcctgccttgtcatcctccagtctcccctctcctgccttgtcatcctccagtctcccctctccatacagatgggtggaggtggaaagcaaagtcatgaaaatgctcccagcggctccactttcacattcgtccatgtaatttcaggcggactcttcctgacactgggcaacccctttgtggctttcttaacaactcagta

SEQ ID NO: 34637 - DNA, 342 bp, Homo sapiens
cctgcccccaggactgtgggcctttgctcttgctggtccttttgcctgcatcctccccaccctggcttggtgagcccctactcaattttcagttctcatctcctgtcgcttcctcagtgacagaaccctgacacactaaccgagatctcatcccccctctgacatgctctcatagcatcaccaaatacctctcactcctgacactacttgtagctataatcttatagctggctgtggtctctcacactacactgctagctccatgaggacagggactgtgtctccactctgatatgtccaaggcatggcactgtgcctggactgttgtaagcaatcaaaaaa

SEQ ID NO: 34638 - DNA, 1873 bp, Homo sapiens
gccttgcacatggagatgcttagctgagggggtggctttgttagactatttgcaggtcgtgagatagagcctgagatgggggactgggcccctgcctgggggattgggtcgtgacctgtgtggagccccacactgagctgcagtgggtggggagggtggtttacaggggtgctctgtgcagcccctctgattttcccctgggagtcccaggtccaggggaaggaggacagtggcccaggccacacagctcactgggcggctctcactcccccagggctggctgctggcgggatggacaccctggaggaggtgacttgggccaatgggagcacagcgctacccccacccctggcaccaaacatcagtgtgcctcatcgctgcctgctgctgctctacgaagacattggcacctccagggtccggtactgggacctcttgctgctcatccccaatgtgctcttcctcatcttcctgctctggaagcttccatctgctcgggcgaagatccgcatcacctccagccccatttttatcaccttctacatcctggtgtttgtggtggcgctggtgggcattgcccgggccgtggtatccatgacggtgagcacctcgaacgctgcaactgttgctgataagatcctgtgggagatcacccgcttcttcctgctggccatcgagctgagtgtgatcatcctgggcctggcctttggcacctgggagagtaagtccagcatcaagcgggtgctggccatcaccacagtgctgtccctggcctactctgtcacccaggggaccctggagatcctgtaccctgatgcccatctctcagctgaggactttaatatctatggccatgggggccgccagttctggctggtcagctcctgcttcttcttcctggtctactctctggtggtcatccttcccaagaccccgctgaaggagcgcatctccctgccttctcggaggagcttctacgtgtatgcgggcatcctggcactgctcaacctactgcaggggctggggagtgtgctgctgtgcttcgacatcatcgaggggctctgctgtgtagatgccacaaccttcctgtacttcagcttcttcgctccgctcatctacgtggctttcctccggggcttcttcggctcggagcccaagatcctcttctcctacaaatgccaagtggacgagacagaggagccagatgtacacctaccccagccctacgctgtggcccggcgggagggcctggaggctgcaggggctgctggggcctcagctgccagctactcgagcacgcagttcgactctgccggcggggtggcctacctggatgacatcgcttccatgccctgccacactggcagcatcaacagcacagacagcgagcgctggaaggccatcaatgcctgagggcagctgccagggcctgtggaggacaggccagagaggaggccagcaggcccagagtccccaggggaggaggaccaggtcaagggacgttctgtgggcagtagccctgtgtggccctgttcccaccatgagtctggaggccccacctccctggggctcccaatcccctttgccatctctgctctcactggggaccctcctccccttcccacctgctctcatactgctcagtgacatggcccaggctttccttccagggccatgcttggcaaggttggctgagggcaccctccttctctgcacccttggcacgagggcagggctggctctcccaatgcctccatcccatccccatggtgctttggcctcctcaaagcatccaccatggtggatggactgaagtgtgtatattttcttgatctattttttaataaaaaggaaaaggagcagaaggtgctaa

SEQ ID NO: 34639 - DNA, 544 bp, Homo sapiens
aggcgactgttggtcaattccttccttatctggtggccccatcagcctggagaggaaggctcttcctgaatcactcagtgaggcttccatgcccctcttttccttttatcagctcggagcccaagatcctcttctcctacaaatgccaagtggacgagacagaggagccagatgtacacctaccccagccctacgctgtggcccggcgggagggcctggaggctgcaggggctgctggggcctcagctgccagctactcgagcacgcagttcgactctgccggcggggtggcctacctggatgacatcgcttccatgccctgccacactggcagcatcaacagcacagacagcgagcgctggaaggccatcaatgcctgagggcagctgccagggcctgtggagggctggctctcccaatgcctccatcccatccccatggtgctttggcctcctcaaagcatccaccatggtggatggactgaagtgtgtatattttcttgatctattttttaataaaaaggaaaaggagcagaaggtgctaa

SEQ ID NO: 34640 - DNA, 1842 bp, Homo sapiens
gccttgcacatggagatgcttagctgagggggtggctttgttagactatttgcaggtcgtgagatagagcctgagatgggggactgggcccctgcctgggggattgggtcgtgacctgtgtggagccccacactgagctgcagtgggtggggagggtggtttacaggggtgctctgtgcagcccctctgattttcccctgggagtcccaggtccaggggaaggaggacagtggcccaggccacacagctcactgggcggctctcactcccccagggctggctgctggcgggatggacaccctggaggaggtgacttgggccaatgggagcacagcgctacccccacccctggcaccaaacatcagtgtgcctcatcgctgcctgctgctgctctacgaagacattggcacctccagggtccggtactgggacctcttgctgctcatccccaatgtgctcttcctcatcttcctgctctggaagcttccatctgctcgggcgaagatccgcatcacctccagccccatttttatcaccttctacatcctggtgtttgtggtggcgctggtgggcattgcccgggccgtggtatccatgacggtgagcacctcgaacgctgcaactgttgctgataagatcctgtgggagatcacccgcttcttcctgctggccatcgagctgagtgtgatcatcctgggcctggcctttggcacctgggagagtaagtccagcatcaagcgggtgctggccatcaccacagtgctgtccctggcctactctgtcacccaggggaccctggagatcctgtaccctgatgcccatctctcagctgaggactttaatatctatggccatgggggccgccagttctggctggtcagctcctgcttcttcttcctggtctactctctggtggtcatccttcccaagaccccgctgaaggagcgcatctccctgccttctcggaggagcttctacgtgtatgcgggcatcctggcactgctcaacctactgcaggggctggggagtgtgctgctgtgcttcgacatcatcgaggggctctgcgcttcttcgctccgctcatctacgtggctttcctccggggcttcttcggctcggagcccaagatcctcttctcctacaaatgccaagtggacgagacagaggagccagatgtacacctaccccagccctacgctgtggcccggcgggagggcctggaggctgcaggggctgctggggcctcagctgccagctactcgagcacgcagttcgactctgccggcggggtggcctacctggatgacatcgcttccatgccctgccacactggcagcatcaacagcacagacagcgagcgctggaaggccatcaatgcctgagggcagctgccagggcctgtggaggacaggccagagaggaggccagcaggcccagagtccccaggggaggaggaccaggtcaagggacgttctgtgggcagtagccctgtgtggccctgttcccaccatgagtctggaggccccacctccctggggctcccaatcccctttgccatctctgctctcactggggaccctcctccccttcccacctgctctcatactgctcagtgacatggcccaggctttccttccagggccatgcttggcaaggttggctgagggcaccctccttctctgcacccttggcacgagggcagggctggctctcccaatgcctccatcccatccccatggtgctttggcctcctcaaagcatccaccatggtggatggactgaagtgtgtatattttcttgatctattttttaataaaaaggaaaaggagcagaaggtgctaa

SEQ ID NO: 34641 - DNA, 840 bp, Homo sapiens
aggcgactgttggtcaattccttccttatctggtggccccatcagcctggagaggaaggctcttcctgaatcactcagtgaggcttccatgcccctcttttccttttatcagctcggagcccaagatcctcttctcctacaaatgccaagtggacgagacagaggagccagatgtacacctaccccagccctacgctgtggcccggcgggagggcctggaggctgcaggggctgctggggcctcagctgccagctactcgagcacgcagttcgactctgccggcggggtggcctacctggatgacatcgcttccatgccctgccacactggcagcatcaacagcacagacagcgagcgctggaaggccatcaatgcctgagggcagctgccagggcctgtggaggacaggccagagaggaggccagcaggcccagagtccccaggggaggaggaccaggtcaagggacgttctgtgggcagtagccctgtgtggccctgttcccaccatgagtctggaggccccacctccctggggctcccaatcccctttgccatctctgctctcactggggaccctcctccccttcccacctgctctcatactgctcagtgacatggcccaggctttccttccagggccatgcttggcaaggttggctgagggcaccctccttctctgcacccttggcacgagggcagggctggctctcccaatgcctccatcccatccccatggtgctttggcctcctcaaagcatccaccatggtggatggactgaagtgtgtatattttcttgatctattttttaataaaaaggaaaaggagcagaaggtgctaa

SEQ ID NO: 34642 - DNA, 479 bp, Homo sapiens
attgtccccacaagagacagctttacagggccatgtcagaatatgtcaaagaaatatatttttgggtaaagtacttctgtttctttcagggcctgcaatctgtcatgtgatgctatactagagtcaggttgaaatttggtgtcttattgctacaaagtctgttttgtcagtcttgggatctcttttaatgctaacgctggtcagctgtgcctgaattccatagggagaagggcataatgaggcaagttcgaccccacattcccattatggcttgaactagtttttcaggttaactttggaatgcccttggccaagagcaggagtccattcagttgggtggggggcttagaatttatttttcggtttataccgtgcttactgatgttggcccacgtgcattcattcattgccatgaccccacgttcctttccttctagcctgtgaccctagggctgctgtggtgggactgcaaaaaaaaa

SEQ ID NO: 34643 - DNA, 289 bp, Homo sapiens
agaaggggaagagttgtgctcctgaaacccagacactattggaacagggtaaatgtaaaattaaaatatttactgcatagatgaagagagctatgtggaaatacagtcaagcttttattatcattagaatatcacaggaaacatttgtatcctctttaaatattggattgagctgtcttttttttttttttttttaagatggagactcactctttcgcccaggctgaagtgcagtgagctgagatcaatcacgccattgcactccagcctgggtgacaaagcgagactc

SEQ ID NO: 34644 - DNA, 463 bp, Homo sapiens
ctttggaccttgacagaccacttcataagctttagattttgagaatttcacagcataaagctcatcgctgatgcagtaatgaaggaaatgttctacaagttaatagatgagtgagagaagagggcattcatattagatttatttacttactgaactcagagccttgggttactgcttgacccccactgttatctagtttaagggtccttttattttttgtttttttgaggtggagtttcactcttgttccccaggctagagtgcaatggcccggtctctgctcactgcaatctccgcctcccagattctcctgtctcagcctcccaagtagctgggattataggtacccaccaccacgccctgctagtttttgtatttttagtagagacagggtttcaccatattggtcaggctggtctcgaactcctgacctcaggcagtctgcccacctcagcctcccaaa

SEQ ID NO: 34645 - DNA, 432 bp, Homo sapiens
gaggttgcagtgggccaagattgcatcaccgcactctagtctgggccacagagggagactctgttcctaaataaataaataaataaatacataaaactggtaatactgagtcactgagagagagagtattaaaaaataaaaatgggccaggcacggtggctcacgcctgcaatcccagcactttgggaggccaaggtgggccgatcatctgaggtcaagagctggagaccaacctggccaacatggtgaaacccagtctctactaaaaatacaaaaattagccaggcatgatggcgggtacctgtaatcccagctactcgggaggctgacacaggagaattgcttgaacctaggaggccgaggttgcagtgagctgagatcatgctactggactccagcctgggtgacagagcaagactctgtctcaaaaaa

SEQ ID NO: 34646 - DNA, 482 bp, Homo sapiens
taagcacttctcagagaatgctattgaagggataacgcccagggaacaatgaagaggataagatgaagaagctgcaattctgcctgggtgccttggggtgtattttacttataacctgtgtgttttccacagtccctgcttcccgaggttgtggtattggtaggggtaacaggccaatcggtgtggcttcagcttctgaggatctgccgggtgctgaggtctctcaaactccttgcacaattccgtcaaattcaaattattattttggtcctggtcagggccctcaaggtgatttgactgttgcaagctaaagcagggggcaaggtagataaatgtgagggcttaacatagaatatgaagcaaattggccgggtgcggtggctcacgcctgtaatcccagcactttgggaagccgagggggatgggtcatgaggtcaggagttcgagaccagcctgaccaacatggtgaaaccctgtctcta

SEQ ID NO: 34647 - DNA, 88 bp, Homo sapiens
cactaccaagaggttaaactattctgtccccagatgtggaaatttttagacatgaaggaaccaaaataaacttctcaaaaaattacta

SEQ ID NO: 34648 - DNA, 416 bp, Homo sapiens
gaccacattagtgagagaagtgagacacagatgtgacctctgctgttagagttaaaaatagagtgagaatcagattttaaaacttgtttttgcttgggattttataaaaatagtgttctaatttggtaagtaaaaactggtgtcttaatttgcatttttttttagcgaagttaaactttttacttgtttattgaatacgttttaagaagttatccttgactttaagaaattatccttgactcacttttcttttttgatataagtatttttaatttatttctaaatactcaaaaaatagaaactattagctctttgtcatatttttacaagtattatttcccagtaaaacaattttttaacttaaaatttatatatagaatctcgctgtgttgcccaggctggtcttgaactacttg

SEQ ID NO: 34649 - DNA, 610 bp, Homo sapiens
gtatagcactttatactttttttttcaaagcgttttcacatccattatctcatttgatcctcacaacaaccttatgaggtaggtagggcaggtggtatgacccccattttacagctgagaaaactgagacccagaaagattaaatgactaggcaaaggtcacacagctgggaccagacccttacttcttcactgcaggtccttgttctttctgtgtaccagggaccttagtccctgggtagagggaggcagaatctgtggtagcagggctttctcgaaggtctttggtggctcctaggctgttgtagaatgtcagagactctccatccctagccagccttgtccttgatgccctgcaatggtggttttcaaactgtgagtgcctgtgttccaaaaagtcctggatcacttaaactgatgggttgaacttttccttcccatgcatatctcttccttccccaaattggattaaaccagaagagctccattgtcatctagtttatgtattggagttccagtcaacattttgttaaagaaaaaagcaaagatttctgctaaataaaaaaagaaccagaaacgtttgaaaaccactgctctgggatggcaagaat

SEQ ID NO: 34650 - DNA, 413 bp, Homo sapiens
ttccttcccaaacactgttttactcataacttataggctcaaaatcatttacttaagcaccataactaggcactcaaggcctttcatcagctggtcttactctacctttctaatcttagtttccattatttccttacacaagcccagtaaaatcagtactcactgtactttggacataactttctgcttttctgtctctgtgcctctgctcaaaatgttcgtcatctctaatactctctttcctcaatcttagaaaatccaatatttcttcaagcctttaatggagcagagttcatctgacctccccaatatctactgcattttactgttgtgtatatgcatacatatgtctgctttgtgttccttgcttcagttaaaggacagagatggaaatgtatctatctttataacca

SEQ ID NO: 34651 - DNA, 411 bp, Homo sapiens
  misc_feature (2)..(6): n is a, c, g, or t
tnnnnnatgcagcacagactgtacacatataaagggtatcctgacagaggaatagctccataaataaagggtagcaattacgtgaagggtccggcctccttctgtagaatcagagctgtgaaatcaggcaccttttcagagaactccagtgggtaactggagcactgcctgggttagatcctggctccacccctttccagtgtgacctagtcataatttgcatccagtaacctctgaccccagggctccacactctcacatggcccctgtttaaacctgctgcaaagtaatctccaggtcaagctcctattcctggcctgttctatgatgttcccttcctctatcccacaaacccccagagacttgccttcccatcttcccaacatggccttccctctgatctcactccct

SEQ ID NO: 34652 - DNA, 263 bp, Homo sapiens
gatctctatatagatttctttgcatataaatccttacctggcaagctattttaccagtccagcccccagtgactgaagatagtgtgatgaatctgagagcagtaagtgttaatcacatgaaaaataacccaggagcatggatgtagtatcaaatgtaatatttatgatgtcttgcctaaatttctagactgtgcctatcttattagctcttttggtatttcagtgtgactttgctactcagaaaaccagactccagcataaca

SEQ ID NO: 34653 - DNA, 389 bp, Homo sapiens
tttttcccccctttaattctgtattctgttttcaaaaaaatgtgcatgaagaggaaaaagtcaagtcaggaaaaataagctccttctgggtttattgtaaatttattttcacataagcattctagttcaatcttggtgaaaatattttatttgctctagaattgtaatttaaggggcaaaacagattttcattgcatctggttgctatacttgagaatcttaagaatttctgagaaaaagggaacaaaggctttgggtataaatgcatctgcatggatgtcttgaatctctaatgctgagttttgtaagagctggggcttcaagcctcctccctgtgtgggctgcagtgccaagattacagcagggactggataaattttttggcatgt

SEQ ID NO: 34654 - DNA, 1097 bp, Homo sapiens
gatgagttcccggtggggctctggggggggctcctgagcggggcattccttcctgaagcctcatccccgctcagccctgctcagcccctcctcctactcccctccccctccccctcctgccgggccaggaattgggtttggggcgggttctgcttccaaagccatctcttccagcaggagagggctctactctgagctcctattttccaaggctccgggccgcgctcggcgctggcctgctgccccggcgggtccgccggccggaggcgggagtcacaggaagagccctccacaaaaggaggcctcggcggatcaggacagctgcaggtgggtgtgcagactggtgagctgccagcaggggcccagacgcgccaggcctggagatggctggaaactgctcctgggaggcccatcccggcaacaggaacaagatgtgccctggcctgagcgaggccccggaactctacagccggggcttcctgaccatcgagcagatcgcgatgctgccgcctccggccgtcatgaactacatcttcctgctcctctgcctgtgtggcctggtgggcaacgggctggtcctctggtttttcggcttctccatcaagaggaaccccttctccatctacttcctgcacctggccagcgccgatgtgggctacctcttcagcaaggcggtgttctccatcctgaacacggggggcttcctgggcacgtttgccgactacatccgcagcgtgtgccgggtcctggggctctgcatgttccttaccggcgtgagcctcctgccggccgtcagcgccgagcgctgcgcctcggtcatcttccccgcctggtactggcgccggcggcccaagcgcctgtcggccgtggtgtgcgccctgctgtgggtcctgtccctcctggtcacctgcctgcacaactacttctgcgtgttcctgggccgcggggccccggcgcggcctgcaggcacatggacatcttcctgggcatcctcctgttcctgctctgctgcccgctcatggtgctgccctgcctggccctcatcctgcacgtggagtgccgggcccgacggcgccaggctctgccaagctcaagca

SEQ ID NO: 34655 - DNA, 953 bp, Homo sapiens
ccaaagtggctgtacggctcggattacgggatggagagggctctactctgagctcctattttccaaggctccgggccgcgctcggcgctggcctgctgccccggcgggtccgccggccggaggcgggagtcacaggaagagccctccacaaaaggaggcctcggcggatcaggacagctgcaggtgggtgtgcagactggtgagctgccagcaggggcccagacgcgccaggcctggagatggctggaaactgctcctgggaggcccatcccggcaacaggaacaagatgtgccctggcctgagcgaggccccggaactctacagccggggcttcctgaccatcgagcagatcgcgatgctgccgcctccggccgtcatgaactacatcttcctgctcctctgcctgtgtggcctggtgggcaacgggctggtcctctggtttttcggcttctccatcaagaggaaccccttctccatctacttcctgcacctggccagcgccgatgtgggctacctcttcagcaaggcggtgttctccatcctgaacacggggggcttcctgggcacgtttgccgactacatccgcagcgtgtgccgggtcctggggctctgcatgttccttaccggcgtgagcctcctgccggccgtcagcgccgagcgctgcgcctcggtcatcttccccgcctggtactggcgccggcggcccaagcgcctgtcggccgtggtgtgcgccctgctgtgggtcctgtccctcctggtcacctgcctgcacaactacttctgcgtgttcctgggccgcggggccccggcgcggcctgcaggcacatggacatcttcctgggcatcctcctgttcctgctctgctgcccgctcatggtgctgccctgcctggccctcatcctgcacgtggagtgccgggcccgacggcgccaggctctgccaagctcaagca

SEQ ID NO: 34656 - DNA, 724 bp, Homo sapiens
ccaaagtggctgtacggctcggattacgggatggagagggctctactctgagctcctattttccaaggctccgggccgcgctcggcgctggcctgctgccccggcgggtccgccggccggaggcgggagtcacaggaagagccctccacaaaaggaggcctcggcggatcaggacagctgcaggtgggtgtgcagactggtgagctgccagcaggggcccagacgcgccaggcctggagatggctggaaactgctcctgggaggcccatcccggcaacaggaacaaggtaagtgccacaggcggagggccctggtcttgcccagacgggtgtgggtgggaggggcagacccagcccagcatctcctcccccatcccccccttcctggccccactttccagctctggacccaccgtgggcagtgggctcctctgggctatgtggccgggcacaagttccctggaccctcctaccctcctgtcctcatcagtgaggcaagcaccaggactggacctcaaggtccctcgctgtgctgacactgtggtcgccttgtagcatccttgcaaggtcttgtttcatctcttccctgcagaggtggggcagtcagctacttactacagccaggcgggccaggaagccctgggacgctgactccaaggtggccctgatgtcatgtgctccatggagcctagggggtcctgggccaccccgagagtgttgcccca

SEQ ID NO: 34657 - DNA, 143 bp, Homo sapiens
gttgttttcccattcaagggattattgtaataagctttgttttaaggttttattgtttagcaacattgtgaaaacatctctatgtcttctgttcctcattcttttttaaatacaagattttatttcttcaaatcctatccttg

SEQ ID NO: 34658 - DNA, 205 bp, Homo sapiens
cccctttgttttcggagcacaaagcaggcacttttaaaatggcatgcaggggaggaagtgtatttccgtctttacactggtttccgggggcaagaaatgtttttttttttgcagagggtagagagtgaaagaacacatacataagctctgctgaccatccagtctcaattacaagtaaggactctgctcttgcactttttttggg

SEQ ID NO: 34659 - DNA, 691 bp, Homo sapiens
attttcaaaggggtgtgtgatgtgggcatctgagtttcttctgggagtgaatattggcaactatgtaagtaaatcttcaactctgacttataattgagcacatttgtgaaggaaatggttaattttacaaccaaaggcaaactcgcacctcgacaggtctgctgaaagaaatgtgccccagtctttttgctggcaagcgcaccaccaggtcataaatccacaggctttatttacagcccataacacttatgaatgttaagatatttgacgccacgttggccttataatattcaaggtccgcagacattggcagtagctcagatttctctcactaattataagcaatgagatggggggaggtggtggtatcctaatgcaaatgctgccctcccttctccgctgacccccacctctacaatcttgagtttactgagacagacgccaccactcctttggcagctgacttgtacgtttcctctaggctattgttatacacatttataaagagcactttcaggaatggaaattcagtgggggctctgcacagatgcctttttcaaaagcaaagttgctctaggtgtttgcatcttttcccttttcttttctccctttttcctttctttctcttttcttaattccccccaacacccccacctcctgcaataaaatagtagcatcggcaaaaaaaaaa

SEQ ID NO: 34660 - DNA, 373 bp, Homo sapiens
gtggtgggcagaacaatggtcctcaaatctgtccatgtcctaatcctcagaacctgtgagtattttacctttcatggcaaaaggaattctgaagatgagattaagcttaaggaccctgagatgaggtgactttccaggtaggtccaatctaatgacaaggaaaacctcccctggctccagggaaccagagaggtagtggtgtgagaaggacttgacttgacattgctggctctgaagacggaggatggggccatgagccatggaatgcaggtggcctttagaagctagaaaaagcaggggagcagattatctcctgggtcttgcaaaaaggcatgcagccctgctgacaccccgactttagaccagtgagacc

SEQ ID NO: 34661 - DNA, 402 bp, Homo sapiens
ccaagtttgggtttggaaatgtggtactgtaattttggaggacagcctccctgttcacagattggtgattgcaggtttaggccatctatagtggatgggatccaatcttaacaaaatctttttgcctgtgagtgaagcgggaggggaggtgtgtgtgtactgggatgggggcatgggggtgagcagggtgatgctgctgagctgtccactgggacttctgaaccccaaatttttaacctgaaaaacttgaagaacacttggcaaaggaatttggtagctgtccgcaacattttggcctaagtattgttgatgtagtgtggatttgtggattgttccttatgtggatttttctacaactggaacactagaatgtacctatctcctcttaaatatcagctatgt

SEQ ID NO: 34662 - DNA, 473 bp, Homo sapiens
ccattgcgagggagaagggaagcagacctctggggcctccacctctgcttcaactaaagtgctgcactgtatctcttacatctcaaacttctaagattttatttgaagatttccgttttcaaaatggtggcccaaacacatactgctgccttcccttcagcactaggttttcagacacaatagaaaaaatatgtaacaggccgggcgtggtggctcacgcctgtaatccaagcactttggggtggtcgagatgaggggatcatttgaggttaggagttggagaccagcctggctaacatggtgaaaccccatcactactgaaaatacagaagttagccagccatgttggcactcatctgtaatcccagctactggagaggctgagacaggagaatcgctgaacccaggagacagaggttgctgtgagccgagactgcaccactgtactccagcctgggcaacagagtgagtca

SEQ ID NO: 34663 - DNA, 457 bp, Homo sapiens
ttttttttttgagatggagtcttgctctgccacccagtctggagtgcaatggcacgatttcggctcactgtaacctccgcctcccaggtttaagcgattctcctgcctcagcctcccaggtagctgggactacaggcatgtgccaccacatccggctaattttgttgtatttttagtagagatggggtttcaccatgctgaccaggctggtctcaaactcctgacctcaagggattcacccgcctcggcctcccaaagtgctgggattacagatgtgagccaccgtgcccagccaagcccatctatatatagaaaagggtatgtaacagaatcaaaaatgtgattcaaattttacgtaggctgtcttgaaataaatattcatcaaacatgaacatatcacagtttagaaaagagcagagttttgaatctgtgaattacacacaatagtcttttggtt

SEQ ID NO: 34664 - DNA, 486 bp, Homo sapiens
ttggcagctcgacataacggggtataaatatgatcacagaatgttctaagaaacttctgccagtttttctagctagatacaaactttattcttggtatattttatgacttatttaactgaaaataagtacttccttaatagaaatttgtacttgactttaaaaatcaaactgtttggtctcttctaagaagtttattagaaatgcaacaaagggccaggcacagtggctcatgcctataatcccagcacgttggaaggccaaggtgaagggattgcttgaacccacgagttcaagaccagcctgggcaacatagcaagaccacgtctctacaaaaaatttaaaaattagctgggtatggtggctcacacctgtagtcccagctactctggaggctaaggtgggaggatcacttgaccccaagaggttgaggctgcagtgagctatgattgtgccactgtactccagcctgggtgacagagcaagac

SEQ ID NO: 34665 - DNA, 387 bp, Homo sapiens
aattccccactgcctcctgtaagatatgtctgacagctgaaagtaaactagtctttgcaagcactaaattgctcatcaatcttacaaaaggtgtcatttagtcatttacattcccaagggaaatacaaatggaacacagctgcctgagaaaaattaattcacccaactcgagtaagtagctcacagagaacagctttcataatcctaaaatatctgaatcatatttcattcctggttttcaccaaaaagaagtagggttttcacctttttattaattatttgaattttagctgattagtgcagtgcggtttgcacagttatagcccaatgacaagcaggcataatgtcacccaaagctttgagcatgaaacaaccaaaatgtacctt

SEQ ID NO: 34666 - DNA, 1117 bp, Homo sapiens
gagactgaagtggcaagaagaatcgaatatactctgttctaacctttctgatgtttgcttgttaagtgggaaacttaaaaatttctactgtccactatagtagtactttgaaaaataagttttctcccagcacaaaacccatgtcagccacacacaagtagcaacctacaggcctgtctcttgacctctcgtttataggcacaagcctcccacaggcccagaattattttgcccaccagctgcttgccaggtctgatactcacctaaaagaactttagggagcattgccaaaccagcctgatgaaagggagttctcatgtatctaaatgagtagcaagaattcacatgggaacttcatttatgtcagtggactgacaatagcagatatgatcactaagctttctgtgaagtaaataacaagtctgctttcactttctgttggataagactttggaatttcagaattttctttccaagatgtcaaattaaaaatggtttttattactcagtggctatatgacattgctttttagaacttatctgtgagttttatgtagacaattcatttgcctccctcagcgtgactcttgtaggatttgtttctgatttgtggagttaaaactgttttgaattaatgggctgggaacatggaaagaaatatgtaattaatgaagaaatattagcaccccagtttttagtgatatttaccattactagagttctggattcactgaaaaaatgaattttggtctatatgcaacatattccttaactataatgtttcactatttcctaatagtatgacatcatctctactacctttaaattgtcctttggacatagaaaagaaaagaactatggacccacagtacctcattagatgcccttgggaccagatgtgcattggaattcagaattttttggattttagaagagaaatatagtctgtgtaacatacattatgtaacactccagactctgaaacatttttaaagcaaatatatatataaatatttacattaaatggcccaaataaaaattataagtagtgtcaccaagtgaggtacggctttgttgccaaagttctttttaaaaaaacttcctgaggccaggcacg

SEQ ID NO: 34667 - DNA, 583 bp, Homo sapiens
gtctcccaaagtgctgggattgcaggtgtgagccaccgtgcccggccaaaaattactttttaaacgtttaaacattttaaaagaaagactttttaaaaagtcgcaaatccaccattttgagacagtgtagggcttagagctaagacatgaatgtccgtttgttaagctcccccatccatataaataagcatttactatgtgtcaggtattgggaattttgaaattaataaaacatagttcttgccttaagagtttgtttggcagtgagggagacagatatttgattgtacaagtagtttgagtataagaactgctgttgggaaatatgtactaggtatattggaattcagagaaatgcctagtttagtctggagtgaagggtaaattaaggtttcccacagtttgtttcagtgtaggcctgagactagtagctatgtgtgcagaaggcagtagggatatagttattctgtcagtctgtctaatatctgtatgtcacctacctacctacgtacctgctttcttttttctgacagtgccattcagaagggatatggttattctaaggctgagggaatagttatgt

SEQ ID NO: 34668 - DNA, 351 bp, Homo sapiens
tcctaataaattacactttatttgccaagatcccaaaaagttcttagtaatgatcatagttcttactttatcctctattattatagtgttagtgctttgggactccaagacttttagctccttaagtgtaggaacagccctaaagttaacaaaatcgatcatcccctgtggcacctagcaaagtagaggaattaaaaatatatctgctgtccagcctggcatggtccacttacgtccccagccctgcctgcctttccagcactctctgcacgctgtgcaagcaccccatcctgacacaaacttccctgaccacagctctgccttgccacttcatccaggagctcagctgtg

SEQ ID NO: 34669 - DNA, 100 bp, Homo sapiens
gtgtatagagtgtgagtatgaatttagactccgaatctgagttctggccacagcacctgatgggtaccaaccccgaaagagctgcccacctccaaggaaa

SEQ ID NO: 34670 - DNA, 379 bp, Homo sapiens
aaaattaaatagtattttgtttaatctgatacatccaagatattgtcattttaatatgcaataaaaaatgattgattcgatatttgcatccttcacaacctaccatgtagtttacactcagagcccagctcagtctcacagcaagcaccagcggcccccgtgctggacagcatggctaatgggaggagctgacccgtcggaggcaccaaggtcacgctgtgaccaaggctgtggtgacgcaaaggcagcgggtttcctggcacagcctggaggtgcaccagcctgtcctgtgtgctctgcataatgtggtacagcagtggtcacagagctttgcaccagatgctgattccagcccacctaggggggttcagggaagtgg

SEQ ID NO: 34671 - DNA, 429 bp, Homo sapiens
agggttcttcagagaaacagaatgaacaggaaacaggtaggggtgtgtgtgtgtgtgtgtgtgtgtgtgtgtgtgtgtgtgtgtgtaaagagagggggccaaggagagggagagagatttattttaaagaattatctaaagtgattgtggggctggcaagtccaaaatgtgtagggccagctggctggctggaaactcagaaaggaaactcaatcctgaggcagcattattttttcttctctgggaaacctgagtttttgctgtgaaggccttcaactgattgaatgaggcccactcacattatggaaagtaatctccttcactgaaggtcaactgattgtaggtattcaccatgtctgtaaaataccttcccagccaggtgcggtggctcatgcctgtaatcccagcactttgggaggctgacgtggg

SEQ ID NO: 34672 - DNA, 327 bp, Homo sapiens
acagactcgagattcaaactggcattctctttcattctagaaaagaaagtttggtaaggagtgattttttttttaaggccaggcaatctggttgtatccatcattacccttacttaatgacctgcttgtaagttagcagctgctgttgccaaggagaggtacctggtttctaacagcagtacctcattgctagctggggtgagggaatgagaggactcaatggccagcctcagggccatgtggatgagtggacccaggttaaaaagaatgtgctttttctcagttacctagaaggactgtaagtgtctcccttggaagaaactgaga

SEQ ID NO: 34673 - DNA, 205 bp, Homo sapiens
gagagagcactggaaaagaggtgatacctaaagcaaacaagaattaggtgaggcagcctgcttggccaggatgggctgggtgctgagagactttccaacaaggtcaggggtcagtgatctccagggatccatgttcataccaggtatctctgtaattctagccactggagagctaaccccactcagtgggccctgaaactaacat

SEQ ID NO: 34674 - DNA, 646 bp, Homo sapiens
  misc_feature (420)..(420): n is a, c, g, or t
aatgatgtatggtttttatcaactgtctccaaaataatcccctggttatgccagggagtacagttcttttcattccatacataagttcagtagttgcttccctaactgcaaaggcaatctcatttagttgagtagctcttgaaagcagctttgagttagaagtatgtgtgttacaccctcacattagtgtgcctgtgtggggcagttcaacacaaatgtaacaatgtatttttgtgaatgagagttggcatgtcaaatgcatcctctagaaaaataattagtgttatagtcttaagatttgttttctaaagttgatactgtgggttatttttgtgaacagcctgatgtttgggaccttttttcctcaaaataaacaagtccttattaaaccaggaatttggagaaaaaaaaaaccctggntttttatttttgtattttattattgtttacttcaaactttgttttacagcgtcctccacaaaacctctagaatgcactaggatatatttttcttgggagtcataatcatgatgcataccaacacaacactactcaaattatatttcattgaggatggcatgttgcattgagggagtcaacttggacctaggagtgggagacttttttcaaaatggctttttacatc

SEQ ID NO: 34675 - DNA, 1225 bp, Homo sapiens
aggaggtttgtggatggcgtggagcaatggtaggctggtctgtagccctctgtgagtcaacatcgaatggcgcgtgccggtttccagcactgcgcaacaagtgggaccgccgctgccgccgcgagcacagcagggtgcagcgtggtggcagaactggctggtttctctttgccccagtggaaaccaggaacggcccctcccaaccctcccgatgtccactccgagacccacaacttcaccaaaagaccatacccgactccccactcccccgctttgccaggcgcagtgagcctgagtgggatccagcactcggcccccagcgcccctttcctccgagaagatcaggagtttattcccgactttctttgctggatgaccagtgtttggcaagaatctctgccaatactgtcgagtgccattctgccttttgaagacaagtgcaccttctttcccttcccagtacataaagcttttcggaggctgggggagaaatcaacttatgatacatgaaaccagctccagataccgcgttgtggttgctagaggcgggagcatcgggaggaacggaattacatacactaaattaaatgttttctagctttgcttttagaggcaatcacacccccaaccctcgcccccaccagacagaaaataaagaggggcgggtagggatcggtgtggaagctgcggccgcgcggcgattctcggacgggctggcctgccacctagcggtgggctgagatcgagttcgcggccatgggcggtgggctcgccgttccacctcccgggcggcggtaccctgaccagatgctaggactgacagaaggagggcaccctccaatggggatggcatacaacctccaaagttttggcaagagggatgaaaatcagaaaggcctcgctgcttgcccatcactcagcgatgagcatctatttgcactaagaaaaaccacaaataacccgcttcgaacacaccatcttcctgtccctgtggcccctcttaggggaagtcggtagtggaaggatgccacctaggagctcaggggctttgggacgtacaactctgttttgcagttgaggaaacaggcccgacgaggaggcttgttagtggtgagttagtgacttaaccaggaccagattttaagcttctgaatttcatgtcagtgactgaaagccaaaggcgggtttatctcagctccttagaagtatttatgagaaaggagcg

SEQ ID NO: 34676 - DNA, 694 bp, Homo sapiens
gttaaaaataaaaacatcttcacagatatcagagaaaagtgaaaactcatatctgaaagattataaatatactttatatcaattttccagagaacttaaacttctaataatattggtaatattctcatggttactattttatattctttcctgctttttgtagctactggtgtactatgacagttataataaagattatatgggggtatacttaaatgccatacttttaaaatcctgaatcattgtttataaagttttattcaatatttttctttgcacatgccctttttcagtccaattgaacacttagagatttttctttgctttcacttgcattaaatggaatatacagatgtactaagatagaaagaaaaaggtgaaagagaactatacaggcagaaatgcatgtgtgtgtacctgtcttcaaatggaaaagaaaatgatggatcacaacaggaaactggagaactgttgatttattacagttctcaaattagaaacctcccaaattcttaaagctaaattagcttttcattgcacactgaatttttctctgataaatctaatgtcttctgggttcagactttatcccgtacaaatccttttttcttgcctgtgattcatgtgagaagaattatataattttcttatttcaaagcttataaactattacttataagttcatggattttaa

SEQ ID NO: 34677 - DNA, 304 bp, Homo sapiens
atttatctgtaattctcaaccttttgtcagacagttgaacttaaggcctgcattttgagtaccctttccaaactaacaaatgttcctgtgtccttccagggagtgtcttacctttatttccctaagaatcaagtgccatctgccaggagtttgagatcagcctggccaacatggtgaaaccctacctctaccaaaaatacaaaaaaattagctgggtgtggtggtgtgtgcctgtggttccagctacttagaacattgaggcaggagatcccctgaagctgggaggcagagggtgcagtgagct

SEQ ID NO: 34678 - DNA, 560 bp, Homo sapiens
cttccagacccgctcccgaaaccttgtcgaaggaccaaaggcgaccggtgcaggtgcacgacgccagctcccttctggggggccggggcctgggggttgccatggcccccagccacctgtcacagtgtgaagtctgttgtgtttgagcttctcagagtggaatgactccttttccttcctggccctcgggggcctctcgaggtcagcctctccaacccctacctcagctcctgtctgcactgagaaacctccccgggtgatgtctgcaaagtctgtgctgtccgtgccccaggctgggagagctatctggggagggggagaggaggccgagcagaatacaccccagagttagggtttgcgactccgcctccctgggacctggattgggtcagatgcctgtccttggaggggacaaggttgactgcttaggaggcgcgacgcacagggctgccaggcctggcccctctctgggaaggttgagagctgagacgggcagccctgtcccttcctccagatccgtctggttttttacaccgtttgttaataaagcctgaaaccgc

SEQ ID NO: 34679 - DNA, 1330 bp, Homo sapiens
cttgatatcgaattcgcggccgcgtcgaaggaccaaaggcgaccggtgcaggtgcacgacgccagctcccttctggggggccggggcctgggggttgccatggcccccagccacctgtcagtgcgggagatgagggaagatgagaagcccctggtgctggagatgctgaaggccggcgtgaaggacacggaaaaccgcgtggccctccatgccttgacacggccgccggccctgctcctcctggcggcggccagcagcggcctgcgctttgtcctggcttccttcgccctggccctcctcctgccggtgttcctggctgtggccgccgtgaagctgggcctgcgggcccgatggggctcgctgcctccgccgggtggcctggggggcccctgggtggccgtgcggggctccggtgacgtgtgtggggtcctggctctggcccctggcacaaatgcaggggacggggcccgggtcacccgcctgtctgtctctcgctggcaccgccgccggggcgtgggcaggaggctgctggccttcgcggaggcccgggctcgggcctgggctgggggcatgggggagccccgggcccggctcgtggtccccgtggctgtggccgcctggggggtgggagggatgctggagggctgtggctaccaggccgaggggggctggggctgcctgggctacacgctggtgagggaattcagcaaagacctgtgaagctacagactgacagccagggcaggggaggagggaggggcgccagcacctgatgatcgcctactgtctgcgggttcttttacctgctctccctcagtgagtcctcaaccaccctgggcccagaaacagaggcctgccgaggggaggagcctggcctctgtccacccgtcagcagtgtgaagtctgttgtgtttgagcttctcagagtggaatgactccttttccttcctggccctcgggggcctctcgaggtcagcctctccaacccctacctcagctcctgtctgcactgagaaacctccccgggtgatgtctgcaaagtctgtgctgtccgtgccccaggctgggagagctatctggggagggggagaggaggccgagcagaatacaccccagagttagggtttgcgactccgcctccctgggacctggattgggtcagatgcctgtccttggaggggacaaggttgactgcttaggaggcgcgacgcacagggctgccaggcctggcccctctctgggaaggttgagagctgagacgggcagccctgtcccttcctccagatccgtctggttttttacaccgtttgttaataaagcctgaaaccgc

SEQ ID NO: 34680 - DNA, 1332 bp, Homo sapiens
cttccagacccgctcccgaaaccttgtcgaaggaccaaaggcgaccggtgcaggtgcacgacgccagctcccttctggggggccggggcctgggggttgccatggcccccagccacctgtcagtgcgggagatgagggaagatgagaagcccctggtgctggagatgctgaaggccggcgtgaaggacacggaaaaccgcgtggccctccatgccttgacacggccgccggccctgctcctcctggcggcggccagcagcggcctgcgctttgtcctggcttccttcgccctggccctcctcctgccggtgttcctggctgtggccgccgtgaagctgggcctgcgggcccgatggggctcgctgcctccgccgggtggcctggggggcccctgggtggccgtgcggggctccggtgacgtgtgtggggtcctggctctggcccctggcacaaatgcaggggacggggcccgggtcacccgcctgtctgtctctcgctggcaccgccgccggggcgtgggcaggaggctgctggccttcgcggaggcccgggctcgggcctgggctgggggcatgggggagccccgggcccggctcgtggtccccgtggctgtggccgcctggggggtgggagggatgctggagggctgtggctaccaggccgaggggggctggggctgcctgggctacacgctggtgagggaattcagcaaagacctgtgaagctacagactgacagccagggcaggggaggagggaggggcgccagcacctgatgatcgcctactgtctgcgggttcttttacctgctctccctcagtgagtcctcaaccaccctgggcccagaaacagaggcctgccgaggggaggagcctggcctctgtccacccgtcagcagtgtgaagtctgttgtgtttgagcttctcagagtggaatgactccttttccttcctggccctcgggggcctctcgaggtcagcctctccaacccctacctcagctcctgtctgcactgagaaacctccccgggtgatgtctgcaaagtctgtgctgtccgtgccccaggctgggagagctatctggggagggggagaggaggccgagcagaatacaccccagagttagggtttgcgactccgcctccctgggacctggattgggtcagatgcctgtccttggaggggacaaggttgactgcttaggaggcgcgacgcacagggctgccaggcctggcccctctctgggaaggttgagagctgagacgggcagccctgtcccttcctccagatccgtctggttttttacaccgtttgttaataaagcctgaaaccgc

SEQ ID NO: 34681 - DNA, 1970 bp, Homo sapiens
ggctggtacggtcggagtgtacggatctgaaaccttgtcgaaggaccaaaggcgaccggtgcaggtgcacgacgccagctcccttctggggggccggggcctgggggttgccatggcccccagccacctgtcagtgcgggagatgagggaagatgagaagcccctggtgctggagatgctgaaggtgagaggcaggggccccagggggcctgggagtggctgcagtgggggaattgcaagtggattcagccaccccctcccacccacctgagccagcctggacccctggagcgggatcttttcctcctgagcctcagccgccctgctgctgaaaaccacagcaggtgtggcaggtgggggctcacccccccagccctactgggaccccagcaccaacgccctccctggtctcccatctccagtcggctgtgcacgccagcacaacagccagctctgtgcctcggaccccaactcttcaaagcacagcccagcaccccaacctagcccagcagcctccctccagcctccactccagcctgaggcaacctccctgtccttacttccctggggcctcactgcggcattgctactgaattgagtgcccccacagctcctaattcactcatccatccatcattcgctctcgttcattcattcactccatacccagtgtgccacactgaacatcggactgtgctgccttcccttcccatttgggagctctcaccccgccccgggcagggtctacctcctctctttgtccaggaggccctagcgtttcggatggctgagccacccctcctgcccacaggccggcgtgaaggacacggaaaaccgcgtggccctccatgccttgacacggccgccggccctgctcctcctggcggcggccagcagcggcctgcgctttgtcctggcttccttcgccctggccctcctcctgccggtgttcctggctgtggccgccgtgaagctgggcctgcgggcccgatggggctcgctgcctccgccgggtggcctggggggcccctgggtggccgtgcggggctccggtgacgtgtgtggggtcctggctctggcccctggcacaaatgcaggggacggggcccgggtcacccgcctgtctgtctctcgctggcaccgccgccggggcgtgggcaggaggctgctggccttcgcggaggcccgggctcgggcctgggctgggggcatgggggagccccgggcccggctcgtggtccccgtggctgtggccgcctggggggtgggagggatgctggagggctgtggctaccaggccgaggggggctggggctgcctgggctacacgctggtgagggaattcagcaaagacctgtgaagctacagactgacagccagggcaggggaggagggaggggcgccagcacctgatgatcgcctactgtctgcgggttcttttacctgctctccctcagtgagtcctcaaccaccctgggcccagaaacagaggcctgccgaggggaggagcctggcctctgtccacccgtcagcagtgtgaagtctgttgtgtttgagcttctcagagtggaatgactccttttccttcctggccctcgggggcctctcgaggtcagcctctccaacccctacctcagctcctgtctgcactgagaaacctccccgggtgatgtctgcaaagtctgtgctgtccgtgccccaggctgggagagctatctggggagggggagaggaggccgagcagaatacaccccagagttagggtttgcgactccgcctccctgggacctggattgggtcagatgcctgtccttggaggggacaaggttgactgcttaggaggcgcgacgcacagggctgccaggcctggcccctctctgggaaggttgagagctgagacgggcagccctgtcccttcctccagatccgtctggttttttacaccgtttgttaataaagcctgaaaccgc

SEQ ID NO: 34682 - DNA, 1537 bp, Homo sapiens
  misc_feature (1340)..(1340): n is a, c, g, or t
  misc_feature (1346)..(1346): n is a, c, g, or t
cttgatatcgaattcgcggccgcgtcgaaggaccaaaggcgaccggtgcaggtgcacgacgccagctcccttctggggggccggggcctgggggttgccatggcccccagccacctgtcagtgcgggagatgagggaagatgagaagcccctggtgctggagatgctgaaggccggcgtgaaggacacggaaaaccgcgtggccctccatgccttgacacggccgccggccctgctcctcctggcggcggccagcagcggcctgcgctttgtcctggcttccttcgccctggccctcctcctgccggtgttcctggctgtggccgccgtgaagctgggcctgcgggcccgatggggctcgctgcctccgccgggtggcctggggggcccctgggtggccgtgcggggctccggtgacgtgtgtggggtcctggctctggcccctggcacaaatgcaggggacggggcccgggtcacccgcctgtctgtctctcgctggcaccgccgccggggcgtgggcaggaggctgctggccttcgcggaggcccgggctcgggcctgggctgggggcatgggggagccccgggcccggctcgtggtccccgtggctgtggccgcctggggggtgggagggatgctggagggctgtggctaccaggccgaggggggctggggctgcctgggctacacgctggtgagggaattcagcaaagacctgtgaagctacagactgacagccagggcaggggaggagggaggggcgccagcacctgatgatcgcctactgtctgcgggttcttttacctgctctccctcagtgagtcctcaaccaccctgggcccagaaacagaggcctgccgaggggaggagcctggcctctgtccacccgtcagcagtgtgaagtctgttgtgtttgagcttctcagagtggaatgactccttttccttcctggccctcgggggcctctcgaggtcagcctctccaacccctacctcagctcctgtctgcactgagaaacctccccgggtgatgtctgcaaagtctgtgctgtccgtgccccaggctgggagagctatctggggagggggagaggaggccgagcagaatacaccccagagttagggtttgcgactccgcctccctgggacctggattgggtcagatgcctgtccttggaggggacaaggttgactgcttaggaggcgcgacgcacagggctgccaggcctggcccctctctgggaaggttgagagctgagacgggcagccctgtcccttcctccagatccgtctggttttttacaccgtttgttaataaagcctgaaaccgcaaaaaaaacncaaaanaaaaagacacgaaaaaactcgagcgacaaacagagaagcaggggggcacacaaccggaacaaaagcagaacaagggacacaacggggacactgacaccagacatagcgggcacagagtgcacacactcgggggcacacaccgaagagaggagcaacatagtgcagcaacgacagagaaaacacagcaaaga

SEQ ID NO: 34683 - DNA, 1681 bp, Homo sapiens
ggctggtacggtcggagtgtacggatctgaaaccttgtcgaaggaccaaaggcgaccggtgcaggtgcacgacgccagctcccttctggggggccggggcctgggggttgccatggcccccagccacctgtcagtgcgggagatgagggaagatgagaagcccctggtgctggagatgctgaaggtgagaggcaggggccccagggggcctgggagtggctgcagtgggggaattgcaagtggattcagccaccccctcccacccacctgagccagcctggacccctggagcgggatcttttcctcctgagcctcagccgccctgctgctgaaaaccacagcaggtgtggcaggtgggggctcacccccccagccctactgggaccccagcaccaacgccctccctggtctcccatctccagtcggctgtgcacgccagcacaacagccagctctgtgcctcggaccccaactcttcaaagcacagcccagcaccccaacctagcccagcagcctccctccagcctccactccagcctgaggcaacctccctgtccttacttccctggggcctcactgcggcattgctactgaattgagtgcccccacagctcctaattcactcatccatccatcattcgctctcgttcattcattcactccatacccagtgtgccacactgaacatcggactgtgctgccttcccttcccatttgggagctctcaccccgccccgggcagggtctacctcctctctttgtccaggaggccctagcgtttcggatggctgagccacccctcctgcccacaggccggcgtgaaggacacggaaaaccgcgtggccctccatgccttgacacggccgccggccctgctcctcctggcggcggccagcagcggcctgcgctttgtcctggcttccttcgccctggccctcctcctgccggtgtccccgtggctgtggccgcctggggggtgggagggatgctggagggctgtggctaccaggccgaggggggctggggctgcctgggctacacgctggtgagggaattcagcaaagacctgtgaagctacagactgacagccagggcaggggaggagggaggggcgccagcacctgatgatcgcctactgtctgcgggttcttttacctgctctccctcagtgagtcctcaaccaccctgggcccagaaacagaggcctgccgaggggaggagcctggcctctgtccacccgtcagcagtgtgaagtctgttgtgtttgagcttctcagagtggaatgactccttttccttcctggccctcgggggcctctcgaggtcagcctctccaacccctacctcagctcctgtctgcactgagaaacctccccgggtgatgtctgcaaagtctgtgctgtccgtgccccaggctgggagagctatctggggagggggagaggaggccgagcagaatacaccccagagttagggtttgcgactccgcctccctgggacctggattgggtcagatgcctgtccttggaggggacaaggttgactgcttaggaggcgcgacgcacagggctgccaggcctggcccctctctgggaaggttgagagctgagacgggcagccctgtcccttcctccagatccgtctggttttttacaccgtttgttaataaagcctgaaaccgc

SEQ ID NO: 34684 - DNA, 1344 bp, Homo sapiens
cttgatatcgaattcgcggccgcgtcgaaggaccaaaggcgaccggtgcaggtgcacgacgccagctcccttctggggggccggggcctgggggttgccatggcccccagccacctgtcagtgcgggagatgagggaagatgagaagcccctggtgctggagatgctgaaggccggcgtgaaggacacggaaaaccgcgtggccctccatgccttgacacggccgccggccctgctcctcctggcggcggccagcagcggcctgcgctttgtcctggcttccttcgccctggccctcctcctgccggtgttcctggctgtggccgccgtgaagctgggcctgcgggcccgatggggctcgctgcctccgccgggtggcctggggggcccctgggtggccgtgcggggctccggtgacgtgtgtggggtcctggctctggcccctggcacaaatgcaggggacggggcccgggtcacccgcctgtctgtctctcgctggcaccgccgccggggcgtgggcaggaggctgctggccttcgcggaggcccgggctcgggcctgggctgggggcatgggggagccccgggcccggctcgtggtccccgtggctgtggccgcctggggggtgggagggatgctggagggctgtggctaccaggccgaggggggctggggctgcctgggctacacgctggtgagggaattcagcaaagacctgtgaagctacagactgacagccagggcaggggaggagggaggggcgccagcacctgatgatcgcctactgtctgcgggttcttttacctgctctccctcagtgagtcctcaaccaccctgggcccagaaacagaggcctgccgaggggaggagcctggcctctgtccacccgtcagcagtgtgaagtctgttgtgtttgagcttctcagagtggaatgactccttttccttcctggccctcgggggcctctcgaggtcagcctctccaacccctacctcagctcctgtctgcactgagaaacctccccgggtgatgtctgcaaagtctgtgctgtccgtgccccaggctgggagagctatctggggagggggagaggaggccgagcagaatacaccccagagttagggtttgcgactccgcctccctgggacctggattgggtcagatgcctgtccttggaggggacaaggttgactgcttaggaggcgcgacgcacagggctgccaggcctggcccctctctgggaaggttgagagctgagacgggcagccctgtcccttcctccagatccgtctggttttttacaccgttgtataacatccctttttctcccttcctccttttctg

SEQ ID NO: 34685 - DNA, 1353 bp, Homo sapiens
cttgatatcgaattcgcggccgcgtcgaaggaccaaaggcgaccggtgcaggtgcacgacgccagctcccttctggggggccggggcctgggggttgccatggcccccagccacctgtcagtgcgggagatgagggaagatgagaagcccctggtgctggagatgctgaaggccggcgtgaaggacacggaaaaccgcgtggccctccatgccttgacacggccgccggccctgctcctcctggcggcggccagcagcggcctgcgctttgtcctggcttccttcgccctggccctcctcctgccggtgttcctggctgtggccgccgtgaagctgggcctgcgggcccgatggggctcgctgcctccgccgggtggcctggggggcccctgggtggccgtgcggggctccggtgacgtgtgtggggtcctggctctggcccctggcacaaatgcaggggacggggcccgggtcacccgcctgtctgtctctcgctggcaccgccgccggggcgtgggcaggaggctgctggccttcgcggaggcccgggctcgggcctgggctgggggcatgggggagccccgggcccggctcgtggtccccgtggctgtggccgcctggggggtgggagggatgctggagggctgtggctaccaggccgaggggggctggggctgcctgggctacacgctggtgagggaattcagcaaagacctgtgaagctacagactgacagccagggcaggggaggagggaggggcgccagcacctgatgatcgcctactgtctgcgggttcttttacctgctctccctcagtgagtcctcaaccaccctgggcccagaaacagaggcctgccgaggggaggagcctggcctctgtccacccgtcagcagtgtgaagtctgttgtgtttgagcttctcagagtggaatgactccttttccttcctggccctcgggggcctctcgaggtcagcctctccaacccctacctcagctcctgtctgcactgagaaacctccccgggtgatgtctgcaaagtctgtgctgtccgtgccccaggctgggagagctatctggggagggggagaggaggccgagcagaatacaccccagagttagggtttgcgactccgcctccctgggacctggattgggtcagatgcctgtccttggaggggacaaggttgactgcttaggaggcgcgacgcacagggctgccaggcctggcccctctctgggaaggttgagagctgagacgggcagccctgtcccttcctccagatccgtttaatgctgtacaccgttgtaaactcgcgggtcctcggggtgggtggggtggtgtgtgtggtg

SEQ ID NO: 34686 - DNA, 1463 bp, Homo sapiens
ggctggtacggtcggagtgtacggatctgaaaccttgtcgaaggaccaaaggcgaccggtgcaggtgcacgacgccagctcccttctggggggccggggcctgggggttgccatggcccccagccacctgtcagtgcgggagatgagggaagatgagaagcccctggtgctggagatgctgaaggtgagaggcaggggccccagggggcctgggagtggctgcagtgggggaattgcaagtggattcagccaccccctcccacccacctgagccagcctggacccctggagcgggatcttttcctcctgagcctcagccgccctgctgctgaaaaccacagcaggtgtggcaggtgggggctcacccccccagccctactgggaccccagcaccaacgccctccctggtctcccatctccagtcggctgtgcacgccagcacaacagccagctctgtgcctcggaccccaactcttcaaagcacagcccagcaccccaacctagcccagcagcctccctccagcctccactccagcctgaggcaacctccctgtccttacttccctggggcctcactgcggcattgctactgaattgagtgcccccacagctcctaattcactcatccatccatcattcgctctcgttcattcattcactccatacccagtgtgccacactgaacatcggactgtgctgccttcccttcccatttgggagctctcaccccgccccgggcagggtctacctcctctctttgtccaggaggccctagcgtttcggatggctgagccacccctcctgcccacaggccggcgtgaaggacacggaaaaccgcgtggccctccatgccttgacacggccgccggccctgctcctcctggcggcggccagcagcggcctgcgctttgtcctggcttccttcgccctggccctcctcctgccggtgtccccgtggctgtggccgcctggggggtgggagggatgctggagggctgtggctaccaggccgaggggggctggggctgcctgggctacacgctggtgagggaattcagcaaagacctgtgaagctacagactgacagccagggcaggggaggagggaggggcgccagcacctgatgatcgctcctgtctgcactgagaaacctccccgggtgatgtctgcaaagtctgtgctgtccgtgccccaggctgggagagctatctggggagggggagaggaggccgagcagaatacaccccagagttagggtttgcgactccgcctccctgggacctggattgggtcagatgcctgtccttggaggggacaaggttgactgcttaggaggcgcgacgcacagggctgccaggcctggcccctctctgggaaggttgagagctgagacgggcagccctgtcccttcctccagatccgtctggttttttacaccgtttgttaataaagcctgaaaccgc

SEQ ID NO: 34687 - DNA, 410 bp, Homo sapiens
cgggagactttagcaaggtcgctgagtattgtggggggcgcctgtcctgccgagatcctcgcttgggggccccgagggttctcagtgtcctgatctgggaagtgccgttgctgctccctacccctcgggggagctttggggacagaggtgcccccctgacgctgacctacttatgttctcaccaggtgcacgacgccagctcccttctggggggccggggcctgggggttgccatggcccccagccacctgtcagtgcgggagatgagggaagatgagaagcccctggtgctggagatgctgaaggtgagaggcaggggccccagggggcctgggagtggctgcagtgggggaattgcaagtggattcagccaccccctcccacccacctgagccagcctggacccctgg

SEQ ID NO: 34688 - DNA, 377 bp, Homo sapiens
atgaaacctgggccatgtgctgtgtggtacattctatgctcatcactggggcttatcaacatggaaagtttgatgcttagaaatagaggtattggccgggtgtggtagttcacacctgtaatcccagcactttgggaggccgaggcaggcagatcacttgaggtcaggagatcgagaccagcctggccaacatggtgaaaccctgtctctactaaaaatacaaaaattacccgggcgtgcagcatgtgcatgttagtcccagctactccagaggctgagacaggagaatcactcgaacccagtaggcggaggttacagtgggccaagatcgcgccactgcattccagcctgggtgacagggtgaggctccatctctt

SEQ ID NO: 34689 - DNA, 865 bp, Homo sapiens
cttcctagcttttctccgacacatcatataggcccctttcctcccgtgtgctggccagcctcctaagcagccactccagtgaggtcagggtggagctgagactgtgtgcctccctgctttctactgacagttcaaaaaatgtgacttttgtagagcacaacccacttggtatacccttggacacagtccagtcttttaaagcgtaaagttgagagaaacaatggaattctttcaggattataatgtataaattagcactcaaagtgctgagaaagctggactaaaattttaacatcttaagtttctcatttttctggggactcaacaaatttaggaatccacatcaaaagcaaaaagaaagaatgtacttcttttaaacaattttcagcactttctatccctttactaaataaataccacccatcctaccaaaggatttaactaaaagcagttttgacagtagctatgttggctgattaggctgatgcctaagcattctttaaggaaaaattgatgtagttggttagattgaaggaggtttcttccaagttctttcttcctattgaattgcatctgaaacgttcctttgctgcccagttctttagtgggcaagttttagttggtgagaggtgagagagacagcctggatccagatccattgcttcaactcattttttctgaattcccttcagagatcaaatttaagaatgccttctgggttcaattttaaaaactccaaaatttctaaagcaaaaggaaggaaacctcaaacatattttaaataacagatgtttgtttttactgacaccctgccgtttattttctgggtgggctgtaagaaaactagggtatggacaagacacag

SEQ ID NO: 34690 - DNA, 13935 bp, Homo sapiens
  misc_feature (13516)..(13516): n is a, c, g, or t
catgaggcttttaagaatcatgtgttcaatgtagacaatgcaaaatttgtagttaaatttgacctcaattgactacaaaatttgtagttaaatttgactacaattggaaatgccaaaaactcactaatagggatgtgggcgctatctccaactgtctttgcacttctgagtaagaatctgatgattgtgcacagtgacctggctgttcacttccctgccattcagtatgctgtgctctacacattgtattctcattgtaccaggcatgatcactttatctctagtagcctcagttcttcctctccttctttgtttgatggagctgtgattagcactgtaactacggctacaaagaaacatttctcaattatattaaatcttctgggaatattacttaagaaagataaccttaaccaggacacgaggaaactgttaatgacttgggctttggaagcagctgttttaatgaagaagtctgaaacatacgcacctttattctctcttccgtctttccataaattttgcaaaggccttttagccaacactctcgttgaagatgtgaatatctgtctgcaggcatgcagcagtctacatgctctgtcctcttccttgccagatgatcttttacagagatgtgtcgatgtttgccgtgttcaactagtgcacagtggaactcgtattcgacaagcatttggaaaactgttgaaatcaattcctttagatgttgtcctaagcaataacaatcacacagaaattcaagaaatttctttagcattaagaagtcacatgagtaaagcaccaagtaatacattccacccccaagatttctctgatgttattagttttattttgtatgggaactctcatagaacagggaaggacaattggttggaaagactgttctatagctgccagagactggataagcgtgaccagtcaacaattccacgcaatctcctgaagacagatgctgtcctttggcagtgggccatatgggaagctgcacaattcactgttctttctaagctgagaaccccactgggcagagctcaagacaccttccagacaattgaaggtatcattcgaagtctcgcagctcacacattaaaccctgatcaggatgttagtcagtggacaactgcagacaatgatgaaggccatggtaacaaccaacttagacttgttcttcttctgcagtatctggaaaatctggagaaattaatgtataatgcatacgagggatgtgctaatgcattaacttcacctcccaaggtcattagaacttttttctataccaatcgccaaacttgtcaggactggctaacgcggattcgactctccatcatgagggtaggattgttggcaggccagcctgcagtgacagtgagacatggctttgacttgcttacagagatgaaaacaaccagcctatctcaggggaatgaattggaagtaaccattatgatggtggtagaagcattatgtgaacttcattgtcctgaagctatacagggaattgctgtctggtcatcatctattgttggaaaaaatcttctgtggattaactcagtggctcaacaggctgaagggaggtttgaaaaggcctctgtggagtaccaggaacacctgtgtgccatgacaggtgttgattgctgcatctccagctttgacaaatcggtgctcaccttagccaatgctgggcgtaacagtgccagcccgaaacattctctgaatggtgaatccagaaaaactgtgctgtccaaaccgactgactcttcccctgaggttataaattatttaggaaataaagcatgtgagtgctacatctcaattgccgattgggctgctgtgcaggaatggcagaacgctatccatgacttgaaaaagagtaccagtagcacttccctcaacctgaaagctgacttcaactatataaaatcattaagcagctttgagtctggaaaatttgttgaatgtaccgagcagttagaattgttaccaggagaaaatatcaatctacttgctggaggatcaaaagaaaaaatagacatgaaaaaactgcttcctaacatgttaagtccggatccgagggaacttcagaaatccattgaagttcaattgttaagaagttctgtttgtttggcaactgctttaaacccgatagaacaagatcagaagtggcagtctataactgaaaatgtggtaaagtacttgaagcaaacatcccgcatcgctattggacctctgagactttctactttaacagtttcacagtctttgccagttctaagtaccttgcagctgtattgctcatctgctttggagaacacagtttctaacagactttcaacagaggactgtcttattccactcttcagtgaagctttacgttcatgtaaacagcatgacgtgaggccatggatgcaggcattaaggtatactatgtaccagaatcagttgttggagaaaattaaagaacaaacagtcccaattagaagccatctcatggaattaggtctaacagcagcaaaatttgctagaaaacgagggaatgtgtcccttgcaacaagactgctggcacagtgcagtgaagttcagctgggaaagaccaccactgcacaggatttagtccaacattttaaaaaactatcaacccaaggtcaagtggatgaaaaatgggggcccgaacttgatattgaaaaaaccaaattgctttatacagcaggccagtcaacacatgcaatggaaatgttgagttcttgtgccatatctttctgcaagtctgtgaaagctgaatatgcagttgctaaatcaattctgacactggctaaatggatccaggcagaatggaaagagatttcaggacagctgaaacaggtttacagagctcagcaccaacagaacttcacaggtctttctactttgtctaaaaacatactcactctaatagaactgccatctgttaatacgatggaagaagagtatcctcggatcgagagtgaatctacagtgcatattggagttggagaacctgacttcattttgggacagttgtatcacctgtcttcagtacaggcacctgaagtagccaaatcttgggcagcgttggccagctgggcttataggtggggcagaaaggtggttgacaatgccagtcagggagaaggtgttcgtctgctgcctagagaaaaatctgaagttcagaatctacttccagacactataactgaggaagagaaagagagaatatatggtattcttggacaggctgtgtgtcggccggcggggattcaggatgaagatataacacttcagataactgagagtgaagacaacgaagaagatgacatggttgatgttatctggcgtcagttgatatcaagctgcccatggctttcagaacttgatgaaagtgcaactgaaggagttattaaagtgtggaggaaagttgtagatagaatattcagcctgtacaaactctcttgcagtgcatactttactttccttaaactcaacgctggtcaaattcctttagatgaggatgaccctaggctgcatttaagtcacagagtggaacagagcactgatgacatgattgtgatggccacattgcgcctgctgcggttgctcgtgaagcacgctggtgagcttcggcagtatctggagcacggcttggagacaacacccactgcaccatggagaggaattattccgcaacttttctcacgcttaaaccaccctgaagtgtatgtgcgccaaagtatttgtaaccttctctgccgtgtggctcaagattccccacatctcatattgtatcctgcaatagtgggtaccatatcgcttagtagtgaatcccaggcttcaggaaataaattttccactgcaattccaactttacttggcaatattcaaggagaagaattgctggtttctgaatgtgagggaggaagtcctcctgcatctcaggatagcaataaggatgaacctaaaagtggattaaatgaagaccaagccatgatgcaggattgttacagcaaaattgtagataagctgtcctctgcaaaccccaccatggtattacaggttcagatgctcgtggctgaactgcgcagggtcactgtgctctgggatgagctctggctgggagttttgctgcaacaacacatgtatgtcctgagacgaattcagcagcttgaagatgaggtgaagagagtccagaacaacaacaccttacgcaaagaagagaaaattgcaatcatgagggagaagcacacagctttgatgaagcccatcgtatttgctttggagcatgtgaggagtatcacagcggctcctgcagaaacacctcatgaaaaatggtttcaggataactatggtgatgccattgaaaatgccctagaaaaactgaagactccattgaaccctgcaaagcctgggagcagctggattccatttaaagagataatgctaagtttgcaacagagagcacagaaacgtgcaagttacatcttgcgtcttgaagaaatcagtccatggttggctgccatgactaacactgaaattgctcttcctggggaagtctcagccagagacactgtcacaatccatagtgtgggcggaaccatcacaatcttaccgactaaaaccaagccaaagaaacttctctttcttggatcagatgggaagagctatccttatcttttcaaaggactggaggatttacatctggatgagagaataatgcagttcctatctattgtgaataccatgtttgctacaattaatcgccaagaaacaccccggttccatgctcgacactattctgtaacaccactaggaacaagatcaggactaatccagtgggtagatggagccacacccttatttggtctttacaaacgatggcaacaacgggaagctgccttacaagcacaaaaggcccaagattcctaccaaactcctcagaatcctggaattgtaccccgtcctagtgaactttattacagtaaaattggccctgctttgaaaacagttgggcttagcctggatgtgtcccgtcgggattggcctcttcatgtaatgaaggcagtattggaagagttaatggaggccacacccccgaatctccttgccaaagagctctggtcatcttgcacaacacctgatgaatggtggagagttacgcagtcttatgcaagatctactgcagtcatgtctatggttggatacataattggccttggagacagacatctggataatgttcttatagatatgacgactggagaagttgttcacatagattacaatgtttgctttgaaaaaggtaaaagccttagagttcctgagaaagtaccttttcgaatgacacaaaacattgaaacagcactgggtgtaactggagtagaaggtgtatttaggctttcatgtgagcaggttttacacattatgcggcgtggcagagagaccctgctgacgctgctggaggcctttgtgtacgaccctctggtggactggacagcaggaggcgaggctgggtttgctggtgctgtctatggtggaggtggccagcaggccgagagcaagcagagcaagagagagatggagcgagagatcacccgcagcctgttttcttctagagtagctgagattaaggtgaactggtttaagaatagagatgagatgctggttgtgcttcccaagttggacggtagcttagatgaatacctaagcttgcaagagcaactgacagatgtggaaaaactgcagggcaaactactggaggaaatagagtttctagaaggagctgaaggggtggatcatccttctcatactctgcaacacaggtattctgagcacacccaactacagactcagcaaagagctgttcaggaagcaatccaggtgaagctgaatgaatttgaacaatggataacacattatcaggctgcattcaataatttagaagcaacacagcttgcaagcttgcttcaagagataagcacacaaatggaccttggtcctccaagttacgtgccagcaacagcctttctgcagaatgctggtcaggcccacttgattagccagtgcgagcagctggagggggaggttggtgctctcctgcagcagaggcgctccgtgctccgtggctgtctggagcaactgcatcactatgcaaccgtggccctgcagtatccgaaggccatatttcagaaacatcgaattgaacagtggaagacctggatggaagagctcatctgtaacaccacagtagagcgttgtcaagagctctataggaaatatgaaatgcaatatgctccccagccacccccaacagtgtgtcagttcatcactgccactgaaatgaccctgcagcgatacgcagcagacatcaacagcagacttattagacaagtggaacgcttgaaacaggaagctgtcactgtgccagtttgtgaagatcagttgaaagaaattgaacgttgcattaaagttttccttcatgagaatggagaagaaggatctttgagtctagcaagtgttattatttctgccctttgtacccttacaaggcgtaacctgatgatggaaggtgcagcgtcaagtgctggagaacagctggttgatctgacttctcgggatggagcctggttcttggaggaactctgcagtatgagcggaaacgtcacctgcttggttcagttactgaagcagtgccacctggtgccacaggacttagatatcccgaaccccatggaagcgtctgagacagttcacttagccaatggagtgtatacctcacttcaggaattgaattcgaatttccggcaaatcatatttccagaagcacttcgatgtttaatgaaaggggaatacacgttagaaagtatgctgcatgaactggacggtcttattgagcagaccaccgatggcgttcccctgcagactctagtggaatctcttcaggcctacttaagaaacgcagctatgggactggaagaagaaacacatgctcattacatcgatgttgccagactactacatgctcagtacggtgaattaatccaaccgagaaatggttcagttgatgaaacacccaaaatgtcagctggccagatgcttttggtagcattcgatggcatgtttgctcaagttgaaactgctttcagcttattagttgaaaagttgaacaagatggaaattcccatagcttggcgaaagattgacatcataagggaagccaggagtactcaagttaatttttttgatgatgataatcaccggcaggtgctagaagagattttctttctaaaaagactacagactattaaggagttcttcaggctctgtggtaccttttctaaaacattgtcaggatcaagttcacttgaagatcagaatactgtgaatgggcctgtacagattgtcaatgtgaaaaccctttttagaaactcttgtttcagtgaagaccaaatggccaaacctatcaaggcattcacagctgactttgtgaggcagctcttgatagggctacccaaccaagccctcggactcacactgtgcagttttatcagtgctctgggtgtagacatcattgctcaagtagaggcaaaggactttggtgccgaaagcaaagtttctgttgatgatctctgtaagaaagcggtggaacataacatccagatagggaagttctctcagctggttatgaacagggcaactgtgttagcaagttcttacgacactgcctggaagaagcatgacttggtgcgaaggctagaaaccagtatttcttcttgtaagacaagcctgcagcgggttcagctgcatattgccatgtttcagtggcaacatgaagatctacttatcaatagaccacaagccatgtcagtcacacctcccccacggtctgctatcctaaccagcatgaaaaagaagctgcataccctgagccagattgaaacttctattgcgacagttcaggagaagctagctgcacttgaatcaagtattgaacagcgactcaagtgggcaggtggtgccaaccctgcattggcccctgtactacaagattttgaagcaacgatagctgaaagaagaaatcttgtccttaaagagagccaaagagcaagtcaggtcacatttctctgcagcaatatcattcattttgaaagtttacgaacaagaactgcagaagccttaaacctggatgcggcgttatttgaactaatcaagcgatgtcagcagatgtgttcgtttgcatcacagtttaacagttcagtgtctgagttagagcttcgtttattacagagagtggacactggtcttgaacatcctattggcagctctgaatggcttttgtcagcacacaaacagttgacccaggatatgtctactcagagggcaattcagacagagaaagagcagcagatagaaacggtctgtgaaacaattcagaatctggttgataatataaagactgtgctcactggtcataaccgacagcttggagatgtcaaacatctcttgaaagctatggctaaggatgaagaagctgctctggcagatggtgaagatgttccctatgagaacagtgttaggcagtttttgggtgaatataaatcatggcaagacaacattcaaacagttctatttacattagtccaggctatgggtcaggttcgaagtcaagaacacgttgaaatgctccaggaaatcactcccaccttgaaagaactgaaaacacaaagtcagagtatctataataatttagtgagttttgcatcacccttagtcaccgatgcaacaaatgaatgttcgagtccaacgtcatctgctacttatcagccatccttcgctgcagcagtccggagtaacactggccagaagactcagcctgatgtcatgtcacagaatgctagaaagctgatccagaaaaatcttgctacatcagctgatactccaccaagcaccgttccaggaactggcaagagtgttgcttgtagtcctaaaaaggcagtcagagaccctaaaactgggaaagcggtgcaagagagaaactcctatgcagtgagtgtgtggaagagagtgaaagccaagttagagggccgagatgttgatccgaataggaggatgtcagttgctgaacaggttgactatgtcattaaggaagcaactaatctagataacttggctcagctgtatgaaggttggacagcctgggtgtgaatggcaagacagtagatgagtctggttaagcgaggtcagacatccaccagaatcaactcagcctcaggcatccaaagccacaccacagtcggtggtgatgcaactgggggcttactctgaggaaacctaggaaatctcggtgcactaggaagtgaatcccgcaggacagctgcactcagggatacgcccaacaccatggcctgcaaccccagggtcaagggtgaaggaaagcaagctcaccgcctgaacacggagattgtctttctgccacagaacagcagcagacgtgtcgggaggttagctgcggaaagaaatcgggatgccgcggagcacagagtgatttggaactccattccacctgaccctgtgtgtacaatccaggaaaaaaacaaaccccactcagaaacagagaaaactggggtcgcgaagaaatcacagccaaggaagatttgatgcattcagattctcgtgtaacacttgttgcttggcaacagtactggttgggttgaccagtaagtagaaaaaggctaaaggctatgcgatatgaatttcagaaatggactgaaaatggagagctatgtaacagatacactacagtagaagaacttacttctgaaatgaagggaaaaaaaccaccccatcgttccctactcctccccaccacttacccgttccccctttacctaatctagtagattagccatctttcaaattcacttttatttcagtccttatatttcatatacttccgtctcgatgctgttaacaacttctgataacatggaaaattcaaggattgtttaaaggtctgatgatcacacacaaaatgtaattccggttatttaagtcatttctgtgattctatcatgtacagtttccagaattgtcactgtgcattcaaaagtaatgaatctaacagacatttgatttaatgtacactcccttttgcttatagtgtgcattttttttggaggtcattcaaattttccctcttctgtgatagctgtagtttctttcatagaaagtagctaatccagtgtaatcttttacctttttaaaaaccaagatagagtatctattagagttttacattgttgatgatagattaacaataaagtgatgttctggtggaggtagactgaaatttttttaattcatgtttttcatttgatacttttaatttacacttagtaaattaaaagttgtttaatttacttggcattttaggacatgtacatgaaacagtgaaaatgagatccaccaacatcttttattaagttcagttattagtctgtgaagtgctttactttttgcacaattttaatagcttgctattcagtaatacattatagtgaattcatgatcaaggtttccttaaatttagcattgcatttcagtactgactgtgtaagctaaattgctgatccaaaataaaaacccagactagaatagggttcttaaaatcaagtatcaatacaaaatagaacacaattaaaatcttaattgttggctgggcacagtggctcacgcctgtaatcccagcactttgggaggccgaggcgggcggatcatgaggttaggagagcgagaccatcctggctaacacggtgaaaccccgtctttactaaaaatacaaaaaaaattagccgggtgtggtggcgggcgcctgtagtcccagctactcgggaggctgaggcaggagaatggcgtgaacccaggaggcggagcttgcagtgagccgagattgtgccactgcactccagcctgggcaacagagctagactctgtgtcaaaaataaatgactagataaaaaaaaaaattgtttgagtacattttccctgcattttagagattaggacagtggtcactttctagttgccgtcttcacagacaaacttgaaaggtattaaggaaaaaattccacatagctctgggccttttttgtattctgattgccacgttaatctgtaatcgttaagtacccatgaaagaatgtgtttcagtatcagtgctttttggtactttaacaagtatgtaggcacggtggatttttttgaaatacccatgtgtccaatagcaagttaaggaacctagcgcatcaaattttgttttcttcattcatttggaaccttattttcgcaaaaaacctagctggaataataatgccatatgtattttgcacactgctttattttctagaggctctgggagcaaattacattcatcacattacctctgctctctcaagattaaagtctttcagcaacattctttattgtcatcataaggaaaaacttttatcgcaatgatagtcagttcacattagtttagcactatagatagtattcagaaattgctttctctttggtaaagaagataaataggtgaattttattgcctgtgttttcaggcttcagaggtacctggcaccttactcaagcaaaaacaaaaaacagctttacttcaaaagcatgtgcctctggtaaattatccatcacttttgttttaaagtggtccctccaagaataatgtggcatacacagtgggtttggttgtaaggcagatgtaatagatgacttcaaaagcctgctccttactgcactctggacaaggccctggtctgtatagtttggcttcctctgttaagtcattctacaaggtgacttgccatttgaactttcgtaagagacctcagcagttagactgagaaaagttagagtgctgtagttatgaagtcatacatttttgataaaatacctgtggaaaaccagggatcctctcctgtttctctctcttgcctccccctttccctccattcctctgtcgcctccccctctcctccactttctttaagaatcagggggtacagaataacctacaaacaacctcttcaaagtacccttggaaattgaagttcaatcttaagttttttgctgtctttaatttactagaattgcctaatttttagttgatttctctacagagcttagcttgtgtagttatttctcttttactgttgctttggtgtgtcttgaagtttgattgattatttttggtcattgagttcttagtgtagtttgctagatgattattaagattcttttgtgtctgacacttgtggtgagttgcttttgaaatctgttgagatttccatgtgagaactgataatcaggctcttgatctgcttccctaaattacttttttagagcccaaaccccaggtttagggtgagggtttgtaatacaaagaaacacttccatcacttctgcccttaacccttgcctctattacctaagcttagtaagtagttttcttaatattgtccaatgtttggtgttatctgcattgttttttgtttttttaattgtggttgttctgacgtgtgaaatttaaggaaagagccattttttaaaaatgccgagcagggcaatgcaagtacagccaaatattagacttgatgtgcaatcttcggtcctttttaatctggggtattataggcagtactttaaattgcaaagtcttccgggcctattttcctctacatttttgtaattaactctgggggcttacttgttttggcagtactgaaatcaaaggagctggttcttcttttctcccaattattttcatatgaaagcacctacaattagcctgttagtcctattcagatacatcaaatatcagtgaatgctttactattcgcacatttaagcatctttgttttacataaaattagagtatgaaaaccagtgttcaattttttatcttgttgagcttgtaaaatgccagcaatttaaaactaggacttttccccccataagccaaggaggtagaattactaatacaagggttaaagaaggtagattttgttttcaatatttgggtaatattagaaagattcttcccacagggaagaactagcaagtgtcccaattttttccaaacgttggggaggggaaaattcactgtatcatgaaaccctaagggtttgttgcacttcctgctttttaggcctggataacagtatcaccatccttatttacagaagggtaaaactgactcttaatgagaaaagctttataagttcaagggctgtaaaatatgaactacttagggtcgtttgccttccatgggaacttggctagacttagaaaaagctgtttgttgtgctaatgtaaaagtgtcatacaatttagaagatttttgaagatggtaaacttagaagaattctatgttctgaaatgcacacttttagaatgtttttctttgaaaacaggctaatagttntttctttttttgacaaagtttcagctcctctttaaagttattgtgtcatttttctggtttaaatttcccttatatttccacctgtaatgtcagtggcaacaacatcatacttcacttacttgttaatttactttttacccttattctaagagcaagttgagttgaactgaatcttccttgtcttagtaacaatgtataaatagtggcttttctgtacaaaaggttgtaatgcctcctgatggatataattttgtgattgtatttaaaagttgaataaatcacaccagcttcctgaaaatgttcataatgcatcttttggaaaacaaatacatgcctactttgtgcatatttgcattaacatggcaaagattgtatgaaatacctgtttttcagaaaataaaggttcagtctcaaaagat

SEQ ID NO: 34691 - DNA, 13881 bp, Homo sapiens
  misc_feature (13462)..(13462): n is a, c, g, or t
catgaggcttttaagaatcatgtgttcaatgtagacaatgcaaaatttgtagttaaatttgacctcaattgactacaaaatttgtagttaaatttgactacaattggaaatgccaaaaactcactaatagggatgtgggcgctatctccaactgtctttgcacttctgagtaagaatctgatgattgtgcacagtgacctggctgttcacttccctgccattcagtatgctgtgctctacacattgtattctcattgtaccaggcatgatcactttatctctagtagcctcagttcttcctctccttctttgtttgatggagctgtgattagcactgtaactacggctacaaagaaacatttctcaattatattaaatcttctgggaatattacttaagaaagataaccttaaccaggacacgaggaaactgttaatgacttgggctttggaagcagctgttttaatgaagaagtctgaaacatacgcacctttattctctcttccgtctttccataaattttgcaaaggccttttagccaacactctcgttgaagatgtgaatatctgtctgcaggcatgcagcagtctacatgctctgtcctcttccttgccagatgatcttttacagagatgtgtcgatgtttgccgtgttcaactagtgcacagtggaactcgtattcgacaagcatttggaaaactgttgaaatcaattcctttagatgttgtcctaagcaataacaatcacacagaaattcaagaaatttctttagcattaagaagtcacatgagtaaagcaccaagtaatacattccacccccaagatttctctgatgttattagttttattttgtatgggaactctcatagaacagggaaggacaattggttggaaagactgttctatagctgccagagactggataagcgtgaccagtcaacaattccacgcaatctcctgaagacagatgctgtcctttggcagtgggccatatgggaagctgcacaattcactgttctttctaagctgagaaccccactgggcagagctcaagacaccttccagacaattgaaggtatcattcgaagtctcgcagctcacacattaaaccctgatcaggatgttagtcagtggacaactgcagacaatgatgaaggccatggtaacaaccaacttagacttgttcttcttctgcagtatctggaaaatctggagaaattaatgtataatgcatacgagggatgtgctaatgcattaacttcacctcccaaggtcattagaacttttttctataccaatcgccaaacttgtcaggactggctaacgcggattcgactctccatcatgagggtaggattgttggcaggccagcctgcagtgacagtgagacatggctttgacttgcttacagagatgaaaacaaccagcctatctcaggggaatgaattggaagtaaccattatgatggtggtagaagcattatgtgaacttcattgtcctgaagctatacagggaattgctgtctggtcatcatctattgttggaaaaaatcttctgtggattaactcagtggctcaacaggctgaagggaggtttgaaaaggcctctgtggagtaccaggaacacctgtgtgccatgacaggtgttgattgctgcatctccagctttgacaaatcggtgctcaccttagccaatgctgggcgtaacagtgccagcccgaaacattctctgaatggtgaatccagaaaaactgtgctgtccaaaccgactgactcttcccctgaggttataaattatttaggaaataaagcatgtgagtgctacatctcaattgccgattgggctgctgtgcaggaatggcagaacgctatccatgacttgaaaaagagtaccagtagcacttccctcaacctgaaagctgacttcaactatataaaatcattaagcagctttgagtctggaaaatttgttgaatgtaccgagcagttagaattgttaccaggagaaaatatcaatctacttgctggaggatcaaaagaaaaaatagacatgaaaaaactgcttcctaacatgttaagtccggatccgagggaacttcagaaatccattgaagttcaattgttaagaagttctgtttgtttggcaactgctttaaacccgatagaacaagatcagaagtggcagtctataactgaaaatgtggtaaagtacttgaagcaaacatcccgcatcgctattggacctctgagactttctactttaacagtttcacagtctttgccagttctaagtaccttgcagctgtattgctcatctgctttggagaacacagtttctaacagactttcaacagaggactgtcttattccactcttcagtgaagctttacgttcatgtaaacagcatgacgtgaggccatggatgcaggcattaaggtatactatgtaccagaatcagttgttggagaaaattaaagaacaaacagtcccaattagaagccatctcatggaattaggtctaacagcagcaaaatttgctagaaaacgagggaatgtgtcccttgcaacaagactgctggcacagtgcagtgaagttcagctgggaaagaccaccactgcacaggatttagtccaacattttaaaaaactatcaacccaaggtcaagtggatgaaaaatgggggcccgaacttgatattgaaaaaaccaaattgctttatacagcaggccagtcaacacatgcaatggaaatgttgagttcttgtgccatatctttctgcaagtctgtgaaagctgaatatgcagttgctaaatcaattctgacactggctaaatggatccaggcagaatggaaagagatttcaggacagctgaaacaggtttacagagctcagcaccaacagaacttcacaggtctttctactttgtctaaaaacatactcactctaatagaactgccatctgttaatacgatggaagaagagtatcctcggatcgagagtgaatctacagtgcatattggagttggagaacctgacttcattttgggacagttgtatcacctgtcttcagtacaggcacctgaagtagccaaatcttgggcagcgttggccagctgggcttataggtggggcagaaaggtggttgacaatgccagtcagggagaaggtgttcgtctgctgcctagagaaaaatctgaagttcagaatctacttccagacactataactgaggaagagaaagagagaatatatggtattcttggacaggctgtgtgtcggccggcggggattcaggatgaagatataacacttcagataactgagagtgaagacaacgaagaagatgacatggttgatgttatctggcgtcagttgatatcaagctgcccatggctttcagaacttgatgaaagtgcaactgaaggagttattaaagtgtggaggaaagttgtagatagaatattcagcctgtacaaactctcttgcagtgcatactttactttccttaaactcaacgctggtcaaattcctttagatgaggatgaccctaggctgcatttaagtcacagagtggaacagagcactgatgacatgattgtgatggccacattgcgcctgctgcggttgctcgtgaagcacgctggtgagcttcggcagtatctggagcacggcttggagacaacacccactgcaccatggagaggaattattccgcaacttttctcacgcttaaaccaccctgaagtgtatgtgcgccaaagtatttgtaaccttctctgccgtgtggctcaagattccccacatctcatattgtatcctgcaatagtgggtaccatatcgcttagtagtgaatcccaggcttcaggaaataaattttccactgcaattccaactttacttggcaatattcaaggagaagaattgctggtttctgaatgtgagggaggaagtcctcctgcatctcaggatagcaataaggatgaacctaaaagtggattaaatgaagaccaagccatgatgcaggattgttacagcaaaattgtagataagctgtcctctgcaaaccccaccatggtattacaggttcagatgctcgtggctgaactgcgcagggtcactgtgctctgggatgagctctggctgggagttttgctgcaacaacacatgtatgtcctgagacgaattcagcagcttgaagatgaggtgaagagagtccagaacaacaacaccttacgcaaagaagagaaaattgcaatcatgagggagaagcacacagctttgatgaagcccatcgtatttgctttggagcatgtgaggagtatcacagcggctcctgcagaaacacctcatgaaaaatggtttcaggataactatggtgatgccattgaaaatgccctagaaaaactgaagactccattgaaccctgcaaagcctgggagcagctggattccatttaaagagataatgctaagtttgcaacagagagcacagaaacgtgcaagttacatcttgcgtcttgaagaaatcagtccatggttggctgccatgactaacactgaaattgctcttcctggggaagtctcagccagagacactgtcacaatccatagtgtgggcggaaccatcacaatcttaccgactaaaaccaagccaaagaaacttctctttcttggatcagatgggaagagctatccttatcttttcaaaggactggaggatttacatctggatgagagaataatgcagttcctatctattgtgaataccatgtttgctacaattaatcgccaagaaacaccccggttccatgctcgacactattctgtaacaccactaggaacaagatcaggactaatccagtgggtagatggagccacacccttatttggtctttacaaacgatggcaacaacgggaagctgccttacaagcacaaaaggcccaagattcctaccaaactcctcagaatcctggaattgtaccccgtcctagtgaactttattacagtaaaattggccctgctttgaaaacagttgggcttagcctggatgtgtcccgtcgggattggcctcttcatgtaatgaaggcagtattggaagagttaatggaggccacacccccgaatctccttgccaaagagctctggtcatcttgcacaacacctgatgaatggtggagagttacgcagtcttatgcaagatctactgcagtcatgtctatggttggatacataattggccttggagacagacatctggataatgttcttatagatatgacgactggagaagttgttcacatagattacaatgtttgctttgaaaaaggtaaaagccttagagttcctgagaaagtaccttttcgaatgacacaaaacattgaaacagcactgggtgtaactggagtagaaggtgtatttaggctttcatgtgagcaggttttacacattatgcggcgtggcagagagaccctgctgacgctgctggaggcctttgtgtacgaccctctggtggactggacagcaggaggcgaggctgggtttgctggtgctgtctatggtggaggtggccagcaggccgagagcaagcagagcaagagagagatggagcgagagatcacccgcagcctgttttcttctagagtagctgagattaaggtgaactggtttaagaatagagatgagatgctggttgtgcttcccaagttggacggtagcttagatgaatacctaagcttgcaagagcaactgacagatgtggaaaaactgcagggcaaactactggaggaaatagagtttctagaaggagctgaaggggtggatcatccttctcatactctgcaacacaggtattctgagcacacccaactacagactcagcaaagagctgttcaggaagcaatccaggtgaagctgaatgaatttgaacaatggataacacattatcaggctgcattcaataatttagaagcaacacagcttgcaagcttgcttcaagagataagcacacaaatggaccttggtcctccaagttacgtgccagcaacagcctttctgcagaatgctggtcaggcccacttgattagccagtgcgagcagctggagggggaggttggtgctctcctgcagcagaggcgctccgtgctccgtggctgtctggagcaactgcatcactatgcaaccgtggccctgcagtatccgaaggccatatttcagaaacatcgaattgaacagtggaagacctggatggaagagctcatctgtaacaccacagtagagcgttgtcaagagctctataggaaatatgaaatgcaatatgctccccagccacccccaacagtgtgtcagttcatcactgccactgaaatgaccctgcagcgatacgcagcagacatcaacagcagacttattagacaagtggaacgcttgaaacaggaagctgtcactgtgccagtttgtgaagatcagttgaaagaaattgaacgttgcattaaagttttccttcatgagaatggagaagaaggatctttgagtctagcaagtgttattatttctgccctttgtacccttacaaggcgtaacctgatgatggaaggtgcagcgtcaagtgctggagaacagctggttgatctgacttctcgggatggagcctggttcttggaggaactctgcagtatgagcggaaacgtcacctgcttggttcagttactgaagcagtgccacctggtgccacaggacttagatatcccgaaccccatggaagcgtctgagacagttcacttagccaatggagtgtatacctcacttcaggaattgaattcgaatttccggcaaatcatatttccagaagcacttcgatgtttaatgaaaggggaatacacgttagaaagtatgctgcatgaactggacggtcttattgagcagaccaccgatggcgttcccctgcagactctagtggaatctcttcaggcctacttaagaaacgcagctatgggactggaagaagaaacacatgctcattacatcgatgttgccagactactacatgctcagtacggtgaattaatccaaccgagaaatggttcagttgatgaaacacccaaaatgtcagctggccagatgcttttggtagcattcgatggcatgtttgctcaagttgaaactgctttcagcttattagttgaaaagttgaacaagatggaaattcccatagcttggcgaaagattgacatcataagggaagccaggagtactcaagttaatttttttgatgatgataatcaccggcaggtgctagaagagattttctttctaaaaagactacagactattaaggagttcttcaggctctgtggtaccttttctaaaacattgtcaggatcaagttcacttgaagatcagaatactgtgaatgggcctgtacagattgtcaatgtgaaaaccctttttagaaactcttgtttcagtgaagaccaaatggccaaacctatcaaggcattcacagctgactttgtgaggcagctcttgatagggctacccaaccaagccctcggactcacactgtgcagttttatcagtgctctgggtgtagacatcattgctcaagtagaggcaaaggactttggtgccgaaagcaaagtttctgttgatgatctctgtaagaaagcggtggaacataacatccagatagggaagttctctcagctggttatgaacagggcaactgtgttagcaagttcttacgacactgcctggaagaagcatgacttggtgcgaaggctagaaaccagtatttcttcttgtaagacaagcctgcagcgggttcagctgcatattgccatgtttcagtggcaacatgaagatctacttatcaatagaccacaagccatgtcagtcacacctcccccacggtctgctatcctaaccagcatgaaaaagaagctgcataccctgagccagattgaaacttctattgcgacagttcaggagaagctagctgcacttgaatcaagtattgaacagcgactcaagtgggcaggtggtgccaaccctgcattggcccctgtactacaagattttgaagcaacgatagctgaaagaagaaatcttgtccttaaagagagccaaagagcaagtcaggtcacatttctctgcagcaatatcattcattttgaaagtttacgaacaagaactgcagaagccttaaacctggatgcggcgttatttgaactaatcaagcgatgtcagcagatgtgttcgtttgcatcacagtttaacagttcagtgtctgagttagagcttcgtttattacagagagtggacactggtcttgaacatcctattggcagctctgaatggcttttgtcagcacacaaacagttgacccaggatatgtctactcagagggcaattcagacagagaaagagcagcagatagaaacggtctgtgaaacaattcagaatctggttgataatataaagactgtgctcactggtcataaccgacagcttggagatgtcaaacatctcttgaaagctatggctaaggatgaagaagctgctctggcagatggtgaagatgttccctatgagaacagtgttaggcagtttttgggtgaatataaatcatggcaagacaacattcaaacagttctatttacattagtccaggctatgggtcaggttcgaagtcaagaacacgttgaaatgctccaggaaatcactcccaccttgaaagaactgaaaacacaaagtcagagtatctataataatttagtgagttttgcatcacccttagtcaccgatgcaacaaatgaatgttcgagtccaacgtcatctgctacttatcagccatccttcgctgcagcagtccggagtaacactggccagaagactcagcctgatgtcatgtcacagaatgctagaaagctgatccagaaaaatcttgctacatcagctgatactccaccaagcaccgttccaggaactggcaagagtgttgcttgtagtcctaaaaaggcagtcagagaccctaaaactgggaaagcggtgcaagagagaaactcctatgcagtgagtgtgtggaagagagtgaaagccaagttagagggccgagatgttgatccgaataggaggatgtcagttgctgaacaggttgactatgtcattaaggaagcaactaatctagataacttggctcagctgtatgaaggttggacagcctgggtgtgaatggcaagacagtagatgagtctggttaagcgaggtcagacatccaccagaatcaactcagcctcaggcatccaaagccacaccacagtcggtggtgatgcaactgggggcttactctgaggaaacctaggaaatctcggtgcactaggaagtgaatcccgcaggacagctgcactcagggatacgcccaacaccatggcctgcaaccccagggtcaagggtgaaggaaagcaagctcaccgcctgaacacggagattgtctttctgccacagaacagcagcagacgtgtcgggaggttagctgcggaaagaaatcgggatgccgcggagcacagagtgatttggaactccattccacctgaccctgtgtgtacaatccaggaaaaaaacaaaccccactcagaaacagagaaaactggggtcgcgaagaaatcacagccaaggaagatttgatgcattcagattctcgtgtaacacttgttgcttggcaacagtactggttgggttgaccagtaagtagaaaaaggctaaaggctatgcgatatgaatttcagaaatggactgaaaatggagagctatgtaacagatacactacagtagaagaacttacttctgaaatgaagggaaaaaaaccaccccatcgttccctactcctccccaccacttacccgttccccctttacctaatctagtagattagccatctttcaaattcacttttatttcagtccttatatttcatatacttccgtctcgatgctgttaacaacttctgataacatggaaaattcaaggattgtttaaaggtctgatgatcacacacaaaatgtaattccggttatttaagtcatttctgtgattctatcatgtacagtttccagaattgtcactgtgcattcaaaagtaatgaatctaacagacatttgatttaatgtacactcccttttgcttatagtgtgcattttttttggaggtcattcaaattttccctcttctgtgatagctgtagtttctttcatagaaagtagctaatccagtgtaatcttttacctttttaaaaaccaagatagagtatctattagagttttacattgttgatgatagattaacaataaagtgatgttctggtggaggtagactgaaatttttttaattcatgtttttcatttgatacttttaatttacacttagtaaattaaaagttgtttaatttacttggcattttaggacatgtacatgaaacagtgaaaatgagatccaccaacatcttttattaagttcagttattagtctgtgaagtgctttactttttgcacaattttaatagcttgctattcagtaatacattatagtgaattcatgatcaaggtttccttaaatttagcattgcatttcagtactgactgtgtaagctaaattgctgatccaaaataaaaacccagactagaatagggttcttaaaatcaagtatcaatacaaaatagaacacaattaaaatcttaattgttggctgggcacagtggctcacgcctgtaatcccagcactttgggaggccgaggcgggcggatcatgaggttaggagagcgagaccatcctggctaacacggtgaaaccccgtctttactaaaaatacaaaaaaaattagccgggtgtggtggcgggcgcctgtagtcccagctactcgggaggctgaggcaggagaatggcgtgaacccaggaggcggagcttgcagtgagccgagattgtgccactgcactccagcctgggcaacagagctagactctgtgtcaaaaataaatgactagataaaaaaaaaaattgtttgagtacattttccctgcattttagagattaggacagtggtcactttctagttgccgtcttcacagacaaacttgaaaggtattaaggaaaaaattccacatagctctgggccttttttgtattctgattgccacgttaatctgtaatcgttaagtacccatgaaagaatgtgtttcagtatcagtgctttttggtactttaacaagtatgtaggcacggtggatttttttgaaatacccatgtgtccaatagcaagttaaggaacctagcgcatcaaattttgttttcttcattcatttggaaccttattttcgcaaaaaacctagctggaataataatgccatatgtattttgcacactgctttattttctagaggctctgggagcaaattacattcatcacattacctctgctctctcaagattaaagtctttcagcaacattctttattgtcatcataaggaaaaacttttatcgcaatgatagtcagttcacattagtttagcactatagatagtattcagaaattgctttctctttggtaaagaagataaataggtgaattttattgcctgtgttttcaggcttcagaggtacctggcaccttactcaagcaaaaacaaaaaacagctttacttcaaaagcatgtgcctctggtaaattatccatcacttttgttttaaagtggtccctccaagaataatgtggcatacacagtgggtttggttgtaaggcagatgtaatagatgacttcaaaagcctgctccttactgcactctggacaaggccctggtctgtatagtttggcttcctctgttaagtcattctacaaggtgacttgccatttgaactttcgtaagagacctcagcagttagactgagaaaagttagagtgctgtagttatgaagtcatacatttttgataaaatacctgtggaaaaccagggatcctctcctgtttctctctcttgcctccccctttccctccattcctctgtcgcctccccctctcctccactttctttaagaatcagggggtacagaataacctacaaacaacctcttcaaagtacccttggaaattgaagttcaatcttaagttttttgctgtctttaatttactagaattgcctaatttttagttgatttctctacagagcttagcttgtgtagttatttctcttttactgttgctttggtgtgtcttgaagtttgattgattatttttggtcattgagttcttagtgtagtttgctagatgattattaagattcttttgtgtctgacacttgtggtgagttgcttttgaaatctgttgagatttccatgtgagaactgataatcaggctcttgatctgcttccctaaattacttttttagagcccaaaccccaggtttagggtgagggtttgtaatacaaagaaacacttccatcacttctgcccttaacccttgcctctattacctaagcttagtaagtagttttcttaatattgtccaatgtttggtgttatctgcattgttttttgtttttttaattgtggttgttctgacgtgtgaaatttaaggaaagagccattttttatcttcggtcctttttaatctggggtattataggcagtactttaaattgcaaagtcttccgggcctattttcctctacatttttgtaattaactctgggggcttacttgttttggcagtactgaaatcaaaggagctggttcttcttttctcccaattattttcatatgaaagcacctacaattagcctgttagtcctattcagatacatcaaatatcagtgaatgctttactattcgcacatttaagcatctttgttttacataaaattagagtatgaaaaccagtgttcaattttttatcttgttgagcttgtaaaatgccagcaatttaaaactaggacttttccccccataagccaaggaggtagaattactaatacaagggttaaagaaggtagattttgttttcaatatttgggtaatattagaaagattcttcccacagggaagaactagcaagtgtcccaattttttccaaacgttggggaggggaaaattcactgtatcatgaaaccctaagggtttgttgcacttcctgctttttaggcctggataacagtatcaccatccttatttacagaagggtaaaactgactcttaatgagaaaagctttataagttcaagggctgtaaaatatgaactacttagggtcgtttgccttccatgggaacttggctagacttagaaaaagctgtttgttgtgctaatgtaaaagtgtcatacaatttagaagatttttgaagatggtaaacttagaagaattctatgttctgaaatgcacacttttagaatgtttttctttgaaaacaggctaatagttntttctttttttgacaaagtttcagctcctctttaaagttattgtgtcatttttctggtttaaatttcccttatatttccacctgtaatgtcagtggcaacaacatcatacttcacttacttgttaatttactttttacccttattctaagagcaagttgagttgaactgaatcttccttgtcttagtaacaatgtataaatagtggcttttctgtacaaaaggttgtaatgcctcctgatggatataattttgtgattgtatttaaaagttgaataaatcacaccagcttcctgaaaatgttcataatgcatcttttggaaaacaaatacatgcctactttgtgcatatttgcattaacatggcaaagattgtatgaaatacctgtttttcagaaaataaaggttcagtctcaaaagat

SEQ ID NO: 34692 - DNA, 2794 bp, Homo sapiens
  misc_feature (2375)..(2375): n is a, c, g, or t
ggctggtacggaccggaagttagggatttttgtattctgattgccacgttaatctgtaatcgttaagtacccatgaaagaatgtgtttcagtatcagtgctttttggtactttaacaagtatgtaggcacggtggatttttttgaaatacccatgtgtccaatagcaagttaaggaacctagcgcatcaaattttgttttcttcattcatttggaaccttattttcgcaaaaaacctagctggaataataatgccatatgtattttgcacactgctttattttctagaggctctgggagcaaattacattcatcacattacctctgctctctcaagattaaagtctttcagcaacattctttattgtcatcataaggaaaaacttttatcgcaatgatagtcagttcacattagtttagcactatagatagtattcagaaattgctttctctttggtaaagaagataaataggtgaattttattgcctgtgttttcaggcttcagaggtacctggcaccttactcaagcaaaaacaaaaaacagctttacttcaaaagcatgtgcctctggtaaattatccatcacttttgttttaaagtggtccctccaagaataatgtggcatacacagtgggtttggttgtaaggcagatgtaatagatgacttcaaaagcctgctccttactgcactctggacaaggccctggtctgtatagtttggcttcctctgttaagtcattctacaaggtgacttgccatttgaactttcgtaagagacctcagcagttagactgagaaaagttagagtgctgtagttatgaagtcatacatttttgataaaatacctgtggaaaaccagggatcctctcctgtttctctctcttgcctccccctttccctccattcctctgtcgcctccccctctcctccactttctttaagaatcagggggtacagaataacctacaaacaacctcttcaaagtacccttggaaattgaagttcaatcttaagttttttgctgtctttaatttactagaattgcctaatttttagttgatttctctacagagcttagcttgtgtagttatttctcttttactgttgctttggtgtgtcttgaagtttgattgattatttttggtcattgagttcttagtgtagtttgctagatgattattaagattcttttgtgtctgacacttgtggtgagttgcttttgaaatctgttgagatttccatgtgagaactgataatcaggctcttgatctgcttccctaaattacttttttagagcccaaaccccaggtttagggtgagggtttgtaatacaaagaaacacttccatcacttctgcccttaacccttgcctctattacctaagcttagtaagtagttttcttaatattgtccaatgtttggtgttatctgcattgttttttgtttttttaattgtggttgttctgacgtgtgaaatttaaggaaagagccattttttaaaaatgccgagcagggcaatgcaagtacagccaaatattagacttgatgtgcaatcttcggtcctttttaatctggggtattataggcagtactttaaattgcaaagtcttccgggcctattttcctctacatttttgtaattaactctgggggcttacttgttttggcagtactgaaatcaaaggagctggttcttcttttctcccaattattttcatatgaaagcacctacaattagcctgttagtcctattcagatacatcaaatatcagtgaatgctttactattcgcacatttaagcatctttgttttacataaaattagagtatgaaaaccagtgttcaattttttatcttgttgagcttgtaaaatgccagcaatttaaaactaggacttttccccccataagccaaggaggtagaattactaatacaagggttaaagaaggtagattttgttttcaatatttgggtaatattagaaagattcttcccacagggaagaactagcaagtgtcccaattttttccaaacgttggggaggggaaaattcactgtatcatgaaaccctaagggtttgttgcacttcctgctttttaggcctggataacagtatcaccatccttatttacagaagggtaaaactgactcttaatgagaaaagctttataagttcaagggctgtaaaatatgaactacttagggtcgtttgccttccatgggaacttggctagacttagaaaaagctgtttgttgtgctaatgtaaaagtgtcatacaatttagaagatttttgaagatggtaaacttagaagaattctatgttctgaaatgcacacttttagaatgtttttctttgaaaacaggctaatagttntttctttttttgacaaagtttcagctcctctttaaagttattgtgtcatttttctggtttaaatttcccttatatttccacctgtaatgtcagtggcaacaacatcatacttcacttacttgttaatttactttttacccttattctaagagcaagttgagttgaactgaatcttccttgtcttagtaacaatgtataaatagtggcttttctgtacaaaaggttgtaatgcctcctgatggatataattttgtgattgtatttaaaagttgaataaatcacaccagcttcctgaaaatgttcataatgcatcttttggaaaacaaatacatgcctactttgtgcatatttgcattaacatggcaaagattgtatgaaatacctgtttttcagaaaataaaggttcagtctcaaaagat

SEQ ID NO: 34693 - DNA, 9589 bp, Homo sapiens
catgaggcttttaagaatcatgtgttcaatgtagacaatgcaaaatttgtagttaaatttgacctcaattgactacaaaatttgtagttaaatttgactacaattggaaatgccaaaaactcactaatagggatgtgggcgctatctccaactgtctttgcacttctgagtaagaatctgatgattgtgcacagtgacctggctgttcacttccctgccattcagtatgctgtgctctacacattgtattctcattgtaccaggcatgatcactttatctctagtagcctcagttcttcctctccttctttgtttgatggagctgtgattagcactgtaactacggctacaaagaaacatttctcaattatattaaatcttctgggaatattacttaagaaagataaccttaaccaggacacgaggaaactgttaatgacttgggctttggaagcagctgttttaatgaagaagtctgaaacatacgcacctttattctctcttccgtctttccataaattttgcaaaggccttttagccaacactctcgttgaagatgtgaatatctgtctgcaggcatgcagcagtctacatgctctgtcctcttccttgccagatgatcttttacagagatgtgtcgatgtttgccgtgttcaactagtgcacagtggaactcgtattcgacaagcatttggaaaactgttgaaatcaattcctttagatgttgtcctaagcaataacaatcacacagaaattcaagaaatttctttagcattaagaagtcacatgagtaaagcaccaagtaatacattccacccccaagatttctctgatgttattagttttattttgtatgggaactctcatagaacagggaaggacaattggttggaaagactgttctatagctgccagagactggataagcgtgaccagtcaacaattccacgcaatctcctgaagacagatgctgtcctttggcagtgggccatatgggaagctgcacaattcactgttctttctaagctgagaaccccactgggcagagctcaagacaccttccagacaattgaaggtatcattcgaagtctcgcagctcacacattaaaccctgatcaggatgttagtcagtggacaactgcagacaatgatgaaggccatggtaacaaccaacttagacttgttcttcttctgcagtatctggaaaatctggagaaattaatgtataatgcatacgagggatgtgctaatgcattaacttcacctcccaaggtcattagaacttttttctataccaatcgccaaacttgtcaggactggctaacgcggattcgactctccatcatgagggtaggattgttggcaggccagcctgcagtgacagtgagacatggctttgacttgcttacagagatgaaaacaaccagcctatctcaggggaatgaattggaagtaaccattatgatggtggtagaagcattatgtgaacttcattgtcctgaagctatacagggaattgctgtctggtcatcatctattgttggaaaaaatcttctgtggattaactcagtggctcaacaggctgaagggaggtttgaaaaggcctctgtggagtaccaggaacacctgtgtgccatgacaggtgttgattgctgcatctccagctttgacaaatcggtgctcaccttagccaatgctgggcgtaacagtgccagcccgaaacattctctgaatggtgaatccagaaaaactgtgctgtccaaaccgactgactcttcccctgaggttataaattatttaggaaataaagcatgtgagtgctacatctcaattgccgattgggctgctgtgcaggaatggcagaacgctatccatgacttgaaaaagagtaccagtagcacttccctcaacctgaaagctgacttcaactatataaaatcattaagcagctttgagtctggaaaatttgttgaatgtaccgagcagttagaattgttaccaggagaaaatatcaatctacttgctggaggatcaaaagaaaaaatagacatgaaaaaactgcttcctaacatgttaagtccggatccgagggaacttcagaaatccattgaagttcaattgttaagaagttctgtttgtttggcaactgctttaaacccgatagaacaagatcagaagtggcagtctataactgaaaatgtggtaaagtacttgaagcaaacatcccgcatcgctattggacctctgagactttctactttaacagtttcacagtctttgccagttctaagtaccttgcagctgtattgctcatctgctttggagaacacagtttctaacagactttcaacagaggactgtcttattccactcttcagtgaagctttacgttcatgtaaacagcatgacgtgaggccatggatgcaggcattaaggtatactatgtaccagaatcagttgttggagaaaattaaagaacaaacagtcccaattagaagccatctcatggaattaggtctaacagcagcaaaatttgctagaaaacgagggaatgtgtcccttgcaacaagactgctggcacagtgcagtgaagttcagctgggaaagaccaccactgcacaggatttagtccaacattttaaaaaactatcaacccaaggtcaagtggatgaaaaatgggggcccgaacttgatattgaaaaaaccaaattgctttatacagcaggccagtcaacacatgcaatggaaatgttgagttcttgtgccatatctttctgcaagtctgtgaaagctgaatatgcagttgctaaatcaattctgacactggctaaatggatccaggcagaatggaaagagatttcaggacagctgaaacaggtttacagagctcagcaccaacagaacttcacaggtctttctactttgtctaaaaacatactcactctaatagaactgccatctgttaatacgatggaagaagagtatcctcggatcgagagtgaatctacagtgcatattggagttggagaacctgacttcattttgggacagttgtatcacctgtcttcagtacaggcacctgaagtagccaaatcttgggcagcgttggccagctgggcttataggtggggcagaaaggtggttgacaatgccagtcagggagaaggtgttcgtctgctgcctagagaaaaatctgaagttcagaatctacttccagacactataactgaggaagagaaagagagaatatatggtattcttggacaggctgtgtgtcggccggcggggattcaggatgaagatataacacttcagataactgagagtgaagacaacgaagaagatgacatggttgatgttatctggcgtcagttgatatcaagctgcccatggctttcagaacttgatgaaagtgcaactgaaggagttattaaagtgtggaggaaagttgtagatagaatattcagcctgtacaaactctcttgcagtgcatactttactttccttaaactcaacgctggtcaaattcctttagatgaggatgaccctaggctgcatttaagtcacagagtggaacagagcactgatgacatgattgtgatggccacattgcgcctgctgcggttgctcgtgaagcacgctggtgagcttcggcagtatctggagcacggcttggagacaacacccactgcaccatggagaggaattattccgcaacttttctcacgcttaaaccaccctgaagtgtatgtgcgccaaagtatttgtaaccttctctgccgtgtggctcaagattccccacatctcatattgtatcctgcaatagtgggtaccatatcgcttagtagtgaatcccaggcttcaggaaataaattttccactgcaattccaactttacttggcaatattcaaggagaagaattgctggtttctgaatgtgagggaggaagtcctcctgcatctcaggatagcaataaggatgaacctaaaagtggattaaatgaagaccaagccatgatgcaggattgttacagcaaaattgtagataagctgtcctctgcaaaccccaccatggtattacaggttcagatgctcgtggctgaactgcgcagggtcactgtgctctgggatgagctctggctgggagttttgctgcaacaacacatgtatgtcctgagacgaattcagcagcttgaagatgaggtgaagagagtccagaacaacaacaccttacgcaaagaagagaaaattgcaatcatgagggagaagcacacagctttgatgaagcccatcgtatttgctttggagcatgtgaggagtatcacagcggctcctgcagaaacacctcatgaaaaatggtttcaggataactatggtgatgccattgaaaatgccctagaaaaactgaagactccattgaaccctgcaaagcctgggagcagctggattccatttaaagagataatgctaagtttgcaacagagagcacagaaacgtgcaagttacatcttgcgtcttgaagaaatcagtccatggttggctgccatgactaacactgaaattgctcttcctggggaagtctcagccagagacactgtcacaatccatagtgtgggcggaaccatcacaatcttaccgactaaaaccaagccaaagaaacttctctttcttggatcagatgggaagagctatccttatcttttcaaaggactggaggatttacatctggatgagagaataatgcagttcctatctattgtgaataccatgtttgctacaattaatcgccaagaaacaccccggttccatgctcgacactattctgtaacaccactaggaacaagatcaggactaatccagtgggtagatggagccacacccttatttggtctttacaaacgatggcaacaacgggaagctgccttacaagcacaaaaggcccaagattcctaccaaactcctcagaatcctggaattgtaccccgtcctagtgaactttattacagtaaaattggccctgctttgaaaacagttgggcttagcctggatgtgtcccgtcgggattggcctcttcatgtaatgaaggcagtattggaagagttaatggaggccacacccccgaatctccttgccaaagagctctggtcatcttgcacaacacctgatgaatggtggagagttacgcagtcttatgcaagatctactgcagtcatgtctatggttggatacataattggccttggagacagacatctggataatgttcttatagatatgacgactggagaagttgttcacatagattacaatgtttgctttgaaaaaggtaaaagccttagagttcctgagaaagtaccttttcgaatgacacaaaacattgaaacagcactgggtgtaactggagtagaaggtgtatttaggctttcatgtgagcaggttttacacattatgcggcgtggcagagagaccctgctgacgctgctggaggcctttgtgtacgaccctctggtggactggacagcaggaggcgaggctgggtttgctggtgctgtctatggtggaggtggccagcaggccgagagcaagcagagcaagagagagatggagcgagagatcacccgcagcctgttttcttctagagtagctgagattaaggtgaactggtttaagaatagagatgagatgctggttgtgcttcccaagttggacggtagcttagatgaatacctaagcttgcaagagcaactgacagatgtggaaaaactgcagggcaaactactggaggaaatagagtttctagaaggagctgaaggggtggatcatccttctcatactctgcaacacaggtattctgagcacacccaactacagactcagcaaagagctgttcaggaagcaatccaggtgaagctgaatgaatttgaacaatggataacacattatcaggctgcattcaataatttagaagcaacacagcttgcaagcttgcttcaagagataagcacacaaatggaccttggtcctccaagttacgtgccagcaacagcctttctgcagaatgctggtcaggcccacttgattagccagtgcgagcagctggagggggaggttggtgctctcctgcagcagaggcgctccgtgctccgtggctgtctggagcaactgcatcactatgcaaccgtggccctgcagtatccgaaggccatatttcagaaacatcgaattgaacagtggaagacctggatggaagagctcatctgtaacaccacagtagagcgttgtcaagagctctataggaaatatgaaatgcaatatgctccccagccacccccaacagtgtgtcagttcatcactgccactgaaatgaccctgcagcgatacgcagcagacatcaacagcagacttattagacaagtggaacgcttgaaacaggaagctgtcactgtgccagtttgtgaagatcagttgaaagaaattgaacgttgcattaaagttttccttcatgagaatggagaagaaggatctttgagtctagcaagtgttattatttctgccctttgtacccttacaaggcgtaacctgatgatggaaggtgcagcgtcaagtgctggagaacagctggttgatctgacttctcgggatggagcctggttcttggaggaactctgcagtatgagcggaaacgtcacctgcttggttcagttactgaagcagtgccacctggtgccacaggacttagatatcccgaaccccatggaagcgtctgagacagttcacttagccaatggagtgtatacctcacttcaggaattgaattcgaatttccggcaaatcatatttccagaagcacttcgatgtttaatgaaaggggaatacacgttagaaagtatgctgcatgaactggacggtcttattgagcagaccaccgatggcgttcccctgcagactctagtggaatctcttcaggcctacttaagaaacgcagctatgggactggaagaagaaacacatgctcattacatcgatgttgccagactactacatgctcagtacggtgaattaatccaaccgagaaatggttcagttgatgaaacacccaaaatgtcagctggccagatgcttttggtagcattcgatggcatgtttgctcaagttgaaactgctttcagcttattagttgaaaagttgaacaagatggaaattcccatagcttggcgaaagattgacatcataagggaagccaggagtactcaagttaatttttttgatgatgataatcaccggcaggtgctagaagagattttctttctaaaaagactacagactattaaggagttcttcaggctctgtggtaccttttctaaaacattgtcaggatcaagttcacttgaagatcagaatactgtgaatgggcctgtacagattgtcaatgtgaaaaccctttttagaaactcttgtttcagtgaagaccaaatggccaaacctatcaaggcattcacagctgactttgtgaggcagctcttgatagggctacccaaccaagccctcggactcacactgtgcagttttatcagtgctctgggtgtagacatcattgctcaagtagaggcaaaggactttggtgccgaaagcaaagtttctgttgatgatctctgtaagaaagcggtggaacataacatccagatagggaagttctctcagctggttatgaacagggcaactgtgttagcaagttcttacgacactgcctggaagaagcatgacttggtgcgaaggctagaaaccagtatttcttcttgtaagacaagcctgcagcgggttcagctgcatattgccatgtttcagtggcaacatgaagatctacttatcaatagaccacaagccatgtcagtcacacctcccccacggtctgctatcctaaccagcatgaaaaagaagctgcataccctgagccagattgaaacttctattgcgacagttcaggagaagctagctgcacttgaatcaagtattgaacagcgactcaagtgggcaggtggtgccaaccctgcattggcccctgtactacaagattttgaagcaacgatagctgaaagaagaaatcttgtccttaaagagagccaaagagcaagtcaggtcacatttctctgcagcaatatcattcattttgaaagtttacgaacaagaactgcagaagccttaaacctggatgcggcgttatttgaactaatcaagcgatgtcagcagatgtgttcgtttgcatcacagtttaacagttcagtgtctgagttagagcttcgtttattacagagagtggacactggtcttgaacatcctattggcagctctgaatggcttttgtcagcacacaaacagttgacccaggatatgtctactcagagggcaattcagacagagaaagagcagcagatagaaacggtctgtgaaacaattcagaatctggttgataatataaagactgtgctcactggtcataaccgacagcttggagatgtcaaacatctcttgaaagctatggctaaggatgaagaagctgctctggcagatggtgaagatgttccctatgagaacagtgttaggcagtttttgggtgaatataaatcatggcaagacaacattcaaacagttctatttacattagtccaggctatgggtcaggttcgaagtcaagaacacgttgaaatgctccaggaaatcactcccaccttgaaagaactgaaaacacaaagtcagagtatctataataatttagtgagttttgcatcacccttagtcaccgatgcaacaaatgaatgttcgagtccaacgtcatctgctacttatcagccatccttcgctgcagcagtccggagtaacactggccagaagactcagcctgatgtcatgtcacagaatgctagaaagctgatccagaaaaatcttgctacatcagctgatactccaccaagcaccgttccaggaactggcaagagtgttgcttgtagtcctaaaaaggcagtcagagaccctaaaactgggaaagcggtgcaagagagaaactcctatgcagtgagtgtgtggaagagagtgaaagccaagttagagggccgagatgttgatccgaataggaggatgtcagttgctgaacaggtgaccgtgttttaaacttgggctacacattttaatgctgctggaaaagtagaggtgtataaagatccctctcatcgatttccttaatagttcatcaaggaacttaaatgtgttttcaggattcagaagattttgagtaacacagctctggcgtcgtcaagtagtcaccattttactctgacccttccctatgagcactttcctttcccctagccctgttttaacccaaatataagtccgatcctcctccaccagactacagttagtttccatttaaagaagactgttgaaggtttcaaatgaaatgccaaggaccctttgggttgcaggtgtagtatgagtggagcatccctaattagaaactcatatgctccaaatccgaagcattttgagagttgacatgatgccataagtgaaaagttccatgcctgacctggtg

SEQ ID NO: 34694 - DNA, 6854 bp, Homo sapiens
catgaggcttttaagaatcatgtgttcaatgtagacaatgcaaaatttgtagttaaatttgacctcaattgactacaaaatttgtagttaaatttgactacaattggaaatgccaaaaactcactaatagggatgtgggcgctatctccaactgtctttgcacttctgagtaagaatctgatgattgtgcacagtgacctggctgttcacttccctgccattcagtatgctgtgctctacacattgtattctcattgtaccaggcatgatcactttatctctagtagcctcagttcttcctctccttctttgtttgatggagctgtgattagcactgtaactacggctacaaagaaacatttctcaattatattaaatcttctgggaatattacttaagaaagataaccttaaccaggacacgaggaaactgttaatgacttgggctttggaagcagctgttttaatgaagaagtctgaaacatacgcacctttattctctcttccgtctttccataaattttgcaaaggccttttagccaacactctcgttgaagatgtgaatatctgtctgcaggcatgcagcagtctacatgctctgtcctcttccttgccagatgatcttttacagagatgtgtcgatgtttgccgtgttcaactagtgcacagtggaactcgtattcgacaagcatttggaaaactgttgaaatcaattcctttagatgttgtcctaagcaataacaatcacacagaaattcaagaaatttctttagcattaagaagtcacatgagtaaagcaccaagtaatacattccacccccaagatttctctgatgttattagttttattttgtatgggaactctcatagaacagggaaggacaattggttggaaagactgttctatagctgccagagactggataagcgtgaccagtcaacaattccacgcaatctcctgaagacagatgctgtcctttggcagtgggccatatgggaagctgcacaattcactgttctttctaagctgagaaccccactgggcagagctcaagacaccttccagacaattgaaggtatcattcgaagtctcgcagctcacacattaaaccctgatcaggatgttagtcagtggacaactgcagacaatgatgaaggccatggtaacaaccaacttagacttgttcttcttctgcagtatctggaaaatctggagaaattaatgtataatgcatacgagggatgtgctaatgcattaacttcacctcccaaggtcattagaacttttttctataccaatcgccaaacttgtcaggactggctaacgcggattcgactctccatcatgagggtaggattgttggcaggccagcctgcagtgacagtgagacatggctttgacttgcttacagagatgaaaacaaccagcctatctcaggggaatgaattggaagtaaccattatgatggtggtagaagcattatgtgaacttcattgtcctgaagctatacagggaattgctgtctggtcatcatctattgttggaaaaaatcttctgtggattaactcagtggctcaacaggctgaagggaggtttgaaaaggcctctgtggagtaccaggaacacctgtgtgccatgacaggtgttgattgctgcatctccagctttgacaaatcggtgctcaccttagccaatgctgggcgtaacagtgccagcccgaaacattctctgaatggtgaatccagaaaaactgtgctgtccaaaccgactgactcttcccctgaggttataaattatttaggaaataaagcatgtgagtgctacatctcaattgccgattgggctgctgtgcaggaatggcagaacgctatccatgacttgaaaaagagtaccagtagcacttccctcaacctgaaagctgacttcaactatataaaatcattaagcagctttgagtctggaaaatttgttgaatgtaccgagcagttagaattgttaccaggagaaaatatcaatctacttgctggaggatcaaaagaaaaaatagacatgaaaaaactgcttcctaacatgttaagtccggatccgagggaacttcagaaatccattgaagttcaattgttaagaagttctgtttgtttggcaactgctttaaacccgatagaacaagatcagaagtggcagtctataactgaaaatgtggtaaagtacttgaagcaaacatcccgcatcgctattggacctctgagactttctactttaacagtttcacagtctttgccagttctaagtaccttgcagctgtattgctcatctgctttggagaacacagtttctaacagactttcaacagaggactgtcttattccactcttcagtgaagctttacgttcatgtaaacagcatgacgtgaggccatggatgcaggcattaaggtatactatgtaccagaatcagttgttggagaaaattaaagaacaaacagtcccaattagaagccatctcatggaattaggtctaacagcagcaaaatttgctagaaaacgagggaatgtgtcccttgcaacaagactgctggcacagtgcagtgaagttcagctgggaaagaccaccactgcacaggatttagtccaacattttaaaaaactatcaacccaaggtcaagtggatgaaaaatgggggcccgaacttgatattgaaaaaaccaaattgctttatacagcaggccagtcaacacatgcaatggaaatgttgagttcttgtgccatatctttctgcaagtctgtgaaagctgaatatgcagttgctaaatcaattctgacactggctaaatggatccaggcagaatggaaagagatttcaggacagctgaaacaggtttacagagctcagcaccaacagaacttcacaggtctttctactttgtctaaaaacatactcactctaatagaactgccatctgttaatacgatggaagaagagtatcctcggatcgagagtgaatctacagtgcatattggagttggagaacctgacttcattttgggacagttgtatcacctgtcttcagtacaggcacctgaagtagccaaatcttgggcagcgttggccagctgggcttataggtggggcagaaaggtggttgacaatgccagtcagggagaaggtgttcgtctgctgcctagagaaaaatctgaagttcagaatctacttccagacactataactgaggaagagaaagagagaatatatggtattcttggacaggctgtgtgtcggccggcggggattcaggatgaagatataacacttcagataactgagagtgaagacaacgaagaagatgacatggttgatgttatctggcgtcagttgatatcaagctgcccatggctttcagaacttgatgaaagtgcaactgaaggagttattaaagtgtggaggaaagttgtagatagaatattcagcctgtacaaactctcttgcagtgcatactttactttccttaaactcaacgctggtcaaattcctttagatgaggatgaccctaggctgcatttaagtcacagagtggaacagagcactgatgacatgattgtgatggccacattgcgcctgctgcggttgctcgtgaagcacgctggtgagcttcggcagtatctggagcacggcttggagacaacacccactgcaccatggagaggaattattccgcaacttttctcacgcttaaaccaccctgaagtgtatgtgcgccaaagtatttgtaaccttctctgccgtgtggctcaagattccccacatctcatattgtatcctgcaatagtgggtaccatatcgcttagtagtgaatcccaggcttcaggaaataaattttccactgcaattccaactttacttggcaatattcaaggagaagaattgctggtttctgaatgtgagggaggaagtcctcctgcatctcaggatagcaataaggatgaacctaaaagtggattaaatgaagaccaagccatgatgcaggattgttacagcaaaattgtagataagctgtcctctgcaaaccccaccatggtattacaggttcagatgctcgtggctgaactgcgcagggtcactgtgctctgggatgagctctggctgggagttttgctgcaacaacacatgtatgtcctgagacgaattcagcagcttgaagatgaggtgaagagagtccagaacaacaacaccttacgcaaagaagagaaaattgcaatcatgagggagaagcacacagctttgatgaagcccatcgtatttgctttggagcatgtgaggagtatcacagcggctcctgcagaaacacctcatgaaaaatggtttcaggataactatggtgatgccattgaaaatgccctagaaaaactgaagactccattgaaccctgcaaagcctgggagcagctggattccatttaaagagataatgctaagtttgcaacagagagcacagaaacgtgcaagttacatcttgcgtcttgaagaaatcagtccatggttggctgccatgactaacactgaaattgctcttcctggggaagtctcagccagagacactgtcacaatccatagtgtgggcggaaccatcacaatcttaccgactaaaaccaagccaaagaaacttctctttcttggatcagatgggaagagctatccttatcttttcaaaggactggaggatttacatctggatgagagaataatgcagttcctatctattgtgaataccatgtttgctacaattaatcgccaagaaacaccccggttccatgctcgacactattctgtaacaccactaggaacaagatcaggactaatccagtgggtagatggagccacacccttatttggtctttacaaacgatggcaacaacgggaagctgccttacaagcacaaaaggcccaagattcctaccaaactcctcagaatcctggaattgtaccccgtcctagtgaactttattacagtaaaattggccctgctttgaaaacagttgggcttagcctggatgtgtcccgtcgggattggcctcttcatgtaatgaaggcagtattggaagagttaatggaggccacacccccgaatctccttgccaaagagctctggtcatcttgcacaacacctgatgaatggtggagagttacgcagtcttatgcaagatctactgcagtcatgtctatggttggatacataattggccttggagacagacatctggataatgttcttatagatatgacgactggagaagttgttcacatagattacaatgtttgctttgaaaaaggtaaaagccttagagttcctgagaaagtaccttttcgaatgacacaaaacattgaaacagcactgggtgtaactggagtagaaggtgtatttaggctttcatgtgagcaggttttacacattatgcggcgtggcagagagaccctgctgacgctgctggaggcctttgtgtacgaccctctggtggactggacagcaggaggcgaggctgggtttgctggtgctgtctatggtggaggtggccagcaggccgagagcaagcagagcaagagagagatggagcgagagatcacccgcagcctgttttcttctagagtagctgagattaaggtgaactggtttaagaatagagatgagatgctggttgtgcttcccaagttggacggtagcttagatgaatacctaagcttgcaagagcaactgacagatgtggaaaaactgcagggcaaactactggaggaaatagagtttctagaaggagctgaaggggtggatcatccttctcatactctgcaacacaggtattctgagcacacccaactacagactcagcaaagagctgttcaggaagcaatccaggtgaagctgaatgaatttgaacaatggataacacattatcaggctgcattcaataatttagaagcaacacagcttgcaagcttgcttcaagagataagcacacaaatggaccttggtcctccaagttacgtgccagcaacagcctttctgcagaatgctggtcaggcccacttgattagccagtgcgagcagctggagggggaggttggtgctctcctgcagcagaggcgctccgtgctccgtggctgtctggagcaactgcatcactatgcaaccgtggccctgcagtatccgaaggccatatttcagaaacatcgaattgaacagtggaagacctggatggaagagctcatctgtaacaccacagtagagcgttgtcaagagctctataggaaatatgaaatgcaatatgctccccagccacccccaacagtgtgtcagttcatcactgccactgaaatgaccctgcagcgatacgcagcagacatcaacagcagacttattagacaagtggaacgcttgaaacaggaagctgtcactgtgccagtttgtgaagatcagttgaaagaaattgaacgttgcattaaagttttccttcatgagaatggagaagaaggatctttgagtctagcaagtgttattatttctgccctttgtacccttacaaggcgtaacctgatgatggaaggtgcagcgtcaagtgctggagaacagctggttgatctgacttctcgggatggagcctggttcttggaggaactctgcagtatgagcggaaacgtcacctgcttggttcagttactgaagcagtgccccactgatagcagggactggacctatacccatgatagagggatcacatccagatacataagtagcccacattcttgccgtggtgtgaagttatgtttcttgacagcatcttcactagctatgattacgctcctccc

SEQ ID NO: 34695 - DNA, 1806 bp, Homo sapiens
aggaaatgaggctgaactttgtagtgccctcgctaaccttcagaccagtaaaccagatgctgtagagcagacatgtatattggaatctacagaaattgctttgcttaacaacatcccatatcatgaaggctttaaaatggcaatgagcaaagttttgtcttcactgactccagagaaactgtatcagaccatggatactcactgtcagaatgagatgagctctggaactggacagagtaatactgtacagaacatccttgaacctttctacgtgttagatgtgtccgaaggcttctctgttctgcctgttattgctggcacacttgggcaggttaaaccatacagttctgtggagaaagaccagcatcgtattgctctggacctcatatctgaagccaatcactttcctaaagaaacacttgagttttggctgagacatgtggaggatgaatctgctatgttacaaaggccaaaatcagacaagttatggagcataattatattggatgtcattgagccatctgggctcattcagcaggaaataatggaaaaagctgcaatatccaggtgtttactacaatctggaggcaagatctttcctcagtatgtgctgatgtttgggttgcttgtggaatcacagacactcctagaggagaatgctgttcaaggaacagaacgtactcttggattaaatatagcaccttttattaaccagtttcaggtacctatacgtgtatttttggacctatcctcattgccctgtatacctttaagcaagccagtggaactcttaagactagatttaatgactccgtatttgaacacctctaacagagaagtaaaggtatacgtttgtaaatctggaagactgactgctattccattttggtatcatatgtaccttgatgaagagattaggttggatacttcaagtgaagcctcccactggaaacaagctgcagttgttttagataatcccatccaggttgaaatgggagaggaacttgtactcagcattcagcatcacaaaagcaatgtcagcatcacagtaaagcaatgaagagcagttttccaatgaaaactgtgtaaatagagcatcaacaagtacaaaattcttgtcttaattagtgggggtatataaaaattccttgtaatggtcaaatattttttaaaattgacattaataaagcatattttaaaagattctaaaaaaaagggtagcattattatagaaatactgctgcagatttgctttctggaaaaggatacatcactagttttttaaattaggaaacttcttttgctcgattttacagaatagggattttaaaagtcttatcgttattgacatgtgtaagtaaagcaaaactttacttttgtaggcatcttggccttttttcttaaatccaaacttgtaattgggaaacactgaaaggcttccactgaagactgagggttatggttacctgtaaattccaatcttgcttcctttaaatactcagtgtacatctgaaacatctcaggttttgttttgagaatgcaagcttgaaaaagaatttaagctataagctaaatgtaattaaaacagtaaaggagttagggaataaatcttcaggaggcagcatttttcttggtctactttggcaaaagaacatttaaaagctggtaacaaaacaaagttaaattgaaggaagacttaatcctatactatttttcaaagttttgatttggatgtacaataagtacattaattgatccaatttttacaaacttttgaaataaaggaagatcattattatgcctcct

SEQ ID NO: 34696 - DNA, 1474 bp, Homo sapiens
aggaaatgaggctgaactttgtagtgccctcgctaaccttcagaccagtaaaccagatgctgtagagcagacatgtatattggaatctacagaaattgctttgcttaacaacatcccatatcatgaaggctttaaaatggcaatgagcaaagttttgtcttcactgactccagagaaactgtatcagaccatggatactcactgtcagaatgagatgagctctggaactggacagagtaatactgtacagaacatccttgaacctttctacgtgttagatgtgtccgaaggcttctctgttctgcctgttattgctggcacacttgggcaggttaaaccatacagttctgtggagaaagaccagcatcgtattgctctggacctcatatctgaagccaatcactttcctaaagaaacacttgagttttggctgagacatgtggaggatgaatctgctatgttacaaaggccaaaatcagacaagttatggagcataattatattggatgtcattgagccatctgggctcattcagcaggaaataatggaaaaagctgcaatatccaggtgtttactacaatctggaggcaagatctttcctcagtatgtgctgatgtttgggttgcttgtggaatcacagacactcctagaggagaatgctgttcaaggaacagaacgtactcttggattaaatatagcaccttttattaaccagtttcaggtacctatacgtgtatttttggacctatcctcattgccctgtatacctttaagcaagccagtggaactcttaagactagatttaatgactccgtatttgaacacctctaacagagaagtaaaggtatacgtttgtaaatctggaagactgactgctattccattttggtatcatatgtaccttgatgaagagattaggttggatacttcaagtgaagcctcccactggaaacaagctgcagttgttttagataatcccatccaggttgaaatgggagaggaacttgtactcagcattcagcatcacaaaagcaatgtcagcatcacagtaaagcaatgaagagcagttttccaatgaaaactgtgtaaatagagcatcaacaagtacaaaattcttgtcttaattagtgggggtatataaaaattccttgtaatggtcaaatattttttaaaattgacattaataaagcatattttaaaagattctaaaaaaaagaaaattggtctcttgggctaagcggtggagctttgcggcgtttccttaaggagggtaatcatgatctcgcttattgctcgttgcgttcggcgtcggttggggaagcggttaacttattcaagcgggaattcggttatcccaatcaggggtacgcaggaaaacttgtgacaaaggccgcaaagccggaaccgaaaggccggtggtgggttttctatggtccgcccctcaaattacaaaatcacttcaagaagggctacc

SEQ ID NO: 34697 - DNA, 959 bp, Homo sapiens
atactaaatatttttatcactgtataatgttcataataaagatctaattctagtgtttactacaatctggaggcaagatctttcctcagtatgtgctgatgtttgggttgcttgtggaatcacagacactcctagaggagaatgctgttcaaggaacagaacgtactcttggattaaatatagcaccttttattaaccagtttcaggtacctatacgtgtatttttggacctatcctcattgccctgtatacctttaagcaagccagtggaactcttaagactagatttaatgactccgtatttgaacacctctaacagagaagtaaaggtatacgtttgtaaatctggaagactgactgctattccattttggtatcatatgtaccttgatgaagagattaggttggatacttcaagtgaagcctcccactggaaacaagctgcagttgttttagataatcccatccaggttgaaatgggagaggaacttgtactcagcattcagcatcacaaaagcaatgtcagcatcacagtaaagcaatgaagagcagttttccaatgaaaactgtgtaaatagagcatcaacaagtacaaaattcttgtcttaattagtgggggtatataaaaattccttgtaatggtcaaatattttttaaaattgacattaataaagcatattttaaaagattctaaaaaaaagaaaattggtctcttgggctaagcggtggagctttgcggcgtttccttaaggagggtaatcatgatctcgcttattgctcgttgcgttcggcgtcggttggggaagcggttaacttattcaagcgggaattcggttatcccaatcaggggtacgcaggaaaacttgtgacaaaggccgcaaagccggaaccgaaaggccggtggtgggttttctatggtccgcccctcaaattacaaaatcacttcaagaagggctacc

SEQ ID NO: 34698 - DNA, 953 bp, Homo sapiens
gcggccgcctactactactactgcctactactactaaattcgcggccgcttgatgaagagattaggttggatacttcaagtgaagcctcccactggaaacaagctgcagttgttttagataatcccatccaggttgaaatgggagaggaacttgtactcagcattcagcatcacaaaagcaatgtcagcatcacagtaaagcaatgaagagcagttttccaatgaaaactgtgtaaatagagcatcaacaagtacaaaattcttgtcttaattagtgggggtatataaaaattccttgtaatggtcaaatattttttaaaattgacattaataaagcatattttaaaagattctaaaaaaaagggtagcattattatagaaatactgctgcagatttgctttctggaaaaggatacatcactagttttttaaattaggaaacttcttttgctcgattttacagaatagggattttaaaagtcttatcgttattgacatgtgtaagtaaagcaaaactttacttttgtaggcatcttggccttttttcttaaatccaaacttgtaattgggaaacactgaaaggcttccactgaagactgagggttatggttacctgtaaattccaatcttgcttcctttaaatactcagtgtacatctgaaacatctcaggttttgttttgagaatgcaagcttgaaaaagaatttaagctataagctaaatgtaattaaaacagtaaaggagttagggaataaatcttcaggaggcagcatttttcttggtctactttggcaaaagaacatttaaaagctggtaacaaaacaaagttaaattgaaggaagacttaatcctatactatttttcaaagttttgatttggatgtacaataagtacattaattgatccaatttttacaaacttttgaaataaaggaagatcattattatgcctcct

SEQ ID NO: 34699 - DNA, 320 bp, Homo sapiens
cacagacactcctagaggagaatgctgttcaaggaacagaacgtactcttggattaaatatagcaccttttattaaccagtttcaggtaagtgtctagaggagaagttcaaccaggatgctgttgaacagtctaccatcgctctctctttagtcactgtttaatctagctaaacacagtgactaaagtttagctggattaatcacagtgacttagatttttacctataataagttcctagaacaaaggaacttattataggtaaaaatcaacctagaggttacaataaccaaggaattttgtcatgactgctgataaaag

SEQ ID NO: 34700 - DNA, 429 bp, Homo sapiens
tattttgtgatcttctgacttctttgtaccttagaggccaggagatgataggactttattatcttctgacaaggtaaatcttattcatggaaaatctggacagtctattttatactatccagttgtatacaaatgggtaaagttatgtattcaccaaatcaaattttttttactacttgtctatatttctattacacgcaatttatatttttacactgaaattacattgagtaatatttaaaaaattaaatttgaatgctgaataaatgagtattttaccaaataattgtattaaagatagatgttgctaagttggaaagtgacatttaaaggtttcagccaggtgcagtggctcacacctgtaacatcaccactttgggaagccgaggcaggtggactccttgagctcaggagtttgagaccagcctg

SEQ ID NO: 34701 - DNA, 387 bp, Homo sapiens
gtgcatgcctgtagtcccagctactcaggaggctgaggtggaaggatcacttgagccccaggcatctaggagtttgaggctgcagtgagctatgatcttgccattgtagagtttgaggctgcagtgagctatgatcttgccattgtaccacggcctgggcaacactgacaccccatctcttaaaaaaaaaaaaaattaactccttaggggctctttcccccagatgttaaattctcaattcctatagaatatatcttaattgaaaatgttacaccaatgctgaatgatgcaccactgttttataacttatcttaagaagactggatgtggtggctcactcctgtaatcccaactcctcaagaggttgaggtgagaggatcactggag

SEQ ID NO: 34702 - DNA, 848 bp, Homo sapiens
gctccccaggttgcacttcgtaattctcactatccatggccttgttgataactgaggatctgatactggcttcctgatgtttcttttttttttggagacagagtctcgatctgttgcccgggctggagtgcaatggcaagatcaatctcagctcagtgcaaccttcacctcccgggttcaagcaatcctcctgcctcagactcccaagttgctgggattacagaaaaacctacatcacaaaggagaggtaacacgaccaaatcattaacagggaagcgaaagcaactgcaccaggaacctggagtcttatcaggagaataaatatgtatgtgaaatctcatactggattttcctgttcctttcctataaaagacgtggtttccgatgttgacctggggcaaaatcaaagctcacctgggctaagtcagcacacagttcctaatccttaggtaaaaagatacacttgtgaacagtaacgctcagtcaagctcacagcctctccacatcatcagggagttaacgtgcaatttataagcaggctaggatgcttgaagaatcccattccattcactaaaaacccagggatctcattcccaccctaagtgcagggcaagccctcggtattgtttcagttaacattcctgggcctcagtttcctcgtctgaaaaaggaagggactttggaatgggaaatctctacgatccctctcatgattcagataggctatttttcttttccaccaatagaggaagagactttctgacagccaacatttccattcctactattttggaacaaccagaacactgaaaatttggtacgaaaagcttttcttacgataaagagat

SEQ ID NO: 34703 - DNA, 758 bp, Homo sapiens
attcactcagaaaaaaaaataaccaacaaagagttatatgttaaacagcaaaaagaaaataatacagactagagccaaatatttattgactgagtaaggaagatgatttagaccattatttacatcatttcagaaaaacctacatcacaaaggagaggtaacacgaccaaatcattaacagggaagcgaaagcaactgcaccaggaacctggagtcttatcaggagaataaatatgtatgtgaaatctcatactggattttcctgttcctttcctataaaagacgtggtttccgatgttgacctggggcaaaatcaaagctcacctgggctaagtcagcacacagttcctaatccttaggtaaaaagatacacttgtgaacagtaacgctcagtcaagctcacagcctctccacatcatcagggagttaacgtgcaatttataagcaggctaggatgcttgaagaatcccattccattcactaaaaacccagggatctcattcccaccctaagtgcagggcaagccctcggtattgtttcagttaacattcctgggcctcagtttcctcgtctgaaaaaggaagggactttggaatgggaaatctctacgatccctctcatgattcagataggctatttttcttttccaccaatagaggaagagactttctgacagccaacatttccattcctactattttggaacaaccagaacactgaaaatttggtacgaaaagcttttcttacgataaagagat

SEQ ID NO: 34704 - DNA, 396 bp, Homo sapiens
tttttgagacagtgtcttactttgtcacccaggctgaagtgcagtggcacgatctcagttcactgcagcctcgacctcctgggttcaagtgatcctcccacctcagccccaagcggtcatacaccaccacacccaactaattttttgtatttgtggttgggggggaaccctcagacgaggttttgccatgttgcccaggcagatctcaaactcatgagctcaagcaatccacccacctcagccacccaaaacaaaggtcattcttaatgtgctatcagctgacgacaccatcaggtactctttgaattttgctgcaagcagggaactggaaatacctccctggccccaggatgacaatgactggccactgtacttgaccaccaggagggttttatg

SEQ ID NO: 34705 - DNA, 1160 bp, Homo sapiens
gagtcttttaaatcaagtactgattaactattaagtacaactttgagattttagttttaactcttcagaagccagtgtgaaatagaattggttattctcaaagactcaggataaactaaataagctatatatagagtacatttaaaatgtacaacacaaattggaaataaaataagttacaagataagtttacagggatatattgcttacaatttttaaaaggcagtttgttttttatgtgaatatgtttcttagtgaaattttacattcctttgttttggaagattggcgatatttgaagagttaaaaatagtacagaaatgtgaagtttggtatctctaaatgtgttgtacttgactttcttttttattttgtttttttttttttttgactacttagaattttcacaattctaataagattgtttccaagtctctcatgtgcaagctttaaaggatgcactcttgccattttatgtactggaagatcattggtcagatgaatactgtgtctgacaaaaatgtaaactgtataaactgaggaacctcagctaatcagtattactttgtagatcaccatgcccaccacatttcaaactcaaactatctgtagatttcaaaatccattgtgtttgagtttgtttgcagttccctcagcttgctggtaattgtggtgttttgttttttgttttgttttcaatgcaaatgtgatgtaatattcttattttctttggatcaaagctggactggaaattgtatcgtgtaattatttttgtgttcttaatgttatttggtactcaagttgtaaataacgtctactactgtttattccagtttctactacctcaggtgtcctatagatttttcttctaccaaagttcactttcacaatgaaattatatttgctgtgtgactatgattcctaagatttccagggcttaagggctaacttctattagcaccttactgtgtaagcaaatgttacaaaaaaaaaaaaaaaaaatctctgggttaagaaaatttggcttaaatgtatcctttgttattttaaatatattgagatattttaattaaaatttttaccccattgaaccgattttatagtatttgtacctattttggtgtttttgtctttatagtaaataaaagtttttgaacaaa

SEQ ID NO: 34706 - DNA, 931 bp, Homo sapiens
aaactccatctcaaaaataaataaataaataaatattagattaaataaacattaaattaaatgcactaaatattagatttttgaaaaatcttttgtgatgtcttagtccatcacggctgctataacaaatcccaccatagactaggttgtctataagcaacggccctttatctctcacagttcttgggggtttggttttaatgcatgaatttagctgggaaacaaactttcagaccatagcagatgccttgtgatcttcatgacaccttgaggccacattttgggatttttcccccactgtgaacacgcaatcctgaaatgacccaaagcagcgataaatatgatttggtttatatacaactttatagtaacatcttcactggaaaatgaaggatagttcaatggtctttttcctcttcagtgaatagtatggctggccaacatggcaaaaccccatctctgcaaaaaatacaaaaattagctgggcatggtggcatgcgcctgtaaatcccagctactcgggaggctgaggcaggagatttgcttgaatccaggaggtggaggttgcagtgagctgagatcacacaactgcactccagtctgggtgacagagtgagactccatctcaaaaaaaaaaaaaacccaaaaaactatatatatatatatacatgaatgtatccatcaaacagtggtcattgcacgtggctttttcagaacttatggttccttcatgtaacgtgagatatagtataggacacagtatatgcaggagaagacaagttctaccattgtacgtgagctagaaatgatcatctcaacaagaatttcaggctctttgatgcaagaatgtatggtgtctttctggtgttccttggccacttctgtctttgatgaatcattttgatactggattgggattcactgttaattt

SEQ ID NO: 34707 - DNA, 140 bp, Homo sapiens
caacaaacaacagcgaagaatttattgcatgaatttgggcacagagatagatatggaagcaatctttcttcactgtggcttttctggcaaaccagctttctaggcaagggaagtgggagaacccctggtttctagcattg

SEQ ID NO: 34708 - DNA, 338 bp, Homo sapiens
ccagcaaagtctcttttgaccacacgctttatccgagatgcttagaagtatatttggctgttttatttgcatctttgattaagatgtctatcattgtaaaaaggtattcaaaacaaaagtgtactcttttattattatgaatcacattgtactgagctgtgaagtcagtgttttaaaaatgtagagtttattcatggagcatgccattgaggtttggatggtggcaggtaaaacagaaaggcaagatgtcatctgacattaggctacttataaataaatgtttatctagcttttatttcatgccctaatgaataaaacatgcttggaaaaagaaagta

SEQ ID NO: 34709 - DNA, 739 bp, Homo sapiens
agcggaggaaggggctcccacagtgcagtgggggggctgaagggctcctcaaatgccaccaaagtgggagcccaggcaggggaggtgccgagagcaagcgagggctctgaggactgccagcatgctgtcacctctcagcaggctggattggatttggcacttctttactgaaggctggagtgcaatggtgcgatctcagctcatcaagttcaagagactctaatgcctcagcctcccaagtagcaggggttacagattctttaatctccagctcagcttcaacaattcaacgctgttctttctgaaaaagtacacatcgtgccttctctacttcgctcttggaacataatttctcatggcaggtatgtgtgatttcagtcactaaattaaaaataaccagaaaagctatttcttggattggctgattttggggtaatgctttaagagaaaaggacatgattaacagtggatgtttttaggattttcatgcattagcactttccacattcattatattttcctgattcttcattgtataacttagacatgatttcatgaagttttttccacaggtttgaagagtggtttctgacagggctacctttaaattctgagtgagaactgaactttagcctggttaaattgtgagcaacagtgttctagtatagcaatagaaaatgccaaatattaatgacacaatgctgaaaaggttttaattgactatttatgttgtgacatc

SEQ ID NO: 34710 - DNA, 548 bp, Homo sapiens
ctgtattgtggttcctggaacactttagaggcttgtgattctactgcttcttattcacactataatacatgtctcaccaatagatgattcaagaacatcatttaaatacacaatttttcattctctatttttgctaaatttcttcatactcaactttcagattctttaatctccagctcagcttcaacaattcaacgctgttctttctgaaaaagtacacatcgtgccttctctacttcgctcttggaacataatttctcatggcagcttttactaaactgagtattgagccagcatttactccaggacccaacatagaactccagaaagactctgactgctgttcttgccaagaaaaatgggttgggtaccggtgcaactgttacttcatttccagtgaacagaaaacttggaacgaaagtcggcatctctgtgcttctcagaaatccagcctgcttcagcttcaaaacacagatgaactggcatgtgctgagtctgattttctacattttctttgatctagaaaaatatactatctaaacaagtta

SEQ ID NO: 34711 - DNA, 1730 bp, Homo sapiens
ctgtattgtggttcctggaacactttagaggcttgtgattctactgcttcttattcacactataatacatgtctcaccaatagatgattcaagaacatcatttaaatacacaatttttcattctctatttttgctaaatttcttcatactcaactttcagattctttaatctccagctcagcttcaacaattcaacgctgttctttctgaaaaagtacacatcgtgccttctctacttcgctcttggaacataatttctcatggcagtgtttaagaccactctgtggaggttaatttctgggaccttagggataatatgcctttcgttgatggctacgttgggaattttgttgaaaaattcttttactaaactgagtattgagccagcatttactccaggacccaacatagaactccagaaagactctgactgctgttcttgccaagaaaaatgggttgggtaccggtgcaactgttacttcatttccagtgaacagaaaacttggaacgaaagtcggcatctctgtgcttctcagaaatccagcctgcttcagcttcaaaacacagatgaactggattttatgagctccagtcaacaattttactggattggactctcttacagtgaggagcacaccgcctggttgtgggagaatggctctgcactctcccagtatctatttccatcatttgaaacttttaatacaaagaactgcatagcgtataatccaaatggaaatgctttagatgaatcctgtgaagataaaaatcgttatatctgtaagcaacagctcatttaaatgtttcttggggcagagaaggtggagagtaaagacccaacattactaacaatgatacagttgcatgttatattattactaattgtctacttctggagtctataaaatgtttttaaacagtgtcatatacaattgtcatgtatgtgaaacaatgtgttttaaaattgatgaaattcgttcacctacatttgagaattataaaattaacataaagaattttgtattttcatttaatgtatataatgttaaattcaatgtagttttattacacatttatgtaattttatttacattcttgctaattctcagcagaaatttaaataagatttaattcacatcaaataaaatttagaaaataaaatttaactcacactgcccaggctggagcatagtggcaagatcatagctcattgcaagctcaagtgatcctcctgactcagcctcccaagtagctaggactgcaggcaccatgtcactatgcccgactaatttttaatttttaattttttgtcaagacaaggtcttgctatgttgcccaggctggtcttgaactcctggcctcaagggattctcccaccttggattcccaaagtgctgggattataggtgtgaaccaccatccctggccctcttcacattcttgtatgaagattgatttgggaaaaatgcatttcaggtaactgacaaaagatataggatgaaaaataatatctttcaaatgtttaatttgaactaagagagcttatgcattgcactttctggagatttgtaatgttttggttttgttgtccatgtgactacaaaataatatattttttaattaaaaaatttaaaataataaaaaacagaaaaagcaaaacaaaaagaaaaaaacatttgtgggggcggcttggggccctgggaaaagttttataaaacacaatcgggtgg

SEQ ID NO: 34712 - DNA, 1637 bp, Homo sapiens
ctgtattgtggttcctggaacactttagaggcttgtgattctactgcttcttattcacactataatacatgtctcaccaatagatgattcaagaacatcatttaaatacacaatttttcattctctatttttgctaaatttcttcatactcaactttcagattctttaatctccagctcagcttcaacaattcaacgctgttctttctgaaaaagtacacatcgtgccttctctacttcgctcttggaacataatttctcatggcagcttttactaaactgagtattgagccagcatttactccaggacccaacatagaactccagaaagactctgactgctgttcttgccaagaaaaatgggttgggtaccggtgcaactgttacttcatttccagtgaacagaaaacttggaacgaaagtcggcatctctgtgcttctcagaaatccagcctgcttcagcttcaaaacacagatgaactggattttatgagctccagtcaacaattttactggattggactctcttacagtgaggagcacaccgcctggttgtgggagaatggctctgcactctcccagtatctatttccatcatttgaaacttttaatacaaagaactgcatagcgtataatccaaatggaaatgctttagatgaatcctgtgaagataaaaatcgttatatctgtaagcaacagctcatttaaatgtttcttggggcagagaaggtggagagtaaagacccaacattactaacaatgatacagttgcatgttatattattactaattgtctacttctggagtctataaaatgtttttaaacagtgtcatatacaattgtcatgtatgtgaaacaatgtgttttaaaattgatgaaattcgttcacctacatttgagaattataaaattaacataaagaattttgtattttcatttaatgtatataatgttaaattcaatgtagttttattacacatttatgtaattttatttacattcttgctaattctcagcagaaatttaaataagatttaattcacatcaaataaaatttagaaaataaaatttaactcacactgcccaggctggagcatagtggcaagatcatagctcattgcaagctcaagtgatcctcctgactcagcctcccaagtagctaggactgcaggcaccatgtcactatgcccgactaatttttaatttttaattttttgtcaagacaaggtcttgctatgttgcccaggctggtcttgaactcctggcctcaagggattctcccaccttggattcccaaagtgctgggattataggtgtgaaccaccatccctggccctcttcacattcttgtatgaagattgatttgggaaaaatgcatttcaggtaactgacaaaagatataggatgaaaaataatatctttcaaatgtttaatttgaactaagagagcttatgcattgcactttctggagatttgtaatgttttggttttgttgtccatgtgactacaaaataatatattttttaattaaaaaatttaaaataataaaaaacagaaaaagcaaaacaaaaagaaaaaaacatttgtgggggcggcttggggccctgggaaaagttttataaaacacaatcgggtgg

SEQ ID NO: 34713 - DNA, 1195 bp, Homo sapiens
ctgtattgtggttcctggaacactttagaggcttgtgattctactgcttcttattcacactataatacatgtctcaccaatagatgattcaagaacatcatttaaatacacaatttttcattctctatttttgctaaatttcttcatactcaactttcagattctttaatctccagctcagcttcaacaattcaacgctgttctttctgaaaaagtacacatcgtgccttctctacttcgctcttggaacataatttctcatggcagtgtttaagaccactctgtggaggttaatttctgggaccttagggataatatgcctttcgttgatggctacgttgggaattttgttgaaaaattcttttactaaactgagtattgagccagcatttactccaggacccaacatagaactccagaaagactctgactgctgttcttgccaagaaaaatgggttgggtaccggtgcaactgttacttcatttccagtgaacagaaaacttggaacgaaagtcggcatctctgtgcttctcagaaatccagcctgcttcagcttcaaaacacagatgaactggattttatgagctccagtcaacaattttactggattggactctcttacagtgaggagcacaccgcctggttgtgggagaatggctctgcactctcccagtatctatttccatcatttgaaacttttaatacaaagaactgcatagcgtataatccaaatggaaatgctttagatgaatcctgtgaagataaaaatcgttatatctacaaggtcttgctatgttgcccaggctggtcttgaactcctggcctcaagggattctcccaccttggattcccaaagtgctgggattataggtgtgaaccaccatccctggccctcttcacattcttgtatgaagattgatttgggaaaaatgcatttcaggtaactgacaaaagatataggatgaaaaataatatctttcaaatgtttaatttgaactaagagagcttatgcattgcactttctggagatttgtaatgttttggttttgttgtccatgtgactacaaaataatatattttttaattaaaaaatttaaaataataaaaaacagaaaaagcaaaacaaaaagaaaaaaacatttgtgggggcggcttggggccctgggaaaagttttataaaacacaatcgggtgg

SEQ ID NO: 34714 - DNA, 526 bp, Homo sapiens
aaacatttaacacagaaaagccatagacttacatctagattctaccattaagatatttctatacttgctttatcacctatcttcccatctattcattcatcagttaatcttattttcagtgaattttaaagtataatacattgcagatatcagtacatatctccctaatacttcaacatttatatcattaagtagagttcaatatttgcttacagctttttaaagttacaatgtatatgcaatgatgtttaaaatattaaatatacactcactgagttttgaccaatgcatatacctatttaacccaaacccttatcaagatataaaatattactatcactacaggaagtactctcatacttctgcacatacatctcagaggaacccacagtttgattttcttttaccactatagattagatttttgcctgttctgtttatctcttcttttatgaatacacatctggactctttccagtttcaggttattatgaataaagttgctgtgaacattcatgtaaaagtg

SEQ ID NO: 34715 - DNA, 2011 bp, Homo sapiens
acgcgtccgcccacgcgtccgaagaacaacaatttgaatgggacaacagaagaagtgacttcagaagaagaggaagaagaagaagagatggctgaagatatagaagacttagatcactatgagatgaaggaagaagagcctattagtgggaaaaagtcagaggatgaaggaattgaaaaagaaaatttggcaatattagagaaaattaggaagactcaaaggcaagaccatttaaatgataactttccatttgatcctccatttgttcgagtggtgttacctgttctctcaggaggaatcaatataatctagcaagagcccaacaatcctataattccattgtacagatacatgagaaaaatggctggtacacccctccaaaggaagatggctaaatatgttgactgttgtatgtttggactaatgttgctttaaagaaaatctttccaacatgcagacaaaagctttgagtgcccctattacagcagtaccgaagatgttagttaatagatattttagtggataatctgtcatctgacatccagtataagttacagccttcgcattttgctcattttagatatcttggactgagcagtggggcctttactgtatttttcctgataaatacacatactggccactccttatctctttttcttgaaaagtgaactttttaaagcagccaagtcaacatcaggctactgaagttgaggctttagggtaactttcctatattgagcccatgggttacaaggatttgcaatatattgttccatttacagccaatacaggtttaatcgatgttcaatattggtttaggaaatttaaggccttctaaatcataatagctctttcatgtctaaaaccattttatgatattgccaaaatgtgataggaaacctactcattaaattgttaaactttttaatgactatgtgaagatatgaattgtttcctgaagataatactcttaattgagttgtattgtacttcttaggcaaagcagtgtaaaactgtatcaattaaggcttgtgagtagtgatttccactggggcatcagagtcttggctgggctgaatctgctgcttgttggttcagtgtttcttatgaacaagagccacagtacagagcttcaagttatttaaaatactaagtcatcttacgtttccattttattaacgggatgttgcaatcgtttgtaaactaataaacttataaagtgattggcacaaagactccttgagcaaaagctgtgcagttaagtacaaaaagatacttaatttggagactcttacagtaatttttgccatgtcaaaacaatggcttttacattgaaagattaatagaaactctacatatgttaatttttttatagaacctgactcaaatcaaggtactctccattttattgccttacctgaatcagtcctttttggttggtaatagatttttttatacacccacgtttgatttaaaagtaaattctagttcttaagcacttttaacaagaaatccagaagcacatttttctgcacaaacaagttacaaagttcaaaagtgtttcttgtgcattagctttgagattcagtttttaactttgtaaaccacatctgagagacttgtcatttctacattgtgtgtgtttaatttcttttgattccattttggttaagagagcagtaaatagattttctggtattcttgttcacttgattacatttgtataaagttctgattgccagttgctcagataacaagtgacaaggcagaattctttaaatcagtaaagttccttaagcctaaggctaaatcttgaatacattgttgaattctttaatatcctgatggcaagcagactgatagctgcacatttggcatgctttgtttaatggattttatttttaattgcagatttatttggcaatgtacagtaaattttgtaaacttgcatcaagtttatgaataaagaaccatttaaaaattttgtttgtgctgatcatggcaagca

SEQ ID NO: 34716 - DNA, 2999 bp, Homo sapiens
gtgcacgcgctgaaaccggagcgcgcagggcgcgccagggtgagggggacgggggcggggtgggggcagccctttcccaggcggtagcgggggcggcgtcgctgttgcccttttaagccgcggggccgccgcctcctgccgctggagtcggttacaaaggaagcgccacccaggccgccacacgccgaggcttccgcgcccctcgccattttccagcagcgctcgacgaggcggagccgcgagagcgcggcccaggccggccccgcggggcggtcgcggccgtgacggcggctccgggcccggctccccttccgcgcccggctccccttccgcgcccctcccgccggagatgaggggaagatgtccgtgtcagggctcaaggccgagctgaagttcctggcgtccatcttcgacaagaaccacgagcgattccgcatcgtcagttggaagctggacgagctgcactgccagttcctggtgccgcagcagggcagcccgcactcgctgccgccgccactcacgctccactgcaacatcacggaatcctatccatcttcttcaccgatatggtttgtggattctgaagacccaaatctgacatcagttctggaacgtctagaagatactaagaacaacaatttgaatgggacaacagaagaagtgacttcagaagaagaggaagaagaagaagagatggctgaagatatagaagacttagatcactatgagatgaaggaagaagagcctattagtgggaaaaagtcagaggatgaaggaattgaaaaagaaaatttggcaatattagagaaaattaggaagactcaaaggcaagaccatttaaatggtgcagtgtctgggtcagtgcaagcttcagatagacttatgaaagagctcagggacatatacagatcacagagttataaaacagggatttattcagtggaactcataaatgacagtttatatgactggcatgttaaactgcagaaggttgaccctgatagtcctttgcacagtgatcttcagatcttaaaagaaaaagaaggcatagaatatattttgcttaacttctcttttaaggataactttccatttgatcctccatttgttcgagtggtgttacctgttctctcaggagggtatgtattgggtggaggagcattatgtatggaacttctcacaaaacagggctggagcagtgcctactcaatagaatcggtcatcatgcaaataaatgccaccttagtcaaaggcaaagccagagtgcagtttggagcaaataagaatcaatataatctagcaagagcccaacaatcctataattccattgtacagatacatgagaaaaatggctggtacacccctccaaaggaagatggctaaatatgttgactgttgtatgtttggactaatgttgctttaaagaaaatctttccaacatgcagacaaaagctttgagtgcccctattacagcagtaccgaagatgttagttaatagatattttagtggataatctgtcatctgacatccagtataagttacagccttcgcattttgctcattttagatatcttggactgagcagtggggcctttactgtatttttcctgataaatacacatactggccactccttatctctttttcttgaaaagtgaactttttaaagcagccaagtcaacatcaggctactgaagttgaggctttagggtaactttcctatattgagcccatgggttacaaggatttgcaatatattgttccatttacagccaatacaggtttaatcgatgttcaatattggtttaggaaatttaaggccttctaaatcataatagctctttcatgtctaaaaccattttatgatattgccaaaatgtgataggaaacctactcattaaattgttaaactttttaatgactatgtgaagatatgaattgtttcctgaagataatactcttaattgagttgtattgtacttcttaggcaaagcagtgtaaaactgtatcaattaaggcttgtgagtagtgatttccactggggcatcagagtcttggctgggctgaatctgctgcttgttggttcagtgtttcttatgaacaagagccacagtacagagcttcaagttatttaaaatactaagtcatcttacgtttccattttattaacgggatgttgcaatcgtttgtaaactaataaacttataaagtgattggcacaaagactccttgagcaaaagctgtgcagttaagtacaaaaagatacttaatttggagactcttacagtaatttttgccatgtcaaaacaatggcttttacattgaaagattaatagaaactctacatatgttaatttttttatagaacctgactcaaatcaaggtactctccattttattgccttacctgaatcagtcctttttggttggtaatagatttttttatacacccacgtttgatttaaaagtaaattctagttcttaagcacttttaacaagaaatccagaagcacatttttctgcacaaacaagttacaaagttcaaaagtgtttcttgtgcattagctttgagattcagtttttaactttgtaaaccacatctgagagacttgtcatttctacattgtgtgtgtttaatttcttttgattccattttggttaagagagcagtaaatagattttctggtattcttgttcacttgattacatttgtataaagttctgattgccagttgctcagataacaagtgacaaggcagaattctttaaatcagtaaagttccttaagcctaaggctaaatcttgaatacattgttgaattctttaatatcctgatggcaagcagactgatagctgcacatttggcatgctttgtttaatggattttatttttaattgcagatttatttggcaatgtacagtaaattttgtaaacttgcatcaagtttatgaataaagaaccatttaaaaattttgtttgtgctgatcatggcaagca

SEQ ID NO: 34717 - DNA, 414 bp, Homo sapiens
ccacgcgtccgcacacaatgtagaaatgacaagtctctcagatgtgtgtttaatttcttttgattccattttggttaagagagcagtaaatagattttctggtattcttgttcacttgattacatttgtataaagttctgattgccagttgctcagataacaagtgacaaggcagaattctttaaatcagtaaagttccttaagcctaaggctaaatcttgaatacattgttgaattctttaatatcctgatggcaagcagactgatagctgcacatttggcatgctttgtttaatggattttatttttaattgcagatttatttggcaatgtacagtaaattttgtaaacttgcatcaagtttatgaataaagaaccatttaaaaattttgtttgtgctgatcatggcaagca

SEQ ID NO: 34718 - DNA, 913 bp, Homo sapiens
cttctcgccaggggctggcttgggggcttctggcccatctcggtccccgtctcctagccccgaggggggagtccgcggcggcccaagcccttgtggggtccatggccgccctcagccggcctgctcccgggaccggggcggggcggggcggggcggcgcagctccggctgttgtttgagcccaggccggcaaggggaacggcccttaagttttaacgcctcatttttcagtcggattttccttcttcccgcttgttcagccaattgtttttaagtttgcgtttaaggagaaactgacaatgagaatggactcgttgacggaggaaaagttggaatgcagactctggtgctgtttgagcgacccctctcccccgggcctggctgcgcgctgctgtgttctggaaaggagcatagtaccgtcgttgcggcaggaatcctatccatcttcttcaccgatatggtttgtggattctgaagacccaaatctgacatcagttctggaacgtctagaagatactaagaacaacaatttgcttcgtcagcaattgaagtggttgatatgtgaactctgcagtttatataaccttcctaagcacctggatgttgagatgctagatcaaccactacccacgggtcagaatgggacaacagaagaagtgacttcagaagaagaggaagaagaagaagagatggctgaagataactttccatttgatcctccatttgttcgagtggtgttacctgttctctcaggaggtgtattgcgtggcaggaagcattaatgtatggaacttctcacaaaacagggctggaaccatgcctactccatagaattcggcaatatgcaattaaatgccactttagtcaaagcaaagcagaggagttggacaatagaatatttatctacgacccaa

SEQ ID NO: 34719 - DNA, 598 bp, Homo sapiens
atagcttagttgttccatgttttaagagcaaaatttctagctttcgttggctatttagtgtatacatttataccatagtaatagttatatgatgaaatgaagagtagctaacatgctctatatcttaacagggatttattcagtggaactcataaatgacagtttatatgactggcatgttaaactgcagaagtaagtggctttttaatgctcacccactctttgcaatggtagactatcacagtggaggttattttccttctaacttgatacctttatactatggcttttacttagaactttagactttgtttctatagaaatagttcttagattgtttaaatgagctgttgctgaggtctaataagaaagtgagaaagaggaaggacagaaagagggaccagctgcgggataaagtgttgagctcaacgctttatacttctcaacgctttatactttctcaacgctttatacttcctcaacgctttatactttctcacgctttatacttcctcacgctttatacttccgtattgaattcaagtataatattaagtatgctggagaagtataaagcgtgaaaagtataaagcgttga

SEQ ID NO: 34720 - DNA, 191 bp, Homo sapiens
gcggccgcctactactactactactgctcgaattcaagcttctaacgatgtacggggacatgctttgtttaatggattttatttttaattgcagatttatttggcaatgtacagtaaattttgtaaacttgcatcaagtttatgaataaagaaccatttaaaaattttgtttgtgctgatcatggcaagca

SEQ ID NO: 34721 - DNA, 2892 bp, Homo sapiens
gtgcacgcgctgaaaccggagcgcgcagggcgcgccagggtgagggggacgggggcggggtgggggcagccctttcccaggcggtagcgggggcggcgtcgctgttgcccttttaagccgcggggccgccgcctcctgccgctggagtcggttacaaaggaagcgccacccaggccgccacacgccgaggcttccgcgcccctcgccattttccagcagcgctcgacgaggcggagccgcgagagcgcggcccaggccggccccgcggggcggtcgcggccgtgacggcggctccgggcccggctccccttccgcgcccggctccccttccgcgcccctcccgccggagatgaggggaagatgtccgtgtcagggctcaaggccgagctgaagttcctggcgtccatcttcgacaagaaccacgagcgattccgcatcgtcagttggaagctggacgagctgcactgccagttcctggtgccgcagcagggcagcccgcactcgctgccgccgccactcacgctccactgcaacatcacggaatcctatccatcttcttcaccgatatggtttgtggattctgaagacccaaatctgacatcagttctggaacgtctagaagatactaagaacaacaatttgcttcgtcagcaattgaagtggttgatatgtgaactctgcagtttatataaccttcctaagcacctggatgttgagatgctagatcaaccactacccacgggtcagaatgggacaacagaagaagtgacttcagaagaagaggaagaagaagaagagatggctgaagatatagaagacttagatcactatgagatgaaggaagaagagcctattagtgggaaaaagtcagaggatgaaggaattgaaaaagaaaatttggcaatattagagaaaattaggaagactcaaaggcaagaccatttaaatggtgcagtgtctgggtcagtgcaagcttcagatagacttatgaaagagctcagggacatatacagatcacagagttataaaacagggatttattcagtggaactcataaatgacagtttatatgactggcatgttaaactgcagaaggttgaccctgatagtcctttgcacagtgatcttcagatcttaaaagaaaaagaaggcatagaatatattttgcttaacttctcttttaaggataactttccatttgatcctccatttgttcgagtggtgttacctgttctctcaggagggctggtacacccctccaaaggaagatggctaaatatgttgactgttgtatgtttggactaatgttgctttaaagaaaatctttccaacatgcagacaaaagctttgagtgcccctattacagcagtaccgaagatgttagttaatagatattttagtggataatctgtcatctgacatccagtataagttacagccttcgcattttgctcattttagatatcttggactgagcagtggggcctttactgtatttttcctgataaatacacatactggccactccttatctctttttcttgaaaagtgaactttttaaagcagccaagtcaacatcaggctactgaagttgaggctttagggtaactttcctatattgagcccatgggttacaaggatttgcaatatattgttccatttacagccaatacaggtttaatcgatgttcaatattggtttaggaaatttaaggccttctaaatcataatagctctttcatgtctaaaaccattttatgatattgccaaaatgtgataggaaacctactcattaaattgttaaactttttaatgactatgtgaagatatgaattgtttcctgaagataatactcttaattgagttgtattgtacttcttaggcaaagcagtgtaaaactgtatcaattaaggcttgtgagtagtgatttccactggggcatcagagtcttggctgggctgaatctgctgcttgttggttcagtgtttcttatgaacaagagccacagtacagagcttcaagttatttaaaatactaagtcatcttacgtttccattttattaacgggatgttgcaatcgtttgtaaactaataaacttataaagtgattggcacaaagactccttgagcaaaagctgtgcagttaagtacaaaaagatacttaatttggagactcttacagtaatttttgccatgtcaaaacaatggcttttacattgaaagattaatagaaactctacatatgttaatttttttatagaacctgactcaaatcaaggtactctccattttattgccttacctgaatcagtcctttttggttggtaatagatttttttatacacccacgtttgatttaaaagtaaattctagttcttaagcacttttaacaagaaatccagaagcacatttttctgcacaaacaagttacaaagttcaaaagtgtttcttgtgcattagctttgagattcagtttttaactttgtaaaccacatctgagagacttgtcatttctacattgtgtgtgtttaatttcttttgattccattttggttaagagagcagtaaatagattttctggtattcttgttcacttgattacatttgtataaagttctgattgccagttgctcagataacaagtgacaaggcagaattctttaaatcagtaaagttccttaagcctaaggctaaatcttgaatacattgttgaattctttaatatcctgatggcaagcagactgatagctgcacatttggcatgctttgtttaatggattttatttttaattgcagatttatttggcaatgtacagtaaattttgtaaacttgcatcaagtttatgaataaagaaccatttaaaaattttgtttgtgctgatcatggcaagca

SEQ ID NO: 34722 - DNA, 3104 bp, Homo sapiens
gtgcacgcgctgaaaccggagcgcgcagggcgcgccagggtgagggggacgggggcggggtgggggcagccctttcccaggcggtagcgggggcggcgtcgctgttgcccttttaagccgcggggccgccgcctcctgccgctggagtcggttacaaaggaagcgccacccaggccgccacacgccgaggcttccgcgcccctcgccattttccagcagcgctcgacgaggcggagccgcgagagcgcggcccaggccggccccgcggggcggtcgcggccgtgacggcggctccgggcccggctccccttccgcgcccggctccccttccgcgcccctcccgccggagatgaggggaagatgtccgtgtcagggctcaaggccgagctgaagttcctggcgtccatcttcgacaagaaccacgagcgattccgcatcgtcagttggaagctggacgagctgcactgccagttcctggtgccgcagcagggcagcccgcactcgctgccgccgccactcacgctccactgcaacatcacggaatcctatccatcttcttcaccgatatggtttgtggattctgaagacccaaatctgacatcagttctggaacgtctagaagatactaagaacaacaatttgcttcgtcagcaattgaagtggttgatatgtgaactctgcagtttatataaccttcctaagcacctggatgttgagatgctagatcaaccactacccacgggtcagaatgggacaacagaagaagtgacttcagaagaagaggaagaagaagaagagatggctgaagatatagaagacttagatcactatgagatgaaggaagaagagcctattagtgggaaaaagtcagaggatgaaggaattgaaaaagaaaatttggcaatattagagaaaattaggaagactcaaaggcaagaccatttaaatggtgcagtgtctgggtcagtgcaagcttcagatagacttatgaaagagctcagggacatatacagatcacagagttataaaacagggatttattcagtggaactcataaatgacagtttatatgactggcatgttaaactgcagaaggttgaccctgatagtcctttgcacagtgatcttcagatcttaaaagaaaaagaaggcatagaatatattttgcttaacttctcttttaaggataactttccatttgatcctccatttgttcgagtggtgttacctgttctctcaggagggtatgtattgggtggaggagcattatgtatggaacttctcacaaaacagggctggagcagtgcctactcaatagaatcggtcatcatgcaaataaatgccaccttagtcaaaggcaaagccagagtgcagtttggagcaaataagaatcaatataatctagcaagagcccaacaatcctataattccattgtacagatacatgagaaaaatggctggtacacccctccaaaggaagatggctaaatatgttgactgttgtatgtttggactaatgttgctttaaagaaaatctttccaacatgcagacaaaagctttgagtgcccctattacagcagtaccgaagatgttagttaatagatattttagtggataatctgtcatctgacatccagtataagttacagccttcgcattttgctcattttagatatcttggactgagcagtggggcctttactgtatttttcctgataaatacacatactggccactccttatctctttttcttgaaaagtgaactttttaaagcagccaagtcaacatcaggctactgaagttgaggctttagggtaactttcctatattgagcccatgggttacaaggatttgcaatatattgttccatttacagccaatacaggtttaatcgatgttcaatattggtttaggaaatttaaggccttctaaatcataatagctctttcatgtctaaaaccattttatgatattgccaaaatgtgataggaaacctactcattaaattgttaaactttttaatgactatgtgaagatatgaattgtttcctgaagataatactcttaattgagttgtattgtacttcttaggcaaagcagtgtaaaactgtatcaattaaggcttgtgagtagtgatttccactggggcatcagagtcttggctgggctgaatctgctgcttgttggttcagtgtttcttatgaacaagagccacagtacagagcttcaagttatttaaaatactaagtcatcttacgtttccattttattaacgggatgttgcaatcgtttgtaaactaataaacttataaagtgattggcacaaagactccttgagcaaaagctgtgcagttaagtacaaaaagatacttaatttggagactcttacagtaatttttgccatgtcaaaacaatggcttttacattgaaagattaatagaaactctacatatgttaatttttttatagaacctgactcaaatcaaggtactctccattttattgccttacctgaatcagtcctttttggttggtaatagatttttttatacacccacgtttgatttaaaagtaaattctagttcttaagcacttttaacaagaaatccagaagcacatttttctgcacaaacaagttacaaagttcaaaagtgtttcttgtgcattagctttgagattcagtttttaactttgtaaaccacatctgagagacttgtcatttctacattgtgtgtgtttaatttcttttgattccattttggttaagagagcagtaaatagattttctggtattcttgttcacttgattacatttgtataaagttctgattgccagttgctcagataacaagtgacaaggcagaattctttaaatcagtaaagttccttaagcctaaggctaaatcttgaatacattgttgaattctttaatatcctgatggcaagcagactgatagctgcacatttggcatgctttgtttaatggattttatttttaattgcagatttatttggcaatgtacagtaaattttgtaaacttgcatcaagtttatgaataaagaaccatttaaaaattttgtttgtgctgatcatggcaagca

SEQ ID NO: 34723 - DNA, 3443 bp, Homo sapiens
gtgcacgcgctgaaaccggagcgcgcagggcgcgccagggtgagggggacgggggcggggtgggggcagccctttcccaggcggtagcgggggcggcgtcgctgttgcccttttaagccgcggggccgccgcctcctgccgctggagtcggttacaaaggaagcgccacccaggccgccacacgccgaggcttccgcgcccctcgccattttccagcagcgctcgacgaggcggagccgcgagagcgcggcccaggccggccccgcggggcggtcgcggccgtgacggcggctccgggcccggctccccttccgcgcccggctccccttccgcgcccctcccgccggagatgaggggaagatgtccgtgtcagggctcaaggccgagctgaagttcctggcgtccatcttcgacaagaaccacgagcgattccgcatcgtcagttggaagctggacgagctgcactgccagttcctggtgccgcagcagggcagcccgcactcgctgccgccgccactcacgctccactgcaacatcacggaatcctatccatcttcttcaccgatatggtttgtggattctgaagacccaaatctgacatcagttctggaacgtctagaagatactaagaacaacaatttgcttcgtcagcaattgaagtggttgatatgtgaactctgcagtttatataaccttcctaagcacctggatgttgagatgctagatcaaccactacccacgggtcagaatgggacaacagaagaagtgacttcagaagaagaggaagaagaagaagagatggctgaagatatagaagacttagatcactatgagatgaaggaagaagagcctattagtgggaaaaagtcagaggatgaaggaattgaaaaagaaaatttggcaatattagagaaaattaggaagactcaaaggcaagaccatttaaatggtgcagtgtctgggtcagtgcaagcttcagatagacttatgaaagagctcagggacatatacagatcacagagttataaaacagggatttattcagtggaactcataaatgacagtttatatgactggcatgttaaactgcagaagtaagtggctttttaatgctcacccactctttgcaatggtagactatcacagtggaggttattttccttctaacttgatacctttatactatggcttttacttagaactttagactttgtttctatagaaatagttcttagattgtttaaatgagctgttgctgaggtctaataagaaagtgagaaagaggaaggacagaaagagggaccagctgcgggataaagtgttttatggagttagagcaggggaacttaaaaacaaaagtgtatttaataacttcatgagactgtgataaccagtttatatttgaaatatatacagcactttgggagactgagggttgaccctgatagtcctttgcacagtgatcttcagatcttaaaagaaaaagaaggcatagaatatattttgcttaacttctcttttaaggataactttccatttgatcctccatttgttcgagtggtgttacctgttctctcaggagggtatgtattgggtggaggagcattatgtatggaacttctcacaaaacagggctggagcagtgcctactcaatagaatcggtcatcatgcaaataaatgccaccttagtcaaaggcaaagccagagtgcagtttggagcaaataagaatcaatataatctagcaagagcccaacaatcctataattccattgtacagatacatgagaaaaatggctggtacacccctccaaaggaagatggctaaatatgttgactgttgtatgtttggactaatgttgctttaaagaaaatctttccaacatgcagacaaaagctttgagtgcccctattacagcagtaccgaagatgttagttaatagatattttagtggataatctgtcatctgacatccagtataagttacagccttcgcattttgctcattttagatatcttggactgagcagtggggcctttactgtatttttcctgataaatacacatactggccactccttatctctttttcttgaaaagtgaactttttaaagcagccaagtcaacatcaggctactgaagttgaggctttagggtaactttcctatattgagcccatgggttacaaggatttgcaatatattgttccatttacagccaatacaggtttaatcgatgttcaatattggtttaggaaatttaaggccttctaaatcataatagctctttcatgtctaaaaccattttatgatattgccaaaatgtgataggaaacctactcattaaattgttaaactttttaatgactatgtgaagatatgaattgtttcctgaagataatactcttaattgagttgtattgtacttcttaggcaaagcagtgtaaaactgtatcaattaaggcttgtgagtagtgatttccactggggcatcagagtcttggctgggctgaatctgctgcttgttggttcagtgtttcttatgaacaagagccacagtacagagcttcaagttatttaaaatactaagtcatcttacgtttccattttattaacgggatgttgcaatcgtttgtaaactaataaacttataaagtgattggcacaaagactccttgagcaaaagctgtgcagttaagtacaaaaagatacttaatttggagactcttacagtaatttttgccatgtcaaaacaatggcttttacattgaaagattaatagaaactctacatatgttaatttttttatagaacctgactcaaatcaaggtactctccattttattgccttacctgaatcagtcctttttggttggtaatagatttttttatacacccacgtttgatttaaaagtaaattctagttcttaagcacttttaacaagaaatccagaagcacatttttctgcacaaacaagttacaaagttcaaaagtgtttcttgtgcattagctttgagattcagtttttaactttgtaaaccacatctgagagacttgtcatttctacattgtgtgtgtttaatttcttttgattccattttggttaagagagcagtaaatagattttctggtattcttgttcacttgattacatttgtataaagttctgattgccagttgctcagataacaagtgacaaggcagaattctttaaatcagtaaagttccttaagcctaaggctaaatcttgaatacattgttgaattctttaatatcctgatggcaagcagactgatagctgcacatttggcatgctttgtttaatggattttatttttaattgcagatttatttggcaatgtacagtaaattttgtaaacttgcatcaagtttatgaataaagaaccatttaaaaattttgtttgtgctgatcatggcaagca

SEQ ID NO: 34724 - DNA, 1085 bp, Homo sapiens
gtgcacgcgctgaaaccggagcgcgcagggcgcgccagggtgagggggacgggggcggggtgggggcagccctttcccaggcggtagcgggggcggcgtcgctgttgcccttttaagccgcggggccgccgcctcctgccgctggagtcggttacaaaggaagcgccacccaggccgccacacgccgaggcttccgcgcccctcgccattttccagcagcgctcgacgaggcggagccgcgagagcgcggcccaggccggccccgcggggcggtcgcggccgtgacggcggctccgggcccggctccccttccgcgcccggctccccttccgcgcccctcccgccggagatgaggggaagatgtccgtgtcagggctcaaggccgagctgaagttcctggcgtccatcttcgacaagaaccacgagcgattccgcatcgtcagttggaagctggacgagctgcactgccagttcctggtgccgcagcagggcagcccgcactcgctgccgccgccactcacgctccactgcaacatcacggaatcctatccatcttcttcaccgatatggtttgtggattctgaagacccaaatctgacatcagttctggaacgtctagaagatactaagaacaacaatttgcttcgtcagcaattgaagtggttgatatgtgaactctgcagtttatataaccttcctaagcacctggatgttgagatgctagatcaaccactacccacgggtcagaatgggacaacagaagaagtgacttcagaagaagaggaagaagaagaagagatggctgaagatatagaagacttagatcactatgagatgaaggaagaagagcctattagtgggaaaaagtcagaggatgaaggaattgaaaaagaaaatttggcaatattagagaaaattaggaagactcaaaggcaagaccatttaaatgtgcagtgtctggatcatgcaggcactgggctcctggaagatgtccttgaagaagtgacgtccctgagccccaaaccctcctcagggtggttgagttccagccatgctccctataaatgtcatgtggcttacctctc

SEQ ID NO: 34725 - DNA, 1019 bp, Homo sapiens
gtgcacgcgctgaaaccggagcgcgcagggcgcgccagggtgagggggacgggggcggggtgggggcagccctttcccaggcggtagcgggggcggcgtcgctgttgcccttttaagccgcggggccgccgcctcctgccgctggagtcggttacaaaggaagcgccacccaggccgccacacgccgaggcttccgcgcccctcgccattttccagcagcgctcgacgaggcggagccgcgagagcgcggcccaggccggccccgcggggcggtcgcggccgtgacggcggctccgggcccggctccccttccgcgcccggctccccttccgcgcccctcccgccggagatgaggggaagatgtccgtgtcagggctcaaggccgagctgaagttcctggcgtccatcttcgacaagaaccacgagcgattccgcatcgtcagttggaagctggacgagctgcactgccagttcctggtgccgcagcagggcagcccgcactcgctgccgccgccactcacgctccactgcaacatcacggaatcctatccatcttcttcaccgatatggtttgtggattctgaagacccaaatctgacatcagttctggaacgtctagaagatactaagaacaacaatttgcttcgtcagcaattgaagtggttgatatgtgaactctgcagtttatataaccttcctaagcacctggatgttgagatgctagatcaaccactacccacgggtcagaatgggacaacagaagaagtgacttcagaagaagaggaagaagaagaagagatggctgaagatatagaagacttagatcactatgagatgaaggaagaagagcctattagtgggaaaaagtcagaggatgaaggaattgaaaaagaaaatttggcaatattagagaaaattaggaagactcaaaggcaagaccatttaaataccagcctggccaacatggcaaaaccccgtctctactaaaaatacaaaaattagctgggcgtggtggtggg

SEQ ID NO: 34726 - DNA, 978 bp, Homo sapiens
gtgcacgcgctgaaaccggagcgcgcagggcgcgccagggtgagggggacgggggcggggtgggggcagccctttcccaggcggtagcgggggcggcgtcgctgttgcccttttaagccgcggggccgccgcctcctgccgctggagtcggttacaaaggaagcgccacccaggccgccacacgccgaggcttccgcgcccctcgccattttccagcagcgctcgacgaggcggagccgcgagagcgcggcccaggccggccccgcggggcggtcgcggccgtgacggcggctccgggcccggctccccttccgcgcccggctccccttccgcgcccctcccgccggagatgaggggaagatgtccgtgtcagggctcaaggccgagctgaagttcctggcgtccatcttcgacaagaaccacgagcgattccgcatcgtcagttggaagctggacgagctgcactgccagttcctggtgccgcagcagggcagcccgcactcgctgccgccgccactcacgctccactgcaacatcacggaatcctatccatcttcttcaccgatatggtttgtggattctgaagacccaaatctgacatcagttctggaacgtctagaagatactaagaacaacaatttgcttcgtcagcaattgaagtggttgatatgtgaactctgcagtttatataaccttcctaagcacctggatgttgagatgctagatcaaccactacccacgggtcagtatggtactacagtatgaagtgacttcagaagtagaggaagaagaagaagtagtatggctgtaggatatagaagtacttagatctactataagatgaagaatgagaacgcagacaagttactatagagcgaaaagcaaatgaagaagtctgagaaatagagcagcagagaagagaccgagcgagaagaactataggaggtaaaacagaacaggatggctatcagagacccc

SEQ ID NO: 34727 - DNA, 272 bp, Homo sapiens
catgcaaataaatgccaccttagtcaaaggcaaagccagagtgcagtttggagcaaataaggtacttctgttaagaattttacataaaccataagatacattttatattactttataagctttcttcctgtcttgacttaattcttttttgagatagtttcattttcatttggtttgttttcttcttgttacaaaagtgatctatagaaaatatggaattataagaaaattaaagatactaattgataatcacttaatgatttcgtatctgt

SEQ ID NO: 34728 - DNA, 1604 bp, Homo sapiens
ggcacgaggccgccacccgagccggagcgggctgggccgccaaggcaagatggtggactacagcgtgtgggaccacattgaggtgtctgatgatgaagacgagacgcaccccaacatcgacacggccagtctcttccgctggcggcatcaggcccgggtggaacgcatggagcagttccagaaggagaaggaggaactggacaggggctgccgcgagtgcaagcgcaaggtggccgagtgccagaggaaactgaaggagctggaggtggccgagggcggcaaggcagagctggagcgcctgcaggccgaggcacagcagctgcgcaaggaggagcggagctgggagcagaagctggaggagatgcgcaagaaggagaagagcatgccctggaacgtggacacgctcagcaaagacggcttcagcaagagcatggtaaataccaagcccgagaagacggaggaggactcagaggaggtgagggagcagaaacacaagaccttcgtggaaaaatacgagaaacagatcaagcactttggcatgcttcgccgctgggatgacagccaaaagtacctgtcagacaacgtccacctggtgtgcgaggagacagccaattacctggtcatttggtgcattgacctagaggtggaggagaaatgtgcactcatggagcaggtggcccaccagacaatcgtcatgcaatttatcctggagctggccaagagcctaaaggtggacccccgggcctgcttccggcagttcttcactaagattaagacagccgatcgccagtacatggagggcttcaacgacgagctggaagccttcaaggagcgtgtgcggggccgtgccaagctgcgcatcgagaaggccatgaaggagtacgaggaggaggagcgcaagaagcggctcggccccggcggcctggaccccgtcgaggtctacgagtccctccctgaggaactccagaagtgcttcgatgtgaaggacgtgcagatgctgcaggacgccatcagcaagatggaccccaccgacgcaaagtaccacatgcagcgctgcattgactctggcctctgggtccccaactctaaggccagcgaggccaaggagggagaggaggcaggtcctggggacccattactggaagctgttcccaagacgggcgatgagaaggatgtcagtgtgtgacctgccccagctaccaccgccacctgcttccaggcccctatgtgccccttttcagaaaacagatagatgccatctcgcccgctcctgacttcctctacttgcgctgctcggcccagcctggggggcccgcccagccctccctggcctctccactgtctccactctccagcgcccattcaagtctctgctttgagtcaaggggcttcactgcctgcagccccccatcagcattatgccaaaggcccgggggtccggggaagggcagaggtcaccaggctggtctaccaggtagttggggagggtccccagccaaggggccggctctcgtcactgggctctgttttcactgttcgtctgctgtctgtgtcttctatttggcaaacagcaatgatcttccaataaaagatttcagatgctc

SEQ ID NO: 34729 - DNA, 1652 bp, Homo sapiens
ggcacgaggccgccacccgagccggagcgggctgggccgccaaggcaagatggtggactacagcgtgtgggaccacattgaggtgtctgatgatgaagacgagacgcaccccaacatcgacacggccagtctcttccgctggcggcatcaggcccgggtggaacgcatggagcagttccagaaggagaaggaggaactggacaggggctgccgcgagtgcaagcgcaaggtggccgagtgccagaggaaactgaaggagctggaggtggccgagggcggcaaggcagagctggagcgcctgcaggccgaggcacagcagctgcgcaaggaggagcggagctgggagcagaagctggaggagatgcgcaagaaggagaagagcatgccctggaacgtggacacgctcagcaaagacggcttcagcaagagcatggtaaataccaagcccgagaagacggaggaggactcagaggaggtgagggagcagaaacacaagaccttcgtggaaaaatacgagaaacagatcaagcactttggcatgcttcgccgctgggatgacagccaaaagtacctgtcagacaacgtccacctggtgtgcgaggagacagccaattacctggtcatttggtgcattgacctagaggtggaggagaaatgtgcactcatggagcaggtggcccaccagacaatcgtcatgcaatttatcctggagctggccaagagcctaaaggtggacccccgggcctgcttccggcagttcttcactaagattaagacagccgatcgccagtacatggagggcttcaacgacgagctggaagccttcaaggagcgtgtgcggggccgtgccaagctgcgcatcgagaaggccatgaaggagtacgaggaggaggagcgcaagaagcggctcggccccggcggcctggaccccgtcgaggtctacgagtccctccctgaggaactccagaagtgcttcgatgtgaaggacgtgcagatgctgcaggacgccatcagcaagatggaccccaccgacgcaaagtaccacatgcagcgctgcattgactctggcctctgggtccccaactctaaggccagcgaggccaaggagggagaggaggcaggtcctggggacccattactggaagctgttcccaagacgggcgatgagaaggatgtcagtgtgtgacctgccccagctaccaccgccacctgcttccaggcccctatgtgccccttttcagaaaacagatagatgccatctcgcccgctcctgacttcctctacttgcgctgctcggcccagcctggggggcccgcccagccctccctggcctctccactgtctccactctccagcgcccattcaagtctctgctttgagtcaaggggcttcactgcctgcagccccccatcagcattatgccaaaggcccgggggtccggggaagggcagaggtcaccaggctggtctaccaggtagttggggagggtccccagccaaggggccggctctcgtcactgggctctgttttcactgttcgtctgctgtctgtgtcttctatttggcaaacagcaatgatcttccaataaaagatttcagatgctcaaaaaaaaaaacaaataaaaaaacaagcacacacaacaaaaacaaaaa

SEQ ID NO: 34730 - DNA, 1352 bp, Homo sapiens
  misc_feature (129)..(129): n is a, c, g, or t
aagcttggcacgagggcaaggcccatgcccacgctcccgccaccttgatgctcatggcttcgtcaccacctccgccgtggatgggatgggcgctgcgaccacggcccgcccggccgcgctcgaggcgcnttccgcagccttgccccagcccactccccctctcaccctaccacagagcatggtaaataccaagcccgagaagacggaggaggactcagaggaggtgagggagcagaaacacaagaccttcgtggaaaaatacgagaaacagatcaagcactttggcatgcttcgccgctgggatgacagccaaaagtacctgtcagacaacgtccacctggtgtgcgaggagacagccaattacctggtcatttggtgcattgacctagaggtggaggagaaatgtgcactcatggagcaggtggcccaccagacaatcgtcatgcaatttatcctggagctggccaagagcctaaaggtggacccccgggcctgcttccggcagttcttcactaagattaagacagccgatcgccagtacatggagggcttcaacgacgagctggaagccttcaaggagcgtgtgcggggccgtgccaagctgcgcatcgagaaggccatgaaggagtacgaggaggaggagcgcaagaagcggctcggccccggcggcctggaccccgtcgaggtctacgagtccctccctgaggaactccagaagtgcttcgatgtgaaggacgtgcagatgctgcaggacgccatcagcaagatggaccccaccgacgcaaagtaccacatgcagcgctgcattgactctggcctctgggtccccaactctaaggccagcgaggccaaggagggagaggaggcaggtcctggggacccattactggaagctgttcccaagacgggcgatgagaaggatgtcagtgtgtgacctgccccagctaccaccgccacctgcttccaggcccctatgtgccccttttcagaaaacagatagatgccatctcgcccgctcctgacttcctctacttgcgctgctcggcccagcctggggggcccgcccagccctccctggcctctccactgtctccactctccagcgcccattcaagtctctgctttgagtcaaggggcttcactgcctgcagccccccatcagcattatgccaaaggcccgggggtccggggaagggcagaggtcaccaggctggtctaccaggtagttggggagggtccccagccaaggggccggctctcgtcactgggctctgttttcactgttcgtctgctgtctgtgtcttctatttggcaaacagcaatgatcttccaataaaagatttcagatgctc

SEQ ID NO: 34731 - DNA, 560 bp, Homo sapiens
tgcaggaagccggggtgaatcggccgaggccaaggagggagaggaggcaggtcctggggacccattactggaagctgttcccaagacgggcgatgagaaggatgtcagtgtgtgacctgccccagctaccaccgccacctgcttccaggcccctatgtgccccttttcagaaaacagatagatgccatctcgcccgctcctgacttcctctacttgcgctgctcggcccagcctggggggcccgcccagccctccctggcctctccactgtctccactctccagcgcccattcaagtctctgctttgagtcaaggggcttcactgcctgcagccccccatcagcattatgccaaaggcccgggggtccggggaagggcagaggtcaccaggctggtctaccaggtagttggggagggtccccagccaaggggccggctctcgtcactgggctctgttttcactgttcgtctgctgtctgtgtcttctatttggcaaacagcaatgatcttccaataaaagatttcagatgctcctctgggctgctgggagggccgttcag

SEQ ID NO: 34732 - DNA, 1695 bp, Homo sapiens
ggcacgaggccgccacccgagccggagcgggctgggccgccaaggcaagatggtggactacagcgtgtgggaccacattgaggtgtctgatgatgaagacgagacgcaccccaacatcgacacggccagtctcttccgctggcggcatcaggcccgggtggaacgcatggagcagttccagaaggagaaggaggaactggacaggggctgccgcgagtgcaagcgcaaggtggccgagtgccagaggaaactgaaggagctggaggtggccgagggcggcaaggcagagctggagcgcctgcaggccgaggcacagcagctgcgcaaggaggagcggagctgggagcagaagctggaggagatgcgcaagaaggagaagagcatgccctggaacgtggacacgctcagcaaagacggcttcagcaagagcatggtaaataccaagcccgagaagacggaggaggactcagaggaggtgagggagcagaaacacaagaccttcgtggaaaaatacgagaaacagatcaagcactttggtgagtggggcttgtgggttatggggggcaaggtcgaggcaggccctttgcctccagggccctccagcaccttgccagcatcttcccacaggcatgcttcgccgctgggatgacagccaaaagtacctgtcagacaacgtccacctggtgtgcgaggagacagccaattacctggtcatttggtgcattgacctagaggtggaggagaaatgtgcactcatggagcaggtggcccaccagacaatcgtcatgcaatttatcctggagctggccaagagcctaaaggtggacccccgggcctgcttccggcagttcttcactaagattaagacagccgatcgccagtacatggagggcttcaacgacgagctggaagccttcaaggagcgtgtgcggggccgtgccaagctgcgcatcgagaaggccatgaaggagtacgaggaggaggagcgcaagaagcggctcggccccggcggcctggaccccgtcgaggtctacgagtccctccctgaggaactccagaagtgcttcgatgtgaaggacgtgcagatgctgcaggacgccatcagcaagatggaccccaccgacgcaaagtaccacatgcagcgctgcattgactctggcctctgggtccccaactctaaggccagcgaggccaaggagggagaggaggcaggtcctggggacccattactggaagctgttcccaagacgggcgatgagaaggatgtcagtgtgtgacctgccccagctaccaccgccacctgcttccaggcccctatgtgccccttttcagaaaacagatagatgccatctcgcccgctcctgacttcctctacttgcgctgctcggcccagcctggggggcccgcccagccctccctggcctctccactgtctccactctccagcgcccattcaagtctctgctttgagtcaaggggcttcactgcctgcagccccccatcagcattatgccaaaggcccgggggtccggggaagggcagaggtcaccaggctggtctaccaggtagttggggagggtccccagccaaggggccggctctcgtcactgggctctgttttcactgttcgtctgctgtctgtgtcttctatttggcaaacagcaatgatcttccaataaaagatttcagatgctc

SEQ ID NO: 34733 - DNA, 1631 bp, Homo sapiens
ggcacgaggccgccacccgagccggagcgggctgggccgccaaggcaagatggtggactacagcgtgtgggaccacattgaggtgtctgatgatgaagacgagacgcaccccaacatcgacacggccagtctcttccgctggcggcatcaggcccgggtggaacgcatggagcagttccagaaggagaaggaggaactggacaggggctgccgcgagtgcaagcgcaaggtggccgagtgccagaggaaactgaaggagctggaggtggccgagggcggcaaggcagagctggagcgcctgcaggccgaggcacagcagctgcgcaaggaggagcggagctgggagcagaagctggaggagatgcgcaagaaggagaagagcatgccctggaacgtggacacgctcagcaaagacggcttcagcaagagcatggtaaataccaagcccgagaagacggaggaggactcagaggaggtgagggagcagaaacacaagaccttcgtggaaaaatacgagaaacagatcaagcactttggcatgcttcgccgctgggatgacagccaaaagtacctgtcagacaacgtccacctggtgtgcgaggagacagccaattacctggtcatttggtgcattgacctagaggtggaggagaaatgtgcactcatggagcaggtggcccaccagacaatcgtcatgcaatttatcctggagctggccaagagcctaaaggtggacccccgggcctgcttccggcagttcttcactaagattaagacagccgatcgccagtacatggagggcttcaacgacgagctggaagccttcaaggagcgtgtgcggggccgtgccaagctgcgcatcgagaaggccatgaaggagtacgaggaggaggagcgcaagaagcggctcggccccggcggcctggaccccgtcgaggtctacgagtccctccctgaggaactccagaagtgcttcgatgtgaaggacgtgcagatgctgcaggacgccatcagcaagatggaccccaccgacgcaaagtaccacatgcagcgctgcattgactctggcctctgggtccccaactctaaggccagcgaggccaaggagggagaggaggcaggtcctggggacccattactggaagctgttcccaagacgggcgatgagaaggatgtcagtgtgtgacctgccccagctaccaccgccacctgcttccaggcccctatgtgccccttttcagaaaacagatagatgccatctcgcccgctcctgacttcctctacttgcgctgctcggcccagcctggggggcccgcccagccctccctggcctctccactgtctccactctccagcgcccattcaagtctctgctttgagtcaaggggcttcactgcctgcagccccccatcagcattatgccaaaggcccgggggtccggggaagggcagaggtcaccaggctggtctaccaggtagttggggagggtccccagccaaggggccggctctcgtcactgggctctgttttcactgttcgtctgctgtctgtgtcttctatttggcaaacagcaatgatcttccaataaaagatttcagatgctcctctgggctgctgggagggccgttcag

SEQ ID NO: 34734 - DNA, 3012 bp, Homo sapiens
  misc_feature (1613)..(1613): n is a, c, g, or t
  misc_feature (1618)..(1618): n is a, c, g, or t
ggcacgaggccgccacccgagccggagcgggctgggccgccaaggcaagatggtggactacagcgtgtgggaccacattgaggtgtctgatgatgaagacgagacgcaccccaacatcgacacggccagtctcttccgctggcggcatcaggcccgggtggaacgcatggagcagttccagaaggagaaggaggaactggacaggggctgccgcgagtgcaagcgcaaggtggccgagtgccagaggaaactgaaggagctggaggtggccgagggcggcaaggcagagctggagcgcctgcaggccgaggcacagcagctgcgcaaggaggagcggagctgggagcagaagctggaggagatgcgcaagaaggagaagagcatgccctggaacgtggacacgctcagcaaagacggcttcagcaagagcatggtaaataccaagcccgagaagacggaggaggactcagaggaggtgagggagcagaaacacaagaccttcgtggaaaaatacgagaaacagatcaagcactttggcatgcttcgccgctgggatgacagccaaaagtacctgtcagacaacgtccacctggtgtgcgaggagacagccaattacctggtcatttggtgcattgacctagaggtggaggagaaatgtgcactcatggagcaggtggcccaccagacaatcgtcatgcaatttatcctggagctggccaagagcctaaaggtggacccccgggcctgcttccggcagttcttcactaagattaagacagccgatcgccagtacatggagggcttcaacgacgagctggaagccttcaaggagcgtgtgcggggccgtgccaagctgcgcatcgagaaggccatgaaggagtacgaggaggaggagcgcaagaagcggctcggccccggcggcctggaccccgtcgaggtctacgagtccctccctgaggaactccagaagtgcttcgatgtgaaggacgtgcagatgctgcaggacgccatcagcaagatggaccccaccgacgcaaagtaccacatgcagcgctgcattgactctggcctctgggtccccaactctaaggccagcgaggccaaggagggagaggaggcaggtcctggggacccattactggaagctgttcccaagacgggcgatgagaaggatgtcagtgtgtgacctgccccagctaccaccgccacctgcttccaggcccctatgtgccccttttcagaaaacagatagatgccatctcgcccgctcctgacttcctctacttgcgctgctcggcccagcctggggggcccgcccagccctccctggcctctccactgtctccactctccagcgcccattcaagtctctgctttgagtcaaggggcttcactgcctgcagccccccatcagcattatgccaaaggcccgggggtccggggaagggcagaggtcaccaggctggtctaccaggtagttggggagggtccccagccaaggggccggctctcgtcactgggctctgttttcactgttcgtctgctgtctgtgtcttctatttggcaaacagcaatgatcttccaataaaagatttcagatgctcaaaaaaaanaaaanaaaaaaaaaacactgcggagagatataagatctctctcttcttgtctctctcttctgggggcctctccgcgcgcagccgcgggaaatgcgtggcgcccaatatcccggggccctcacgccgcgcgcccaattccgccctgtgacgcgggttaagcccccagagaattttcttttaaactgcacaactctctgtgggaatataatactccacgtgtgaagagaaagaggctttctgaaggcactctcaagtgggccaccactgtgtgtgtgtggcccaatttggggggcggcggggatagtggggacgacagcgtgatagagatatggatggcgcacctgattctcgtgggccacagggagcgtcgcgagagcgtgagcgaagtgaaaaacagactgtgggcgaccaacaagaggagtggcgccccaaacaagcgctgcacatataccccgagttattgcgggacaaacatgtggtgtccagaggggggatattcacaccccaaacccgtgggcgacgcgccacatcgtggggacacatctacaaccgccggcgtgtcgttgcgcgcgagaagaagatgtgtgtaaccccacccgcggtgttagtatatggaggcagaattgggtgacggccaaataattctgcgaagtgtgtgaacacacaacaaattctccggcgggaccacgtgggggtgcgcacacgaaggaggtaaaccaaatggggggcggtgacaatcatcatcaaaggcaaagcccgataaaaacacagatgatatgcgcacacgacgacggcgcaaatcgtctggccgaacaagttagagtgaagactcaccgccgagaaaacccccaacgaggtggggaccatgccggggacgagagaaacaagcccccgagcaacacagtcgatggttgatggacacaccacaaggcgacggcaccacgatgggagcgaccacaaaccgaacacgggtgggtcatcgtgtgacgaaacaagcgcgtggttgtagcaccactacctagggggcgccaaaggggggcgggacagacggcgccaacacaataaagaaagggtgtgtcccctcggggggaaaacgacaatacaacattcgagggaggagtacaaaacacacttgtggcgggtagaacgcagcgagaggagacgcacagaaagagggggactgatcgggcgcgagggagagctggtccgacgacaggagagacggggtggcggtggcaagagtggaagaggctgcccgccggagcagacgccccatttagaaaacatgggggcaccatgtacgtccgggggcgccactgcaagtagtgtggagaaaaccaaccaggagagaaagacgatcccctcggagacagtcggaactacacaccacaggccgcgg

SEQ ID NO: 34735 - DNA, 999 bp, Homo sapiens
ctcgtcatctagaggatcccggcacatctgacctagaggtggaggagaaatgtgcactcatggagcaggtggcccaccagacaatcgtcatgcaatttatcctggagctggccaagagcctaaaggtggacccccgggcctgcttccggcagttcttcactaagattaagacagccgatcgccagtacatggagggcttcaacgacgagctggaagccttcaaggagcgtgtgcggggccgtgccaagctgcgcatcgagaaggccatgaaggagtacgaggaggaggagcgcaagaagcggctcggccccggcggcctggaccccgtcgaggtctacgagtccctccctgaggaactccagaagtgcttcgatgtgaaggacgtgcagatgctgcaggacgccatcagcaagatggaccccaccgacgcaaagtaccacatgcagcgctgcattgactctggcctctgggtccccaactctaaggccagcgaggccaaggagggagaggaggcaggtcctggggacccattactggaagctgttcccaagacgggcgatgagaaggatgtcagtgtgtgacctgccccagctaccaccgccacctgcttccaggcccctatgtgccccttttcagaaaacagatagatgccatctcgcccgctcctgacttcctctacttgcgctgctcggcccagcctggggggcccgcccagccctccctggcctctccactgtctccactctccagcgcccattcaagtctctgctttgagtcaaggggcttcactgcctgcagccccccatcagcattatgccaaaggcccgggggtccggggaagggcagaggtcaccaggctggtctaccaggtagttggggagggtccccagccaaggggccggctctcgtcactgggctctgttttcactgttcgtctgctgtctgtgtcttctatttggcaaacagcaatgatcttccaataaaagatttcagatgctc

SEQ ID NO: 34736 - DNA, 1304 bp, Homo sapiens
ggcacgaggccgccacccgagccggagcgggctgggccgccaaggcaagatggtggactacagcgtgtgggaccacattgaggtgtctgatgatgaagacgagacgcaccccaacatcgacacggccagtctcttccgctggcggcatcaggcccgggtggaacgcatggagcagttccagaaggagaaggaggaactggacaggggctgccgcgagtgcaagcgcaaggtggccgagtgccagaggaaactgaaggagctggaggtggccgagggcggcaaggcagagctggagcgcctgcaggccgaggcacagcagctgcgcaaggaggagcggagctgggagcagaagctggaggagatgcgcaagaaggagaagagcatgccctggaacgtggacacgctcagcaaagacggcttcagcaagagcatggtaaataccaagcccgagaagacggaggaggactcagaggagacagccgatcgccagtacatggagggcttcaacgacgagctggaagccttcaaggagcgtgtgcggggccgtgccaagctgcgcatcgagaaggccatgaaggagtacgaggaggaggagcgcaagaagcggctcggccccggcggcctggaccccgtcgaggtctacgagtccctccctgaggaactccagaagtgcttcgatgtgaaggacgtgcagatgctgcaggacgccatcagcaagatggaccccaccgacgcaaagtaccacatgcagcgctgcattgactctggcctctgggtccccaactctaaggccagcgaggccaaggagggagaggaggcaggtcctggggacccattactggaagctgttcccaagacgggcgatgagaaggatgtcagtgtgtgacctgccccagctaccaccgccacctgcttccaggcccctatgtgccccttttcagaaaacagatagatgccatctcgcccgctcctgacttcctctacttgcgctgctcggcccagcctggggggcccgcccagccctccctggcctctccactgtctccactctccagcgcccattcaagtctctgctttgagtcaaggggcttcactgcctgcagccccccatcagcattatgccaaaggcccgggggtccggggaagggcagaggtcaccaggctggtctaccaggtagttggggagggtccccagccaaggggccggctctcgtcactgggctctgttttcactgttcgtctgctgtctgtgtcttctatttggcaaacagcaatgatcttccaataaaagatttcagatgctc

SEQ ID NO: 34737 - DNA, 1644 bp, Homo sapiens
ggcacgaggccgccacccgagccggagcgggctgggccgccaaggcaagatggtggactacagcgtgtgggaccacattgaggtgtctgatgatgaagacgagacgcaccccaacatcgacacggccagtctcttccgctggcggcatcaggcccgggtggaacgcatggagcagttccagaaggagaaggaggaactggacaggggctgccgcgagtgcaagcgcaaggtggccgagtgccagaggaaactgaaggagctggaggtggccgagggcggcaaggcagagctggagcgcctgcaggccgaggcacagcagctgcgcaaggaggagcggagctgggagcagaagctggaggagatgcgcaagaaggagaagagcatgccctggaacgtggacacgctcagcaaagacggcttcagcaagagcatggtaaataccaagcccgagaagacggaggaggactcagaggaggtgagggagcagaaacacaagaccttcgtggaaaaatacgagaaacagatcaagcactttggcatgcttcgccgctgggatgacagccaaaagtacctgtcagacaacgtccacctggtgtgcgaggagacagccaattacctggtcatttggtgcattgacctagaggtggaggagaaatgtgcactcatggagcaggtggcccaccagacaatcgtcatgcaatttatcctggagctggccaagagcctaaaggtggacccccgggcctgcttccggcagttcttcactaagattaagacagccgatcgccagtacatggagggcttcaacgacgagctggaagccttcaaggagcgtgtgcggggccgtgccaagctgcgcatcgagaaggccatgaaggagtacgaggaggaggagcgcaagaagcggctcggccccggcggcctggaccccgtcgaggtctacgagtccctccctgaggaactccagaagtgcttcgatgtgaaggacgtgcagatgctgcaggacgccatcagcaagatggaccccaccgacgcaaagtaccacatgcagcgctgcattgactctggcctctgggtccccaactctaaggccagcgaggccaaggagggagaggaggcaggtcctggggacccattactggaagctgttcccaagacgggcgatgagaaggatgtcagtgtgtgacctgccccagctaccaccgccacctgcttccaggcccctatgtgccccttttcagaaaacagatagatgccatctcgcccgctcctgacttcctctacttgcgctgctcggcccagcctggggggcccgcccagccctccctggcctctccactgtctccactctccagcgcccattcaagtctctgctttgagtcaaggggcttcactgcctgcgagtgcaagcgcaaggtggccgagtgccagaggaaactgaaggagctggaggtggccgagggcggcaaggcagagctggagcgcctgcaggccgaggcacagcagctgcgcaaggaggaagcggagcctgggagcagaaagctggaggagatgcgcaagaaggagaagagcatgccctggaacgtggacacggctcagcaaagacggcttcagcaagagcatggtaaataccaagcccgagaa

SEQ ID NO: 34738 - DNA, 1550 bp, Homo sapiens
ggcacgaggccgccacccgagccggagcgggctgggccgccaaggcaagatggtggactacagcgtgtgggaccacattgaggtgtctgatgatgaagacgagacgcaccccaacatcgacacggccagtctcttccgctggcggcatcaggcccgggtggaacgcatggagcagttccagaaggagaaggaggaactggacaggggctgccgcgagtgcaagcgcaaggtggccgagtgccagaggaaactgaaggagctggaggtggccgagggcggcaaggcagagctggagcgcctgcaggccgaggcacagcagctgcgcaaggaggagcggagctgggagcagaagctggaggagatgcgcaagaaggagaagagcatgccctggaacgtggacacgctcagcaaagacggcttcagcaagagcatggtaaataccaagcccgagaagacggaggaggactcagaggaggtgagggagcagaaacacaagaccttcgtggaaaaatacgagaaacagatcaagcactttggcatgcttcgccgctgggatgacagccaaaagtacctgtcagacaacgtccacctggtgtgcgaggagacagccaattacctggtcatttggtgcattgacctagaggtggaggagaaatgtgcactcatggagcaggtggcccaccagacaatcgtcatgcaatttatcctggagctggccaagagcctaaaggtggacccccgggcctgcttccggcagttcttcactaagattaagacagccgatcgccagtacatggagggcttcaacgacgagctggaagccttcaaggagcgtgtgcggggccgtgccaagctgcgcatcgagaaggccatgaaggagtacgaggaggaggagcgcaagaagcggctcggccccggcggcctggaccccgtcgaggtctacgagtccctccctgaggaactccagaagtgcttcgatgtgaaggacgtgcagatgctgcaggacgccatcagcaagatggaccccaccgacgcaaagtaccacatgcagcgctgcattgactctggcctctgggtccccaactctaaggccagcgaggccaaggagggagaggaggcaggtcctggggacccattactggaagctgttcccaagacgggcgatgagaaggatgtcagtgtgtgacctgccccagctaccaccgccacctgcttccaggcccctatgtgccccttttcagaaaacagatagatgccatctcgcccgctcctgacttcctctacttgcgctgctcggcccagcctggggggcccgcccagccctccctggcctctccactgtctccaagccccccatcagcattatgccaaaggcccgggggtccggggaagggcagaggtcaccaggctggtctaccaggtagttggggagggtccccagccaaggggccggctctcgtcactgggctctgttttcactgttcgtctgctgtctgtgtcttctatttggcaaacagcaatgatcttccaataaaagatttcagatgctc

SEQ ID NO: 34739 - DNA, 1583 bp, Homo sapiens
ggcacgaggccgccacccgagccggagcgggctgggccgccaaggcaagatggtggactacagcgtgtgggaccacattgaggtgtctgatgatgaagacgagacgcaccccaacatcgacacggccagtctcttccgctggcggcatcaggcccgggtggaacgcatggagcagttccagaaggagaaggaggaactggacaggggctgccgcgagtgcaagcgcaaggtggccgagtgccagaggaaactgaaggagctggaggtggccgagggcggcaaggcagagctggagcgcctgcaggccgaggcacagcagctgcgcaaggaggagcggagctgggagcagaagctggaggagatgcgcaagaaggagaagagcatgccctggaacgtggacacgctcagcaaagacggcttcagcaagagcatggtaaataccaagcccgagaagacggaggaggactcagaggaggtgagggagcagaaacacaagaccttcgtggaaaaatacgagaaacagatcaagcactttggcatgcttcgccgctgggatgacagccaaaagtacctgtcagacaacgtccacctggtgtgcgaggagacagccaattacctggtcatttggtgcattgacctagaggtggaggagaaatgtgcactcatggagcaggtggcccaccagacaatcgtcatgcaatttatcctggagctggccaagagcctaaaggtggacccccgggcctgcttccggcagttcttcactaagattaagacagccgatcgccagtacatggagggcttcaacgacgagctggaagccttcaaggagcgtgtgcggggccgtgccaagctgcgcatcgagaaggccatgaaggagtacgaggaggaggagcgcaagaagcggctcggccccggcggcctggaccccgtcgaggaactccagaagtgcttcgatgtgaaggacgtgcagatgctgcaggacgccatcagcaagatggaccccaccgacgcaaagtaccacatgcagcgctgcattgactctggcctctgggtccccaactctaaggccagcgaggccaaggagggagaggaggcaggtcctggggacccattactggaagctgttcccaagacgggcgatgagaaggatgtcagtgtgtgacctgccccagctaccaccgccacctgcttccaggcccctatgtgccccttttcagaaaacagatagatgccatctcgcccgctcctgacttcctctacttgcgctgctcggcccagcctggggggcccgcccagccctccctggcctctccactgtctccactctccagcgcccattcaagtctctgctttgagtcaaggggcttcactgcctgcagccccccatcagcattatgccaaaggcccgggggtccggggaagggcagaggtcaccaggctggtctaccaggtagttggggagggtccccagccaaggggccggctctcgtcactgggctctgttttcactgttcgtctgctgtctgtgtcttctatttggcaaacagcaatgatcttccaataaaagatttcagatgctc

SEQ ID NO: 34740 - DNA, 1466 bp, Homo sapiens
ggcacgaggccgccacccgagccggagcgggctgggccgccaaggcaagatggtggactacagcgtgtgggaccacattgaggtgtctgatgatgaagacgagacgcaccccaacatcgacacggccagtctcttccgctggcggcatcaggcccgggtggaacgcatggagcagttccagaaggagaaggaggaactggacaggggctgccgcgagtgcaagcgcaaggtggccgagtgccagaggaaactgaaggagctggaggtggccgagggcggcaaggcagagctggagcgcctgcaggccgaggcacagcagctgcgcaaggaggagcggagctgggagcagaagctggaggagatgcgcaagaaggagaagagcatgccctggaacgtggacacgctcagcaaagacggcttcagcaagagcatggtaaataccaagcccgagaagacggaggaggactcagaggaggtgagggagcagaaacacaagaccttcgtggaaaaatacgagaaacagatcaagcactttggcatgcttcgccgctgggatgacagccaaaagtacctgtcagacaacgtccacctggtgtgcgaggagacagccaattacctggtcatttggtgcattgacctagaggtggaggagaaatgtgcactcatggagcaggtggcccaccagacaatcgtcatgcaatttatcctggagctggccaagagcctaaaggtggacccccgggcctgcttccggcagttcttcactaagattaagacagccgatcgccagtacatggagggcttcaacgacgagctggaagccttcaaggagcgtgtgcggggccgtgccaagctgcgcatcgagaaggccatgaaggagtacgaggaggaggagcgcaagaagcggctcggccccggcggcctggaccccgtcgaggtctacgagtccctccctgaggaactccagaagtgcttcgatgtgaaggacgtgcagatgctgcaggacgccatcagcaagatggaccccaccgacgcaaagtaccacatgcagcgctgcattgactctggcctctgggtccccaactctaaggccagcgaggccaaggagggagaggaggcaggtcctggggacccattactggaagctgttcccaagacgggcgatgagaaggatgtcagtgtgtgacctgccccagctaccaccgccacctgcttccaggcccctatgtgccccttttcagaaaacagatagatgccatctcgcccgctcctgacttcctctacttgcgctgctcggcccagccgaagggcagaggtcaccaggctggtctaccaggtagttggggagggtccccagccaaggggccggctctcgtcactgggctctgttttcactgttcgtctgctgtctgtgtcttctatttggcaaacagcaatgatcttccaataaaagatttcagatgctc

SEQ ID NO: 34741 - DNA, 1282 bp, Homo sapiens
ggcacgaggccgccacccgagccggagcgggctgggccgccaaggcaagatggtggactacagcgtgtgggaccacattgaggtgtctgatgatgaagacgagacgcaccccaacatcgacacggccagtctcttccgctggcggcatcaggcccgggtggaacgcatggagcagttccagaaggagaaggaggaactggacaggggctgccgcgagtgcaagcgcaaggtggccgagtgccagaggaaactgaaggagctggaggtggccgagggcggcaaggcagagctggagcgcctgcaggccgaggcacagcagctgcgcaaggaggagcggagctgggagcagaagctggaggagatgcgcaagaaggagaagagcatgccctggaacgtggacacgctcagcaaagacggcttcagcaagagcatggtaaataccaagcccgagaagacggaggaggactcagaggaggtgagggagcagaaacacaagaccttcgtggaaaaatacgagaaacagatcaagcactttggcatgcttcgccgctgggatgacagccaaaagtacctgtcagacaacgtccacctggtgtgcgaggagacagccaattacctggtcatttggtgcattgacctagaggtggaggagaaatgtgcactcatggagcaggtggcccaccagacaatcgtcatgcaatttatcctggagctggccaagagcctaaaggtggacccccgggcctgcttccggcagttcttcactaagattaagacagccgatcgccagtacatggagggcttcaacgacgagctggaagccttcaaggagcgtgtgcggggccgtgccaagctgcgcatcgagaaggccatgaaggagtacgaggaggaggagcgcaagaagcggctcggccccggcggcctggaccccgtcgaggtctacgagtccctccctgaggaactccagaagtgcttcgatgtgaaggacgtgcagatgctgcaggacgccatcagcaagatggaccccaccgacgcaaagtaccacatgcagcgctgcattgactctggcctctgggtccccaactctaaggccagcgaggccaaggagggagaggaggcaggtcctggggacccattactggaagctgttcccaagacgggcgatgagaaggatgtcagtgtgtgacctgccccagctaccaccgccacctgcttccaggcccctatgtgctgtccagctgtccacctcctttgtgctgtcacctcctctgtgctgtcacct

SEQ ID NO: 34742 - DNA, 1451 bp, Homo sapiens
ggcacgaggccgccacccgagccggagcgggctgggccgccaaggcaagatggtggactacagcgtgtgggaccacattgaggtgtctgatgatgaagacgagacgcaccccaacatcgacacggccagtctcttccgctggcggcatcaggcccgggtggaacgcatggagcagttccagaaggagaaggaggaactggacaggggctgccgcgagtgcaagcgcaaggtggccgagtgccagaggaaactgaaggagctggaggtggccgagggcggcaaggcagagctggagcgcctgcaggccgaggcacagcagctgcgcaaggaggagcggagctgggagcagaagctggaggagatgcgcaagaaggagaagagcatgccctggaacgtggacacgctcagcaaagacggcttcagcaagagcatggtaaataccaagcccgagaagacggaggaggactcagaggaggtgagggagcagaaacacaagaccttcgtggaaaaatacgagaaacagatcaagcactttggcatgcttcgccgctgggatgacagccaaaagtacctgtcagacaacgtccacctggtgtgcgaggagacagccaattacctggtcatttggtgcattgacctagaggtggaggagaaatgtgcactcatggagcaggtggcccaccagacaatcgtcatgcaatttatcctggagctggccaagagcctaaaggtggacccccgggcctgcttccggcagttcttcactaagattaagacagccgatcgccagtacatggagggcttcaacgacgagctggaagccttcaaggagcgtgtgcggggccgtgccaagctgcgcatcgagaaggccatgaaggagtacgaggaggaggagcgcaagaagcggctcggccccggcggcctggaccccgtcgaggtctacgagtccctccctgaggaactccagaagtgcttcgatgtgaaggacgtgcagatgctgcaggacgccatcagcaagatggaccccaccgacgcaaagtaccacatgcagcgctgcattgactctggcctctgggtccccaactctaaggccagcgaggccaaggagggagaggaggcaggtcctggggacccattactggaagctgttctggggggcccgcccagccctccctggcctctccactgtctccactctccagcgcccattcaagtctctgctttgagtcaaggggcttcactgcctgcagccccccatcagcattatgccaaaggcccgggggtccggggaagggcagaggtcaccaggctggtctaccaggtagttggggagggtccccagccaaggggccggctctcgtcactgggctctgttttcactgttcgtctgctgtctgtgtcttctatttggcaaacagcaatgatcttccaataaaagatttcagatgctc

SEQ ID NO: 34743 - DNA, 1553 bp, Homo sapiens
ggcacgaggccgccacccgagccggagcgggctgggccgccaaggcaagatggtggactacagcgtgtgggaccacattgaggtgtctgatgatgaagacgagacgcaccccaacatcgacacggccagtctcttccgctggcggcatcaggcccgggtggaacgcatggagcagttccagaaggagaaggaggaactggacaggggctgccgcgagtgcaagcgcaaggtggccgagtgccagaggaaactgaaggagctggaggtggccgagggcggcaaggcagagctggagcgcctgcaggccgaggcacagcagctgcgcaaggaggagcggagctgggagcagaagctggaggagatgcgcaagaaggagaagagcatgccctggaacgtggacacgctcagcaaagacggcttcagcaagagcatggtaaataccaagcccgagaagacggaggaggactcagaggaggtgagggagcagaaacacaagaccttcgtggaaaaatacgagaaacagatcaagcactttggcatgcttcgccgctgggatgacagccaaaagtacctgtcagacaacgtccacctggtgtgcgaggagacagccaattacctggtcatttggtgcattgacctagaggtggaggagaaatgtgcactcatggagcaggtggcccaccagacaatcgtcatgcaatttatcctgaagctgttcccaagacgggcgatgagaaggatgtcagtgtgtgacctgccccagctaccaccgccacctgcttccaggcccctatgtgccccttttcagaaaacagatagatgccatctcgcccgctcctgacttcctctacttgcgctgctcggcccagcctggggggcccgcccagccctccctggcctctccactgtctccactctccagcgcccattcaagtctctgctttgagtcaaggggcttcactgcctgcttccggcagttcttcactaagattaagacagccgatcgccagtacatggagggcttcaacgacgagctggaagccttcaaggagcgtgtgcggggccgtgccaagctgcgcatcgagaaggccatgaaggagtacgaggaggaggagcgcaagaagcggctcggccccggcggcctggaccccgtcgaggtctacgagtccctccctgaggaactccagaagtgcttcgatgtgaaggacgtgcagatgctgcaggacgccatcagcaagatggaccccaccgacgcaaagtaccacatgcagcgctgcattgactctggcctctgggtccccaactctaaggccagcgaggccaaggagggagaggaggcaggtcctggggacccattactggaagctgttcccaagacgggcgatgagaaggaagggcagaggtcaccaggctggtctaccaggtagttggggagggtccccagccaaggggccggctctcgtcactgggctctgttttcactgttcgtctgctgtctgtgtcttctatttggcaaacagcaatgatcttccaataaaagatttcagatgctc

SEQ ID NO: 34744 - DNA, 1268 bp, Homo sapiens
ggcacgaggccgccacccgagccggagcgggctgggccgccaaggcaagatggtggactacagcgtgtgggaccacattgaggtgtctgatgatgaagacgagacgcaccccaacatcgacacggccagtctcttccgctggcggcatcaggcccgggtggaacgcatggagcagttccagaaggagaaggaggaactggacaggggctgccgcgagtgcaagcgcaaggtggccgagtgccagaggaaactgaaggagctggaggtggccgagggcggcaaggcagagctggagcgcctgcaggccgaggcacagcagctgcgcaaggaggagcggagctgggagcagaagctggaggagatgcgcaagaaggagaagagcatgccctggaacgtggacacgctcagcaaagacggcttcagcaagagcatggtaaataccaagcccgagaagacggaggaggactcagaggaggtgagggagcagaaacacaagaccttcgtggaaaaatacgagaaacagatcaagcactttggcatgcttcgccgctgggatgacagccaaaagtacctgtcagacaacgtccacctggtgtgcgaggagacagccaattacctggtcatttggtgcattgacctagaggtggaggagaaatgtgcactcatggagcaggtggcccaccagacaatcgtcatgcaatttatcctggagctggccaagagcctaaaggtggacccccgggcctgcttccggcagttcttcactaagattaagacagccgatcgccagtacatggagggcttcaacgacgagctggaagccttcaaggagcgtgtgcggggccgtgccaagctgcgcatcgagaaggccatgaaggagtacgaggaggaggagcgcaagaagcggctcggccccggcggcctggaccccgtcgaggaactccagaagtgcttcgatgtgaaggacgtgcagatgctgcaggacgccatcagcaagatggaccccaccgacgcaaagtaccacatgcagcgctgcattgactctggcctctgggtccccaactctaaggccagcgaggccaaggagggagaggaggcaggtcctggggacccattactggaagctgttcccaagacgggcgatgagaagggtccccagccaaggggccggctctcgtcactgggctctgttttcactgttcgtctgctgtctgtgtcttctatttggcaaacagcaatgatcttccaataaaagatttcagatgctc

SEQ ID NO: 34745 - DNA, 1578 bp, Homo sapiens
ggcacgaggccgccacccgagccggagcgggctgggccgccaaggcaagatggtggactacagcgtgtgggaccacattgaggtgtctgatgatgaagacgagacgcaccccaacatcgacacggccagtctcttccgctggcggcatcaggcccgggtggaacgcatggagcagttccagaaggagaaggaggaactggacaggggctgccgcgagtgcaagcgcaaggtggccgagtgccagaggaaactgaaggagctggaggtggccgagggcggcaaggcagagctggagcgcctgcaggccgaggcacagcagctgcgcaaggaggagcggagctgggagcagaagctggaggagatgcgcaagaaggagaagagcatgccctggaacgtggacacgctcagcaaagacggcttcagcaagagcatggtaaataccaagcccgagaagacggaggaggactcagaggaggtgagggagcagaaacacaagaccttcgtggaaaaatacgagaaacagatcaagcactttggcatgcttcgccgctgggatgacagccaaaagtacctgtcagacaacgtccacctggtgtgcgaggagacagccaattacctggtcatttggtgcattgacctagaggtggaggagaaatgtgcactcatggagcaggtggcccaccagacaatcgtcatgcaatttatcctgaagctgttcccaagacgggcgatgagaaggatgtcagtgtgtgacctgccccagctaccaccgccacctgcttccaggcccctatgtgccccttttcagaaaacagatagatgccatctcgcccgctcctgacttcctctacttgcgctgctcggcccagcctggggggcccgcccagccctccctggcctctccactgtctccactctccagcgcccattcaagtctctgctttgagtcaaggggcttcactgcctgcagccccccctcagcattatgcctgcttccggcagttcttcactaagattaagacagccgatcgccagtacatggagggcttcaacgacgagctggaagccttcaaggagcgtgtgcggggccgtgccaagctgcgcatcgagaaggccatgaaggagtacgaggaggaggagcgcaagaagcggctcggccccggcggcctggaccccgtcgaggtctacgagtccctccctgaggaactccagaagtgcttcgatgtgaaggacgtgcagatgctgcaggacgccatcagcaagatggaccccaccgacgcaaagtaccacatgcagcgctgcattgactctggcctctgggtccccaactctaaggccagcgaggccaaggagggagaggaggcaggtcctggggacccattactggaagctgttcccaagacgggcgatgagaaggaagggcagaggtcaccaggctggtctaccaggtagttggggagggtccccagccaaggggccggctctcgtcactgggctctgttttcactgttcgtctgctgtctgtgtcttctatttggcaaacagcaatgatcttccaataaaagatttcagatgctc

SEQ ID NO: 34746 - DNA, 1340 bp, Homo sapiens
ggcacgaggccgccacccgagccggagcgggctgggccgccaaggcaagatggtggactacagcgtgtgggaccacattgaggtgtctgatgatgaagacgagacgcaccccaacatcgacacggccagtctcttccgctggcggcatcaggcccgggtggaacgcatggagcagttccagaaggagaaggaggaactggacaggggctgccgcgagtgcaagcgcaaggtggccgagtgccagaggaaactgaaggagctggaggtggccgagggcggcaaggcagagctggagcgcctgcaggccgaggcacagcagctgcgcaaggaggagcggagctgggagcagaagctggaggagatgcgcaagaaggagaagagcatgccctggaacgtggacacgctcagcaaagacggcttcagcaagagcatggtaaataccaagcccgagaagacggaggaggactcagaggaggtgagggagcagaaacacaagaccttcgtggaaaaatacgagaaacagatcaagcactttggcatgcttcgccgctgggatgacagccaaaagtacctgtcagacaacgtccacctggtgtgcgaggagacagccaattacctggtcatttggtgcattgacctagaggtggaggagaaatgtgcactcatggagcaggtggcccaccagacaatcgtcatgcaatttatcctggagctggccaagagcctaaaggtggacccccgggcctgcttccggcagttcttcactaagattaagacagccgatcgccagtacatggagggcttcaacgacgagctggaagccttcaaggagcgtgtgcggggccgtgccaagctgcgcatcgagaaggccatgaaggagtacgaggaggaggagcgcaagaagcggctcggccccggcggcctggaccccgtcgaggtctacgagtccctccctgaggaactccagaagtgcttcgatgtgaaggacgtgcagatgctgcaggacgccatcagcaagatggaccccaccgtgagtaacccccgcgccccatgccttcccggcgggccgtgtgtctcccccagccctgtgtcccaagtctctgaagccggctggtgaaagtgcccctccaaggcttctccaaggagtaaggggggtcgtgtcaccttggcacacacccacatatattgagcacctactgtatcccagtatccagcagataaatgctgagctttgagcgcatgtccttcgtgactgtcactgttactgtgactgagtccagcctcagtttccttatccaaaccacattttctctcaatatcagctcacaaaatgcgtggga

SEQ ID NO: 34747 - DNA, 463 bp, Homo sapiens
cccgcctcggcctcccaaagtgctgggattacaggcgtgagccaccgcgcccggcctagcctctaggatttttaacctgcgtacctggaggaacagggctatccttaccgagattagggagaccaaggacaaggcaggctgggaggtggccatgttgagttagaggtgcccatgcagggacactgaggacatgagtgtctcagatctgcagtagagcagggctcccaagcaggtggtctttggcaaatgccagatgaggtccccggcgggggagcccaggccttggggagcccttcatgtaggtcaggaatagacttggggaaccgtggggcgcctctgaggagctgtggctggagggtcctgggccccccagtccctcctgagcgttgggccaggtccagtgagcactgcccaacccccatagacagccgatcgccagtacatggagggcttcaacgacgag

SEQ ID NO: 34748 - DNA, 241 bp, Homo sapiens
catacacaggtacatacatatagatgtgtgtataaatatatataattacgtgtgcctgtatatatataaaatttataatgaagaattggctcgtgtgattatggagcctaagaagtgccaagatctgcagttggtaggctggagacccaggaaagctgatggtatggttccaaaacaaaagctagcagccttgagacccaagaagaacttatattttagttcaaatctggcaaaaaaaaaa

SEQ ID NO: 34749 - DNA, 353 bp, Homo sapiens
ctacgagtttggaaacaaggctttgtttgttttatattgcaaattagatatatgatttgttggaaagaatataaaattaaatatgaaggtatgtcacatacgcaatgccatatataaaccatactcctttacctttaactcttcagtatataatctttcagacttttttatttgcacatatgaagtatatacattcgtaaagtttttaatttaaaaattgggtcttaacagcatttttgaatagtgaatgtcttcaaaaatatgttgtaaacaatgaggaagtttaaaatgtctaatcacagtcacccactgtttaggttggggggggtattgtccaccccatggggggttcc

SEQ ID NO: 34750 - DNA, 457 bp, Homo sapiens
tcactaacagtgggagggaacctttctcatggctcctgtaataaatttgttttgagtatatgaaaggttcttcaatttgaaatgatacaggaataaatgaatgctatttcttaaaaatgggcttgggctgtaaaaatatgtttaggagttttcagtggtacagggaaatactcaaatgctaattgaagaaaaactaaatgcacaactgtatattaagaaaggaataaaaggaaagatgttcaaaagactaaaagactaacaactgttcatttcagtgatgggatttcagacagtttttcttgtttctttaactttcataagtttgcccactaaaaatatattagcttttagcaagcaacaacaacaacaacaaaaccatcttctggttatatatacttaaagaatttaaaaaaggaaaaacaaaatcaagaaatagggggagaaatgaagatttaaa

SEQ ID NO: 34751 - DNA, 309 bp, Homo sapiens
gtcataagcttcaggtctgacaagactcaaggccaacccgggaggattatattgttcaatctgcatagtaaccttgggaagtcaagggcactttatcccccctaccttacagacaaggacacttagagcacaaaaaagccttccttagatttcttgaaaattctgggccagggccaggcatggtggctcacgcctgtgtaatcccaacactttggcaggccagggcaggtggatcactggaggtaatgagtttgagaccagcctggccaacatggtaaaaccccatctctactaaaaatacaaaaaaaa

SEQ ID NO: 34752 - DNA, 670 bp, Homo sapiens
attttagtagcgtcgacatgggctcagaaatatgagcatttgtttggtttttgcattaccacattgtttacccagaaacaactcctgcttccatgtcagcttacgtataaactattgcatcttgctactgcaggctgtataacaagacagctaagatttgccttcctggcatttatgactgatgtgaacctcctcccggatgtgtctggacatatgcatgggaaatgtcttctttcaggcaacccttattgaaaaccacttcagaagtcccttggggacagagaggaagtggtgggacagagcaatctctgtatgttacttgacacaaaggtccttttagactcctggtccctgttgccaagcagttctatgccctcagcctcagaactaaggactgtgagaacccattccccactctccttgaacccagaatagctatttcaatcttcctgtagttgcctcaatcgtattatggctgaaagaagccaggattcataattttgagccagtaactttacctggtctctcatgctttgtatcattaaacattcactgacactaactttgtgttaaatttaactaatttagaatttcgaaagcataggataaaactttccttctgaattaaagcaaatcttgagattgtaaggcagatgggaaaaaaaaattg

SEQ ID NO: 34753 - DNA, 471 bp, Homo sapiens
gtctgtccttagaatcatcagagcttctattatgtaattctttggagtaaaccctagttaatcagagcatgcatttcactggaggggcagctcagtgagtgatgtgaaggtgtttcctctgagaaacggaaacagttatgaagtgttttgtggtcctttgggagttgaggtgctatagaaatgtaaggcttttattacaactcctgacctactatacagaaccatgctaacatcattgatgattcttttgcataatcaaagaattaaacataaaagtcatattaattttcagcttcattagagatgcaagaatcaaaagagatgtttgccaaatgggaaggcactaaattggtaggagaaagaattttaatttcaagcttcaagtgaatgttataaataacctagcataaaaaagacactaccaaaagcgcctgacaatgtcctttttaaagatcagcaacattaaaaagg

SEQ ID NO: 34754 - DNA, 221 bp, Homo sapiens
tttgttatggcacacaccacttctaggtatcgatttctgtattgtttattgtcacaataatgcagctaaccacaaacacaaagactcaatggcattatggcaataaacatttatttttgctcctaagtctgtggatcatctcaacggttctactgatctagggtggcttggctcatctttgctgggctcacttcatgaatgcacagtcagatggcagattg

SEQ ID NO: 34755 - DNA, 234 bp, Homo sapiens
gcagcccttgagtctgggagaagattctggaaggccccttggaggaggtggcatctgagtggggcagggaaaggaaaggtggtggttagggcagcgctttggagtccctgctttacccctcagccaaggccgtccaacagtctcgggcaagtccacacttttctctatgtttcagtttgatgtggctccttaaatgaaacaatttctctgacagattaaatcagataactcata

SEQ ID NO: 34756 - DNA, 235 bp, Homo sapiens
tttgggtctcatgcagacttgattctggaaactgtaatctcaagggtgacactctcctccctcacttcccttctccaggcatttctgttcttcccatttcttttgcttttgtataaaagacagcacctctgtttggagactttagcttctctgccatgccatgtttgagggctggattgttgctggtggagctcacttgtttttttggtggtggtggtggttttgttgttgttgt

SEQ ID NO: 34757 - DNA, 377 bp, Homo sapiens
ttataattggcaacaaccaaatagagcttttaatagtgttaaaaggctgctgggttctgtcccaggttaaagcaacatacgatatgaaatacccgtaaatgaactggaaaatggcatccagttccctttctcctgtaagtggaactgtcaggtctgtattagcattcaaaaactttacgataagaacatcctaaagtaaaaatatatttgatgctagttactgatgaggaataattgtggaggatgatcttctttacaaaattccctttctcctataagtgaaattgtcaggtctgtatgagcattcaaaaactttaggataagaatatcctactgtgaaaatttttttgatgatagttactgataaagagtaatta

SEQ ID NO: 34758 - DNA, 103 bp, Homo sapiens
acccagccaaaccagcaagcacatttaaaacctctgctcacctcacattcacttacattctgttggccaaaagaagccaagcattccatcactgtacaaagca

SEQ ID NO: 34759 - DNA, 393 bp, Homo sapiens
aagtttgaagcagaatctatgattgatgtcagataccagatagataacaaaaagatgataagatgataacaaaaatggtatttaaattagtgcttaccaagtactttagatcatttactcttcccaaaaattctatgagctagttactattttatatgcactttttaggtgagatagctaaagtagaggagattaggtaactgtcagtctgattccagaacctaaagttctattaattacaaaatgctgcttctcaagttcaaaactacaaacattccctttgtcttaaatagatgttttctaaccttttgaaggccttgtcatacatgtgacctctaactaggaacatcttcattctagccatctataccttttttccatgtttctctcctc

SEQ ID NO: 34760 - DNA, 652 bp, Homo sapiens
aaccaaaacatctaaaaatctttagctcattttataatgattaatcccttgaagaggaagagaatagatctttatataaaggcctagagacagataatcattcagtcatagatcatttctttttcaggttaaaggccttggatttttttaatttaaaaaaagagattgcactttcagccataattttttttatgtgtgcttgtgttgtcccatttctcagtactttttccccaaatttactggcacaacactcagataaggaactgactaatgtggcttattgatgccatccttctgtttttcaatcaggatcacattacttttatgtaatcccatacaatgtacttcttaaactaggtggacaagagcagggttgttccccccaccaccccccaacccacccctcacctgccgccattctatgattccagggctggctggcagggaaaataccagaaatgacacatagatttgtcctttttatattttatttgcaggattggtttatattttatcgatcttaaatacaacatttggaccacaatttaaaatgggctatgcaaatattatatcttgttttttttgtttgtttgttttgttttgctttgctttaattcccaatgcacagattgggccttctcataaaaaaaaa

SEQ ID NO: 34761 - DNA, 403 bp, Homo sapiens
tgtttttgtgtatttgtttgtggggaagggtaagtgtttttgaagaaaagtgggaaaaaatgccaatatctaagagaggtttgctactgagaaactgttaaggagtggtgagagattaaattcttaatagtcttgtggcttgtgcaagagctactattactcttttcataagtttataaacaggcaagctgcatagtactttttaaattttatttatgtattttttttttgagatggagtatcgctctgtcacccaggctaaagtgcagtggcgccatctcagcttactgcagcctctgtccccacaggagaattgcttgaacctgggaggcagaggttgcagtcagccaaagtggtgccactgtactccagcctgggcaacagagcgagactcagtctctcc

SEQ ID NO: 34762 - DNA, 365 bp, Homo sapiens
tggaaacggagcctcactctgtctcacccaggctggagtgcaattgtgcaatctcggctcactgcaacctccgcctctcaggttcaagcgattctcctgtctcagcctcccaactagctggtactacaggctgcactgccatatctggctaattttgtgtttttaatagagatggggttttttaccatgttggccaggctggtctcaaattcctgacctcaggccttggcctcccaaagtgctggaattacagacatgagcctctgcgcccggcccctaatgcattttctaaccccgtcttctccattcctaggaagggatttcattggtccaggccttaagaaggggaagcatgactggagttt

SEQ ID NO: 34763 - DNA, 881 bp, Homo sapiens
ggcaatcagaagcccaaactgcctttgagtctaagatgtgatgactttgatgaaacacaactgaaaacatgagggactatatccagtcacttgtagccagtttcacaggccagctacagaattgtccaaacaaacattatttctgactgcaatttttttcccccaaatttaaagcaatccctggctttaaatgacaaggcacctaccaatgttcttgggtcactgaagaagctactaccatgagcctgggcatagaattttaggagataaaaggatgaatttctgtgactgccagtcagatcttaacaggtttctgttgagccagaatctgtttcagatccaagatggagaggaacactatggaaacttcccaggtgactttcagagcagttgtttcaaacacatcattgtccttttaggggaaccagtttttagaaggttgtgaattggctttttcacaaagcatgattatcttcctggctgatccaggagaaaattagaacagaaaaataatggttgtggattttgaaacaaagcaaggtaaagcctttttttttttcaccttgcattggcaaaactacctcttcagtgtttttaacttttgattcaaaagcatcttaccaataaggataaatatcatatacatcgttatgaaaatattgctatgagataataagccacatatgaatgttgtatacaactttagggtttacatttaatcctgaagtgttacctcctttcatgtctatttacactattttcccatttactaagtggggagggggtctccttatatagtgcttcatcgttaataagtcaatacctgttgttcctgggatgttcttttttgtgcattaaaaacttcaaaattattttttgtg

SEQ ID NO: 34764 - DNA, 378 bp, Homo sapiens
tttttttgagacaaggttatgctctgttgcccaggctggagtgcaatgacccaatcatagttcactgcagcctcctgggctcaaggaatcctcccacttcagcctcccaagtagctgggactacagtcatgtgccaccacacccagccagattttttttaaagagatgggggtctcactatgttgcccaggctggtatcaaactcctcagctcaagagatcctcccaccacagcctcccaaagtgccagaattataggcatgagccaccatgcgcaggccacgtcctatctcatacattgtcttcaacaaaacttaaggtgttttaataactttatgcatttattcaggctgttacgtctcctactccaccagtaaac

SEQ ID NO: 34765 - DNA, 194 bp, Homo sapiens
taaaaatatcttaattacagattggttaaataaatcaaagcatagccatatattggaatattctgcagttatttaaaaatcgtgcattaaaagaattttcacttatgttggaaatttttaattagcatacaaaatcacatgtgtaacagaatttcaggttcattaaaatatagatatatgtatatcaagaaagt

SEQ ID NO: 34766 - DNA, 330 bp, Homo sapiens
taatgagcagcattcttggctttaatcagttttcccattagtatttcaagtgacctttggtctttacacatccgcagagtaagatggaattgtgctaagcacatattatcatttttattggcatcatttctagattctagaaggcccactgccagcaaacactggtgacctctgtttgcctttacaagtacaacctgatcgagagcaggttcgctgggccctttttaaaaaataaaacttatctattaaattcaagatatcattgcatattgaacaatgtgacttatataaaatagcaagtctcaaggtcagagaattgtttctaataga

SEQ ID NO: 34767 - DNA, 792 bp, Homo sapiens
tagagagggagaggaggaaggaagggaggaacacagagagagcttgtgtgtcaggggcaccatttcaacccgagttcccagtgctggaacagcatcacactgggaaacgttccattttctctctggagctggtgtgcttgacctctctggagcaaacgcctttccggatactccctgtgacacgcactgtctatgctggccagagagcaggctttcactcctgtgggctgctgaggccaggtctccaaggcctgtgtgggcgaggggtgcacagccccgtctggcttgaatgctcaggcagcaccttgtctggagaagcaatgtcttcccaatagtgacagaggctctacctgcctcttattaggtattgatgtgtcaatgtcatggcaggcaggtgactagggcagggttggggccgtgctggctcctggttctggctcatggggacctcaggagccctctctccagctgactgaggcctcgcctgcacgcctggccgtcccagcccattggtaccggatttctctacagctggggattgggtaggtcctggagctgcccagaaactccagggaactgtcattctccttccttggaactggacaaccttggagaggggctctgggaggcccagaacctctggcaggagctgggtagtgcctggggttgagggtgggtcttcccattcactgagtgccttgatgtccttgctccttagcttcccaaattccctccggaacttactgagctccttctaagctttgccttggcctgaactggttctggggaaaa

SEQ ID NO: 34768 - DNA, 402 bp, Homo sapiens
gcactatatagctcccatgttccaacctctgcattttacagaggatgaaatcagggcccagagaagcaaaaggacttggccaaggtcacaccactaggaggtgacaaggccagctccagtttccttcctttccagggctatgctcctcccactctgccacactgacatttctgacatttttctttcccttgtttcagatgtcctggtacgtgtttcaatttaacgggtaatcaggcatcgctctctaccgaggatcccctgaggaccccagcttcatccagccgcctgtcagagaaacccaggaagctttgccaggcagcagagtgggaggatttcccagagggagcatcagacttaatggcccctccagccagggtcaagtcctcctgaaagccattaaca

SEQ ID NO: 34769 - DNA, 391 bp, Homo sapiens
ttttgagacgagtctcactctgtcgccccaggctggaagtgcaagtggtgcgacctcctgcctcacctgcaacctctgctgccccaggttcaagtgatcctcctgcctcagccccctagtagctgggattacaggtgcgtgctacctcacccagctaatttttgtagttttagtagagatggggtttcatcatcttggcccagggtagtcttgaactcctgacctcgtgatccacctgcctcagccacccaaagtgctgggattacaggcgtgagccaccacacgtggccagttttgttaatttttaaagaaatcttacacttagaaaaaatgcttaatttgtagttattacaaagggtgatgcatgtccattttgaaaatgtgtgaaact

SEQ ID NO: 34770 - DNA, 493 bp, Homo sapiens
agcttcatatctctccacctcaccccaaacccgtgttaattagcccttcttgcttaaatcaaatcaccttgttgaaatttaatgctgtgactagcaatgtattctttgaccatatccttgtttccagcaacaaatactgccacgttaaggggagaaggaagtgatggatagagggaccagttggcagattgggacacacgtacaaacactattcctttaacttgctttctttagatccgtagttcctacctgtgagtctcatttctgtattgatctgcattggctaagcatacgactaaagtgggattctttgtcttttcttcagtgagctagccaggaatctcagaaaaagggcaaagaagtccagaatgatgtaatgctgcaaaaaatgttactgctgtttctaaggggagtggaagaaacccaagccagttttgagttgagtgtgcttcctgttggaagggggtgagaattcagagatgtatacctatta

SEQ ID NO: 34771 - DNA, 146 bp, Homo sapiens
catactgtgctgagtttctaccatccctctagaggctgcagtgctgtccattaaacaacgggcctccttcaagatcaaggatgccaaatgccgtttgcacctgcgaaacaaaggcaaaacagaggaggctggcagaatcacagggc

SEQ ID NO: 34772 - DNA, 460 bp, Homo sapiens
tattaacaaattttgtagcagatggaagtttaaacaggataacgtatatactttttccttacttgtgtgtaagaagtgtcagatggcttatttaaaattgattacttgataaatttaatcttttgtgaactgcagtggcaaattgctatcaagttattgcattttacatagttgaagttgtgaacaattgttaagaacaacaaatgatgactaggatcattatcttttcttacacacaaaggtcccatcttttagcacttttctgttctagatgtgaatgtaaaatgatgtgagatctaagaatggaactgaaagattgaaaagttctttcttctgcccctttgggcatgaaaacaatgaagcagctgttgagcataactcaggactgccttcccctctctgactttcaacatcctatcttcatgtttttaactatttagtcataaaagagtgcatcaga

SEQ ID NO: 34773 - DNA, 1530 bp, Homo sapiens
cggggcggaagggcccgggtctgctgcggacggggcggggcggagcctcctcctgcacgggggagcccccgggctcgccccagctcagacactcctagccttggggcagctgccgggcgagtcagcggagtagcggccagcgggcgatggagacagagagacacccgacgagaggaggcggggtgggggaggcggggagagtgcgggggcggaggctggcagggggcgctggaagctggagcggtccgtgcgctccccgcgcccgagggtgcaggaggctctgaagcggctgctgcaccgcggggcccaggcggcggctggggggctggggggcgctgccgccgccgccgccgggggcgtcgctggcctcggcccctttgttctcgcgcgctccccctcgccgcccactcccctgctgtcgcgcggcggcggcggtggcggcggcggctcctcccgcccgaggcagtcgggctcggcgccgggggcgggagggggcggggggagcacgccagccgccgagagtggggggcgatggcgaagctccgggtggcttacgagtacacggaagccgaggacaagagcatccggctcggcttgtttctcatcatctccggcgtcgtgtcgctcttcatcttcggcttctgctggctgagtcccgcgctgcaggatctgcaagccacggaggccaattgcacggtgctgtcggtgcagcagatcggcgaggtgttcgagtgcaccttcacctgtggcgccgactgcaggggcacctcgcagtacccctgcgtccaggtctacgtgaacaactctgagtccaactctagggcgctgctgcacagcgacgagcaccagctcctgaccaaccccaagtgctcctatatccctccctgtaagagagaaaatcagaagaatttggaaagtgtcatgaattggcaacagtactggaaagatgagattggttcccagccatttacttgctattttaatcaacatcaaagaccagatgatgtgcttctgcatcgcactcatgatgagattgtcctcctgcattgcttcctctggcccctggtgacatttgtggtgggcgttctcattgtggtcctgaccatctgtgccaagagcttggcggtcaaggcggaagccatgaagaagcgcaagttctcttaaaggggaaggaggcttgtagaaagcaaagtacagaagctgtactcatcggcacgcgtccacctgcggaacctgtgtttcctggcgcaggagatggacagggccacgacagggctctgagaggctcatccctcagtggcaacagaaacaggcacaactggaagacttggaacctcaaagcttgtattccatctgctgtagcaatggctaaagggtcaagatcttagctgtatggagtaactatttcagaaaaccctataagaagttcattttctttcaaaagtaacagtatattatttgtacagtgtagtatacaaaccattatgatttatgctacttaaaaatattaaaatagagtggtctgtgtta

SEQ ID NO: 34774 - DNA, 502 bp, Homo sapiens
ccatttacttgttattttaatcaacatcaaggaccagatgatgtgcttatgcatcgcactcattgtggtcctgaccatctgtgccaagagcttggcggtcaaggcggaagccatgaagaagcgcaagttctcttaaaggggaaggaggcttgtagaaagcaaagtacagaagctgtactcatcggcacgcgtccacctgcggaacctgtgtttcctggcgcaggagatggacagggccacgacagggctctgagaggctcatccctcagtggcaacagaaacaggcacaactggaagacttggaacctcaaagcttgtattccatctgctgtagcaatggctaaagggtcaagatcttagctgtatggagtaactatttcagaaaaccctataagaagttcattttctttcaaaagtaacagtatattatttgtacagtgtagtatacaaaccattatgatttatgctacttaaaaatattaaaatagagtggtctgtgtta

SEQ ID NO: 34775 - DNA, 2473 bp, Homo sapiens
  misc_feature (1918)..(1918): n is a, c, g, or t
  misc_feature (1940)..(1940): n is a, c, g, or t
  misc_feature (1946)..(1951): n is a, c, g, or t
  misc_feature (1962)..(1963): n is a, c, g, or t
  misc_feature (1974)..(1974): n is a, c, g, or t
  misc_feature (1981)..(1982): n is a, c, g, or t
cggggcggaagggcccgggtctgctgcggacggggcggggcggagcctcctcctgcacgggggagcccccgggctcgccccagctcagacactcctagccttggggcagctgccgggcgagtcagcggagtagcggccagcgggcgatggagacagagagacacccgacgagaggaggcggggtgggggaggcggggagagtgcgggggcggaggctggcagggggcgctggaagctggagcggtccgtgcgctccccgcgcccgagggtgcaggaggctctgaagcggctgctgcaccgcggggcccaggcggcggctggggggctggggggcgctgccgccgccgccgccgggggcgtcgctggcctcggcccctttgttctcgcgcgctccccctcgccgcccactcccctgctgtcgcgcggcggcggcggtggcggcggcggctcctcccgcccgaggcagtcgggctcggcgccgggggcgggagggggcggggggagcacgccagccgccgagagtggggggcgatggcgaagctccgggtggcttacgagtacacggaagccgaggacaagagcatccggctcggcttgtttctcatcatctccggcgtcgtgtcgctcttcatcttcggcttctgctggctgagtcccgcgctgcaggatctgcaagccacggaggccaattgcacggtgctgtcggtgcagcagatcggcgaggtgttcgagtgcaccttcacctgtggcgccgactgcaggggcacctcgcagtacccctgcgtccaggtctacgtgaacaactctgagtccaactctagggcgctgctgcacagcgacgagcaccagctcctgaccaaccccaagtgctcctatatccctccctgtaagagagaaaatcagaagaatttggaaagtgtcatgaattggcaacagtactggaaagatgagattggttcccagccatttacttgctattttaatcaacatcaaagaccagatgatgtgcttctgcatcgcactcatgatgagattgtcctcctgcattgcttcctctggcccctggtgacatttgtggtgggcgttctcattgtggtcctgaccatctgtgccaagagcttggcggtcaaggcggaagccatgaagaagcgcaagttctcttaaaggggaaggaggcttgtagaaagcaaagtacagaagctgtactcatcggcacgcgtccacctgcggaacctgtgtttcctggcgcaggagatggacagggccacgacagggctctgagaggctcatccctcagtggcaacagaaacaggcacaactggaagacttggaacctcaaagcttgtattccatctgctgtagcaatggctaaagggtcaagatcttagctgtatggagtaactatttcagaaaaccctataagaagttcattttctttcaaaagtaacagtatattatttgtacagtgtagtatacaaaccattatgatttatgctacttaaaaatattaaaatagagtggtctgtgttattttctatttccttttttatgcttagaacaccagggtttaaaaaaaaaaaaaaggtgaggacatctgggtctcatttgcttctgctaggttaaacttttacttgacaacaaggattcctgctgaagtctgaaccttactgtgtaaccctcagtttccactattaaagagtatcttttgacgtctgcttggaaaatgaatagtatactggtaactcagtctccagtcacctctgtgtctcttaagcaagagattctaaaagattgggaaaacatatcctccaacacctgcctttgcctaaccattatttttcaccagattacttcttaagagagggaggtgattctgaagaaggcttctatctcaaaaagcactgggcccccccacccncccgcccccgccgcccccgacngagccnnnnnngcccgcgcccnnccccacacaancgacgcnncccccccccccccgcccccccccccgctgttttcatttttttttttttttgtaggtcagaaaaaaacaacaaaatcagttcaagcatttttttttctttgtccttgccttgatgttatgagtattaaaaccaggaggattgctgccattgtgcagtttgcttagacaaacctggagatgcaacccagctcacatcattgctactgatgagctttctgtgcctttatcaaaagttgattgagaagaccatatttctttgtatctttttataaactcaaattccaagtatcaaatcgcaggtctcagtgaacatcaaacctatttactacatagaatcaaacctttgtttaggtgagatgtacatcgttagtggaggaaaaactgacaacctaatttcatttgttttcttctgatactcttcagacatgcctctattagaataaaggtaaactggaatttaaagacaagttcccctcagttatttccatggag

SEQ ID NO: 34776 - DNA, 2473 bp, Homo sapiens
cggggcggaagggcccgggtctgctgcggacggggcggggcggagcctcctcctgcacgggggagcccccgggctcgccccagctcagacactcctagccttggggcagctgccgggcgagtcagcggagtagcggccagcgggcgatggagacagagagacacccgacgagaggaggcggggtgggggaggcggggagagtgcgggggcggaggctggcagggggcgctggaagctggagcggtccgtgcgctccccgcgcccgagggtgcaggaggctctgaagcggctgctgcaccgcggggcccaggcggcggctggggggctggggggcgctgccgccgccgccgccgggggcgtcgctggcctcggcccctttgttctcgcgcgctccccctcgccgcccactcccctgctgtcgcgcggcggcggcggtggcggcggcggctcctcccgcccgaggcagtcgggctcggcgccgggggcgggagggggcggggggagcacgccagccgccgagagtggggggcgatggcgaagctccgggtggcttacgagtacacggaagccgaggacaagagcatccggctcggcttgtttctcatcatctccggcgtcgtgtcgctcttcatcttcggcttctgctggctgagtcccgcgctgcaggatctgcaagccacggaggccaattgcacggtgctgtcggtgcagcagatcggcgaggtgttcgagtgcaccttcacctgtggcgccgactgcaggggcacctcgcagtacccctgcgtccaggtctacgtgaacaactctgagtccaactctagggcgctgctgcacagcgacgagcaccagctcctgaccaaccccaagtgctcctatatccctccctgtaagagagaaaatcagaagaatttggaaagtgtcatgaattggcaacagtactggaaagatgagattggttcccagccatttacttgctattttaatcaacatcaaagaccagatgatgtgcttctgcatcgcactcatgatgagattgtcctcctgcattgcttcctctggcccctggtgacatttgtggtgggcgttctcattgtggtcctgaccatctgtgccaagagcttggcggtcaaggcggaagccatgaagaagcgcaagttctcttaaaggggaaggaggcttgtagaaagcaaagtacagaagctgtactcatcggcacgcgtccacctgcggaacctgtgtttcctggcgcaggagatggacagggccacgacagggctctgagaggctcatccctcagtggcaacagaaacaggcacaactggaagacttggaacctcaaagcttgtattccatctgctgtagcaatggctaaagggtcaagatcttagctgtatggagtaactatttcagaaaaccctataagaagttcattttctttcaaaagtaacagtatattatttgtacagtgtagtatacaaaccattatgatttatgctacttaaaaatattaaaatagagtggtctgtgttattttctatttccttttttatgcttagaacaccagggtttaaaaaaaaaaaaaaggtgaggacatctgggtctcatttgcttctgctaggttaaacttttacttgacaacaaggattcctgctgaagtctgaaccttactgtgtaaccctcagtttccactattaaagagtatcttttgacgtctgcttggaaaatgaatagtatactggtaactcagtctccagtcacctctgtgtctcttaagcaagagattctaaaagattgggaaaacatatcctccaacacctgcctttgcctaaccattatttttcaccagattacttcttaagagagggaggtgattctgaagaaggcttctatctcaaaaagcactgggcttccttattcatctgttcttgttgtttttgacggagttaaaaaagtttgtgtgcaatacaatataaatgatgtgaaggacactcttcagcttagtgaaacgctgttttcatttttttttttttttgtaggtcagaaaaaaacaacaaaatcagttcaagcatttttttttctttgtccttgccttgatgttatgagtattaaaaccaggaggattgctgccattgtgcagtttgcttagacaaacctggagatgcaacccagctcacatcattgctactgatgagctttctgtgcctttatcaaaagttgattgagaagaccatatttctttgtatctttttataaactcaaattccaagtatcaaatcgcaggtctcagtgaacatcaaacctatttactacatagaatcaaacctttgtttaggtgagatgtacatcgttagtggaggaaaaactgacaacctaatttcatttgttttcttctgatactcttcagacatgcctctattagaataaaggtaaactggaatttaaagacaagttcccctcagttatttccatggag

SEQ ID NO: 34777 - DNA, 2007 bp, Homo sapiens
cggggcggaagggcccgggtctgctgcggacggggcggggcggagcctcctcctgcacgggggagcccccgggctcgccccagctcagacactcctagccttggggcagctgccgggcgagtcagcggagtagcggccagcgggcgatggagacagagagacacccgacgagaggaggcggggtgggggaggcggggagagtgcgggggcggaggctggcagggggcgctggaagctggagcggtccgtgcgctccccgcgcccgagggtgcaggaggctctgaagcggctgctgcaccgcggggcccaggcggcggctggggggctggggggcgctgccgccgccgccgccgggggcgtcgctggcctcggcccctttgttctcgcgcgctccccctcgccgcccactcccctgctgtcgcgcggcggcggcggtggcggcggcggctcctcccgcccgaggcagtcgggctcggcgccgggggcgggagggggcggggggagcacgccagccgccgagagtggggggcgatggcgaagctccgggtggcttacgagtacacggaagccgaggacaagagcatccggctcggcttgtttctcatcatctccggcgtcgtgtcgctcttcatcttcggcttctgctggctgagtcccgcgctgcaggatctgcaagccacggaggccaattgcacggtgctgtcggtgcagcagatcggcgaggtgttcgagtgcaccttcacctgtggcgccgactgcaggggcacctcgcagtacccctgcgtccaggtctacgtgaacaactctgagtccaactctagggcgctgctgcacagcgacgagcaccagctcctgaccaaccccaagtgctcctatatccctccctgtaagagagaaaatcagaagaatttggaaagtgtcatgaattggcaacagtactggaaagatgagattggttcccagccatttacttgctattttaatcaacatcaaagaccagatgatgtgcttctgcatcgcactcatgatgagattgtcctcctgcattgcttcctctggcccctggtgacatttgtggtgggcgttctcattgtggtcctgaccatctgtgccaagagcttggcggtcaaggcggaagccatgaagaagcgcaagttctcttaaaggggaaggaggcttgtagaaagcaaagtacagaagctgtactcatcggcacgcgtccacctgcggaacctgtgtttcctggcgcaggagatggacagggccacgacagggctctgagaggctcatccctcagtggcaacagaaacaggcacaactggaagacttggaacctcaaagcttgtattccatctgctgtagcaatggctaaagggtcaagatcttagctgtatggagtaactatttcagaaaaccctataagaagttcattttctttcaaaagtaacagtatattatttgtacagtgtagtatacaaaccattatgatttatgctacttaaaaatattaaaatagagtggtctgtgttattttctatttccttttttatgcttagaacaccagggtttaaaaaaaaaaaaaaggtgaggacatctgggtctcatttgcttctgctaggttaaacttttacttgacaacaaggattcctgctgaagtctgaaccttactgtgtaaccctcagtttccactattaaagagtatcttttgacgtctgcttggaaaatgaatagtatactggtaactcagtctccagtcacctctgtgtctcttaagcaagagattctaaaagattgggaaaacatatcctccaacacctgcctttgcctaaccattatttttcaccagattacttcttaagagagggaggtgattctgaagaaggcttctatctcaaaaagcactgggcttccttattcatctgttcttgttgtttttgacggagttaaaaaagtttgtgtgcaatacaatataaatgatgtgaaggacactcttcagcttagtgaaac

SEQ ID NO: 34778 - DNA, 2001 bp, Homo sapiens
  misc_feature (1446)..(1446): n is a, c, g, or t
  misc_feature (1468)..(1468): n is a, c, g, or t
  misc_feature (1474)..(1479): n is a, c, g, or t
  misc_feature (1490)..(1491): n is a, c, g, or t
  misc_feature (1502)..(1502): n is a, c, g, or t
  misc_feature (1509)..(1510): n is a, c, g, or t
tggtagtaagttctatagagcaaaaacaagtttaaagaaggaggttggggtggggggcgatggcgaagctccgggtggcttacgagtacacggaagccgaggacaagagcatccggctcggcttgtttctcatcatctccggcgtcgtgtcgctcttcatcttcggcttctgctggctgagtcccgcgctgcaggatctgcaagccacggaggccaattgcacggtgctgtcggtgcagcagatcggcgaggtgttcgagtgcaccttcacctgtggcgccgactgcaggggcacctcgcagtacccctgcgtccaggtctacgtgaacaactctgagtccaactctagggcgctgctgcacagcgacgagcaccagctcctgaccaaccccaagtgctcctatatccctccctgtaagagagaaaatcagaagaatttggaaagtgtcatgaattggcaacagtactggaaagatgagattggttcccagccatttacttgctattttaatcaacatcaaagaccagatgatgtgcttctgcatcgcactcatgatgagattgtcctcctgcattgcttcctctggcccctggtgacatttgtggtgggcgttctcattgtggtcctgaccatctgtgccaagagcttggcggtcaaggcggaagccatgaagaagcgcaagttctcttaaaggggaaggaggcttgtagaaagcaaagtacagaagctgtactcatcggcacgcgtccacctgcggaacctgtgtttcctggcgcaggagatggacagggccacgacagggctctgagaggctcatccctcagtggcaacagaaacaggcacaactggaagacttggaacctcaaagcttgtattccatctgctgtagcaatggctaaagggtcaagatcttagctgtatggagtaactatttcagaaaaccctataagaagttcattttctttcaaaagtaacagtatattatttgtacagtgtagtatacaaaccattatgatttatgctacttaaaaatattaaaatagagtggtctgtgttattttctatttccttttttatgcttagaacaccagggtttaaaaaaaaaaaaaaggtgaggacatctgggtctcatttgcttctgctaggttaaacttttacttgacaacaaggattcctgctgaagtctgaaccttactgtgtaaccctcagtttccactattaaagagtatcttttgacgtctgcttggaaaatgaatagtatactggtaactcagtctccagtcacctctgtgtctcttaagcaagagattctaaaagattgggaaaacatatcctccaacacctgcctttgcctaaccattatttttcaccagattacttcttaagagagggaggtgattctgaagaaggcttctatctcaaaaagcactgggcccccccacccncccgcccccgccgcccccgacngagccnnnnnngcccgcgcccnnccccacacaancgacgcnncccccccccccccgcccccccccccgctgttttcatttttttttttttttgtaggtcagaaaaaaacaacaaaatcagttcaagcatttttttttctttgtccttgccttgatgttatgagtattaaaaccaggaggattgctgccattgtgcagtttgcttagacaaacctggagatgcaacccagctcacatcattgctactgatgagctttctgtgcctttatcaaaagttgattgagaagaccatatttctttgtatctttttataaactcaaattccaagtatcaaatcgcaggtctcagtgaacatcaaacctatttactacatagaatcaaacctttgtttaggtgagatgtacatcgttagtggaggaaaaactgacaacctaatttcatttgttttcttctgatactcttcagacatgcctctattagaataaaggtaaactggaatttaaagacaagttcccctcagttatttccatggag

SEQ ID NO: 34779 - DNA, 1673 bp, Homo sapiens
cggggcggaagggcccgggtctgctgcggacggggcggggcggagcctcctcctgcacgggggagcccccgggctcgccccagctcagacactcctagccttggggcagctgccgggcgagtcagcggagtagcggccagcgggcgatggagacagagagacacccgacgagaggaggcggggtgggggaggcggggagagtgcgggggcggaggctggcagggggcgctggaagctggagcggtccgtgcgctccccgcgcccgagggtgcaggaggctctgaagcggctgctgcaccgcggggcccaggcggcggctggggggctggggggcgctgccgccgccgccgccgggggcgtcgctggcctcggcccctttgttctcgcgcgctccccctcgccgcccactcccctgctgtcgcgcggcggcggcggtggcggcggcggctcctcccgcccgaggcagtcgggctcggcgccgggggcgggagggggcggggggagcacgccagccgccgagagtggggggcgatggcgaagctccgggtggcttacgagtacacggaagccgaggacaagagcatccggctcggcttgtttctcatcatctccggcgtcgtgtcgctcttcatcttcggcttctgctggctgagtcccgcgctgcaggatctgcaagccacggaggccaattgcacggtgctgtcggtgcagcagatcggcgaggtgttcgagtgcaccttcacctgtggcgccgactgcaggggcacctcgcagtacccctgcgtccaggtctacgtgaacaactctgagtccaactctagggcgctgctgcacagcgacgagcaccagctcctgaccaaccccaagtgctcctatatccctccctgtaagagagaaaatcagaagaatttggaaagtgtcatgaattggcaacagtactggaaagatgagattggttcccagccatttacttgctattttaatcaacatcaaaggtcttgatgattacccctctttatttctgagaactcaggaagcatctccggcaggggttatccttaataggcccccgatctcagggttttaagaatcacattgggaaaaccgacagatggataaaaaataattaccacacagtaccagatgatgtgcttctgcatcgcactcatgatgagattgtcctcctgcattgcttcctctggcccctggtgacatttgtggtgggcgttctcattgtggtcctgaccatctgtgccaagagcttggcggtcaaggcggaagccatgaagaagcgcaagttctcttaaaggggaaggaggcttgtagaaagcaaagtacagaagctgtactcatcggcacgcgtccacctgcggaacctgtgtttcctggcgcaggagatggacagggccacgacagggctctgagaggctcatccctcagtggcaacagaaacaggcacaactggaagacttggaacctcaaagcttgtattccatctgctgtagcaatggctaaagggtcaagatcttagctgtatggagtaactatttcagaaaaccctataagaagttcattttctttcaaaagtaacagtatattatttgtacagtgtagtatacaaaccattatgatttatgctacttaaaaatattaaaatagagtggtctgtgtta

SEQ ID NO: 34780 - DNA, 403 bp, Homo sapiens
  misc_feature (358)..(358): n is a, c, g, or t
atcaggctcctgtttgagaaaatgtgattctccttctggggccaggcaagacacttagggatggctcaggaagaaaagtgggaggtgagacaaacaaaagaagccttgcagattggagcagagaagagaagaaagaggctgaacagagtgaacacaggtcttgtttccagtggagctttttcttctgcatagggacagttttggggactctgcagctgatttcagggaaggtgattcattgaagaccctgttataccctgagcaagttcatcattctatcctcttactccataacattctctgaggcttgcaattccaaaacaagggcaggagttcaaggctgcggtgagctacgatntggccactgcactccagcctgagtgacagagtgaggccctgtctc

SEQ ID NO: 34781 - DNA, 800 bp, Homo sapiens
agaaaattgctcaactcagatttggtatttttcttttgctcagaagtgtgatgtgttcttactctgtaataatttagtagacttctaaatgagtatactaaagtaaagaggtaattaactggtacaaatatcacaatgcctatttgtaaggcatcactagtttatatcagagacctgcatatggcctcagattcctcctgttttaagagccactaagccacctattttccatttctacactatgtgtttcatggttaggtggccaagtcctatgcatgtatctcaggtatctttagtgtgaagtctgcacataccatatatgaaagagatgttttttaaactgaatgtccctagagaagcccttttggcctttgtctgcaagttaatgtcctttcaaataaataaataaacactctttacacctgaactaacataactagcttcagatcactaatcatataaatttcttggggcagttcctctgaagttgtgaagaatgtggtagtataaaatagcctttgtggccgggtgcggtggctcacgcctgtaatcccaacattttgggaggccgaggcaggcggatcacaaggtcaggagatagagaccatcctggctatcacggtgaaaccttgtctctactaaaaatacaaaaattagctgggcatggtggcgctcgcctgtagtcccagctactcgggaggctgagggagaagaatcacttgaacccaaaaggtggggttgcagtgagctgagatcatgccactgcactccagcctgggcaacagagcaagactccatct

SEQ ID NO: 34782 - DNA, 671 bp, Homo sapiens
agaaaattgctcaactcagatttggtatttttcttttgctcagaagtgtgatgtgttcttactctgtaataatttagtagacttctaaatgagtatactaaagtaaagaggtaattaactggtacaaatatcacaatgcctatttgtaaggcatcactagtttatatcagagacctgcatatggcctcagattcctcctgttttaagagccactaagccacctattttccatttctacactatgtgtttcatggttaggtggccaagtcctatgcatgtatctcaggtatctttagtgtgaagtctgcacataccatatatgaaagagatgttttttaaactgaatgtccctagagaagcccttttggcctttgtctgcaagttaatgtcctttcaaataaataaataaacactctttacacctgaactaacataactagcttcagatcactaatcatataaatttcttggggcagttcctctgaagttgtgaagaatgtggtagtataaaatagcctttgtggccgggtgcggtggctcacctgtagtcccagctacttgggaggctgaggcaggagaatggcgtgaacctgggaggcggagcttgcagtgagcggagattgcaccactgcactccagcctggatgacagagcgagactccatctggggg

SEQ ID NO: 34783 - DNA, 313 bp, Homo sapiens
atgatggaccatttggattgtgcaacaaatgaagaaaaccctgtgatatctggtgaacagattgtccagcaataatattatgtggaactgctataatgtgtcattgattttctacaaatagacttcgactttttaaattgacttttgaattgacaatctgaaagagtcttcaatgatatgcttgcaaaaatatatttttatgagctggtactgacagttacatcataaataactaaaacgctttgcttttaatgttaaagttgtgccttcacattaaataaaacatatggtctgtgtagtttccgagatgtac

SEQ ID NO: 34784 - DNA, 782 bp, Homo sapiens
ctgtaattttaaaatgtgtgatttggcatattgcagagaatattaagtgacatcacatatctatgttattgttatacatcagaattattttgtctttcagcagcatgcctgttccaatggatgaccgtacagttgttcctcaatttaaaaagatgtataaatatttaatagaattaagacttactaaatctatttttgaatatgtacattcactaaatagcataaatcttttggaaacagagggtagaagagcaccatctaccattttcctttagccatcctattaattgaggctgccaaaaaccatgtctatcatacagatattgcattattcagctccctagcaagggttaatctttgcccaattctctcctaaatcctcagagcagaccagggctaggagatgggatcagaggccagaggccagaggcttaaatgccatgatccttattgagaggagcaatggaagagaccacagaaaaagtgccaaagttcaatagagtgttcgtgtgctggaaaaattcagatgggccagaggcacataatataggatacagagcaaagaaggaataaggaccaaggaggtgagagcaagtgctattcagagaattggccaggcaggaggaatgagacgagttagggggaatattgagtgattccatagtatcagctagtatttgggttggtatcatacaggagatacactctccgactatttaaggagaagggcagtgccaacaccatgttgatcctcgacaacgtaatgttgattcttatacttt

SEQ ID NO: 34785 - DNA, 369 bp, Homo sapiens
ggttaatctgcagctgtagtgtacctaaagtattctttggcaggttgtggccctagcctaatccccagctggacttagcaccatttaagtgagttacatctcatccccgcaagggattgagtctgtagccaatttggccttgtcaccacttcagccctccctctgatttcacctttgggaaaactacaaagtggccccagacatacatagcaggcttgatcacatgggtggagtctgtcaggacagcatacatcaaataaaatgtccagggaacctgttgtaaataaaccacttcccgcatgctcagtcatcgtggaggtacttgaatgtttagtttcttttagctgatggccaagaaatcaatgttta

SEQ ID NO: 34786 - DNA, 273 bp, Homo sapiens
caaagtacagcatgctcctggttcctttgccacttctcaaaaagcttcttctgatttctgctccgacaccaacttcccgtcctctgacctccgctcttctctctctgtatccttcaccaccacccttcagcattaaccactgaaggaatcactaacctctctcagaggctccagattcacatttgcaagtgtctgctggacatcatcacagaacgtccctttgtagagtatcaatgaaaccagctctgaatgctgcatcttccttccaaatcc

SEQ ID NO: 34787 - DNA, 686 bp, Homo sapiens
ttaggccaatgcttgattaccctgatttcctcttgaaatgatctatatgtgaatgaaaattttggcaaataattattcagccaatttatactttctattgaatgtgtctctaatctctgcccttcgtgtttgaaattgatgtaaacgactggctcaacatatttatgatttagagcttgagactgtggaaggtgtgtctggtagttctttccatttcaggcaagatattaccatgtctgtaaactgcatctccccataatttaccagagtccaggaattactaaacagtttataaagagcctcacacagtctcagtgtcttcttccctgaactataacatattcatacaatgagctcttactgcttatttgcacatttattctcattttaaataataaattaaaacacttgccacatacaaaacatgtgacattacagcttactggacttaaagtagaaattgctttaaaatgaatttttggagtatatttttatatggtttacctcgttttgcagggatgaaggacatcagtgtattcatctgttttttaaaagtatcattgtaggccaggcgcggtggctcacacctgtaatcccagcactttgggaggccgaggcaggcggatcacgaggtcaggagatcgagaccatcctcactaacacggtgaaaccccatctccactaaa

SEQ ID NO: 34788 - DNA, 391 bp, Homo sapiens
tgagacagggtctcactctgtcccccaggttggaatgcagtggtgcgatctcagctcactgcaacctccacctccccaattcaagcaattctcatgcctcagcctcctgagtagctggattacagatgtgcaccactacgcccagctaattattttgtatttttagtagagacagagttttgccacgttggccaggctggtcttgaactcctggcctcatgtgatccaccaaccctggcctcccaaagtgctgggattataggcataagccaccatgcctataatcagccagcaattactttcaaatgctatctatcatttgtgggcattacataataatctaacaataaaaggtattgcttaggatagttatgaataatttaaaaattat

SEQ ID NO: 34789 - DNA, 1186 bp, Homo sapiens
tcttgccttcattaatagatttactaactgtatttatagtaataaaaatcctttattgtctttatatgtacctgtgccaacatacacaaattaatgtaatatcctatattaagggaataaaatataaaaattatatgattatctcaatagatgcagaaaaatacttaacaaagttcaacatgttttcatgatacaaactctcaacaaaatacatatagaagaaaatttcctcaacataactaaagccatttataaaaagccaactgccaacataattttctttgaagttttaaagaccatggatcgatttttctctttatgtagcctaatctgatttttatattcatatctgttaaggcatacacaatagaaattatatgttgacactacctttagagtccaggctccttaacctatacatgcatttgtaactgtatcttacctgttatttgatgctaaaagatggaaaggttttcctctaagatacagtacaaggcaaggtacaaagatgcccaccctctgcacttctattcaacagttctattaaaattgctggaaatactagcaaggacaatcagataagaaaaataaatagaagccatccaaatgcaaaaggaagcaaaattatctttgtttgcagatgatatgatcctctgtgtagaaaatccttaaaatgtcacaaaaattgttagaactaatgatcgaattcagtaaagtagcaggacacaaaatcaacatcaaaaatcagttgcatttatttacatcaataatgatctatctgtaaaagaaatcaagatggtcagacagtttttataagataatctgtggaaaatatgtaaaacttcttctgatattataccattcttgtatttgaatgatatgacctatttgtatattattttttaaatgcattgctagattttgttggttacattttaagtatattgaatctatactcatatataacattgttagatgtattcacagtgaactgcaacttttatcattatgttcttactatttgttatatttttctttttattgaactatcaaagaagttttctacattattttcatttatgtataaaatcatttatatataacatttatacgtaaaatcatttttatataaaaatatacataatttatgaataaatgatcttacattatttctacattcaagttg

SEQ ID NO: 34790 - DNA, 427 bp, Homo sapiens
ctactactactaaattagcggccggtcgactgttaagactccaacacacacagaactttccattcctatcctggaaagcattctcgatcagtatagctagctggtgcttttcagcagttctgcaggcaggtttatttaagcagacctcttttgatagacatttagtatgttctaaggctttgccttttcattcattcactcaaaatatttataaagggcctattccactccaggcactgttttagtcacctagcatacaccagtgattcaccctggtttcccagagttgaattatcataaattactccacctattgtttatgttgttgtgaaaagtgtcaaagatcttgatcttgcttgctgatctctagctcctgactttgcagcccactgatgcgaaatgtcgacgcggccgcaatttagtagta

SEQ ID NO: 34791 - DNA, 683 bp, Homo sapiens
agaggtcgaagatgacgacaagatgtcaatctcaagacctcatccttcaacagctgaatcaaagcctccaacaccaaagtttgacttactagcctcaaattttccacctttacctggaagttcatcaagaatcccagataaactcattttggagaataggatgtctgatgttgttaaaggtgtctacaaagaaaaggataatgaagtgttgagagttagttgcccagtgcctgcagatgagcagacagaatgcacttctgcccagcaactcagtatgagtaccagttctccatgtgcagctgagcctactgcattaagcacaactcagccaaaaaaaaaaaaaaaaaaaggatctaatagaggattcctctgttcagaaggatggtctcaaccagacaactataccagtttctcctccaagtactacaaagccatggagggcaagtactgcctcaccatgtaatcgtaacataaatgtagctacaccgtgactctacaggaaccctgaaagttaagttatgctgaagtgtgccagaagccccctaaagagccatcttcagttcttgtgtagccactatgggaacttcgctccaatgtagtgtctcccacgacaaacaaagacaatgaagctccttagaagtcccttgagaaaccaaatgagaagccagaagcaagggctagta

SEQ ID NO: 34792 - DNA, 318 bp, Homo sapiens
tttttagtagggatggggtttcaccacgttggccaggctgatctcgcactcctgacttcgtgttccacccaccttggcctcccaaaatgctgggattacaggtgtgagccactgcgcccggcctactcctctttaatgtgaataataaccaaggtgttctcagtcttgtaaaaactgtgaataagatcatcttcaacattactatgtttattggtctgctcgaagttgcaatgtaggtaaacagaatatgcatgttacacaaatgcagcttcaaagatcaatcttccagtcccacctaggttactagttttaaggaac

SEQ ID NO: 34793 - DNA, 683 bp, Homo sapiens
tggccgactacgccctgctcatggacttcatccccctggacgacaagagatacaggtatgcctttcacagctcggcctggctggtggcgggcaaggcagacccagccacacctggccgcgtgcacttccaccccgactcaccagccaagggtgcccagtggatgcgccagattgtgtcctttgacaagctcaagctgaccaacaacctgctggatgacaatggccacatcattctcaactctatgcaccgctaccagccccgtttccacgtggtcttcgtggacccacgcaaggacagtgagcgctatgcccaggagaacttcaagtccttcatcttcacagagacccagttcacagcagtgacagcctatcagaaccacaggatcacccagctgaaaatcgccagcaacccttttgccaaaggctttagagagagtgacctggactcctggcctgtggccccacggcccctgctcagtgtcccagcccggagtcacagcagcctcagtccctgtgtgctgaagggtgccacagacagggagaaagaccccaacaaagcttcagcttccacctccaagacccctgcttggctccatcatcaaggaggcctgcctctcccagctgggctggggctcctgtcccccactgtggtgtgcctggggcctggccaggactcccagtga

SEQ ID NO: 34794 - DNA, 549 bp, Homo sapiens
gtaagccatatatgaataaatgttattgactggcaaacaagttatcttcctcttaatggaatggataacagaatgacttcctctgggttcttccttctctactgcctggcttttttatgttactctagatttttggttgagagaacttggttgaaatgtccatccctaaagcaatcatttatgacctgagtggcagtgtacccactgtagaggtatagctggttgtggcagtgtcgaaattcctcaaggagagggcagttctccgtggtattatttttggtctgtataccacttatgcaaaaggatatagatagttttccaactcaaattaccaaaaaacacagtaaagtggttaagaacactagctctagagttagatggatttaaatttgaatcctggaaggccgggcatggcggcttgcatctgtagacctagctacttgggaggctgaagcaggacaattgcttgagcccgagagtttgaggttatagtgagccatgcttgcactccagcctgggcacagagtgagaacttgtctttgaattaaa

SEQ ID NO: 34795 - DNA, 388 bp, Homo sapiens
tccccttcctacaccagccttccaggtctctcctccaggatgccttccctaactcatccagcctcggtatctgcaccccacccttgaacctccacctctttgggtctggagtctgccagggtgtggaagggagggtgtgtgctccgcaagactcagtgtgtagaatctcatccttcccgagcattggtcctagatagaaaccttcccttcaggtaaggaagggagccagccaagagcctcccctctgctcccttggcctcaggggtggctgtctccagttatgggtgtgtacagtggggaggaacaagttcagatccaggcagagccattcctttggcaactcttgctgtcagccatcttccaaagagctttgcaaaatgttaaagaa

SEQ ID NO: 34796 - DNA, 539 bp, Homo sapiens
cttttttcttttggccttaactgatatgcttagcttctgctatactgtctcaggaattcggtagagattttatgccacaaggaaataggcacataaatgaggcctgcccatgaaggcagtttttaatcactcttttatctgaaggtattttgagaggctgcttattacagtgcttgagctcgagctcctgcatgccagagctcaaccgcttgagttcaataccatttattaactgtgtgacttcaggtgagtgacttactctcccaagcttcagttcactcaactggaaaatgggaatagaccgggtgtggtggctcacgcctgtaatcccagctacttgggaggctgaggcaggacaattgcttgaaccaggaaggtgaaggttgcagtgaggtgagattgtgccactgcactccagagaggctgaggcaggtggatcaccaccacgcctggccaggagctggcatttctaacacatgcccaggcatcaggaatgtcacatggaaaagccacaccaacccctaatggaggtatggacg

SEQ ID NO: 34797 - DNA, 2359 bp, Homo sapiens
  misc_feature (99)..(99): n is a, c, g, or t
  misc_feature (216)..(216): n is a, c, g, or t
cgccctgctggacgagctgcagaaggtgttcaccctggagatggcatacacaatctacgtgcccttctcctgcctgttgggtgacatcatccggaaaantcatccccaagccacgagctggttggggagctggcggcgctgtacttggagagcatcagccccagcagtcgcaaccctgccagcgtggagcccaccatgcccggcaccgggcccgangtgggacccccatggtgggggctgccctcaggatgacggccactcagggacctttgggagcgtcctggtggggaaccgcattcagatccccaatgactctcggcctgagaaccccggaccactgggccccatctcgggggtgggtggcgggggcctgggcagcgggagcgacgacaacgccctgaagcaggagctgccgcggagcgtgcacgggctgagcggaaactggctggcgtactggcagtacgagatcggcgtgagccagcaggatgcccactttcacttccaccagatccgcctgcagagcttcccgggccactcgggggccgtcaagtgcgtggcacccctgagcagcgaggacttcttcctgagcggcagcaaggatcgtaccgtgcgcctctggccgctgtacaactacggcgacgggaccagcgagacggccccacgcctcgtctacacccagcaccgcaagagcgtcttcttcgtgggccagcttgaggccccgcagcacgtggtgagctgtgacggggctgtgcacgtctgggaccccttcacagggaagacccttcgcacagtggagccgctggacagccgggtgcccctgactgcggtggctgtcatgcccgccccccacaccagcatcaccatggccagctctgactctaccctgcgctttgtggactgcaggaagcctggtctgcagcacgagttccgactgggcggtgggctgaaccctgggcttgtccgtgccctggccatcagccccagtggccgtagtgtcgtggccggcttctcctcaggcttcatggtgctcctggacacccgcacgggcctggttctgcgaggctggccagcccacgagggggacattctgcagatcaaggcggtggagggcagcgtcctggtcagctcctcctctgaccattccttgactgtctggaaggagctggagcagaagcccacccatcactacaagtcagcatccgaccccatccacacctttgacctgtacggcagcgaggtggtcactggcaccgtgtccaacaagattggcgtctgctccctgcttgagccaccctcgcaggccaccacgaagctcagctctgagaacttccgcggcacgctcaccagcctggccttgctgcccactaaacgccacctcctgctgggctcagacaacggggttatccgcctcctggcatagactgaggcaggagctggccgggcaagggtgggaagacatctgcgggcgcgtgtccactcaccctgttccctgagcagcagctccctccagggaggccctgggtcccacgccctgggtgcccacatggcctgccaactagggcctgcaaatggagtgggggagtcctggcccctgaatcaccagagccaccaagcctgccagaggggtctcattcatggcttggggacacagggctcctagcaagcaggaagttaagagcaggaggaagcgttgctaccttcacttctccccagctctgccctctgggtccacatgaggacagggaagctcgggaaggggaagggagactggccctgcccagccggtctctagcccctcagcccccgctgggcactctctgtcccatccctctaggacagggaagctggcctggtccagggcactgatggtgcttggattccagcctaaggaaggctggccgtggtccaggagttaagggcttgggtctggggtttaagtggccacccatccaggccctggccagtgtgggaccgggacgggaaggaagaaggaggctaggagcagggggaaaaggtgcacttggccagtggcgcctgccaggagtgagtccatgcgttgtctgcccacccctaccacagtgtttgtgccttcagctgagggggcagcctctgggccctgaacccctgctggggctccacgaccctgagagaaggggtgagaagaatcatctctgcacctcgggtctctgccagaggaagacttaagcatccctgcgacctcacattctagacagagatgaggtccaggggttggcccctgctgccttctcacaatttgcaatagatgtaaataggaccaataaatcctttggaagagcaaaaaaaaagacaagaagacaacaacagcacacacaacggg

SEQ ID NO: 34798 - DNA, 496 bp, Homo sapiens
  misc_feature (77)..(77): n is a, c, g, or t
  misc_feature (188)..(188): n is a, c, g, or t
  misc_feature (219)..(219): n is a, c, g, or t
gtacctctcagacaccacactcatggacatcctgccccggatcagccatgaggtcctgctgcccgtgctcagcttcnctcacctccctcgtcacggggttcccaagtggggcccaggctcggaccatcctgtgtgtgaaaaccatcagcctcatcgccctcatctgcctgcgcattggacaggagatnggtccagcagcacctgagcgagcccgtggcncacctttttccaggtcttctctcagctgcatgagcttcggcaacaggatctgaagctggaccctgcgggccgtggtgagggccagctgccacaggtggtcttctctgccagaggaagacttaagcatccctgcgacctcacattctagacagagatgaggtccaggggttggcccctgctgccttctcacaatttgcaatagatgtaaataggaccaataaatcctttggaagagcaaaaaaaaagacaagaagacaacaacagcacacacaacggg

SEQ ID NO: 34799 - DNA, 223 bp, Homo sapiens
ccgctggctgactctagaggatacacttcctctcctcccacctcgggtctctgccagaggaagacttaagcatccctgcgacctcacattctagacagagatgaggtccaggggttggcccctgctgccttctcacaatttgcaatagatgtaaataggaccaataaatcctttggaagagcaaaaaaaaagacaagaagacaacaacagcacacacaacggg

SEQ ID NO: 34800 - DNA, 333 bp, Homo sapiens
  misc_feature (70)..(70): n is a, c, g, or t
gtactgccccatcacgttccccatcacagtcttcgtggctgtctcctcccttgggaggccccattctctngcccttgccccagagtcagcagtgggttctaagagccagcaggatgggtgagagcaaagggatttggcctcagacccctacccccaaggtgacacacaaacaaggactgagcagtagccagcaagagaggcccagaagctggcctgtagtgtccctggggaaggcaggagagtcagggaggtggactggcggtccgcaggagctcggcgagagggaaggagtggcctcctgtttacgaagcttcccctctgagccctgcacgg

SEQ ID NO: 34801 - DNA, 371 bp, Homo sapiens
catccccaccacctattaagagatgagacttccatgacagatgggctaattacaaaattgattgattggctttgggttgccttgcaatgaaatgaatggtagaagcaatgcactgtcttctcccttactatctccctccttttgggaacccaagatccaatataaaatagcacacttaattttggcgatctgcctttgcttcactgtgcctgcttattaagccctaaagatgcatgctttcctggccctgttcctccaaaggctccaccctgaagccagtaatccaattaagaaactagaaataaaaaatcttacaaacactaaatcttcagactgtctgtctgtctctctctctgtctctctctctctct

SEQ ID NO: 34802 - DNA, 363 bp, Homo sapiens
gattttaaaaattctttagttttgtttttctaagtgtcaggcagcatgatggaaagaacactgaatctggagtatgaagacttgggttcgtgtttcaacttctgagaaactcatatacttcaatcaaaaaaggaggacaataccacctgcctaaaatatcagggatattctaagggtcaaataagataagtggtagtgatttttaaatggtacagaactacgtaaatgaaaagtgttattattcttattacaccggaactatgttttactttttaagtcaaagttctgtttttttttttgagacggagtctcacactgtagcctgggctggagtgcaatggcgcaatcttggctcactgcaac

SEQ ID NO: 34803 - DNA, 605 bp, Homo sapiens
agagcaagacgcgtcgacaaaaaaaaaaaaaaaaggatatcttcttctctcaccatacacaaatggtggcacactacaaacactctcctgcctcattaaacatgatagtatatcttggtggtgattgcatttctccaaataaaactcttcctcgtttcagtaccttgtggggagggaccatccctgattggtacccttgccttgctggcggactaggcttctgctgttaccagcaacgctgtagtgaataccccatgtgcttgtcattttgtcatttcagccacatgtgggggttattgccagcacacatttctagaggaagagttgctggacttgttcatgttaaatttggttggccgtttctgtcgcaggagcctcagtttatccatacccaggctagctctctgtgtgtgttaccaacattttgctctttgcctggtggatgggtgacaaatgatatcatgatatcatggcattggttatggggtttaaaaaaaatcttttatggccgggtgcagtggctcactcctgtaacccctggcctttgggaggccgaggcaggcggatcgcttgaggtcaggagtttgggaccagcctgggcaaca

SEQ ID NO: 34804 - DNA, 439 bp, Homo sapiens
ggtggactgagtgtgtctcccccaaattcatacgttgaaactctaacccccaatgggatgatatcaagaggtggtaattagacttggattaggtcatgagggtggggccctcatgatgggattagtgtccttagaagaagtgaaagagagtcaagttcactctcttggctgtgtgaggacacagtgagaagactgccatttgcaaaccaagaagcaggccctcaccagacactggatctgtttgttgacaccttgattttggatgttccagcctccagaacttgagaagtaaatgtttgttgtttaagccattagtttatgacactttcgttatagcaacccgagcagactgacactgtttcagattttcagattgtaattgttgcaaaaatggaatgcttttaacaaaaatgaaatgttatgcataaaggtttttttg

SEQ ID NO: 34805 - DNA, 387 bp, Homo sapiens
cacgttagttattctccagggtaaaccatatgttaggtcacaaattaagtctcaatagattttaaaagatagatattatacaaagtatattctacgaccacaacagtatgaagttagaaaataataataaaaggaaaactggaaaatttataaatttgtggaaataatttaaataatatacctttaaacaacccataagtaaaagaaaaaaatcacaagggaaattgaaaaatacttagagatgactgaaaacagaaacaaaacatacagaaacttatgggatgcagcaaaagttgtgctaaaggggatatttatagctataggtgcttacctttaaaaagaagaaaaatctcaaatcagttatctaacattacatcttaaggaccc

SEQ ID NO: 34806 - DNA, 440 bp, Homo sapiens
cagcaccaggttaacacttcttcttacatgcaaacagctatctggctggcctaaggcattcttctcccctagtatagctgcttgcatttgtttctcctctttcctcattccaagacttaactgctgacaactgctgcaaatcagaatggataccctaatcttagccaccttaccccataccctagtgatagtcctgagtcatcctgatatgaaggttgaccaggatatcataatggcaatgatagtgcttgtaggacatgccatttgagtgtgtattctgtgccagatactgtgctagaacttcaggtgcatcattgttttaatccttaaaaaatcactttcagaggccaaggcagatcgatcgcttgagaccaggagttcaaggaccagcctgggcaacatgttgaaaccccatctctactaaaaatacaaaaaaaaaa

SEQ ID NO: 34807 - DNA, 321 bp, Homo sapiens
tgagaatgctacaagtaatagtatactgaaaagaacatgtctctaattctggactgctctttatctccaagaaacagagagagagagaatgaaaaaaaatcccagcttagaggaattttggaagttactctttcatgaaccatcacattttctgggcctttgtaatctttaaacactgttactctttagaggttggtttgaatttgttgcacagagaacaataatctatgacaaattaatgaacccttttgctaatatcacatgagtacaagtatcttgtatttctcatcacatttaccgtaataaagaatgcagacaagt

SEQ ID NO: 34808 - DNA, 2249 bp, Homo sapiens
ctcccccaggaaacagtgcctaaggatgatgtcaagttacagccagtttgctctgatcccccaggacctaagaaaactgtgagtgcttcagcatgcaaaggtagagctaccagataaggagaataacttggccatttatagcaaactgcctgactttggagtgagaaaccaagcaccttctaggtcctaggataggtgaattggaggtgcagctgctgaagttcccattttctacatacttcaggagccagggtgtttcatttggttttgtaaaactttgctgtaagtcatcacagttaattctttgaatggacattttagagtgtaactttttttcaaaattagcagaacagatatctctgctcattctctttatacatttagttttttaaagttcccctagtatacctgttaggcactctaaataggacacagttaaagctaaaagaaggaccagttgctccctagagcctacagttcagaactatcttgttgtcatgtcctggtttggtttggtttgtttttaactcaacaagttggaaaccatgagtttaaagcaaactatttccttttcttaagcttaaagagaattttttttttaatctttagctcctcatttaggtagtgaaggcttccctgaaagacagcagtgcccttctctggaagaagaggctgggaccaaaagcctgagtctatgggttgaggattttgagcattcctttgacaagcttctatgtatttttaatataagactcataaatgaacctgatgtggtgttcatgacccatcccttaagcatgcttgctttttttaactttactttttgagtatagtacttgtcttgtttttcctggagccatgctaggatttaattcctatgtgccactacccgcccatgtcctggaagatggccatgcctgcagcaatgctcatgtcttgaggagaagcaatgtgaaaagcatcaggaaagctgaaccttacgttcaagtcagcaaacatttgtgagcattctagtatgcttgcgaccttgacactttttaaaaattatctttttatttgcttcgagtatcaaccgtatagttgactctagtggggcgaagggagcagagatgagagcaaaattcagacttgctgcccctgtgtgtctcagttctcatgtctctctgagaaatgtgttggcccaattccctatctgccactctgagtctcttgagtaaatgtgtgtaaatgagaaaaattatctcaaagatttaacttattatttagatattttcttctttttaaactcaggaataaacctggtttgtagataatataatatggctactagagctataattgagtaggtgactagaagcattttttcaaatatatttcttgtaaagacatctactttgttttaactaggaaaagaaactcctcatattaaaataaacatttccataagcactttctagaagagtgtagcatccatctaccatccatcccagaatgtttgtatcttgctcatagtatttcaaaaatttttatgggtgaaaaaaatgcacttttttatttattggaaaagtgtagagttattgaattaaattctcaagtgggacaatttagtgtaaagggaaacatgggttttggagacaagagcacagggctgtggtccctgttccagcattgactttactatgtgacctcgagcaaatgatttaacttctctgtgcctcagtttctccatatacaaaatggggataatgatactaaccattgcctacctcatagagatgttatggggacaaacgaaataatagagataagcacgaatgctttcaactcttcggaagaaaggtgctatataaattgaagttgtgtttttaatgatccaattattaattatgtttagggtttaaataacaatactgttagtcatgttaagaataagttttgttttgatgcatatttccacttctcttctgtggccagatcttgatcattcaaccagtaatggtacctgaggaactgaaatgggtatttgttttctgtatgtttctgccagtagtatttcaattgaatatccagaaaagactggagtttaacttgtaatatcttatagtttacatgtaataaaacttattcaagctatatataaaagtatgattacatgtaaatagcaggtatgttgtaattaaaggcacttatcaaattgtctttgttcttttttaattgtaataaaagtcagttttacataaaaaaaaaaa

SEQ ID NO: 34809 - DNA, 677 bp, Homo sapiens
tacaccagaagatcacctgtgtgaatgtgaatagactgacactggagaggaccagctcagcacagtcacttgaactgcccctttgcatttcaggcaggtaaaatgcctttgaagagtgaaaataaagttactgctgattaagcagagagtttgacttgctgatcaatttgatcagaagcctctcaatgagataattactgcatttatttatttcaagaaaagtaaaagccaaagcccagaatgtggcaaggcaagagttgaaaagaaaagaacaagtttttctttgcctagcaagctcacttcaaggacagttataagataatgctgtttgagaagttgaaaccaaagaaataggctccagacactcccctccgaagcaagggtgaaggaaacaaagaaaaacaaacgtctgtatttagccagttcttgttttttctttcaatgcagctacaaggccaccagctattaaaggccacaagttatgccaagaattcagttatgctataaattacataaactggtcattatataattaactgcctttgttttgcttctgtaagtttacttattaaaatctcactcagtctttgttcaaggctcagctttttggatgtgaattcactgagccagagcataccttaaaataaatatcctcctttattgactcataaaggtct

SEQ ID NO: 34810 - DNA, 430 bp, Homo sapiens
tacttgtttgttttcatatatcttgaaataaaaatatttagtgtatgtaaggtgctggttacatcagaaaaaaatgtttcaaatatgttataaaggaaagattcaaattatagaaactatttcttgagactatttggaaaagtttcaagtgtccaaaatttactttttttaatatttagggggtacaagtacagatttcttaaaatgcatgtgctgggtggtgaagtatgggcttttagtgtacccatcacctgaatagtgaatattagacccaacaggtattttttcaaccctcactccccctcctcaggatttaattttaaatattatattactcaatggtaaatacagttctcccagttgataaagtacatctagatgtatacaacttacgtttagaaaatcatccattcattcgtatggaataacc

SEQ ID NO: 34811 - DNA, 750 bp, Homo sapiens
gaacttacactaaaactgctcataaatatacaggaagaaaggtgtttttctcaaattaataaaagtctagttagcacattcaatctgtgttttcacatgcattcttttacttcctcagtgtatgtgagaaaaaaggctataaggagaatcttgtagttaaattgtgataaagattctgatgttactaccaattatttcaatttattctgttaatagcttttatttagaactttaataaaggatggcattcctcattcttgcagcactggtacatcaggaaaccaagttacaaaaagccctctttgataagtacttgggttataaacacttatttttcactcagtagcatcctccttatgtttaatattctttcaacaaaggatgaaccatcctgaaattcagtgtcatatttaccacttggtatttactcagtagggtctatgtgtactacaatgtgctaggcactatgggagaaccaaggttagtgtcatatggtccttactctcaaggagtttacaatatagttagattaggcatttacatgagataaggaaggaattatgcagacagaactgtaagtattaaaaataaaaagatcgccgggcacagtggctcacacctataatcccagcactttgggaggctgaggcgggaggatcacctgaggtcaggagatcaagaccatcctggctaacatggtgaaatcccatctctactaaaaatacaaaaaaattagccgggcatggtggt

SEQ ID NO: 34812 - DNA, 663 bp, Homo sapiens
acgttgtatattttcatttttaagtcatgatttcacgatatgtgatattttatttaatgaaataatacataggaattgcctgattgataatgaaaactaaaaaataggtttatcatgcggattacatgcagacccttctcacaataactgctcatgttgcccatgttcttgactgcagtccacagcacatgctagcatagttcttcgttctttctgccagttccaaggcttcccctgtagccttggacttaggtcatcttgagtttgttcacttctgtatagtttgcctatattccaaattaagaagctgcccatcccatagtttatattctaactgtgtaaaatcttattttaaatctttaaatgaaaaaggttaggccaggcatggtgactcacacctgtaatcccagctctttgataggccgaggcaggtggatcacttgaggtcaggagttcaaaaccagcctggtcaacatggtgaaactccatttctactaaaaatacaaaaaattagctgggtgcctggtgggtgcctgtaatcccagctactcggtaggctatggcaggagaattgcttgaacctgagaggtggaggttgcagcgagccaaaatcgtgccactagactccagcccaagcgacagattgaaactccacctcaaaaa

SEQ ID NO: 34813 - DNA, 453 bp, Homo sapiens
actattgatacatgcaacaactggatgaatctgaggctttatgctgagtgaaagaagccagtttcaaatggttgcatactgtatggctccatttatgtgacattcttgaaaagacaaaaaattatagtgaatagagacaaggggttgagtgggagggtgtgacttcagaggaggtagcacaagaggcatctaagagcataacagtgatgggactgctcagtatcctaattgtggcagtggttacacagatctgcacatgtgcttagaacttacagaactgtatacaccccagaatatagccagttttactgtgtagtaatttaaggaataagattttaagaataattaggacttctagttaaacattatggaataaacatgtctgctccctcccaaaaatatcactagaatgacagaaatggaataaaaatagaaatataaaataaaaatacc

SEQ ID NO: 34814 - DNA, 342 bp, Homo sapiens
cacacgggcagctgtccataggctgatgtcagtctgggctggtagctaccccgttttggccaaatgctattcctttgccctctagggcaaatgttgtccgtggtaaagattctgagtcccctcaaagtgggaacgttgaaactgggcatgactagaggtctctgccccagttgttagaagttctttaggtcaactcagaataaggcagggagcatgggttagtttgggcatggttttagaacaggggtttccaatattttgccttccctgggccacactggaaggagaagaattgtcttgggccacacataaaatactaatgatagccgatgaacaaaaaca

SEQ ID NO: 34815 - DNA, 441 bp, Homo sapiens
gttagtattataacgttacgctcttttacctttgggaaggttcgttaaaattcatcttttctctccttgtttagggttagggaaagcatcaagaatgaaagtgtgggtcaggcatggtgacttgtgcctataatcccagcactttgcggggccaaggcaggaggattgcttgagctcaggagttggagacgagcctggacaacatatcaaaactttgtctccaccaaaaaaaaaaattagccaggtgtggcctggcacagtgactcatgcctgtaatcccagcactttggaaggccgaggtggacagatcacgaggtcaggagttcaagaccagcctggccaacgtggtgaaactttgtctctactaaaaatacaaaaattagctgggcgtggtggcacacgcctgtagtcccagctactctggaggcagaggcaggagaa

SEQ ID NO: 34816 - DNA, 290 bp, Homo sapiens
taacaatgtttgtcttcagtattttctgaatctgcctgtggtttccatccctcctacccctacagctgtcctcagtccctgacattaagaccattgtaatgttctcccaaccaggttccttgccttccatttttcccgtctaatagattccatgtacgtttgccagattaatcttctgaaaccacatctcttaaaccattctctgcctcaagaccccttaatgagtgcccattgcccgcttaataaagttaaaactctacagcatggtatttaaaagtcttcctgcttgg

SEQ ID NO: 34817 - DNA, 1174 bp, Homo sapiens
tgtaaaatattgttttaggcactgcaatacaatggcaaagaaatcagacatgatcctagctctcatggagcttacattctaatatgagaaacaaatattaagcaaactacacaattatttcatggcaattatggtaagtgctactgaagtatctgtgctattgaatcacatggagtacacgaagaatgagagtacataactaagggatcaaggggaaagatgtttagctgatttttaagggaaaaagacttaattggcaatgatgggagtgggaggggcatagttccaggatattataatacatgcaacaactgagcaaagtcttgttggtaggaagtaatatagtatagtatgtccaagaactgaaaggtcagcatgatggtacacagtgagcaacagggacagtggccttggttagggctagtgtggtatgcagggggaaaaaacatgcagggccatgtaaattgggttaataattttgctctttatcttaataattgcaagatgccattaaagggtcttaaatacccaccccaatgtaggaagcaggttagtactgcagaaagagtgttggtctggcaaccggacctaagtaaggattacagacccctgaggaaattactaacctcttgctataatttaatctgtgtaatggtggcaaggctgaagtttatcacaaggaaggctggaaagttttctttaaaatggtacgtggggaagaaggtagtagtaaccagatgcaaaatgagtgcaaacaatgtttagaaggaacagaaaagtaggcagaagagagcaagatggggaaagtcagctcactagggatactgaacttaaaggcagctggagctagttatcagtcataaaggaagcttggggtgggaagggatttattagcaagctccatcatcttcatctgtagctccacatctccttcgccccatcatttgtgacacaaataagggactttcctcaagcttatgtaatgttatgcaacacagtttcaagcactccaatcctggagatttgctcaaattaaaccctttctatttaaaaactctggagcagcgagtgaaagcaactcactactctgcaggacaagactctgtgtgtgtgtgtgtgtgtgtgtgtgtgtgtgtgtgtgtgtgtgtgatatctcataaggggggtatcctat

SEQ ID NO: 34818 - DNA, 576 bp, Homo sapiens
atgaatgaagagaaccaggagagtatgaatgtaatgaaaccaagggaacagtgagtttcaaggagagtgtaatcaggaccgttctgcatttctagaaaagatgtggggcaaggaaaggactgaaactggaagacgtgtttcttaggaaacggattagaatctttgcatgtccctttctgagttaatggtagttactactcttaataatatctatttttccaagatttacctctaattcttcctcttccttgaaacttttcctattagctttaatactcctagcacttttatttatatttgtatggctcctataatgtaaaagtttttccccttccctgtttaaagtgttatctgtgtttattgttgaaaaatcagaaaagtgcacagaatgtggtatttctaagacttaagattagagacttaatgctcttgatatttcttgcagagaagttttccagataggtataaatttacattcctttcagtagtgtttaagaatgtctagttagccatatcctcattaaagttgaatattaatattaaaaaccattttttatcagtttgctcaaaaaaaaa

SEQ ID NO: 34819 - DNA, 475 bp, Homo sapiens
cctgtaatgccagctactctggaggctgaggcaggagaatcgcttgaacctgggaggtggaggttgcactgagccgagatggcaccactgcactccagcctgggtgacagagcaagactccatctcaaaacagaaaaagtacacagtcaaactgagaatatgctaatactgtaacggtggtgtgaaaacaaattatgtatttatcataaaagttaagacaaaacttaacttgtagcaacaataatttaaattatacaaattataaaatgatataaattgtgtcatcaggaacacaatgtggggttgaaagtaaaagcatagcatttgagtaattgatctaattttagttgtattaatttaaaatagtctcataagtgtaagagactgtttaaggttcatggtaaccacaacgtttgcaaaaaacccttagtagatatgcaaaatataaaaagaaagtagatatgcaaaatataaa

SEQ ID NO: 34820 - DNA, 209 bp, Homo sapiens
tgttcttgcctttccatgagcgtagtaaaccaggcaaagcaaaacaaaaggatcccagactcacttatcttctgccttgaaaggtcgctctggattcatggacatatttaaaggccctcctgatttgtacatagatactagagccgatcatctccatccacctctgccgccagagcgcctcaaactccagtctctatttgaatttcctg

SEQ ID NO: 34821 - DNA, 452 bp, Homo sapiens
cacaggctgtgctgctcttcagcaggtgagaaaagggagaattttaaaccgccttttgttctcagatgcaatataaacacatgtgacatgggagagaaatgtgggattaatgattttctgtgaagtatatcctggtaacagctcaggcacttgagtcagaaagacctggaatgttggttccaccacttcctagctgtgatcttggatgaatgactgggctttgacaagcctgagattctgcatctttaaatggggatgattgtagctgctcctccagacggccattagaggattaaataaacgaatgcacataaggctgtttgcacggtgcctggcacatagtaagtgttcaacaaagatgaggtgttattatggacttttaggcaaagcctgtccagctaaattcctgggcctggcctcccttggctgttgcattaattaaggagatgacc

SEQ ID NO: 34822 - DNA, 218 bp, Homo sapiens
tcaggaagacaaactcctcagagtacgccgtggcagtcctcaccacagggcccagtgcctcactatagccagcgtcctttacctgtttatccacaccaacagaactatcagccttctcagtattctcccaaacagcagcagatccctcagtctgcttaccattcaccacctccttctcaatgtccttcacccttcagctctccacagcatcaagtgca

SEQ ID NO: 34823 - DNA, 261 bp, Homo sapiens
gcactattcagtctcatttccttttacagtcagtaacttatccctgtgcattgatccctcactccaggaaagtgctgagccacatttctgacagtgttgacctttgtctgaaatgctggacaaaatttcagggagtaaggtgattaactaaaaatggatttggagattatctatgggtttcaatgtcaagatcatctctgacactaaacaactgagaagttgttctgtaaaataccaaggcaattataggctcaatacatc

SEQ ID NO: 34824 - DNA, 417 bp, Homo sapiens
ttttattgggaaacagccatgctcattcatttacatgttatctatggcttaacaacagaactgaggagttgtggcagtctgcatggcccacaaagcctaaaatatctaatctcttgacctttacagaaaaagtttattgattcctgacatagaacatcattgacttctaaggtgggaggaatttcaaaatgaggaatcatagaatcagaaaagtgaggaacccccaaaagattaaggcagagaatttgtgagaaaacactacttcccagggaaaggagcaagggggaatgaagggagaatatagaccttccacagacctggcaatagcagccaggacatattgggaaatggatacatctgcttcttttaattcctctgtctctgtgggggatgcaaagccttttgcagagattgtag

SEQ ID NO: 34825 - DNA, 506 bp, Homo sapiens
tagtccttggaacctgtgaatctgctactttacttggtaaaaggggctctacagatatgattaagttaaggattttgagatgggaaggtcatcctggattatctgagtgggtgcagtgtaatcacaagggtcctttaaagatggaggcagactgtcagaggaattggcacaaaagcagaggtcacacacacacacggggggatagagagagagagagagagagaggaagatgttacactgctggctttaaagatggaggaagtggctattaagtcaagcaaggcatgcaacctcaaaagctccaaaaaacaaggaaatgaccttcagaaggaattcaaccttatattccttgctgacccattttagacttttgactatctgaactttaagttaataaagtgctgttgttttaagccaataaattggtggttatttgttacatcagcaataggaaactggtataatgatttttcaatgaaaatttagacaagattagaaaaaaaaaa

SEQ ID NO: 34826 - DNA, 291 bp, Homo sapiens
gcataacatttaggcatacatttaaccaaggagataaaagacctagacactgaaaactatgaaacattgaacaaattctaagatgatacaaataaatggaaagatatctggtgttcatagatcaatagaataaatattgccgaaatagctatactactcaaagtgatctacagattcaaggcaatgcctatcaaatttccagtgactttttttcacagatatagacaaaaaaaatcctaaaatttgaaagaaactacaaaagaccttaaagatctaaagcatacttgagca

SEQ ID NO: 34827 - DNA, 108 bp, Homo sapiens
aagggaatcagtgaaagaagttaaagggatctagctggatgcatcaagggtaaccaagcacacctgtgccatgcaaatcaagaggaaaagcatcaagattgagcactc

SEQ ID NO: 34828 - DNA, 383 bp, Homo sapiens
ttgtttctctatctatatatcactttggtctcttgacctgggtcactctatgagcactttgcattgtctttttggtgtccactgctgtcttcagctatctgcatgcctcatgtattattctatagaaataaattagtaactacatctttaacagacagcgatttgaatattcagtaaatctctttgcttttagccacaaagagagggagagtgttctcttgaacagctaccctgccattctgcacctccacttcctttatattagccaaccactttcagaagtggattttttgcattctcaaataaatatttcctacctttccaacgtcaatggtcattttctcaggtgaccatcattaacagcttgttttcctaggtactaa

SEQ ID NO: 34829 - DNA, 729 bp, Homo sapiens
tatagttcttatgaaaatactggcttgaaagcttcaacagggataacattttcaggtgaaggccaccattgaaagcctgaagatatttagcttctgggagcaatgcataccatctctttgctgaggacccttgaagaggttaagtgaccaacccaagatcacaagactgatgaaaccagtgcttgaactcaagcttctgattccgagtccaatcttctctttccactgcataaagatactcgagtctcttatcaccaccaacaccaagtgatggcttataaagatcatccttagggtctttccccctcaaacgtgctatcattcagtaactctaggatccttgttaaaaaaaaaaaaaaaacgggggttgcggagaagggattgaaatatctcctctccctgtcttcacctcctctgatgaaatctgattttattctgtgatatgtaagacctgaatgaaggtgactgaagtaattgggtacatggttagtggtggaatccggatgtgaacctgagtcatggtcttgccattgttccttgaagacaggaaatatttgtaaatatatttggaagcaactttaaaattgttgcatgtggttgggtctaacagaatcacttgaatgaagagaaaaacataactttttcctgtgaattttcagggaaatgcaattatttcctttcacttggtataaaagctcttcagaggaataaagcatgcatgagccaaca

SEQ ID NO: 34830 - DNA, 411 bp, Homo sapiens
tatgcaaggtgagatgatctatgttggtgggtgactggatatgttttataagattggagcttgtgggtccaaagaatcactgtgatgcgtttcatgtgacaattgttttatagtttacctgcactatctcactgcctcctcactgcacctacaagaattagctgatactatcctctttcacagctgaggacccttgaagaggttaagtgaccaacccaagatcacaagactgatgaaaccagtgcttgaactcaagcttctgattccgagtccaatcttctctttccactgcataaagatactcgagtctcttatcaccaccaacaccaagtgatggcttataaagatcatccttagggtctttccccctcaaacgtgctatcattcagtaactctaggatccttgttaaa

SEQ ID NO: 34831 - DNA, 1463 bp, Homo sapiens
gggggctggagttggcagagctctgcatgtcccggcatgtctgagcaggaggaattccgggcggccaaagggttttatgtagattgcttttggacactcgcccaggagtcaggagttgatttttatctcacttcctggtaaccttgaacttaccaggcagggatgagatgacgtaaacttcctcagatgatgtaagttcagccacatcttgctgcccattagggagagaggacgacccccacagtgaaagtaattgagtgaaatgcacgttctggaaatcagtttctattttggcctggaggaatgtggctatactgcttccctgagtgtgacacagttggaatctaatcttgttggtttcccaacatctaggtttttgtttgtttgtttgtttttatgatagggtcttgttctgttgaccaggctggagtacagtagtgtgatcatggatcactgcagcctctacctcctgggctcaagtgatcctcccatctcagcctcctgagtagctgggactacaggcatgcaccaccacacctggctaatttttaaattttttatacagacagggtttcaccatgttgcccaggctggtctcgaactcctggactcaaactgatcctcctttctcggcctcccaaagtgctgggattacaggcatgagccactgcacccagcccagttctttcttaaaacagctgagagttttgttttcttcagcgttcaccttccttgtctccagttccgatgctggcagtggttcctacctctgttgggtttctagatagtttgggaacggggttgatgggtttctgtgaaacacattttccaagtcttgggctttctctggaggggaaggtggatgctggcgggtgacttgcagtgggcgcctggcagtgggtgtggactgtaactgacaggtggaaatgagtagggacactattgttccctccatgccagctttttttttgctggaaatgccccctccacacccctggtagctctgtgtcctgagaaatccagagtgtgggagacatcactgcatctgtccccccagcttctgtgaagggaagctgtggcctcttttgaatgtggggaacaactgaagactcaggggtcacccagaggtctggtggaaagcaacttcaggtttcatcttgctctattcctcaaaggtctggtctgtgggcctctgaggagaaaacaggtctagccaagacagggacaaaatggggaagggggtgtgccaggcctgaactgagctaagcacctgccccgggctccacacttccatctttcttttgtcttcatttcacctctgtgtttaaagcactgtgtgacatagctccttagagatataacctattgtctgctcattgtcacgtgtgtgtgtgtcatctttgtattcttgcagtggtttcacatttccttacccagtcaagccagtatcccatccttcctca

SEQ ID NO: 34832 - DNA, 652 bp, Homo sapiens
tgatgtgagacttctgtccgggagctgactcggaatttgccatctaatatgttggaaaaggttctctgggcagaggtatccaaagtcactttgcctgtcaccctttgaggtcccagttgttgcctatatcatgtgaccagtgtgtggcttctcttgaattaagagctgcatgtctggactgcctgggattttacagatgtcatctcgttaactctccctggagcttgtgacacccaggagatggcagtttatagaagccctggcaccttcttgaatgatgcttggtttggtttctatgcactgggaattcctcacaaggaaagatttgtcacatcttaaggaaggaaaaaaaggcaaatttgggagtcccatggataccctattattttagattccaggacaaattgtcgaataagcacgtttcataaaaacaatcctccgcagcatcccgtgacagcagctggtccctcgccacaggataattatgtctccttgtgcacacaaaagtctccgagggcatattgttgtggctggagtttctgataatttccaaattgaacaacctcagtcctaatgagtcagaggcttgtgcaatattttcaaacctcaggaacatctttttcattagttgtgcaataaagatggtaggcct

SEQ ID NO: 34833 - DNA, 612 bp, Homo sapiens
ttcttttttctctctgtggagtgggagacttaagtggcttcttaactggtgtgtcgtctgatcaagtggtccaggtaacaggtggatgccaatgtctggcccaggcatcaccccttactggcactggtcattacagaagacactctaccagagctgaaaggacctcttgtcactaggcagctgtggagtccgctctacttgacctagtaaaatctgcctggagactgttagagtcaccccactacctgaagttacctccaggctgacctcttttttttcccaggtggagtcctggcatcttagatattttaataaggatttgcttgttgacatgttctttattcactaaggtgtcagcatattactgtcttagaactgagggttcttcatcttttttggatcaggacctccctctaagaatctgatgactgctctggtccctctcccaataaaaacttccatactcacctgttaaaaaaaaaaaaaactttaaacaaattaacagagttttattcagcaaagaatgattcataaatcgggaaggctgcaaccagaataggttcagagagactccacggtgtgccacgtggttggagaggatttaggatttat

SEQ ID NO: 34834 - DNA, 333 bp, Homo sapiens
gctcttactacacacattgttccataagctgttttttccccccatcacaatgaactgttgacatctttgcaatatcaacaaacggtgatctacattagcattttaaacacctatagaatcttttattgcatcattgtagtataatttaattagccaatttgctattttggaacattttaattatttgcaaatttcactataggaaaaatttttatgaatattttcactataggaaaaatatttcatgaatatattttatgtataattgttatctgctcctctaattatttttataatgtgaattcctaaaagtaaaattgtaaaatgcatgca

SEQ ID NO: 34835 - DNA, 473 bp, Homo sapiens
aacggcatcttatcattgcaagcttttattagatatttatcaatggtttacatactttagctcattacattctcccatcattcctatgaggtgggcacttattgctcccattttacagatgagcaaactgaagtttaggcaagggcaatagcatgctccaagtaacatagctggtgtgggtgggtccaggatttaaactcagtcatctggatggcagcacccaaacccttacccacgacactcagtggcctcacaaggcacctgggtggtggcatgactcaatgaacctgactctttccggaagctcattcctgcaccagcagtggcactatgggcatttactatcttaccttccataaaccacacaacaactctcagtgtagctcctgctcccattttataaaggagacacttgagacctggattgaagaaagggatttccccaagtcacaggcaggcagctaccagaggct

SEQ ID NO: 34836 - DNA, 393 bp, Homo sapiens
atttaggctggagtacagtggcgtgatcatagttcactgcagcctcaaattcctgggctcaagtaatcctcctacctcagcctaccaagtagctgggactaaagatacatgcccccatgcccggctaatttatttttatttgtttgtagagatggggtctcactgttgcccaggctggtctccaattcctgggctcaagcagtcctcctgcctgactctccaagtgctgagatttgtgtccagccacaaagggacattttcatagggcttcctcaggacatgacaatgggcttcctatagtgagcaattcaagagagcaaggagaaacccacagtgtcttttgtgacctagtcttggaagtcaaccaccagcaattctgattctattcattaa

SEQ ID NO: 34837 - DNA, 424 bp, Homo sapiens
ttagcaaatgcttaagtgtagatttagaaagctaaagctatacagtggctgccatctatggtttggacttgtgattaactacattgaaatgctaactctgtaccctagagtatgaattcctgattagagtccttcaggtgctaactaatttatgtatttcatgtttgataatattattacttgagctttgtgggagagcagtcttttcctcccctgagatatagctagaagttacctcctttgtgaagccttcctagatactccaagcagacacggtccttcctttctcccttgcccagcactctgaggttgactctgtggagcactgatccctctgtgttataattgtctatttacacgtcagctaccacctataacacactgagttcctcaacagcagggacactgtccattctttgatccc

SEQ ID NO: 34838 - DNA, 395 bp, Homo sapiens
agaaaaggctaattatcctggtgctctgtctaaaggttcagagcaattgaggagcctactgcttaaatagctttctgtcccttccttaccaccctagagtttagtcctgcccaaaatcagaagaacaaatagtgtgagaagaaaattccgcttgactggaatagtaggccagtttttttatttgtttgtgggtttcttttttttcttttgttaccttgcagttgatttcctcattttcacagtacttcagctatactaatattaaaggatttgctaagactatttgaagccaggcatggtggctcatgcctgttatcccaacactttgggagggcaaggtgggaggattgcttgaggccaggagtttgaaaccagcctggataacataataagac

SEQ ID NO: 34839 - DNA, 314 bp, Homo sapiens
catagcaattcctgtaatttgtaataatccatcctgttattgttgctttttgaagtctctctctcttcatactagattataaactccatgagggcagagaccatctctgccttttttaccactattagctcagtatccagtagaatgtcttagatgtaattaggcaaataaagtttttatttgtttgtttggcttttattacaaatgttacatatgcctttggttttaatgaaacatcatctagattaatagctttaaacaggcatgaccttgcttttgtccaagctcaaatgtctgtgtgcatgtctagacat

SEQ ID NO: 34840 - DNA, 686 bp, Homo sapiens
ctgtggccccccaggcagaacatgacggagatgcgcaggaatggcaaagtacgaggggaaaacagacagtgggatatggtgaaaccgtgacggttggtgaatgagactttgatccaatgacattaaagcagatgagccacccaaaactaatatacagtgtctactgcagaagacgtgtgctcttcaccagtctgtggaccaggaaacgagccgctggggatctcagtcgcaagggtgctcaggtggccttggtgcagacactcacagctctcagactgcagagtgtgccggtcctcggagaaggggtgtccttcagggcagtgcttctctggctgatgccacagactggctagtggatggccagactcatcacactgacacccctgttcacctaaaccagatacaaccccttcctgatgcatctgttggtgccaaatcttttttttttttttgtagctttttattattaaaacagtcactgcaattatcaggagtcgtctaatgtacagtgactgctattcctattgctggtgagtgagaatattaataccatctgtagtagtgagacagcaaatatttcccgcctcacaggtgccctggtattttagtgcagaaaatattcttacagttccctggaaagcacgctttataaactcttacacattttcaaaataaagattttttaa

SEQ ID NO: 34841 - DNA, 599 bp, Homo sapiens
gtccgggcaggatgaaacagtagaaactggtgagtgaatgaatgtgaaggctgaggagcgactgcaatttgttaatgggattatgaggcagtataaagtggttaattacggtggcggaggtaagcaggagtaaaatgatggcttttaactcctctcaaggacaccgaaaattattttaataaacactggaaggctgggaataaatataattcacaccattcttactttcttggtttagagatagcttatctacatccttaaattaatggctgtagctaccctctgcatggctccaaaaaaaaaacaaaaaacaaaaaacaaaaccaaagccggctgcgagtctgcacgagaaaatcgggttgcaccaggccccagccgcccgccgattcgcttagctgtcggaggctaaataaacagctcccgaagcagcgtttggcacagcgcagggtcggaacgtggacactaatttccgcccacgctccccgcgtcctggcgggatcaccacagacacgacgtccattgctggggtcctcggcgatgcccgtgtgcgcagccccgcgagtctcaggtcagaagaccactaatttcgcggccgcgtt

SEQ ID NO: 34842 - DNA, 798 bp, Homo sapiens
tttttttgagtcgagggtctcactctgttgcccaggctggagtgcagtggcttgatcatggctcaatgcaaccttgaactcctgagcccaagcaatcctcctgcctctgcctctgcctcctgagtagctgggactataggtcaccaggccagggtaatagagatgggggtatcgctgtgttgcccaagctggtctcacctcaagtgatcctcctgccttggcgtcgaagaaacttttaacgtttttatgtagtgaacttagtggctgtgttgaatacttatacctagttgtcatatttattctaaaaattcaaatcattcccttgccagagtctgttttcaatttgcattccctaaggaacactttctttgattcagttatcgaactgttgccgttattacatcagatgggagaatgattgtgggaacactgaaaggttttgaccagaccattaatttgattttggatgaaagccatgaacgagtattcagctcttcacagggggtagaacaagtggtactaggattatacattgtaagaggtgacaacgttgcagtcattggagaaatcgatgaagaaacagattctgcgcttgatttggggaatattcgagcagaacctttaaattctgtagcacactgaggaaaaactacatacttggacatctgtaaatctttgtacagaaactgattattctgaggatgatatatggagtttttatgaatgtgtcactggattttgactccttattgattcattgtaatatgtaaattaaaatatttctacattttattgaaa

SEQ ID NO: 34843 - DNA, 584 bp, Homo sapiens
tatggtttggaagtttgagggttttttactgtgtctatccttgtgtgtctgtttcctttaaagattcatgatacaatcactgtgtacaatgtgtcctttaatattggttcctgtaataatgtgccttcaaattatttcttgagttttgtgacttaaatatgcagttcactgactcacgccaatgttgtttgctttttaccttaattctttttactgtgctctctcagttttattttttggaagaatggtactcagtgctttgatttgattagtaagatttttgaaacacatgtaatttatttcagaaatgtgattgttttaactctgacttttttagtgcagtcattggagaaatcgatgaagaaacagattctgcgcttgatttggggaatattcgagcagaacctttaaattctgtagcacactgaggaaaaactacatacttggacatctgtaaatctttgtacagaaactgattattctgaggatgatatatggagtttttatgaatgtgtcactggattttgactccttattgattcattgtaatatgtaaattaaaatatttctacattttattgaaa

SEQ ID NO: 34844 - DNA, 1337 bp, Homo sapiens
gaaaaattagcctggtgtggtggtgcatgcctgtaatcccagctacttgggaggctgaggcagaagaatttcttgaacctggtagatggaggttgcagtgagccaaggttgcgcctttgcactccagcctgggcaaaaagagtgaaactccatcttgaaaaaaaaaagaaaagtggctgatgtgacagaggaactgaattttaaattttatttaattgtaattaattttaatagttacatgtggccagtattagtatagttatagaggctagaagaatgccaaatcagttttctagtgagtactacactgaatcaaaatatagttggaaagaagcaaaagatacattagcaattttaagctagaacatttaacaaattctaggggactaactgtcccctggaataacttaaaaagtgcaggaataatttactcatttaagttgtttatgttagcatcacctttagatgaataaataatttgatctgtaatcaaaaatcaagagtttataaaatattttagagatgacttttaggtggagttacaaggtgagctgtaagtaatgagagagagacagagcagatagggcccaggtctctggatcagaacaacactgtttatattggagctgtgcatagtaattgattttaaggtttctcctacttaaaacaatttttttttcttgaacttcagtgaaaaaagtcttgtgctagagccagcttctactggcccatgaaagcatattgttatattttaaggaattttacaagctggttaattgatgtcttgttagtagcttgaaattggccgtggtgggagtgtttgcacaatggatattagtaaatgcagcaaatcagtctcccgctttttttccagagagctggtttttaaaaatgtatcagcatttccctgcttaccatagggattttaaatgatactgaatattatcatttaaaatttaagaatatttaagagtggaattgaggcctttagtttgagaaaacttaattcattctgccagagtttcatatttttcatttattagatgatttaagactttatatactttaaagcaaaatttggcaaatcccttattactagtattcgtctttagaattaaggcaggcagatcacttgaggtcaggagtttgagaccacactgaccaacatggtgaaacccatctctactaaaatacaaaaattagcaggcgtggtgggacgtgcctgtattccaacctgctagggttacaggatgggcgccctgctggcagatttatgaactttattatcacttaggttgctaattactatcttcctatggttggacacggtttgtgga

SEQ ID NO: 34845 - DNA, 2733 bp, Homo sapiens
ccttcctgcatcggtcctttctcggtgctgcagcagccttttacttactaatttcaccctgaagaaaggtagaccatcctggcgtggcagaagcgtggacattcgttttctaagggatggtcacacacctttgcctatttgcatttagtttctttaaaaagtaaaaacacctccattttggaacacttttagagacaaaagcagaacatacgaaagtgtatttcactgctgagttcttaagaggcgtacaccgtgtggttataacgtgcgcaactctgtcccgggcaactgaacttatttttagcgttattttcggcttctgctgcagaaaactagggattcaactacccgcacctacgtttcacacaacagcactcgtctctctccttcactcctaataaaaacaccttacttcgtttattcctgcctgctctacctcgtctcaacattttctcttgttaacttccaccacactgccttttactcggattggaaacccactctcccccaattctgtctcatacccccaacttcaggaagcgtcttccttttttccgcctctcgttcgcttttgtcttacgaggcttccggaacacggcccagaattacagagaaaacacactgcgcacgcgcactctctcgtcaccgctgtgcggcttctgtttggttggccagttcgtcccaatttccgactcacagggctgcggagcagcaactctcacgatatttgctgcgacccgcaggcgctatccgctgccgggttctggcgcgccctttcagttctgcttgctgtccgcaccgctgcgttacccggaaccgccgggccgaacagcatgacgtccgctttggagaactacatcaaccgaactgttgccgttattacatcagatgggagaatgattgtgggaacactgaaaggttttgaccagaccattaatttgattttggatgaaagccatgaacgagtattcagctcttcacagggggtagaacaagtggtactaggattatacattgtaagaggtgacaacgttgcagtcattggagaaatcgatgaagaaacagattctgcgcttgatttggggaatattcgagcagaacctttaaattctgtagcacactgaggaaaaactacatacttggacatctgtaaatctttgtacagaaactgattattctgaggatgatatatggagtttttatgaatgtgtcactggattttgactccttattgattcattgtaatatgtaaattaaaatatttctacattttattgaaaaaaaaaccttttttttgcctaaatataagtttggtagcttggtttcttttttttattaaatagtgtgaaaatataatgggcattttgaaaacttttagaaaaaagtagtactttttgatactttagtatttatggaaactagtggaaaagagaaattagtgtgctatataaatcaggcattcaagtaacagtaatacaggatatatgtgttttctttccctgatgtttaggaaaatcacaggagggtaaatctttgctggagttatctgaatcattggcatttatccgattccactggtggtagtttgctagtgcttctaaaagttgctccctagcactgagaggtgtgggtaggtaaaaatgtgtttgcttgagaaaagcaaaaatgctaacaaggttttgatagattggcccaaaattctaacttgaatattaagaatgactaggaatggtagaattgacagagatgattagtaaagtctcttgatgcccaattggttaggtatgaaagtaatatgaacacattaatgttgaattttacagacagtatatttgaaaaaaattgattccatgtagtcttcaatttttaatttttaagaattggagaatttctaatgttaaagttagtttataaatgtgagtaaataaactctaagttgtattgaagtagtgctagctattattgtcagcaattttccatgattcattatccataaacctgatttcagaagacgtcaactcagttttttaaataattgaaagaaacaatgtaagtagtgtttagatattcaggctagtccataaaatttctgatcaactcatgtataggcccaagtgtgtgtctttgtgatgagaagaacatagaaaaatatttacatccttgtaattgaaacaaatttaaatagtttatttgttttgtttttatgaaagtgcttaaaaatagtagttggcaagctttttctatgaagatccagatagtcttttaggctttgaaggccatgtggtctgtcacagctactcacctctgctattgtggcctacaaataaccatagataatacataaatgaatagtggctgtcttccagtaaaacttcatttataaaaatggaggtgggggttggattgggcttgaaggcatagttgctgacccttggcttaatacaagttcaataagaaaaaatgaacaatttgtataaattctggaatagatccttatagagagtttagaggtgggtttcattcatattttaaaatattttaaacttcatacttattaaacataatagctttttgggggaggaaaatatcttcactcaaatcagccttataaggggagaagcactattctctagaattatttggttgatgttaagggctgtctctgggagaattagagaagttagctagtattggctattcataagtacttgacttgtagtataatgttttata

SEQ ID NO: 34846 - DNA, 2759 bp, Homo sapiens
ccttcctgcatcggtcctttctcggtgctgcagcagccttttacttactaatttcaccctgaagaaaggtagaccatcctggcgtggcagaagcgtggacattcgttttctaagggatggtcacacacctttgcctatttgcatttagtttctttaaaaagtaaaaacacctccattttggaacacttttagagacaaaagcagaacatacgaaagtgtatttcactgctgagttcttaagaggcgtacaccgtgtggttataacgtgcgcaactctgtcccgggcaactgaacttatttttagcgttattttcggcttctgctgcagaaaactagggattcaactacccgcacctacgtttcacacaacagcactcgtctctctccttcactcctaataaaaacaccttacttcgtttattcctgcctgctctacctcgtctcaacattttctcttgttaacttccaccacactgccttttactcggattggaaacccactctcccccaattctgtctcatacccccaacttcaggaagcgtcttccttttttccgcctctcgttcgcttttgtcttacgaggcttccggaacacggcccagaattacagagaaaacacactgcgcacgcgcactctctcgtcaccgctgtgcggcttctgtttggttggccagttcgtcccaatttccgactcacagggctgcggagcagcaactctcacgatatttgctgcgacccgcaggcgctatccgctgccgggttctggcgcgccctttcagttctgcttgctgtccgcaccgctgcgttacccggaaccgccgggccgaacagcatgacgtccgctttggagaactacatcaaccgtatcctcaagctggccgccgcgggcgaactgttgccgttattacatcagatgggagaatgattgtgggaacactgaaaggttttgaccagaccattaatttgattttggatgaaagccatgaacgagtattcagctcttcacagggggtagaacaagtggtactaggattatacattgtaagaggtgacaacgttgcagtcattggagaaatcgatgaagaaacagattctgcgcttgatttggggaatattcgagcagaacctttaaattctgtagcacactgaggaaaaactacatacttggacatctgtaaatctttgtacagaaactgattattctgaggatgatatatggagtttttatgaatgtgtcactggattttgactccttattgattcattgtaatatgtaaattaaaatatttctacattttattgaaaaaaaaaccttttttttgcctaaatataagtttggtagcttggtttcttttttttattaaatagtgtgaaaatataatgggcattttgaaaacttttagaaaaaagtagtactttttgatactttagtatttatggaaactagtggaaaagagaaattagtgtgctatataaatcaggcattcaagtaacagtaatacaggatatatgtgttttctttccctgatgtttaggaaaatcacaggagggtaaatctttgctggagttatctgaatcattggcatttatccgattccactggtggtagtttgctagtgcttctaaaagttgctccctagcactgagaggtgtgggtaggtaaaaatgtgtttgcttgagaaaagcaaaaatgctaacaaggttttgatagattggcccaaaattctaacttgaatattaagaatgactaggaatggtagaattgacagagatgattagtaaagtctcttgatgcccaattggttaggtatgaaagtaatatgaacacattaatgttgaattttacagacagtatatttgaaaaaaattgattccatgtagtcttcaatttttaatttttaagaattggagaatttctaatgttaaagttagtttataaatgtgagtaaataaactctaagttgtattgaagtagtgctagctattattgtcagcaattttccatgattcattatccataaacctgatttcagaagacgtcaactcagttttttaaataattgaaagaaacaatgtaagtagtgtttagatattcaggctagtccataaaatttctgatcaactcatgtataggcccaagtgtgtgtctttgtgatgagaagaacatagaaaaatatttacatccttgtaattgaaacaaatttaaatagtttatttgttttgtttttatgaaagtgcttaaaaatagtagttggcaagctttttctatgaagatccagatagtcttttaggctttgaaggccatgtggtctgtcacagctactcacctctgctattgtggcctacaaataaccatagataatacataaatgaatagtggctgtcttccagtaaaacttcatttataaaaatggaggtgggggttggattgggcttgaaggcatagttgctgacccttggcttaatacaagttcaataagaaaaaatgaacaatttgtataaattctggaatagatccttatagagagtttagaggtgggtttcattcatattttaaaatattttaaacttcatacttattaaacataatagctttttgggggaggaaaatatcttcactcaaatcagccttataaggggagaagcactattctctagaattatttggttgatgttaagggctgtctctgggagaattagagaagttagctagtattggctattcataagtacttgacttgtagtataatgttttata

SEQ ID NO: 34847 - DNA, 2251 bp, Homo sapiens
tttttttgagtcgagggtctcactctgttgcccaggctggagtgcagtggcttgatcatggctcaatgcaaccttgaactcctgagcccaagcaatcctcctgcctctgcctctgcctcctgagtagctgggactataggtcaccaggccagggtaatagagatgggggtatcgctgtgttgcccaagctggtctcacctcaagtgatcctcctgccttggcgtcgaagaaacttttaacgtttttatgtagtgaacttagtggctgtgttgaatacttatacctagttgtcatatttattctaaaaattcaaatcattcccttgccagagtctgttttcaatttgcattccctaaggaacactttctttgattcagttatcgaactgttgccgttattacatcagatgggagaatgattgtgggaacactgaaaggttttgaccagaccattaatttgattttggatgaaagccatgaacgagtattcagctcttcacagggggtagaacaagtggtactaggattatacattgtaagaggtgacaacgttgcagtcattggagaaatcgatgaagaaacagattctgcgcttgatttggggaatattcgagcagaacctttaaattctgtagcacactgaggaaaaactacatacttggacatctgtaaatctttgtacagaaactgattattctgaggatgatatatggagtttttatgaatgtgtcactggattttgactccttattgattcattgtaatatgtaaattaaaatatttctacattttattgaaaaaaaaaccttttttttgcctaaatataagtttggtagcttggtttcttttttttattaaatagtgtgaaaatataatgggcattttgaaaacttttagaaaaaagtagtactttttgatactttagtatttatggaaactagtggaaaagagaaattagtgtgctatataaatcaggcattcaagtaacagtaatacaggatatatgtgttttctttccctgatgtttaggaaaatcacaggagggtaaatctttgctggagttatctgaatcattggcatttatccgattccactggtggtagtttgctagtgcttctaaaagttgctccctagcactgagaggtgtgggtaggtaaaaatgtgtttgcttgagaaaagcaaaaatgctaacaaggttttgatagattggcccaaaattctaacttgaatattaagaatgactaggaatggtagaattgacagagatgattagtaaagtctcttgatgcccaattggttaggtatgaaagtaatatgaacacattaatgttgaattttacagacagtatatttgaaaaaaattgattccatgtagtcttcaatttttaatttttaagaattggagaatttctaatgttaaagttagtttataaatgtgagtaaataaactctaagttgtattgaagtagtgctagctattattgtcagcaattttccatgattcattatccataaacctgatttcagaagacgtcaactcagttttttaaataattgaaagaaacaatgtaagtagtgtttagatattcaggctagtccataaaatttctgatcaactcatgtataggcccaagtgtgtgtctttgtgatgagaagaacatagaaaaatatttacatccttgtaattgaaacaaatttaaatagtttatttgttttgtttttatgaaagtgcttaaaaatagtagttggcaagctttttctatgaagatccagatagtcttttaggctttgaaggccatgtggtctgtcacagctactcacctctgctattgtggcctacaaataaccatagataatacataaatgaatagtggctgtcttccagtaaaacttcatttataaaaatggaggtgggggttggattgggcttgaaggcatagttgctgacccttggcttaatacaagttcaataagaaaaaatgaacaatttgtataaattctggaatagatccttatagagagtttagaggtgggtttcattcatattttaaaatattttaaacttcatacttattaaacataatagctttttgggggaggaaaatatcttcactcaaatcagccttataaggggagaagcactattctctagaattatttggttgatgttaagggctgtctctgggagaattagagaagttagctagtattggctattcataagtacttgacttgtagtataatgttttata

SEQ ID NO: 34848 - DNA, 1959 bp, Homo sapiens
gcggccgcctactactactactactgctcgaattcaagcttctaacgatgtacggggacatgacgtccgctttggagaactacatcaaccgaactgttgccgttattacatcagatgggagaatgattgtgggaacactgaaaggttttgaccagaccattaatttgattttggatgaaagccatgaacgagtattcagctcttcacagggggtagaacaagtggtactaggattatacattgtaagaggtgacaacgttgcagtcattggagaaatcgatgaagaaacagattctgcgcttgatttggggaatattcgagcagaacctttaaattctgtagcacactgaggaaaaactacatacttggacatctgtaaatctttgtacagaaactgattattctgaggatgatatatggagtttttatgaatgtgtcactggattttgactccttattgattcattgtaatatgtaaattaaaatatttctacattttattgaaaaaaaaaccttttttttgcctaaatataagtttggtagcttggtttcttttttttattaaatagtgtgaaaatataatgggcattttgaaaacttttagaaaaaagtagtactttttgatactttagtatttatggaaactagtggaaaagagaaattagtgtgctatataaatcaggcattcaagtaacagtaatacaggatatatgtgttttctttccctgatgtttaggaaaatcacaggagggtaaatctttgctggagttatctgaatcattggcatttatccgattccactggtggtagtttgctagtgcttctaaaagttgctccctagcactgagaggtgtgggtaggtaaaaatgtgtttgcttgagaaaagcaaaaatgctaacaaggttttgatagattggcccaaaattctaacttgaatattaagaatgactaggaatggtagaattgacagagatgattagtaaagtctcttgatgcccaattggttaggtatgaaagtaatatgaacacattaatgttgaattttacagacagtatatttgaaaaaaattgattccatgtagtcttcaatttttaatttttaagaattggagaatttctaatgttaaagttagtttataaatgtgagtaaataaactctaagttgtattgaagtagtgctagctattattgtcagcaattttccatgattcattatccataaacctgatttcagaagacgtcaactcagttttttaaataattgaaagaaacaatgtaagtagtgtttagatattcaggctagtccataaaatttctgatcaactcatgtataggcccaagtgtgtgtctttgtgatgagaagaacatagaaaaatatttacatccttgtaattgaaacaaatttaaatagtttatttgttttgtttttatgaaagtgcttaaaaatagtagttggcaagctttttctatgaagatccagatagtcttttaggctttgaaggccatgtggtctgtcacagctactcacctctgctattgtggcctacaaataaccatagataatacataaatgaatagtggctgtcttccagtaaaacttcatttataaaaatggaggtgggggttggattgggcttgaaggcatagttgctgacccttggcttaatacaagttcaataagaaaaaatgaacaatttgtataaattctggaatagatccttatagagagtttagaggtgggtttcattcatattttaaaatattttaaacttcatacttattaaacataatagctttttgggggaggaaaatatcttcactcaaatcagccttataaggggagaagcactattctctagaattatttggttgatgttaagggctgtctctgggagaattagagaagttagctagtattggctattcataagtacttgacttgtagtataatgttttata

SEQ ID NO: 34849 - DNA, 2197 bp, Homo sapiens
tttttttgagtcgagggtctcactctgttgcccaggctggagtgcagtggcttgatcatggctcaatgcaaccttgaactcctgagcccaagcaatcctcctgcctctgcctctgcctcctgagtagctgggactataggtcaccaggccagggtaatagagatgggggtatcgctgtgttgcccaagctggtctcacctcaagtgatcctcctgccttggcgtcgaagaaacttttaacgtttttatgtagtgaacttagtggctgtgttgaatacttatacctagttgtcatatttattctgaacactttctttgattcagttatcgaactgttgccgttattacatcagatgggagaatgattgtgggaacactgaaaggttttgaccagaccattaatttgattttggatgaaagccatgaacgagtattcagctcttcacagggggtagaacaagtggtactaggattatacattgtaagaggtgacaacgttgcagtcattggagaaatcgatgaagaaacagattctgcgcttgatttggggaatattcgagcagaacctttaaattctgtagcacactgaggaaaaactacatacttggacatctgtaaatctttgtacagaaactgattattctgaggatgatatatggagtttttatgaatgtgtcactggattttgactccttattgattcattgtaatatgtaaattaaaatatttctacattttattgaaaaaaaaaccttttttttgcctaaatataagtttggtagcttggtttcttttttttattaaatagtgtgaaaatataatgggcattttgaaaacttttagaaaaaagtagtactttttgatactttagtatttatggaaactagtggaaaagagaaattagtgtgctatataaatcaggcattcaagtaacagtaatacaggatatatgtgttttctttccctgatgtttaggaaaatcacaggagggtaaatctttgctggagttatctgaatcattggcatttatccgattccactggtggtagtttgctagtgcttctaaaagttgctccctagcactgagaggtgtgggtaggtaaaaatgtgtttgcttgagaaaagcaaaaatgctaacaaggttttgatagattggcccaaaattctaacttgaatattaagaatgactaggaatggtagaattgacagagatgattagtaaagtctcttgatgcccaattggttaggtatgaaagtaatatgaacacattaatgttgaattttacagacagtatatttgaaaaaaattgattccatgtagtcttcaatttttaatttttaagaattggagaatttctaatgttaaagttagtttataaatgtgagtaaataaactctaagttgtattgaagtagtgctagctattattgtcagcaattttccatgattcattatccataaacctgatttcagaagacgtcaactcagttttttaaataattgaaagaaacaatgtaagtagtgtttagatattcaggctagtccataaaatttctgatcaactcatgtataggcccaagtgtgtgtctttgtgatgagaagaacatagaaaaatatttacatccttgtaattgaaacaaatttaaatagtttatttgttttgtttttatgaaagtgcttaaaaatagtagttggcaagctttttctatgaagatccagatagtcttttaggctttgaaggccatgtggtctgtcacagctactcacctctgctattgtggcctacaaataaccatagataatacataaatgaatagtggctgtcttccagtaaaacttcatttataaaaatggaggtgggggttggattgggcttgaaggcatagttgctgacccttggcttaatacaagttcaataagaaaaaatgaacaatttgtataaattctggaatagatccttatagagagtttagaggtgggtttcattcatattttaaaatattttaaacttcatacttattaaacataatagctttttgggggaggaaaatatcttcactcaaatcagccttataaggggagaagcactattctctagaattatttggttgatgttaagggctgtctctgggagaattagagaagttagctagtattggctattcataagtacttgacttgtagtataatgttttata

SEQ ID NO: 34850 - DNA, 3025 bp, Homo sapiens
gaaaaattagcctggtgtggtggtgcatgcctgtaatcccagctacttgggaggctgaggcagaagaatttcttgaacctggtagatggaggttgcagtgagccaaggttgcgcctttgcactccagcctgggcaaaaagagtgaaactccatcttgaaaaaaaaaagaaaagtggctgatgtgacagaggaactgaattttaaattttatttaattgtaattaattttaatagttacatgtggccagtattagtatagttatagaggctagaagaatgccaaatcagttttctagtgagtactacactgaatcaaaatatagttggaaagaagcaaaagatacattagcaattttaagctagaacatttaacaaattctaggggactaactgtcccctggaataacttaaaaagtgcaggaataatttactcatttaagttgtttatgttagcatcacctttagatgaataaataatttgatctgtaatcaaaaatcaagagtttataaaatattttagagatgacttttaggtggagttacaaggtgagctgtaagtaatgagagagagacagagcagatagggcccaggtctctggatcagaacaacactgtttatattggagctgtgcatagtaattgattttaaggtttctcctacttaaaacaatttttttttcttgaacttcagtgaaaaaagtcttgtgctagagccagcttctactggcccatgaaagcatattgttatattttaaggaattttacaagctggttaattgatgtcttgttagtagcttgaaattggccgtggtgggagtgtttgcacaatggatattagtaaatgcagcaaatcagtctcccgctttttttccagagagctggtttttaaaaatgtatcagcatttccctgcttaccatagggattttaaatgatactgaatattatcatttaaaatttaagaatatttaagagtggaattgaggcctttagtttgagaaaacttaattcattctgccagagtttcatatttttcatttattagatgatttaagactttatatactttaaagcaaaatttggcaaatcccttattactagtattcgtctttagaatttggccgggcacagtggctcacacctgtagtcccagcactttgggaggctgaggctggcgaattaccagaggtcagaggttcgagacctgcctagccaacgtggtgaaaccctgtctctactaaaaatacaaaaattagccgggtgtggtggcatgcgcctgtaatcccagctactcgggaggctgaagcatgagaatcgcttgaacctgtgcagtcattggagaaatcgatgaagaaacagattctgcgcttgatttggggaatattcgagcagaacctttaaattctgtagcacactgaggaaaaactacatacttggacatctgtaaatctttgtacagaaactgattattctgaggatgatatatggagtttttatgaatgtgtcactggattttgactccttattgattcattgtaatatgtaaattaaaatatttctacattttattgaaaaaaaaaccttttttttgcctaaatataagtttggtagcttggtttcttttttttattaaatagtgtgaaaatataatgggcattttgaaaacttttagaaaaaagtagtactttttgatactttagtatttatggaaactagtggaaaagagaaattagtgtgctatataaatcaggcattcaagtaacagtaatacaggatatatgtgttttctttccctgatgtttaggaaaatcacaggagggtaaatctttgctggagttatctgaatcattggcatttatccgattccactggtggtagtttgctagtgcttctaaaagttgctccctagcactgagaggtgtgggtaggtaaaaatgtgtttgcttgagaaaagcaaaaatgctaacaaggttttgatagattggcccaaaattctaacttgaatattaagaatgactaggaatggtagaattgacagagatgattagtaaagtctcttgatgcccaattggttaggtatgaaagtaatatgaacacattaatgttgaattttacagacagtatatttgaaaaaaattgattccatgtagtcttcaatttttaatttttaagaattggagaatttctaatgttaaagttagtttataaatgtgagtaaataaactctaagttgtattgaagtagtgctagctattattgtcagcaattttccatgattcattatccataaacctgatttcagaagacgtcaactcagttttttaaataattgaaagaaacaatgtaagtagtgtttagatattcaggctagtccataaaatttctgatcaactcatgtataggcccaagtgtgtgtctttgtgatgagaagaacatagaaaaatatttacatccttgtaattgaaacaaatttaaatagtttatttgttttgtttttatgaaagtgcttaaaaatagtagttggcaagctttttctatgaagatccagatagtcttttaggctttgaaggccatgtggtctgtcacagctactcacctctgctattgtggcctacaaataaccatagataatacataaatgaatagtggctgtcttccagtaaaacttcatttataaaaatggaggtgggggttggattgggcttgaaggcatagttgctgacccttggcttaatacaagttcaataagaaaaaatgaacaatttgtataaattctggaatagatccttatagagagtttagaggtgggtttcattcatattttaaaatattttaaacttcatacttattaaacataatagctttttgggggaggaaaatatcttcactcaaatcagccttataaggggagaagcactattctctagaattatttggttgatgttaagggctgtctctgggagaattagagaagttagctagtattggctattcataagtacttgacttgtagtataatgttttata

SEQ ID NO: 34851 - DNA, 2037 bp, Homo sapiens
tatggtttggaagtttgagggttttttactgtgtctatccttgtgtgtctgtttcctttaaagattcatgatacaatcactgtgtacaatgtgtcctttaatattggttcctgtaataatgtgccttcaaattatttcttgagttttgtgacttaaatatgcagttcactgactcacgccaatgttgtttgctttttaccttaattctttttactgtgctctctcagttttattttttggaagaatggtactcagtgctttgatttgattagtaagatttttgaaacacatgtaatttatttcagaaatgtgattgttttaactctgacttttttagtgcagtcattggagaaatcgatgaagaaacagattctgcgcttgatttggggaatattcgagcagaacctttaaattctgtagcacactgaggaaaaactacatacttggacatctgtaaatctttgtacagaaactgattattctgaggatgatatatggagtttttatgaatgtgtcactggattttgactccttattgattcattgtaatatgtaaattaaaatatttctacattttattgaaaaaaaaaccttttttttgcctaaatataagtttggtagcttggtttcttttttttattaaatagtgtgaaaatataatgggcattttgaaaacttttagaaaaaagtagtactttttgatactttagtatttatggaaactagtggaaaagagaaattagtgtgctatataaatcaggcattcaagtaacagtaatacaggatatatgtgttttctttccctgatgtttaggaaaatcacaggagggtaaatctttgctggagttatctgaatcattggcatttatccgattccactggtggtagtttgctagtgcttctaaaagttgctccctagcactgagaggtgtgggtaggtaaaaatgtgtttgcttgagaaaagcaaaaatgctaacaaggttttgatagattggcccaaaattctaacttgaatattaagaatgactaggaatggtagaattgacagagatgattagtaaagtctcttgatgcccaattggttaggtatgaaagtaatatgaacacattaatgttgaattttacagacagtatatttgaaaaaaattgattccatgtagtcttcaatttttaatttttaagaattggagaatttctaatgttaaagttagtttataaatgtgagtaaataaactctaagttgtattgaagtagtgctagctattattgtcagcaattttccatgattcattatccataaacctgatttcagaagacgtcaactcagttttttaaataattgaaagaaacaatgtaagtagtgtttagatattcaggctagtccataaaatttctgatcaactcatgtataggcccaagtgtgtgtctttgtgatgagaagaacatagaaaaatatttacatccttgtaattgaaacaaatttaaatagtttatttgttttgtttttatgaaagtgcttaaaaatagtagttggcaagctttttctatgaagatccagatagtcttttaggctttgaaggccatgtggtctgtcacagctactcacctctgctattgtggcctacaaataaccatagataatacataaatgaatagtggctgtcttccagtaaaacttcatttataaaaatggaggtgggggttggattgggcttgaaggcatagttgctgacccttggcttaatacaagttcaataagaaaaaatgaacaatttgtataaattctggaatagatccttatagagagtttagaggtgggtttcattcatattttaaaatattttaaacttcatacttattaaacataatagctttttgggggaggaaaatatcttcactcaaatcagccttataaggggagaagcactattctctagaattatttggttgatgttaagggctgtctctgggagaattagagaagttagctagtattggctattcataagtacttgacttgtagtataatgttttata

SEQ ID NO: 34852 - DNA, 1836 bp, Homo sapiens
ccttcctgcatcggtcctttctcggtgctgcagcagccttttacttactaatttcaccctgaagaaaggtagaccatcctggcgtggcagaagcgtggacattcgttttctaagggatggtcacacacctttgcctatttgcatttagtttctttaaaaagtaaaaacacctccattttggaacacttttagagacaaaagcagaacatacgaaagtgtatttcactgctgagttcttaagaggcgtacaccgtgtggttataacgtgcgcaactctgtcccgggcaactgaacttatttttagcgttattttcggcttctgctgcagaaaactagggattcaactacccgcacctacgtttcacacaacagcactcgtctctctccttcactcctaataaaaacaccttacttcgtttattcctgcctgctctacctcgtctcaacattttctcttgttaacttccaccacactgccttttactcggattggaaacccactctcccccaattctgtctcatacccccaacttcaggaagcgtcttccttttttccgcctctcgttcgcttttgtcttacgaggcttccggaacacggcccagaattacagagaaaacacactgcgcacgcgcactctctcgtcaccgctgtgcggcttctgtttggttggccagttcgtcccaatttccgactcacagggctgcggagcagcaactctcacgatatttgctgcgacccgcaggcgctatccgctgccgggttctggcgcgccctttcagttctgcttgctgtccgcaccgctgcgttacccggaaccgccgggccgaacagcatgacgtccgctttggagaactacatcaaccgtatcctcaagctggccgccgcgggcgtgagccggggtcgcggagaggccgcggtcggggatcggtgggaggttgggaggcctggcctcggcgggatcctgggggcgggcgaggagatgagggccccggaacgacccagagttcgccggcggcgcctcgagccttcccgctgctgcgggcccaggggtcctttccattttgcctgcaaaacccaaataaaaacccagtgtgattattccgaacttttctgtcttaaaaaaaatgtacgctcttgattcttacttactatttccctatggcataagtgttaaagtttgtgaataagatgaacagtcgtcctggcggcgacaacagttttgcaaatctttgtacttgttttattcacataatttgctcgttcgaggatagcaaaaagtttaacgatggttcacagactgtttctgtccctttaccacttgaagtcccaacttgttggtagaatgacacaaaaatggttgctgttgtaatggattatagtgaggagcaagtaacaaccccatgggaagtcttaaaatagactttacaagtgttaccgttttaaagtcttaggacaaaaacactacgttaagctcaggtacaaactgggtgacaaaaattaaataccgaatgcttttaatgatgcgttattggtaccctgtgacactgcttatatagtttctttacttttgaattacagaagcctgtcctggaagacagttttttaacatgctggaaaatcgtccaacatcgattaatttagtactcatccacttttcattttagaaataaacaggctaagaaacgaaatatcctgcctgaaataatagattggtaaccttcctagtagaaaagtgtcaaaaatccaggatattttgagataagatacaccgatcacatacagaaagaggttttctttttctattttttcccttttttaatcatgtaattatcaca

SEQ ID NO: 34853 - DNA, 1715 bp, Homo sapiens
ccttcctgcatcggtcctttctcggtgctgcagcagccttttacttactaatttcaccctgaagaaaggtagaccatcctggcgtggcagaagcgtggacattcgttttctaagggatggtcacacacctttgcctatttgcatttagtttctttaaaaagtaaaaacacctccattttggaacacttttagagacaaaagcagaacatacgaaagtgtatttcactgctgagttcttaagaggcgtacaccgtgtggttataacgtgcgcaactctgtcccgggcaactgaacttatttttagcgttattttcggcttctgctgcagaaaactagggattcaactacccgcacctacgtttcacacaacagcactcgtctctctccttcactcctaataaaaacaccttacttcgtttattcctgcctgctctacctcgtctcaacattttctcttgttaacttccaccacactgccttttactcggattggaaacccactctcccccaattctgtctcatacccccaacttcaggaagcgtcttccttttttccgcctctcgttcgcttttgtcttacgaggcttccggaacacggcccagaattacagagaaaacacactgcgcacgcgcactctctcgtcaccgctgtgcggcttctgtttggttggccagttcgtcccaatttccgactcacagggctgcggagcagcaactctcacgatatttgctgcgacccgcaggcgctatccgctgccgggttctggcgcgccctttcagttctgcttgctgtccgcaccgctgcgttacccggaaccgccgggccgaacagcatgacgtccgctttggagaactacatcaaccgaactgttgccgttattacatcagatgggagaatgattgtgggaacactgaaaggttttgaccagaccattaatttgattttggatgaaagccatgaacgagtattcagctcttcacagggggtagaacaagtggtactaggattatacattgtaagaggtgacaacgttgcagtcattggagaaatcgatgaagaaacagattctgcgcttgatttggggaatattcgagcagaacctttaaattctgtagcacactgaggaaaaactacatacttggacatctgtaaatctttgtacagaaactgattattctgaggatgatatatggagtttttatgaatgtgtcactggattttgactccttattgattcattgtaatatgtaaattaaaatatttctacattttattgaaaaaaaaaaaaaaaaaaaaaaaaaaaaaaaaaaaaaaaaaaaaaaaaaaaaaaaaaaaaaaagggggggggggaaattattctctcgcgggaggggagacaaattattggaggtggtaagccagagttttgttttgaaaagaggggtggccccataatggggggtgcgttatatatagagagaaggggcggagggggcggtcttataaaacgaggttgttgcgtgggggaaaacaacggtgttatgtcgggggagatgttgtggagagaggaggaacacatacattgggggggggggggacaattgtggggggccccatccctccgagagattatttagggctcccaggggaaatattaacaattggaggtggattatggtgggtcaaccagaagggtaatttgttggtcggactaaaatgtggctagggatgtgta

SEQ ID NO: 34854 - DNA, 1568 bp, Homo sapiens
ccttcctgcatcggtcctttctcggtgctgcagcagccttttacttactaatttcaccctgaagaaaggtagaccatcctggcgtggcagaagcgtggacattcgttttctaagggatggtcacacacctttgcctatttgcatttagtttctttaaaaagtaaaaacacctccattttggaacacttttagagacaaaagcagaacatacgaaagtgtatttcactgctgagttcttaagaggcgtacaccgtgtggttataacgtgcgcaactctgtcccgggcaactgaacttatttttagcgttattttcggcttctgctgcagaaaactagggattcaactacccgcacctacgtttcacacaacagcactcgtctctctccttcactcctaataaaaacaccttacttcgtttattcctgcctgctctacctcgtctcaacattttctcttgttaacttccaccacactgccttttactcggattggaaacccactctcccccaattctgtctcatacccccaacttcaggaagcgtcttccttttttccgcctctcgttcgcttttgtcttacgaggcttccggaacacggcccagaattacagagaaaacacactgcgcacgcgcactctctcgtcaccgctgtgcggcttctgtttggttggccagttcgtcccaatttccgactcacagggctgcggagcagcaactctcacgatatttgctgcgacccgcaggcgctatccgctgccgggttctggcgcgccctttcagttctgcttgctgtccgcaccgctgcgttacccggaaccgccgggccgaacagcatgacgtccgctttggagaactacatcaaccgaactgttgccgttattacatcagatgggagaatgattgtgggaacactgaaaggttttgaccagaccattaatttgattttggatgaaagccatgaacgagtattcagctcttcacagggggtagaacaagtggtactaggattatacattgtaagaggtgacaacgtgtaagtaaaatatatctgttaaaattataaatgatactgccttactttatggagaagaggctttccccaaaataccctactgtattgtccatacatagttaatagaatcttgcattcatttctttcgtaaatataccttttcttatgtttgtgtaaaataaggcatatgtatacattttatgtcagcacttctttaggtttcaaccaaagctgtctctctacaaattaaacttttacctgagatttgcccatttttctactagttaagtagcctgggtagagtccagaaagggctctgccttatattaaatacttcattagagagacttcttaaaacgttctttcaaatacccagaattttagaggaacatatttctagagtccaaggccaaagtttgaaaaatgttttgaaatctctgatttgaacaatattaattcatgctcaataacataggtgtatttataaataagtacttactcgttattcattttcttttaattttttagtatcattgacacacttaagatgtccctg

SEQ ID NO: 34855 - DNA, 1489 bp, Homo sapiens
ccttcctgcatcggtcctttctcggtgctgcagcagccttttacttactaatttcaccctgaagaaaggtagaccatcctggcgtggcagaagcgtggacattcgttttctaagggatggtcacacacctttgcctatttgcatttagtttctttaaaaagtaaaaacacctccattttggaacacttttagagacaaaagcagaacatacgaaagtgtatttcactgctgagttcttaagaggcgtacaccgtgtggttataacgtgcgcaactctgtcccgggcaactgaacttatttttagcgttattttcggcttctgctgcagaaaactagggattcaactacccgcacctacgtttcacacaacagcactcgtctctctccttcactcctaataaaaacaccttacttcgtttattcctgcctgctctacctcgtctcaacattttctcttgttaacttccaccacactgccttttactcggattggaaacccactctcccccaattctgtctcatacccccaacttcaggaagcgtcttccttttttccgcctctcgttcgcttttgtcttacgaggcttccggaacacggcccagaattacagagaaaacacactgcgcacgcgcactctctcgtcaccgctgtgcggcttctgtttggttggccagttcgtcccaatttccgactcacagggctgcggagcagcaactctcacgatatttgctgcgacccgcaggcgctatccgctgccgggttctggcgcgccctttcagttctgcttgctgtccgcaccgctgcgttacccggaaccgccgggccgaacagcatgacgtccgctttggagaactacatcaaccgaactgttgccgttattacatcagatgggagaatgattgtgggaacactgaaaggttttgaccagaccattaatttgattttggatgaaagccatgaacgagtattcagctcttcacagggggtagaacaagtggtactaggattatacattgtaagaggtgacaacgttggccgggcacagtggctcacacctgtagtcccagcactttgggaggctgaggctggcgaattaccagaggtcagaggttcgagacctgcctagccaacgtggtgaaaccctgtctctactaaaaatacaaaaattagccgggtgtggtggcatgcgcctgtaatcccagctactcgggaggctgaagcatgagaatcgcttgaacctgtgcagtcattggagaaatcgatgaagaaacagattctgcgcttgatttggggaatattcgagcagaacctttaaattctgtagcacactgaggaaaaactacatacttggacatctgtaaatctttgtacagaaactgattattctgaggatgatatatggagtttttatgaatgtgtcactggattttgactccttattgattcattgtaatatgtaaattaaaatatttctacattttattgaaa

SEQ ID NO: 34856 - DNA, 515 bp, Homo sapiens
ggggctaattatagtactaaatcaaagggtagagatgagttgagaaaatgtgtacagtgtgtttagcacactgcctagtgctggcatatagcatatagtgatactattacattgctgtagttggtatgtatggttcttccttatttatgtatatttggctatcattttcccttaaatatcctttgtcttagtttatacctttagctgctggtctacataagcttttatgctacttacttggagatagtcacattagtacataggtgtcctttgcaactgctgtcaactctacatatgagtgagatgtgtggtgcaggtccccccaccccagccaaataaccaagaggtaaattgtgtaccctcgaatactgttggttataaaaaaggcattttatttgccgtcgtataggtacttgtattggaatacctggcaactaaaatgactgtgaggttaaatttacactttcaggtaaaccagaatatttctctttttctcctgaatattttctttacag

SEQ ID NO: 34857 - DNA, 1280 bp, Homo sapiens
ccttcctgcatcggtcctttctcggtgctgcagcagccttttacttactaatttcaccctgaagaaaggtagaccatcctggcgtggcagaagcgtggacattcgttttctaagggatggtcacacacctttgcctatttgcatttagtttctttaaaaagtaaaaacacctccattttggaacacttttagagacaaaagcagaacatacgaaagtgtatttcactgctgagttcttaagaggcgtacaccgtgtggttataacgtgcgcaactctgtcccgggcaactgaacttatttttagcgttattttcggcttctgctgcagaaaactagggattcaactacccgcacctacgtttcacacaacagcactcgtctctctccttcactcctaataaaaacaccttacttcgtttattcctgcctgctctacctcgtctcaacattttctcttgttaacttccaccacactgccttttactcggattggaaacccactctcccccaattctgtctcatacccccaacttcaggaagcgtcttccttttttccgcctctcgttcgcttttgtcttacgaggcttccggaacacggcccagaattacagagaaaacacactgcgcacgcgcactctctcgtcaccgctgtgcggcttctgtttggttggccagttcgtcccaatttccgactcacagggctgcggagcagcaactctcacgatatttgctgcgacccgcaggcgctatccgctgccgggttctggcgcgccctttcagttctgcttgctgtccgcaccgctgcgttacccggaaccgccgggccgaacagcatgacgtccgctttggagaactacatcaaccgaactgttgccgttattacatcagatgggagaatgattgtgggaacactgaaaggttttgaccagaccattaatttgattttggatgaaagccatgaacgagtattcagctcttcacagggggtagaacaagtggtactaggattatacattgtaagaggtgacaacgttgcagtcattggagaaatcgatgaagaaacagattctgcgcttgatttggggaatattcgagcagaacctttaaattctgtagcacactgaggaaaaactacatacttggacatctgtaaatctttgtacagaaactgattattctgaggatgatatatggagtttttatgaatgtgtcactggattttgactccttattgattcattgtaatatgtaaattaaaatatttctacattttattgaaa

SEQ ID NO: 34858 - DNA, 886 bp, Homo sapiens
aagcgaatgtaaaaaaatttccttctttataagtctgttggttataataattaatgtgaaaatctacttcattaaatggggtctattgatcatttctttgtctggaataaatgaataaataatacattgctgttatatatgtaattaacatgttgtggcaaacataaatgttatgggtaacatttactacctaaaatgccttctagtggctaattatttgtttttgccttaatagtttctgagttttaatttttttaaacttaggcttttgcacttaaaataggaccatataatatgttcattaactgtgtatatccttttaaagaaggaaataggaaacgtgattgtttatgttgtttgaagatggtagtatattcctatttcctcgggaaatgggaagacataattcacattctataatcatatacttaggattactttgttaactctttataactttgagctagtgttctatacattattgaattaatgaaatgggtatatatgcaaaaggaaaagataatttttttccaggtttctttgagaaatagaaaataaaacgagacactagtggtaaatttggttatctgaagaattatttgtgagatagatcactgtcatggaacaatgttaatgcgtaatctgcttatagtcttctgaattaagttcttctaggtcatattaagtttttccctaactttgaataggtttttcttagtaatcaccatttttagttcagtatttaagtgttctataaggtcattgtgaggtataaaaagataaataggccaggtgtgatgactcatgcctgtaataccagcactttgggagggtgaggcaggaggattgaggctaggagtttgagaccagcctggacaaagtgaga

SEQ ID NO: 34859 - DNA, 678 bp, Homo sapiens
gtgatcttggctcactgcagcctcaacctctcaggctgaagcgatcctcccacctcagcctcccaggtagctgggactacaggttcatgccaccatgcccggtgaatttttgtatttttttgtagaggtggggtttcaccatgtcgcctgggctggtctcagacttctgggctcaagccatcctccctcctcggcctcccaaagtgctggcactatgggtatgagccacagtgtccagccttccttatttcataagaagagtgtgtatacaggcatggctgttgattcacgttgccattgaaagacatctactgctctagccagaggaatccctactgactccaggaggtccacagtcatcatccctgtagaaggacaggtattgtatccaaactagcctagttcctcaaactcccaagttctgaagttttatgaactgattactagaaagaggaggcagagattgttctgctgaaattggcggataaattgcagaaaactcagggatggagaaaactaaaataacgaaaatcaatagtgcatctgatgtgatcttacagtttaatctgagcagttcttagcatatataatttgtgagaaaattcattatgtggggatgcagcaagtacattccatatcaatgcacaaatgctctgttaataaatgctatcaccccaa

SEQ ID NO: 34860 - DNA, 493 bp, Homo sapiens
gaattccagttcttaatgacactggagaatttaagtatgaagcaactatttcatgtgatttattccacatttcataaccaatagtctcagaataacaatactaacattatcaaattgttgtgcttataagtcattggaatattttatgtgtggctaaaaattgagcataaattgcattttcattttttatttttagtgattagtttttattaacatttcattttattttaaaattatataaaatgttttatatagttccaaagtcaaatgtataataagaatatattgaaagtatatacaaagaagtataggtttcatccttactatgtccaccattcaaccctttatgaagtaaccattttggcaacttttttgtggtttattcttttattatttgtttttctttttaatgataacagataaacatgtgtgttcttagctcattttatgctgctataacaatacctgagacttggtaatttataaaaaaaaa

SEQ ID NO: 34861 - DNA, 351 bp, Homo sapiens
cttcaaattatactataatgccacaattaccaaaataggatggtgctgatataaaaataggcatatagaggttgggcatggtggctcatgtctgtaatcccagcactttgggaggccgaggtgggcagatcacgaggtcaggagatcgagaccatcctggataacacggtgaaaccccgtcgctaaaaatacaaaaaaaaattagtcgggcatggtggaaggcgcctgtattcccagctactcaggagactgaggcaggagaatggcgtgaacccgggaggtggagcttgcagtgagccgagattgcaccactgcactccagcctgggccacagagtgagactctgtctca

SEQ ID NO: 34862 - DNA, 344 bp, Homo sapiens
gtttaatctaatacctttcttcccaaaataaaccaacaaaagatgaacaaatccgaaatatagccaaggctgcattctcattgatgtaatgctgtgttttaaaaaacaagtcaattgctgtgaggtcctgggtgaatttaatctctttggcccaatgcctgatgccctgacattaaaaccttaggcaacactgattaaaatcataagcttgctcagattgcgctcttattgatttttttttttaaggtgggcaacaaaagggaagtttgcttgttttttttggcagcgttcgttgagcaccagaaattgtgcagggtatagagctgtagagtcatttgaggtaa

SEQ ID NO: 34863 - DNA, 431 bp, Homo sapiens
aaaagcaaccagcagggagcccaagagccttctagagattggttatattttgtttcttgatctggatatcatttactcagacacgtttatttggtgaaaattctttgcactgtggacttacgacgtgtacttttctgtacgcctgttatacatcagttataagattttaaaataattaaaatataaactctaggacaatcagggttaaaaaaaagtagcctgagactctgatttatcttttcttctatttttctgtctcaattgcctgtttttttattgtttcgattaaaatctttatcaacagacgttatataattctttgaaagggttttgtcctgtagcttttgaatgtgtactttcatcattattgtgcatgtctttcaacattttttcaaaaataatttctgtactcagtaaaaatgttctctttg

SEQ ID NO: 34864 - DNA, 1000 bp, Homo sapiens
ttattttgtgatttgaaaatggacttttatgttttaggaattatgtggatgggatgttttcttgggtgatcgatttgaaattgcagaggggagcaggtgccatgtgctggcaatggccggccttccttccttccttccttccttccttccttccttccttccttccttccttcctccattcctcctaccccccgtttcttccttctttctctctctttctttccttttctctttttctttctttttctttcttttctttctttctttctctctctctctttctctctctctctctttcattttgtttgttttaatgagtgagagtaaagagaaagaaaagaactgtttttattttttgtctacctttattgtaaggagagagtgaggataccatgccacacatgcagggtcctgagcagagggctgcaccctgcttagttctaaagacacctagactttatcctgaaagccactgagaggcccatattttgaaacactcagcctctcagaagaggatagaatgggttgccagtgtaatagggagagaaatcgaacatagctgactccatgttgcttctgactcctcaagctaactgcttttaggcacttctgcacacgggccaagttaatcatggaaagaacttagattacagtttaactggaaagcaaggatgataagcgttcctttccaaaactaacctctgaggagataagaagggcatgcacacaagtaacaatgttatattgaagacttgtaggagcgctgtgacctgagcaaggacaaagttttgcaatctccttgggcccctgctgatgcccaagtgtctgtggtcaccagccacccccctcacctcagtctcctccttgttccccttcagtgtaccccttcaatgtacaaagaagcttgagattcatgcctttaaagatggttcgttaggacatgggtccagtatcttcctgacttgctggctctccaaataaagatgcttttcttgctcta

SEQ ID NO: 34865 - DNA, 1478 bp, Homo sapiens
ttattttgtgatttgaaaatggacttttatgttttaggaattatgtggatgggatgttttcttgggtgatcgatttgaaattgcagaggggagcaggtgccatgtgctggcaatggccggccttccttccttccttccttccttccttccttccttccttccttccttccttcctccattcctcctaccccccgtttcttccttctttctctctctttctttccttttctctttttctttctttttctttcttttctttctttctttctctctctctctttctctctctctctctttcattttgtttgttttaatgagtgagagtaaagagaaagaaaagaactgtttttattttttgtctacctttattgtaaggagagagtgaggataccatgccacacatgcagggtcctgagcagagggctgcaccctgcttagttctaaagacacctagactttatcctgaaagccactgagaggcccatattttgaaacactcagcctctcagaagaggatagaatgggttgccagtgtaatagggagagaaatcgaacatagctgactccatgttgcttctgactcctcaagctaactgcttttaggcacttctgcacacgggccaagttaatcatggaaagaacttagattacagtttaactggaaagcaaggatgataagcgttcctttccaaaactaacctctgaggagataagaagggcatgcacacaagtaacaatgttatattgaagacttgtaggagcgctgtgacctgagcaaggacaaagttttgcaatctccttgggcccctgctgatgcccaagtgtctgtggtcaccagccacccccctcacctcagtctcctccttgttccccttcagtgtaccccttcaatgtacaaagaagcttgagattcatgcctttaaagatggttcgttaggacatgggtccagtatcttcctgacttgctggctctccaaataaagatgcttttcttgctctaactttttgtctcgtgaatcattggctgttatgcagtgagcctcaggaactttggactccacagcaccaggacaactctcaggactcccagtctctattgggtgcaggaatcactggggagtctggctgaagtgcagactctgattgaggaggcctgggacacgaggcctgagattctgcatctccagtaagcaccaaggggatgttgatgctgctgatccagggaccacaccttggagagcaatgctgagaagctggtggaagagcccaggctcatgaagatctgaacatggtccatagcagggaggttggggaaatgagataaaaatgttaaaaatggcagttaccttcctggagaagaaatggcttttccattccttattaggctcatgtctttggaactagcccccactggtctccttcctgttatatacctgcagttaccatgttcttgttaaggaagaatggcaaatgcaaaa

SEQ ID NO: 34866 - DNA, 946 bp, Homo sapiens
ttattttgtgatttgaaaatggacttttatgttttaggaattatgtggatgggatgttttcttgggtgatcgatttgaaattgcagaggggagcaggtgccatgtgctggcaatggccggccttccttccttccttccttccttccttccttccttccttccttccttccttcctccattcctcctaccccccgtttcttccttctttctctctctttctttccttttctctttttctttctttttctttcttttctttctttctttctctctctctctttctctctctctctctttcattttgtttgttttaatgagtgagagtaaagagaaagaaaagaactgtttttattttttgtctacctttattgtaaggagagagtgaggataccatgccacacatgcagggtcctgagcagagggctgcaccctgcttagttctaaagacacctagactttatcctgaaagccactgagaggcccatattttgaaacactcagcctctcagaagaggatagaatgggttgccagtgtaatagggagagaaatcgaacatagctgactccatgttgcttctgactcctcaagctaactgcttttaggcacttctgcacacgggccaagttaatcatggaaagaacttagattacagtttaactggaaagcaaggatgataagcgttcctttccaaaactaacctctgaggagataagaagggcatgcacacaagtaacaatgttatattggggcccctgctgatgcccaagtgtctgtggtcaccagccacccccctcacctcagtctcctccttgttccccttcagtgtaccccttcaatgtacaaagaagcttgagattcatgcctttaaagatggttcgttaggacatgggtccagtatcttcctgacttgctggctctccaaataaagatgcttttcttgctcta

SEQ ID NO: 34867 - DNA, 372 bp, Homo sapiens
gaggtccgaccctaaagcaaacccccgactcatgctggtctcgaactcctgagctcaggcaatccgcctgcctcagcctcccaaagtgctgggattacaggcgtgagccacggtgccagcctccgtcatagtttctaaaacacccacaccacaacagtaatcttgactcaacttcagctcctcatcctgtgtctaagccaagtttagccgaagaaaacatctgccgagaaagtaaaaacaaaaacataaagtggggaaaggacacccttttcaacaaatagtgctgggataactggctagccacatgtaagagaatgaaactggttcctcatctctcaccttatacaaaaatcaactcaagatgcattaaag

SEQ ID NO: 34868 - DNA, 840 bp, Homo sapiens
ctgttgcccaggctggagtgcaatggcatgatttcagctcactgcaacctccacctcctgggttcaagcgattctcctgcctcagcctcccgggtagctgggactacaggcgcatgctgccacgcccggctaattttttgtattttagtagagacagggtttcaccgttgttgcccaggctggtctcgaactcctgagctcaggcaatccgcctgcctcagcctcccaaagtgctgggattacaggcgtgagccacggtgccagcctccgtcatagtttctaaaacacccacaccacaacagtaatcttgactcaacttcagctcctcatcctgtgtctaagccaagtttagccgaagaaaacatctgccgagaaagtaaaaacaaaaacatctgccaaaggcaagaacccggtgggaagccccctgagcccagtggcctgcagagtctgttctagtgacaaagcaggcaactggaagagatcagggctgcgagacagcgtgggtgggtttttatctgctgcttctgtaaattcattgcatgatacgtctgtttttcagaggtcccaaagcaaagaaacaaagccccacagagttcacccagagggaaggccttcactggatcaggctataagagaaggactctcccctgagaaagataaatacttattttggggccgtgtttagagaaaaaggaagaacgatggctttcccatagaaacatttacttattttgtgatttgaaaatggacttttatgttttaggaattatgtggatgggatgttttcttgggtgatcgatttgaaattgcagaggggagcaggtgccatgtgctggcaat

SEQ ID NO: 34869 - DNA, 473 bp, Homo sapiens
gcaggtttgttgcacaggtaaatctgtgccatggtggtttgctgcacctatcaacccatcacctaggtattaatcccagcatgcattagctatttttcctaatgaagagcctgattaaaaatataaaaccttggtacctaaacctcagagtcctccaaatacataatttaatttaagctgcatgcctctgtttttttttgtgtgtgtatgtgtcatctattttgctgtagagtttccaaaccaactgtgtctgtgcactatttggaactctcacaggttttatacagtttccttttttacttgtagcagaacggttattgggctggcatattattaaaaatgccaaaaaaagttatatgtattagtgtcttgtcccaaaatttctgatagaaagggaaatatgtgtatttgtaagcagatttaaaatgactgttgaaacagagatgggactccaagaatttaagtatcagcag

SEQ ID NO: 34870 - DNA, 318 bp, Homo sapiens
tgttgtttagggaacacaacagatttgagaagcctcggattaaggaataatttatgaagctccgttgactaccgtggagagatcataatttggggttcaagattccagtctgtgtttttccagaggtgccctgaggagcagggaagcatggctattgtggatgtaaaagccatgttcaagccaggtatggtggtatgtgcctgcagtcccagctactcgggaggctgagatgggaggatccacttgagcccaggaggtcaagtccagcctggacaactatcaagaccccatctctaaaaataaataaataacatttta

SEQ ID NO: 34871 - DNA, 390 bp, Homo sapiens
ccgtcctttcatcatcagaaaaactcagataatatgacttccgccatcaacacttgaacattaatagaaatagcatcctcgtgtttttacaattcctggcacatcataagcacataataaatggcagttttagtttatcactattgcatgctctttggattcaaaattctcagatctggtacactgattttcttcctttcagaccataatcattttttttaatgtatacttactgtctttgaatgattactaaatccaaattagcaggatcagaattagtgagattagatagcgtttttgcaagttatagtttatataatgcttactctcccaaataaaatgtgactttcgtattcgttctgtatcaaactttaaaattttgagtgtgaa

SEQ ID NO: 34872 - DNA, 165 bp, Homo sapiens
acagagtaatcactcctcagatagatatcttaaaaaataattgggtcttgggagaggactggcctgtagggtctgatttgggagttattgtggtgtgaagcaatgtgatgtctgagtgtgatgagcgctgagagagcatgatttggggaaatcagaactttgaga

SEQ ID NO: 34873 - DNA, 432 bp, Homo sapiens
cctccaggggctttgagaaagccagctttggctagctgtaaagttttcagtaatcatttaagaaaaaaaagttattcatcatctttatggcagatcacagccgccacattctccccaggagttcaatccatcaagctcctcaatgcaagaatggctaacaaggtccctgtcactttgggtgaaatatacaagcctcaccagaggctcctgacttccaccaggatcaaagtttgtaggcactgctccagcccagcgtcctccacccgagaagccagcaagacagccttgccttccttcctatctttatttgtagaatacaggtggaaaagaaggaatccttcaaagttttgttctttcatgaaaatgggttcctgtgggcaagaaatctgccattatgcacctaaccttttatatctgagattttcaagagaa

SEQ ID NO: 34874 - DNA, 1414 bp, Homo sapiens
gaacacgagtcttttggctattagtctaatgcattttcctccacattatattgcactgctctgaggcttgcttatatttttcatacctggatttccagggtggtgacgtgggggagggaagtattcaattcagaaccaccgtgaaccaagatctctggaaacaaactctgtactatttctccttcatctcctattttcataactagtgccaagctcaggactaactgcatagactccctttcaaaagaccaatagatattctcagtgacagttgaacacattagtttacaatcacacagaatttgaacagaacttaaagttgacagttaatgccgatctataattaacaaaaatgtcaacttgtggatatgctgatgattttatccagttttcaaaatatgattcctacagttcaggatatcacttattagattgtagacaaggaaaatgtacattgggacattatgtacttaagagtttttccttaagttttgcagaggaagtggttgaaaattgagctaacactagatttcgaggttactaaagaattccagttttccagtctcccacttcaattaccaggtaactataaggcaaaaatatcccaatgctgtgaacttaaggcaatattcatttcctttctacactacttggcatggtaaccatgacaaacttttattttctctttctgatttcctaatgaaatctcattatttgcaaagctttaaaatgactagatgaaggaaaaacattgttatgacccatgaccctcggagcccaaacagcaccatgaagagcatcattaaaactaagagaaagtggctatcagaaaatgaaacagctttaaaggggttccttttaagtcttgttttctattcagaatgttctgtgttttttctcaagtgtgggaatgacatttatcttagcaggttactcaactacactggatgatgtcactctaaccagtgtacggcactgacccaagtcctggggggctccttggaccaatggactattttacaaacctgggaggtgggagggatggtatatttttgataatcagacattccaatgtaatgttttccttagaggtcacacccttccccccattaatgtcatcgtgagatacatcaagtgtgttcttttctattttcgtataataaatgggctttgcttatcaacatcacaatggcaaagaagaaatatactgtacaaaactgcaggaagataaaacatgaaaactttctatgaaaaaaaaaaaacacccttgagtttcctgtcgtcttcttttgaaactgtagtgcatatgttaaaacatgtatatcatttacagtattgagtcgtgtgccactgctgtacctgatgtatccaatctggattaaacaaattatgtgccacaaaccctaaaaaaact

SEQ ID NO: 34875 - DNA, 1915 bp, Homo sapiens
gaacacgagtcttttggctattagtctaatgcattttctaccacacccactgcctctgagagcagtgatgctttggagaagatccatcaaagaatccatactgtaattggagacatagtcttatatgtcaatacgtatatgtcaatactacttggacacagcccttggaaatcacctgactgtaccaatacaaaccatactttggaaaccaccattctctgggtagaaacatctatggactatcaattttgtcagaaatcagtgaacaagtgaagagtcaattttttttagtcaaatattttctcttctcaatgaagagaagactaggacagtgacattttgaagcataccttttatactccttgtggttcttatgacagtctgtgatggtagtagggtaaagtaggctaaatccttgattcagagaggggaaaacatgtggaaagaaactgaacgacttatccaagttcacatgacaagttagtggcagaaccattattgcaatccaggacttaagacatcttgtcctaggatttttcctccacattatattgcactgctctgaggcttgcttatatttttcatacctggatttccagggtggtgacgtgggggagggaagtattcaattcagaaccaccgtgaaccaagatctctggaaacaaactctgtactatttctccttcatctcctattttcataactagtgccaagctcaggactaactgcatagactccctttcaaaagaccaatagatattctcagtgacagttgaacacattagtttacaatcacacagaatttgaacagaacttaaagttgacagttaatgccgatctataattaacaaaaatgtcaacttgtggatatgctgatgattttatccagttttcaaaatatgattcctacagttcaggatatcacttattagattgtagacaaggaaaatgtacattgggacattatgtacttaagagtttttccttaagttttgcagaggaagtggttgaaaattgagctaacactagatttcgaggttactaaagaattccagttttccagtctcccacttcaattaccaggtaactataaggcaaaaatatcccaatgctgtgaacttaaggcaatattcatttcctttctacactacttggcatggtaaccatgacaaacttttattttctctttctgatttcctaatgaaatctcattatttgcaaagctttaaaatgactagatgaaggaaaaacattgttatgacccatgaccctcggagcccaaacagcaccatgaagagcatcattaaaactaagagaaagtggctatcagaaaatgaaacagctttaaaggggttccttttaagtcttgttttctattcagaatgttctgtgttttttctcaagtgtgggaatgacatttatcttagcaggttactcaactacactggatgatgtcactctaaccagtgtacggcactgacccaagtcctggggggctccttggaccaatggactattttacaaacctgggaggtgggagggatggtatatttttgataatcagacattccaatgtaatgttttccttagaggtcacacccttccccccattaatgtcatcgtgagatacatcaagtgtgttcttttctattttcgtataataaatgggctttgcttatcaacatcacaatggcaaagaagaaatatactgtacaaaactgcaggaagataaaacatgaaaactttctatgaaaaaaaaaaaacacccttgagtttcctgtcgtcttcttttgaaactgtagtgcatatgttaaaacatgtatatcatttacagtattgagtcgtgtgccactgctgtacctgatgtatccaatctggattaaacaaattatgtgccacaaaccctaaaaaaact

SEQ ID NO: 34876 - DNA, 700 bp, Homo sapiens
  misc_feature (438)..(438): n is a, c, g, or t
agatctagaggcgcagagtcaagttagattttgcaggtgtatctgtatgccttttggaaggacatgatgtctggcactttttagtgatagtggaaccctctcttcacctttaatgatcagaaatgattttccagctccctggcccctcaggtgcttgaatgcttctcctgcctccaccctccccaccagtttggggcacttagcacataagctcagtgagccttcctgaccttgtctctgtgctcccatgcccctagcccatcttctttcttcccacctccctcccaatgggaactccagctccagaggggaccccagcaagcctccagtccattgatccaccttttcatgttcttcactgcctctcatggcctctttctctgctcttcctgattcagagtctgtggtcacttgcagtcatttccttaacccccatcnccacttcgctttgtcaaaaccagacttaaatccaactttctgcttcatttacgctggcacatgtacagcaaattgcagcagggaaagccactttgccaactggtcttgcttagcctcgcagacgcactaaggtcttaaagcagcccatcaaagtatactctcttgcaccactccagataactattttacgtttccttctctcaaaactcccaggcttcttccgtcttcactgttagtcgacaaattgctccttttttgagaa

SEQ ID NO: 34877 - DNA, 367 bp, Homo sapiens
aaatctttttttttttttttaaacatagcacaaattaatgctggacattagaatcataacgtgttcatactagaaaaaatctcaagagataatttagagataattctcaaaccgtagcatcagaattacctggaaggcttattagaacacaaatggctgggcccactttggagattctgatttagtgggtctgggagggcccaagaattgaaccagggactacattttgagaaccactgcacaatctacttgatttattgatgaggaatctcagctccttaggtttttatatgctaatgctaagcatttttaaaataaatggaaattatccagtgtatcaatatgaatacttttctatacttagttg

SEQ ID NO: 34878 - DNA, 445 bp, Homo sapiens
gaaccagtccttaggaaataatttaaaatgggaaaatgctttttgcactaagattatgatggcagagacttagaaacaacatacatttccactgaaaggaagttatggaatatttccataattagcaaaaattagtaaattatggaatattacacagccaaaaagaaaaatcatgcattataatggctatgtaagaatagagaaacatcttatagcatatcatggtaaattaagaataaaagcaaattcaaagttggtatacaatataattcctttatttaaaaaccaacaacaggacaggtgcaggacaggacaggattgcaaattcatgtctgtaatcccaaaactttggaaagccaatgtgggtgggccacttgagcccaggagttcaagaccagcctgggcaacatagtgagacaggtttaaaaaattaaaaaaaaaaaaa

SEQ ID NO: 34879 - DNA, 472 bp, Homo sapiens
tgttcctagaggtccaactctatgtaatggtcttaggggtgatgaagcactgtagtcctgcttctcactcatacctgccctccagaaaggataaaattataaatgtccaattagagtctttattagtctcttcctatgtagaatttatcaatagtttgacagttctgcagctcatgcattttcagaaaaatccttcttcagtttaaaacattccaccattgttttttgttgttgttttttcaaattgcattgggaagaaggtaaggagtatgtatagaatacaattctgtgaacaaagtgagtgagttacttgctccttgagggcagaaactctggccatttgtcctcaagtcctcagtgcctgacacatatccatgtattaattgagctgcttctatgtgccaggtgctggagtacagcagtaaagcagacaggtatagttcctccttggacagaggtaatagtcaaggca

SEQ ID NO: 34880 - DNA, 549 bp, Homo sapiens
tgagatggagtttcactcttgatgcccaggatggaatgcaatagcacgatccagtctgggtgacagagcaaaactccatctccaaaaaaaaaaaaaaaaagagccaagattaggtagaccggctcagaactcacactcttaaactacatattataatagctcctcaacaaaagtaattccatagcatgagtgggctactggcaccagagctggaacagccaaaagtgaagcttgctcttcgaggttcgaaagattctgggaaacagctgaggtgaagcccaagattagaagcagtgaactaaaatggaccttgaagtgcctgaggaaaaaaccgagattatctgtcagcgtctgctctccctaggcgagaccagggtctgagccccggcttctctatttcccacctcagaagacattctctacatctttattttctcctttatgtttgcccttaagtttccaataagtgcaattataattctctcagagctagtaactactcaaaaaataacctaatcgagccctgtaccttatatctaatccctgtaa

SEQ ID NO: 34881 - DNA, 205 bp, Homo sapiens
gtcagatttacaaaatccccaagaatcactttagtgccaaatactaagccatctatatacactctgcaaaaaagtaataagctggctgggcgcggtggctcagcctgtaatcccagcactttgggaggccgagacgggcggatcacaaggtcaggggatcgagaccatcctgtggatggtgaaacccgtctctagtaaaaataca

SEQ ID NO: 34882 - DNA, 402 bp, Homo sapiens
tcaaatcctcctggccagcaggaagctttcccagtttcccaacagtgcaccttttatttgtgatgtttttcccttctatcccattgctattttcccaacttatcatcctcccttgtatttttccccttgggatctttcccaacctgattccagcccaaagattttccagtgtatttactggaccctactcccatccctgaccaagcatcactagctttgcttagttttttgtttttttgagacagggtcttactctgtcacccaggctgaagtgtaggtggcacagtcacagctcactgtagccttgacctcccgggctcaagcgacctccctccctggcccctgagtagctgagaccacaggcatatgccaccacatccagctaatatttttattttttgt

SEQ ID NO: 34883 - DNA, 102 bp, Homo sapiens
aatgaggaaacagaaataagaggttgaaagtgaccaggataattctactataggtagtggcttatcaggaaaaagtagtttgccatattataagaaaaggaa

SEQ ID NO: 34884 - DNA, 520 bp, Homo sapiens
ggaaatattatagttggccctccatatccacgggttccttatccaggattcaacaaactgcgaatggaaaacattaggggaaaaaaaaaacccaatcctagcactttgggagggtgaggcaggcagatcacatgaggtcaggagttcgagaccagcctggccaacattgtgaaaccctgtctctactgaaaatagaaaaaaaattagctgggcgtggtggcagacacctgtagtcccagctacttaggacgctgaggcaggagagtcgcttgaacctgggaggtggaggttgcagtgagccaagatcatgccattgcactccagcctgggcaacagagtgagatcctgtctcaaaaaaacaaaaagaacaacaaaaaacaacaacaataaaccctggctagccatgctggctcatgcctatagtcccaacaatttgggaggctgaggtgggagggttgttggagcccaggagttggagagcagcctgggcaaagtagcaagacccccatctctacaaaaa

SEQ ID NO: 34885 - DNA, 293 bp, Homo sapiens
caagggctcgacttcccctgtaagtagaatactacctaccagaggaacgccaaaggcttaactcagcccctccttgcccgcctttgtctacaggtcccaatctcagatgaccaaaaagcatctgctccaagcagagagttggaaagttacattatcagttactttgtcaatattaaaccagatcccttggggaactggtttccaggagacacgtggttattcagagagcctgattcctcacgattagctgtaggcgtttggggtcgacgcggccgcgaatttagtagtagtag

SEQ ID NO: 34886 - DNA, 505 bp, Homo sapiens
caagggctcgacttcccctgtaagtagaatactacctaccagaggaacgccaaaggcttaactcagcccctccttgcccgcctttgtctacaggtcccaatctcagatgaccaaaaagcatctgctccaagcagagagttggaaagttacattatcagttactttgtcaatattaaaccagatcccttggggaactggtttccaggagacacgtggttattcagagagcctgattcctcacgattagctgtaggcgtttggggacagtaggaagacaatggatcaaggcccttatgctcaattgtggactaagtaattgtgctcaaaaataatatattcagtcacaggcttttcttctgggtatttcgccagagattagacacttactgagtgtgccacatccacgtaagcatgaatcctttcaaccatcatgaggaaaatgttactcccagttttcccaggggaaactgaggtgtagaggctgaactccttcagagtctcagga

SEQ ID NO: 34887 - DNA, 434 bp, Homo sapiens
ggtcgactgatattttaaaaatgatataactcattagacttttctgataaatgaaacactatggacgttataaattcctcattagtttgcccaggtatattggagattgagtcaaaatcatgaatttaagtaggacaaagttttttgttcttgtttaacttttagaatacttttgtgttaactagattttttttcttaagctatcaatttttttcccttaaaactttttagggaagaaagttttgaaagtttaagttaggccacatacagtggttcacacctatagtcccaacaatttgggaggccaaggtgggaagatcacttgcgctctagagttcaagacagcctggccaacatagtgagacctcatctcttctaaaaataaaaattagccaggcacggtggctcgtgcctatggtcccagccacttggga

SEQ ID NO: 34888 - DNA, 569 bp, Homo sapiens
ctctcaacacaagaaacacagtgttatgatgaaagggggcatatctcagcagaattttcttaagatttttctcccatatctgctgctctctcatctgctggccattggattgaggatctacactggaacacatcaggcaaccttcaccagcactttttgataaagaattggaatttgactctgtttacatagtagaactatatctgagattgcaacatatctaactgaagactattatgattcatgatttttgggtagtcacgtcacttgcattgatttgttctgtaagagtggcattcctaatttagtaaaacataagaatagactgtgagccaccatgcccagctgacctattattatatctatgggatgaattaataagcatgtcagattaatatctactgtaacaattagtaattttctttggatattagatataaatatctaagtataaataatcttaatatactagtaatgacatacattttaaaaattatctgtaaccttcactcagttataatactttatatttcaaaagaataaataacgatattaaaattactatttaa

SEQ ID NO: 34889 - DNA, 1657 bp, Homo sapiens
gttctattttttctgtagagacggggttttgccatgttgcccaggctggtctcagactcctgggctcaagcgatcatttcgcctcagcctcccaaagtgctgagattataggtgtgagccacagcatctggcccagagtgaggagaattaatgagattttttgtgtgtgttagataatattgatttaagcctttttttaaaaagtactctcaaccaaatacaaaattgaaaatgtgaggtttaatagaaatgtgttggctatttgcaatggattttcttcttgcccaagtgtttggagttctactttatgctctgtatttaaaaattagtgacctcaaagcagagttgatgacacaggctttggggccctcatgttcttgtctttagaacatatcactactaagtatcagcttatcttcagaacattacaacattcaccgtgttcatatgctttctgagaagtcaccacttgtaatttcagatcacatacacctgaaggcattttatagttcctaaagttaacatgttagatcttttttttccaccccatgagggtctcactctcacccaggctggaatgcagtggtgtgattgtagcacactttggccaccaactcctgggctcaagtgatcctcctgctttggcctcctctgagaagctgggattactggtgcacaccaccacacctggctaattttttatttttttttatttttggaaatagggtatggctatgttgccttgggcccgtcatgaactcctagcctcaggtgaccctcccacctcaggcctcccaaagggttgggattacaggagtgagctactgcactgggccaacatgttaattttttttttttttttttttgagatggagtctcccaggcgggaatgcaatggtgcgatctcgacttcactgcaatcttcacctcccgggttcgagcgattctcccacctcagcctcctgagtagctgggattacaggcacctgccatcacgctcggctaatttttgtattttgagcagagatggagtttcaccatgttggccaggtgatctgcactcccactccccccacacttcccaaagtgctgggattacaggcataagccacaagccacctcacccagccaacatgttacatcttaattcttggattttcttcactgcagggctttgggtggagaaataaaactcttcaaatgcataatcttggagatccctgtgaatcaataattctttagacaactgcggctcaaaatccctcctttcccttttccgagttattccatccatcttattagaaaggaagtgaattaggtgtaggtggtctgtaacacctgcacatctttttatacgtgtagagggtatgcctgggatatataggttgtcttcaagcagtagctgctactacagctagagagaggaggagtgccaggaaactgatgacctgagaccaagagtcttgttgatgttctgacgtgtcgagataaaggttttgatcattttcatgaaataatgcagggaagtcatttctgctgtttctttactactccattcttggaggattagaacaagtcacactgtaattgactaaaacgactttttattttaaaatattgatggtgggaggagaggaaggggatctctagagcggcc

SEQ ID NO: 34890 - DNA, 1345 bp, Homo sapiens
gttctattttttctgtagagacggggttttgccatgttgcccaggctggtctcagactcctgggctcaagcgatcatttcgcctcagcctcccaaagtgctgagattataggtgtgagccacagcatctggcccagagtgaggagaattaatgagattttttgtgtgtgttagataatattgatttaagcctttttttaaaaagtactctcaaccaaatacaaaattgaaaatgtgaggtttaatagaaatgtgttggctatttgcaatggattttcttcttgcccaagtgtttggagttctactttatgctctgtatttaaaaattagtgacctcaaagcagagttgatgacacaggctttggggccctcatgttcttgtctttagaacatatcactactaagtatcagcttatcttcagaacattacaacattcaccgtgttcatatgctttctgagaagtcaccacttgtaatttcagatcacatacacctgaaggcattttatagttcctaaagttaacatgttagatcttttttttccaccccatgagggtctcactctcacccaggctggaatgcagtggtgtgattgtagcacactttggccaccaactcctgggctcaagtgatcctcctgctttggcctcctctgagaagctgggattaaggcacctgccatcacgctcggctaatttttgtattttgagcagagatggagtttcaccatgttggccaggtgatctgcactcccactccccccacacttcccaaagtgctgggattacaggcataagccacaagccacctcacccagccaacatgttacatcttaattcttggattttcttcactgcagggctttgggtggagaaataaaactcttcaaatgcataatcttggagatccctgtgaatcaataattctttagacaactgcggctcaaaatccctcctttcccttttccgagttattccatccatcttattagaaaggaagtgaattaggtgtaggtggtctgtaacacctgcacatctttttatacgtgtagagggtatgcctgggatatataggttgtcttcaagcagtagctgctactacagctagagagaggaggagtgccaggaaactgatgacctgagaccaagagtcttgttgatgttctgacgtgtcgagataaaggttttgatcattttcatgaaataatgcagggaagtcatttctgctgtttctttactactccattcttggaggattagaacaagtcacactgtaattgactaaaacgactttttattttaaaatattgatggtgggaggagaggaaggggatctctagagcggcc

SEQ ID NO: 34891 - DNA, 511 bp, Homo sapiens
gctgactccaggacttatctcgacacgtcagggtggagaaataaaactcttcaaatgcataatcttggagatccctgtgaatcaataattctttagacaactgcggctcaaaatccctcctttcccttttccgagttattccatccatcttattagaaaggaagtgaattaggtgtaggtggtctgtaacacctgcacatctttttatacgtgtagagggtatgcctgggatatataggttgtcttcaagcagtagctgctactacagctagagagaggaggagtgccaggaaactgatgacctgagaccaagagtcttgttgatgttctgacgtgtcgagataaaggttttgatcattttcatgaaataatgcagggaagtcatttctgctgtttctttactactccattcttggaggattagaacaagtcacactgtaattgactaaaacgactttttattttaaaatattgatggtgggaggagaggaaggggatctctagagcggcc

SEQ ID NO: 34892 - DNA, 3546 bp, Homo sapiens
cccgcccgcccgcgctcctcccggccgctcctcccgccccgcccggcccggcgccgactctgcggccgcccgacgagcccctcgcggcactgccccggccccggccccggccccggccccctcccgccgcaccgcccccggcccggccctccgccctccgcactcccgcctccctccctccgcccgctcccgcgccctcctccctccctcctccccagctgtcccgttcgcgtcatgccgagcctcccggccccgccggccccgctgctgctcctcgggctgctgctgctcggctcccggccggcccgcggcgccggcccagagccccccgtgctgcccatccgttctgagaaggagccgctgcccgttcggggagcggcaggctgcaccttcggcgggaaggtctatgccttggacgagacgtggcacccggacctaggggagccattcggggtgatgcgctgcgtgctgtgcgcctgcgaggcgacagggaccttgaggcccagagagatgaagtagcttgtctagggtcacgcagcttcctcagtggggtcgccgtaccaggggccctggcagggtcagctgcaagaacatcaaaccagagtgcccaaccccggcctgtgggcagccgcgccagctgccgggacactgctgccagacctgcccccaggagcgcagcagttcggagcggcagccgagcggcctgtccttcgagtatccgcgggacccggagcatcgcagttatagcgaccgcggggagccaggcgctgaggagcgggcccgtggtgacggccacacggacttcgtggcgctgctgacagggccgaggtcgcaggcggtggcacgagcccgagtctcgctgctgcgctctagcctccgcttctctatctcctacaggcggctggaccgccctaccaggatccgcttctcagactccaatggcagtgtcctgtttgagcaccctgcagcccccacccaagatggcctggtctgtggggtgtggcgggcagtgcctcggttgtctctgcggctccttagggcagaacagctgcatgtggcacttgtgacactcactcacccttcaggggaggtctgggggcctctcatccggcaccgggccctggctgcagagaccttcagtgccatcctgactctagaaggccccccacagcagggcgtagggggcatcaccctgctcactctcagtgacacagaggactccttgcattttttgctgctcttccgagggctgctggaacccaggagtggggattctacaccaggggcagctactgcgagaacttcaggccaatgtctcagcccaggaaccaggctttgctgaggtgctgcccaacctgacagtccaggagatggactggctggtgctgggggagctgcagatggccctggagtgggcaggcaggccagggctgcgcatcagtggacacattgctgccaggaagagctgcgacgtcctgcaaagtgtcctttgtggggctgatgccctgatcccagtccagacgggtgctgccggctcagccagcctcacgctgctaggaaatggctccctgatctatcaggtgcaagtggtagggacaagcagtgaggtggtggccatgacactggagaccaagcctcagcggagggatcagcgcactgtcctgtgccacatggctggactccagccaggaggacacacggccgtgggtatctgccctgggctgggtgcccgaggggctcatatgctgctgcagaatgagctcttcctgaacgtgggcaccaaggacttcccagacggagagcttcgggggcacgtggctgccctgccctactgtgggcatagcgcccgccatgacacgctgcccgtgcccctagcaggagccctggtgctaccccctgtgaagagccaagcagcagggcacgcctggctttccttggatacccactgtcacctgcactatgaagtgctgctggctgggcttggtggctcagaacaaggcactgtcactgcccacctccttgggcctcctggaacgccagggcctcggcggctgctgaagggattctatggctcagaggcccagggtgtggtgaaggacctggagccggaactgctgcggcacctggcaaaaggcatggcctccctgatgatcaccaccaagggtagccccagaggggagctccgagggcaggtgcacatagccaaccaatgtgaggttggcggactgcgcctggaggcggccggggccgagggggtgcgggcgctgggggctccggatacagcctctgctgcgccgcctgtggtgcctggtctcccggccctagcgcccgccaaacctggtggtcctgggcggccccgagaccccaacacatgcttcttcgaggggcagcagcgcccccacggggctcgctgggcgcccaactacgacccgctctgctcactctgcacctgccagagacgaacggtgatctgtgacccggtggtgtgcccaccgcccagctgcccacacccggtgcaggctcccgaccagtgctgccctgtttgccctgagaaacaagatgtcagagacttgccagggctgccaaggagccgggacccaggagagggctgctattttgatggtgaccggagctggcgggcagcgggtacgcggtggcaccccgttgtgcccccctttggcttaattaagtgtgctgtctgcacctgcaaggggggcactggagaggtgcactgtgagaaggtgcagtgtccccggctggcctgtgcccagcctgtgcgtgtcaaccccaccgactgctgcaaacagtgtccagtggggtcgggggcccacccccagctgggggaccccatgcaggctgatgggccccggggctgccgttttgctgggcagtggttcccagagagtcagagctggcacccctcagtgcccccttttggagagatgagctgtatcacctgcagatgtggggcaggggtgcctcactgtgagcgggatgactgttcactgccactgtcctgtggctcggggaaggagagtcgatgctgttcccgctgcacggcccaccggcggccagccccagagaccagaactgatccagagctggagaaagaagccgaaggctcttagggagcagccagagggccaagtgaccaagaggatggggcctgagctggggaaggggtggcatcgaggaccttcttgcattctcctgtgggaagcccagtgcctttgctcctctgtcctgcctctactcccacccccactacctctgggaaccacagctccacaagggggagaggcagctgggccagaccgaggtcacagccactccaagtcctgccctgccaccctcggcctctgtcctggaagccccacccctttcctcctgtacataatgtcactggcttgttgggatttttaatttatcttcactcagcaccaagggcccccgacactccactcctgctgcccctgagctgagcagagtcattattggagagttttgtatttattaaaacatttctttttcagtcaaaaaacatga

SEQ ID NO: 34893 - DNA, 3520 bp, Homo sapiens
cccgcccgcccgcgctcctcccggccgctcctcccgccccgcccggcccggcgccgactctgcggccgcccgacgagcccctcgcggcactgccccggccccggccccggccccggccccctcccgccgcaccgcccccggcccggccctccgccctccgcactcccgcctccctccctccgcccgctcccgcgccctcctccctccctcctccccagctgtcccgttcgcgtcatgccgagcctcccggccccgccggccccgctgctgctcctcgggctgctgctgctcggctcccggccggcccgcggcgccggcccagagccccccgtgctgcccatccgttctgagaaggagccgctgcccgttcggggagcggcaggctgcaccttcggcgggaaggtctatgccttggacgagacgtggcacccggacctaggggagccattcggggtgatgcgctgcgtgctgtgcgcctgcgaggcgcctcagtggggtcgccgtaccaggggccctggcagggtcagctgcaagaacatcaaaccagagtgcccaaccccggcctgtgggcagccgcgccagctgccgggacactgctgccagacctgcccccaggagcgcagcagttcggagcggcagccgagcggcctgtccttcgagtatccgcgggacccggagcatcgcagttatagcgaccgcggggagccaggcgctgaggagcgggcccgtggtgacggccacacggacttcgtggcgctgctgacagggccgaggtcgcaggcggtggcacgagcccgagtctcgctgctgcgctctagcctccgcttctctatctcctacaggcggctggaccgccctaccaggatccgcttctcagactccaatggcagtgtcctgtttgagcaccctgcagcccccacccaagatggcctggtctgtggggtgtggcgggcagtgcctcggttgtctctgcggctccttagggcagaacagctgcatgtggcacttgtgacactcactcacccttcaggggaggtctgggggcctctcatccggcaccgggccctggctgcagagaccttcagtgccatcctgactctagaaggccccccacagcagggcgtagggggcatcaccctgctcactctcagtgacacagaggactccttgcattttttgctgctcttccgagggctgctggaacccaggagtgggggactaacccaggttcccttgaggctccagattctacaccaggggcagctactgcgagaacttcaggccaatgtctcagcccaggaaccaggctttgctgaggtgctgcccaacctgacagtccaggagatggactggctggtgctgggggagctgcagatggccctggagtgggcaggcaggccagggctgcgcatcagtggacacattgctgccaggaagagctgcgacgtcctgcaaagtgtcctttgtggggctgatgccctgatcccagtccagacgggtgctgccggctcagccagcctcacgctgctaggaaatggctccctgatctatcaggtgcaagtggtagggacaagcagtgaggtggtggccatgacactggagaccaagcctcagcggagggatcagcgcactgtcctgtgccacatggctggactccagccaggaggacacacggccgtgggtatctgccctgggctgggtgcccgaggggctcatatgctgctgcagaatgagctcttcctgaacgtgggcaccaaggacttcccagacggagagcttcgggggcacgtggctgccctgccctactgtgggcatagcgcccgccatgacacgctgcccgtgcccctagcaggagccctggtgctaccccctgtgaagagccaagcagcagggcacgcctggctttccttggatacccactgtcacctgcactatgaagtgctgctggctgggcttggtggctcagaacaaggcactgtcactgcccacctccttgggcctcctggaacgccagggcctcggcggctgctgaagggattctatggctcagaggcccagggtgtggtgaaggacctggagccggaactgctgcggcacctggcaaaaggcatggcctccctgatgatcaccaccaagggtagccccagaggggagctccgagggcaggtgcacatagccaaccaatgtgaggttggcggactgcgcctggaggcggccggggccgagggggtgcgggcgctgggggctccggatacagcctctgctgcgccgcctgtggtgcctggtctcccggccctagcgcccgccaaacctggtggtcctgggcggccccgagaccccaacacatgcttcttcgaggggcagcagcgcccccacggggctcgctgggcgcccaactacgacccgctctgctcactctgcacctgccagagacgaacggtgatctgtgacccggtggtgtgcccaccgcccagctgcccacacccggtgcaggctcccgaccagtgctgccctgtttgccctgagaaacaagatgtcagagacttgccagggctgccaaggagccgggacccaggagagggctgctattttgatggtgaccggagctggcgggcagcgggtacgcggtggcaccccgttgtgcccccctttggcttaattaagtgtgctgtctgcacctgcaaggggggcactggagaggtgcactgtgagaaggtgcagtgtccccggctggcctgtgcccagcctgtgcgtgtcaaccccaccgactgctgcaaacagtgtccagtggggtcgggggcccacccccagctgggggaccccatgcaggctgatgggccccggggctgccgttttgctgggcagtggttcccagagagtcagagctggcacccctcagtgcccccttttggagagatgagctgtatcacctgcagatgtggggcaggggtgcctcactgtgagcgggatgactgttcactgccactgtcctgtggctcggggaaggagagtcgatgctgttcccgctgcacggcccaccggcggccagccccagagaccagaactgatccagagctggagaaagaagccgaaggctcttagggagcagccagagggccaagtgaccaagaggatggggcctgagctggggaaggggtggcatcgaggaccttcttgcattctcctgtgggaagcccagtgcctttgctcctctgtcctgcctctactcccacccccactacctctgggaaccacagctccacaagggggagaggcagctgggccagaccgaggtcacagccactccaagtcctgccctgccaccctcggcctctgtcctggaagccccacccctttcctcctgtacataatgtcactggcttgttgggatttttaatttatcttcactcagcaccaagggcccccgacactccactcctgctgcccctgagctgagcagagtcattattggagagttttgtatttattaaaacatttctttttcagtcaaaaaacatga

SEQ ID NO: 34894 - DNA, 3491 bp, Homo sapiens
cccgcccgcccgcgctcctcccggccgctcctcccgccccgcccggcccggcgccgactctgcggccgcccgacgagcccctcgcggcactgccccggccccggccccggccccggccccctcccgccgcaccgcccccggcccggccctccgccctccgcactcccgcctccctccctccgcccgctcccgcgccctcctccctccctcctccccagctgtcccgttcgcgtcatgccgagcctcccggccccgccggccccgctgctgctcctcgggctgctgctgctcggctcccggccggcccgcggcgccggcccagagccccccgtgctgcccatccgttctgagaaggagccgctgcccgttcggggagcggcaggctgcaccttcggcgggaaggtctatgccttggacgagacgtggcacccggacctaggggagccattcggggtgatgcgctgcgtgctgtgcgcctgcgaggcgcctcagtggggtcgccgtaccaggggccctggcagggtcagctgcaagaacatcaaaccagagtgcccaaccccggcctgtgggcagccgcgccagctgccgggacactgctgccagacctgcccccaggagcgcagcagttcggagcggcagccgagcggcctgtccttcgagtatccgcgggacccggagcatcgcagttatagcgaccgcggggagccaggcgctgaggagcgggcccgtggtgacggccacacggacttcgtggcgctgctgacagggccgaggtcgcaggcggtggcacgagcccgagtctcgctgctgcgctctagcctccgcttctctatctcctacaggcggctggaccgccctaccaggatccgcttctcagactccaatggcagtgtcctgtttgagcaccctgcagcccccacccaagatggcctggtctgtggggtgtggcgggcagtgcctcggttgtctctgcggctccttagggcagaacagctgcatgtggcacttgtgacactcactcacccttcaggggaggtctgggggcctctcatccggcaccgggccctggctgcagagaccttcagtgccatcctgactctagaaggccccccacagcagggcgtagggggcatcaccctgctcactctcagtgacacagaggactccttgcattttttgctgctcttccgagggctgctggaacccaggagtggggattctacaccaggggcagctactgcgagaacttcaggccaatgtctcagcccaggaaccaggctttgctgaggtgctgcccaacctgacagtccaggagatggactggctggtgctgggggagctgcagatggccctggagtgggcaggcaggccagggctgcgcatcagtggacacattgctgccaggaagagctgcgacgtcctgcaaagtgtcctttgtggggctgatgccctgatcccagtccagacgggtgctgccggctcagccagcctcacgctgctaggaaatggctccctgatctatcaggtgcaagtggtagggacaagcagtgaggtggtggccatgacactggagaccaagcctcagcggagggatcagcgcactgtcctgtgccacatggctggactccagccaggaggacacacggccgtgggtatctgccctgggctgggtgcccgaggggctcatatgctgctgcagaatgagctcttcctgaacgtgggcaccaaggacttcccagacggagagcttcgggggcacgtggctgccctgccctactgtgggcatagcgcccgccatgacacgctgcccgtgcccctagcaggagccctggtgctaccccctgtgaagagccaagcagcagggcacgcctggctttccttggatacccactgtcacctgcactatgaagtgctgctggctgggcttggtggctcagaacaaggcactgtcactgcccacctccttgggcctcctggaacgccagggcctcggcggctgctgaagggattctatggctcagaggcccagggtgtggtgaaggacctggagccggaactgctgcggcacctggcaaaaggcatggcctccctgatgatcaccaccaagggtagccccagaggggagctccgagggcaggtgcacatagccaaccaatgtgaggttggcggactgcgcctggaggcggccggggccgagggggtgcgggcgctgggggctccggatacagcctctgctgcgccgcctgtggtgcctggtctcccggccctagcgcccgccaaacctggtggtcctgggcggccccgagaccccaacacatgcttcttcgaggggcagcagcgcccccacggggctcgctgggcgcccaactacgacccgctctgctcactctgcacctgccagagacgaacggtgatctgtgacccggtggtgtgcccaccgcccagctgcccacacccggtgcaggctcccgaccagtgctgccctgtttgccctgagaaacaagatgtcagagacttgccagggctgccaaggagccgggacccaggagagggctgctattttgatggtgaccggagctggcgggcagcgggtacgcggtggcaccccgttgtgcccccctttggcttaattaagtgtgctgtctgcacctgcaaggggggcactggagaggtgcactgtgagaaggtgcagtgtccccggctggcctgtgcccagcctgtgcgtgtcaaccccaccgactgctgcaaacagtgtccagtggggtcgggggcccacccccagctgggggaccccatgcaggctgatgggccccggggctgccgttttgctgggcagtggttcccagagagtcagagctggcacccctcagtgcccccttttggagagatgagctgtatcacctgcagatgtggggcaggggtgcctcactgtgagcgggatgactgttcactgccactgtcctgtggctcggggaaggagagtcgatgctgttcccgctgcacggcccaccggcggccagccccagagaccagaactgatccagagctggagaaagaagccgaaggctcttagggagcagccagagggccaagtgaccaagaggatggggcctgagctggggaaggggtggcatcgaggaccttcttgcattctcctgtgggaagcccagtgcctttgctcctctgtcctgcctctactcccacccccactacctctgggaaccacagctccacaagggggagaggcagctgggccagaccgaggtcacagccactccaagtcctgccctgccaccctcggcctctgtcctggaagccccacccctttcctcctgtacataatgtcactggcttgttgggatttttaatttatcttcactcagcaccaagggcccccgacactccactcctgctgcccctgagctgagcagagtcattattggagagttttgtatttattaaaacatttctttttcagtcaaaaaacatga

SEQ ID NO: 34895 - DNA, 3455 bp, Homo sapiens
cccgcccgcccgcgctcctcccggccgctcctcccgccccgcccggcccggcgccgactctgcggccgcccgacgagcccctcgcggcactgccccggccccggccccggccccggccccctcccgccgcaccgcccccggcccggccctccgccctccgcactcccgcctccctccctccgcccgctcccgcgccctcctccctccctcctccccagctgtcccgttcgcgtcatgccgagcctcccggccccgccggccccgctgctgctcctcgggctgctgctgctcggctcccggccggcccgcggcgccggcccagagccccccgtgctgcccatccgttctgagaaggagccgctgcccgttcggggagcggcaggctgcaccttcggcgggaaggtctatgccttggacgagacgtggcacccggacctaggggagccattcggggtgatgcgctgcgtgctgtgcgcctgcgaggcgacagggaccttgaggcccagagagatgaagtagcttgtctagggtcacgcagcttcctcagtggggtcgccgtaccaggggccctggcagggtcagctgcaagaacatcaaaccagagtgcccaaccccggcctgtgggcagccgcgccagctgccgggacactgctgccagacctgcccccaggagcgcagcagttcggagcggcagccgagcggcctgtccttcgagtatccgcgggacccggagcatcgcagttatagcgaccgcggggagccaggcgctgaggagcgggcccgtggtgacggccacacggacttcgtggcgctgctgacagggccgaggtcgcaggcggtggcacgagcccgagtctcgctgctgcgctctagcctccgcttctctatctcctacaggcggctggaccgccctaccaggatccgcttctcagactccaatggcagtgtcctgtttgagcaccctgcagcccccacccaagatggcctggtctgtggggtgtggcgggcagtgcctcggttgtctctgcggctccttagggcagaacagctgcatgtggcacttgtgacactcactcacccttcaggggaggtctgggggcctctcatccggcaccgggccctggctgcagagaccttcagtgccatcctgactctagaaggccccccacagcagggcgtagggggcatcaccctgctcactctcagtgacacagaggactccttgcattttttgctgctcttccgagggctgctggaacccaggagtgggggactaacccaggttcccttgaggctccagattctacaccaggggcagctactgcgagaacttcaggccaatgtctcagcccaggaaccaggctttgctgaggtgctgcccaacctgacagtccaggagatggactggctggtgctgggggagctgcagatggccctggagtgggcaggcaggccagggctgcgcatcagtggacacattgctgccaggaagagctgcgacgtcctgcaaagtgtcctttgtggggctgatgccctgatcccagtccagacgggtgctgccggctcagccagcctcacgctgctaggaaatggctccctgatctatcaggccgtgggtatctgccctgggctgggtgcccgaggggctcatatgctgctgcagaatgagctcttcctgaacgtgggcaccaaggacttcccagacggagagcttcgggggcacgtggctgccctgccctactgtgggcatagcgcccgccatgacacgctgcccgtgcccctagcaggagccctggtgctaccccctgtgaagagccaagcagcagggcacgcctggctttccttggatacccactgtcacctgcactatgaagtgctgctggctgggcttggtggctcagaacaaggcactgtcactgcccacctccttgggcctcctggaacgccagggcctcggcggctgctgaagggattctatggctcagaggcccagggtgtggtgaaggacctggagccggaactgctgcggcacctggcaaaaggcatggcctccctgatgatcaccaccaagggtagccccagaggggagctccgagggcaggtgcacatagccaaccaatgtgaggttggcggactgcgcctggaggcggccggggccgagggggtgcgggcgctgggggctccggatacagcctctgctgcgccgcctgtggtgcctggtctcccggccctagcgcccgccaaacctggtggtcctgggcggccccgagaccccaacacatgcttcttcgaggggcagcagcgcccccacggggctcgctgggcgcccaactacgacccgctctgctcactctgcacctgccagagacgaacggtgatctgtgacccggtggtgtgcccaccgcccagctgcccacacccggtgcaggctcccgaccagtgctgccctgtttgccctgagaaacaagatgtcagagacttgccagggctgccaaggagccgggacccaggagagggctgctattttgatggtgaccggagctggcgggcagcgggtacgcggtggcaccccgttgtgcccccctttggcttaattaagtgtgctgtctgcacctgcaaggggggcactggagaggtgcactgtgagaaggtgcagtgtccccggctggcctgtgcccagcctgtgcgtgtcaaccccaccgactgctgcaaacagtgtccagtggggtcgggggcccacccccagctgggggaccccatgcaggctgatgggccccggggctgccgttttgctgggcagtggttcccagagagtcagagctggcacccctcagtgcccccttttggagagatgagctgtatcacctgcagatgtggggcaggggtgcctcactgtgagcgggatgactgttcactgccactgtcctgtggctcggggaaggagagtcgatgctgttcccgctgcacggcccaccggcggccagccccagagaccagaactgatccagagctggagaaagaagccgaaggctcttagggagcagccagagggccaagtgaccaagaggatggggcctgagctggggaaggggtggcatcgaggaccttcttgcattctcctgtgggaagcccagtgcctttgctcctctgtcctgcctctactcccacccccactacctctgggaaccacagctccacaagggggagaggcagctgggccagaccgaggtcacagccactccaagtcctgccctgccaccctcggcctctgtcctggaagccccacccctttcctcctgtacataatgtcactggcttgttgggatttttaatttatcttcactcagcaccaagggcccccgacactccactcctgctgcccctgagctgagcagagtcattattggagagttttgtatttattaaaacatttctttttcagtcaaaaaacatga

SEQ ID NO: 34896 - DNA, 3471 bp, Homo sapiens
cccgcccgcccgcgctcctcccggccgctcctcccgccccgcccggcccggcgccgactctgcggccgcccgacgagcccctcgcggcactgccccggccccggccccggccccggccccctcccgccgcaccgcccccggcccggccctccgccctccgcactcccgcctccctccctccgcccgctcccgcgccctcctccctccctcctccccagctgtcccgttcgcgtcatgccgagcctcccggccccgccggccccgctgctgctcctcgggctgctgctgctcggctcccggccggcccgcggcgccggcccagagccccccgtgctgcccatccgttctgagaaggagccgctgcccgttcggggagcggcaggctgcaccttcggcgggaaggtctatgccttggacgagacgtggcacccggacctaggggagccattcggggtgatgcgctgcgtgctgtgcgcctgcgaggcgacagggaccttgaggcccagagagatgaagtagcttgtctagggtcacgcagcttcctcagtggggtcgccgtaccaggggccctggcagggtcagctgcaagaacatcaaaccagagtgcccaaccccggcctgtgggcagccgcgccagctgccgggacactgctgccagacctgcccccaggagcgcagcagttcggagcggcagccgagcggcctgtccttcgagtatccgcgggacccggagcatcgcagttatagcgaccgcggggagccaggcgctgaggagcgggcccgtggtgacggccacacggacttcgtggcgctgctgacagggccgaggtcgcaggcggtggcacgagcccgagtctcgctgctgcgctctagcctccgcttctctatctcctacaggcggctggaccgccctaccaggatccgcttctcagactccaatggcagtgtcctgtttgagcaccctgcagcccccacccaagatggcctggtctgtggggtgtggcgggcagtgcctcggttgtctctgcggctccttagggcagaacagctgcatgtggcacttgtgacactcactcacccttcaggggaggtctgggggcctctcatccggcaccgggccctggctgcagagaccttcagtgccatcctgactctagaaggccccccacagcagggcgtagggggcatcaccctgctcactctcagtgacacagaggactccttgcattttttgctgctcttccgagggctgctggaacccaggagtgggggactaacccaggttcccttgaggctccagattctacaccaggggcagctactgcgagaacttcaggccaatgtctcagcccaggaaccaggctttgctgaggtgctgcccaacctgacagtccaggagatggactggctggtgctgggggagctgcagatggccctggagtgggcaggcaggccagggctgcgcatcagtggacacattgctgccaggaagagctgcgacgtcctgcaaagtgtcctttgtggggctgatgccctgatcccagtccagacgggtgctgccggctcagccagcctcacgctgctaggaaatggctccctgatctatcaggtgcaagtggtagggacaagcagtgaggtggtggccatgacactggagaccaagcctcagcggagggatcagcgcactgtcctgtgccacatggctggactccagccaggaggacacacggccgtgggtatctgccctgggctgggtgcccgaggggctcatatgctgctgcagaatgagctcttcctgaacgtgggcaccaaggacttcccagacggagagcttcgggggcacgtggctgccctgccctactgtgggcatagcgcccgccatgacacgctgcccgtgcccctagcaggagccctggtgctaccccctgtgaagagccaagcagcagggcacgcctggctttccttggatacccactgtcacctgcactatgaagtgctgctggctgggcttggtggctcagaacaaggcactgtcactgcccacctccttgggcctcctggaacgccagggcctcggcggctgctgaagggattctatggctcagaggcccagggtgtggtgaaggacctggagccggaactgctgcggcacctggcaaaaggcatggcctccctgatgatcaccaccaagggtagccccagaggggagctccgagggcaggtgcacatagccaaccaatgtgaggttggcggactgcgcctggaggcggccggggccgagggggtgcgggcgctgggggctccggatacagcctctgctgcgccgcctgtggtgcctggtctcccggccctagcgcccgccaaacctggtggtcctgggcggccccgagaccccaacacatgcttcttcgaggggcagcagcgcccccacggggctcgctgggcgcccaactacgacccgctctgctcactctgcacctgccagagacgaacggtgatctgtgacccggtggtgtgcccaccgcccagctgcccacacccggtgcaggctcccgaccagtgctgccctgtttgccctgagaaacaagatgtcagagacttgccagggctgccaaggagccgggacccaggagagggggggcactggagaggtgcactgtgagaaggtgcagtgtccccggctggcctgtgcccagcctgtgcgtgtcaaccccaccgactgctgcaaacagtgtccagtggggtcgggggcccacccccagctgggggaccccatgcaggctgatgggccccggggctgccgttttgctgggcagtggttcccagagagtcagagctggcacccctcagtgcccccttttggagagatgagctgtatcacctgcagatgtggggcaggggtgcctcactgtgagcgggatgactgttcactgccactgtcctgtggctcggggaaggagagtcgatgctgttcccgctgcacggcccaccggcggccagccccagagaccagaactgatccagagctggagaaagaagccgaaggctcttagggagcagccagagggccaagtgaccaagaggatggggcctgagctggggaaggggtggcatcgaggaccttcttgcattctcctgtgggaagcccagtgcctttgctcctctgtcctgcctctactcccacccccactacctctgggaaccacagctccacaagggggagaggcagctgggccagaccgaggtcacagccactccaagtcctgccctgccaccctcggcctctgtcctggaagccccacccctttcctcctgtacataatgtcactggcttgttgggatttttaatttatcttcactcagcaccaagggcccccgacactccactcctgctgcccctgagctgagcagagtcattattggagagttttgtatttattaaaacatttctttttcagtcaaaaaacatga

SEQ ID NO: 34897 - DNA, 349 bp, Homo sapiens
aaaacacgtgagaaggttagggagagcacctgtctcagaaaggcccacatgtgcggccttgcaggactaacccaggttcccttgaggctccagattctacaccaggggcagctactgcgagaacttcaggccaatgtctcagcccaggtgagtggggatctggctctcgctgccacctgtcttggcctcttgctattgcccatcacaccctgctctgtccccaggaaccaggctttgctgaggtgctgcccaacctgacagtccaggagatggactggctggtgctgggggagctgcagatggccctggagtgggcaggcaggccagggctgcgcatcagtggacacat

SEQ ID NO: 34898 - DNA, 333 bp, Homo sapiens
atgtgacatttagatacattgcaatcatgacaaatatttggatttcaaaatgacgtgtgagccatttatatttttgttgtgctttgttatcttatgggctcccataagataacaaggcttcaacactatggcttgaaaatgttttgatctgaaaggtatattagggaacacacagcataatcctaccactttgcttctgtctggtgaaatgtcaattgtttcctctctctgagcaccagctgtccaaatggcatgggaaggggcagtggaggggaagagaatgaaaatgagggaggttctaagaaggtggcaaggaattgggatgcaaaatcc

SEQ ID NO: 34899 - DNA, 413 bp, Homo sapiens
tagggaattggccttaaggggagccctttcttcctaagagattcttaggtgattctcacttcctcttgccccagtattatttttgtttttggtatggctcactcagatccttttttcctcctatccctaagtaatccgggtttctttttcccatatttagaacaaaatgtatttatgcagagtgtgtccaaacctcaacccaaggcctgtatacaaaataaatcaaattaaacacatctttactgtcttctacctctttcctgacctcaatatatcccaacttgcctcactctgagaaccaaggctgtcccagcacctgagtcgcagatattctactgatttgacagaactgtgtgactatctggaacagcattttgatccacaatttgcccagttacaaagcttaaatgagc

SEQ ID NO: 34900 - DNA, 401 bp, Homo sapiens
gaaggtggatcgtttgagctcaggagttcaagaccagcttgggcaacatgacaaaactctgtctttatataaaaatatgtatataaattttattaaatgtaagaaagtgtggaccgggcacggtggcttacgcctgtaatcctagcactttggggggctgagacgggtggatcacctgaggtcagaagttcaagaccagcctggtcaacatggtgaaaccccgtctctactaaatatacaaaaattagccaggcatggtggtaggcacctgtaatcccagctactcgggaggctgaggcagaagaattgcttgaacccaggaggcagaggttgcagtgagctgagatcacaccattgtgctccagcctgggcaataagagtgagacttcatctcaaaaaaa

SEQ ID NO: 34901 - DNA, 317 bp, Homo sapiens
ggtcgactgaagactcaaccacagtgtcatcctttgtacagaataggattctaatcaggagaccagtgctcatgtgcacagctttgagtcttcatgacaattctcccaaaactgaagataaacattgtagtcattttcatgtttgttcagccaacactggtttgcttcccttttccagttaatttgctcttgtttgtaacccctcaagatgtgggtatttcctaagaagaatctctggatcacagtacaattataaaaatcagaaagtgacagccttacggtactgtgatctaacggacagacacaattccagtttc

SEQ ID NO: 34902 - DNA, 733 bp, Homo sapiens
gaggaatcttctctgaaatatttctgaaaagtggtcatctagcctctgaacacttttaataataggatttctttacaagacagcccaccccattatcaacaagttgtgcttatttgaaagggacagaaaaattaggggtcttgctatagtcacacaatgaggtaatgagaagctggaaataaccctcagtctccttgaatctcagccctgttgctccttttccagttcagggattcccagattttatcttcgaagctacgtgcaacctctgcgtgtgttttactggccacagagggctgggaaccccaggcaactgcatttctgtttctcttgaagaagatgattgctgatggtggtggagtgggtcttctttcacaggatggttgaagtgagaggggatgggatgttcctttcttggaatgcattctttaacacagagacgtgtagtaacttaagaatggtaaaggctgggcgtggtggctcacgcctgttatcccagcactttgtgaggccaaggcgggtggatcacctgaggtcaggagttcgagaccagcctggccaacatggtgaaaccctgtctctaccaaaaatacaaaaattagccgagcatggtggcatgtgcctgtagtactggctactctggaggctgagacaagcaaattgcttgaacctggcaagcagaggttgcggtgagctgagatcgcgccactgcactccagcctgtgtgacagag

SEQ ID NO: 34903 - DNA, 439 bp, Homo sapiens
gagactgagtgtcactctattgcccaggctggagtgcagtgctgtgatctctgcctctcaggttcaagggattctcctgcctcagcctctccagtagctgggattacaggcacaccaccacacccggctaatttttgtatttttaatagagatggggttttccatgttggctaggctggtcttaaactcctgacctcaaatgatttgtccacctcggcctcccaaagggctgggattacaggcatgagccattactcccggcctgtaaatggattttaaaccaaaaacaaaacaaaaaagtcaaggaagtaaaggttcaagcatgtaagagttttctaaatatagcttcttggtattttattttatttacttttttagacagtttcgctcttgttgcccaggctggagtgcaatggcgagatctcggctcaccacaacc

SEQ ID NO: 34904 - DNA, 842 bp, Homo sapiens
ttgggggggggcggtggggtggccagggggcgcagtggtccttgatcttataggtccagagcctgttaatttgttcataaggtgagaactgaccctcaagagctggaaggattgggacatggcagccagtttacaaccatatggtgtcctgatgagcctgcactcagagtggagtgttggctggaacatgcacacctgcaactgagggttctaaagtcataggttaggcccttctcccgggtagggtctggacatgcacaccaggagtgacgttcccaactctagataactatgtgctaggctctgggctaagtgctttacataatgttgctcaggacaacaggacaaccctatgatttaggtgcacccattctacttggagggattgaggcttagatgttaacgtaacttgcctaaggttagagccattaagtttcaggagtctgatctgaactccgtctacacctgcactgtccagtgtggtagtcactagtgacatgtgaccatttgaagttgaattaaaataagaacttcagttccttagttgtgccagcttcatttcaattgctcagcagctgtctgtggctagtttggttggatactgcagatttatggatatttccactgctgcaaaaagttctattgaatagcacttgtctacactaaattgtctctcttccttttgttcttcaaataaatcagcctcaggtagcacaggagctgttctttgtaagcaggttgtatggatctgttctcaggtgtggatttttatttttttccctgcagatatggagtatattttctttaagaaattaaaaactaagaagaaaatgccaaaaaca

SEQ ID NO: 34905 - DNA, 430 bp, Homo sapiens
cctggggaaaaatttagctttagctgcagagataagggagcaaggcctaacaaagaagcctttgttctttggataatcagcgggctcccaggaaaaagtttcctccccttttcagacatgtacatgatgggctccatgggaacttgcacagggagaggggcttacctaaaacatacccacagtttcataaacaagagaagctgtactttgtgcttacctaagacatacctgcagctgcacaggtaaggagagttacacagacagctactacacagttaagggaagttacacaaacagctacagagatgaaaggagttttttcttataaaagcttttggattcaactgtaaaagtggcaaccctctttcagcctcctctttgctgcggagagctttcttctttcaattattaaacttttactccaacctca

SEQ ID NO: 34906 - DNA, 444 bp, Homo sapiens
tactactactaaattcgcggccgctcgatgataaaattcattaaggttgatacaaagttctgtctgtggtccttattggagacacaagcaccaaagtagtttctaaatagaagctctccactgtttttgatttgtggaatttgaggagtgaatgccagtcatggctaagtcagaaatttaacttagcatgcttactgtaccaatgtagaaagtatacatgttatcattatgtccatgcttactcaaaccacatcctcaatcagagcgtcctctctcttatacaaagctctatcacacaccaaccctgaactattcactagagagagttgtacccagtgttacatattatttagtgtctctcctccccacaaacatacaccacttctggatgaggaaggtcataagtcctggttctaaatactgaagtgtaacattgccaagtgt

SEQ ID NO: 34907 - DNA, 601 bp, Homo sapiens
gtttgccttgcttctactgccacaaccggtaagtttcacaatactttacccttctgagagggcataatgctaataacctcaccaaacataaaaagaaatacagaatttaaaagtgctttgatacttgcgttaaacaagctcctgtttataaagacttggtggccatgtaatgagattgttctaattacctaattaaatagctgctactaaaggaagaggagttctttaatttagagcaaaaggtttcttgaggaaatactctttccttctacaatattttaaatctatacagaatttatgccaagaaaaagaaatggaaccagttatactacatcaagaaccagtagaagacacaataggatagaaactctgcagtctgagggtacgttatgtctcaataaagtagagtagacaaaacactgacccatcacttatgtctcttgaaggctgcttaacactatgtttctttaaataaacaacaacagagcaatatacagcttatttgccaaaattaaggataccgggtatggtcacttcatcaaaatactttctaagataaagagctaggaaagcaatatactggttttcataaagagaaaaa

SEQ ID NO: 34908 - DNA, 116 bp, Homo sapiens
gaacattttcttctatgtttatgagccacttgtatttctttttctgtgagctgtttatttatgcccttgttcattttcccagtggcaagcttgtatttttcttatctgtgtgagtt

SEQ ID NO: 34909 - DNA, 1328 bp, Homo sapiens
agtagggtctgaatctgtggcagcaatcttgcagacatgaaatgaaaagtacaaacatgaaaaaccagcatattaaagatgccaggtcagaaaaatagaaagaacctgcttctgtgagccactgaatggtgccattaaccatctgcatttgagcattttgagaaaataaacctctatttcttaaagttctgtatcagtcagggtttcccagagaggcagaacaatagggatagagagatacatagagagagatatgagagggatagagagagacacagagagagatatgagaggggattaagggagttggctcatgtgattgtggaggctgagaaaccccaccacaggccattcataacctggagaccttgggatgctggtggtctggctcagtacaagtccaaaagccttggaaccagggaaactgatggtgtaattctcagtccaaggctgaattttcaagtctgagaacctgggggtgggatgggggagtgatagttttaagtcctggagtcccaaggttagaggatctggggtcctaatgtccatgggcagttggagaagagtgtatccctgctgcaggggagagagagaagccaattctcctttcttctgtttttattctacccaggcctccagtggattggaggtgcctgcccatattgagggcagatcttctctgcctagtccacgctaactcacatgccaatctcctctggaaacaccctcacagacacaccccaaaataatgccttaccagttctctagatattccttaatccagtcaagttgatgcctaaaattaaccatcacaggctttatggctctattacccaagaattctgttactttcagctgaaaacatttctaatggacatattccaattctgtatagatcagatctcagtttcatttcccattatatccttctctctcttgatttagaattctctttttctccactcttctgtgtatgctaaaatactgtcaatctcgtctttgaaggttttgctcatctttaaaaaatcttagttgattatgttttatgtgtcatttaattaaggaatgaatttgcttatttttatttcagtagcttttggggtacaagtggtttttggttgcatggatgaattgtatagtggtgaagtctgaaattttagtgcacctgtcaccagaatagtgtgcattgtacccaatatatagctttttattccttccccttctgagtctccatagtccattatatcactctgtatacccttgtgtatccatagcttagctcccacttacagttgagaacatacagaatttgatttctattccggagt

SEQ ID NO: 34910 - DNA, 1274 bp, Homo sapiens
agtagggtctgaatctgtggcagcaatcttgcagacatgaaatgaaaagtacaaacatgaaaaaccagcatattaaagatgccaggtcagaaaaatagaaagaacctgcttctgtgagccactgaatggtgccattaaccatctgcatttgagcattttgagaaaataaacctctatttcttaaagttctgtatcagtcagggtttcccagagaggcagaacaatagggatagagagatacatagagagagatatgagagggatagagagagacacagagagagatatgagaggggattaagggagttggctcatgtgattgtggaggctgagaaaccccaccacaggccattcataacctggagaccttgggatgctggtggtctggctcagtacaagtccaaaagccttggaaccagggaaactgatggtgtaattctcagtccaaggctgaattttcaagtctgagaacctgggggtgggatgggggagtgatagttttaagtcctggagtcccaaggttagaggatctggggtcctaatgtccatgggcagttggagaagagtgtatccctgctgcaggggagagagagaagccaattctcctttcttctgtttttattctacccaggcctccagtggattggaggtgcctgcccatattgagggcagatcttctctgcctagtccacgctaactcacatgccaatctcctctggaaacaccctcacagacacaccccaaaataatgccttaccagttctctagatattccttaatccagtcaagttgatgcctaaaattaaccatcacaggctttatggctctattacccaagaattctgttactttcagctgaaaacatttctaatggacatattccaattctgtatagatcagatctcagtttcatttcccattatatccttctctctcttgatttagaattctctttttctccactcttctgtgtatgctaaaatactgtcaatctcgtctttgaaggttttgctcatctttaatatttttatttcagtagcttttggggtacaagtggtttttggttgcatggatgaattgtatagtggtgaagtctgaaattttagtgcacctgtcaccagaatagtgtgcattgtacccaatatatagctttttattccttccccttctgagtctccatagtccattatatcactctgtatacccttgtgtatccatagcttagctcccacttacagttgagaacatacagaatttgatttctattccggagt

SEQ ID NO: 34911 - DNA, 106 bp, Homo sapiens
acaaagctctttcaatattggcaaatagacttaaaaatcactttttaccatttttaaaatttttaaatgattatagagtcacaggaagctgcaaaacacgtggcag

SEQ ID NO: 34912 - DNA, 399 bp, Homo sapiens
atagagtacacacactgtaataagactaaaggatgaaaaaagaaattaatcccatgtatactggatttcttcctttttataatttttgtctttatgccatagggtaagattttctcctagccctgagcacttagttctgagcccacaaagatgtgactgttcaaagctgaatcatcaatgctaattcagtctccacagttaactcatctgatcaacaacatggcttctctgttcactctctgaaagttgaagccactaactttgaccaaggttacctccctttggatctaccttacatctccgttcttattaaaaaccctttgtgttacctttcaggttgtagtctccacgttttgctgtgtgtcacaatttgaataaaaagttgaccagaataactaa

SEQ ID NO: 34913 - DNA, 1291 bp, Homo sapiens
ggtgcggagtttggctgctccggggttagcaggtgagcctgcgatgcgcgggaagacgttccgctttgaaatgcagcgggatttggtgagtttcccgctgtctccagcggtgcgggtgaagctggtgtctgcggggttccagactgctgaggaactcctagaggtgaaaccctccgagcttagcaaagaagttgggatatctaaagcagaagccttagaaactctgcaaattatcagaagagaatgtctcacaaataaaccaagatatgctggtacatctgagtcacacaagaagtgtacagcactggaacttcttgagcaggagcatacccagggcttcataatcaccttctgttcagcactagatgatattcttgggggtggagtgcccttaatgaaaacaacagaaatttgtggtgcaccaggtgttggaaaaacacaattatgtatgcagttggcagtagatgtgcagataccagaatgttttggaggagtggcaggtgaagcagtttttattgatacagagggaagttttatggttgatagagtggtagaccttgctactgcctgcattcagcaccttcagcttatagcagaaaaacacaagggagaggaacaccgaaaagctttggaggatttcactcttgataatattctttctcatatttattattttcgctgtcgtgactacacagagttactggcacaagtttatcttcttccagatttcctttcagaacactcaaaggttcgactagtgatagtggatggtattgcttttccatttcgtcatgacctagatgacctgtctcttcgtactcggttattaaatggcctagcccagcaaatgatcagccttgcaaataatcacagattagctgtaattttaaccaatcagatgacaacaaagattgatagaaatcaggccttgcttgttcctgcattaggggaaagttggggacatgctgctacaatacggctaatctttcattgggaccgaaagcaaaggttggcaacattgtacaagtcacccagccagaaggaatgcacagtactgtttcaaatcaaacctcagggatttagagatactgttgttacttctgcatgttcattgcaaacagaaggttccttgagcacccggaaacggtcacgagacccagaggaagaattataacccagaaacaaatctcaaagtgtacaaatttattgatgttgtgaaatcaatgtgtacaagtggacttgttaccttaaagtataaataaacacactatggcatgaatgaatccaaaaa

SEQ ID NO: 34914 - DNA, 1124 bp, Homo sapiens
ggtgcggagtttggctgctccggggttagcaggtgagcctgcgatgcgcgggaagacgttccgctttgaaatgcagcgggatttggtgagtttcccgctgtctccagcggtgcgggtgaagctggtgtctgcggggttccagactgctgaggaactcctagaggtgaaaccctccgagcttagcaaagaagttgggatatctaaagcagaagccttagaaactctgcaaattatcagaagagaatgtctcacaaataaaccaagatatgctggtacatctgagtcacacaagaagtgtacagcactggaacttcttgagcaggagcatacccagggcttcataatcaccttctgttcagcactagatgatattcttgggggtggagtgcccttaatgaaaacaacagaaatttgtggtgcaccaggtgttggaaaaacacaattatgaacaccgaaaagctttggaggatttcactcttgataatattctttctcatatttattattttcgctgtcgtgactacacagagttactggcacaagtttatcttcttccagatttcctttcagaacactcaaaggttcgactagtgatagtggatggtattgcttttccatttcgtcatgacctagatgacctgtctcttcgtactcggttattaaatggcctagcccagcaaatgatcagccttgcaaataatcacagattagctgtaattttaaccaatcagatgacaacaaagattgatagaaatcaggccttgcttgttcctgcattaggggaaagttggggacatgctgctacaatacggctaatctttcattgggaccgaaagcaaaggttggcaacattgtacaagtcacccagccagaaggaatgcacagtactgtttcaaatcaaacctcagggatttagagatactgttgttacttctgcatgttcattgcaaacagaaggttccttgagcacccggaaacggtcacgagacccagaggaagaattataacccagaaacaaatctcaaagtgtacaaatttattgatgttgtgaaatcaatgtgtacaagtggacttgttaccttaaagtataaataaacacactatggcatgaatgaatccaaaaa

SEQ ID NO: 34915 - DNA, 592 bp, Homo sapiens
ggtgcggagtttggctgctccggggttagcaggtgagcctgcgatgcgcgggaagacgttccgctttgaaatgcagcgggatttggtgagtttcccgctgtctccagcggtgcgggtgaagctggtgtctgcggggttccagactgctgaggaactcctagaggtgaaaccctccgagcttagcaaagaagttgggatatctaaagcagaagccttagaaactctgcaaattatcagaagagaatgtctcacaaataaaccaagatatgctggtacatctgagtcacacaagaagtgtacagcactggaacttcttgagcaggagcatacccagggcttcataatcaccttctgttcagcactagatgatattcttgggggtggagtgcccttaatgaaaacaacagaaatttgtggtgcaccaggtgttggaaaaacacaattatggtaaaataaagtgttctccttttaagggtgggtttaataacatattatgaaagtagtattttgtactatcgtcaggaaaccaaataagatatatatgtgctcttaattttaagtgtgtatgtgcattaaacaaaaattagcttac

SEQ ID NO: 34916 - DNA, 489 bp, Homo sapiens
ggtgcggagtttggctgctccggggttagcaggtgagcctgcgatgcgcgggaagacgttccgctttgaaatgcagcgggatttgaagttgggatatctaaagcagaagccttagaaactctgcaaattatcagaagagaatgtctcacaaataaaccaagatatgctggtacatctgagtcacacaagaagtgtacagcactggaacttcttgagcaggagcatacccagggcttcataatcaccttctgttcagcactagatgatattcttgggggtggagtgcccttaatgaaaacaacagaaatttgtggtgcaccaggtgttggaaaaacacaattatggtaaaataaagtgttctccttttaagggtgggtttaataacatattatgaaagtagtattttgtactatcgtcaggaaaccaaataagatatatatgtgctcttaattttaagtgtgtatgtgcattaaacaaaaattagcttac

SEQ ID NO: 34917 - DNA, 635 bp, Homo sapiens
ggtgcggagtttggctgctccggggttagcaggtgagcctgcgatgcgcgggaagacgttccgctttgaaatgcagcgggatttggtgagtttcccgctgtctccagcggtgcgggtgaagctggtgtctgcggggttccagactgctgaggaactcctagaggtgaaaccctccgagcttagcaaagaagttgggatatctaaagcagaagccttagaaactctgcaaattatcagaagagaatgtctcacaaataaaccaagatatgctggtacatctgagtcacacaagaagtgtacagcactggaacttcttgagcaggagcatacccagggcttcataatcaccttctgttcagcactagatgatattcttgggggtggagtgcccttaatgaaaacaacagaaatttgtggtgcaccaggtgttggaaaaacacaattatggtaaaataaagtgttctccttttaagggtgggtttaataacatattatgaaagtagtattttgtactatcgtcaggaaaccaaataagatatatatgtgctcttaattttaagtgtgtatgtgcattaaacaaaaattagcttactatttgtgttacttcattatcccttcttgataaatgtatgcaa

SEQ ID NO: 34918 - DNA, 434 bp, Homo sapiens
ataggggtcaccatgttggccaggctggtcttgaactcctgacctcatgatctgcccacctcagcctcccaaagtgctgggattacaggtgtgagccactgcgcctggccctagaataaagtagctttcttattagttacttaaaaatatttctaagatcagtcttcaaatgttcttaaagcatatttgtatatatattttttatctttcagcctcagggatttagagatactgttgttacttctgcatgttcattgcaaacagaaggttccttgagcacccggaaacggtcacgagacccagaggaagaattataacccagaaacaaatctcaaagtgtacaaatttattgatgttgtgaaatcaatgtgtacaagtggacttgttaccttaaagtataaataaacacactatggcatgaatgaatccaaaaa

SEQ ID NO: 34919 - DNA, 436 bp, Homo sapiens
atttttaatatttctctcctttttgtgttcttagagaaaaaatagaattattaatataataaacctatacatttaaataatgagtttggtcatctgaacttttaattaattaagttcatgtgtttgtatgtatttattctttttctttaagcagttggcaacattgtacaagtcacccagccagaaggaatgcacagtactgtttcaaatcaaacctcagggatttagagatactgttgttacttctgcatgttcattgcaaacagaaggttccttgagcacccggaaacggtcacgagacccagaggaagaattataacccagaaacaaatctcaaagtgtacaaatttattgatgttgtgaaatcaatgtgtacaagtggacttgttaccttaaagtataaataaacacactatggcatgaatgaatccaaaaa

SEQ ID NO: 34920 - DNA, 363 bp, Homo sapiens
cccccgggggcggcgaaccccccccccccccccccccccaccccccccattttccccccctccccccccccccccgggggcccttttttttccccaaatcccccccccccccggaagtccccccgctgatttttgaccccccccctggccccccaccccccctttttttttttccccccaaaaaaaaaaagtaaggggaaaaaacccctatatttttggcccgagcccccagaggaagaattataacccagaaacaaatctcaaagtgtacaaatttattgatgttgtgaaatcaatgtgtacaagtggacttgttaccttaaagtataaataaacacactatggcatgaatgaatccaaaaa

SEQ ID NO: 34921 - DNA, 307 bp, Homo sapiens
atttttaatatttctctcctttttgtgttcttagagaaaaaatagaattattaatataataaacctatacatttaaataatgagtttggtcatctgaacttttaattaattaagttcatgtgtttgtatgtatttattctttttctttaagcagttggcaacattgtacaagtcacccagccagaaggaatgcacagtactgtttcaaatcaaagtcagtattatttgattagagtgggattttgatattgatgggcggtaattatctaaagagagaatttacaacttgcttctgtcaacttctgta

SEQ ID NO: 34922 - DNA, 2314 bp, Homo sapiens
ggtgcggagtttggctgctccggggttagcaggtgagcctgcgatgcgcgggaagacgttccgctttgaaatgcagcgggatttggtgagtttcccgctgtctccagcggtgcgggtgaagctggtgtctgcggggttccagactgctgaggaactcctagaggtgaaaccctccgagcttagcaaaggtaacgactcctgatggcaagctgaggcacaccggccgccgtcagcgccgcctcagtcttcgttctctcgcctcggccttcagcccagtctccgttagattctgcttcctcccacgtccatgtttacagcgtgaaagagctcctcgactccacttacaagttgtctgaatggttaggagaactgtggtcgtgaaaacatttactaattgcttttcctctggcaatgcctgctgaatgctttgaggattgtctcatttaaccctcaacccgcttacgtagattattatattcagtatatggatgagagaactgatatcttggggagcttaggtaacttttcatgctaactgggttaggaaatactggagtcagaattggttgtctaatttttgctgttccaagatccaaggggtaagggttaaatttcagaaatgcaggattttgtgtaggactagagacactaagaatgagaaagagagtagaatccccggaatcttgaggaagcatagaaagaatattctcttacgtaattaactgaaacacccaaaacctcatattccagagcattgcagatgggaaccactgcatcctgagacatacaaatatgaggctggcggtggtcacttgttgtgcacatctctctatgacatgtctggacctgtgctattcactgaagaagatggaacagaattttaagttactgcccttactgatggaaaatacagaggtttcaattcgcctctaaagaataagtctcgtggacccagccttaactgtttaagtcataccgcgcgcagactgtgtcccccaagatttgatgggctcttttttcttcaacaagttggcttttcaaagaagaaatgtgagaccctgaataataatgatcactaacaactattgactactttagatggtcttgatattctaccaagctttttacatgtatcgtctcattcccattttatagacgaaaaaaatctgagcaaaaaagaaaaagtgaagtaacttgcccaaagtcatgcaaagttgggatatctaaagcagaagccttagaaactctgcaaattatcagaagagaatgtctcacaaataaaccaagatatgctggtacatctgagtcacacaagaagtgtacagcactggaacttcttgagcaggagcatacccagggcttcataatcaccttctgttcagcactagatgatattcttgggggtggagtgcccttaatgaaaacaacagaaatttgtggtgcaccaggtgttggaaaaacacaattatgtatgcagttggcagtagatgtgcagataccagaatgttttggaggagtggcaggtgaagcagtttttattgatacagagggaagttttatggttgatagagtggtagaccttgctactgcctgcattcagcaccttcagcttatagcagaaaaacacaagggagaggaacaccgaaaagctttggaggatttcactcttgataatattctttctcatatttattattttcgctgtcgtgactacacagagttactggcacaagtttatcttcttccagatttcctttcagaacactcaaaggttcgactagtgatagtggatggtattgcttttccatttcgtcatgacctagatgacctgtctcttcgtactcggttattaaatggcctagcccagcaaatgatcagccttgcaaataatcacagattagctgtaattttaaccaatcagatgacaacaaagattgatagaaatcaggccttgcttgttcctgcattaggggaaagttggggacatgctgctacaatacggctaatctttcattgggaccgaaagcaaaggttggcaacattgtacaagtcacccagccagaaggaatgcacagtactgtttcaaatcaaacctcagggatttagagatactgttgttacttctgcatgttcattgcaaacagaaggttccttgagcacccggaaacggtcacgagacccagaggaagaattataacccagaaacaaatctcaaagtgtacaaatttattgatgttgtgaaatcaatgtgtacaagtggacttgttaccttaaagtataaataaacacactatggcatgaatgaatccaaaaa

SEQ ID NO: 34923 - DNA, 1411 bp, Homo sapiens
ggtgcggagtttggctgctccggggttagcaggtgagcctgcgatgcgcgggaagacgttccgctttgaaatgcagcgggatttggtgagtttcccgctgtctccagcggtgcgggtgaagctggtgtctgcggggttccagactgctgaggaactcctagaggtgaaaccctccgagcttagcaaagaagttgggatatctaaagcagaagccttagaaactctgcaaattatcagaagagaatgtctcacaaataaaccaagatatgctggtacatctgagtcacacaagaagtgtacagcactggaacttcttgagcaggagcatacccagggcttcataatcaccttctgttcagcactagatgatattcttgggggtggagtgcccttaatgaaaacaacagaaatttgtggtgcaccaggtgttggaaaaacacaattatgtatgcagttggcagtagatgtgcagataccagaatgttttggaggagtggcaggtgaagcagtttttattgatacagagggaagttttatggttgatagagtggtagaccttgctactgcctgcattcagcaccttcagcttatagcagaaaaacacaagggagaggaacaccgaaaagctttggaggatttcactcttgataatattctttctcatatttattattttcgctgtcgtgactacacagagttactggcacaagtttatcttcttccagatttcctttcagaacactcaaaggcccactgcagtagcagaatcaccctactgctctgtggggtggccctgccccttcctctctctgcaagggccccaccctctgaaaccaaggacgacatagcattgccccctgggcttatggttcgactagtgatagtggatggtattgcttttccatttcgtcatgacctagatgacctgtctcttcgtactcggttattaaatggcctagcccagcaaatgatcagccttgcaaataatcacagattagctgtaattttaaccaatcagatgacaacaaagattgatagaaatcaggccttgcttgttcctgcattaggggaaagttggggacatgctgctacaatacggctaatctttcattgggaccgaaagcaaaggttggcaacattgtacaagtcacccagccagaaggaatgcacagtactgtttcaaatcaaacctcagggatttagagatactgttgttacttctgcatgttcattgcaaacagaaggttccttgagcacccggaaacggtcacgagacccagaggaagaattataacccagaaacaaatctcaaagtgtacaaatttattgatgttgtgaaatcaatgtgtacaagtggacttgttaccttaaagtataaataaacacactatggcatgaatgaatccaaaaa

SEQ ID NO: 34924 - DNA, 1436 bp, Homo sapiens
ggtgcggagtttggctgctccggggttagcaggtgagcctgcgatgcgcgggaagacgttccgctttgaaatgcagcgggatttggtgagtttcccgctgtctccagcggtgcgggtgaagctggtgtctgcggggttccagactgctgaggaactcctagaggtgaaaccctccgagcttagcaaagaagttgggatatctaaagcagaagccttagaaactctgcaaattatcagaagagaatgtctcacaaataaaccaagatatgctggtacatctgagtcacacaagaagtgtacagcactggaacttcttgagcaggagcatacccagggcttcataatcaccttctgttcagcactagatgatattcttgggggtggagtgcccttaatgaaaacaacagaaatttgtggtgcaccaggtgttggaaaaacacaattatgtatgcagttggcagtagatgtgcagataccagaatgttttggaggagtggcaggtgaagcagtttttattgatacagagggaagttttatggttgatagagtggtagaccttgctactgcctgcattcagcaccttcagcttatagcagaaaaacacaagggagaggaacaccgaaaagctttggaggatttcactcttgataatattctttctcatatttattattttcgctgtcgtgactacacagagttactggcacaagtttatcttcttccagatttcctttcagaacactcaaagccccaaacgtcttaaccggttccatcatcaactctaaaagtcccaggcttcatctaaatattatctaaatcagagattggtgagactctagttataattcatcctgaagtgaaattcccttccagctgtgaacgtttgaaatcaggttcgactagtgatagtggatggtattgcttttccatttcgtcatgacctagatgacctgtctcttcgtactcggttattaaatggcctagcccagcaaatgatcagccttgcaaataatcacagattagctgtaattttaaccaatcagatgacaacaaagattgatagaaatcaggccttgcttgttcctgcattaggggaaagttggggacatgctgctacaatacggctaatctttcattgggaccgaaagcaaaggttggcaacattgtacaagtcacccagccagaaggaatgcacagtactgtttcaaatcaaacctcagggatttagagatactgttgttacttctgcatgttcattgcaaacagaaggttccttgagcacccggaaacggtcacgagacccagaggaagaattataacccagaaacaaatctcaaagtgtacaaatttattgatgttgtgaaatcaatgtgtacaagtggacttgttaccttaaagtataaataaacacactatggcatgaatgaatccaaaaa

SEQ ID NO: 34925 - DNA, 2531 bp, Homo sapiens
ggtgcggagtttggctgctccggggttagcaggtgagcctgcgatgcgcgggaagacgttccgctttgaaatgcagcgggatttggtgagtttcccgctgtctccagcggtgcgggtgaagctggtgtctgcggggttccagactgctgaggaactcctagaggtgaaaccctccgagcttagcaaaggtaacgactcctgatggcaagctgaggcacaccggccgccgtcagcgccgcctcagtcttcgttctctcgcctcggccttcagcccagtctccgttagattctgcttcctcccacgtccatgtttacagcgtgaaagagctcctcgactccacttacaagttgtctgaatggttaggagaactgtggtcgtgaaaacatttactaattgcttttcctctggcaatgcctgctgaatgctttgaggattgtctcatttaaccctcaacccgcttacgtagattattatattcagtatatggatgagagaactgatatcttggggagcttaggtaacttttcatgctaactgggttaggaaatactggagtcagaattggttgtctaatttttgctgttccaagatccaaggggtaagggttaaatttcagaaatgcaggattttgtgtaggactagagacactaagaatgagaaagagagtagaatccccggaatcttgaggaagcatagaaagaatattctcttacgtaattaactgaaacacccaaaacctcatattccagagcattgcagatgggaaccactgcatcctgagacatacaaatatgaggctggcggtggtcacttgttgtgcacatctctctatgacatgtctggacctgtgctattcactgaagaagatggaacagaattttaagttactgcccttactgatggaaaatacagaggtttcaattcgcctctaaagaataagtctcgtggacccagccttaactgtttaagtcataccgcgcgcagactgtgtcccccaagatttgatgggctcttttttcttcaacaagttggcttttcaaagaagaaatgtgagaccctgaataataatgatcactaacaactattgactactttagatggtcttgatattctaccaagctttttacatgtatcgtctcattcccattttatagacgaaaaaaatctgagcaaaaaagaaaaagtgaagtaacttgcccaaagtcatgcaaagttgggatatctaaagcagaagccttagaaactctgcaaattatcagaagagaatgtctcacaaataaaccaagatatgctggtacatctgagtcacacaagaagtgtacagcactggaacttcttgagcaggagcatacccagggcttcataatcaccttctgttcagcactagatgatattcttgggggtggagtgcccttaatgaaaacaacagaaatttgtggtgcaccaggtgttggaaaaacacaattatgtatgcagttggcagtagatgtgcagataccagaatgttttggaggagtggcaggtgaagcagtttttattgatacagagggaagttttatggttgatagagtggtagaccttgctactgcctgcattcagcaccttcagcttatagcagaaaaacacaagggagaggaatctggctctaccgcccgggctggagtgcagtggcgcaatcttggcttactgcgaccttcacctcccaggttcaagcgattctcctgactcagcctcctgagtagctgggagctgcgaatacagaacaccgaaaagctttggaggatttcactcttgataatattctttctcatatttattattttcgctgtcgtgactacacagagttactggcacaagtttatcttcttccagatttcctttcagaacactcaaagccccaaacgtcttaaccggttccatcatcaaactctagttataattcatcctgaagtgaaattcccttccagctgtgaacgtttgaaatcaggttcgactagtgatagtggatggtattgcttttccatttcgtcatgacctagatgacctgtctcttcgtactcggttattaaatggcctagcccagcaaatgatcagccttgcaaataatcacagattagctgtaattttaaccaatcagatgacaacaaagattgatagaaatcaggccttgcttgttcctgcattaggggaaagttggggacatgctgctacaatacggctaatctttcattgggaccgaaagcaaaggttggcaacattgtacaagtcacccagccagaaggaatgcacagtactgtttcaaatcaaacctcagggatttagagatactgttgttacttctgcatgttcattgcaaacagaaggttccttgagcacccggaaacggtcacgagacccagaggaagaattataacccagaaacaaatctcaaagtgtacaaatttattgatgttgtgaaatcaatgtgtacaagtggacttgttaccttaaagtataaataaacacactatggcatgaatgaatccaaaaa

SEQ ID NO: 34926 - DNA, 1169 bp, Homo sapiens
ggtgcggagtttggctgctccggggttagcaggtgagcctgcgatgcgcgggaagacgttccgctttgaaatgcagcgggatttggtgagtttcccgctgtctccagcggtgcgggtgaagctggtgtctgcggggttccagactgctgaggaactcctagaggtgaaaccctccgagcttagcaaagaagttgggatatctaaagcagaagccttagaaactctgcaaattatcagaagagaatgtctcacaaataaaccaagatatgctggtacatctgagtcacacaagaagtgtacagcactggaacttcttgagcaggagcatacccagggcttcataatcaccttctgttcagcactagatgatattcttgggggtggagtgcccttaatgaaaacaacagaaatttgtggtgcaccaggtgttggaaaaacacaattatgtatgcagttggcagtagatgtgcagataccagaatgttttggaggagtggcaggtgaagcagtttttattgatacagagggaagttttatggttgatagagtggtagaccttgctactgcctgcattcagcaccttcagcttatagcagaaaaacacaagggagaggaacaccgaaaagctttggaggatttcactcttgataatattctttctcatatttattattttcgctgtcgtgactacacagagttactggcacaagtttatcttcttccagatttcctttcagaacactcaaaggttcgactagtgatagtggatggtattgcttttccatttcgtcatgacctagatgacctgtctcttcgtactcggttattaaatggcctagcccagcaaatgatcagccttgcaaataatcacagattagctgtaattttaaccaatcagatgacaacaaagattgatagaaatcaggccttgcttgttcctgcattagcctcagggatttagagatactgttgttacttctgcatgttcattgcaaacagaaggttccttgagcacccggaaacggtcacgagacccagaggaagaattataacccagaaacaaatctcaaagtgtacaaatttattgatgttgtgaaatcaatgtgtacaagtggacttgttaccttaaagtataaataaacacactatggcatgaatgaatccaaaaa

SEQ ID NO: 34927 - DNA, 2292 bp, Homo sapiens
ggtgcggagtttggctgctccggggttagcaggtgagcctgcgatgcgcgggaagacgttccgctttgaaatgcagcgggatttggtgagtttcccgctgtctccagcggtgcgggtgaagctggtgtctgcggggttccagactgctgaggaactcctagaggtgaaaccctccgagcttagcaaaggtaacgactcctgatggcaagctgaggcacaccggccgccgtcagcgccgcctcagtcttcgttctctcgcctcggccttcagcccagtctccgttagattctgcttcctcccacgtccatgtttacagcgtgaaagagctcctcgactccacttacaagttgtctgaatggttaggagaactgtggtcgtgaaaacatttactaattgcttttcctctggcaatgcctgctgaatgctttgaggattgtctcatttaaccctcaacccgcttacgtagattattatattcagtatatggatgagagaactgatatcttggggagcttaggtaacttttcatgctaactgggttaggaaatactggagtcagaattggttgtctaatttttgctgttccaagatccaaggggtaagggttaaatttcagaaatgcaggattttgtgtaggactagagacactaagaatgagaaagagagtagaatccccggaatcttgaggaagcatagaaagaatattctcttacgtaattaactgaaacacccaaaacctcatattccagagcattgcagatgggaaccactgcatcctgagacatacaaatatgaggctggcggtggtcacttgttgtgcacatctctctatgacatgtctggacctgtgctattcactgaagaagatggaacagaattttaagttactgcccttactgatggaaaatacagaggtttcaattcgcctctaaagaataagtctcgtggacccagccttaactgtttaagtcataccgcgcgcagactgtgtcccccaagatttgatgggctcttttttcttcaacaagttggcttttcaaagaagaaatgtgagaccctgaataataatgatcactaacaactattgactactttagatggtcttgatattctaccaagctttttacatgtatcgtctcattcccattttatagacgaaaaaaatctgagcaaaaaagaaaaagtgaagtaacttgcccaaagtcatgcaaagttgggatatctaaagcagaagccttagaaactctgcaaattatcagaagagaatgtctcacaaataaaccaagatatgctggtacatctgagtcacacaagaagtgtacagcactggaacttcttgagcaggagcatacccagggcttcataatcaccttctgttcagcactagatgatattcttgggggtggagtgcccttaatgaaaacaacagaaatttgtggtgcaccaggtgttggaaaaacacaattatgaacaccgaaaagctttggaggatttcactcttgataatattctttctcatatttattattttcgctgtcgtgactacacagagttactggcacaagtttatcttcttccagatttcctttcagaacactcaaagccccaaacgtcttaaccggttccatcatcaactctaaaagtcccaggcttcatctaaatattatctaaatcagagattggtgagactctagttataattcatcctgaagtgaaattcccttccagctgtgaacgtttgaaatcaggttcgactagtgatagtggatggtattgcttttccatttcgtcatgacctagatgacctgtctcttcgtactcggttattaaatggcctagcccagcaaatgatcagccttgcaaataatcacagattagctgtaattttaaccaatcagatgacaacaaagattgatagaaatcaggccttgcttgttcctgcattaggggaaagttggggacatgctgctacaatacggctaatctttcattgggaccgaaagcaaaggttggcaacattgtacaagtcacccagccagaaggaatgcacagtactgtttcaaatcaaacctcagggatttagagatactgttgttacttctgcatgttcattgcaaacagaaggttccttgagcacccggaaacggtcacgagacccagaggaagaattataacccagaaacaaatctcaaagtgtacaaatttattgatgttgtgaaatcaatgtgtacaagtggacttgttaccttaaagtataaataaacacactatggcatgaatgaatccaaaaa

SEQ ID NO: 34928 - DNA, 1188 bp, Homo sapiens
ggtgcggagtttggctgctccggggttagcaggtgagcctgcgatgcgcgggaagacgttccgctttgaaatgcagcgggatttgaagttgggatatctaaagcagaagccttagaaactctgcaaattatcagaagagaatgtctcacaaataaaccaagatatgctggtacatctgagtcacacaagaagtgtacagcactggaacttcttgagcaggagcatacccagggcttcataatcaccttctgttcagcactagatgatattcttgggggtggagtgcccttaatgaaaacaacagaaatttgtggtgcaccaggtgttggaaaaacacaattatgtatgcagttggcagtagatgtgcagataccagaatgttttggaggagtggcaggtgaagcagtttttattgatacagagggaagttttatggttgatagagtggtagaccttgctactgcctgcattcagcaccttcagcttatagcagaaaaacacaagggagaggaacaccgaaaagctttggaggatttcactcttgataatattctttctcatatttattattttcgctgtcgtgactacacagagttactggcacaagtttatcttcttccagatttcctttcagaacactcaaaggttcgactagtgatagtggatggtattgcttttccatttcgtcatgacctagatgacctgtctcttcgtactcggttattaaatggcctagcccagcaaatgatcagccttgcaaataatcacagattagctgtaattttaaccaatcagatgacaacaaagattgatagaaatcaggccttgcttgttcctgcattaggggaaagttggggacatgctgctacaatacggctaatctttcattgggaccgaaagcaaaggttggcaacattgtacaagtcacccagccagaaggaatgcacagtactgtttcaaatcaaacctcagggatttagagatactgttgttacttctgcatgttcattgcaaacagaaggttccttgagcacccggaaacggtcacgagacccagaggaagaattataacccagaaacaaatctcaaagtgtacaaatttattgatgttgtgaaatcaatgtgtacaagtggacttgttaccttaaagtataaataaacacactatggcatgaatgaatccaaaaa

SEQ ID NO: 34929 - DNA, 1145 bp, Homo sapiens
gcaatctggaacgactctcttaatcctccaccgctacagcagaagttgggatatctaaagcagaagccttagaaactctgcaaattatcagaagagaatgtctcacaaataaaccaagatatgctggtacatctgagtcacacaagaagtgtacagcactggaacttcttgagcaggagcatacccagggcttcataatcaccttctgttcagcactagatgatattcttgggggtggagtgcccttaatgaaaacaacagaaatttgtggtgcaccaggtgttggaaaaacacaattatgtatgcagttggcagtagatgtgcagataccagaatgttttggaggagtggcaggtgaagcagtttttattgatacagagggaagttttatggttgatagagtggtagaccttgctactgcctgcattcagcaccttcagcttatagcagaaaaacacaagggagaggaacaccgaaaagctttggaggatttcactcttgataatattctttctcatatttattattttcgctgtcgtgactacacagagttactggcacaagtttatcttcttccagatttcctttcagaacactcaaaggttcgactagtgatagtggatggtattgcttttccatttcgtcatgacctagatgacctgtctcttcgtactcggttattaaatggcctagcccagcaaatgatcagccttgcaaataatcacagattagctgtaattttaaccaatcagatgacaacaaagattgatagaaatcaggccttgcttgttcctgcattaggggaaagttggggacatgctgctacaatacggctaatctttcattgggaccgaaagcaaaggttggcaacattgtacaagtcacccagccagaaggaatgcacagtactgtttcaaatcaaacctcagggatttagagatactgttgttacttctgcatgttcattgcaaacagaaggttccttgagcacccggaaacggtcacgagacccagaggaagaattataacccagaaacaaatctcaaagtgtacaaatttattgatgttgtgaaatcaatgtgtacaagtggacttgttaccttaaagtataaataaacacactatggcatgaatgaatccaaaaa

SEQ ID NO: 34930 - DNA, 1230 bp, Homo sapiens
ggtgcggagtttggctgctccggggttagcaggtgagcctgcgatgcgcgggaagacgttccgctttgaaatgcagcgggatttggtgagtttcccgctgtctccagcggtgcgggtgaagctggtgtctgcggggttccagactgctgaggaactcctagaggtgaaaccctccgagcttagcaaagaagttgggatatctaaagcagaagccttagaaactctgcaaattatcagaagagaatgtctcacaaataaaccaagatatgctggtacatctgagtcacacaagaagtgtacagcactggaacttcttgagcaggagcatacccagggcttcataatcaccttctgttcagcactagatgatattcttgggggtggagtgcccttaatgaaaacaacagaaatttgtggtgcaccaggtgttggaaaaacacaattatgtatgcagttggcagtagatgtgcagataccagaatgttttggaggagtggcaggtgaagcagtttttattgatacagagggaagttttatggttgatagagtggtagaccttgctactgcctgcattcagcaccttcagcttatagcagaaaaacacaagggagaggaacaccgaaaagctttggaggatttcactcttgataatattctttctcatatttattattttcgctgtcgtgactacacagagttactggcacaagtttatcttcttccagatttcctttcagaacactcaaaggttcgactagtgatagtggatggtattgcttttccatttcgtcatgacctagatgacctgtctcttcgtactcggttattaaatggcctagcccagcaaatgatcagccttgcaaataatcacagattagctgtaattttaaccaatcagatgacaacaaagattgatagaaatcaggccttgcttgttcctgcattaggggaaagttggggacatgctgctacaatacggctaatctttcattgggaccgaaagcaaagcctcagggatttagagatactgttgttacttctgcatgttcattgcaaacagaaggttccttgagcacccggaaacggtcacgagacccagaggaagaattataacccagaaacaaatctcaaagtgtacaaatttattgatgttgtgaaatcaatgtgtacaagtggacttgttaccttaaagtataaataaacacactatggcatgaatgaatccaaaaa

SEQ ID NO: 34931 - DNA, 1230 bp, Homo sapiens
ggtgcggagtttggctgctccggggttagcaggtgagcctgcgatgcgcgggaagacgttccgctttgaaatgcagcgggatttggtgagtttcccgctgtctccagcggtgcgggtgaagctggtgtctgcggggttccagactgctgaggaactcctagaggtgaaaccctccgagcttagcaaagaagttgggatatctaaagcagaagccttagaaactctgcaaattatcagaagagaatgtctcacaaataaaccaagatatgctggtacatctgagtcacacaagaagtgtacagcactggaacttcttgagcaggagcatacccagggcttcataatcaccttctgttcagcactagatgatattcttgggggtggagtgcccttaatgaaaacaacagaaatttgtggtgcaccaggtgttggaaaaacacaattatgtatgcagttggcagtagatgtgcagataccagaatgttttggaggagtggcaggtgaagcagtttttattgatacagagggaagttttatggttgatagagtggtagaccttgctactgcctgcattcagcaccttcagcttatagcagaaaaacacaagggagaggaacaccgaaaagctttggaggatttcactcttgataatattctttctcatatttattattttcgctgtcgtgactacacagagttactggcacaagtttatcttcttccagatttcctttcagaacactcaaaggttcgactagtgatagtggatggtattgcttttccatttcgtcatgacctagatgacctgtctcttcgtactcggttattaaatggcctagcccagcaaatgatcagccttgcaaataatcacagattagctgtaattttaaccaatcagatgacaacaaagattgatagaaatcaggccttgcttgttcctgcattaggttggcaacattgtacaagtcacccagccagaaggaatgcacagtactgtttcaaatcaaacctcagggatttagagatactgttgttacttctgcatgttcattgcaaacagaaggttccttgagcacccggaaacggtcacgagacccagaggaagaattataacccagaaacaaatctcaaagtgtacaaatttattgatgttgtgaaatcaatgtgtacaagtggacttgttaccttaaagtataaataaacacactatggcatgaatgaatccaaaaa

SEQ ID NO: 34932 - DNA, 1613 bp, Homo sapiens
ggtgcggagtttggctgctccggggttagcaggtgagcctgcgatgcgcgggaagacgttccgctttgaaatgcagcgggatttggtgagtttcccgctgtctccagcggtgcgggtgaagctggtgtctgcggggttccagactgctgaggaactcctagaggtgaaaccctccgagcttagcaaagaagttgggatatctaaagcagaagccttagaaactctgcaaattatcagaagagaatgtctcacaaataaaccaagatatgctggtacatctgagtcacacaagaagtgtacagcactggaacttcttgagcaggagcatacccagggcttcataatcaccttctgttcagcactagatgatattcttgggggtggagtgcccttaatgaaaacaacagaaatttgtggtgcaccaggtgttggaaaaacacaattatgtatgcagttggcagtagatgtgcagataccagaatgttttggaggagtggcaggtgaagcagtttttattgatacagagggaagttttatggttgatagagtggtagaccttgctactgcctgcattcagcaccttcagcttatagcagaaaaacacaagggagaggaacaccgaaaagctttggaggatttcactcttgataatattctttctcatatttattattttcgctgtcgtgactacacagagttactggcacaagtttatcttcttccagatttcctttcagaacactcaaaggttcgactagtgatagtggatggtattgcttttccatttcgtcatgacctagatgacctgtctcttcgtactcggttattaaatggcctagcccagcaaatgatcagccttgcaaataatcacagattagctgtaattttaaccaatcagatgacaacaaagattgatagaaatcaggccttgcttgttcctgcattaggtgggtaattaatcagataaacattttagtttatcacagtttttcttatctctttcatttgattctcattgagtactatacgcttcatgaaagcagactgtatttgtcttgttcactggttaatcttagcactaagcacagtaccgttagatactgattgttccttttagttatttaacatttattgagtggccagacacagtgtcccacacctgtaatcccaacaccttgggaggccgaggcggatcacttgaggctggtcttgaactcctgacctcatgatctgcccacctcagcctcccaaagtgctgggattacaggtgtgagccactgcgcctggccctagaataaagtagctttcttattagttacttaaaaatatttctaagatcagtcttcaaatgttcttaaagcatatttgtatatatattttttatctttcagcctcagggatttagagatactgttgttacttctgcatgttcattgcaaacagaaggttccttgagcacccggaaacggtcacgagacccagaggaagaattataacccagaaacaaatctcaaagtgtacaaatttattgatgttgtgaaatcaatgtgtacaagtggacttgttaccttaaagtataaataaacacactatggcatgaatgaatccaaaaa

SEQ ID NO: 34933 - DNA, 1416 bp, Homo sapiens
ggtgcggagtttggctgctccggggttagcaggtgagcctgcgatgcgcgggaagacgttccgctttgaaatgcagcgggatttggtgagtttcccgctgtctccagcggtgcgggtgaagctggtgtctgcggggttccagactgctgaggaactcctagaggtgaaaccctccgagcttagcaaagaagttgggatatctaaagcagaagccttagaaactctgcaaattatcagaagagaatgtctcacaaataaaccaagatatgctggtacatctgagtcacacaagaagtgtacagcactggaacttcttgagcaggagcatacccagggcttcataatcaccttctgttcagcactagatgatattcttgggggtggagtgcccttaatgaaaacaacagaaatttgtggtgcaccaggtgttggaaaaacacaattatgtatgcagttggcagtagatgtgcagataccagaatgttttggaggagtggcaggtgaagcagtttttattgatacagagggaagttttatggttgatagagtggtagaccttgctactgcctgcattcagcaccttcagcttatagcagaaaaacacaagggagaggaatctggctctaccgcccgggctggagtgcagtggcgcaatcttggcttactgcgaccttcacctcccaggttcaagcgattctcctgactcagcctcctgagtagctgggagctgcgaatacagaacaccgaaaagctttggaggatttcactcttgataatattctttctcatatttattattttcgctgtcgtgactacacagagttactggcacaagtttatcttcttccagatttcctttcagaacactcaaaggttcgactagtgatagtggatggtattgcttttccatttcgtcatgacctagatgacctgtctcttcgtactcggttattaaatggcctagcccagcaaatgatcagccttgcaaataatcacagattagctgtaattttaaccaatcagatgacaacaaagattgatagaaatcaggccttgcttgttcctgcattaggggaaagttggggacatgctgctacaatacggctaatctttcattgggaccgaaagcaaaggttggcaacattgtacaagtcacccagccagaaggaatgcacagtactgtttcaaatcaaacctcagggatttagagatactgttgttacttctgcatgttcattgcaaacagaaggttccttgagcacccggaaacggtcacgagacccagaggaagaattataacccagaaacaaatctcaaagtgtacaaatttattgatgttgtgaaatcaatgtgtacaagtggacttgttaccttaaagtataaataaacacactatggcatgaatgaatccaaaaa

SEQ ID NO: 34934 - DNA, 1032 bp, Homo sapiens
ggtgcggagtttggctgctccggggttagcaggtgagcctgcgatgcgcgggaagacgttccgctttgaaatgcagcgggatttggtgagtttcccgctgtctccagcggtgcgggtgaagctggtgtctgcggggttccagactgctgaggaactcctagaggtgaaaccctccgagcttagcaaagtatgcagttggcagtagatgtgcagataccagaatgttttggaggagtggcaggtgaagcagtttttattgatacagagggaagttttatggttgatagagtggtagaccttgctactgcctgcattcagcaccttcagcttatagcagaaaaacacaagggagaggaacaccgaaaagctttggaggatttcactcttgataatattctttctcatatttattattttcgctgtcgtgactacacagagttactggcacaagtttatcttcttccagatttcctttcagaacactcaaaggttcgactagtgatagtggatggtattgcttttccatttcgtcatgacctagatgacctgtctcttcgtactcggttattaaatggcctagcccagcaaatgatcagccttgcaaataatcacagattagctgtaattttaaccaatcagatgacaacaaagattgatagaaatcaggccttgcttgttcctgcattaggggaaagttggggacatgctgctacaatacggctaatctttcattgggaccgaaagcaaaggttggcaacattgtacaagtcacccagccagaaggaatgcacagtactgtttcaaatcaaacctcagggatttagagatactgttgttacttctgcatgttcattgcaaacagaaggttccttgagcacccggaaacggtcacgagacccagaggaagaattataacccagaaacaaatctcaaagtgtacaaatttattgatgttgtgaaatcaatgtgtacaagtggacttgttaccttaaagtataaataaacacactatggcatgaatgaatccaaaaa

SEQ ID NO: 34935 - DNA, 1269 bp, Homo sapiens
ggtgcggagtttggctgctccggggttagcaggtgagcctgcgatgcgcgggaagacgttccgctttgaaatgcagcgggatttggtgagtttcccgctgtctccagcggtgcgggtgaagctggtgtctgcggggttccagactgctgaggaactcctagaggtgaaaccctccgagcttagcaaagaagttgggatatctaaagcagaagccttagaaactctgcaaattatcagaagagaatgtctcacaaataaaccaagatatgctggtacatctgagtcacacaagaagtgtacagcactggaacttcttgagcaggagcatacccagggcttcataatcaccttctgttcagcactagatgatattcttgggggtggagtgcccttaatgaaaacaacagaaatttgtggtgcaccaggtgttggaaaaacacaattatgaacaccgaaaagctttggaggatttcactcttgataatattctttctcatatttattattttcgctgtcgtgactacacagagttactggcacaagtttatcttcttccagatttcctttcagaacactcaaagccccaaacgtcttaaccggttccatcatcaactctaaaagtcccaggcttcatctaaatattatctaaatcagagattggtgagactctagttataattcatcctgaagtgaaattcccttccagctgtgaacgtttgaaatcaggttcgactagtgatagtggatggtattgcttttccatttcgtcatgacctagatgacctgtctcttcgtactcggttattaaatggcctagcccagcaaatgatcagccttgcaaataatcacagattagctgtaattttaaccaatcagatgacaacaaagattgatagaaatcaggccttgcttgttcctgcattaggggaaagttggggacatgctgctacaatacggctaatctttcattgggaccgaaagcaaaggttggcaacattgtacaagtcacccagccagaaggaatgcacagtactgtttcaaatcaaacctcagggatttagagatactgttgttacttctgcatgttcattgcaaacagaaggttccttgagcacccggaaacggtcacgagacccagaggaagaattataacccagaaacaaatctcaaagtgtacaaatttattgatgttgtgaaatcaatgtgtacaagtggacttgttaccttaaagtataaataaacacactatggcatgaatgaatccaaaaa

SEQ ID NO: 34936 - DNA, 1166 bp, Homo sapiens
ggtgcggagtttggctgctccggggttagcaggtgagcctgcgatgcgcgggaagacgttccgctttgaaatgcagcgggatttgaagttgggatatctaaagcagaagccttagaaactctgcaaattatcagaagagaatgtctcacaaataaaccaagatatgctggtacatctgagtcacacaagaagtgtacagcactggaacttcttgagcaggagcatacccagggcttcataatcaccttctgttcagcactagatgatattcttgggggtggagtgcccttaatgaaaacaacagaaatttgtggtgcaccaggtgttggaaaaacacaattatgaacaccgaaaagctttggaggatttcactcttgataatattctttctcatatttattattttcgctgtcgtgactacacagagttactggcacaagtttatcttcttccagatttcctttcagaacactcaaagccccaaacgtcttaaccggttccatcatcaactctaaaagtcccaggcttcatctaaatattatctaaatcagagattggtgagactctagttataattcatcctgaagtgaaattcccttccagctgtgaacgtttgaaatcaggttcgactagtgatagtggatggtattgcttttccatttcgtcatgacctagatgacctgtctcttcgtactcggttattaaatggcctagcccagcaaatgatcagccttgcaaataatcacagattagctgtaattttaaccaatcagatgacaacaaagattgatagaaatcaggccttgcttgttcctgcattaggggaaagttggggacatgctgctacaatacggctaatctttcattgggaccgaaagcaaaggttggcaacattgtacaagtcacccagccagaaggaatgcacagtactgtttcaaatcaaacctcagggatttagagatactgttgttacttctgcatgttcattgcaaacagaaggttccttgagcacccggaaacggtcacgagacccagaggaagaattataacccagaaacaaatctcaaagtgtacaaatttattgatgttgtgaaatcaatgtgtacaagtggacttgttaccttaaagtataaataaacacactatggcatgaatgaatccaaaaa

SEQ ID NO: 34937 - DNA, 1163 bp, Homo sapiens
ggtgcggagtttggctgctccggggttagcaggtgagcctgcgatgcgcgggaagacgttccgctttgaaatgcagcgggatttggtgagtttcccgctgtctccagcggtgcgggtgaagctggtgtctgcggggttccagactgctgaggaactcctagaggtgaaaccctccgagcttagcaaagaagttgggatatctaaagcagaagccttagaaactctgcaaattatcagaagagaatgtctcacaaataaaccaagatatgctggtacatctgagtcacacaagaagtgtacagcactggaacttcttgagcaggagcatacccagggcttcataatcaccttctgttcagcactagatgatattcttgggggtggagtgcccttaatgaaaacaacagaaatttgtggtgcaccaggtgttggaaaaacacaattatgtatgcagttggcagtagatgtgcagataccagaatgttttggaggagtggcaggtgaagcagtttttattgatacagagggaagttttatggttgatagagtggtagaccttgctactgcctgcattcagcaccttcagcttatagcagaaaaacacaagggagaggaacaccgaaaagctttggaggatttcactcttgataatattctttctcatatttattattttcgctgtcgtgactacacagagttactggcacaagtttatcttcttccagatttcctttcagaacactcaaaggttcgactagtgatagtggatggtattgcttttccatttcgtcatgacctagatgacctgtctcttcgtactcggttattaaatggcctagcccagcaaatgatcagccttgcaaataatcacagattagctgttggcaacattgtacaagtcacccagccagaaggaatgcacagtactgtttcaaatcaaacctcagggatttagagatactgttgttacttctgcatgttcattgcaaacagaaggttccttgagcacccggaaacggtcacgagacccagaggaagaattataacccagaaacaaatctcaaagtgtacaaatttattgatgttgtgaaatcaatgtgtacaagtggacttgttaccttaaagtataaataaacacactatggcatgaatgaatccaaaaa

SEQ ID NO: 34938 - DNA, 1350 bp, Homo sapiens
ggtgcggagtttggctgctccggggttagcaggtgagcctgcgatgcgcgggaagacgttccgctttgaaatgcagcgggatttggtgagtttcccgctgtctccagcggtgcgggtgaagctggtgtctgcggggttccagactgctgaggaactcctagaggtgaaaccctccgagcttagcaaagaagttgggatatctaaagcagaagccttagaaactctgcaaattatcagaagagaatgtctcacaaataaaccaagatatgctggtacatctgagtcacacaagaagtgtacagcactggaacttcttgagcaggagcatacccagggcttcataatcaccttctgttcagcactagatgatattcttgggggtggagtgcccttaatgaaaacaacagaaatttgtggtgcaccaggtgttggaaaaacacaattatgtatgcagttggcagtagatgtgcagataccagaatgttttggaggagtggcaggtgaagcagtttttattgatacagagggaagttttatggttgatagagtggtagaccttgctactgcctgcattcagcaccttcagcttatagcagaaaaacacaagggagaggaacaccgaaaagctttggaggatttcactcttgataatattctttctcatatttattattttcgctgtcgtgactacacagagttactggcacaagtttatcttcttccagatttcctttcagaacactcaaaggcccactgcagtagcagaatcaccctactgctctgtggggtggccctgccccttcctctctctgcaagggccccaccctctgaaaccaaggacgacatagcattgccccctgggcttatggttcgactagtgatagtggatggtattgcttttccatttcgtcatgacctagatgacctgtctcttcgtactcggttattaaatggcctagcccagcaaatgatcagccttgcaaataatcacagattagctgtaattttaaccaatcagatgacaacaaagattgatagaaatcaggccttgcttgttcctgcattaggttggcaacattgtacaagtcacccagccagaaggaatgcacagtactgtttcaaatcaaacctcagggatttagagatactgttgttacttctgcatgttcattgcaaacagaaggttccttgagcacccggaaacggtcacgagacccagaggaagaattataacccagaaacaaatctcaaagtgtacaaatttattgatgttgtgaaatcaatgtgtacaagtggacttgttaccttaaagtataaataaacacactatggcatgaatgaatccaaaaa

SEQ ID NO: 34939 - DNA, 1615 bp, Homo sapiens
ggtgcggagtttggctgctccggggttagcaggtgagcctgcgatgcgcgggaagacgttccgctttgaaatgcagcgggatttggtgagtttcccgctgtctccagcggtgcgggtgaagctggtgtctgcggggttccagactgctgaggaactcctagaggtgaaaccctccgagcttagcaaaggtaacgactcctgatggcaagctgaggcacaccggccgccgtcagcgccgcctcagtcttcgttctctcgcctcggccttcagcccagtctccgttagattctgcttcctcccacgtccatgtttacagcgtgaaagagctcctcgactccacttacaagttgtctgaatggttaggagaactgtggtcgtgaaaacatttactaattgcttttcctctggcaatgcctgctgaatgctttgaggattgtctcatttaaccctcaacccgcttacgtagattattatattcagtatatggatgagagaactgatatcttggggagcttaggtaacttttcatgctaactgggttaggaaatactggagtcagaattggttgtctaatttttgctgttccaagatccaaggggtaagggttaaatttcagaaatgcaggattttgtgtaggactagagacactaagaatgagaaagagagtagaatccccggaatcttgaggaagcatagaaagaatattctcttacgtaattaactgaaacacccaaaacctcatattccagagcattgcagatgggaaccactgcatcctgagacatacaaatatgaggctggcggtggtcacttgttgtgcacatctctctatgacatgtctggacctgtgctattcactgaagaagatggaacagaattttaagttactgcccttactgatggaaaatacagaggtttcaattcgcctctaaagaataagtctcgtggacccagccttaactgtttaagtcataccgcgcgcagactgtgtcccccaagatttgatgggctcttttttcttcaacaagttggcttttcaaagaagaaatgtgagaccctgaataataatgatcactaacaactattgactactttagatggtcttgatattctaccaagctttttacatgtatcgtctcattcccattttatagacgaaaaaaatctgagcaaaaaagaaaaagtgaagtaacttgcccaaagtcatgcaaagttgggatatctaaagcagaagccttagaaactctgcaaattatcagaagagaatgtctcacaaataaaccaagatatgctggtacatctgagtcacacaagaagtgtacagcactggaacttcttgagcaggagcatacccagggcttcataatcaccttctgttcagcactagatgatattcttgggggtggagtgcccttaatgaaaacaacagaaatttgtggtgcaccaggtgttggaaaaacacaattatggtaaaataaagtgttctccttttaagggtgggtttaataacatattatgaaagtagtattttgtactatcgtcaggaaaccaaataagatatatatgtgctcttaattttaagtgtgtatgtgcattaaacaaaaattagcttac

SEQ ID NO: 34940 - DNA, 1658 bp, Homo sapiens
ggtgcggagtttggctgctccggggttagcaggtgagcctgcgatgcgcgggaagacgttccgctttgaaatgcagcgggatttggtgagtttcccgctgtctccagcggtgcgggtgaagctggtgtctgcggggttccagactgctgaggaactcctagaggtgaaaccctccgagcttagcaaaggtaacgactcctgatggcaagctgaggcacaccggccgccgtcagcgccgcctcagtcttcgttctctcgcctcggccttcagcccagtctccgttagattctgcttcctcccacgtccatgtttacagcgtgaaagagctcctcgactccacttacaagttgtctgaatggttaggagaactgtggtcgtgaaaacatttactaattgcttttcctctggcaatgcctgctgaatgctttgaggattgtctcatttaaccctcaacccgcttacgtagattattatattcagtatatggatgagagaactgatatcttggggagcttaggtaacttttcatgctaactgggttaggaaatactggagtcagaattggttgtctaatttttgctgttccaagatccaaggggtaagggttaaatttcagaaatgcaggattttgtgtaggactagagacactaagaatgagaaagagagtagaatccccggaatcttgaggaagcatagaaagaatattctcttacgtaattaactgaaacacccaaaacctcatattccagagcattgcagatgggaaccactgcatcctgagacatacaaatatgaggctggcggtggtcacttgttgtgcacatctctctatgacatgtctggacctgtgctattcactgaagaagatggaacagaattttaagttactgcccttactgatggaaaatacagaggtttcaattcgcctctaaagaataagtctcgtggacccagccttaactgtttaagtcataccgcgcgcagactgtgtcccccaagatttgatgggctcttttttcttcaacaagttggcttttcaaagaagaaatgtgagaccctgaataataatgatcactaacaactattgactactttagatggtcttgatattctaccaagctttttacatgtatcgtctcattcccattttatagacgaaaaaaatctgagcaaaaaagaaaaagtgaagtaacttgcccaaagtcatgcaaagttgggatatctaaagcagaagccttagaaactctgcaaattatcagaagagaatgtctcacaaataaaccaagatatgctggtacatctgagtcacacaagaagtgtacagcactggaacttcttgagcaggagcatacccagggcttcataatcaccttctgttcagcactagatgatattcttgggggtggagtgcccttaatgaaaacaacagaaatttgtggtgcaccaggtgttggaaaaacacaattatggtaaaataaagtgttctccttttaagggtgggtttaataacatattatgaaagtagtattttgtactatcgtcaggaaaccaaataagatatatatgtgctcttaattttaagtgtgtatgtgcattaaacaaaaattagcttactatttgtgttacttcattatcccttcttgataaatgtatgcaa

SEQ ID NO: 34941 - DNA, 1921 bp, Homo sapiens
ggtgcggagtttggctgctccggggttagcaggtgagcctgcgatgcgcgggaagacgttccgctttgaaatgcagcgggatttggtgagtttcccgctgtctccagcggtgcgggtgaagctggtgtctgcggggttccagactgctgaggaactcctagaggtgaaaccctccgagcttagcaaaggtaacgactcctgatggcaagctgaggcacaccggccgccgtcagcgccgcctcagtcttcgttctctcgcctcggccttcagcccagtctccgttagattctgcttcctcccacgtccatgtttacagcgtgaaagagctcctcgactccacttacaagttgtctgaatggttaggagaactgtggtcgtgaaaacatttactaattgcttttcctctggcaatgcctgctgaatgctttgaggattgtctcatttaaccctcaacccgcttacgtagattattatattcagtatatggatgagagaactgatatcttggggagcttaggtaacttttcatgctaactgggttaggaaatactggagtcagaattggttgtctaatttttgctgttccaagatccaaggggtaagggttaaatttcagaaatgcaggattttgtgtaggactagagacactaagaatgagaaagagagtagaatccccggaatcttgaggaagcatagaaagaatattctcttacgtaattaactgaaacacccaaaacctcatattccagagcattgcagatgggaaccactgcatcctgagacatacaaatatgaggctggcggtggtcacttgttgtgcacatctctctatgacatgtctggacctgtgctattcactgaagaagatggaacagaattttaagttactgcccttactgatggaaaatacagaggtttcaattcgcctctaaagaataagtctcgtggacccagccttaactgtttaagtcataccgcgcgcagactgtgtcccccaagatttgatgggctcttttttcttcaacaagttggcttttcaaagaagaaatgtgagaccctgaataataatgatcactaacaactattgactactttagatggtcttgatattctaccaagctttttacatgtatcgtctcattcccattttatagacgaaaaaaatctgagcaaaaaagaaaaagtgaagtaacttgcccaaagtcatgcaaagttgggatatctaaagcagaagccttagaaactctgcaaattatcagaagagaatgtctcacaaataaaccaagatatgctggtacatctgagtcacacaagaagtgtacagcactggaacttcttgagcaggagcatacccagggcttcataatcaccttctgttcagcactagatgatattcttgggggtggagtgcccttaatgaaaacaacagaaatttgtggtgcaccaggtgttggaaaaacacaattatgtatgcagttggcagtagatgtgcagataccagaatgttttggaggagtggcaggtgaagcagtttttattgatacagagggaagttttatggttgatagagtggtagaccttgctactgcctgcattcagcaccttcagcttatagcagaaaaacacaagggagagggtaagttagtaaatgatcttctttttttctgtattaataaaagtaatttgcatttgtgcccatctgagacctcagcaacactccatttggaatgtgaagcctaattactggacagttaactagtgttaaactcttttactactgttacaaaatgagaaatgccacagcctggactggcttttttttgttccccttttatggccctcacttcttcctgtaggagctttgggacaaaacctatgtatgtattccagcctgggtgacagagcgagactctgtctcat

SEQ ID NO: 34942 - DNA, 2022 bp, Homo sapiens
ggtgcggagtttggctgctccggggttagcaggtgagcctgcgatgcgcgggaagacgttccgctttgaaatgcagcgggatttggtgagtttcccgctgtctccagcggtgcgggtgaagctggtgtctgcggggttccagactgctgaggaactcctagaggtgaaaccctccgagcttagcaaaggtaacgactcctgatggcaagctgaggcacaccggccgccgtcagcgccgcctcagtcttcgttctctcgcctcggccttcagcccagtctccgttagattctgcttcctcccacgtccatgtttacagcgtgaaagagctcctcgactccacttacaagttgtctgaatggttaggagaactgtggtcgtgaaaacatttactaattgcttttcctctggcaatgcctgctgaatgctttgaggattgtctcatttaaccctcaacccgcttacgtagattattatattcagtatatggatgagagaactgatatcttggggagcttaggtaacttttcatgctaactgggttaggaaatactggagtcagaattggttgtctaatttttgctgttccaagatccaaggggtaagggttaaatttcagaaatgcaggattttgtgtaggactagagacactaagaatgagaaagagagtagaatccccggaatcttgaggaagcatagaaagaatattctcttacgtaattaactgaaacacccaaaacctcatattccagagcattgcagatgggaaccactgcatcctgagacatacaaatatgaggctggcggtggtcacttgttgtgcacatctctctatgacatgtctggacctgtgctattcactgaagaagatggaacagaattttaagttactgcccttactgatggaaaatacagaggtttcaattcgcctctaaagaataagtctcgtggacccagccttaactgtttaagtcataccgcgcgcagactgtgtcccccaagatttgatgggctcttttttcttcaacaagttggcttttcaaagaagaaatgtgagaccctgaataataatgatcactaacaactattgactactttagatggtcttgatattctaccaagctttttacatgtatcgtctcattcccattttatagacgaaaaaaatctgagcaaaaaagaaaaagtgaagtaacttgcccaaagtcatgcaaagttgggatatctaaagcagaagccttagaaactctgcaaattatcagaagagaatgtctcacaaataaaccaagatatgctggtacatctgagtcacacaagaagtgtacagcactggaacttcttgagcaggagcatacccagggcttcataatcaccttctgttcagcactagatgatattcttgggggtggagtgcccttaatgaaaacaacagaaatttgtggtgcaccaggtgttggaaaaacacaattatgtatgcagttggcagtagatgtgcagataccagaatgttttggaggagtggcaggtgaagcagtttttattgatacagagggaagttttatggttgatagagtggtagaccttgctactgcctgcattcagcaccttcagcttatagcagaaaaacacaagggagaggaatctggctctaccgcccgggctggagtgcagtggcgcaatcttggcttactgcgaccttcacctcccaggttcaagcgattctcctgactcagcctcctgagtagctgggagctgcgaatacaggcacgtgccaccatacctggctaatttttgtatttttagtagagacagagtttcatcatgttggccagactggtctcaaacttctgacctcaagtgatcctcctacgtcggcttccctaagtgctgggattatgagtgtgaacacctgtgcccagctccaaatctaaccaaacttttgagttactaatctctggactcccctgtgttgttacatgcactatgcacaattaataaactctttctcttgttaatccatcttt

SEQ ID NO: 34943 - DNA, 1497 bp, Homo sapiens
ggtgcggagtttggctgctccggggttagcaggtgagcctgcgatgcgcgggaagacgttccgctttgaaatgcagcgggatttggtgagtttcccgctgtctccagcggtgcgggtgaagctggtgtctgcggggttccagactgctgaggaactcctagaggtgaaaccctccgagcttagcaaaggtaacgactcctgatggcaagctgaggcacaccggccgccgtcagcgccgcctcagtcttcgttctctcgcctcggccttcagcccagtctccgttagattctgcttcctcccacgtccatgtttacagcgtgaaagagctcctcgactccacttacaagttgtctgaatggttaggagaactgtggtcgtgaaaacatttactaattgcttttcctctggcaatgcctgctgaatgctttgaggattgtctcatttaaccctcaacccgcttacgtagattattatattcagtatatggatgagagaactgatatcttggggagcttaggtaacttttcatgctaactgggttaggaaatactggagtcagaattggttgtctaatttttgctgttccaagatccaaggggtaagggttaaatttcagaaatgcaggattttgtgtaggactagagacactaagaatgagaaagagagtagaatccccggaatcttgaggaagcatagaaagaatattctcttacgtaattaactgaaacacccaaaacctcatattccagagcattgcagatgggaaccactgcatcctgagacatacaaatatgaggctggcggtggtcacttgttgtgcacatctctctatgacatgtctggacctgtgctattcactgaagaagatggaacagaattttaagttactgcccttactgatggaaaatacagaggtttcaattcgcctctaaagaataagtctcgtggacccagccttaactgtttaagtcataccgcgcgcagactgtgtcccccaagatttgatgggctcttttttcttcaacaagttggcttttcaaagaagaaataagttgggatatctaaagcagaagccttagaaactctgcaaattatcagaagagaatgtctcacaaataaaccaagatatgctggtacatctgagtcacacaagaagtgtacagcactggaacttcttgagcaggagcatacccagggcttcataatcaccttctgttcagcactagatgatattcttgggggtggagtgcccttaatgaaaacaacagaaatttgtggtgcaccaggtgttggaaaaacacaattatggtaaaataaagtgttctccttttaagggtgggtttaataacatattatgaaagtagtattttgtactatcgtcaggaaaccaaataagatatatatgtgctcttaattttaagtgtgtatgtgcattaaacaaaaattagcttactatttgtgttacttcattatcccttcttgataaatgtatgcaa

SEQ ID NO: 34944 - DNA, 550 bp, Homo sapiens
agatggcagcagctcactgcagagcagcgcgagctgtcgctgcaagcggtgatcgcctgggaaatccagaacctgcccgaagagcagcgcaccggctacatggggccgcaggaatgcgcgtcgaagtcggcgccggtgccgaacatcctgttcaagtcggatgcgatccattgatagaaatcaggccttgcttgttcctgcattaggggaaagttggggacatgctgctacaatacggctaatctttcattgggaccgaaagcaaaggttggcaacattgtacaagtcacccagccagaaggaatgcacagtactgtttcaaatcaaacctcagggatttagagatactgttgttacttctgcatgttcattgcaaacagaaggttccttgagcacccggaaacggtcacgagacccagaggaagaattataacccagaaacaaatctcaaagtgtacaaatttattgatgttgtgaaatcaatgtgtacaagtggacttgttaccttaaagtataaataaacacactatggcatgaatgaatccaaaaa

SEQ ID NO: 34945 - DNA, 965 bp, Homo sapiens
tagagatggggtttcaccatgttgcccagctggtcagaaggcggaggttgggctcaagcgatcatctgccggcctcagcctcctaaagtactaggattacaggtgcatgccaccatgtctggttaatttttgtatttttagtagagatggggtttcacaatcttggccagactggtctacttgataattttcaaagagactcacctaattttcttacattttgtttttgtaggtaattttaaccaatcagatgacaacaaagattgatagaaatcaggccttgcttgttcctgcattaggtgggtaattaatcagataaacattttagtttatcacagtttttcttatctctttcatttgattctcattgagtactatacgcttcatgaaagcagactgtatttgtcttgttcactggttaatcttagcactaagcacagtaccgttagatactgattgttccttttagttatttaacatttattgagtggccagacacagtgtcccacacctgtaatcccaacaccttgggaggccgaggcggatcacttgaggctggtcttgaactcctgacctcatgatctgcccacctcagcctcccaaagtgctgggattacaggtgtgagccactgcgcctggccctagaataaagtagctttcttattagttacttaaaaatatttctaagatcagtcttcaaatgttcttaaagcatatttgtatatatattttttatctttcagcctcagggatttagagatactgttgttacttctgcatgttcattgcaaacagaaggttccttgagcacccggaaacggtcacgagacccagaggaagaattataacccagaaacaaatctcaaagtgtacaaatttattgatgttgtgaaatcaatgtgtacaagtggacttgttaccttaaagtataaataaacacactatggcatgaatgaatccaaaaa

SEQ ID NO: 34946 - DNA, 510 bp, Homo sapiens
tttcgttatgttaaattaataaagtaagattatatttgatcagaggcgttctgagaaatgtataaccaagtcagtaaggccatatacagttattatgttttttactctcaggggaaagttggggacatgctgctacaatacggctaatctttcattgggaccgaaagcaaaggtcagtacagaaacaagttaataactccgaatattgggttaattatactgaatgaacacttacaggtttcttagagctagtcctgtggatgagatatacagtgacccatgaagtgacacttttgttgccttgtctgatatcacctagagcaaacatagaaatgtgttgttattactgcatatttagctacataggaaattctctggaatatttaaatgatggggcgcatgcacctgaaatgagtaggtggccaaggaatgccattttctaaagctcttcgaaataatttattagccatgtagaaggaggtgagtactctgtgttcctggaagagattg

SEQ ID NO: 34947 - DNA, 343 bp, Homo sapiens
tagtaattttgctataatttgtcatctttcagttaaagaattttgttatccaaaggagaacattttgttattaaaaagcattgtttttctacaattgccaatacatccaaacaggtaaaactaattaagagtgttttgttgtttcagaacaccgaaaagctttggaggatttcactcttgataatattctttctcatatttattattttcgctgtcgtgactacacagagttactggcacaagtttatcttcttccagatttcctttcagaacactcaaaggtatgagtcagactactgaaatgtaactaaccaagtattttttgaggtgtttgataagcatg

SEQ ID NO: 34948 - DNA, 559 bp, Homo sapiens
caccttggtggtgacactgcctcacaaggtggaggacgagcgggtgctccagcaggccctgcagctctgagggagccaggagtcgcggcccctgcctcccttcctccctggcgatcctcacctgcccagccatggcacacacccttcctgcacacccgcactacctgcacttctcgcacatcctcacgtggcccttatggtgccctgtgcagggtgccaccacagcctcattttacagacagccccctgaggcccagagacatgcagctctctgtccacaaccatgccacttgcatgggagccctgaaggctgtcaaagtccatttagggccaagtcccaagcctcccgggggcctgcggtgaacactggtcaagctctctccggctgggatgatcacaccctctgcttcctggccacctgccagcctccatgcaactctgtctgtctgctgcccatctgctgtctgtgcaagcaacttctggaccctggcaccctgggctgctggcctggaggagttcgggaaggaggatagaccaggaaataaagggtcaacagagc

SEQ ID NO: 34949 - DNA, 533 bp, Homo sapiens
cataaagctatcctgtttttcatgtttaggacattgttcccataaattcatgagctattcaaccctttataataaaaaagaatttgtgttagatgattttgcccaaatgtaggttaatgtaagtgttctgagtacgtttaaggtaggctagtctaagctctgatgctcagtaggttaggtgtattaaagacgtttttacttacgatatcttcccctcccaataaacccattgtaagtcaagaagcacctgtagaggtctgcctttaccaatttcagctgcgacaaatttaatgttcctgtattgcttttaaattggagagcagaagcaggtctgaaacaaatactgcagttagctttgtgttcttcgctatttattgaacagttcagagggcaaggaagcaaagagaagtgctctgagtgtgtctttgcttgccagctcctgaatttttaacagttctacagtggccttcctgtatttttctctcgttttgtgtgttctcttctgtttttgttgaccctgtctcaaaaaaaaa

SEQ ID NO: 34950 - DNA, 458 bp, Homo sapiens
gcggccgcctactactactactactaattcgcggccgcgtcgactgtaatcccagcactttgggaggccgagtgggtggatcatgaggtcaggagatcgagaccatcttggctaacatggtgaaaccccgtctctattaaaaatacaaaaaattagccaggcgtggtggtgggcacctgtagtcccagctacttgggagactgaggcaggagaatggcgtgaacccaggaggcagagcttgcagtgagctgagatcacgccactgcactccaccctaggcgacagagtgagattctgtctcaaaaaaaaaaaaagaaagcaaaaaaagattaccccaccttctttccatagtcctccctggaaggaggtcgatgtgcagagcccatgcttaaggaatgtggagttacactccactccttcatggggggtggggatatctgtataaattatttggaata

SEQ ID NO: 34951 - DNA, 349 bp, Homo sapiens
gcccagctccttctttcagggtggggggcattcagcctccactgtgtctgtcttttcttccctggggctccccctcgaggcgaggggccatgcatgtctgggggacccctgccccccaaaaccctctgtctgtctctgtctctttgctgtttgtccaagactcagtgtcccgacccttgttctcgccgtgaatgtcaatgggccaatcctctctgtcctttcagacacacacacacctgtgtccaccccttctgttcgccacaccctgcgtctggccggtccccccactgctgctgctatcaacgccagaataaacacactctgtgggtctcactccaactgggcctcc

SEQ ID NO: 34952 - DNA, 1523 bp, Homo sapiens
cccaccttggccgggattaccctccgagttccaggccatgacaaatgacatcactcccggcccaggcttaaaatctccccatgtgaggggatgtgtttccttcagcctctgctgtctggccgctctgtctaggtcctgggccacgggagagccccgtccctcctttctgaaggccccctgacttgggcctcagtgtccccgaagatcatgatggcgtatatgaacccggggccccactattctgtcaacgccttggccctaagtggccccagtgtggatctgatgcaccaggctgtgccctacccaagcgcccccaggaagcagcggcgggagcgcaccaccttcacccggagccaactggaggagctggaggcactgtttgccaagacccagtacccagacgtctatgcccgtgaggaggtggctctgaagatcaatctgcctgagtccagggttcaggtttggttcaagaaccggagggctaaatgcaggcagcagcgacagcagcagaaacagcagcagcagcccccagggggccaggccaaggcccggcctgccaagaggaaggcgggcacgtccccaagaccctccacagatgtgtgtccagaccctctgggcatctcagattcctacagtccccctctgcccggcccctcaggctccccaaccacggcagtggccactgtgtccatctggagcccagcctcagagtcccctttgcctgaggcgcagcgggctgggctggtggcctcagggccgtctctgacctccgccccctatgccatgacctacgccccggcctccgctttctgctcttccccctccgcctatgggtctccgagctcctatttcagcggcctagacccctacctttctcccatggtgccccagctagggggcccggctcttagccccctctctggcccctccgtgggaccttccctggcccagtcccccacctccctatcaggccagagctatggcgcctacagccccgtggatagcttggaattcaaggaccccacgggcacctggaaattcacctacaatcccatggaccctctggactacaaggatcagagtgcctggaagtttcagatcttgtagaggacgcagtctccatctctctccatcgggcctcgggaccctttctcttctgaatctgcttccctgcagtttagatcccgggatggcattcctgagaaagcaacccgaaccagctgtccttctgacagctcggtgttcagcttacagagaccacccctttcctccacagggagaggctcctccctctcctgggacagctcacaggtcctagtgattctctcaaccctaacaccgtctggcacgattgtgaccgctgaagtacaccacgagctccaggcttcagaaagtggtgctgagaacttgctccaagaagtcaaaccaaacttgcagttgatttggggtcatgtttaggtcagaatcaccgtgcccttgaacaagcaggtaggggggcttgataacttaactttccacgtgga

SEQ ID NO: 34953 - DNA, 1577 bp, Homo sapiens
aagagttgctgacaccttctctgtcccgctggaagttattttctcctccctctccctgtacagctgaccttccttccctgctgcagggccagggggtctgttccaggactggattctcccatcaggagcctctggactggtcgccgagggtcagacggcccctccctctcttgctgtcatccctggctcttcaagctaatgagacctgtcctgattcctcagccaggccccctgacttgggcctcagtgtccccgaagatcatgatggcgtatatgaacccggggccccactattctgtcaacgccttggccctaagtggccccagtgtggatctgatgcaccaggctgtgccctacccaagcgcccccaggaagcagcggcgggagcgcaccaccttcacccggagccaactggaggagctggaggcactgtttgccaagacccagtacccagacgtctatgcccgtgaggaggtggctctgaagatcaatctgcctgagtccagggttcaggtttggttcaagaaccggagggctaaatgcaggcagcagcgacagcagcagaaacagcagcagcagcccccagggggccaggccaaggcccggcctgccaagaggaaggcgggcacgtccccaagaccctccacagatgtgtgtccagaccctctgggcatctcagattcctacagtccccctctgcccggcccctcaggctccccaaccacggcagtggccactgtgtccatctggagcccagcctcagagtcccctttgcctgaggcgcagcgggctgggctggtggcctcagggccgtctctgacctccgccccctatgccatgacctacgccccggcctccgctttctgctcttccccctccgcctatgggtctccgagctcctatttcagcggcctagacccctacctttctcccatggtgccccagctagggggcccggctcttagccccctctctggcccctccgtgggaccttccctggcccagtcccccacctccctatcaggccagagctatggcgcctacagccccgtggatagcttggaattcaaggaccccacgggcacctggaaattcacctacaatcccatggaccctctggactacaaggatcagagtgcctggaagtttcagatcttgtagaggacgcagtctccatctctctccatcgggcctcgggaccctttctcttctgaatctgcttccctgcagtttagatcccgggatggcattcctgagaaagcaacccgaaccagctgtccttctgacagctcggtgttcagcttacagagaccacccctttcctccacagggagaggctcctccctctcctgggacagctcacaggtcctagtgattctctcaaccctaacaccgtctggcacgattgtgaccgctgaagtacaccacgagctccaggcttcagaaagtggtgctgagaacttgctccaagaagtcaaaccaaacttgcagttgatttggggtcatgtttaggtcagaatcaccgtgcccttgaacaagcaggtaggggggcttgataacttaactttccacgtgga

SEQ ID NO: 34954 - DNA, 3995 bp, Homo sapiens
gtttttttccagatttataatttaatggctgtgcagatcccagtccctcatttctgtcgctcacgtgcccactggtctggggtcagggttttctgttcaaaggcatggatgtgcgggagctcttctgctaggcacgcgttcaccagcctgtgtctctgaagcagcggtttcccctcgaacttggccgacaccaccaggactcggaagctacaggagcaacggttgagggtcgtgtcctccacctccacatgctccgcctccaggtcccgctgcagcttctcgcggaggtattcggcgctgagttccatggcggcagtccagctggaacggcagcccagtccagccttgccccggcgccctgacctgacgccctggcctgacgccctgcttcgtcgcctcctttctctcccaggtgctggaccagggactgagcgtcccccggagagggtccggtgtgaccccgacaagaagcagaaatggggaagaaactggatctttccaagctcactgatgaagaggcccagcatgtcttggaagttgttcaacgagattttgacctccgaaggaaagaagaggaacggctagaggcgttgaagggcaagattaagaaggaaagctccaagagggagctgctttccgacactgcccatctgaacgagacccactgcgcccgctgcctgcagccctaccagctgcttgtgaatagcaaaaggcagtgcctggaatgtggcctcttcacctgcaaaagctgtggccgcgtccacccggaggagcagggctggatctgtgacccctgccatctggccagagtcgtgaagatcggctcactggagtggtactatgagcatgtgaaagcccgcttcaagaggttcggaagtgccaaggtcatccggtccctccacgggcggctgcagggtggagctgggcctgaactgatatctgaagagagaagtggagacagcgaccagacagatgaggatggagaacctggctcagaggcccaggcccaggcccagccctttggcagcaaaaaaaagcgcctcctctccgtccacgacttcgacttcgagggagactcagatgactccactcagcctcaaggtcactccctgcacctgtcctcagtccctgaggccagggacagcccacagtccctcacagatgagtcctgctcagagaaggcagcccctcacaaggctgagggcctggaggaggctgatactggggcctctgggtgccactcccatccggaagagcagccgaccagcatctcaccttccagacacggcgccctggctgagctctgcccgcctggaggctcccacaggatggccctggggactgctgctgcactcgggtcgaatgtcatcaggaatgagcagctgcccctgcagtacttggccgatgtggacacctctgatgaggaaagcatccgggctcacgtgatggcctcccaccattccaagcggagaggccgggcgtcttctgagagtcagatctttgagctgaataagcatatttcagctgtggaatgcctgctgacctacctggagaacacagttgtgcctcccttggccaagggtctaggtgctggagtgcgcacggaggccgatgtagaggaggaggccctgaggaggaagctggaggagctgaccagcaacgtcagtgaccaggagacctcgtccgaggaggaggaagccaaggacgaaaaggcagagcccaacagggacaaatcagttgggcctctcccccaggcggacccggaggtgggcacggctgcccatcaaaccaacagacaggaaaaaagcccccaggaccctggggaccccgtccagtacaacaggaccacagatgaggagctgtcagagctggaggacagagtggcagtgacggcctcagaagtccagcaggcagagagcgaggtttcagacattgaatccaggattgcagccctgagggccgcagggctcacggtgaagccctcgggaaagccccggaggaagtcaaacctcccgatatttctccctcgagtggctgggaaacttggcaagagaccagaggacccaaatgcagacccttcaagtgaggccaaggcaatggctgtgccctatcttctgagaagaaagttcagtaattccctgaaaagtcaaggtaaagatgatgattcttttgatcggaaatcagtgtaccgaggctcgctgacacagagaaaccccaacgcgaggaaaggaatggccagccacaccttcgcgaaacctgtggtggcccaccagtcctaacgggacaggacagagagacagagcagccctgcactgttttccctccaccacagccatcctgtccctcattggctctgtgctttccactatacacagtcaccgtcccaatgagaaacaagaaggagcaccctccacatggactcccacctgcaagtggacagcgacattcagtcctgcactgctcacctgggtttactgatgactcctggctgccccaccatcctctctgatctgtgagaaacagctaagctgctgtgacttccctttaggacaatgttgtgtaaatctttgaaggacacaccgaagacctttatactgtgatcttttacccctttcactcttggctttcttatgttgctttcatgaatggaatggaaaaaagatgactcagttaaggcaccagccatatgtgtattcttgatggtctatatcggggtgtgagcagatgtttgcgtatttcttgtgggtgtgactggatattagacatccggacaagtgactgaactaatgatctgctgaataatgaaggaggaatagacaccccagtccccaccctacgtgcacccgctctgcaagttcccatgtgatctgtagaccaggggaaattacactgcggtcaagggcagagcctgcacatgacagcaagtgagcatttgatagatgctcagatgctagtgcagagagcctgctgggagacgaagagacagcaggcagagctccagatgggcaaggaagaggcttggttctagcctggctctgcccctcactgcagtggatccagtggggcagaggacagagggtcacaaccaatgagggatgtctgccaaggatgggggtgcagaggccacaggagtcagcttgccactcgcccattggttacatagatgatctctcagacaggctgggactcagagttatttcctagtatcggtgtgccccatccagttttaagtggagccctccaagactctccagagctgcctttgaacatcctaacagtaatcacatctcaccctccctgaggttcactttagacaggacccaatggctgcactgcctttgtcagagggggtgctgagaggagtggcttcttttagaatcaaacagtagagacaagagtcaagccttgtgtcttcaagcattgaccaagttaagtgtttccttccctctctcaataagacacttccaggagctttccaatctctcacttaaaactaaggtttgaatctcaaagtgttgctgggaggctgatactcctgcaacttcaggagacctgtgagcacacattagcagctgtttctctgactccttgtggcatcagataaaaacgtgggagtttttccatataattcccagccttacttataaattctattctttgaaaaaattattcaggctaggtaaggtggctcatacctataatcccagccctttgagaggccaaggtgggagaattgcttgaggccaggagtttgagacctcctgggcaacatagtgagatcccatctctacaaaaaacaaaacaaaaaaattacccaagcatgatggtatatgcctgtagtcgtacctacttacttaggaggctgaggcaggaggatcacttgagccctggaggttggggctgcagtgagccatgatcgcatcactatactcgagcctgggcaacagagtgagaccttgtctcttaaaaaaattaataataaataaatgaaaata

SEQ ID NO: 34955 - DNA, 3646 bp, Homo sapiens
agttgcccgcctgccccggagagccaggcgctaaccagccgctctgcgccccgcgccctgcttgcccccattatccagccttgccccggcgccctgacctgacgccctggcctgacgccctgcttcgtcgcctcctttctctcccaggtgctggaccagggactgagcgtcccccggagagggtccggtgtgaccccgacaagaagcagaaatggggaagaaactggatctttccaagctcactgatgaagaggcccagcatgtcttggaagttgttcaacgagattttgacctccgaaggaaagaagaggaacggctagaggcgttgaagggcaagattaagaaggaaagctccaagagggagctgctttccgacactgcccatctgaacgagacccactgcgcccgctgcctgcagccctaccagctgcttgtgaatagcaaaaggcagtgcctggaatgtggcctcttcacctgcaaaagctgtggccgcgtccacccggaggagcagggctggatctgtgacccctgccatctggccagagtcgtgaagatcggctcactggagtggtactatgagcatgtgaaagcccgcttcaagaggttcggaagtgccaaggtcatccggtccctccacgggcggctgcagggtggagctgggcctgaactgatatctgaagagagaagtggagacagcgaccagacagatgaggatggagaacctggctcagaggcccaggcccaggcccagccctttggcagcaaaaaaaagcgcctcctctccgtccacgacttcgacttcgagggagactcagatgactccactcagcctcaaggtcactccctgcacctgtcctcagtccctgaggccagggacagcccacagtccctcacagatgagtcctgctcagagaaggcagcccctcacaaggctgagggcctggaggaggctgatactggggcctctgggtgccactcccatccggaagagcagccgaccagcatctcaccttccagacacggcgccctggctgagctctgcccgcctggaggctcccacaggatggccctggggactgctgctgcactcgggtcgaatgtcatcaggaatgagcagctgcccctgcagtacttggccgatgtggacacctctgatgaggaaagcatccgggctcacgtgatggcctcccaccattccaagcggagaggccgggcgtcttctgagagtcagggtctaggtgctggagtgcgcacggaggccgatgtagaggaggaggccctgaggaggaagctggaggagctgaccagcaacgtcagtgaccaggagacctcgtccgaggaggaggaagccaaggacgaaaaggcagagcccaacagggacaaatcagttgggcctctcccccaggcggacccggaggtgggcacggctgcccatcaaaccaacagacaggaaaaaagcccccaggaccctggggaccccgtccagtacaacaggaccacagatgaggagctgtcagagctggaggacagagtggcagtgacggcctcagaagtccagcaggcagagagcgaggtttcagacattgaatccaggattgcagccctgagggccgcagggctcacggtgaagccctcgggaaagccccggaggaagtcaaacctcccgatatttctccctcgagtggctgggaaacttggcaagagaccagaggacccaaatgcagacccttcaagtgaggccaaggcaatggctgtgccctatcttctgagaagaaagttcagtaattccctgaaaagtcaaggtaaagatgatgattcttttgatcggaaatcagtgtaccgaggctcgctgacacagagaaaccccaacgcgaggaaaggaatggccagccacaccttcgcgaaacctgtggtggcccaccagtcctaacgggacaggacagagagacagagcagccctgcactgttttccctccaccacagccatcctgtccctcattggctctgtgctttccactatacacagtcaccgtcccaatgagaaacaagaaggagcaccctccacatggactcccacctgcaagtggacagcgacattcagtcctgcactgctcacctgggtttactgatgactcctggctgccccaccatcctctctgatctgtgagaaacagctaagctgctgtgacttccctttaggacaatgttgtgtaaatctttgaaggacacaccgaagacctttatactgtgatcttttacccctttcactcttggctttcttatgttgctttcatgaatggaatggaaaaaagatgactcagttaaggcaccagccatatgtgtattcttgatggtctatatcggggtgtgagcagatgtttgcgtatttcttgtgggtgtgactggatattagacatccggacaagtgactgaactaatgatctgctgaataatgaaggaggaatagacaccccagtccccaccctacgtgcacccgctctgcaagttcccatgtgatctgtagaccaggggaaattacactgcggtcaagggcagagcctgcacatgacagcaagtgagcatttgatagatgctcagatgctagtgcagagagcctgctgggagacgaagagacagcaggcagagctccagatgggcaaggaagaggcttggttctagcctggctctgcccctcactgcagtggatccagtggggcagaggacagagggtcacaaccaatgagggatgtctgccaaggatgggggtgcagaggccacaggagtcagcttgccactcgcccattggttacatagatgatctctcagacaggctgggactcagagttatttcctagtatcggtgtgccccatccagttttaagtggagccctccaagactctccagagctgcctttgaacatcctaacagtaatcacatctcaccctccctgaggttcactttagacaggacccaatggctgcactgcctttgtcagagggggtgctgagaggagtggcttcttttagaatcaaacagtagagacaagagtcaagccttgtgtcttcaagcattgaccaagttaagtgtttccttccctctctcaataagacacttccaggagctttccaatctctcacttaaaactaaggtttgaatctcaaagtgttgctgggaggctgatactcctgcaacttcaggagacctgtgagcacacattagcagctgtttctctgactccttgtggcatcagataaaaacgtgggagtttttccatataattcccagccttacttataaattctattctttgaaaaaattattcaggctaggtaaggtggctcatacctataatcccagccctttgagaggccaaggtgggagaattgcttgaggccaggagtttgagacctcctgggcaacatagtgagatcccatctctacaaaaaacaaaacaaaaaaattacccaagcatgatggtatatgcctgtagtcgtacctacttacttaggaggctgaggcaggaggatcacttgagccctggaggttggggctgcagtgagccatgatcgcatcactatactcgagcctgggcaacagagtgagaccttgtctcttaaaaaaattaataataaataaatgaaaata

SEQ ID NO: 34956 - DNA, 515 bp, Homo sapiens
gcatttttacagaagcgataggggaaaggaagcaatcagctatgcaggtgagcctcagggggatgactgtgaatagaatgggaggcagctttgccctaagcagttcccagcttgactttttcctttagcttggtgattgtggagtctcaagatttgttttcttttcacaatctgaaattcaaagttccctgggtatcctgtattttcatttgcacactttggcgccctagtcccagagtcctggagcggcatactgggggtggctgtgcagtcccagcatccccaacccagcatgtatagagagcatccatccttacatccagctgacccatgcccatgctcctccctgtggctggaggttcaacaataacataagtctcttctttgccctccagatatttctccctcgagtggctgggaaacttggcaagagaccagaggacccaaatgcagacccttcaagtgaggccaaggtatgtgttactccattcaagccccagacacccgacaaaggt

SEQ ID NO: 34957 - DNA, 490 bp, Homo sapiens
catctcatagctgattcctgaggataaaactaatgctatgaaccacgtaccttttaaaatgcgtattcccggagttaaaaacaattcacttaaattcattaaactacacaagtttccagacaagcattagaaaaccatttaacccaagtacagacagatgtcctgagaagtcagcagcgttctgtgttgtctcttactctgtgacttgattggtattggtaggcttctgggactgatgacttgtgatcctgtgacattccaggtgtgaccccgacaagaagcagaaatggggaagaaactggatctttccaagctcactgatgaagaggcccagcatgtcttggaagttgttcaacgagattttgacctccgaaggaaagaagaggaacggctagagtgagtgtgccgtgctgagcccacggagcccggggtccctgatcttcccccagggccatcatatgggtgctgtatgggtgggtcaacagccacg

SEQ ID NO: 34958 - DNA, 468 bp, Homo sapiens
cagtggtaagggggagtgctgggatttaaaccagacctgcagggcagaaacttgtactctttctgccataccacccaaatgtggcagcttccccaaagctgagcatctcttatttcaggcatttcatgcttaatttattgaaaatgtccattctcatattgctaaaagttcaaatattgctagagagcagaaaatagtggccatggttaattagaagctggaagaacaataagaaatccaaaattagttgacaattcctaaacgtcacaacttgatgaagcctgggtgacagagcaagactttgtctcaaaaaaaaaaaaaagaaagaacaaaaaagaaaagaaagtcaaggaaatgcgaagaccacacaccagtgcagtgtgatgggcctttctgctgcttcattagtgtgaggatttccagggccacagcactccagcctgggtgacagagcaagactttgtctca

SEQ ID NO: 34959 - DNA, 3745 bp, Homo sapiens
cgctagtagaggcggggtgaatcggacgaggcggagagccaggcgctaaccagccgctctgcgccccgcgccctgcttgcccccattatccagccttgccccggcgccctgacctgacgccctggcctgacgccctgcttcgtcgcctcctttctctcccaggtgctggaccagggactgagcgtcccccggagagggtccggtgtgaccccgacaagaagcagaaatggggaagaaactggatctttccaagctcactgatgaagaggcccagcatgtcttggaagttgttcaacgagattttgacctccgaaggaaagaagaggaacggctagaggcgttgaagggcaagattaagaaggaaagctccaagagggagctgctttccgacactgcccatctgaacgagacccactgcgcccgctgcctgcagccctaccagctgcttgtgaatagcaaaaggcagtgcctggaatgtggcctcttcacctgcaaaagctgtggccgcgtccacccggaggagcagggctggatctgtgacccctgccatctggccagagtcgtgaagatcggctcactggagtggtactatgagcatgtgaaagcccgcttcaagaggttcggaagtgccaaggtcatccggtccctccacgggcggctgcagggtggagctgggcctgaactgatatctgaagagagaagtggagacagcgaccagacagatgaggatggagaacctggctcagaggcccaggcccaggcccagccctttggcagcaaaaaaaagcgcctcctctccgtccacgacttcgacttcgagggagactcagatgactccactcagcctcaaggtcactccctgcacctgtcctcagtccctgaggccagggacagcccacagtccctcacagatgagtcctgctcagagaaggcagcccctcacaaggctgagggcctggaggaggctgatactggggcctctgggtgccactcccatccggaagagcagccgaccagcatctcaccttccagacacggcgccctggctgagctctgcccgcctggaggctcccacaggatggccctggggactgctgctgcactcgggtcgaatgtcatcaggaatgagcagctgcccctgcagtacttggccgatgtggacacctctgatgaggaaagcatccgggctcacgtgatggcctcccaccattccaagcggagaggccgggcgtcttctgagagtcagatctttgagctgaataagcatatttcagctgtggaatgcctgctgacctacctggagaacacagttgtgcctcccttggccaagggtctaggtgctggagtgcgcacggaggccgatgtagaggaggaggccctgaggaggaagctggaggagctgaccagcaacgtcagtgaccaggagacctcgtccgaggaggaggaagccaaggacgaaaaggcagagcccaacagggacaaatcagttgggcctctcccccaggcggacccggaggtgggcacggctgcccatcaaaccaacagacaggaaaaaagcccccaggaccctggggaccccgtccagtacaacaggaccacagatgaggagctgtcagagctggaggacagagtggcagtgacggcctcagaagtccagcaggcagagagcgaggtttcagacattgaatccaggattgcagccctgagggccgcagggctcacggtgaagccctcgggaaagccccggaggaagtcaaacctcccgatatttctccctcgagtggctgggaaacttggcaagagaccagaggacccaaatgcagacccttcaagtgaggccaaggcaatggctgtgccctatcttctgagaagaaagttcagtaattccctgaaaagtcaaggtaaagatgatgattcttttgatcggaaatcagtgtaccgaggctcgctgacacagagaaaccccaacgcgaggaaaggaatggccagccacaccttcgcgaaacctgtggtggcccaccagtcctaacgggacaggacagagagacagagcagccctgcactgttttccctccaccacagccatcctgtccctcattggctctgtgctttccactatacacagtcaccgtcccaatgagaaacaagaaggagcaccctccacatggactcccacctgcaagtggacagcgacattcagtcctgcactgctcacctgggtttactgatgactcctggctgccccaccatcctctctgatctgtgagaaacagctaagctgctgtgacttccctttaggacaatgttgtgtaaatctttgaaggacacaccgaagacctttatactgtgatcttttacccctttcactcttggctttcttatgttgctttcatgaatggaatggaaaaaagatgactcagttaaggcaccagccatatgtgtattcttgatggtctatatcggggtgtgagcagatgtttgcgtatttcttgtgggtgtgactggatattagacatccggacaagtgactgaactaatgatctgctgaataatgaaggaggaatagacaccccagtccccaccctacgtgcacccgctctgcaagttcccatgtgatctgtagaccaggggaaattacactgcggtcaagggcagagcctgcacatgacagcaagtgagcatttgatagatgctcagatgctagtgcagagagcctgctgggagacgaagagacagcaggcagagctccagatgggcaaggaagaggcttggttctagcctggctctgcccctcactgcagtggatccagtggggcagaggacagagggtcacaaccaatgagggatgtctgccaaggatgggggtgcagaggccacaggagtcagcttgccactcgcccattggttacatagatgatctctcagacaggctgggactcagagttatttcctagtatcggtgtgccccatccagttttaagtggagccctccaagactctccagagctgcctttgaacatcctaacagtaatcacatctcaccctccctgaggttcactttagacaggacccaatggctgcactgcctttgtcagagggggtgctgagaggagtggcttcttttagaatcaaacagtagagacaagagtcaagccttgtgtcttcaagcattgaccaagttaagtgtttccttccctctctcaataagacacttccaggagctttccaatctctcacttaaaactaaggtttgaatctcaaagtgttgctgggaggctgatactcctgcaacttcaggagacctgtgagcacacattagcagctgtttctctgactccttgtggcatcagataaaaacgtgggagtttttccatataattcccagccttacttataaattctattctttgaaaaaattattcaggctaggtaaggtggctcatacctataatcccagccctttgagaggccaaggtgggagaattgcttgaggccaggagtttgagacctcctgggcaacatagtgagatcccatctctacaaaaaacaaaacaaaaaaattacccaagcatgatggtatatgcctgtagtcgtacctacttacttaggaggctgaggcaggaggatcacttgagccctggaggttggggctgcagtgagccatgatcgcatcactatactcgagcctgggcaacagagtgagaccttgtctcttaaaaaaattaataataaataaatgaaaata

SEQ ID NO: 34960 - DNA, 3730 bp, Homo sapiens
agttgcccgcctgccccggagagccaggcgctaaccagccgctctgcgccccgcgccctgcttgcccccattatccagccttgccccggcgccctgacctgacgccctggcctgacgccctgcttcgtcgcctcctttctctcccaggtgctggaccagggactgagcgtcccccggagagggtccggtgtgaccccgacaagaagcagaaatggggaagaaactggatctttccaagctcactgatgaagaggcccagcatgtcttggaagttgttcaacgagattttgacctccgaaggaaagaagaggaacggctagaggcgttgaagggcaagattaagaaggaaagctccaagagggagctgctttccgacactgcccatctgaacgagacccactgcgcccgctgcctgcagccctaccagctgcttgtgaatagcaaaaggcagtgcctggaatgtggcctcttcacctgcaaaagctgtggccgcgtccacccggaggagcagggctggatctgtgacccctgccatctggccagagtcgtgaagatcggctcactggagtggtactatgagcatgtgaaagcccgcttcaagaggttcggaagtgccaaggtcatccggtccctccacgggcggctgcagggtggagctgggcctgaactgatatctgaagagagaagtggagacagcgaccagacagatgaggatggagaacctggctcagaggcccaggcccaggcccagccctttggcagcaaaaaaaagcgcctcctctccgtccacgacttcgacttcgagggagactcagatgactccactcagcctcaaggtcactccctgcacctgtcctcagtccctgaggccagggacagcccacagtccctcacagatgagtcctgctcagagaaggcagcccctcacaaggctgagggcctggaggaggctgatactggggcctctgggtgccactcccatccggaagagcagccgaccagcatctcaccttccagacacggcgccctggctgagctctgcccgcctggaggctcccacaggatggccctggggactgctgctgcactcgggtcgaatgtcatcaggaatgagcagctgcccctgcagtacttggccgatgtggacacctctgatgaggaaagcatccgggctcacgtgatggcctcccaccattccaagcggagaggccgggcgtcttctgagagtcagatctttgagctgaataagcatatttcagctgtggaatgcctgctgacctacctggagaacacagttgtgcctcccttggccaagggtctaggtgctggagtgcgcacggaggccgatgtagaggaggaggccctgaggaggaagctggaggagctgaccagcaacgtcagtgaccaggagacctcgtccgaggaggaggaagccaaggacgaaaaggcagagcccaacagggacaaatcagttgggcctctcccccaggcggacccggaggtgggcacggctgcccatcaaaccaacagacaggaaaaaagcccccaggaccctggggaccccgtccagtacaacaggaccacagatgaggagctgtcagagctggaggacagagtggcagtgacggcctcagaagtccagcaggcagagagcgaggtttcagacattgaatccaggattgcagccctgagggccgcagggctcacggtgaagccctcgggaaagccccggaggaagtcaaacctcccgatatttctccctcgagtggctgggaaacttggcaagagaccagaggacccaaatgcagacccttcaagtgaggccaaggcaatggctgtgccctatcttctgagaagaaagttcagtaattccctgaaaagtcaaggtaaagatgatgattcttttgatcggaaatcagtgtaccgaggctcgctgacacagagaaaccccaacgcgaggaaaggaatggccagccacaccttcgcgaaacctgtggtggcccaccagtcctaacgggacaggacagagagacagagcagccctgcactgttttccctccaccacagccatcctgtccctcattggctctgtgctttccactatacacagtcaccgtcccaatgagaaacaagaaggagcaccctccacatggactcccacctgcaagtggacagcgacattcagtcctgcactgctcacctgggtttactgatgactcctggctgccccaccatcctctctgatctgtgagaaacagctaagctgctgtgacttccctttaggacaatgttgtgtaaatctttgaaggacacaccgaagacctttatactgtgatcttttacccctttcactcttggctttcttatgttgctttcatgaatggaatggaaaaaagatgactcagttaaggcaccagccatatgtgtattcttgatggtctatatcggggtgtgagcagatgtttgcgtatttcttgtgggtgtgactggatattagacatccggacaagtgactgaactaatgatctgctgaataatgaaggaggaatagacaccccagtccccaccctacgtgcacccgctctgcaagttcccatgtgatctgtagaccaggggaaattacactgcggtcaagggcagagcctgcacatgacagcaagtgagcatttgatagatgctcagatgctagtgcagagagcctgctgggagacgaagagacagcaggcagagctccagatgggcaaggaagaggcttggttctagcctggctctgcccctcactgcagtggatccagtggggcagaggacagagggtcacaaccaatgagggatgtctgccaaggatgggggtgcagaggccacaggagtcagcttgccactcgcccattggttacatagatgatctctcagacaggctgggactcagagttatttcctagtatcggtgtgccccatccagttttaagtggagccctccaagactctccagagctgcctttgaacatcctaacagtaatcacatctcaccctccctgaggttcactttagacaggacccaatggctgcactgcctttgtcagagggggtgctgagaggagtggcttcttttagaatcaaacagtagagacaagagtcaagccttgtgtcttcaagcattgaccaagttaagtgtttccttccctctctcaataagacacttccaggagctttccaatctctcacttaaaactaaggtttgaatctcaaagtgttgctgggaggctgatactcctgcaacttcaggagacctgtgagcacacattagcagctgtttctctgactccttgtggcatcagataaaaacgtgggagtttttccatataattcccagccttacttataaattctattctttgaaaaaattattcaggctaggtaaggtggctcatacctataatcccagccctttgagaggccaaggtgggagaattgcttgaggccaggagtttgagacctcctgggcaacatagtgagatcccatctctacaaaaaacaaaacaaaaaaattacccaagcatgatggtatatgcctgtagtcgtacctacttacttaggaggctgaggcaggaggatcacttgagccctggaggttggggctgcagtgagccatgatcgcatcactatactcgagcctgggcaacagagtgagaccttgtctcttaaaaaaattaataataaataaatgaaaata

SEQ ID NO: 34961 - DNA, 3464 bp, Homo sapiens
  misc_feature (26)..(26): n is a, c, g, or t
tatcacaggacttatgcgatggaatngactccgaaggaaagaagagaacggtagaggcgttgaagggcaagattaagaaggaaagctccaagagggagctgctttccgacactgcccatctgaacgagacccactgcgcccgctgcctgcagccctaccagctgcttgtgaatagcaaaaggcagtgcctggaatgtggcctcttcacctgcaaaagctgtggccgcgtccacccggaggagcagggctggatctgtgacccctgccatctggccagagtcgtgaagatcggctcactggagtggtactatgagcatgtgaaagcccgcttcaagaggttcggaagtgccaaggtcatccggtccctccacgggcggctgcagggtggagctgggcctgaactgatatctgaagagagaagtggagacagcgaccagacagatgaggatggagaacctggctcagaggcccaggcccaggcccagccctttggcagcaaaaaaaagcgcctcctctccgtccacgacttcgacttcgagggagactcagatgactccactcagcctcaaggtcactccctgcacctgtcctcagtccctgaggccagggacagcccacagtccctcacagatgagtcctgctcagagaaggcagcccctcacaaggctgagggcctggaggaggctgatactggggcctctgggtgccactcccatccggaagagcagccgaccagcatctcaccttccagacacggcgccctggctgagctctgcccgcctggaggctcccacaggatggccctggggactgctgctgcactcgggtcgaatgtcatcaggaatgagcagctgcccctgcagtacttggccgatgtggacacctctgatgaggaaagcatccgggctcacgtgatggcctcccaccattccaagcggagaggccgggcgtcttctgagagtcagatctttgagctgaataagcatatttcagctgtggaatgcctgctgacctacctggagaacacagttgtgcctcccttggccaagggtctaggtgctggagtgcgcacggaggccgatgtagaggaggaggccctgaggaggaagctggaggagctgaccagcaacgtcagtgaccaggagacctcgtccgaggaggaggaagccaaggacgaaaaggcagagcccaacagggacaaatcagttgggcctctcccccaggcggacccggaggtgggcacggctgcccatcaaaccaacagacaggaaaaaagcccccaggaccctggggaccccgtccagtacaacaggaccacagatgaggagctgtcagagctggaggacagagtggcagtgacggcctcagaagtccagcaggcagagagcgaggtttcagacattgaatccaggattgcagccctgagggccgcagggctcacggtgaagccctcgggaaagccccggaggaagtcaaacctcccgatatttctccctcgagtggctgggaaacttggcaagagaccagaggacccaaatgcagacccttcaagtgaggccaaggcaatggctgtgccctatcttctgagaagaaagttcagtaattccctgaaaagtcaaggtaaagatgatgattcttttgatcggaaatcagtgtaccgaggctcgctgacacagagaaaccccaacgcgaggaaaggaatggccagccacaccttcgcgaaacctgtggtggcccaccagtcctaacgggacaggacagagagacagagcagccctgcactgttttccctccaccacagccatcctgtccctcattggctctgtgctttccactatacacagtcaccgtcccaatgagaaacaagaaggagcaccctccacatggactcccacctgcaagtggacagcgacattcagtcctgcactgctcacctgggtttactgatgactcctggctgccccaccatcctctctgatctgtgagaaacagctaagctgctgtgacttccctttaggacaatgttgtgtaaatctttgaaggacacaccgaagacctttatactgtgatcttttacccctttcactcttggctttcttatgttgctttcatgaatggaatggaaaaaagatgactcagttaaggcaccagccatatgtgtattcttgatggtctatatcggggtgtgagcagatgtttgcgtatttcttgtgggtgtgactggatattagacatccggacaagtgactgaactaatgatctgctgaataatgaaggaggaatagacaccccagtccccaccctacgtgcacccgctctgcaagttcccatgtgatctgtagaccaggggaaattacactgcggtcaagggcagagcctgcacatgacagcaagtgagcatttgatagatgctcagatgctagtgcagagagcctgctgggagacgaagagacagcaggcagagctccagatgggcaaggaagaggcttggttctagcctggctctgcccctcactgcagtggatccagtggggcagaggacagagggtcacaaccaatgagggatgtctgccaaggatgggggtgcagaggccacaggagtcagcttgccactcgcccattggttacatagatgatctctcagacaggctgggactcagagttatttcctagtatcggtgtgccccatccagttttaagtggagccctccaagactctccagagctgcctttgaacatcctaacagtaatcacatctcaccctccctgaggttcactttagacaggacccaatggctgcactgcctttgtcagagggggtgctgagaggagtggcttcttttagaatcaaacagtagagacaagagtcaagccttgtgtcttcaagcattgaccaagttaagtgtttccttccctctctcaataagacacttccaggagctttccaatctctcacttaaaactaaggtttgaatctcaaagtgttgctgggaggctgatactcctgcaacttcaggagacctgtgagcacacattagcagctgtttctctgactccttgtggcatcagataaaaacgtgggagtttttccatataattcccagccttacttataaattctattctttgaaaaaattattcaggctaggtaaggtggctcatacctataatcccagccctttgagaggccaaggtgggagaattgcttgaggccaggagtttgagacctcctgggcaacatagtgagatcccatctctacaaaaaacaaaacaaaaaaattacccaagcatgatggtatatgcctgtagtcgtacctacttacttaggaggctgaggcaggaggatcacttgagccctggaggttggggctgcagtgagccatgatcgcatcactatactcgagcctgggcaacagagtgagaccttgtctcttaaaaaaattaataataaataaatgaaaata

SEQ ID NO: 34962 - DNA, 3625 bp, Homo sapiens
cgctagtagaggcggggtgaatcggacgaggcggagagccaggcgctaaccagccgctctgcgccccgcgccctgcttgcccccattatccagccttgccccggcgccctgacctgacgccctggcctgacgccctgcttcgtcgcctcctttctctcccaggtgctggaccagggactgagcgtcccccggagagggtccggtgtgaccccgacaagaagcagaaatggggaagaaactggatctttccaagctcactgatgaagaggcccagcatgtcttggaagttgttcaacgagattttgacctccgaaggaaagaagaggaacggctagaggcgttgaagggcaagattaagaaggaaagctccaagagggagctgctttccgacactgcccatctgaacgagacccactgcgcccgctgcctgcagccctaccagctgcttgtgaatagcaaaaggcagtgcctggaatgtggcctcttcacctgcaaaagctgtggccgcgtccacccggaggagcagggctggatctgtgacccctgccatctggccagagtcgtgaagatcggctcactggagtggtactatgagcatgtgaaagcccgcttcaagaggttcggaagtgccaaggtcatccggtccctccacgggcggctgcagggtggagctgggcctgaactgatatctgaagagagaagtggagacagcgaccagacagatgaggatggagaacctggctcagaggcccaggcccaggcccagccctttggcagcaaatccctcacagatgagtcctgctcagagaaggcagcccctcacaaggctgagggcctggaggaggctgatactggggcctctgggtgccactcccatccggaagagcagccgaccagcatctcaccttccagacacggcgccctggctgagctctgcccgcctggaggctcccacaggatggccctggggactgctgctgcactcgggtcgaatgtcatcaggaatgagcagctgcccctgcagtacttggccgatgtggacacctctgatgaggaaagcatccgggctcacgtgatggcctcccaccattccaagcggagaggccgggcgtcttctgagagtcagatctttgagctgaataagcatatttcagctgtggaatgcctgctgacctacctggagaacacagttgtgcctcccttggccaagggtctaggtgctggagtgcgcacggaggccgatgtagaggaggaggccctgaggaggaagctggaggagctgaccagcaacgtcagtgaccaggagacctcgtccgaggaggaggaagccaaggacgaaaaggcagagcccaacagggacaaatcagttgggcctctcccccaggcggacccggaggtgggcacggctgcccatcaaaccaacagacaggaaaaaagcccccaggaccctggggaccccgtccagtacaacaggaccacagatgaggagctgtcagagctggaggacagagtggcagtgacggcctcagaagtccagcaggcagagagcgaggtttcagacattgaatccaggattgcagccctgagggccgcagggctcacggtgaagccctcgggaaagccccggaggaagtcaaacctcccgatatttctccctcgagtggctgggaaacttggcaagagaccagaggacccaaatgcagacccttcaagtgaggccaaggcaatggctgtgccctatcttctgagaagaaagttcagtaattccctgaaaagtcaaggtaaagatgatgattcttttgatcggaaatcagtgtaccgaggctcgctgacacagagaaaccccaacgcgaggaaaggaatggccagccacaccttcgcgaaacctgtggtggcccaccagtcctaacgggacaggacagagagacagagcagccctgcactgttttccctccaccacagccatcctgtccctcattggctctgtgctttccactatacacagtcaccgtcccaatgagaaacaagaaggagcaccctccacatggactcccacctgcaagtggacagcgacattcagtcctgcactgctcacctgggtttactgatgactcctggctgccccaccatcctctctgatctgtgagaaacagctaagctgctgtgacttccctttaggacaatgttgtgtaaatctttgaaggacacaccgaagacctttatactgtgatcttttacccctttcactcttggctttcttatgttgctttcatgaatggaatggaaaaaagatgactcagttaaggcaccagccatatgtgtattcttgatggtctatatcggggtgtgagcagatgtttgcgtatttcttgtgggtgtgactggatattagacatccggacaagtgactgaactaatgatctgctgaataatgaaggaggaatagacaccccagtccccaccctacgtgcacccgctctgcaagttcccatgtgatctgtagaccaggggaaattacactgcggtcaagggcagagcctgcacatgacagcaagtgagcatttgatagatgctcagatgctagtgcagagagcctgctgggagacgaagagacagcaggcagagctccagatgggcaaggaagaggcttggttctagcctggctctgcccctcactgcagtggatccagtggggcagaggacagagggtcacaaccaatgagggatgtctgccaaggatgggggtgcagaggccacaggagtcagcttgccactcgcccattggttacatagatgatctctcagacaggctgggactcagagttatttcctagtatcggtgtgccccatccagttttaagtggagccctccaagactctccagagctgcctttgaacatcctaacagtaatcacatctcaccctccctgaggttcactttagacaggacccaatggctgcactgcctttgtcagagggggtgctgagaggagtggcttcttttagaatcaaacagtagagacaagagtcaagccttgtgtcttcaagcattgaccaagttaagtgtttccttccctctctcaataagacacttccaggagctttccaatctctcacttaaaactaaggtttgaatctcaaagtgttgctgggaggctgatactcctgcaacttcaggagacctgtgagcacacattagcagctgtttctctgactccttgtggcatcagataaaaacgtgggagtttttccatataattcccagccttacttataaattctattctttgaaaaaattattcaggctaggtaaggtggctcatacctataatcccagccctttgagaggccaaggtgggagaattgcttgaggccaggagtttgagacctcctgggcaacatagtgagatcccatctctacaaaaaacaaaacaaaaaaattacccaagcatgatggtatatgcctgtagtcgtacctacttacttaggaggctgaggcaggaggatcacttgagccctggaggttggggctgcagtgagccatgatcgcatcactatactcgagcctgggcaacagagtgagaccttgtctcttaaaaaaattaataataaataaatgaaaata

SEQ ID NO: 34963 - DNA, 3541 bp, Homo sapiens
cgctagtagaggcggggtgaatcggacgaggcggagagccaggcgctaaccagccgctctgcgccccgcgccctgcttgcccccattatccagccttgccccggcgccctgacctgacgccctggcctgacgccctgcttcgtcgcctcctttctctcccaggtgctggaccagggactgagcgtcccccggagagggtccggtgtgaccccgacaagaagcagaaatggggaagaaactggatctttccaagctcactgatgaagaggcccagcatgtcttggaagttgttcaacgagattttgacctccgaaggaaagaagaggaacggctagaggcgttgaagggcaagattaagaaggaaagctccaagagggagctgctttccgacactgcccatctgaacgagacccactgcgcccgctgcctgcagccctaccagctgcttgtgaatagcaaaaggcagtgcctggaatgtggcctcttcacctgcaaaagctgtggccgcgtccacccggaggagcagggctggatctgtgacccctgccatctggccagagtcgtgaagatcggctcactggagtggtactatgagcatgtgaaagcccgcttcaagaggttcggaagtgccaaggtcatccggtccctccacgggcggctgcagggtggagctgggcctgaactgatatctgaagagagaagtggagacagcgaccagacagatgaggatggagaacctggctcagaggcccaggcccaggcccagccctttggcagcaaatccctcacagatgagtcctgctcagagaaggcagcccctcacaaggctgagggcctggaggaggctgatactggggcctctgggtgccactcccatccggaagagcagccgaccagcatctcaccttccagacacggcgccctggctgagctctgcccgcctggaggctcccacaggatggccctggggactgctgctgcactcgggtcgaatgtcatcaggaatgagcagctgcccctgcagtacttggccgatgtggacacctctgatgaggaaagcatccgggctcacgtgatggcctcccaccattccaagcggagaggccgggcgtcttctgagagtcagggtctaggtgctggagtgcgcacggaggccgatgtagaggaggaggccctgaggaggaagctggaggagctgaccagcaacgtcagtgaccaggagacctcgtccgaggaggaggaagccaaggacgaaaaggcagagcccaacagggacaaatcagttgggcctctcccccaggcggacccggaggtgggcacggctgcccatcaaaccaacagacaggaaaaaagcccccaggaccctggggaccccgtccagtacaacaggaccacagatgaggagctgtcagagctggaggacagagtggcagtgacggcctcagaagtccagcaggcagagagcgaggtttcagacattgaatccaggattgcagccctgagggccgcagggctcacggtgaagccctcgggaaagccccggaggaagtcaaacctcccgatatttctccctcgagtggctgggaaacttggcaagagaccagaggacccaaatgcagacccttcaagtgaggccaaggcaatggctgtgccctatcttctgagaagaaagttcagtaattccctgaaaagtcaaggtaaagatgatgattcttttgatcggaaatcagtgtaccgaggctcgctgacacagagaaaccccaacgcgaggaaaggaatggccagccacaccttcgcgaaacctgtggtggcccaccagtcctaacgggacaggacagagagacagagcagccctgcactgttttccctccaccacagccatcctgtccctcattggctctgtgctttccactatacacagtcaccgtcccaatgagaaacaagaaggagcaccctccacatggactcccacctgcaagtggacagcgacattcagtcctgcactgctcacctgggtttactgatgactcctggctgccccaccatcctctctgatctgtgagaaacagctaagctgctgtgacttccctttaggacaatgttgtgtaaatctttgaaggacacaccgaagacctttatactgtgatcttttacccctttcactcttggctttcttatgttgctttcatgaatggaatggaaaaaagatgactcagttaaggcaccagccatatgtgtattcttgatggtctatatcggggtgtgagcagatgtttgcgtatttcttgtgggtgtgactggatattagacatccggacaagtgactgaactaatgatctgctgaataatgaaggaggaatagacaccccagtccccaccctacgtgcacccgctctgcaagttcccatgtgatctgtagaccaggggaaattacactgcggtcaagggcagagcctgcacatgacagcaagtgagcatttgatagatgctcagatgctagtgcagagagcctgctgggagacgaagagacagcaggcagagctccagatgggcaaggaagaggcttggttctagcctggctctgcccctcactgcagtggatccagtggggcagaggacagagggtcacaaccaatgagggatgtctgccaaggatgggggtgcagaggccacaggagtcagcttgccactcgcccattggttacatagatgatctctcagacaggctgggactcagagttatttcctagtatcggtgtgccccatccagttttaagtggagccctccaagactctccagagctgcctttgaacatcctaacagtaatcacatctcaccctccctgaggttcactttagacaggacccaatggctgcactgcctttgtcagagggggtgctgagaggagtggcttcttttagaatcaaacagtagagacaagagtcaagccttgtgtcttcaagcattgaccaagttaagtgtttccttccctctctcaataagacacttccaggagctttccaatctctcacttaaaactaaggtttgaatctcaaagtgttgctgggaggctgatactcctgcaacttcaggagacctgtgagcacacattagcagctgtttctctgactccttgtggcatcagataaaaacgtgggagtttttccatataattcccagccttacttataaattctattctttgaaaaaattattcaggctaggtaaggtggctcatacctataatcccagccctttgagaggccaaggtgggagaattgcttgaggccaggagtttgagacctcctgggcaacatagtgagatcccatctctacaaaaaacaaaacaaaaaaattacccaagcatgatggtatatgcctgtagtcgtacctacttacttaggaggctgaggcaggaggatcacttgagccctggaggttggggctgcagtgagccatgatcgcatcactatactcgagcctgggcaacagagtgagaccttgtctcttaaaaaaattaataataaataaatgaaaata

SEQ ID NO: 34964 - DNA, 2453 bp, Homo sapiens
tacttagaggatccgagtggtagtgtttctgagagtagggtctaggtgctggagtgcgcacggaggccgatgtagaggaggaggccctgaggaggaagctggaggagctgaccagcaacgtcagtgaccaggagacctcgtccgaggaggaggaagccaaggacgaaaaggcagagcccaacagggacaaatcagttgggcctctcccccaggcggacccggaggtgggcacggctgcccatcaaaccaacagacaggaaaaaagcccccaggaccctggggaccccgtccagtacaacaggaccacagatgaggagctgtcagagctggaggacagagtggcagtgacggcctcagaagtccagcaggcagagagcgaggtttcagacattgaatccaggattgcagccctgagggccgcagggctcacggtgaagccctcgggaaagccccggaggaagtcaaacctcccgatatttctccctcgagtggctgggaaacttggcaagagaccagaggacccaaatgcagacccttcaagtgaggccaaggcaatggctgtgccctatcttctgagaagaaagttcagtaattccctgaaaagtcaaggtaaagatgatgattcttttgatcggaaatcagtgtaccgaggctcgctgacacagagaaaccccaacgcgaggaaaggaatggccagccacaccttcgcgaaacctgtggtggcccaccagtcctaacgggacaggacagagagacagagcagccctgcactgttttccctccaccacagccatcctgtccctcattggctctgtgctttccactatacacagtcaccgtcccaatgagaaacaagaaggagcaccctccacatggactcccacctgcaagtggacagcgacattcagtcctgcactgctcacctgggtttactgatgactcctggctgccccaccatcctctctgatctgtgagaaacagctaagctgctgtgacttccctttaggacaatgttgtgtaaatctttgaaggacacaccgaagacctttatactgtgatcttttacccctttcactcttggctttcttatgttgctttcatgaatggaatggaaaaaagatgactcagttaaggcaccagccatatgtgtattcttgatggtctatatcggggtgtgagcagatgtttgcgtatttcttgtgggtgtgactggatattagacatccggacaagtgactgaactaatgatctgctgaataatgaaggaggaatagacaccccagtccccaccctacgtgcacccgctctgcaagttcccatgtgatctgtagaccaggggaaattacactgcggtcaagggcagagcctgcacatgacagcaagtgagcatttgatagatgctcagatgctagtgcagagagcctgctgggagacgaagagacagcaggcagagctccagatgggcaaggaagaggcttggttctagcctggctctgcccctcactgcagtggatccagtggggcagaggacagagggtcacaaccaatgagggatgtctgccaaggatgggggtgcagaggccacaggagtcagcttgccactcgcccattggttacatagatgatctctcagacaggctgggactcagagttatttcctagtatcggtgtgccccatccagttttaagtggagccctccaagactctccagagctgcctttgaacatcctaacagtaatcacatctcaccctccctgaggttcactttagacaggacccaatggctgcactgcctttgtcagagggggtgctgagaggagtggcttcttttagaatcaaacagtagagacaagagtcaagccttgtgtcttcaagcattgaccaagttaagtgtttccttccctctctcaataagacacttccaggagctttccaatctctcacttaaaactaaggtttgaatctcaaagtgttgctgggaggctgatactcctgcaacttcaggagacctgtgagcacacattagcagctgtttctctgactccttgtggcatcagataaaaacgtgggagtttttccatataattcccagccttacttataaattctattctttgaaaaaattattcaggctaggtaaggtggctcatacctataatcccagccctttgagaggccaaggtgggagaattgcttgaggccaggagtttgagacctcctgggcaacatagtgagatcccatctctacaaaaaacaaaacaaaaaaattacccaagcatgatggtatatgcctgtagtcgtacctacttacttaggaggctgaggcaggaggatcacttgagccctggaggttggggctgcagtgagccatgatcgcatcactatactcgagcctgggcaacagagtgagaccttgtctcttaaaaaaattaataataaataaatgaaaata

SEQ ID NO: 34965 - DNA, 2375 bp, Homo sapiens
gcatttttacagaagcgataggggaaaggaagcaatcagctatgcaggtgagcctcagggggatgactgtgaatagaatgggaggcagctttgccctaagcagttcccagcttgactttttcctttagcttggtgattgtggagtctcaagatttgttttcttttcacaatctgaaattcaaagttccctgggtatcctgtattttcatttgcacactttggcgccctagtcccagagtcctggagcggcatactgggggtggctgtgcagtcccagcatccccaacccagcatgtatagagagcatccatccttacatccagctgacccatgcccatgctcctccctgtggctggaggttcaacaataacataagtctcttctttgccctccagatatttctccctcgagtggctgggaaacttggcaagagaccagaggacccaaatgcagacccttcaagtgaggccaaggcaatggctgtgccctatcttctgagaagaaagttcagtaattccctgaaaagtcaaggtaaagatgatgattcttttgatcggaaatcagtgtaccgaggctcgctgacacagagaaaccccaacgcgaggaaaggaatggccagccacaccttcgcgaaacctgtggtggcccaccagtcctaacgggacaggacagagagacagagcagccctgcactgttttccctccaccacagccatcctgtccctcattggctctgtgctttccactatacacagtcaccgtcccaatgagaaacaagaaggagcaccctccacatggactcccacctgcaagtggacagcgacattcagtcctgcactgctcacctgggtttactgatgactcctggctgccccaccatcctctctgatctgtgagaaacagctaagctgctgtgacttccctttaggacaatgttgtgtaaatctttgaaggacacaccgaagacctttatactgtgatcttttacccctttcactcttggctttcttatgttgctttcatgaatggaatggaaaaaagatgactcagttaaggcaccagccatatgtgtattcttgatggtctatatcggggtgtgagcagatgtttgcgtatttcttgtgggtgtgactggatattagacatccggacaagtgactgaactaatgatctgctgaataatgaaggaggaatagacaccccagtccccaccctacgtgcacccgctctgcaagttcccatgtgatctgtagaccaggggaaattacactgcggtcaagggcagagcctgcacatgacagcaagtgagcatttgatagatgctcagatgctagtgcagagagcctgctgggagacgaagagacagcaggcagagctccagatgggcaaggaagaggcttggttctagcctggctctgcccctcactgcagtggatccagtggggcagaggacagagggtcacaaccaatgagggatgtctgccaaggatgggggtgcagaggccacaggagtcagcttgccactcgcccattggttacatagatgatctctcagacaggctgggactcagagttatttcctagtatcggtgtgccccatccagttttaagtggagccctccaagactctccagagctgcctttgaacatcctaacagtaatcacatctcaccctccctgaggttcactttagacaggacccaatggctgcactgcctttgtcagagggggtgctgagaggagtggcttcttttagaatcaaacagtagagacaagagtcaagccttgtgtcttcaagcattgaccaagttaagtgtttccttccctctctcaataagacacttccaggagctttccaatctctcacttaaaactaaggtttgaatctcaaagtgttgctgggaggctgatactcctgcaacttcaggagacctgtgagcacacattagcagctgtttctctgactccttgtggcatcagataaaaacgtgggagtttttccatataattcccagccttacttataaattctattctttgaaaaaattattcaggctaggtaaggtggctcatacctataatcccagccctttgagaggccaaggtgggagaattgcttgaggccaggagtttgagacctcctgggcaacatagtgagatcccatctctacaaaaaacaaaacaaaaaaattacccaagcatgatggtatatgcctgtagtcgtacctacttacttaggaggctgaggcaggaggatcacttgagccctggaggttggggctgcagtgagccatgatcgcatcactatactcgagcctgggcaacagagtgagaccttgtctcttaaaaaaattaataataaataaatgaaaata

SEQ ID NO: 34966 - DNA, 1935 bp, Homo sapiens
  misc_feature (14)..(14): n is a, c, g, or t
gatcccattcccanccactcgagggaggccaaggcaatggctgtgccctatcttctgagaagaaagttcagtaattccctgaaaagtcaaggtaaagatgatgattcttttgatcggaaatcagtgtaccgaggctcgctgacacagagaaaccccaacgcgaggaaaggaatggccagccacaccttcgcgaaacctgtggtggcccaccagtcctaacgggacaggacagagagacagagcagccctgcactgttttccctccaccacagccatcctgtccctcattggctctgtgctttccactatacacagtcaccgtcccaatgagaaacaagaaggagcaccctccacatggactcccacctgcaagtggacagcgacattcagtcctgcactgctcacctgggtttactgatgactcctggctgccccaccatcctctctgatctgtgagaaacagctaagctgctgtgacttccctttaggacaatgttgtgtaaatctttgaaggacacaccgaagacctttatactgtgatcttttacccctttcactcttggctttcttatgttgctttcatgaatggaatggaaaaaagatgactcagttaaggcaccagccatatgtgtattcttgatggtctatatcggggtgtgagcagatgtttgcgtatttcttgtgggtgtgactggatattagacatccggacaagtgactgaactaatgatctgctgaataatgaaggaggaatagacaccccagtccccaccctacgtgcacccgctctgcaagttcccatgtgatctgtagaccaggggaaattacactgcggtcaagggcagagcctgcacatgacagcaagtgagcatttgatagatgctcagatgctagtgcagagagcctgctgggagacgaagagacagcaggcagagctccagatgggcaaggaagaggcttggttctagcctggctctgcccctcactgcagtggatccagtggggcagaggacagagggtcacaaccaatgagggatgtctgccaaggatgggggtgcagaggccacaggagtcagcttgccactcgcccattggttacatagatgatctctcagacaggctgggactcagagttatttcctagtatcggtgtgccccatccagttttaagtggagccctccaagactctccagagctgcctttgaacatcctaacagtaatcacatctcaccctccctgaggttcactttagacaggacccaatggctgcactgcctttgtcagagggggtgctgagaggagtggcttcttttagaatcaaacagtagagacaagagtcaagccttgtgtcttcaagcattgaccaagttaagtgtttccttccctctctcaataagacacttccaggagctttccaatctctcacttaaaactaaggtttgaatctcaaagtgttgctgggaggctgatactcctgcaacttcaggagacctgtgagcacacattagcagctgtttctctgactccttgtggcatcagataaaaacgtgggagtttttccatataattcccagccttacttataaattctattctttgaaaaaattattcaggctaggtaaggtggctcatacctataatcccagccctttgagaggccaaggtgggagaattgcttgaggccaggagtttgagacctcctgggcaacatagtgagatcccatctctacaaaaaacaaaacaaaaaaattacccaagcatgatggtatatgcctgtagtcgtacctacttacttaggaggctgaggcaggaggatcacttgagccctggaggttggggctgcagtgagccatgatcgcatcactatactcgagcctgggcaacagagtgagaccttgtctcttaaaaaaattaataataaataaatgaaaata

SEQ ID NO: 34967 - DNA, 1945 bp, Homo sapiens
acgccgttcctgagggaaaagacgagccgtagtgcgagtcatggcaatggctgtgccctatcttctgagaagaaagttcagtaattccctgaaaagtcaaggtaaagatgatgattcttttgatcggaaatcagtgtaccgaggctcgctgacacagagaaaccccaacgcgaggaaaggaatggccagccacaccttcgcgaaacctgtggtggcccaccagtcctaacgggacaggacagagagacagagcagccctgcactgttttccctccaccacagccatcctgtccctcattggctctgtgctttccactatacacagtcaccgtcccaatgagaaacaagaaggagcaccctccacatggactcccacctgcaagtggacagcgacattcagtcctgcactgctcacctgggtttactgatgactcctggctgccccaccatcctctctgatctgtgagaaacagctaagctgctgtgacttccctttaggacaatgttgtgtaaatctttgaaggacacaccgaagacctttatactgtgatcttttacccctttcactcttggctttcttatgttgctttcatgaatggaatggaaaaaagatgactcagttaaggcaccagccatatgtgtattcttgatggtctatatcggggtgtgagcagatgtttgcgtatttcttgtgggtgtgactggatattagacatccggacaagtgactgaactaatgatctgctgaataatgaaggaggaatagacaccccagtccccaccctacgtgcacccgctctgcaagttcccatgtgatctgtagaccaggggaaattacactgcggtcaagggcagagcctgcacatgacagcaagtgagcatttgatagatgctcagatgctagtgcagagagcctgctgggagacgaagagacagcaggcagagctccagatgggcaaggaagaggcttggttctagcctggctctgcccctcactgcagtggatccagtggggcagaggacagagggtcacaaccaatgagggatgtctgccaaggatgggggtgcagaggccacaggagtcagcttgccactcgcccattggttacatagatgatctctcagacaggctgggactcagagttatttcctagtatcggtgtgccccatccagttttaagtggagccctccaagactctccagagctgcctttgaacatcctaacagtaatcacatctcaccctccctgaggttcactttagacaggacccaatggctgcactgcctttgtcagagggggtgctgagaggagtggcttcttttagaatcaaacagtagagacaagagtcaagccttgtgtcttcaagcattgaccaagttaagtgtttccttccctctctcaataagacacttccaggagctttccaatctctcacttaaaactaaggtttgaatctcaaagtgttgctgggaggctgatactcctgcaacttcaggagacctgtgagcacacattagcagctgtttctctgactccttgtggcatcagataaaaacgtgggagtttttccatataattcccagccttacttataaattctattctttgaaaaaattattcaggctaggtaaggtggctcatacctataatcccagccctttgagaggccaaggtgggagaattgcttgaggccaggagtttgagacctcctgggcaacatagtgagatcccatctctacaaaaaacaaaacaaaaaaattacccaagcatgatggtatatgcctgtagtcgtacctacttacttaggaggctgaggcaggaggatcacttgagccctggaggttggggctgcagtgagccatgatcgcatcactatactcgagcctgggcaacagagtgagaccttgtctcttaaaaaaattaataataaataaatgaaaata

SEQ ID NO: 34968 - DNA, 2511 bp, Homo sapiens
cagtggtaagggggagtgctgggatttaaaccagacctgcagggcagaaacttgtactctttctgccataccacccaaatgtggcagcttccccaaagctgagcatctcttatttcaggcatttcatgcttaatttattgaaaatgtccattctcatattgctaaaagttcaaatattgctagagagcagaaaatagtggccatggttaattagaagctggaagaacaataagaaatccaaaattagttgacaattcctaaacgtcacaacttgatgaagcctgggtgacagagcaagactttgtctcaaaaaaaaaaaaaagaaagaacaaaaaagaaaagaaagtcaaggaaatgcgaagaccacacaccagtgcagtgtgatgggcctttctgctgcttcattagtgtgaggatttccagggccacagtgaggaagaatgttaatgccagtgccagagcaaaggagaaagaagttggcaaaactgttgatttgcatgacagctgaaatgtaaatactttttaaaaaatatgtgatgtggaagcttcttaaaaggggatatgtccatttttttctaccttttaaatttctgaggaggccaaggcacttgtttgggctaagtatgtgattgataaagcaccatccctcttcctgttttccccaaaggtaaagatgatgattcttttgatcggaaatcagtgtaccgaggctcgctgacacagagaaaccccaacgcgaggaaaggaatggccagccacaccttcgcgaaacctgtggtggcccaccagtcctaacgggacaggacagagagacagagcagccctgcactgttttccctccaccacagccatcctgtccctcattggctctgtgctttccactatacacagtcaccgtcccaatgagaaacaagaaggagcaccctccacatggactcccacctgcaagtggacagcgacattcagtcctgcactgctcacctgggtttactgatgactcctggctgccccaccatcctctctgatctgtgagaaacagctaagctgctgtgacttccctttaggacaatgttgtgtaaatctttgaaggacacaccgaagacctttatactgtgatcttttacccctttcactcttggctttcttatgttgctttcatgaatggaatggaaaaaagatgactcagttaaggcaccagccatatgtgtattcttgatggtctatatcggggtgtgagcagatgtttgcgtatttcttgtgggtgtgactggatattagacatccggacaagtgactgaactaatgatctgctgaataatgaaggaggaatagacaccccagtccccaccctacgtgcacccgctctgcaagttcccatgtgatctgtagaccaggggaaattacactgcggtcaagggcagagcctgcacatgacagcaagtgagcatttgatagatgctcagatgctagtgcagagagcctgctgggagacgaagagacagcaggcagagctccagatgggcaaggaagaggcttggttctagcctggctctgcccctcactgcagtggatccagtggggcagaggacagagggtcacaaccaatgagggatgtctgccaaggatgggggtgcagaggccacaggagtcagcttgccactcgcccattggttacatagatgatctctcagacaggctgggactcagagttatttcctagtatcggtgtgccccatccagttttaagtggagccctccaagactctccagagctgcctttgaacatcctaacagtaatcacatctcaccctccctgaggttcactttagacaggacccaatggctgcactgcctttgtcagagggggtgctgagaggagtggcttcttttagaatcaaacagtagagacaagagtcaagccttgtgtcttcaagcattgaccaagttaagtgtttccttccctctctcaataagacacttccaggagctttccaatctctcacttaaaactaaggtttgaatctcaaagtgttgctgggaggctgatactcctgcaacttcaggagacctgtgagcacacattagcagctgtttctctgactccttgtggcatcagataaaaacgtgggagtttttccatataattcccagccttacttataaattctattctttgaaaaaattattcaggctaggtaaggtggctcatacctataatcccagccctttgagaggccaaggtgggagaattgcttgaggccaggagtttgagacctcctgggcaacatagtgagatcccatctctacaaaaaacaaaacaaaaaaattacccaagcatgatggtatatgcctgtagtcgtacctacttacttaggaggctgaggcaggaggatcacttgagccctggaggttggggctgcagtgagccatgatcgcatcactatactcgagcctgggcaacagagtgagaccttgtctcttaaaaaaattaataataaataaatgaaaata

SEQ ID NO: 34969 - DNA, 3622 bp, Homo sapiens
cgctagtagaggcggggtgaatcggacgaggcggagagccaggcgctaaccagccgctctgcgccccgcgccctgcttgcccccattatccagccttgccccggcgccctgacctgacgccctggcctgacgccctgcttcgtcgcctcctttctctcccaggtgctggaccagggactgagcgtcccccggagagggtccggtgtgaccccgacaagaagcagaaatggggaagaaactggatctttccaagctcactgatgaagaggcccagcatgtcttggaagttgttcaacgagattttgacctccgaaggaaagaagaggaacggctagaggcgttgaagggcaagattaagaaggaaagctccaagagggagctgctttccgacactgcccatctgaacgagacccactgcgcccgctgcctgcagccctaccagctgcttgtgaatagcaaaaggcagtgcctggaatgtggcctcttcacctgcaaaagctgtggccgcgtccacccggaggagcagggctggatctgtgacccctgccatctggccagagtcgtgaagatcggctcactggagtggtactatgagcatgtgaaagcccgcttcaagaggttcggaagtgccaaggtcatccggtccctccacgggcggctgcagggtggagctgggcctgaactgatatctgaagagagaagtggagacagcgaccagacagatgaggatggagaacctggctcagaggcccaggcccaggcccagccctttggcagcaaaaaaaagcgcctcctctccgtccacgacttcgacttcgagggagactcagatgactccactcagcctcaaggtcactccctgcacctgtcctcagtccctgaggccagggacagcccacagtccctcacagatgagtcctgctcagagaaggcagcccctcacaaggctgagggcctggaggaggctgatactggggcctctgggtgccactcccatccggaagagcagccgaccagcatctcaccttccagacacggcgccctggctgagctctgcccgcctggaggctcccacaggatggccctggggactgctgctgcactcgggtcgaatgtcatcaggaatgagcagctgcccctgcagtacttggccgatgtggacacctctgatgaggaaagcatccgggctcacgtgatggcctcccaccattccaagcggagaggccgggcgtcttctgagagtcagatctttgagctgaataagcatatttcagctgtggaatgcctgctgacctacctggagaacacagttgtgcctcccttggccaagggtctaggtgctggagtgcgcacggaggccgatgtagaggaggaggccctgaggaggaagctggaggagctgaccagcaacgtcagtgaccaggagacctcgtccgaggaggaggaagccaaggacgaaaaggcagagcccaacagggacaaatcagttgggcctctcccccaggcggacccggaggtgggcacggctgcccatcaaaccaacagacaggaaaaaagcccccaggaccctggggaccccgtccagtacaacaggaccacagatgaggagctgtcagagctggaggacagagtggcagtgacggcctcagaagtccagcaggcagagagcgaggtttcagacattgaatccaggattgcagccctgagggccgcagggctcacggtgaagccctcgggaaagccccggaggaagtcaaacctcccgatatttctccctcgagtggctgggaaacttggcaagagaccagaggacccaaatgcagacccttcaagtgaggccaaggcaatggctgtgccctatcttctgagaagaaagttcagtaattccctgaaaagtcaaggtaaagatgatgattcttttgatcggaaatcagtgtaccgaggctcgctgacacagagaaaccccaacgcgaggaaaggaatggccagccacaccttcgcgtcaccgtcccaatgagaaacaagaaggagcaccctccacatggactcccacctgcaagtggacagcgacattcagtcctgcactgctcacctgggtttactgatgactcctggctgccccaccatcctctctgatctgtgagaaacagctaagctgctgtgacttccctttaggacaatgttgtgtaaatctttgaaggacacaccgaagacctttatactgtgatcttttacccctttcactcttggctttcttatgttgctttcatgaatggaatggaaaaaagatgactcagttaaggcaccagccatatgtgtattcttgatggtctatatcggggtgtgagcagatgtttgcgtatttcttgtgggtgtgactggatattagacatccggacaagtgactgaactaatgatctgctgaataatgaaggaggaatagacaccccagtccccaccctacgtgcacccgctctgcaagttcccatgtgatctgtagaccaggggaaattacactgcggtcaagggcagagcctgcacatgacagcaagtgagcatttgatagatgctcagatgctagtgcagagagcctgctgggagacgaagagacagcaggcagagctccagatgggcaaggaagaggcttggttctagcctggctctgcccctcactgcagtggatccagtggggcagaggacagagggtcacaaccaatgagggatgtctgccaaggatgggggtgcagaggccacaggagtcagcttgccactcgcccattggttacatagatgatctctcagacaggctgggactcagagttatttcctagtatcggtgtgccccatccagttttaagtggagccctccaagactctccagagctgcctttgaacatcctaacagtaatcacatctcaccctccctgaggttcactttagacaggacccaatggctgcactgcctttgtcagagggggtgctgagaggagtggcttcttttagaatcaaacagtagagacaagagtcaagccttgtgtcttcaagcattgaccaagttaagtgtttccttccctctctcaataagacacttccaggagctttccaatctctcacttaaaactaaggtttgaatctcaaagtgttgctgggaggctgatactcctgcaacttcaggagacctgtgagcacacattagcagctgtttctctgactccttgtggcatcagataaaaacgtgggagtttttccatataattcccagccttacttataaattctattctttgaaaaaattattcaggctaggtaaggtggctcatacctataatcccagccctttgagaggccaaggtgggagaattgcttgaggccaggagtttgagacctcctgggcaacatagtgagatcccatctctacaaaaaacaaaacaaaaaaattacccaagcatgatggtatatgcctgtagtcgtacctacttacttaggaggctgaggcaggaggatcacttgagccctggaggttggggctgcagtgagccatgatcgcatcactatactcgagcctgggcaacagagtgagaccttgtctcttaaaaaaattaataataaataaatgaaaata

SEQ ID NO: 34970 - DNA, 1933 bp, Homo sapiens
cgctagtagaggcggggtgaatcggacgaggcggagagccaggcgctaaccagccgctctgcgccccgcgccctgcttgcccccattatccagccttgccccggcgccctgacctgacgccctggcctgacgccctgcttcgtcgcctcctttctctcccaggtgctggaccagggactgagcgtcccccggagagggtccggtgtgaccccgacaagaagcagaaatggggaagaaactggatctttccaagctcactgatgaagaggcccagcatgtcttggaagttgttcaacgagattttgacctccgaaggaaagaagaggaacggctagaggcgttgaagggcaagattaagaaggaaagctccaagagggagctgctttccgacactgcccatctgaacgagacccactgcgcccgctgcctgcagccctaccagctgcttgtgaatagcaaaaggcagtgcctggaatgtggcctcttcacctgcaaaagctgtggccgcgtccacccggaggagcagggctggatctgtgacccctgccatctggccagagtcgtgaagatcggctcactggagtggtactatgagcatgtgaaagcccgcttcaagaggttcggaagtgccaaggtcatccggtccctccacgggcggctgcagggtggagctgggcctgaactgatatctgaagagagaagtggagacagcgaccagacagatgaggatggagaacctggctcagaggcccaggcccaggcccagccctttggcagcaaaaaaaagcgcctcctctccgtccacgacttcgacttcgagggagactcagatgactccactcagcctcaaggtcactccctgcacctgtcctcagtccctgaggccagggacagcccacagtccctcacagatgagtcctgctcagagaaggcagcccctcacaaggctgagggcctggaggaggctgatactggggcctctgggtgccactcccatccggaagagcagccgaccagcatctcaccttccagacacggcgccctggctgagctctgcccgcctggaggctcccacaggatggccctggggactgctgctgcactcgggtcgaatgtcatcaggaatgagcagctgcccctgcagtacttggccgatgtggacacctctgatgaggaaagcatccgggctcacgtgatggcctcccaccattccaagcggagaggccgggcgtcttctgagagtcagatctttgagctgaataagcatatttcagctgtggaatgcctgctgacctacctggagaacacagttgtgcctcccttggccaagggtctaggtgctggagtgcgcacggaggccgatgtagaggaggaggccctgaggaggaagctggaggagctgaccagcaacgtcagtgaccaggagacctcgtccgaggaggaggaagccaaggacgaaaaggcagagcccaacagggacaaatcagttgggcctctcccccaggcggacccggaggtgggcacggctgcccatcaaaccaacagacaggaaaaaagcccccaggaccctggggaccccgtccagtacaacaggaccacagccatcctgtccctcattggctctgtgctttccactatacacagtcaccgtcccaatgagaaacaagaaggagcaccctccacatggactcccacctgcaagtggacagcgacattcagtcctgcactgctcacctgggtttactgatgactcctggctgccccaccatcctctctgatctgtgagaaacagctaagctgctgtgacttccctttaggacaatgttgtgtaaatctttgaaggacacaccgaagacctttatactgtgatcttttacccctttcactcttggctttcttatgttgcttctggtggtgggcagtgcccgtaggc

SEQ ID NO: 34971 - DNA, 1475 bp, Homo sapiens
cgctagtagaggcggggtgaatcggacgaggcggagagccaggcgctaaccagccgctctgcgccccgcgccctgcttgcccccattatccagccttgccccggcgccctgacctgacgccctggcctgacgccctgcttcgtcgcctcctttctctcccaggtgctggaccagggactgagcgtcccccggagagggtccggtgtgaccccgacaagaagcagaaatggggaagaaactggatctttccaagctcactgatgaagaggcccagcatgtcttggaagttgttcaacgagattttgacctccgaaggaaagaagaggaacggctagaggcgttgaagggcaagattaagaaggaaagctccaagagggagctgctttccgacactgcccatctgaacgagacccactgcgcccgctgcctgcagccctaccagctgcttgtgaatagcaaaaggcagtgcctggaatgtggcctcttcacctgcaaaagctgtggccgcgtccacccggaggagcagggctggatctgtgacccctgccatctggccagagtcgtgaagatcggctcactggagtggtactatgagcatgtgaaagcccgcttcaagaggttcggaagtgccaaggtcatccggtccctccacgggcggctgcagggtggagctgggcctgaactgatatctgaagagagaagtggagacagcgaccagacagatgaggatggagaacctggctcagaggcccaggcccaggcccagccctttggcagcaaaaaaaagcgcctcctctccgtccacgacttcgacttcgagggagactcagatgactccactcagcctcaaggtcactccctgcacctgtcctcagtccctgaggccagggacagcccacagtccctcacagatgagtcctgctcagagaaggcagcccctcacaaggctgagggcctggaggaggctgatactggggcctctgggtgccactcccatccggaagagcagccgaccagcatctcaccttccagacacggcgccctggctgagctctgcccgcctggaggctcccacaggatggccctggggactgctgctgcactcgggtcgaatgtcatcaggaatgagcagctgcccctgcagtacttggccgatgtggacacctctgatgaggaaagcatccgggctcacgtgatggcctcccaccattccaagcggagaggccgggcgtcttctgagagtcaggtaacggtggctggaaagacttctgtcttgtcgtttctttgggtggagtctttttacctccacaccaagtcactttagagaaattacagcttttaatactttcaaactatgaaattgcacaagcctacttaatggagatacgtcatcacaatattttttgtggaagtgaattcacataacagaaaattaaccatcttagtatggccattccccaaaaattaaaaatcga

SEQ ID NO: 34972 - DNA, 1267 bp, Homo sapiens
cgctagtagaggcggggtgaatcggacgaggcggagagccaggcgctaaccagccgctctgcgccccgcgccctgcttgcccccattatccagccttgccccggcgccctgacctgacgccctggcctgacgccctgcttcgtcgcctcctttctctcccaggtgctggaccagggactgagcgtcccccggagagggtccggtgtgaccccgacaagaagcagaaatggggaagaaactggatctttccaagctcactgatgaagaggcccagcatgtcttggaagttgttcaacgagattttgacctccgaaggaaagaagaggaacggctagaggcgttgaagggcaagattaagaaggaaagctccaagagggagctgctttccgacactgcccatctgaacgagacccactgcgcccgctgcctgcagccctaccagctgcttgtgaatagcaaaaggcagtgcctggaatgtggcctcttcacctgcaaaagctgtggccgcgtccacccggaggagcagggctggatctgtgacccctgccatctggccagagtcgtgaagatcggctcactggagtggtactatgagcatgtgaaagcccgcttcaagaggttcggaagtgccaaggtcatccggtccctccacgggcggctgcagggtggagctgggcctgaactgatatctgaagagagaagtggagacagcgaccagacagatgaggatggagaacctggctcagaggcccaggcccaggcccagccctttggcagcaaaaaaaagcgcctcctctccgtccacgacttcgacttcgagggagactcagatgactccactcagcctcaaggtcactccctgcacctgtcctcagtccctgaggccagggacagcccacaggtcagtgggtcctcgtgtctttcccctgcccctcccaggaacctgagtggcaggtgctcaggccccaggtgagggacagcactctggaagcagtgtctgatggccacacagtcccacctggctcccaaggcatgacagggaaggggaccgatgtgggaagacaggatccagagacctcacactcccccaggattagcatgtctggagatatgagcaggcagcttggagaagcagggggcgatgcagggccctgagactggacagatgagttggggcccagggatcggtgcttgggacagaaataaggcagaacccccgagactcaggagggcgggactgcctcgtcgacgcggccgcgaatttagt

SEQ ID NO: 34973 - DNA, 1624 bp, Homo sapiens
ggagtagggtcttacggatagtatcttagggagcaccctccacatggactcccacctgcaagtggacagcgacattcagtcctgcactgctcacctgggtttactgatgactcctggctgccccaccatcctctctgatctgtgagaaacagctaagctgctgtgacttccctttaggacaatgttgtgtaaatctttgaaggacacaccgaagacctttatactgtgatcttttacccctttcactcttggctttcttatgttgctttcatgaatggaatggaaaaaagatgactcagttaaggcaccagccatatgtgtattcttgatggtctatatcggggtgtgagcagatgtttgcgtatttcttgtgggtgtgactggatattagacatccggacaagtgactgaactaatgatctgctgaataatgaaggaggaatagacaccccagtccccaccctacgtgcacccgctctgcaagttcccatgtgatctgtagaccaggggaaattacactgcggtcaagggcagagcctgcacatgacagcaagtgagcatttgatagatgctcagatgctagtgcagagagcctgctgggagacgaagagacagcaggcagagctccagatgggcaaggaagaggcttggttctagcctggctctgcccctcactgcagtggatccagtggggcagaggacagagggtcacaaccaatgagggatgtctgccaaggatgggggtgcagaggccacaggagtcagcttgccactcgcccattggttacatagatgatctctcagacaggctgggactcagagttatttcctagtatcggtgtgccccatccagttttaagtggagccctccaagactctccagagctgcctttgaacatcctaacagtaatcacatctcaccctccctgaggttcactttagacaggacccaatggctgcactgcctttgtcagagggggtgctgagaggagtggcttcttttagaatcaaacagtagagacaagagtcaagccttgtgtcttcaagcattgaccaagttaagtgtttccttccctctctcaataagacacttccaggagctttccaatctctcacttaaaactaaggtttgaatctcaaagtgttgctgggaggctgatactcctgcaacttcaggagacctgtgagcacacattagcagctgtttctctgactccttgtggcatcagataaaaacgtgggagtttttccatataattcccagccttacttataaattctattctttgaaaaaattattcaggctaggtaaggtggctcatacctataatcccagccctttgagaggccaaggtgggagaattgcttgaggccaggagtttgagacctcctgggcaacatagtgagatcccatctctacaaaaaacaaaacaaaaaaattacccaagcatgatggtatatgcctgtagtcgtacctacttacttaggaggctgaggcaggaggatcacttgagccctggaggttggggctgcagtgagccatgatcgcatcactatactcgagcctgggcaacagagtgagaccttgtctcttaaaaaaattaataataaataaatgaaaata

SEQ ID NO: 34974 - DNA, 835 bp, Homo sapiens
cgctagtagaggcggggtgaatcggacgaggcggagagccaggcgctaaccagccgctctgcgccccgcgccctgcttgcccccattatccagccttgccccggcgccctgacctgacgccctggcctgacgccctgcttcgtcgcctcctttctctcccaggtgctggaccagggactgagcgtcccccggagagggtccggtgtgaccccgacaagaagcagaaatggggaagaaactggatctttccaagctcactgatgaagaggcccagcatgtcttggaagttgttcaacgagattttgacctccgaaggaaagaagaggaacggctagaggcgttgaagggcaagattaagaaggaaagctccaagagggagctgctttccgacactgcccatctgaacgagacccactgcgcccgctgcctgcagccctaccagctgcttgtgaatagcaaaaggcagtgcctggaatgtggcctcttcacctgcaaaagctgtggccgcgtccacccggaggagcagggctggatctgtgacccctgccatctggccagagtcgtgaagatcggctcactggagtggtactatgagcatgtgaaagcccgcttcaagaggttcggaagtgccaaggtcatccggtccctccacgggcggctgcagggtggaggtaaggagtggagagtaagaacggctttttgttcccaggcattttaggaatattaaagcaggttcctttggagtgtgcatgtgtgtgtgtacgtgtgtgtgtgcatgtgtgtgtgcacatgtgtgtgcatgcacatgcctctctgtgaattcctgcttctggct

SEQ ID NO: 34975 - DNA, 483 bp, Homo sapiens
acatgtgtatatgtgtgcatgtgttgtgtgtgtaggtttgtgtgtgtgtgtgtgaatttatttactggcttacaaagcgaagacaatccctgcctctcccaggcatctaccggcttccacccccataccccgtcgctctgctgcgtcctgcctgatgggcgctgggcttccatttctcacggggatcctgcagtttctcagccccatgcactctgggacgaagttcagctcatatcaggcccaatggcgtttacaggctgaacgtcattcccgatctttccaccgagggcctctgtgatttgggggctttgtcaggaaagtggagcctcacggaaaagcatactggctaaaacacgcggcttcttcatcgactcaatctaatcatccccttggtgttcgtctgtgagaccccaggcagccagccctgtcgatctgtctcaataggcttcgtccaaatagaaaattaaatgatcatgtgcaata

SEQ ID NO: 34976 - DNA, 3907 bp, Homo sapiens
gaaggacaggcaggccgggcggactggagacggcggctcgccttgggaccctctgagcttgcgggccccgctgagcacccaaaggccggccctagagtccaggagaagagcgcagcggcgcggagctcccaggcgttccccgcagcgcgtcctcggtcctggaaccaccgcgccgcgcgtcctggcttccacatctgccccatttgcccgcggatcttgactttttcttggcgggcaaggcctcggtctcctccccgcagcagggctgcccgcggctgcgggaccctcctggtcctgatgcctggcagaatcgaaggggtgagggtgctggaccagggactgagcgtcccccggagagggtccggtgtgaccccgacaagaagcagaaatggggaagaaactggatctttccaagctcactgatgaagaggcccagcatgtcttggaagttgttcaacgagattttgacctccgaaggaaagaagaggaacggctagaggcgttgaagggcaagattaagaaggaaagctccaagagggagctgctttccgacactgcccatctgaacgagacccactgcgcccgctgcctgcagccctaccagctgcttgtgaatagcaaaaggcagtgcctggaatgtggcctcttcacctgcaaaagctgtggccgcgtccacccggaggagcagggctggatctgtgacccctgccatctggccagagtcgtgaagatcggctcactggagtggtactatgagcatgtgaaagcccgcttcaagaggttcggaagtgccaaggtcatccggtccctccacgggcggctgcagggtggagctgggcctgaactgatatctgaagagagaagtggagacagcgaccagacagatgaggatggagaacctggctcagaggcccaggcccaggcccagccctttggcagcaaaaaaaagcgcctcctctccgtccacgacttcgacttcgagggagactcagatgactccactcagcctcaaggtcactccctgcacctgtcctcagtccctgaggccagggacagcccacagtccctcacagatgagtcctgctcagagaaggcagcccctcacaaggctgagggcctggaggaggctgatactggggcctctgggtgccactcccatccggaagagcagccgaccagcatctcaccttccagacacggcgccctggctgagctctgcccgcctggaggctcccacaggatggccctggggactgctgctgcactcgggtcgaatgtcatcaggaatgagcagctgcccctgcagtacttggccgatgtggacacctctgatgaggaaagcatccgggctcacgtgatggcctcccaccattccaagcggagaggccgggcgtcttctgagagtcagatctttgagctgaataagcatatttcagctgtggaatgcctgctgacctacctggagaacacagttgtgcctcccttggccaagggtctaggtgctggagtgcgcacggaggccgatgtagaggaggaggccctgaggaggaagctggaggagctgaccagcaacgtcagtgaccaggagacctcgtccgaggaggaggaagccaaggacgaaaaggcagagcccaacagggacaaatcagttgggcctctcccccaggcggacccggaggtgggcacggctgcccatcaaaccaacagacaggaaaaaagcccccaggaccctggggaccccgtccagtacaacaggaccacagatgaggagctgtcagagctggaggacagagtggcagtgacggcctcagaagtccagcaggcagagagcgaggtttcagacattgaatccaggattgcagccctgagggccgcagggctcacggtgaagccctcgggaaagccccggaggaagtcaaacctcccgatatttctccctcgagtggctgggaaacttggcaagagaccagaggacccaaatgcagacccttcaagtgaggccaaggcaatggctgtgccctatcttctgagaagaaagttcagtaattccctgaaaagtcaaggtaaagatgatgattcttttgatcggaaatcagtgtaccgaggctcgctgacacagagaaaccccaacgcgaggaaaggaatggccagccacaccttcgcgaaacctgtggtggcccaccagtcctaacgggacaggacagagagacagagcagccctgcactgttttccctccaccacagccatcctgtccctcattggctctgtgctttccactatacacagtcaccgtcccaatgagaaacaagaaggagcaccctccacatggactcccacctgcaagtggacagcgacattcagtcctgcactgctcacctgggtttactgatgactcctggctgccccaccatcctctctgatctgtgagaaacagctaagctgctgtgacttccctttaggacaatgttgtgtaaatctttgaaggacacaccgaagacctttatactgtgatcttttacccctttcactcttggctttcttatgttgctttcatgaatggaatggaaaaaagatgactcagttaaggcaccagccatatgtgtattcttgatggtctatatcggggtgtgagcagatgtttgcgtatttcttgtgggtgtgactggatattagacatccggacaagtgactgaactaatgatctgctgaataatgaaggaggaatagacaccccagtccccaccctacgtgcacccgctctgcaagttcccatgtgatctgtagaccaggggaaattacactgcggtcaagggcagagcctgcacatgacagcaagtgagcatttgatagatgctcagatgctagtgcagagagcctgctgggagacgaagagacagcaggcagagctccagatgggcaaggaagaggcttggttctagcctggctctgcccctcactgcagtggatccagtggggcagaggacagagggtcacaaccaatgagggatgtctgccaaggatgggggtgcagaggccacaggagtcagcttgccactcgcccattggttacatagatgatctctcagacaggctgggactcagagttatttcctagtatcggtgtgccccatccagttttaagtggagccctccaagactctccagagctgcctttgaacatcctaacagtaatcacatctcaccctccctgaggttcactttagacaggacccaatggctgcactgcctttgtcagagggggtgctgagaggagtggcttcttttagaatcaaacagtagagacaagagtcaagccttgtgtcttcaagcattgaccaagttaagtgtttccttccctctctcaataagacacttccaggagctttccaatctctcacttaaaactaaggtttgaatctcaaagtgttgctgggaggctgatactcctgcaacttcaggagacctgtgagcacacattagcagctgtttctctgactccttgtggcatcagataaaaacgtgggagtttttccatataattcccagccttacttataaattctattctttgaaaaaattattcaggctaggtaaggtggctcatacctataatcccagccctttgagaggccaaggtgggagaattgcttgaggccaggagtttgagacctcctgggcaacatagtgagatcccatctctacaaaaaacaaaacaaaaaaattacccaagcatgatggtatatgcctgtagtcgtacctacttacttaggaggctgaggcaggaggatcacttgagccctggaggttggggctgcagtgagccatgatcgcatcactatactcgagcctgggcaacagagtgagaccttgtctcttaaaaaaattaataataaataaatgaaaata

SEQ ID NO: 34977 - DNA, 3589 bp, Homo sapiens
cgctagtagaggcggggtgaatcggacgaggcggagagccaggcgctaaccagccgctctgcgccccgcgccctgcttgcccccattatccagccttgccccggcgccctgacctgacgccctggcctgacgccctgcttcgtcgcctcctttctctcccaggtgctggaccagggactgagcgtcccccggagagggtccggtgtgaccccgacaagaagcagaaatggggaagaaactggatctttccaagctcactgatgaagaggcccagcatgtcttggaagttgttcaacgagattttgacctccgaaggaaagaagaggaacggctagaggcgttgaagggcaagattaagaaggaaagctccaagagggagctgctttccgacactgcccatctgaacgagacccactgcgcccgctgcctgcagccctaccagctgcttgtgaatagcaaaaggcagtgcctggaatgtggcctcttcacctgcaaaagctgtggccgcgtccacccggaggagcagggctggatctgtgacccctgccatctggccagagtcgtgaagatcggctcactggagtggtactatgagcatgtgaaagcccgcttcaagaggttcggaagtgccaaggtcatccggtccctccacgggcggctgcagggtggagctgggcctgaactgatatctgaagagagaagtggagacagcgaccagacagatgaggatggagaacctggctcagaggcccaggcccaggcccagccctttggcagcaaaaaaaagcgcctcctctccgtccacgacttcgacttcgagggagactcagatgactccactcagcctcaaggtcactccctgcacctgtcctcagtccctgaggccagggacagcccacagtccctcacagatgagtcctgctcagagaaggcagcccctcacaaggctgagggcctggaggaggctgatactggggcctctgggtgccactcccatccggaagagcagccgaccagcatctcaccttccagacacggcgccctggctgagctctgcccgcctggaggctcccacaggatggccctggggactgctgctgcactcgggtcgaatgtcatcaggaatgagcagctgcccctgcagtacttggccgatgtggacacctctgatgaggaaagcatccgggctcacgtgatggcctcccaccattccaagcggagaggccgggcgtcttctgagagtcagatctttgagctgaataagcatatttcagctgtggaatgcctgctgacctacctggagaacacagttgtgcctcccttggccaagggtctaggtgctggagtgcgcacggaggccgatgtagaggaggaggccctgaggaggaagctggaggagctgaccagcaacgtcagtgaccaggagacctcgtccgaggaggaggaagccaaggacgaaaaggcagagcccaacagggacaaatcagttgggcctctcccccaggcggacccggaggtttcagacattgaatccaggattgcagccctgagggccgcagggctcacggtgaagccctcgggaaagccccggaggaagtcaaacctcccgatatttctccctcgagtggctgggaaacttggcaagagaccagaggacccaaatgcagacccttcaagtgaggccaaggcaatggctgtgccctatcttctgagaagaaagttcagtaattccctgaaaagtcaaggtaaagatgatgattcttttgatcggaaatcagtgtaccgaggctcgctgacacagagaaaccccaacgcgaggaaaggaatggccagccacaccttcgcgaaacctgtggtggcccaccagtcctaacgggacaggacagagagacagagcagccctgcactgttttccctccaccacagccatcctgtccctcattggctctgtgctttccactatacacagtcaccgtcccaatgagaaacaagaaggagcaccctccacatggactcccacctgcaagtggacagcgacattcagtcctgcactgctcacctgggtttactgatgactcctggctgccccaccatcctctctgatctgtgagaaacagctaagctgctgtgacttccctttaggacaatgttgtgtaaatctttgaaggacacaccgaagacctttatactgtgatcttttacccctttcactcttggctttcttatgttgctttcatgaatggaatggaaaaaagatgactcagttaaggcaccagccatatgtgtattcttgatggtctatatcggggtgtgagcagatgtttgcgtatttcttgtgggtgtgactggatattagacatccggacaagtgactgaactaatgatctgctgaataatgaaggaggaatagacaccccagtccccaccctacgtgcacccgctctgcaagttcccatgtgatctgtagaccaggggaaattacactgcggtcaagggcagagcctgcacatgacagcaagtgagcatttgatagatgctcagatgctagtgcagagagcctgctgggagacgaagagacagcaggcagagctccagatgggcaaggaagaggcttggttctagcctggctctgcccctcactgcagtggatccagtggggcagaggacagagggtcacaaccaatgagggatgtctgccaaggatgggggtgcagaggccacaggagtcagcttgccactcgcccattggttacatagatgatctctcagacaggctgggactcagagttatttcctagtatcggtgtgccccatccagttttaagtggagccctccaagactctccagagctgcctttgaacatcctaacagtaatcacatctcaccctccctgaggttcactttagacaggacccaatggctgcactgcctttgtcagagggggtgctgagaggagtggcttcttttagaatcaaacagtagagacaagagtcaagccttgtgtcttcaagcattgaccaagttaagtgtttccttccctctctcaataagacacttccaggagctttccaatctctcacttaaaactaaggtttgaatctcaaagtgttgctgggaggctgatactcctgcaacttcaggagacctgtgagcacacattagcagctgtttctctgactccttgtggcatcagataaaaacgtgggagtttttccatataattcccagccttacttataaattctattctttgaaaaaattattcaggctaggtaaggtggctcatacctataatcccagccctttgagaggccaaggtgggagaattgcttgaggccaggagtttgagacctcctgggcaacatagtgagatcccatctctacaaaaaacaaaacaaaaaaattacccaagcatgatggtatatgcctgtagtcgtacctacttacttaggaggctgaggcaggaggatcacttgagccctggaggttggggctgcagtgagccatgatcgcatcactatactcgagcctgggcaacagagtgagaccttgtctcttaaaaaaattaataataaataaatgaaaata

SEQ ID NO: 34978 - DNA, 3333 bp, Homo sapiens
tgagtaggtggatgagtggataaatgggtgggtgggtaggtgaatagatgaatagattgataaatagggggatgggtggattggtagatgggtagatggagggatacattgctgtgtggataggtgggtgaatggatgaaggagggagggatgggcaggtagatggatagattagtggatggatgggtggatgggctgacaaatggcttgttcccagactgtttgtccttgggtggagtcatgcaggtatctattgcagctgggcctgaactgatatctgaagagagaagtggagacagcgaccagacagatgaggatggagaacctggctcagaggcccaggcccaggcccagccctttggcagcaaaaaaaagcgcctcctctccgtccacgacttcgacttcgagggagactcagatgactccactcagcctcaaggtcactccctgcacctgtcctcagtccctgaggccagggacagcccacagtccctcacagatgagtcctgctcagagaaggcagcccctcacaaggctgagggcctggaggaggctgatactggggcctctgggtgccactcccatccggaagagcagccgaccagcatctcaccttccagacacggcgccctggctgagctctgcccgcctggaggctcccacaggatggccctggggactgctgctgcactcgggtcgaatgtcatcaggaatgagcagctgcccctgcagtacttggccgatgtggacacctctgatgaggaaagcatccgggctcacgtgatggcctcccaccattccaagcggagaggccgggcgtcttctgagagtcagatctttgagctgaataagcatatttcagctgtggaatgcctgctgacctacctggagaacacagttgtgcctcccttggccaagggtctaggtgctggagtgcgcacggaggccgatgtagaggaggaggccctgaggaggaagctggaggagctgaccagcaacgtcagtgaccaggagacctcgtccgaggaggaggaagccaaggacgaaaaggcagagcccaacagggacaaatcagttgggcctctcccccaggcggacccggaggtgggcacggctgcccatcaaaccaacagacaggaaaaaagcccccaggaccctggggaccccgtccagtacaacaggaccacagatgaggagctgtcagagctggaggacagagtggcagtgacggcctcagaagtccagcaggcagagagcgaggtttcagacattgaatccaggattgcagccctgagggccgcagggctcacggtgaagccctcgggaaagccccggaggaagtcaaacctcccgatatttctccctcgagtggctgggaaacttggcaagagaccagaggacccaaatgcagacccttcaagtgaggccaaggcaatggctgtgccctatcttctgagaagaaagttcagtaattccctgaaaagtcaaggtaaagatgatgattcttttgatcggaaatcagtgtaccgaggctcgctgacacagagaaaccccaacgcgaggaaaggaatggccagccacaccttcgcgaaacctgtggtggcccaccagtcctaacgggacaggacagagagacagagcagccctgcactgttttccctccaccacagccatcctgtccctcattggctctgtgctttccactatacacagtcaccgtcccaatgagaaacaagaaggagcaccctccacatggactcccacctgcaagtggacagcgacattcagtcctgcactgctcacctgggtttactgatgactcctggctgccccaccatcctctctgatctgtgagaaacagctaagctgctgtgacttccctttaggacaatgttgtgtaaatctttgaaggacacaccgaagacctttatactgtgatcttttacccctttcactcttggctttcttatgttgctttcatgaatggaatggaaaaaagatgactcagttaaggcaccagccatatgtgtattcttgatggtctatatcggggtgtgagcagatgtttgcgtatttcttgtgggtgtgactggatattagacatccggacaagtgactgaactaatgatctgctgaataatgaaggaggaatagacaccccagtccccaccctacgtgcacccgctctgcaagttcccatgtgatctgtagaccaggggaaattacactgcggtcaagggcagagcctgcacatgacagcaagtgagcatttgatagatgctcagatgctagtgcagagagcctgctgggagacgaagagacagcaggcagagctccagatgggcaaggaagaggcttggttctagcctggctctgcccctcactgcagtggatccagtggggcagaggacagagggtcacaaccaatgagggatgtctgccaaggatgggggtgcagaggccacaggagtcagcttgccactcgcccattggttacatagatgatctctcagacaggctgggactcagagttatttcctagtatcggtgtgccccatccagttttaagtggagccctccaagactctccagagctgcctttgaacatcctaacagtaatcacatctcaccctccctgaggttcactttagacaggacccaatggctgcactgcctttgtcagagggggtgctgagaggagtggcttcttttagaatcaaacagtagagacaagagtcaagccttgtgtcttcaagcattgaccaagttaagtgtttccttccctctctcaataagacacttccaggagctttccaatctctcacttaaaactaaggtttgaatctcaaagtgttgctgggaggctgatactcctgcaacttcaggagacctgtgagcacacattagcagctgtttctctgactccttgtggcatcagataaaaacgtgggagtttttccatataattcccagccttacttataaattctattctttgaaaaaattattcaggctaggtaaggtggctcatacctataatcccagccctttgagaggccaaggtgggagaattgcttgaggccaggagtttgagacctcctgggcaacatagtgagatcccatctctacaaaaaacaaaacaaaaaaattacccaagcatgatggtatatgcctgtagtcgtacctacttacttaggaggctgaggcaggaggatcacttgagccctggaggttggggctgcagtgagccatgatcgcatcactatactcgagcctgggcaacagagtgagaccttgtctcttaaaaaaattaataataaataaatgaaaata

SEQ ID NO: 34979 - DNA, 2155 bp, Homo sapiens
acttgggcctgacgtagaggcgggtgcagagaggggagggtgatcaggacaccagcacagggttcagcaggcagagagcgaggtttcagacattgaatccaggattgcagccctgagggccgcagggctcacggtgaagccctcgggaaagccccggaggaagtcaaacctcccgatatttctccctcgagtggctgggaaacttggcaagagaccagaggacccaaatgcagacccttcaagtgaggccaaggcaatggctgtgccctatcttctgagaagaaagttcagtaattccctgaaaagtcaaggtaaagatgatgattcttttgatcggaaatcagtgtaccgaggctcgctgacacagagaaaccccaacgcgaggaaaggaatggccagccacaccttcgcgaaacctgtggtggcccaccagtcctaacgggacaggacagagagacagagcagccctgcactgttttccctccaccacagccatcctgtccctcattggctctgtgctttccactatacacagtcaccgtcccaatgagaaacaagaaggagcaccctccacatggactcccacctgcaagtggacagcgacattcagtcctgcactgctcacctgggtttactgatgactcctggctgccccaccatcctctctgatctgtgagaaacagctaagctgctgtgacttccctttaggacaatgttgtgtaaatctttgaaggacacaccgaagacctttatactgtgatcttttacccctttcactcttggctttcttatgttgctttcatgaatggaatggaaaaaagatgactcagttaaggcaccagccatatgtgtattcttgatggtctatatcggggtgtgagcagatgtttgcgtatttcttgtgggtgtgactggatattagacatccggacaagtgactgaactaatgatctgctgaataatgaaggaggaatagacaccccagtccccaccctacgtgcacccgctctgcaagttcccatgtgatctgtagaccaggggaaattacactgcggtcaagggcagagcctgcacatgacagcaagtgagcatttgatagatgctcagatgctagtgcagagagcctgctgggagacgaagagacagcaggcagagctccagatgggcaaggaagaggcttggttctagcctggctctgcccctcactgcagtggatccagtggggcagaggacagagggtcacaaccaatgagggatgtctgccaaggatgggggtgcagaggccacaggagtcagcttgccactcgcccattggttacatagatgatctctcagacaggctgggactcagagttatttcctagtatcggtgtgccccatccagttttaagtggagccctccaagactctccagagctgcctttgaacatcctaacagtaatcacatctcaccctccctgaggttcactttagacaggacccaatggctgcactgcctttgtcagagggggtgctgagaggagtggcttcttttagaatcaaacagtagagacaagagtcaagccttgtgtcttcaagcattgaccaagttaagtgtttccttccctctctcaataagacacttccaggagctttccaatctctcacttaaaactaaggtttgaatctcaaagtgttgctgggaggctgatactcctgcaacttcaggagacctgtgagcacacattagcagctgtttctctgactccttgtggcatcagataaaaacgtgggagtttttccatataattcccagccttacttataaattctattctttgaaaaaattattcaggctaggtaaggtggctcatacctataatcccagccctttgagaggccaaggtgggagaattgcttgaggccaggagtttgagacctcctgggcaacatagtgagatcccatctctacaaaaaacaaaacaaaaaaattacccaagcatgatggtatatgcctgtagtcgtacctacttacttaggaggctgaggcaggaggatcacttgagccctggaggttggggctgcagtgagccatgatcgcatcactatactcgagcctgggcaacagagtgagaccttgtctcttaaaaaaattaataataaataaatgaaaata

SEQ ID NO: 34980 - DNA, 2113 bp, Homo sapiens
  misc_feature (22)..(22): n is a, c, g, or t
  misc_feature (26)..(26): n is a, c, g, or t
  misc_feature (95)..(95): n is a, c, g, or t
  misc_feature (98)..(98): n is a, c, g, or t
  misc_feature (101)..(102): n is a, c, g, or t
  misc_feature (108)..(108): n is a, c, g, or t
  misc_feature (130)..(130): n is a, c, g, or t
  misc_feature (212)..(212): n is a, c, g, or t
  misc_feature (267)..(267): n is a, c, g, or t
gggacccatccataaacagccnaaangaggtgtcagagtgagaagatgcataagctcacagtccacagcagagagcgagtttcaaacatgcatcnagnatnncagccntgatttcgcaggctcacgtgangcctcgggaagccccgaggagtcaaactccgatattctcctcgagtgctggaactgcagagacagagacacaagcagacatncagtgagccaggcatggtgtgcctatctctgagagaagtcagtaatcctgaaagncagtaaagatgatgattcttttgatcggaaatcagtgtaccgaggctcgctgacacagagaaaccccaacgcgaggaaaggaatggccagccacaccttcgcgaaacctgtggtggcccaccagtcctaacgggacaggacagagagacagagcagccctgcactgttttccctccaccacagccatcctgtccctcattggctctgtgctttccactatacacagtcaccgtcccaatgagaaacaagaaggagcaccctccacatggactcccacctgcaagtggacagcgacattcagtcctgcactgctcacctgggtttactgatgactcctggctgccccaccatcctctctgatctgtgagaaacagctaagctgctgtgacttccctttaggacaatgttgtgtaaatctttgaaggacacaccgaagacctttatactgtgatcttttacccctttcactcttggctttcttatgttgctttcatgaatggaatggaaaaaagatgactcagttaaggcaccagccatatgtgtattcttgatggtctatatcggggtgtgagcagatgtttgcgtatttcttgtgggtgtgactggatattagacatccggacaagtgactgaactaatgatctgctgaataatgaaggaggaatagacaccccagtccccaccctacgtgcacccgctctgcaagttcccatgtgatctgtagaccaggggaaattacactgcggtcaagggcagagcctgcacatgacagcaagtgagcatttgatagatgctcagatgctagtgcagagagcctgctgggagacgaagagacagcaggcagagctccagatgggcaaggaagaggcttggttctagcctggctctgcccctcactgcagtggatccagtggggcagaggacagagggtcacaaccaatgagggatgtctgccaaggatgggggtgcagaggccacaggagtcagcttgccactcgcccattggttacatagatgatctctcagacaggctgggactcagagttatttcctagtatcggtgtgccccatccagttttaagtggagccctccaagactctccagagctgcctttgaacatcctaacagtaatcacatctcaccctccctgaggttcactttagacaggacccaatggctgcactgcctttgtcagagggggtgctgagaggagtggcttcttttagaatcaaacagtagagacaagagtcaagccttgtgtcttcaagcattgaccaagttaagtgtttccttccctctctcaataagacacttccaggagctttccaatctctcacttaaaactaaggtttgaatctcaaagtgttgctgggaggctgatactcctgcaacttcaggagacctgtgagcacacattagcagctgtttctctgactccttgtggcatcagataaaaacgtgggagtttttccatataattcccagccttacttataaattctattctttgaaaaaattattcaggctaggtaaggtggctcatacctataatcccagccctttgagaggccaaggtgggagaattgcttgaggccaggagtttgagacctcctgggcaacatagtgagatcccatctctacaaaaaacaaaacaaaaaaattacccaagcatgatggtatatgcctgtagtcgtacctacttacttaggaggctgaggcaggaggatcacttgagccctggaggttggggctgcagtgagccatgatcgcatcactatactcgagcctgggcaacagagtgagaccttgtctcttaaaaaaattaataataaataaatgaaaata

SEQ ID NO: 34981 - DNA, 2312 bp, Homo sapiens
cgctagtagaggcggggtgaatcggacgaggcggagagccaggcgctaaccagccgctctgcgccccgcgccctgcttgcccccattatccagccttgccccggcgccctgacctgacgccctggcctgacgccctgcttcgtcgcctcctttctctcccaggtgctggaccagggactgagcgtcccccggagagggtccggtgtgaccccgacaagaagcagaaatggggaagaaactggatctttccaagctcactgatgaagaggcccagcatgtcttggaagttgttcaacgagattttgacctccgaaggaaagaagaggaacggctagaggcgttgaagggcaagattaagaaggaaagctccaagagggagctgctttccgacactgcccatctgaacgagacccactgcgcccgctgcctgcagccctaccagctgcttgtgaatagcaaaaggcagtgcctggaatgtggcctcttcacctgcaaaagctgtggccgcgtccacccggaggagcagggctggatctgtgacccctgccatctggccagagtcgtgaagatcggctcactggagtggtactatgagcatgtgaaagcccgcttcaagaggttcggaagtgccaaggtcatccggtccctccacgggcggctgcagggtggagctgggcctgaactgatatctgaagagagaagtggagacagcgaccagacagatgaggatggagaacctggctcagaggcccaggcccaggcccagccctttggcagcaaaaaaaagcgcctcctctccgtccacgacttcgacttcgagggagactcagatgactccactcagcctcaaggtcactccctgcacctgtcctcagtccctgaggccagggacagcccacagtccctcacagatgagtcctgctcagagaaggcagcccctcacaaggctgagggcctggaggaggctgatactggggcctctgggtgccactcccatccggaagagcagccgaccagcatctcaccttccagacacggcgccctggctgagctctgcccgcctggaggctcccacaggatggccctggggactgctgctgcactcgggtcgaatgtcatcaggaatgagcagctgcccctgcagtacttggccgatgtggacacctctgatgaggaaagcatccgggctcacgtgatggcctcccaccattccaagcggagaggccgggcgtcttctgagagtcagatctttgagctgaataagcatatttcagctgtggaatgcctgctgacctacctggagaacacagttgtgcctcccttggccaagggtctaggtgctggagtgcgcacggaggccgatgtagaggaggaggccctgaggaggaagctggaggagctgaccagcaacgtcagtgaccaggagacctcgtccgaggaggaggaagccaaggacgaaaaggcagagcccaacagggacaaatcagttgggcctctcccccaggcggacccggaggtgggcacggctgcccatcaaaccaacagacaggaaaaaagcccccaggaccctggggaccccgtccagtacaacaggaccacagatgaggagctgtcagagctggaggacagagtggcagtgacggcctcagaagtccagcaggcagagagcgaggtttcagacattgaatccaggattgcagccctgagggccgcagggctcacggtgaagccctcgggaaagccccggaggaagtcaaacctcccgatatttctccctcgagtggctgggaaacttggcaagagaccagaggacccaaatgcagacccttcaagtgaggccaaggcaatggctgtgccctatcttctgagaagaaagttcagtaattccctgaaaagtcaaggtaaagatgatgattcttttgatcggaaatcagtgtaccgaggctcgctgacacagagaaaccccaacgcgaggaaaggaatggccagccacaccttcgcgaaacctgtggtggcccaccagtcctaacgggacaggacagagagacagagcagccctgcactgttttccctccaccacagccatcctgtccctcattggctctgtgctttccactatacacagtcaccgtcccaatgagaaacaagaaggagcaccctccacatggactcccacctgcaagtggacagcgacattcagtcctgcactgctcacctgggtttactgatgactcctggctgccccaccatcctctctgatctgtgagaaacaaaacgctgccctggtacccctatgtccaggtatagcagtt

SEQ ID NO: 34982 - DNA, 1557 bp, Homo sapiens
cgctagtagaggcggggtgaatcggacgaggcggagagccaggcgctaaccagccgctctgcgccccgcgccctgcttgcccccattatccagccttgccccggcgccctgacctgacgccctggcctgacgccctgcttcgtcgcctcctttctctcccaggtgctggaccagggactgagcgtcccccggagagggtccggtgtgaccccgacaagaagcagaaatggggaagaaactggatctttccaagctcactgatgaagaggcccagcatgtcttggaagttgttcaacgagattttgacctccgaaggaaagaagaggaacggctagaggcgttgaagggcaagattaagaaggaaagctccaagagggagctgctttccgacactgcccatctgaacgagacccactgcgcccgctgcctgcagccctaccagctgcttgtgaatagcaaaaggcagtgcctggaatgtggcctcttcacctgcaaaagctgtggccgcgtccacccggaggagcagggctggatctgtgacccctgccatctggccagagtcgtgaagatcggctcactggagtggtactatgagcatgtgaaagcccgcttcaagaggttcggaagtgccaaggtcatccggtccctccacgggcggctgcagggtggagctgggcctgaactgatatctgaagagagaagtggagacagcgaccagacagatgaggatggagaacctggctcagaggcccaggcccaggcccagccctttggcagcaaaaaaaagcgcctcctctccgtccacgacttcgacttcgagggagactcagatgactccactcagcctcaaggtcactccctgcacctgtcctcagtccctgaggccagggacagcccacagtccctcacagatgagtcctgctcagagaaggcagcccctcacaaggctgagggcctggaggaggctgatactggggcctctgggtgccactcccatccggaagagcagccgaccagcatctcaccttccagacacggcgccctggctgagctctgcccgcctggaggctcccacaggatggccctggggactgctgctgcactcgggtcgaatgtcatcaggaatgagcagctgcccctgcagtacttggccgatgtggacacctctgatgaggaaagcatccgggctcacgtgatggcctcccaccattccaagcggagaggccgggcgtcttctgagagtcagatctttgagctgaataagcatatttcagctgtggaatgcctgctgacctacctggagaacacagttgtgcctcccttggccaaggctgaacgtcattcccgatctttccaccgagggcctctgtgatttgggggctttgtcaggaaagtggagcctcacggaaaagcatactggctaaaacacgcggcttcttcatcgactcaatctaatcatccccttggtgttcgtctgtgagaccccaggcagccagccctgtcgatctgtctcaataggcttcgtccaaatagaaaattaaatgatcatgtgcaata

SEQ ID NO: 34983 - DNA, 2284 bp, Homo sapiens
cgctagtagaggcggggtgaatcggacgaggcggagagccaggcgctaaccagccgctctgcgccccgcgccctgcttgcccccattatccagccttgccccggcgccctgacctgacgccctggcctgacgccctgcttcgtcgcctcctttctctcccaggtgctggaccagggactgagcgtcccccggagagggtccggtgtgaccccgacaagaagcagaaatggggaagaaactggatctttccaagctcactgatgaagaggcccagcatgtcttggaagttgttcaacgagattttgacctccgaaggaaagaagaggaacggctagaggcgttgaagggcaagattaagaaggaaagctccaagagggagctgctttccgacactgcccatctgaacgagacccactgcgcccgctgcctgcagccctaccagctgcttgtgaatagcaaaaggcagtgcctggaatgtggcctcttcacctgcaaaagctgtggccgcgtccacccggaggagcagggctggatctgtgacccctgccatctggccagagtcgtgaagatcggctcactggagtggtactatgagcatgtgaaagcccgcttcaagaggttcggaagtgccaaggtcatccggtccctccacgggcggctgcagggtggagctgggcctgaactgatatctgaagagagaagtggagacagcgaccagacagatgaggatggagaacctggctcagaggcccaggcccaggcccagccctttggcagcaaacccaccatcctctctgatctgtgagaaacagctaagctgctgtgacttccctttaggacaatgttgtgtaaatctttgaaggacacaccgaagacctttatactgtgatcttttacccctttcactcttggctttcttatgttgctttcatgaatggaatggaaaaaagatgactcagttaaggcaccagccatatgtgtattcttgatggtctatatcggggtgtgagcagatgtttgcgtatttcttgtgggtgtgactggatattagacatccggacaagtgactgaactaatgatctgctgaataatgaaggaggaatagacaccccagtccccaccctacgtgcacccgctctgcaagttcccatgtgatctgtagaccaggggaaattacactgcggtcaagggcagagcctgcacatgacagcaagtgagcatttgatagatgctcagatgctagtgcagagagcctgctgggagacgaagagacagcaggcagagctccagatgggcaaggaagaggcttggttctagcctggctctgcccctcactgcagtggatccagtggggcagaggacagagggtcacaaccaatgagggatgtctgccaaggatgggggtgcagaggccacaggagtcagcttgccactcgcccattggttacatagatgatctctcagacaggctgggactcagagttatttcctagtatcggtgtgccccatccagttttaagtggagccctccaagactctccagagctgcctttgaacatcctaacagtaatcacatctcaccctccctgaggttcactttagacaggacccaatggctgcactgcctttgtcagagggggtgctgagaggagtggcttcttttagaatcaaacagtagagacaagagtcaagccttgtgtcttcaagcattgaccaagttaagtgtttccttccctctctcaataagacacttccaggagctttccaatctctcacttaaaactaaggtttgaatctcaaagtgttgctgggaggctgatactcctgcaacttcaggagacctgtgagcacacattagcagctgtttctctgactccttgtggcatcagataaaaacgtgggagtttttccatataattcccagccttacttataaattctattctttgaaaaaattattcaggctaggtaaggtggctcatacctataatcccagccctttgagaggccaaggtgggagaattgcttgaggccaggagtttgagacctcctgggcaacatagtgagatcccatctctacaaaaaacaaaacaaaaaaattacccaagcatgatggtatatgcctgtagtcgtacctacttacttaggaggctgaggcaggaggatcacttgagccctggaggttggggctgcagtgagccatgatcgcatcactatactcgagcctgggcaacagagtgagaccttgtctcttaaaaaaattaataataaataaatgaaaata

SEQ ID NO: 34984 - DNA, 856 bp, Homo sapiens
gtttttttccagatttataatttaatggctgtgcagatcccagtccctcatttctgtcgctcacgtgcccactggtctggggtcagggttttctgttcaaaggcatggatgtgcgggagctcttctgctaggcacgcgttcaccagcctgtgtctctgaagcagcggtttcccctcgaacttggccgacaccaccaggactcggaagctacaggagcaacggttgagggtcgtgtcctccacctccacatgctccgcctccaggtcccgctgcagcttctcgcggaggtattcggcgctgagttccatggcggcagtccagctggaacggcagcccagtccagccttgccccggcgccctgacctgacgccctggcctgacgccctgcttcgtcgcctcctttctctcccaggtgctggaccagggactgagcgtcccccggagagggtccggtgtgaccccgacaagaagcagaaatggggaagaaactggatctttccaagctcactgatgaagaggcccagcatgtcttggaagttgttcaacgagattttgacctccgaaggaaagaagaggaacggctagaggcgttgaagggcaagattaagaaggaaagctccaagagggagctgctttccgacactgcccatctgaacgagacccactgcgcccgctgcctgcagccctaccagctgcttgtgaatagcaaaaggcagtgcctggaatgtggcctcttcacctgcaaaagctgtggccgcgtccacccggaggagcagggctggatctgtgacccctgccatctggccagagtcgtgaagatcgctcactgagcgtggacaatcatgtggaccagcta

SEQ ID NO: 34985 - DNA, 438 bp, Homo sapiens
cacatatacttatcagatacattttcttatctaatgtacataagaggccactgaaatgaactgttatgtccatgcctgaaagttagcatctcagactaggtttctggcttgtataaatataacttgaagtttaaagagttttaagttttggccaggcgcagtggctcacacctgtactcccagcagtttgaggtcccgaggtggatggatcacgaggtcagaaattcaagaccagccaggccaaacatggttgaaaccctatctctactaaaaatacaaaaagttagctgggtgtggtggccagcacctgtaatcccagctactcgggaggctgatgaggcaggagaatcgcttgaacttgggagatggaggtcgcggtgagcggagatcacaccactgcactccagtgggtgataatgcaagactcagtctcaaaaa

SEQ ID NO: 34986 - DNA, 437 bp, Homo sapiens
tggatcatatgtgtattcattctcaacagaaatagaacccataggaaggagggaaagagatgattgatagacagataatagatagataatggataggtagatgatagataatggatagatgattgatagatagatagatagatagatagatagatagatagatagatagattagatagatagatagataggagataggtaggccaggtgcggtggctcactcctgtaatcccagcactttgggaggttgagataggtggatcacttaagggagttcaagaccagcctgaccaacatggcgaaaccccatgtctaccaaaataagttagccaggcatggtggtgcatgcctgtaatcccagtttcttgggaggctgaggcacgagaatcacttgaacctggggggcagaggctgcagtgagctgagatggtgccactg

SEQ ID NO: 34987 - DNA, 439 bp, Homo sapiens
agctcactgcaacctccacttcccaagtttaagcgattctccctgcctcggcctcccgagtagctgggattacaggtgcctgccaccacgattggctaatttttgtattttttagtagagacagggtttcgccatgttggccaggctggtcttgaactcctgacctcaggtgatccgcccacttcggcctcccaaagtgctgggattacaggtgtgagccactgcatccagccaggtttgtgtctttaggtactaaaaaatgttataacggcctattccttagttggttcacatagttctttgagatcttgttccttcttggcctcatctctttattctgtccagtgtctttcctggactcattgaggtcagagtgaaatttctgttcctatgaaagttattctttttgtcacctctgatcctttgaccgtggtagtcc

SEQ ID NO: 34988 - DNA, 348 bp, Homo sapiens
aatttgggccctcgaggcccaagaattcggcacgaggtgagaaagcagttcaatgaatctctccatcaggtttcagtgagtgtgtcagttattaaactattgcctctcagcatcaaagccacatggccatattcaacattgggatgctaaggctggggacagagagccaaatcatataattccacccctggctccttccaaatcttatgtccttctcatatttcaaaacgcaatcatgccttctcaacagtccccctattcttaactcattccagtattaactcaaaagtccaaatccaaaggctcatctgagacaagggcaagtcccttcttcctatggagcctgta

SEQ ID NO: 34989 - DNA, 569 bp, Homo sapiens
  misc_feature (549)..(549): n is a, c, g, or t
aggagtagaagtgagatgttaagatcttatggcactaaagacttactattctgttcctacatactctgttaggatcagatagatgttatagaaatgccttttgtttctcctgcccttcttgatgtcacagttttttgtacttccagctgtctaaaggcatgaatctcctcttggagcattctcccagacccttctttagaagagtctatactaagttcttggtgccctcttcggcagccaagggtgaaggccccatagaggagaggatccaaaggagcattgaggaggcccaagaggaaaaggatgtggctcaggctgggagggacttcagttagcatggtgggggagaaccagtaccacatacccagtaggtaataaggtgtccagcagaggatgaaggtcagcaagataagcagggccagtctcagggcccggagacgaacacggggacaattgtcaaaggagcgggggagggcaaattcaccagcaggggctaggaatttagaaaatatactgtaattcagacactcagcttctgatctgagtaangatcctgtagatcacctcag

SEQ ID NO: 34990 - DNA, 390 bp, Homo sapiens
tgtatccccaacacctagtttgttgcccagcacatagcacaaactgcagattccaagacttactacatttaataagttctacttcttccacactaagaactaaggtcctttctgagcacatgattggaaagtagataaaaagtagtaaagatagaaactctcaggtgggaagttgtccacattacttcatttgcaagtgagggacactgtggattcttgacttttctgtttcgcagaaaggtctttgggcatttctaaagaatatttgaaaattgaagtgtggagataaaactataaaacctttagaagaagatacaggagtaaatcttcataaccctggattatgcagtggtttcttagatatgacaccaaaagcacaagcaacaacaa

SEQ ID NO: 34991 - DNA, 532 bp, Homo sapiens
ccacgcgtccgaagaaaagttactcttatatagggttaaaattgccattcgtagctattcttgctatatttggtttctcatttaaaatttgaaagtaattttcaaggatcctagaaatcaaaagaaaaattaatatttttaaaaaatgtctatgaaaaataatttactctttagtaaacagtatttttctggagttgctatgataacttgaattattccattgcaggagataagtggctctgagctgtgctttccaagtgggcagaaaataaaatctgcttatcttccccaaaggcaaattcacataccagctgtttttcagtctcctgctcattataagcagactttcacatcttgcctcataggtatggctgttgtgtttttattgtatcatgattgctgcttcatgtaagtagtaaaattgtgagaatttaatacattatattgtgaattttcatactaaataccttatttttcatatgttctagtttttgacagtaacttttattctaatttcagatcaaaactgagt

SEQ ID NO: 34992 - DNA, 122 bp, Homo sapiens
agaaaatacatgattatagcccaacttattctacctgataaactctgaattatgggtcacataaaccattttagaggggtagttttaaaccaattaaatttattctaaatttaatgtgttat

SEQ ID NO: 34993 - DNA, 300 bp, Homo sapiens
tggggataattgcttgaaatgtttgtgtgtattttgaggatttgttgtaattgaatttaattgagtgctttgcaaaatcatttgtcatgattttaggcttggtatgcatagatatttaaattcgggggcatgtctcaaattatttacagaagagattgaaacttgaaataatgtaagttatgatttttactttatcttttcctcactttcagtattcttcacatgaggatgtatatacttttgttataaaagtagtcttgttcacagaggcatatttaaaacatatgtaccggtaaaaaa

SEQ ID NO: 34994 - DNA, 769 bp, Homo sapiens
attcccagggaagatgttttttgttgtggttagttggtttttggttttgttttgtttttgcactctccagaggagcctctggagggagcatgccctctttttggtaattaaccctttagcagctggcgaggccgctttgctgggggttgaagatagtcatagaggagggaaaaggggtgacggttttggaagcatctgcccacacctacaatgggcttaagcacaacttgctttctgttttcctgagttggcatggaggaattttttttttgtcactattgcattggtatgtgagttttctttggacaaactagcctccgatgaagtatgactttgtgggatacctttgtccatgggaaagagtgttgcataggaaaattgttcaagtctttgttctagttctcttattcagccacatctcttgtacattatccattacttgtgaattcttgcaagaaaaagatcagtctcaattcttgctttttgttttacttctatggaaactgaggcacagagcttcaaatgacatgcacattctcacagaggaactgagaatgggaacattatcatccaaaatgcctgcggaatgactggctgggtatgaaattgtgttgactgctagtcacagagcatattggtggacacagccctgactcctttagtgtagcaatgggaaagaagggaggaggagggaagggggtgaagcaaagaggagctggaactctgtctctgtccctaccgccccccccgccccaccacctatgtttaa

SEQ ID NO: 34995 - DNA, 369 bp, Homo sapiens
gatctttatgatctttcatcacattttgaaaagtatggttccactgaacctaagcagtaggtttgtattcaagaatacgaagaagtggccgggcgcggtggctcacgcctgtcatcccagcactttgggaggctgaggcaggcggatcatgaagtcaggagattgagaccatcctggctaacatggtgaaaccctgtctctactaagtatacaaaaaaagtagccgggcgtggtggtgggtgcctgtagtcccagctactcgggaggctgaggcaggagaatgggcctgaacccgggaggcggagcttgcagtgagccgagattgcaccactgcactccagcctgggcaacagagcgagactccatctc

SEQ ID NO: 34996 - DNA, 1393 bp, Homo sapiens
ctttaagtgaaaaggtgaaagttcttggcttagtaaggagataaaatacattatgtgccgagattgctaagatctgtgagaacaaatcgtctatgaaattgtgaagaaggaaaaacaaatttgtgctagttttgctgtcacacctcaaactgcaaaagttacagtcacagtgcataagtgcttggttaagacaggaaaagcattaaatttgtgggtggaagacatgaacagaaatgtgttccaattaatggcaattgggttcagtactgtctgtggtttcagggatccactaggggtcttggaacatatcccccacacataagagggcactactgcattgcttagaagcaagtcacaggtcctcctcacatttaaggggatggggtcatacaaggatgtgaaaaccaagattagaacataatggaggccaccttaagaatctattcactggcattttaaggaagtcctgggagtgatgtcaccaatatggcatagtagatctacaagccttaatctccccataaaaaaatatagatagccattcacaaaccagaatagccctgatagtgctcaaggatctatttaagaatctaccacaacacactggagaaaaaaaagaagaatatccacagaaaggattgctgttgaaattggcatacttgaggcaccaggagatggttaggaacgaagaaatgcagaggatattggtatcagctgtacaggtgaactgctgtggttcccaggagcctgctttgcagaggacagtggcatcttttgcaacagaggtaaccaacagccattcctgtccaggaaccccatagagggagatgtggctgcacactcccataacccctaagaatcagttgctcttgtgctgttctgggactggagctgccacatttcccatccctgtgcatgcccccaacctctgagctgtggctgttccacaagtgcccacattcctgaccccttctctgagggtttattctgtgtacccatgtctcatacaccagaaccatagcaagctagatcatgtgtgggtcccagagccaaggtctctccgtgcatgcctgtgctctgggtacaaacttagctgccatagagagctagctggcatccctaacgctgcagccactgtagctctattcatgcccatagtcctgtcccaggttccctggcttacccattacttcataagcaccaacatgcaagtgggggtgccttcatcccagcaccaatgccattaatgccttggatcccagagccatagtccctctgctcatgctcatacttcaagacttggctctatggctgctttacatgccactcatcagacacctgtaccactgccactgtgagcaggcccacaagccagaccttgtgccaaaagaga

SEQ ID NO: 34997 - DNA, 1602 bp, Homo sapiens
cggggagagcgcgcatgcctggtccggtggagggagggtgccgggcgtcacaggtcctgacagggaagaagttggcaggtcctggcaggggacgagctgcggcggtggcacctccgggtgtggaaggctccagtgagatggagtcgcgagtcgcggacgctgggaccggcgagaccgcgcgagcagcgggcgggagtccggcagttggctgcaccactcgggggcccgtagtctcggcgcccctgggagccgcccggtggaagctcctgcggcaggttctgaagcaaaaacacctggatgattgcctgcgacatgtatctgtaagaagatttgaatcatttaatctgttttcagtaacagaaggcaaagaaagggaaactgaagaggaggttggtgcatgggtccaatatacaagcatcttctgtcctgaatacagtatctccttaaggcataatagtggatccttgaatgttgaagatgtccttaccagctttgacaatacaggaaatgtttgcatctggccatctgaagaggttttggcttactactgcctcaagcacaataatatattcagggcccttgctgtgtgtgagctagggggtggcatgacatgcttggctgggctcatggttgctatttctgcagatgtcaaagaagttctgttaactgatgggaatgaaaaggccatcagaaatgtgcaagacatcatcacaaggaatcagaaggctggtgtgtttaagacccagaaaatatcaagctgcgttttacgatgggataatgagacagatgtctctcaactggaaggacattttgacattgttatgtgtgctgactgcctgtttctggaccagtacagagccagccttgttgatgcaataaagagattactccagcccagggggaaagcgatggtatttgccccacgccgagggaatactttaaaccagttttgcaatctagctgaaaaagctggtttctgtatccaaagacatgaaaattatgatgaacacatttcaaacttccactccaagttgaaaaaggaaaacccggacatatatgaagaaaaccttcattacccgcttctgcttattttgaccaaacatggatagaagattaagcttctcaaagacgaagaaacgtatcaagtgcatagggaatatttttacaaaaacggaaatctgtaaggggtataatcgcctgcctgcgccctttgcagcatttcacgtgtgggctatggactccacctgtcctcacccacgttattccccagctgccctctccagctccctccccgcctctttttacactctgcttgttgctcgtcctgccctaaacctttgtttgtctttaaatgtgtataagctgcctgtctgtgacttgaatttgactggtgaacaaactaaatatttttccctgtaattgagacagaatttcttttgatgatacccatccctccttcattttttttttttttttggtctttgttctgttttggtggtggtagtttttaatcagtaaacccagcaaatatcatgattctttcctggttagaaaaataaataaagtgtatctttttatctccctccaattaattgtattaaa

SEQ ID NO: 34998 - DNA, 805 bp, Homo sapiens
cggggagagcgcgcatgcctggtccggtggagggagggtgccgggcgtcacaggtcctgacagggaagaagttggcaggtcctggcaggggacgagctgcggcggtggcacctccgggtgtggaaggctccagtgagatggagtcgcgagtcgcggacgctgggaccggcgagaccgcgcgagcagcgggcgggagtccggcagttggctgcaccactcgggggcccgtagtctcggcgcccctgggagccgcccggtggaagctcctgcggcaggttctgaagcaaaaacacctggatgattgcctgcgacatgtatctgtaagaagatttgaatcatttaatctgttttcagtaacagaaggcaaagaaagggaaactgaagaggaggttggtgcatgggtccaatatacaagcatcttctgtcctgaatacagtatctccttaaggcataatagtggatccttgaatgttgaagatgtccttaccagctttgacaatacaggaaatgtttgggaagcaaccaggggaaaatgaagatatcaccatcagtagtaactcttccttttttgtttaaatggtaaatatgcctggggagatgggacttataagaaatcatagcagaaatcctcatgctaaatgtttttcttttccttcttttctgggagatcattaatcagctatcctattttcctattttacgatttctccttctccagcccaattatgttttctacaaagctagtgtctgggatactaactcttaactcattcaagcaagcttctcggctatatcattcaataaa

SEQ ID NO: 34999 - DNA, 1077 bp, Homo sapiens
cggggagagcgcgcatgcctggtccggtggagggagggtgccgggcgtcacaggtcctgacagggaagaagttggcaggtcctggcaggggacgagctgcggcggtggcacctccgggtgtggaaggctccagtgagatggagtcgcgagtcgcggacgctgggaccggcgagaccgcgcgagcagcgggcgggagtccggcagttggctgcaccactcgggggcccgtagtctcggcgcccctgggagccgcccggtggaagctcctgcggcaggttctgaagcaaaaacacctggatgattgcctgcgacatgtatctgtaagaagatttgaatcatttaatctgttttcagtaacagaaggcaaagaaagggaaactgaagaggaggttggtgcatgggtccaatatacaagcatcttctgtcctgaatacagtatctccttaaggcataatagtggatccttgaatgttgaagatgtccttaccagctttgacaatacaggaaatgtttaaaggtttaagactttggaatgatactcacctgcatttgacttctggctctgaaattcatcttgagcaatttgtatcatctctatgaacctcaactgttttcatctcttagggctggctgtgttataaagaaagtaacttttcattgcttgaatttcttcgaatgttgtgggaagaaattaagaggaatctcgtacagaatgaatcacgtctgcgtattgatttattgctgtgtgatatacgacccaaccttctttttatatatttatatttactatggtggaaaacaaaccattttgaaagtgcttacctttaactaggaatagccagtatcttcgagaaagcgtatttttgaaacatacttatttgagttaaaattgtgaaatgcatttaaaaattgaaattgaaagtagaactactggagaagttttaaatatttattggaacagaaagagcaatctccacaagtgtttattaagttcctattatgtgctgtcctgcattttcaattctcaaatgatttatcaactttgaagtacaaagtagtaaaacattctttctacac

SEQ ID NO: 35000 - DNA, 990 bp, Homo sapiens
cggggagagcgcgcatgcctggtccggtggagggagggtgccgggcgtcacaggtcctgacagggaagaagttggcaggtcctggcaggggacgagctgcggcggtggcacctccgggtgtggaaggctccagtgagatggagtcgcgagtcgcggacgctgggaccggcgagaccgcgcgagcagcgggcgggagtccggcagttggctgcaccactcgggggcccgtagtctcggcgcccctgggagccgcccggtggaagctcctgcggcaggttctgaagcaaaaacacctggatgattgcctgcgacatgtatctgtaagaagatttgaatcatttaatctgttttcagtaacagaaggcaaagaaagggaaactgaagaggaggttggtgcatgggtccaatatacaagcatcttctgtcctgaatacagtatctccttaaggcataatagtggatccttgaatgttgaagatgtccttaccagctttgacaatacaggaaatgtttacacagggtctcactctgttgcccaggctggagtgcagtggtgatcataactcagtgcagcctcaaactcctgaactgctcatatatttaagaaacacttcgtggcagaagattatgatactcttgcttatttattggcttaaggattaaggatccccaaagtctcagacttcagtaagtaagcctatgtcctacatgatgtctgtaaactccactccctcttagacttacatcctagaacaaagacatagggggcttcttcaactgtggccatacatttttgtcccagacccagcttcattgtgttaaaagtcttggtgttatgtgaagagtgtctttatccatccttccgtcattcagtgtagagttctaggatttttgaaataggatagattcattctgacctgcctgaattgaaagtcatattaaaatgtgggcagggaatcgggaagggaaatgtggagaaaaggaatgtgt

SEQ ID NO: 35001 - DNA, 860 bp, Homo sapiens
cggggagagcgcgcatgcctggtccggtggagggagggtgccgggcgtcacaggtcctgacagggaagaagttggcaggtcctggcaggggacgagctgcggcggtggcacctccgggtgtggaaggctccagtgagatggagtcgcgagtcgcggacgctgggaccggcgagaccgcgcgagcagcgggcgggagtccggcagttggctgcaccactcgggggcccgtagtctcggcgcccctgggagccgcccggtggaagctcctgcggcaggttctgaagcaaaaacacctggatgattgcctgcgacatgtatctgtaagaagatttgaatcatttaatctgttttcagtaacagaaggcaaagaaagggaaactgaagaggaggttggtgcatgggtccaatatacaagcatcttctgtcctgaatacagtatctccttaaggcataatagtggatccttgaatgttgaagatgtccttaccagctttgacaatacaggaaatgtttgggaagcaaccaggggaaaatgaagatatcaccatcagtagtaactcttccttttttgtttaaatggtaaatatgcctggggagatgggacttataagaaaagatgttttggccaaggcatcctacctctgcttgtcttcatgatcttcattacaatcatagcagaaatcctcatgctaaatgtttttcttttccttcttttctgggagatcattaatcagctatcctattttcctattttacgatttctccttctccagcccaattatgttttctacaaagctagtgtctgggatactaactcttaactcattcaagcaagcttctcggctatatcattcaataaa

SEQ ID NO: 35002 - DNA, 1776 bp, Homo sapiens
cggggagagcgcgcatgcctggtccggtggagggagggtgccgggcgtcacaggtcctgacagggaagaagttggcaggtcctggcaggggacgagctgcggcggtggcacctccgggtgtggaaggctccagtgagatggagtcgcgagtcgcggacgctgggaccggcgagaccgcgcgagcagcgggcgggagtccggcagttggctgcaccactcgggggcccgtagtctcggcgcccctgggagccgcccggtggaagctcctgcggcaggttctgaagcaaaaacacctggatgattgcctgcgacatgtatctgtaagaagatttgaatcatttaatctgttttcagtaacagaaggcaaagaaagggaaactgaagaggaggttggtgcatgggtccaatatacaagcatcttctgtcctgaatacagtatctccttaaggcataatagtggatccttgaatgttgaagatgtccttaccagctttgacaatacaggaaatgtttacacagggtctcactctgttgcccaggctggagtgcagtggtgatcataactcagtgcagcctcaaactcctgaactgctcatatatttaagaaacacttcgtggcagaagattatgatactcttgcttatttattggcttaaggattaaggatccccaaagtctcagacttcagcatctggccatctgaagaggttttggcttactactgcctcaagcacaataatatattcagggcccttgctgtgtgtgagctagggggtggcatgacatgcttggctgggctcatggttgctatttctgcagatgtcaaagaagttctgttaactgatgggaatgaaaaggccatcagaaatgtgcaagacatcatcacaaggaatcagaaggctggtgtgtttaagacccagaaaatatcaagctgcgttttacgatgggataatgagacagatgtctctcaactggaaggacattttgacattgttatgtgtgctgactgcctgtttctggaccagtacagagccagccttgttgatgcaataaagagattactccagcccagggggaaagcgatggtatttgccccacgccgagggaatactttaaaccagttttgcaatctagctgaaaaagctggtttctgtatccaaagacatgaaaattatgatgaacacatttcaaacttccactccaagttgaaaaaggaaaacccggacatatatgaagaaaaccttcattacccgcttctgcttattttgaccaaacatggatagaagattaagcttctcaaagacgaagaaacgtatcaagtgcatagggaatatttttacaaaaacggaaatctgtaaggggtataatcgcctgcctgcgccctttgcagcatttcacgtgtgggctatggactccacctgtcctcacccacgttattccccagctgccctctccagctccctccccgcctctttttacactctgcttgttgctcgtcctgccctaaacctttgtttgtctttaaatgtgtataagctgcctgtctgtgacttgaatttgactggtgaacaaactaaatatttttccctgtaattgagacagaatttcttttgatgatacccatccctccttcattttttttttttttttggtctttgttctgttttggtggtggtagtttttaatcagtaaacccagcaaatatcatgattctttcctggttagaaaaataaataaagtgtatctttttatctccctccaattaattgtattaaa

SEQ ID NO: 35003 - DNA, 1874 bp, Homo sapiens
cggggagagcgcgcatgcctggtccggtggagggagggtgccgggcgtcacaggtcctgacagggaagaagttggcaggtcctggcaggggacgagctgcggcggtggcacctccgggtgtggaaggctccagtgagatggagtcgcgagtcgcggacgctgggaccggcgagaccgcgcgagcagcgggcgggagtccggcagttggctgcaccactcgggggcccgtagtctcggcgcccctgggagccgcccggtggaagctcctgcggcaggttctgaagcaaaaacacctggatgattgcctgcgacatgtatctgtaagaagatttgaatcatttaatctgttttcagtaacagaaggcaaagaaagggaaactgaagaggaggttggtgcatgggtccaatatacaagcatcttctgtcctgaatacagtatctccttaaggcataatagtggatccttgaatgttgaagatgtccttaccagctttgacaatacaggaaatgtttgtcttcatcctcatcatcttaccattgaataggctgaggtgaaggaggcggaaaaggaggagtttgtcttgctgtcagaggcggaagaaaatccatgtacacagggtctcactctgttgcccaggctggagtgcagtggtgatcataactcagtgcagcctcaaactcctgaactgctcatatatttaagaaacacttcgtggcagaagattatgatactcttgcttatttattggcttaaggattaaggatccccaaagtctcagacttcagcatctggccatctgaagaggttttggcttactactgcctcaagcacaataatatattcagggcccttgctgtgtgtgagctagggggtggcatgacatgcttggctgggctcatggttgctatttctgcagatgtcaaagaagttctgttaactgatgggaatgaaaaggccatcagaaatgtgcaagacatcatcacaaggaatcagaaggctggtgtgtttaagacccagaaaatatcaagctgcgttttacgatgggataatgagacagatgtctctcaactggaaggacattttgacattgttatgtgtgctgactgcctgtttctggaccagtacagagccagccttgttgatgcaataaagagattactccagcccagggggaaagcgatggtatttgccccacgccgagggaatactttaaaccagttttgcaatctagctgaaaaagctggtttctgtatccaaagacatgaaaattatgatgaacacatttcaaacttccactccaagttgaaaaaggaaaacccggacatatatgaagaaaaccttcattacccgcttctgcttattttgaccaaacatggatagaagattaagcttctcaaagacgaagaaacgtatcaagtgcatagggaatatttttacaaaaacggaaatctgtaaggggtataatcgcctgcctgcgccctttgcagcatttcacgtgtgggctatggactccacctgtcctcacccacgttattccccagctgccctctccagctccctccccgcctctttttacactctgcttgttgctcgtcctgccctaaacctttgtttgtctttaaatgtgtataagctgcctgtctgtgacttgaatttgactggtgaacaaactaaatatttttccctgtaattgagacagaatttcttttgatgatacccatccctccttcattttttttttttttttggtctttgttctgttttggtggtggtagtttttaatcagtaaacccagcaaatatcatgattctttcctggttagaaaaataaataaagtgtatctttttatctccctccaattaattgtattaaa

SEQ ID NO: 35004 - DNA, 1184 bp, Homo sapiens
cggggagagcgcgcatgcctggtccggtggagggagggtgccgggcgtcacaggtcctgacagggaagaagttggcaggtcctggcaggggacgagctgcggcggtggcacctccgggtgtggaaggctccagtgagatggagtcgcgagtcgcggacgctgggaccggcgagaccgcgcgagcagcgggcgggagtccggcagttggctgcaccactcgggggcccgtagtctcggcgcccctgggagccgcccggtggaagctcctgcggcaggttctgaagcaaaaacacctggatgattgcctgcgacatgtatctgtaagaagatttgaatcatttaatctgttttcagtaacagaaggcaaagaaagggaaactgaagaggaggttggtgcatgggtccaatatacaagcatcttctgtcctgaatacagtatctccttaaggcataatagtggatccttgaatgttgaagatgtccttaccagctttgacaatacaggaaatgtttgtcttcatcctcatcatcttaccattgaataggctgaggtgaaggaggcggaaaaggaggagtttgtcttgctgtcagaggcggaagaaaatccatgtacacagggtctcactctgttgcccaggctggagtgcagtggtgatcataactcagtgcagcctcaaactcctgaactgctcatatatttaagaaacacttcgtggcagaagattatgatactcttgcttatttattggcttaaggattaaggatccccaaagtctcagacttcagcatctggccatctgaagaggttttggcttactactgcctcaagcacaataatatattcaggtacagagctgcacttaagatattttttagcccatcacggatattgaatcaacatattaaaaattgccatgattatattcttcaaattaaattgttagaaaaaaatataagaaaagaaaaacaggaagaaaaggaaaacagaaagaggggaaaaagttcacagtgaacacatgttgcttctcaagtgaaatctgaattgccttgggtactaatattgcacagcaaggtttttgctatatgtcaaaggcttttgatttccactcaaggcattttatttcactttgatttgggggaaacaaaagtgaagctccaatcaatccttactgattgtgaaggtc

SEQ ID NO: 35005 - DNA, 1088 bp, Homo sapiens
cggggagagcgcgcatgcctggtccggtggagggagggtgccgggcgtcacaggtcctgacagggaagaagttggcaggtcctggcaggggacgagctgcggcggtggcacctccgggtgtggaaggctccagtgagatggagtcgcgagtcgcggacgctgggaccggcgagaccgcgcgagcagcgggcgggagtccggcagttggctgcaccactcgggggcccgtagtctcggcgcccctgggagccgcccggtggaagctcctgcggcaggttctgaagcaaaaacacctggatgattgcctgcgacatgtatctgtaagaagatttgaatcatttaatctgttttcagtaacagaaggcaaagaaagggaaactgaagaggaggttggtgcatgggtccaatatacaagcatcttctgtcctgaatacagtatctccttaaggcataatagtggatccttgaatgttgaagatgtccttaccagctttgacaatacaggaaatgtttgtcttcatcctcatcatcttaccattgaataggctgaggtgaaggaggcggaaaaggaggagtttgtcttgctgtcagaggcggaagaaaatccatgtacacagggtctcactctgttgcccaggctggagtgcagtggtgatcataactcagtgcagcctcaaactcctgaactgctcatatatttaagaaacacttcgtggcagaagattatgatactcttgcttatttattggcttaaggattaaggatccccaaagtctcagacttcagtaagtaagcctatgtcctacatgatgtctgtaaactccactccctcttagacttacatcctagaacaaagacatagggggcttcttcaactgtggccatacatttttgtcccagacccagcttcattgtgttaaaagtcttggtgttatgtgaagagtgtctttatccatccttccgtcattcagtgtagagttctaggatttttgaaataggatagattcattctgacctgcctgaattgaaagtcatattaaaatgtgggcagggaatcgggaagggaaatgtggagaaaaggaatgtgt

SEQ ID NO: 35006 - DNA, 704 bp, Homo sapiens
cggggagagcgcgcatgcctggtccggtggagggagggtgccgggcgtcacaggtcctgacagggaagaagttggcaggtcctggcaggggacgagctgcggcggtggcacctccgggtgtggaaggctccagtgagatggagtcgcgagtcgcggacgctgggaccggcgagaccgcgcgagcagcgggcgggagtccggcagttggctgcaccactcgggggcccgtagtctcggcgcccctgggagccgcccggtggaagctcctgcggcaggttctgaagcaaaaacacctggatgattgcctgcgacatgtatctgtaagaagatttgaatcatttaatctgttttcagtaacagaaggcaaagaaagggaaactgaagaggaggttggtgcatgggtccaatatacaagcatcttctgtcctgaatacagtatctccttaaggcataatagtggatccttgaatgttgaagatgtccttaccagctttgacaatacaggaaatgtttaaaggtttaagactttggaatgatactcacctgcatttgacttctggctctgaaattcatcttgagcaatttgtatcatctctatgaacctcaactgttttcatctcttagggctggctgtgttataaagaaagtacgtacatactgcatggctgagagttgatatgcaataaaagttattaattattact

SEQ ID NO: 35007 - DNA, 660 bp, Homo sapiens
aactatagattctagaagcaccaggagaagtgatgcccttgtgctcctctcactctccattagattagagggtcaccctgagagtcaacactggaacctctgttaaagctgcttcagaaaaaccaagtatctttacaactattctaagcagcacaagttggttgtgaattatagttaacaccatctttccttgtttcaaatctcatgttagtgcatctgattagttaaaccaaaatcacatctgaaactttggctgctaaggattccaggaaatacagcttctagctttccaactctataaaatagaaagtaacagaaggcaaagaaagggaaactgaagaggaggttggtgcatgggtccaatatacaagcatcttctgtcctgaatacagtatctccttaaggcataatagtggatccttgaatgttgaagatgtccttaccagctttgacaatacaggaaatgtttaaaggtttaagactttggaatgatactcacctgcatttgacttctggctctgaaattcatcttgagcaatttgtatcatctctatgaacctcaactgttttcatctcttagggctggctgtgttataaagaaagtacgtacatactgcatggctgagagttgatatgcaataaaagttattaattattact

SEQ ID NO: 35008 - DNA, 840 bp, Homo sapiens
cggggagagcgcgcatgcctggtccggtggagggagggtgccgggcgtcacaggtcctgacagggaagaagttggcaggtcctggcaggggacgagctgcggcggtggcacctccgggtgtggaaggctccagtgagatggagtcgcgagtcgcggacgctgggaccggcgagaccgcgcgagcagcgggcgggagtccggcagttggctgcaccactcgggggcccgtagtctcggcgcccctgggagccgcccggtggaagctcctgcggcaggttctgaagcaaaaacacctggatgattgcctgcgacatgtatctgtaagaagatttgaatcatttaatctgttttcagtaacagaaggcaaagaaagggaaactgaagaggaggttggtgcatgggtccaatatacaagcatcttctgtcctgaatacagtatctccttaaggcataatagtggatccttgaatgttgaagatgtccttaccagctttgacaatacaggaaatgtttacacagggtctcactctgttgcccaggctggagtgcagtggtgatcataactcagtgcagcctcaaactcctgaactgctcatatatttaagaaacacttcgtggcagaagattatgatactcttgcttatttattggcttaaggattaaggatccccaaagtctcagacttcatcagttaccaagatctattgaccatctatccactcttttctgaaccaaaggcatactctaaaagcttgcagtgactggatgagtcaaattctgtcacttcctctttacaagttgttttgtaatgattaaaccagtgatacattgtatcataca

SEQ ID NO: 35009 - DNA, 925 bp, Homo sapiens
ggttcatggttattaaacatctttttcttgtcttcgtagagaggtttgggggtgagtgaaatgcctgtagatgtgagtgttggtctccatgtttatctgccacatttgtagaaaggtgtgtgtgtgtgcgtgtgtatgtgcatgcgtgtgtgtgtgcattcatacatccactcttacctcggcacccagaggatatgcatctactgttagctgtttgggatatttacttttcatctttttcatttagtcatttaagaatacttacaaatagtgcacagacactctctcattagatttaatgagtattgatttatttctctccactgaattagtgctgtaatgaattttttttaagccaggtatggtggctcatgcctgtagtcccagctactcggaggctgaggcgggaggattgcctgggcctgggagtcagaggctgcagtgagccaggagcaagcctgtgaatagccactgcagtgcagtgggcagtgtggaatagaccccatttcaattaaacaacaaaaaaataacaacagataaaaccaagaaaaaaaagagaaacgcttttttccattgatgatggttttagagcgtggagcctcttggttcctgtgtcggcttcctgaagggttgtaccagttgtcgtgggacggttgctgatggccatgtccttcctgtcattcttagtgaagtggagcagtggccacgagctcatgagcccacacgtgtctccccgtgggaatgcatgattgctgaagtgtctgcgcagacctgtgtgcatgcccgtgtctatgcccggcccgggcacagcagatgtggtctggcctcctggcggatgacaacctggccatctagcggccttggcttattttgctaggatctgcctcattggctttgtcatctgcctgggcatattggcactcga

SEQ ID NO: 35010 - DNA, 2144 bp, Homo sapiens
ggcacgagggcgtcaccgaccggtgcggacaggaagaggctctgggctggcacatgtgtatggcggtgaggcgggcgggtacatggcgggctctgtgggactggcgttgtgcgggcagacgttggtggtgcggggcggcagccgattcctggccacctccatagcaagcagtgatgatgacagcctcttcatctatgactgcagtgctgcagaaaagaagtcacaagaaaataaaggggaggacgcgcccttggaccaggggagcggtgcgattctggcgtccaccttctccaagtctggcagctattttgctttaaccgatgacagtaagcgtctgattcttttccgtacaaaaccatggcaatgtctgagtgtcaggaccgtggcaaggaggtgtacagccctgactttcatagcctcggaggagaaggtcttggtggccgacaagtctggagacgtctactccttttcggtgctggagccacacgggtgtggccgtctagagctggggcacctgtctatgctgttagatgtggctgtgagtcctgatgaccgcttcatcctcactgccgaccgggacgagaagatccgagtcagctgggccgcggcgccccatagcatcgagtccttctgcttggggcacacagagtttgtgagccgtatctccgtggtgccaactcagcccgggctgcttctgtcctcctctggggacggcaccctgaggctctgggagtacaggagcggccgccagctgcactgctgtcacctggccagtctgcaggagctggtggacccccaggccccccagaagtttgccgcgtccaggattgcattctggtgccaggagaactgcgtggcgctcctgtgcgacggcactcctgtggtctacatcttccagctggacgcccgcagacagcagttggtgtacaggcagcagctggcgttccagcaccaagtgtgggacgtggctttcgaggagacccaggggctgtgggtgctccaggactgccaggaagcccccctggtgctctacaggcctgtgggcgaccagtggcagtctgttcctgagagcaccgtgttaaagaaagtctctggtgttcttcgtgggaactgggccatgctggaaggctctgccggcgcagacgccagcttcagcagtctctacaaggccacgttcgacaacgtgacctcctacctgaagaagaaagaggagagactgcagcagcagctagagaagaagcagcggcgccggagtcccccgcctgggcccgacgggcatgccaagaagatgagaccgggggaggcgacgctaagttgctgatcgtggcggtcagtggtgtctctcacctcaaattaggaaaagctttttaacttgttcccctgcatcctggcatgtcccttcaagaaggaaaaggtgacatcagttgtgaccagctcagaggatggggctgtcccctgggctctagaaagaacattctgtgtcaccagcacaggctcttgctgggtgcctgtgccccctttctggttgaagggaagccagaccagtggagtggaagctcttgaagcactttcttttcatgtcggaggctgcgtgtgagccggtggtggcggcagctgtctgtgtttctcctgttctcataccgcccttcgtgtccgctgcatcttcctctaggagcatctgtgggctgacgtttctggcatggtggatgttttcatgttgttccgccgtctcagcatccaggtgacgtgctgtcccgcagtagctgctcgccacacaggctgttgaaactcagcacgaatgcttgagcctgccccagccccagccgtagcccttgtgctcaggagctgctcctggagagtggctcccttgtgggaagtgagaaacacgtttcggagtcgcagggagctctgtctggcatcggtggcacagatggtgaacttgtttcaggaagtgtgagcacgggcctggctggcacccggtttacagggaggtgattgaggacgtcgttatgatttgatttgaccttggcacacactgcagagccacagggatgttgctgaatttcaatcaccgatcagcaaggatgaaccttctcaacttcctaggaatgtttagcagcaacctaatataccaggcaaaactc

SEQ ID NO: 35011 - DNA, 501 bp, Homo sapiens
tcactccttcaatttaatctgctctcttccgttatttttttagtttctatgtattttacttttaggacattccttggactttgttctacctctttaattgatgaagaaaatttggtcattgtatctggttttttttttgagacagagtgacggtctcaaaaaaaaaaaaaaaaaaaaaaagcacaccagtgtcttccatttctcttttaatcataatcatgctttaaaaaataccctcgagcatatggagcaaatttaagataattgttccttttctgctaattcattattactgtcatatctaggtctgtttctgtcgactgtggaccacttatgtgcgatccgtggaccacttgcgtgcgatctgtcggccgacgatgagcttgttcggatgtagctccatcgtaagtcgaggagcatctgtgatttgtcctctgcttatgggatatgtttttccgctactgagtctgtgtagtaaatttttgactaggaaaaaagtga

SEQ ID NO: 35012 - DNA, 664 bp, Homo sapiens
tcactccttcaatttaatctgctctcttccgttatttttttagtttctatgtattttacttttaggacattccttggactttgttctacctctttaattgatgaagaaaatttggtcattgtatctggttttttttttgagacagagcaagaatctgtcttaaaaaaaaaaaaaattagccaggtgtggtggcacatgcctgtagtcccagctgctcgggaggctgaggcgggaggatcacttgagcctgggagtttgaggctgcagcaagccgtgattgcactactgcattccagcctgggtgacagagtgacggtctcaaaaaaaaaaaaaaaaaaaaaaagcacaccagtgtcttccatttctcttttaatcataatcatgctttaaaaaataccctcgagcatatggagcaaatttaagataattgttccttttctgctaattcattattactgtcatatctaggtctgtttctgtcgactgtggaccacttatgtgcgatccgtggaccacttgcgtgcgatctgtcggccgacgatgagcttgttcggatgtagctccatcgtaagtcgaggagcatctgtgatttgtcctctgcttatgggatatgtttttccgctactgagtctgtgtagtaaatttttgactaggaaaaaagtga

SEQ ID NO: 35013 - DNA, 1525 bp, Homo sapiens
ggcacgagggcgtcaccgaccggtgcggacaggaagaggctctgggctggcacatgtgtatggcggtgaggcgggcgggtacatggcgggctctgtgggactggcgttgtgcgggcagacgttggtggtgcggggcggcagccgattcctggccacctccatagcaagcagtgatgatgacagcctcttcatctatgactgcagtgctgcagaaaagaagtcacaagaaaataaaggggaggacgcgcccttggaccaggggagcggtgcgattctggcgtccaccttctccaagtctggcagctattttgctttaaccgatgacagtaagcgtctgattcttttccgtacaaaaccatggcaatgtctgagtgtcaggaccgtggcaaggaggtgtacagccctgactttcatagcctcggaggagaaggtcttggtggccgacaagtctggagacgtctactccttttcggtgctggagccacacgggtgtggccgtctagagctggggcacctgtctatgctgttagatgtggctgtgagtcctgatgaccgcttcatcctcactgccgaccgggacgagaagatccgagtcagctgggccgcggcgccccatagcatcgagtccttctgcttggggcacacagagtttgtgagccgtatctccgtggtgccaactcagcccgggctgcttctgtcctcctctggggacggcaccctgaggctctgggagtacaggagcggccgccagctgcactgctgtcacctggccagtctgcaggagctggtggacccccaggccccccagaagtttgccgcgtccaggattgcattctggtgccaggagaactgcgtggcgctcctgtgcgacggcactcctgtggtctacatcttccagctggacgcccgcagacagcagttggtgtacaggcagcagctggcgttccagcaccaagtgtgggacgtggctttcgaggagacccaggggctgtgggtgctccaggactgccaggaagcccccctggtgctctacaggcctgtgggcgaccagtggcagtctgttcctgagagcaccgtgttaaagaaagtctctggtgttcttcgtgggaactgggccatgctggaaggctctgccggcgcagacgccagcttcagcagtctctacaaggccacgttcgacaacgtgacctcctacctgaagaagaaagaggagagactgcagcagcagctagagaagaagcagcggcgccggagtcccccgcctgggcccgacgggcatgccaagaagatgagaccgggggaggcgacgctaagttgctgatcgtggcggtctgtttctgtcgactgtggaccacttatgtgcgatccgtggaccacttgcgtgcgatctgtcggccgacgatgagcttgttcggatgtagctccatcgtaagtcgaggagcatctgtgatttgtcctctgcttatgggatatgtttttccgctactgagtctgtgtagtaaatttttgactaggaaaaaagtga

SEQ ID NO: 35014 - DNA, 1255 bp, Homo sapiens
ggcacgagggcgtcaccgaccggtgcggacaggaagaggctctgggctggcacatgtgtatggcggtgaggcgggcgggtacatggcgggctctgtgggactggcgttgtgcgggcagacgttggtggtgcggggcggcagccgattcctggccacctccatagcaagcagtgatgatgacagcctcttcatctatgactgcagtgctgcagaaaagaagtcacaagaaaataaaggggaggacgcgcccttggaccaggggagcggtgcgattctggcgtccaccttctccaagtctggcagctattttgctttaaccgatgacagtaagcgtctgattcttttccgtacaaaaccatggcaatgtctgagtgtcaggtttgtgagccgtatctccgtggtgccaactcagcccgggctgcttctgtcctcctctggggacggcaccctgaggctctgggagtacaggagcggccgccagctgcactgctgtcacctggccagtctgcaggagctggtggacccccaggccccccagaagtttgccgcgtccaggattgcattctggtgccaggagaactgcgtggcgctcctgtgcgacggcactcctgtggtctacatcttccagctggacgcccgcagacagcagttggtgtacaggcagcagctggcgttccagcaccaagtgtgggacgtggctttcgaggagacccaggggctgtgggtgctccaggactgccaggaagcccccctggtgctctacaggcctgtgggcgaccagtggcagtctgttcctgagagcaccgtgttaaagaaagtctctggtgttcttcgtgggaactgggccatgctggaaggctctgccggcgcagacgccagcttcagcagtctctacaaggccacgttcgacaacgtgacctcctacctgaagaagaaagaggagagactgcagcagcagctagagaagaagcagcggcgccggagtcccccgcctgggcccgacgggcatgccaagaagatgagaccgggggaggcgacgctaagttgctgatcgtggcggtctgtttctgtcgactgtggaccacttatgtgcgatccgtggaccacttgcgtgcgatctgtcggccgacgatgagcttgttcggatgtagctccatcgtaagtcgaggagcatctgtgatttgtcctctgcttatgggatatgtttttccgctactgagtctgtgtagtaaatttttgactaggaaaaaagtga

SEQ ID NO: 35015 - DNA, 862 bp, Homo sapiens
ggcacgagggcgtcaccgaccggtgcggacaggaagaggctctgggctggcacatgtgtatggcggtgaggcgggcgggtacatggcgggctctgtgggactggcgttgtgcgggcagacgttggtggtgcggggcggcagccgattcctggccacctccatagcaagcagtgatgatgacagcctcttcatctatgactgcagtgctgcagaaaagaagtcacaagaaaataaaggggaggacgcgcccttggaccaggggagcggtgcgattctggcgtccaccttctccaagtctggcagctattttgctttaaccgatgacagtaagcgtctgattcttttccgtacaaaaccatggcaatgtctgagtgtcaggaccgtggcaaggaggtgtacagccctgactttcatagcctcggaggagaaggtcttggtggccgacaagtctggagacgtctactccttttcggtgctggagccacacgggtgtggccgtctagagctggggcacctgtctatgctgttagatgtggctgtgagtcctgatgaccgcttcatcctcactgccgaccgggacgagaagatccgagtcagctgggccgcggcgccccatagcatcgagtccttctgcttggggcacacagaatggtgaacttgtttcaggaagtgtgagcacgggcctggctggcacccggtttacagggaggtgattgaggacgtcgttatgatttgatttgaccttggcacacactgcagagccacagggatgttgctgaatttcaatcaccgatcagcaaggatgaaccttctcaacttcctaggaatgtttagcagcaacctaatataccaggcaaaactc

SEQ ID NO: 35016 - DNA, 2639 bp, Homo sapiens
ggttcatggttattaaacatctttttcttgtcttcgtagagaggtttgggggtgagtgaaatgcctgtagatgtgagtgttggtctccatgtttatctgccacatttgtagaaaggtgtgtgtgtgtgcgtgtgtatgtgcatgcgtgtgtgtgtgcattcatacatccactcttacctcggcacccagaggatatgcatctactgttagctgtttgggatatttacttttcatctttttcatttagtcatttaagaatacttacaaatagtgcacagacactctctcattagatttaatgagtattgatttatttctctccactgaattagtgctgtaatgaattttttttaagccaggtatggtggtcatggtgcagtagtggctttctccgggcgtgcaagcagagagtgctggcggggtggaggcccagccttggtgccctggtttccattacattctttcatctttgccccgttctgttagtagccagtcctcaggtccagccagggtgtgggtcccaggaggtgggcaccgtggggagccgtcccagaaggcgccccccacggtccaccgaggactctgggagtcacgaggtaactccctgctgcagggggcccgctgtggtggccgagtcccatgttcctgccccacctggcacctgtccttgttcccccatcacaggctctgccggcgcagacgccagcttcagcagtctctacaaggccacgttcgacaacgtgacctcctacctgaagaagaaagaggagagactgcagcagcagctagagaagaagcagcggcgccggagtcccccgcctgggcccgacgggcatgccaagaagatgagaccgggggaggcgacgctaagttgctgatcgtggcggtcagtggtgtctctcacctcaaattaggaaaagctttttaacttgttcccctgcatcctggcatgtcccttcaagaaggaaaaggtgacatcagttgtgaccagctcagaggatggggctgtcccctgggctctagaaagaacattctgtgtcaccagcacaggctcttgctgggtgcctgtgccccctttctggttgaagggaagccagaccagtggagtggaagctcttgaagcactttcttttcatgtcggaggctgcgtgtgagccggtggtggcggcagctgtctgtgtttctcctgttctcataccgcccttcgtgtccgctgcatcttcctctaggagcatctgtgggctgacgtttctggcatggtggatgttttcatgttgttccgccgtctcagcatccaggtgacgtgctgtcccgcagtagctgctcgccacacaggctgttgaaactcagcacgaatgcttgagcctgccccagccccagccgtagcccttgtgctcaggagctgctcctggagagtggctcccttgtgggaagtgagaaacacgtttcggagtcgcagggagctctgtctggcatcggtggcacagatggtgaacttgtttcaggaagtgtgagcacgggcctggctggcacccggtttacagggaggtgattgaggacgtcgttatgatttgatttgaccttggcacacactgcagagccacagggatgttgctgaatttcaatcaccgatcagcaaggatgaaccttctcaacttcctaggaatgtttagcagcaacctaatataccaggcaaaactccttggtgcctgcgctgtgtgtgtgtgaggtgcgcggtgtgattgtgcgctgtgtgtgtgtgaggtgcacgctgcgtgatcgtgtgctgtgtgagtgaggtacgcacctcacaagcaaacacagcgcacgatcacgcggcgcgcaacgaagcgccgctgggtctgggtgcccggaggcagcagcgttcgggagttccgcccgctggccccgatcaccatgtcggctttcgaaacaacccttcgggacccagtggatgtaaaccccttcaggatccctctgtgacccagctgacaacgcccgagggcggctggcggaattcaaccctttctcagagacaaatgcagcgaccacaagtccgtgagaccaactcctgggtctcacagcagcggtctccagcatagtgaaccaacccagcagaccccaaggcccggagtctgcagccaggagccgtgtccggcacaggaaggactggacgggaagctgcgaacttggagcgcgagggagcgggatcgtgcagcacacttgtgagccaacttgacgtgtgaacgatgaacaaagtgggcccctgctgcctcgtggtgccctgcgaggccctgttctatcaggattctgcagagaatcctggcgataccagggggcaaagctcaaaataggcccaaggaacctgaggaagtagcaatccaggaaccaagagtcggcgacacatggctggaagggccgaggacacgataccgcgggaaaacagtccaaagggcagttggacctagggcacctcccgaacacgtgagaagtgaaattacagaccacgtagacacaccctgtgggtgagcagacgcgcaacactagtaggcgcacatgaacaggagcaaggcagacactactgaacgggaaaaacatacactgccagtagcatcgaaggaacacggggccccaagagg

SEQ ID NO: 35017 - DNA, 1047 bp, Homo sapiens
acccaggctgaagtgcagtggtgtgatctcagctcacagcagcctcaacctcccaggctcaagcagtcctcccaccttggcctcccagagtgctgggattacaggcacgagccattatgcccagcccgtctttcttcattttgattacagtgtgcgtactgtacatccgagaagtgcatgtgaaatgctggaactgggatttcagcaactgaatgcacgtgtgtgactacccacgagaagcaggacacttagcacctgctgagaagcccccacgcccatgttcccttctaggcactgcacatgcatgctggccggcctgacctcagtttccctcttgctgtggccgcttctgctccactctctgtgaggctcatccaccttgttgcctgtggttgtggattgttcattctcagtgctctgtatgccaagtactccattgtgtgaaaatcccacagcacgttcattctattatcaatgggcatttgggtagtttccacagtttggctgttaggaatagtgcagtgatgaacatgctggcacctgtcttctgttttttttttatttttagagacagggtcttgctctgttacccaggctggagtgcagtggtgtgaccttggctcgctgggcctgggagtttgaggctgcagcaagccgtgattgcactactgcattccagcctgggtgacagagtgacggtctcaaaaaaaaaaaaaaaaaaaaaaagcacaccagtgtcttccatttctcttttaatcataatcatgctttaaaaaataccctcgagcatatggagcaaatttaagataattgttccttttctgctaattcattattactgtcatatctaggtctgtttctgtcgactgtggaccacttatgtgcgatccgtggaccacttgcgtgcgatctgtcggccgacgatgagcttgttcggatgtagctccatcgtaagtcgaggagcatctgtgatttgtcctctgcttatgggatatgtttttccgctactgagtctgtgtagtaaatttttgactaggaaaaaagtga

SEQ ID NO: 35018 - DNA, 771 bp, Homo sapiens
actcccaaagtgctgggattataggtgtcagccactgcacccaatctattgtatttaattctaagcactttcttccagacggtctcactctgtcacccaggctgaagtgcagtggtgtgatctcagctcacagcagcctcaacctcccaggctcaagcagtcctcccaccttggcctcccagagtgctgggattacaggcacgagccattatgcccagcccgtctttcttcattttgattacagtgtgcgtactgtacatccgagaagtgcatgtgaaatgctggaactgggatttcagcaactgaatgcacgtgtgtgactacccacgagaagcaggacacttagcacctgctgagaagcccccacgcccatgttcccttctaggcactgcacatgcatgctggccggcctgacctcagtttccctcttgctgtggccgcttctgctccactctctgtgaggctcatccaccttgttgcctgtggttgtggattgttcattctcagtgctctgtatgccaagtactccattgtgtgaaaatcccacagcacgttcattctattatcaatgggcatttgggtagtttccacagtttggctgttaggaatagtgcagtgatgaacatgctggcacctgtcttctgttttttttttatttttagagacagggtcttgctctgttacccaggctggagtgcagtggtgtgaccttggctcgctgggcctcctgggctcaagcgatcctcccacctcagtctcctgagtagctgg

SEQ ID NO: 35019 - DNA, 1986 bp, Homo sapiens
ggcacgagggcgtcaccgaccggtgcggacaggaagaggctctgggctggcacatgtgtatggcgtgatgatgacagcctcttcatctatgactgcagtgctgcagaaaagaagtcacaagaaaataaaggggaggacgcgcccttggaccaggggagcggtgcgattctggcgtccaccttctccaagtctggcagctattttgctttaaccgatgacagaccgtggcaaggaggtgtacagccctgactttcatagcctcggaggagaaggtcttggtggccgacaagtctggagacgtctactccttttcggtgctggagccacacgggtgtggccgtctagagctggggcacctgtctatgctgttagatgtggctgtgagtcctgatgaccgcttcatcctcactgccgaccgggacgagaagatccgagtcagctgggccgcggcgccccatagcatcgagtccttctgcttggggcacacagagtttgtgagccgtatctccgtggtgccaactcagcccgggctgcttctgtcctcctctggggacggcaccctgaggctctgggagtacaggagcggccgccagctgcactgctgtcacctggccagtctgcaggagctggtggacccccaggccccccagaagtttgccgcgtccaggattgcattctggtgccaggagaactgcgtggcgctcctgtgcgacggcactcctgtggtctacatcttccagctggacgcccgcagacagcagttggtgtacaggcagcagctggcgttccagcaccaagtgtgggacgtggctttcgaggagacccaggggctgtgggtgctccaggactgccaggaagcccccctggtgctctacaggcctgtgggcgaccagtggcagtctgttcctgagagcaccgtgttaaagaaagtctctggtgttcttcgtgggaactgggccatgctggaaggctctgccggcgcagacgccagcttcagcagtctctacaaggccacgttcgacaacgtgacctcctacctgaagaagaaagaggagagactgcagcagcagctagagaagaagcagcggcgccggagtcccccgcctgggcccgacgggcatgccaagaagatgagaccgggggaggcgacgctaagttgctgatcgtggcggtcagtggtgtctctcacctcaaattaggaaaagctttttaacttgttcccctgcatcctggcatgtcccttcaagaaggaaaaggtgacatcagttgtgaccagctcagaggatggggctgtcccctgggctctagaaagaacattctgtgtcaccagcacaggctcttgctgggtgcctgtgccccctttctggttgaagggaagccagaccagtggagtggaagctcttgaagcactttcttttcatgtcggaggctgcgtgtgagccggtggtggcggcagctgtctgtgtttctcctgttctcataccgcccttcgtgtccgctgcatcttcctctaggagcatctgtgggctgacgtttctggcatggtggatgttttcatgttgttccgccgtctcagcatccaggtgacgtgctgtcccgcagtagctgctcgccacacaggctgttgaaactcagcacgaatgcttgagcctgccccagccccagccgtagcccttgtgctcaggagctgctcctggagagtggctcccttgtgggaagtgagaaacacgtttcggagtcgcagggagctctgtctggcatcggtggcacagatggtgaacttgtttcaggaagtgtgagcacgggcctggctggcacccggtttacagggaggtgattgaggacgtcgttatgatttgatttgaccttggcacacactgcagagccacagggatgttgctgaatttcaatcaccgatcagcaaggatgaaccttctcaacttcctaggaatgtttagcagcaacctaatataccaggcaaaactc

SEQ ID NO: 35020 - DNA, 3082 bp, Homo sapiens
ggcacgagggcgtcaccgaccggtgcggacaggaagaggctctgggctggcacatgtgtatggcggtgaggcgggcgggtacatggcgggctctgtgggactggcgttgtgcgggcagacgttggtggtgcggggcggcagccgattcctggccacctccatagcaagcagtgatgatgacagcctcttcatctatgactgcagtgctgcagaaaagaagtcacaagaaaataaaggggaggacgcgcccttggaccaggggagcggtgcgattctggcgtccaccttctccaagtctggcagctattttgctttaaccgatgacagtaagcgtctgattcttttccgtacaaaaccatggcaatgtctgagtgtcaggaccgtggcaaggaggtgtacagccctgactttcatagcctcggaggagaaggtcttggtggccgacaagtctggagacgtctactccttttcggtgctggagccacacgggtgtggccgtctagagctggggcacctgtctatgctgttagatgtggctgtgagtcctgatgaccgcttcatcctcactgccgaccgggacgagaagatccgagtcagctgggccgcggcgccccatagcatcgagtccttctgcttggggcacacagagtttgtgagccgtatctccgtggtgccaactcagcccgggctgcttctgtcctcctctggggacggcaccctgaggctctgggagtacaggagcggccgccagctgcactgctgtcacctggccagtctgcaggagctggtggacccccaggccccccagaagtttgccgcgtccaggattgcattctggtgccaggagaactgcgtggcgctcctgtgcgacggcactcctgtggtctacatcttccagctggacgcccgcagacagcagttggtgtacaggcagcagctggcgttccagcaccaagtgtgggacgtggctttcgaggagacccaggggctgtgggtgctccaggactgccaggaagcccccctggtgctctacaggcctgtgggcgaccagtggcagtctgttcctgagagcaccgtgttaaagaaagtctctggtgttcttcgtgggaactgggccatgctggaaggctctgccggcgcagacgccagcttcagcagtctctacaaggccacgttcgacaacgtgacctcctacctgaagaagaaagaggagagactgcagcagcagctagagaagaagcagcggcgccggagtcccccgcctgggcccgacgggcatgccaagaagatgagaccgggggaggcgacgctaagttgctgatcgtggcggtcagtggtgtctctcacctcaaattaggaaaagctttttaacttgttcccctgcatcctggcatgtcccttcaagaaggaaaaggtgacatcagttgtgaccagctcagaggatggggctgtcccctgggctctagaaagaacattctgtgtcaccagcacaggctcttgctgggtgcctgtgccccctttctggttgaagggaagccagaccagtggagtggaagctcttgaagcactttcttttcatgtcggaggctgcgtgtgagccggtggtggcggcagctgtctgtgtttctcctgttctcataccgcccttcgtgtccgctgcatcttcctctaggagcatctgtgggctgacgtttctggcatggtggatgttttcatgttgttccgccgtctcagcatccaggtgacgtgctgtcccgcagtagctgctcgccacacaggctgttgaaactcagcacgaatgcttgagcctgccccagccccagccgtagcccttgtgctcaggagctgctcctggagagtggctcccttgtgggaagtgagaaacacgtttcggagtcgcagggagctctgtctggcatcggtggcacagatggtgaacttgtttcaggaagtgtgagcacgggcctggctggcacccggtttacagggaggtgattgaggacgtcgttatgatttgatttgaccttggcacacactgcagagccacagggatgttgctgaatttcaatcaccgatcagcaaggatgaaccttctcaacttcctaggaatgtttagcagcaacctaatataccaggcaaaactccttggtgcctgcgctgtgtgtgtgtgaggtgcgcggtgtgattgtgcgctgtgtgtgtgtgaggtgcacgctgcgtgatcgtgtgctgtgtgagtgaggtacgcacctcacaagcaaacacagcgcacgatcacgcggcgcgcaacgaagcgccgctgggtctgggtgcccggaggcagcagcgttcgggagttccgcccgctggccccgatcaccatgtcggctttcgaaacaacccttcgggacccagtggatgtaaaccccttcaggatccctctgtgacccagctgacaacgcccgagggcggctggcggaattcaaccctttctcagagacaaatgcagcgaccacaagtccgtgagaccaactcctgggtctcacagcagcggtctccagcatagtgaaccaacccagcagaccccaaggcccggagtctgcagccaggagccgtgtccggcacaggaaggactggacgggaagctgcgaacttggagcgcgagggagcgggatcgtgcagcacacttgtgagccaacttgacgtgtgaacgatgaacaaagtgggcccctgctgcctcgtggtgccctgcgaggccctgttctatcaggattctgcagagaatcctggcgataccagggggcaaagctcaaaataggcccaaggaacctgaggaagtagcaatccaggaaccaagagtcggcgacacatggctggaagggccgaggacacgataccgcgggaaaacagtccaaagggcagttggacctagggcacctcccgaacacgtgagaagtgaaattacagaccacgtagacacaccctgtgggtgagcagacgcgcaacactagtaggcgcacatgaacaggagcaaggcagacactactgaacgggaaaaacatacactgccagtagcatcgaaggaacacggggccccaagagg

SEQ ID NO: 35021 - DNA, 1426 bp, Homo sapiens
ggcacgagggcgtcaccgaccggtgcggacaggaagaggctctgggctggcacatgtgtatggcggtgaggcgggcgggtacatggcgggctctgtgggactggcgttgtgcgggcagacgttggtggtgcggggcggcagccgattcctggccacctccatagcaagcagtgatgatgacagcctcttcatctatgactgcagtgctgcagaaaagaagtcacaagaaaataaaggggaggacgcgcccttggaccaggggagcggtgcgattctggcgtccaccttctccaagtctggcagctattttgctttaaccgatgacagtaagcgtctgattcttttccgtacaaaaccatggcaatgtctgagtgtcaggaccgtggcaaggaggtgtacagccctgactttcatagcctcggaggagaaggtcttggtggccgacaagtctggagacgtctactccttttcggtgctggagccacacgggtgtggccgtctagagctggggcacctgtctatgctgttagatgtggctgtgagtcctgatgaccgcttcatcctcactgccgaccgggacgagaagatccgagtcagctgggccgcggcgccccatagcatcgagtccttctgcttggggcacacagagtttgtgagccgtatctccgtggtgccaactcagcccgggctgcttctgtcctcctctgggaagtttgccgcgtccaggattgcattctggtgccaggagaactgcgtggcgctcctgtgcgacggcactcctgtggtctacatcttccagctggacgcccgcagacagcagttggtgtacaggcagcagctggcgttccagcaccaagtgtgggacgtggctttcgaggagacccaggggctgtgggtgctccaggactgccaggaagcccccctggtgctctacaggcctgtgggcgaccagtggcagtctgttcctgagagcaccgtgttaaagaaagtctctggtgttcttcgtgggaactgggccatgctggaaggctctgccggcgcagacgccagcttcagcagtctctacaaggccacgttcgacaacgtgacctcctacctgaagaagaaagaggagagactgcagcagcagctagagaagaagcagcggcgccggagtcccccgcctgggcccgacgggcatgccaagaagatgagaccgggggaggcgacgctaagttgctgatcgtggcggtctgtttctgtcgactgtggaccacttatgtgcgatccgtggaccacttgcgtgcgatctgtcggccgacgatgagcttgttcggatgtagctccatcgtaagtcgaggagcatctgtgatttgtcctctgcttatgggatatgtttttccgctactgagtctgtgtagtaaatttttgactaggaaaaaagtga

SEQ ID NO: 35022 - DNA, 284 bp, Homo sapiens
gttagcattgcttaatttttttggcaccaccttcagcagctggaaaacagagcatatggccaggtaccggtgcctgccaccgcccacgtggcctgccaggctgtcgaggaccctgcgctgctcctggaagctaatgggggtgtctttctggccttctaggaccgtggcaaggaggtgtacagccctgactttcatagcctcggaggagaaggtcttggtggccgacaagtctggagacgtctactccttttcggtgctggagccacacgggtgtggccgtctag

SEQ ID NO: 35023 - DNA, 398 bp, Homo sapiens
accggcgagggctgcaccgtctggggtgctggctgcagagcggagcccgtgggcctgcagtcctagtaatcatgctctctttcttcgtggcaagcactcctgtggtctacatcttccagctggacgcccgcagacagcagttggtgtacaggcagcagctggcgttccagcaccaagtgtgggacgtggctttcgaggagacccaggggctgtgggtgctccaggactgccaggaagcccccctggtgctctacaggcctgtgggcgaccagtggcaggtgagactcggcaccttccagatgtcctatgccctgcctttccataagcctgggggtgtggggcggcagctatgttttttgggtccatgggtaagcctctttcaactcagccacttctgg

SEQ ID NO: 35024 - DNA, 1509 bp, Homo sapiens
attgtttttccctaatcttccgtcaagtacacaaagtaactttgcgggatatttagggtactattcattcactcttcctgcgtagaagatatggaagaacgaggtttatattttcatgtggtactactgaagaaggtgcattgatacatttttaaatgtaagttgagaaaaatttataagccaaaggttcagaaaattaaactacagaatattaaatattataatgtgcccaaagctctgaatagttaaaaattaaatatttattttcttccccaagctttaggtaaggagaagaggggtcaagagttaaacttagagaccctttgtctctgagaagcatccttctaagacattctgttggagttccctcagtactattccttacaactggagtgggtagaagccttatgaaaattatactgacaacctgatctcgtttactccatgttaatcacattcctaccaacctaaatttctgccaagtcagttctctttggaggaagcccattactccataactgactggatggtccagtgtcattttgatctgcttttcagaatggaaatttataatataaatatatgttttaataccacaaacactgtggggcacttgatatttattagtggtgtatatggtccactggtttcaggccaaatctagaatttagtgatactggctcagaagaatttaagttctattcagctttcctgggtgttagaacctagattcaaaatggcttgtctttgctacttttgttccacattctctctctttacctttgccctaccttctgtttgtaaggatgattttaatattaattccaggaacacatgtttttatttcctctgctggaataggagaaagcttaatatattcccaagctgaatgttcttgaattatatctgcatttaccactgtatatgcatatagtgacagtataacctgtctatactacagtagttccagtcctaactttctgaattatttttaaagatcttctctaacaagctatgggaatttggcttcatactctttctttgcaacagcagtgttctgggtgataattttgaattgatacctgttcctttttctgggttttgttggctttttgaaaaattgtctttccttatcattggtgggaggcttggtagcaaagtaacattttttggaaaagaggacagaaaaattgaactacagcttgagaacgtattctttttttcctacttgttatgcaattgaggaatcacttttaactgttttaggtggtgtgttgtccagagtgagcaggattatgttttggatgtcaagaggatgcttagtcttaataaaattaattttaaaagcaaaaaaaaaaaaaaaaaaaaaaaaattttgggggctcgggccgaaaagttttaaaccttgtgggggcggggcccaggtaagaattggctaccggcccagggaatcgggtagaatgtgggttccacaaaacgcgggacaggtgaaacacagggtgggcacgc

SEQ ID NO: 35025 - DNA, 1210 bp, Homo sapiens
attgtttttccctaatcttccgtcaagtacacaaagtaactttgcgggatatttagggtactattcattcactcttcctgcgtagaagatatggaagaacgaggtttatattttcatgtggtactactgaagaaggtgcattgatacatttttaaatgtaagttgagaaaaatttataagccaaaggttcagaaaattaaactacagaatattaaatattataatgtgcccaaagctctgaatagttaaaaattaaatatttattttcttccccaagctttaggtaaggagaagaggggtcaagagttaaacttagagaccctttgtctctgagaagcatccttctaagacattctgttggagttccctcagtactattccttacaactggagtgggtagaagccttatgaaaattatactgacaacctgatctcgtttactccatgttaatcacattcctaccaacctaaatttctgccaagtcagttctctttggaggaagcccattactccataactgactggatggtccagtgtcattttgatctgcttttcagaatggaaatttataatataaatatatgttttaataccacaaacactgtggggcacttgatatttattagtggtgtatatggtccactggtttcaggccaaatctagaatttagtgatactggctcagaagaatttaagttctattcagctttcctgggtgttagaacctagattcaaaatggcttgtctttgctacttttgttccacattctctctctttacctttgccctaccttctgtttgtaaggatgattttaatattaattccaggaacacatgtttttatttcctctgctggaataggagaaagcttaatatattcccaagctgaatgttcttgaattatatctgcatttaccactgtatatgcatatagtgacagtataacctgtctatactacagtagttccagtcctaactttctgaattatttttaaagatcttctctaacaagctatgggaatttggcttcatactctttctttgcaacagcagtgttctgggtgataattttgaattgatacctgttcctttttctgggttttgttggctttttgacgactcctcggtccttctctttcctcggtgtcatcacgacccccggtcatagctgtgtcccgagtacaacacgacccccagtcatccctgctcc

SEQ ID NO: 35026 - DNA, 1389 bp, Homo sapiens
attgtttttccctaatcttccgtcaagtacacaaagtaactttgcgggatatttagggtactattcattcactcttcctgcgtagaagatatggaagaacgaggtttatattttcatgtggtactactgaagaaggtgcattgatacatttttaaatctttaggtaaggagaagaggggtcaagagttaaacttagagaccctttgtctctgagaagcatccttctaagacattctgttggagttccctcagtactattccttacaactggagtgggtagaagccttatgaaaattatactgacaacctgatctcgtttactccatgttaatcacattcctaccaacctaaatttctgccaagtcagttctctttggaggaagcccattactccataactgactggatggtccagtgtcattttgatctgcttttcagaatggaaatttataatataaatatatgttttaataccacaaacactgtggggcacttgatatttattagtggtgtatatggtccactggtttcaggccaaatctagaatttagtgatactggctcagaagaatttaagttctattcagctttcctgggtgttagaacctagattcaaaatggcttgtctttgctacttttgttccacattctctctctttacctttgccctaccttctgtttgtaaggatgattttaatattaattccaggaacacatgtttttatttcctctgctggaataggagaaagcttaatatattcccaagctgaatgttcttgaattatatctgcatttaccactgtatatgcatatagtgacagtataacctgtctatactacagtagttccagtcctaactttctgaattatttttaaagatcttctctaacaagctatgggaatttggcttcatactctttctttgcaacagcagtgttctgggtgataattttgaattgatacctgttcctttttctgggttttgttggctttttgaaaaattgtctttccttatcattggtgggaggcttggtagcaaagtaacattttttggaaaagaggacagaaaaattgaactacagcttgagaacgtattctttttttcctacttgttatgcaattgaggaatcacttttaactgttttaggtggtgtgttgtccagagtgagcaggattatgttttggatgtcaagaggatgcttagtcttaataaaattaattttaaaagcaaaaaaaaaaaaaaaaaaaaaaaaattttgggggctcgggccgaaaagttttaaaccttgtgggggcggggcccaggtaagaattggctaccggcccagggaatcgggtagaatgtgggttccacaaaacgcgggacaggtgaaacacagggtgggcacgc

SEQ ID NO: 35027 - DNA, 1455 bp, Homo sapiens
attgtttttccctaatcttccgtcaagtacacaaagtaactttgcgggatatttagggtactattcattcactcttcctgcgtagaagatatggaagaacgaggtttatattttcatgtggtactactgaagaaggtgcattgatacatttttaaatgtaagttgagaaaaatttataagccaaaggttcagaaaattaaactacagaatattaaatattataatgtgcccaaagctctgaatagttaaaaattaaatatttattttcttccccaagctttaggtaaggagaagaggggtcaagagttaaacttagagaccctttgtctctgagaagcatccttctaagacattctgttggagttccctcagtactattccttacaactggagtgggtagaagccttatgaaaattatactgacaacctgatctcgtttactccatgttaatcacattcctaccaacctaaatttctgccaagtcagttctctttggaggaagcccattactccataactgactggatggtccagtgtcattttgatctgcttttcagaatggaaatttataatataaatatatgttttaataccacaaacactgtggggcacttgatatttattagtggtgtatatggtccactggtttcaggccaaatctagaatttagtgatactggctcagaagaatttaagttctattcagctttcctgggtgttagaacctagattcctaccttctgtttgtaaggatgattttaatattaattccaggaacacatgtttttatttcctctgctggaataggagaaagcttaatatattcccaagctgaatgttcttgaattatatctgcatttaccactgtatatgcatatagtgacagtataacctgtctatactacagtagttccagtcctaactttctgaattatttttaaagatcttctctaacaagctatgggaatttggcttcatactctttctttgcaacagcagtgttctgggtgataattttgaattgatacctgttcctttttctgggttttgttggctttttgaaaaattgtctttccttatcattggtgggaggcttggtagcaaagtaacattttttggaaaagaggacagaaaaattgaactacagcttgagaacgtattctttttttcctacttgttatgcaattgaggaatcacttttaactgttttaggtggtgtgttgtccagagtgagcaggattatgttttggatgtcaagaggatgcttagtcttaataaaattaattttaaaagcaaaaaaaaaaaaaaaaaaaaaaaaattttgggggctcgggccgaaaagttttaaaccttgtgggggcggggcccaggtaagaattggctaccggcccagggaatcgggtagaatgtgggttccacaaaacgcgggacaggtgaaacacagggtgggcacgc

SEQ ID NO: 35028 - DNA, 596 bp, Homo sapiens
attgtttttccctaatcttccgtcaagtacacaaagtaactttgcgggatatttagggtactattcattcactcttcctgcgtagaagatatggaagaacgaggtttatattttcatgtggtactactgaagaaggtgcattgatacatttttaaatgtaagttgagaaaaatttataagccaaaggttcagaaaattaaactacagaatattaaatattataatgtgcccaaagctctgaatagttaaaaattaaatatttattttcttccccaagctttaggtaaggagaagaggggtcaagagttaaacttagagaccctttgtctctgagaagcatccttctaagacattctgttggagttccctcagtactattccttacaactggagtgggtagaagccttatgaaaattatactgacaacctgatctcgtttactccatgttaatcacattcctaccaacctaaatttctgccaagtcagttctctttggaggaagcccattactccataactgactggatggtccagtgtcattttgatctgcttttcagaatggaaatttataatataaatatatgttttaatacca

SEQ ID NO: 35029 - DNA, 425 bp, Homo sapiens
tacaactcttgaaaaacgtaaagccattcccagtcctatggtttatcaaactctgttgtcagtgactgctttcacacattaaaggcagagttgagtagttgtgacaagatactatatggcctgcaaagcctaaaatatttattaattgaccgtttatagaaaaagtttcccaaatcctggtctaggtaaccactctggacccaattacttttactggtttattttttactctttgtcttttcaaactatgttttcttccccattttaatgtctgatattaacagtgacaactttgttgaaataggttatttgctttcataatattgatttgtatgagtcctagtatcagccagtaatcaaaactgttggttatttagttgataagctgtttggcaatttcttttgtttagcagatattaatagaa

SEQ ID NO: 35030 - DNA, 1362 bp, Homo sapiens
atttacaaactcttgattggtgttagttgtgtagggcacgtgtccagaatgacaatttcatgaccagaagggtaatggaaaccatctttgagatgcatgcaaaatgccaggagatcccagcctgtgagatctgcatgaaaagtaactggatgatgaataagaggggagaaatgcattccagagcattgctgtcagtttcaagtattcaagcctggatgctgcaggaccttaatgaaattcccctgctctctgagatccatgtagctatcatgcccatgggcttctgtgggctttcctccataaaatggtgccataatgtcacaatgcctaaagtatggggatttgcctcagattcttctcctacttggtggaacaggtgcaggagctttgtaaaggtgttatgttttaggatgtgcttgcataataatacaaatagttacgtggtgtaaatttgaatcattgtaaaagacgtcttggtaagagaaactgccatttctcatatattgctggtagaaaattagagttttagtattttaaagaagtagactggaaaatgtagtaacagtaataattttcataaactttggctgagcattcttactcctatgagtctacctcccataaatagaagcagcagcatatgatatgtgtacaaaaatgtttattgtgacaatgtttgcagtaacaaaaaaaaaatggaattgagcgattaccatcaagaggtgggatctatgagtgaattgtgttccatatggtattgctgactgaaaaagaaaagctcaagaaaagcacatatatgtcttttttggaaaataataacaaaaaagtgtgcatatttgtctgtatcgtatgtgcacgtacatatcattcaatgaaagcagagaagactagtttgtcaaaatgtgttttcttttggggctgcaggtattgaggtcactaataggagtttgaggaggaaagaaggagaaggactttagaagaagaatatatatacatgtttatttatgtacatatttgtatgtatgcattgaaagagagagagaggcagacagggaaaaaaagaaaagagatatattaattttattagtaatttattaccccctcccaaattcacttaggggctcataaaaatcctggtcaatgtaggcatctttaatatttgcagagatgtagaaattctgtccagatatatgtagggaaaaatgggactgaaacacagattctgcatacatatcaccacttattagctgcattacgttgagtaagcctgtaacccctcagctcctcctcttccttagatgcaaaatggagaggacacttcctcccctgacacagctgggagaacccaatgagcttgtgttt

SEQ ID NO: 35031 - DNA, 364 bp, Homo sapiens
agcgaagtttgggttcctcagctatttagttttcaacacttggggagtagtcatttaggtaagtatttttaaggtactgtttgaggtgtctacatgagtgtgagtgtgcacaccacacctaaaatacagagagatgcctcttccacaaacttcagtttatcaaactgaaagttcttctcaactaatctgagaaccaacttgtaagaaaaaaagaatttctatttagtgttggtggccaactggaatattcttaacactaaaactcaattttacaaaactactgttttaaattcttcctcttagactcattgttttatgtttaatttctgatccaagagaattttcagcttcatttagcattttt

SEQ ID NO: 35032 - DNA, 756 bp, Homo sapiens
cacacttgtttggtaagttcctaaaaatacggctcggccacttctggggcttttgcatttagccacttttgttgcacttgccgcaggagccatctcgggagtgtacttgtttgcaggggttggttctcggcagcagccgcgaggttacttggtccagtgggcaggtcacagggcaaggagtagggaagatgcgatgcatttttttctggagggtgatctgtgtttgtaaacattttggcggaccagagggaagtccggccccgagtgctggtagactgtggaattcggctgtgtcctgaggccaccctagagaccccgcgccgcgtgagtgccggagcgctcggtggccgccgcgccgcgcgcctggagggatgctaacgtggagccggcgccgagtccgcccggcgtgcgtgcgtgtgtgggagcgcgcgagtcccctgacgcggggaccagttatgaatcgggggtgtgtgtttgcctccagagacctggcaaggtgcggagccctccagaagtgcggtcaagcggcagcggagacggcgagccaggaacctccccccgcgtccccagcttcccagcgtggcggcggaacccccggagaaagtttgcaaacttccagcgggcgcggcgaggacgccgggtcacctagggggcgggtgggcgcgcgcgcagggggctcgctctccccggtgcggagctgcagctgccacctctcccgccgggctgccggctgcagcgggtgggcgcgcgcccggg

SEQ ID NO: 35033 - DNA, 244 bp, Homo sapiens
ttggaggaaggtgggtggagagcctgctgcttgtttctcacaggtgtttgccacacaagagatcaaacttctgtttcctgttgagattggtttccatctctctccattcatctctgacactccctatctctcttaattatgtcttatactgacgtctataaccctgctcagccctctccctccagaccccctcccagcagcaactgctgttagtagagctattaagaacacaggcctgtgatct

SEQ ID NO: 35034 - DNA, 1374 bp, Homo sapiens
  misc_feature (4)..(4): n is a, c, g, or t
  misc_feature (912)..(912): n is a, c, g, or t
  misc_feature (915)..(915): n is a, c, g, or t
tggncagtttgatttcctgtaaactgaaaaggatatctaaaggctggattcaattctggttaaacattttgggcaagaatactttgtggttgatactgtgttcctcattttcgttacacaagggggcacataatatctggtttttccactgttagtgatgttaagtattgttccttgaataaggtggtaacagccagaactctccattgtgaagttagtttttgccctcatgactagtaagtaaactgtgaagtcatgctttggcgccactgtgaatgttcagttacccattgcccttttgcctaagattttagcatgcgttgatgattataaccctaatgaaatattccattcaagtgacaaaatggtgatttccccaattctatcattttctttacacttatcagttatcattcttccataaagaagaggtttcccttaggaactggggccatttggctccccttctggaagggcaatatgtatccttgattctttctctccagttaatgatttcagaatgagggattcatgttatggtcacctccaataacatcaaatgaaccttttaggaggaagattctatcttgtgagtactatattggactcatgaattattatattttcaaatatgcccacatcaattaccttacttttttaaacttattattttgagataattatagattcgtgtgaagttgtaagaaataatacagagagaacccatgtaccttttacgcagttttccctagtgggagcattttgaaaaactgtagtacaatatcacaaggatattgatgttgatgatgtcaagatgccgagtatttccgttactgtaggatctctcatgttgcccttttatttatcattctttttgatgctttgactgtccaaactttggccagtagaaangcnttcaagattcctgtgtctttttcacataatcccatgctgtttgatttcatgctttctggcagtacaaggtgtctcagagttgcccgtgctttctgcctgagacctggaatccactatttcttcaaggagcctttcctagttcgtggcatttccaaagaaaagtccaagggctaggggtactcagtgccactcagttgtcattgatcctgggctcttgcaatgcacaaaatggaaatgtttatatatttcaaattaattaaaatatcttcaactgatggggaagatcaaaattaacattatataacattcccagatttttacttaacattaatttcaaacttttgtctcttgctctgcaaatcttttttcctaacatacttatttgctttatgctatgctatacataaaaaagtttcaaaatatgattattacggcttacaataaagtcactgaatcaat

SEQ ID NO: 35035 - DNA, 458 bp, Homo sapiens
acttgaggtggggagtttgagaccagcccagccaacttggggaaaccccacctctactgaaaaaaatacaaaaattagctgggcgtcatggtgcatgcctgtagtcccagccacttgggaggctgaggcacgagaatcgcttgaacccaggaggcagaggttgtagtgagccgagatcacatcagcacactctagcctgggtgacagagcgagactgactcaaaaaataaataaaataaatatcacttacattagatatacccaaggggtggtctatagagacttggaagcagtggttattgcaacaggggcacggaagtcatctgctatgccaggatgcccaggggatactcggggtgggtggcatggtggtgctggggactcaccgcacaggacgctctgattgacgcactgccaggagtagcgctctgtcttggggctgcagccggcctcctcag

SEQ ID NO: 35036 - DNA, 265 bp, Homo sapiens
gggcacatctttgggatgtgggaggaaaccagaggaaccaaggaaaactcagacatggggaaagagtgtaaactacacagacaggggccccagccaggaatcaattttttctcatcaatgttataattgaaatgatgttactggaggccctgctctacttaactcccccaagaaccctaaaagtctcaatcccaatacatcactggctcataatggatcttgccatgtaaattgggtccagatgtggatgaggttcctcagatat

SEQ ID NO: 35037 - DNA, 130 bp, Homo sapiens
aatttttttatacatggagaatctttaaaaacggaggctttctgcttaggtactctccagattggcactccaattttgccaaatgctcctagtatctgttactctgactgaaataaatataccatgaata

SEQ ID NO: 35038 - DNA, 364 bp, Homo sapiens
tattactattatcttatttactgatattgttattgttattatcattttactgcaactggatgtctgtgaagaatacaatgagtactagaagagctgccaatgtctaggtttgtgtgaaggtgccagaattcatactctatattgcttttgcaccattagtgcaaatgtcaacacaagagaaatgcaaattattggtattacggatcatgctttgagaacacagctgcatagtaatatttgaaaacacaaatataacattgttagacagtagcagaaatgtagatatgtcagagaaaaataagtatttaaggaccaggtgaggatataaatgcttcggctatctggggcagtgaggtcggtattg

SEQ ID NO: 35039 - DNA, 409 bp, Homo sapiens
ggggctcggggcctgccagaggttcaggacctgccggggactcagggcctgctggaagttcaggacctgctggggatcagggcctgccagggatttagggtctgctgggcgggccaccttttggcctctccctcatgcttgaggccatcagtgtttcctactaatttcccattttaagcctgagaagtgacaagagagggtaaagacccagcctctgctctgtcccatgagaaatactgagggacgtgcccccatcaggcctatgcggtcatttgctgggcttcgttatacgccaaggcctgtaggcctgagaagagggagagacttcagggggcggagcggagaggaaaagcttctagtaagaatcttttcagattttcaccaggcgcggtggcttttcaccgggcac

SEQ ID NO: 35040 - DNA, 777 bp, Homo sapiens
aagactgatcaaagaaggaaggagaaagggcaggagagaggaatagccaatatcagaaaggaaaacaggtaagttacttcagattatgcagacatttaaaatatttaagagccagcctggataacatggtgaaaccctcctgtctctacacacacacacacaaattagctgagcatggtggtgtgtgcctgtagtcccagctactggagaggctaaggtaggaggattacctgagcccaggaggtagaggctgcagtgagctgtggtcatggcaccacactccagcctgggcaatggagtgagagaccgtgtctcaaaaatatgtatacatatttaagagaatattatgaataccaataaattttaaatctagttgaaatgatctttattgcagtgataggtgtatacatatgtctaatcaaattgtacactttattacatatgtgcagttttatatattaagtatgcctcattaaagttgtttttagattttgcataaaatgaacaaattctttaaaaaaaaaaaaaaactctccaaaactgacatgaaacgatcctgaacattggaatcatcctatatctagcgcatacattgagtccataattacaatctgccacaggaaatttacagaccaagatggcttcagtagtgaatttaaccaaacatttaagagtgaaataatgccagttttagacagtctcccagaaaatagaaaaaccttctaatttgttttatgaaaacagcttaaccttagatataaagaatttgccaagaac

SEQ ID NO: 35041 - DNA, 294 bp, Homo sapiens
cagaagcatcatgtgatttttgaagtaatgtcttattttgatggatgttaacattaagatctatcagtgcaagtttatcatcctctgaatgtaacacttccaaatttcattttttcagatcgttttttggtggtttagttttagccagtgctgtttaaatggagaaaaaaagaaaagttcaccatagactacctcacgttgttacttaattgtgctaggtattcacgcagttcttttgcagcctggaatctgccatagcgcttctttgggttggcacactcatccagcaaggcc

SEQ ID NO: 35042 - DNA, 1248 bp, Homo sapiens
  misc_feature (379)..(379): n is a, c, g, or t
  misc_feature (665)..(665): n is a, c, g, or t
  misc_feature (967)..(967): n is a, c, g, or t
  misc_feature (1026)..(1026): n is a, c, g, or t
gtacagctgttaactattcgcttataaataatcttttttgcctctcaacctgtctcccaggtagtgtacctgtcaccattaataactctttagccgctccctagtgatttgacctatcagttgtcgttcacagaaaagtggtgctctggcctgctattgaagcttatgcaggttctttcagctcctcagtcaccccagcagccatatacttgtaggaagttgtgttggtgggcttcacaagcaggcagctgaacacttcgtacagtttgataaaggtggcattacattttgaacaatagatgataagactcccatttagaccgcaaaacagtgccacaggggtagacaggggtctgggggagataagatgggtggtgangatgaccaacagcaaataaactttcctgtctctttgatgctaattatctctttgcacctaattatcatggcatcatcatcatcctctgatgtttgcaaactaagagttgatgtgtttgatcaggttagtgaatctgtcaggtatggcattctgcctgtttctgaagcttaagaatgagaagccagtagctatcatgcggaagatgtgaactgccccccagtcctcgtcctttagcagtgtgtcattcctctgtttggacatgtgctctcttgcttcctctcttccnctctctgttcctgaagtgtgctgcttccaacacttccccagattaattcctacctgcatttaggtctcaacctagccatcactttttcaggaaactgctactgctctctctatttggcattgactgtaccaactaaaatgcccatatggcagttttcatttatttcttattatgctctacaataactgcttgtttacttgtctttttctcctactggattgtaagttttttcatggatggtacatagtgttgtttgctatatccacgttctgggagtgtcatagaatctcaataaatttatntgaagagaatgagaatttattttttatgaactcactttccattgacatatcatggtcanatcaatggggagttcaggcaataaattatggcatatattgtctactgtatactgtgctggcaccaggggttcagataggaaaacatttcgattgctttttacccttttagtgagtgactaatggacatttctttgtctgaggatatatcttggcagtacaggatttcttcagacgtggctcaggaaatggccgagagtaaggtgaatcacaaggcaaaaaaa

SEQ ID NO: 35043 - DNA, 360 bp, Homo sapiens
gccaccgcacctggactgatagatcataaatatttttaatgatagctcgttatgcgatttttggcatgtaatttggaaggtggtaaaaaaaattagtagtacaggaacagtccaggttgagtatcccttacttgaaatgcttaagaccggaagtgttttggattttggaatttttacgattttggaatatttgcattatgttaatatatacttagcagttgagcatccctaatctgaaatttgaagtctgaaatgctcccatgagcatttccttgcagtgtcatgtcagaactcaaaaagttttcagattttggaacatttctgattttgggttttcagattctcaaactgtagtaacag

SEQ ID NO: 35044 - DNA, 226 bp, Homo sapiens
cacaatgactaatttacattcccaccagcggcatgtgaatattcccttttctctgcaagctcaccagaatctgtttttgttttgttttgttttggttcttaagagccatttgcactggtgtgagatggtatctgattttgggtttgatttgcgtttccctaatgatgagtgatgttgagcattttctcatatgcttcttggccacatgtatgtctttttttgaaaa

SEQ ID NO: 35045 - DNA, 800 bp, Homo sapiens
ggtgcctctcttgaccagctaccctcccaggggaccatgaggaagctcagaggaaagacccccgcctgctcctgtctcacggagcccacagggtcacggagggcaatggagggtcattcgctctgctggggttgccttttgcactgaagatagagaccacctttttgagtgacttgagcccaaaggcaagcgtatatcaaacgatcttctccacataacctctctgtgccatcataagaatagctgcttccgcccccggatttgctcaggcctgggaatccgctgactgaaggcctcttgttgagtgccagctctaaacaagtccctttatgcagagccacagctgtgcatgctcagccctgccgaggtcccaggccaggctttgttgcttccgttcatggaagcgcacaggatggggccgacgctgtgccggtcgtggggaaatctcactggggaagagaaaagcccaagccttgttggttacgtcagccggtccatggcggtgtcctgcggaccccagagcccccgggaagggcgcaagtcaaagagcactggaggcaccgccggcgatggacgtccaggtcccggctcctgtgctggaaagcgttgatggggagcgtcggcgctgaccacacgcgggagctgcggaagcccagcggttcacacaggcctcccttcaacgtagtcatcccctggtggtggaagcaagacgacggcccctgacgtgcagccacacacagaaaaggctgctgtgaacattttatgcttcgactttttttttcttcagagacagggtgtcg

SEQ ID NO: 35046 - DNA, 481 bp, Homo sapiens
acatcagatgtgcttcaaagaacttgaatgttagttggggagacgagttatgtgatgttggataaaatgataatatatttcctttaattgttacctaggtggaaaaccagggcctccaagttcaggggaaggagaatcactttggactttaccagttaggactccactttcagaggagatagaatttaggccagtcagtgaagaatggaaagaaagagacatagcattttagcaagagggaattatacaggataattcaaaaggcatttatatttgactaggaagtacacattttacttggctatagaaatgtctaagcactaaaaatttcctaccactcagatgaagtgatatggagaccagctcagatgggagatagaaccctcacttttccaaatgactcagtacctccttatggctcactcttgcctttgaggcacaggcattttactgtttgcgaactaaagctctggatggcaaa

SEQ ID NO: 35047 - DNA, 296 bp, Homo sapiens
tggctcaggtcttacatcttccattcctgtcaaggtaactcctcctcatgttccagctcatatctgatatatcatcttttaaaaggatgtctgcctaaacctgtagaatgggcttaagagggcttcctgtttattctcatactgtgtacaatgaaaatctactcattgatttacttctctctcccacccaactttatgttcctttaacatagaaacttttaggcatcgaagaattcttttttttacatgacacataaactctcaatgattgttgaaggaatgaaatgaggagtatt

SEQ ID NO: 35048 - DNA, 316 bp, Homo sapiens
gctgaagtgacacagagcagccccatctcaggagccttcaagacacaatagcctcccgggagctctcagggtactcagtggcaacaagatgctccacctctgggctgcccctgccctcagcctgtgccgaccctgctagccccaagtcctgcccccagcacaggccaggtactcagcagggtcatcactgttctggaaatccccttgcagggcatagaaagttctcagcgaacacccatggagtaaaacaagaggcggccttcacccttaggtggattgtaatattttagcactaaatgcaaaaagttcttttatg

SEQ ID NO: 35049 - DNA, 198 bp, Homo sapiens
gtgattgatcgtttttttcctctttacacaaaagttttagtgtcaagaccagtcatgaaagttcaaacattatatggtgtaaagagtgtaggccggcgcggtggctcacgcctgtaatcccagcactttgggaggctgaggcgggtagatcacttgaggtcaggagtttgaggccagcctggtcaacatggtgaaacc

SEQ ID NO: 35050 - DNA, 402 bp, Homo sapiens
gtccatggttttcaggatacaaaatcagcatgcaaaaatcagttgtgtttctatacagcagcaacaaacaatccaaaagggaaaccaagaaaacagtcccatttacaatagcatcagaaataataaaatacttgggaataaacttaaccaaggaggcaaatgatctgtataatgaaaactacaaatattgctgaaagaaatcaaagaagacctaaagatactctatgctcatgattggaagacttaatattgttaaaatgttcattttatccaaagagatgtacaaattaaatgcaattcctatcaaaatcccaaagacatttttgtggaaataaaaatacaatcctaaaattcatgtggaaccataaagaaccccaaatagttcaaacaaccttgagaaag

SEQ ID NO: 35051 - DNA, 3457 bp, Homo sapiens
ccaaaggcagatgataaaggaagcttttgctggggatgatgtcatcagagatttcttgaaagagaagagggaagctgtggaggcgagtaagccaaaggacgtggacctgacactacctggctggggcgagtggggtggtgtgggcctaaagcccagtgccaagaaaagacgccagtttctcattaaagcccctgagggtcctccaagaaaagataagaatttgccaaatgtgattatcagtgagaagcgcaacatccacgcagcagctcatcaggtacaagtgcttccatatccatttacccaccatcggcaatttgaaaggaccatccagacccctataggatccacatggaacacccagagggctttccaaaagctgactactcccaaggtcgtcaccaagccaggccatatcattaagcccataaaagcagaggatgtgggctaccagtcttcctcaaggtcagacctgcctgtcatacagaggaatccaaaacgaatcaccacacgtcacaataaagaagaaaaactgtaggttgtgtagctggagaagtgacagtcaggggccctgattccacttcctttggtccagttttactctgctacagggtggattccaaaactggctcagcacattgcatgtagttgagccacattttttaaaaaaagaaaatggatgaccattaattgactagcattttagaattgatcagacattagaacacagaaaaattctagtacatttaaattctaaacaatacagtggatgacccttttgaatatacctaatgatttccttaaaaaagaaattttaaacagacttgtttaatcgtgttctcaaagcatacagtcaagaggtgggactgactgatgctttataggtgtgtgtagggtggtagaggccaaggtgctgccagcaatcctttccatactaggtactggtgaaaattgtttttgtttatgctgtcagcacatttgtgtgggtctctcattgtcccttaacagtgccgcatctcagcctggaagtcagctttaagtcattcaagagaacctcaggctgtttttctgacagtgatgatatgatatacagatacatccacagggtatctattaccagcataatgcattgtaagatggcaaggtggcattttgaaagagcgctgggcaagcagttagcacatctgggcctaccttcagcttcttcatttacaaacttctgaccttttgacactaaagctgctcctttatctttctgagtctcagattcttcatctgtaatctggagttgttaattccagtccttactaccttttagagttggaatgagatggaaagtagatgaaactactttgaaaattacgacagttaagggctgggtgcggtgtctcacacctgtaatcccagcactttgggaggccgagatgggtggatcatgaggtcagcagttgagaccagcctgaacaacatggtgaaaccctgtctgtactaaaaatacaaaaaaattagctgggcctggtggcaggcacctgtaatcccagctacttgggagactgaggcaggagaattgcttgaaactggaaggcagaggttgcagtgagccaagattgtgccactgcactctagcctgggcaataagcaaaactccatctcaaaaaagaaaaaaaggacaaaagaaaattatgagagttacttaaaggtaacatcacatactaaatgtcttctataatcctatatttattaatgcattacaactctgtagattgttagttactaggccagtagctaggaattggtataaatttaatgcaccttctatcctgaataactagcatggaaaagtgaatatatgtgtgagcagatatggctataaagacctatagcttttgcactttatgcatatataatcaatcctttctagttcagtgaattgaccccatccacaggctgattcatctttgtgttaaggggcaaatgaaacggtatattatttctttgcagtctcctctcagtcattcatcaatgtggccagcttatctactcccaattatgttgttgatacatctccaagccatctgtcatcagatcaaaaagcagcaaacagagggtcagtcacaggatgttctgacacaccattgtaactttttgttagagatgatcccatttagaaaaagactggtagaaattggagtgaaaggaaccctacagattagcccagttctctcttattttcagctttacagacaagaacaatttaaatctaaagaatttagtagattccttcagtgtcacaaagctgtttcatgaaagaatcaagattataacctggatattctgactcctggcccagtgctttttcttactttgtagctacactttgaagtaagattcaaactgttatccactcaattgccttattcctgaggatgtagtgaaggaagaaaaagttttctggaattccgtaaactatattttaagcttatttcttcaaaattattttcatatatcacagatatatcattggaagatataatttgcatatatgttcattatcagtgttcctaatttggtattacatgtattctatttttttctgaatgatagcatgaaaagtgtcaaagtggtttgtccgctagcgtctgtctgcagaactttcaggatgactattaattcctctcagatgtcatttttgagtggtccaagcctgctgttttgaacccacagcagtggagatttgtattcttatttacagttgtgtactataaagtgtgtgttacataggttttgtgtaataattatttgtaaatattatttagatttgtatttagacatgatttatatctaatatagatacaaagtctgtgtctaaatattatttaaagaagtgatttttcattctcttggattctttccagtgtggtgccttttatatgcctcacatagtctccttgttctcctactaatattcccaagctccatatgccaattaaagaagaaacaaaaataaaagtttgtcttgcttgtgaaacattaagaagaggctgtcaggtttaataaactttttaatgaatatttcagacataacaaaaaactgcagagcttcgtacacttgatttaaataattcttgagggattttataaggtcatcttatagacaaaattaagagacaccagtgtggttatcaatgctttcagaatacttgtgtttatgtaaatataccccagagtccaaaactctgatatattcatatatattcacaatgagaggatgtctgtgccaaatctgtcaatcagtacaatagaaaagttaattatataactacaacacgaaacacaaatttttagaagcaaattatgtcctgtaatttacccccctccccgctgctcctctgctaactcattttcctcttttcccactctaaatgtaaggcaacccttggctttggagaagcatctgttc

SEQ ID NO: 35052 - DNA, 2906 bp, Homo sapiens
ccaaaggcagatgataaaggaagcttttgctggggatgatgtcatcagagatttcttgaaagagaagagggaagctgtggaggcgagtaagccaaaggacgtggacctgacactacctggctggggcgagtggggtggtgtgggcctaaagcccagtgccaagaaaagacgccagtttctcattaaagcccctgagggtcctccaagaaaagataagaatttgccaaatgtgattatcagtgagaagcgcaacatccacgcagcagctcatcaggtacaagtgcttccatatccatttacccaccatcggcaatttgaaaggaccatccagacccctataggatccacatggaacacccagagggctttccaaaagctgactactcccaaggtcgtcaccaagccaggccatatcattaagcccataaaagcagaggatgtgggctaccagtcttcctcaaggtcagacctgcctgtcatacagaggaatccaaaacgaatcaccacacgtcacaataaagaagaaaaactgtaggttgtgtagctggagaagtgacagtcaggggccctgattccacttcctttggtccagttttactctgctacagggtggattccaaaactggctcagcacattgcatgtagttgagccacattttttaaaaaaagaaaatggatgaccattaattgactagcattttagaattgatcagacattagaacacagaaaaattctagtacatttaaattctaaacaatacagtggatgacccttttgaatatacctaatgatttccttaaaaaagaaattttaaacagacttgtttaatcgtgttctcaaagcatacagtcaagaggtgggactgactgatgctttataggtgtgtgtagggtggtagaggccaaggtgctgccagcaatcctttccatactaggtactggtgaaaattgtttttgtttatgctgtcagcacatttgtgtgggtctctcattgtcccttaacagtgccgcatctcagcctggaagtcagctttaagtcattcaagagaacctcaggctgtttttctgacagtgatgatatgatatacagatacatccacagggtatctattaccagcataatgcattgtaagatggcaaggtggcattttgaaagagcgctgggcaagcagttagcacatctgggcctaccttcagcttcttcatttacaaacttctgaccttttgacactaaagctgctcctttatctttctgagtctcagattcttcatctgtaatctggagttgttaattccagtccttactaccttttagagttggaatgagatggaaagtagatgaaactactttgaaaattacgacagttaagggctgggtgcggtgtctcacacctgtaatcccagcactttgggaggccgagatgggtggatcatgaggtcagcagttgagaccagcctgaacaacatggtgaaaccctgtctgtactaaaaatacaaaaaaattagctgggcctggtggcaggcacctgtaatcccagctacttgggagactgaggcaggagaattgcttgaaactggaaggcagaggttgcagtgagccaagattgtgccactgcactctagcctgggcaataagcaaaactccatctcaaaaaagaaaaaaaggacaaaagaaaattatgagagttacttaaaggtaacatcacatactaaatgtcttctataatcctatatttattaatgcattacaactctgtagattgttagttactaggccagtagctaggaattggtataaatttaatgcaccttctatcctgaataactagcatggaaaagtgaatatatgtgtgagcagatatggctataaagacctatagcttttgcactttatgcatatataatcaatcctttctagttcagtgaattgaccccatccacaggctgattcatctttgtgttaaggggcaaatgaaacggtatattatttctttgcagtctcctctcagtcattcatcaatgtggccagcttatctactcccaattatgttgttgatacatctccaagccatctgtcatcagatcaaaaagcagcaaacagagggtcagtcacaggatgttctgacacaccattgtaactttttgttagagatgatcccatttagaaaaagactggtagaaattggagtgaaaggaaccctacagattagcccagttctctcttattttcagctttacagacaagaacaatttaaatctaaagaatttagtagattccttcagtgtcacaaagctgtttcatgaaagaatcaagattataacctggatattctgactcctggcccagtgctttttcttactttgtagctacactttgaagtaagattcaaactgttatccactcaattgccttattcctgaggatgtagtgaaggaagaaaaagttttctggaattccgtaaactatattttaagcttatttcttcaaaattattttcatatatcacagatatatcattggaagatataatttgcatatatgttcattatcagtgttcctaatttggtattacatgtattctatttttttctgaatgatagcatgaaaagtgtcaaagtggtttgtccgctagcgtctgtctgcagaactttcaggatgactattaattcctctcagatgtcatttttgagtggtccaagcctgctgttttgaacccacagcagtggagatttgtattcttatttacagttgtgtactataaagtgtgtgttacataggttttgtgcaaacatcacttgccctcacgtgctaccctgtctcccaatatccctctattcccacaccttctccccaatatcatctcccacacttcttccacatctccttcacctgcctacaccccctc

SEQ ID NO: 35053 - DNA, 2913 bp, Homo sapiens
  misc_feature (2826)..(2826): n is a, c, g, or t
  misc_feature (2839)..(2839): n is a, c, g, or t
ccaaaggcagatgataaaggaagcttttgctggggatgatgtcatcagagatttcttgaaagagaagagggaagctgtggaggcgagtaagccaaaggacgtggacctgacactacctggctggggcgagtggggtggtgtgggcctaaagcccagtgccaagaaaagacgccagtttctcattaaagcccctgagggtcctccaagaaaagataagaatttgccaaatgtgattatcagtgagaagcgcaacatccacgcagcagctcatcaggtacaagtgcttccatatccatttacccaccatcggcaatttgaaaggaccatccagacccctataggatccacatggaacacccagagggctttccaaaagctgactactcccaaggtcgtcaccaagccaggccatatcattaagcccataaaagcagaggatgtgggctaccagtcttcctcaaggtcagacctgcctgtcatacagaggaatccaaaacgaatcaccacacgtcacaataaagaagaaaaactgtaggttgtgtagctggagaagtgacagtcaggggccctgattccacttcctttggtccagttttactctgctacagggtggattccaaaactggctcagcacattgcatgtagttgagccacattttttaaaaaaagaaaatggatgaccattaattgactagcattttagaattgatcagacattagaacacagaaaaattctagtacatttaaattctaaacaatacagtggatgacccttttgaatatacctaatgatttccttaaaaaagaaattttaaacagacttgtttaatcgtgttctcaaagcatacagtcaagaggtgggactgactgatgctttataggtgtgtgtagggtggtagaggccaaggtgctgccagcaatcctttccatactaggtactggtgaaaattgtttttgtttatgctgtcagcacatttgtgtgggtctctcattgtcccttaacagtgccgcatctcagcctggaagtcagctttaagtcattcaagagaacctcaggctgtttttctgacagtgatgatatgatatacagatacatccacagggtatctattaccagcataatgcattgtaagatggcaaggtggcattttgaaagagcgctgggcaagcagttagcacatctgggcctaccttcagcttcttcatttacaaacttctgaccttttgacactaaagctgctcctttatctttctgagtctcagattcttcatctgtaatctggagttgttaattccagtccttactaccttttagagttggaatgagatggaaagtagatgaaactactttgaaaattacgacagttaagggctgggtgcggtgtctcacacctgtaatcccagcactttgggaggccgagatgggtggatcatgaggtcagcagttgagaccagcctgaacaacatggtgaaaccctgtctgtactaaaaatacaaaaaaattagctgggcctggtggcaggcacctgtaatcccagctacttgggagactgaggcaggagaattgcttgaaactggaaggcagaggttgcagtgagccaagattgtgccactgcactctagcctgggcaataagcaaaactccatctcaaaaaagaaaaaaaggacaaaagaaaattatgagagttacttaaaggtaacatcacatactaaatgtcttctataatcctatatttattaatgcattacaactctgtagattgttagttactaggccagtagctaggaattggtataaatttaatgcaccttctatcctgaataactagcatggaaaagtgaatatatgtgtgagcagatatggctataaagacctatagcttttgcactttatgcatatataatcaatcctttctagttcagtgaattgaccccatccacaggctgattcatctttgtgttaaggggcaaatgaaacggtatattatttctttgcagtctcctctcagtcattcatcaatgtggccagcttatctactcccaattatgttgttgatacatctccaagccatctgtcatcagatcaaaaagcagcaaacagagggtcagtcacaggatgttctgacacaccattgtaactttttgttagagatgatcccatttagaaaaagactggtagaaattggagtgaaaggaaccctacagattagcccagttctctcttattttcagctttacagacaagaacaatttaaatctaaagaatttagtagattccttcagtgtcacaaagctgtttcatgaaagaatcaagattataacctggatattctgactcctggcccagtgctttttcttactttgtagctacactttgaagtaagattcaaactgttatccactcaattgccttattcctgaggatgtagtgaaggaagaaaaagttttctggaattccgtaaactatattttaagcttatttcttcaaaattattttcatatatcacagatatatcattggaagatataatttgcatatatgttcattatcagtgttcctaatttggtattacatgtattctatttttttctgaatgatagcatgaaaagtgtcaaagtggtttgtccgctagcgtctgtctgcagaactttcaggatgactattaattcctctcagatgtcatttttgagtggtccaagcctgctgttttgaacccacagcagtggagatttgtattcttatttacagttgtgtactataaagccgtgtggtttaccattagagggtttttgcgctcaaactacactctactctcctcggtaaanagtcggttgggtntggggagggaggcgggtgtggggggggcgtggggaggggtcgaagggggggggtgggggccggggggggtcctc

SEQ ID NO: 35054 - DNA, 569 bp, Homo sapiens
ctcagtttatctgttggggggtggtgtatgaattagtgtatctgtaattgtatgaatacggagtattcttatctttgtatgtgatggtgtgcttctattttaaatttatttttaactatagataggcttgctaggttggtcattccacagcttggtcttctttccgtttttgaagtaaaggtaactcactaatggtcctcagtaaacagagtgatggggcaagctgacttatatttcaattgttctgagaattgaacaactctactaatgtttcctttccaacttcaaacatacctgttcagtttcttcaacatcctgataggagctgatctcctcagaactctcccctctcatcagacagaggacttgggcatgctctaatctcttactgttaattattctttttagttttaaagccctttaaagtaatctttctgtaattagattgttgagtagattgtctttagtaatatggtggtcttaaattttgtgtggattttcagattgttaaatggttgcagaggctttcattcatgaagttcaagtttactatatcatggtatgtcagg

SEQ ID NO: 35055 - DNA, 436 bp, Homo sapiens
gctttctcagctgggttgtcagccttggctcaccctagctgagtgctggtgcaggtgggctgtggaggaccctagatttctgtggtgctggaatcttttgaaaactaacataatctttgtgatgagaaaaaacaacattaaagctatggagctggacatggtggcacacacctgtaatcccagcaccttgggaggccaaggcaggagaattgtttgagcccagtagttcgagaccagcctggtcaaaatagtgagaccctgtctctacaaaaaatttaaaaattagctggaggtggtaacgcacacctatagtgccagctatcgggaggttgaggtgggaggatcatttgagcccaggagatcaaggctgcagtgagccctgtttgcaccattgctttccagcctgggcaacagagccagaccatgtctcaaaaaa

SEQ ID NO: 35056 - DNA, 458 bp, Homo sapiens
gcccataattttatgagtctaacataattgttgtaaatttggtaaactttccagtctttttctattatttttagatgaactagatattattttgtcttattttatttagttttttcacttaacattatgagaggaatatatttctgtactatgaaataatatgcccaagttatcaaatctgacaatggccagtttcctagataattgtgccgtagttcatttatttcttctatttttaaaattctgggtgtttgcttgcttacttgcttgtatggttttatggtcactataaaacaatgctatagtaaacatatgaaagcatgttaatatttctcttctttggaatttattaccatgccaaatgtttgagttttatgtaggtaatgatttagatggtgaaccatttcactaccacatattcattttgaaaaggtacttttttagtatacttgtgaaaa

SEQ ID NO: 35057 - DNA, 242 bp, Homo sapiens
gccagaaaagccaaggcaggaggatcacttgaggccaggagctcgagatcaacctgggtaacatagggagaccccgactctacaaaaaaatagaaacattggccaggtgtgacagcgcatacctatagtcctaggtgcttgggggtctgaggcaggaggatcgcttaagcctgcagtgagctaggattgcaccactgcactccagccaggataaaggagttagatcctgccaaaaaaaaaaa

SEQ ID NO: 35058 - DNA, 506 bp, Homo sapiens
gattttttttttaatctcttaaaatctgtgacagagaatattgggattttccatcctgccatttgtttcccatatttgttataagtaatgagcacttcttatttgtcaggccctgcattggcgctggggaagacacaacagtgcgcagaaaccaaccagcctctaattgcaaaaaacttcacagcccagtgaggaggctgacattaatccaaggatcacacaatgcaactacaaaatgtgctaaggaggcaagcgtctggtgctaggagagtgtgtaatttgatatagtctgagaggtcagggtatggatgtgtaagccaatgaggagaacagcctgtgcaaaagccctggactgtgtctggtaccaggacttagccagttagggcgagcagagcaagggaggggtgggcggtggagctgagactggagaggcaagacgtgccagaccatgaggcttttgcaacatttagcccctaggccccacccacaaagattccgattcaact

SEQ ID NO: 35059 - DNA, 564 bp, Homo sapiens
gggaaagacagatggtcaacacactaataaatatataacttgtcaagtgccatgaagaaacataaagtgaggtcaaaggagtggatgactgatggtgttttttagcagggtggttaggaaaaagactttgctgatgaaatggtatttgaacacacataaaagaaagaggggccaaaccatgcagacatatggtggaagaacattccaacaagcatagggaacagaggagggcagagagggagaaaagaggagatacatgggcaagatctcatgagaccttgctagtacagatttctttctgaatgcactttttgtttcttcgatgaggccaatgagatgaggatctactagagggtttggaacacaggaagtacatgatcttctttgtattttagatggatcattctgaatgctgtggggagactagactccaaggagtcaagagtgtaaataagaaacccatttaggaggtgaggatagagagagaagtagagaagcaggggaggaggtggtgagcagggcacagattcaggatgaactcggaaatcagagctgcagcatttg

SEQ ID NO: 35060 - DNA, 446 bp, Homo sapiens
gagggaacttgacaggtacagtctgtctcccacaaagcttatggctgagtttttaaaatataattcaagcttttcaggaatacagtcaatccataaagcaatagggagaaacatttccaatatcaagaggcactgatgaatgaatgtgtgaataactaaattttgtaactttttttgtagacataaaaataagcattcactgtgtcatccttaaataaaatcattggcagagtgtagcctataaatgtctggaaatacctcaccaaaggctagaagacattttgccagaaggaagtaatgtttacatttctatattttgtttctttttcctctacatatgcattttgtcctatgtctatgtctccttcttaataggctttgacatgaacccaaagcaaatgtttcctattattttatctatttattgaatatacattgttttctga

SEQ ID NO: 35061 - DNA, 397 bp, Homo sapiens
tatttttgagaagctcatggtcttcccaaagtaatgctggctctggactcctgtaggacacactgctggggtcactgttcccctctgggccagccctcaccttgggacctacagctgctgatctctgtctctagcctctccctgcttaagtccagttgtggaacattcacccacgatgcagaccttatggggcctgggacacccgtcatctgcagattcaagggggatctgacctcaatctgctgtcaggacatgctgggtgctaccctacatcactgccagagccacctcaaggtgcacattcacctttctttgcctggtagcgcccctcatctgcacacctacctacctggggaagcctcattcatctgtcaggaccagccccagcatcgcctcc

SEQ ID NO: 35062 - DNA, 383 bp, Homo sapiens
gttaggcttttgttaaacccaagtcagttaagctgtagtagaagttttctttgaaggcaggctgttagggagaacagagagctctgggcatatttcagaatggttaccttctcatgcttctgctggaaacataaaggtatttttctccagtcttcacagtgagaatctggtggaattcctggaggtaaaactcaacaaaagtgtaagtgtgagggttcccccctgccctgaacccttggagttttgaacactgaagctagtctacactgagcctccagcagtttttcagttaagtcttcctacctgtattggctccatctttgatcttctgctcttgggcttctgcttcttgtaagctgtgactctgtttccacctgtctgtc

SEQ ID NO: 35063 - DNA, 326 bp, Homo sapiens
cacatacacaaaaaatgacactgggtacattctattagtaaaagaaaaaaaaatacatatatatatatgtatgtataaaacaattgataaatattcaaagtgatgggtatcctaaataccttgatttgatccttatacgttgtatgaatgtatcaatatattgcttgtgctccataaatatgtataatttgtatcgataaaaactaaaaaaaaagctcatgagaaatctaatgtatagcaggaggactatagttagtaatactctattgtatactagaaatttgtcaggaaagtaggttttaagtactcttaccctaaacaaaaaa

SEQ ID NO: 35064 - DNA, 453 bp, Homo sapiens
agccagtgtacccagcctcttgtgtttatttaaaaagaaatactggcgtttgtcgaatgatggagtcttattttcaaacttttgtattaaatatattttcgctttcaccagatcagtaaatcagtgtatcagatgagtcttgctggaagtctgatgtagtttgtgtatagttttagacccaaatttatatgcagagataacgcaggaaaagataattaagtctatctaagattcagtgggattagtaagccttaaaaaaaaaaaaagaccaaatctgtttattgataggttatagaaaagcaaaatacttccttaaattaggcactttttgataggcttaaataaatgatgtataactgttcatgatgttctgatattaaatgaattgtacattcccaggatgaccttgagccctttttctagaccctagtaattaacctgattgctcattac

SEQ ID NO: 35065 - DNA, 1043 bp, Homo sapiens
tgaatgtgggagaaaatcggagagaagcgataggagttagaacatctggatgtgtctgcagcctgctgtcagcccaattgggccagggggtcccaaagacgcatattctcaccccacctccacctgcttcctgatcacatcccagtcaccagcggcagtttcctggatagtgagggagaacaactgcaagttgagagaggcagaggggtggaagggacctgaagctggcctggagaaaagcataggcccaggagagcctgccctgggacagcgcctgtctcccacacagcagcacttggcccagcaaggacctcctcccttggccctggcacatcccactcctgccctttcataagccccctggggaaagcactccagtcttctctgttccaggctgggcagatagggtcctatggggcacagccagggtcctatgggcatagccagggccctatgggtcctctggaagcaagaaagggggccatggaagcagcccagacagctggggttcactcagagaggacccaagtcccagtcccttcctttcagtcaaaacacggatatctttgcctcaggtcacagggccactggggccctgtcatcaaagatgagattcctgaagcctggcattgactggtcccctaagaacagatgttgggatggagaatggggattcatttgggtttcagtaaaacaggggggtctggacaagagcgggtgggctacttggtatccacacacacgcactcacacaggagccaacccattgcagctgaacaagcagagaaactcagtctggaaaggcccctcctgcctgctgaagtcactgagaccctgccacacctctcctcgccactgtcaccactcagggcaccactgtacagtgcaacaagtcaggagacctaggtcctactcctgacacttgctaattagctctatgactctgggcaaatcgcatatctgggcctcagtttcctcatctgtaaaaatgacagcaaactcgtaatgctcaataaatgtttaaataacaactgaaggaggcc

SEQ ID NO: 35066 - DNA, 184 bp, Homo sapiens
gcgtgacctcatagctactcacaataataaaattacacatgaaagcaggaattggctaactctaggcctatgggccagatccagccagttgcgtttttgtaaatagagtttttttgaaacaccagtcaccagccacattcttttacttatgtcttgtctatggccgttttcaagccacaatagc

SEQ ID NO: 35067 - DNA, 548 bp, Homo sapiens
  misc_feature (527)..(527): n is a, c, g, or t
gatcaattcaaggagaatagttttgggacagtctcccaaaccaagcacggtgcctctctaagggctttttcctaacaatctataattttccttcttttatctttcagaaaacatccttgtgtgtgctccagtagcctccattccaggtctacgcatgattatctgggtctatgaatgcctgggacttcatccttgtgctacaagtcacaatctcaacaggacacatacagagataaaatgctcaaccagcaacccaaagaaaaaactgaaagtgaagtggccagggccatgatgttgctctgctatcctctatcacacatcatcagaaataccctcacctctgtagtccttgattcactcccaatttaaaatgtttccatggattcccactgtatttacatccaagacctactccaccacactctttgctgcaccttctacacactagaatttcttaggaggatctccccgcaaaaatccaatttggtcccaggatgtggttaggctctgagatctcactctttcanttccatctgtgatggcatgag

SEQ ID NO: 35068 - DNA, 362 bp, Homo sapiens
accttcttgaagatcctactgagttattttagagtcttttttagagttgctctattattttaattttaactgcagtgatttcatgctgaccttgtaggctggctttcctcatgtgattttccttatgaatttttgaaatttgtaggcttatcttgaatagcccatttttttctctctgcactcatctctccatatttaatagttctgtgtgttcttttgccagttcttccagagtccccagttctgagccaagatttactgagataatcttgaggctcatacatcatggtgatatcaggactatcacagattcagtcatgcatttgggggcagcttggctcagccactggtcataggctgtg

SEQ ID NO: 35069 - DNA, 368 bp, Homo sapiens
aagatgttattaagatgtaacagtggagatttcattagtcctgcaaagtgtggtatttcttggctgtcgtgtgagtcctgtggactcaccaattatcattaatccagcctctttctactcaaagttcacacttaaaaggaaagctctgtaaaagggaggaagacgtgaagaaggagcacgcccggcagtactgagtgcacgttattagtcagtgctgcccttttgctgtatttttcgtaaaatatttattaaatttgggtgtcattgtgacaagaagaaatgcagttaagtgtgacctttttttttccccaaacatgttaggttttaagaacctttgagctattgtcagatataaccagaaaaaaata

SEQ ID NO: 35070 - DNA, 510 bp, Homo sapiens
tttttttaaaatttcttttttaatttatatatatatttttgagatagagtctcgctctgtcacccatgctggagtgcagtggcacacccttgactcaccacaacctctgcctcctgggttcaagaaattctcctccctcagcctcccgagtggctgggattacaggctcccaccaccactcctggctaatttttgtatttttagtagagacagggtttcactatgttggcctgactggtcttgaactcctgatctcaggtgacctgcccgttttggcctcccaaagtgctggaattacaggtgtaagccactgtgcccagcctctctgctcaattttaggggtttatgtgattagattaggtccactcagataatccaaaataatcaacccattttacagtttgtcacctaattacatcacggggtccctttcgctgtgttttgcaacatatttcaggttctagggcttacacatgagcattttatggagctattataccgcctattgaa

SEQ ID NO: 35071 - DNA, 456 bp, Homo sapiens
aaaaaaaagcaaccccacaaggttcagtcccggagcatcctctagggtctgtgccacctgacagaagtacagggctccatcctgccccaccccaccccctgcctgggatccagtgtgaggcccagactctgtccctccccctgggccaccgggcctggcacacacagttggcattgggaacataaaggatggatttgaaccccctcctgggctgctccttcgagacctggagacctgtctcaagacccagctccaggcagacagacatcgtttcctccacaatcccacccactctggggacatctgcagggcctcaccgatggggcatgggaggcctggcggctcccaggaagccaccctcagccctcactgccctgagctcttcacctccactctcagacctgagcccagcccacccttactgatggggcatccctcttgttcacccttccttcc

SEQ ID NO: 35072 - DNA, 437 bp, Homo sapiens
ttttttccagacacaagcattttgagtaagagagtcaggaatatgtctaacatgcaaatgacaagaaaccccatggccagagtggagaaagtaaattaaggagtattggctagatagtgtaaactttagaatgacagtccgaggcaagagtttggaacttttgttgccatggacctctttggcagtaacgaagccttagaattatgttttcaaatgtgagaaataaagtatttaggattacaaaggaaaccgataatattgaaatacagttgttaaaacattaagctcttctttactgatgcatgaaataacaagatttagcagttattctaattaccataatttccaagtagtgatcaatgaaaaagatatcttgtgtccaggcacggtggctcacgcctgtaatcccagcactttaggaggctgagatgggcgga

SEQ ID NO: 35073 - DNA, 1007 bp, Homo sapiens
ccactggtgaggaatctcagccttcaggacaaccagactaaatcattcatgccatctcccatgacagcatcatgtggaccagggagcctaccttatggtgaactcatggctgggagatctgaggtccagacatgacaggaaaaggaaaaagaccaggagctctgcctaagtagcccccctgtgtgaatcactctaccctccaccctcatcttcagttcgtgatgggtattgtcttgtgaaaactgaaagctgggctgggacacaggcaagagagtctctgactcacaaatctccatcgtgggctctctggcctttctgatattcttttcacacatcaattctgggccaagacacatccatgctcatcaagaaggcattgataggagaatcaggtagcctccagagagacaggaagcagataaacaccctcatgttggcctcctaagcccagaggagaaaaaaaaaagttggaggggaagaagttcaagaagccacactagaagccactgattaccatcacctcggcacctgtcctccatctgcccctctttcaagtgaggaccagactcaggggacagcacctgcacctccccctctgtccatgcactgtgtagggagcctccttctgctctcatctcaaggtggctgctccgccaggtcagccgtatcactgctgagagtcttccctgggtcctggtcacagggtctgggatcagcagcaacctggctttgattcagctctgaccctgccccttcaggacacaaagcccattattaaagggataactgaactctcctagttcactcaaccttagattttccttctcagtgtccttctagaaagtgccgcctctactaaatgatttcatgttatttcctcaggtctagagctatttgatttccaaaattctatactcttctgttctcattcccggtcatggctcattttccctcagcagctaatgatgctaatcatgtatctaccccccattgtcacaaaaaagaga

SEQ ID NO: 35074 - DNA, 282 bp, Homo sapiens
tcttttttttataatagctatcctgacaggtgtgaggggatatttcatactggttttgatctgcattttcccgacgattagtgacgttgaacaatttttcatatacctcttggctattggtttgtgtttttttgagaaatgtctaagtctttagcccattttaattggcttattagtttttttgtttttgccattgagttgtggggggttattttatattttggaatcaaccatacttcctctattcaacatagcattggaagtcccagccagaataagtgg

SEQ ID NO: 35075 - DNA, 532 bp, Homo sapiens
ccccggccaccatttttgcaacctactaacgactttctatggatggatgcagttggtcatttcattcataccatccgctgaaatcctaatgccactgttatggaattggcatcattatctctactttacaggaaagaaaattaagactcaggggagaaatgggagttgcccagaatttcctgcttgtacatgtgccctgtcggcttctttctccagagactggggctctagaaggtaaaggacctgttcacgatcgcccagctcactggagccagagctgtctggttatagcaatggccatgggagaagtctgcgtccagagcaaacacaaagggctcagtagcaggttggatttgaatcctttttttttttctttttttttggagatggagtctcgctctgtccaagcaggaagaggccaggcgaggtggctcacccctgtaatcccagcactttgtgaaactaaggcgggcagatcacttgagatcaggagttcgagaccagcctggccaacatggcaaaaccccatctc

SEQ ID NO: 35076 - DNA, 453 bp, Homo sapiens
cagaagaattgcttgaacccgggaggcggaggttgcaatgagccaagatcgcaccattgcactccagcccgggtgacagtacgagactcggtctcaaaacaacaacaacaacaacaacaacaacaacaacaaagaattgaaattgtatatatttaaagtgtactgtgtgagttttgaaatacatatactataaccgagccacatctctctctccaaataaatctttaaacaatttctggtgaagggttggtgcctgacagtatcctagggggtaaaaaatgatagcatctgaagttaaaagtaaattaattcttacatcttaccaggaaaattatcacagcaaatactatatttttccttaataactctattgtttatttccattcatttcttagaagggaaatggcatttcactacaaaataatttggttaataaagaagtttcaagatatc

SEQ ID NO: 35077 - DNA, 511 bp, Homo sapiens
aacagcaggtaaaacatgaaccaacctacttagcaagttagatcaagaatctattgattgccaagtctctttgagtcctgcaacacacttcctctctgtcccttctgttaaagcaaactaaatatggcccaagaaggaccccatacttctatatttcagtccctgtggacgaactgtaacctagcttaataggcagacaagattgagaacctaatttagtagtatgtgcctgtaacaatagctgagtcttggccaatcccagcagccatgcttcaaccactcatagactgctgagtgttcaaactgtgttcaaagaaggcaaatgccaacctgtaaccaatccaactgtttctgtacctcacttcagatttctgcatgtcacttcccttttttgtgtctataaatttgttctgaccaccagacatccctggagtctctctgaatctgctgattctgggggctgcccaattcacgaattgttcattgctcaattaaactccttgaaattcaa

SEQ ID NO: 35078 - DNA, 220 bp, Homo sapiens
ttgtttttttttggtcgatttagctagagatttgccaattttgttctctttcaaggaaccacctttttgttgctttgattttctctgtttttctgtaatctctcccacttattttcactataaacttcattattttttccttctgcttgctttgggttttattttctcttaattttgtgtttcttataatgaaagactaggatatttatttgagatgagt

SEQ ID NO: 35079 - DNA, 732 bp, Homo sapiens
gataaaaatatcatttatccatcttattctatggtaattgtcataaaaatatagctctagtttaaattaataattggtctagcaattggaaaaatagcaaatcattttatttaattagatcttttcatgaaaactgatttgaagaaatcttaaaatatgcttcatatttcaggaaatgataagatactttaagctttgcctattgattttctactggaggatggtagactggggaagggtaactttaatgtgaaacttccatataaaatgtgttaatgtattctctgagatcccacccatagaaaatagactattttaattctatgcccttttctattttcttctaaacagggaatctggtgtcactaggttactgcagtttaagacagattgcctttgtccaacctttccgtgtttgccaagtaaatagtaaataactggacagtatctttgtgattaaaatgatcttccaaaatagtttcctccacaagatactccaatatgtttctgcatatttaagtaagctagactgtgtctctaggataatttattttagacacctgaagagttcataaagtgctacagagtgaaattattatttgagttgtatcatgtatcaaattccatatgaaactgcttttcttctaagactgaaccaggaagaaattgaatacctgaacagaccaataatgagctccaaaactgaatcagtaataagtagcctacccacaa

SEQ ID NO: 35080 - DNA, 1039 bp, Homo sapiens
atttttgccatcatttttttaattaaagaaaaaatttccagaagaggaaaaaaaaactacaaaaaacaaaacattgaaggttgatattttatgtggaagaacatttgaattgaattcagaatttttctgaaggtgtagatactttttttttttttttaacagaaaacctgatgtcaagaggtgggcaatagaaatggaaacaaattgtcttcctcaataattaagctactttctctttttcccttcttgttttaatctagtgggttttttattttattttttcttagaaatatgtaggtaaggtttatcttgaatcttaattgccttaattttaaggacgtcaaaggctctcgaggcaagctgtcaacgtcttgttgaaaacaaaaatcaagaaagaattgaaatactgtgccggctttcactggcacagaagtttaagactatgagtttttagggtgaagaaaaaactgtacagtttaaatgaaaatgtttttcttcatttgaagaaaatttgttgataaaccatggcaactgcaagaattggaaaaatgctgggacttttcatgaactttgtcttaagtgttgacatgaatcattctaaaaggctaaaacattttacagtaaagttattaaggttggtttaaaaacaactgcattagaaataatgcgtgtttggggggcagaatgcagatttttttaatttacaaagcgtgatcgctagcaaaagcattagtgctttttatctgcagtcttttttatgagctttacaaagtttttagtcagctttgcttgtcacattgcaaaacctagcttaagagcattaaaaaaaaaaacttaagtagataggagcttatggtcaaaaagtgcaaaaaaaaaaaacaaaaaaaaagcaatagatagagaaattgttgacaatttctgtagtctttcctagttgtgatcaaattcagcctatggatggcctattttataccaaagatgaagtgacaccctattacagtccagaagatagaggttgttttcgtttcttttcttttta

SEQ ID NO: 35081 - DNA, 681 bp, Homo sapiens
tggcgaagcgggccccagtcactgagccgccgccgaggattcagcagcctcccccttgagccccctcgcttcccgacgttccgttcccccctgcccgccttctcccgccaccgccgccgccgccttccgcaggccgtttccaccgaggaaaaggaatcgtatcgtatgtccgctatccagaacctccactctttcgacccctttgctgatgcaagtaagggtgatgacctgcttcctgctggcactgaggattatatccatataagaattcaacagagaaacggcaggaagacccttactactgtccaagggatcgctgatgattacgataaaaagaaactagtgaaggcgtttaagaaaaagtttgcctgcaatggtactgtaattgagcatccggaatatggagaagtaattcagctacagggtgaccaacgcaagaacatatgccagttcctcgtagagattggactggctaaggacgatcagctgaaggttcatgggttttaagtgcttgtggctcactgaagcttaagtgaggatttccttgcaatgagtagaatttcccttctctcccttgtcacaggtttaaaaacctcacagcttgtataatgtaaccatttggggtccgcttttaacttggactagtgtaactccttcatgcaataaactgaaaagagccat

SEQ ID NO: 35082 - DNA, 555 bp, Homo sapiens
ctccgactaaagggcggggacgaaaaggaatcgtatcgtatgtccgctatccagaacctccactctttcgacccctttgctgatgcaagtaagggtgatgacctgcttcctgctggcactgaggattatatccatataagaattcaacagagaaacggcaggaagacccttactactgtccaagggatcgctgatgattacgataaaaagaaactagtgaaggcgtttaagaaaaagtttgcctgcaatggtactgtaattgagcatccggaatatggagaagtaattcagctacagggtgaccaacgcaagaacatatgccagttcctcgtagagattggactggctaaggacgatcagctgaaggttcatgggttttaagtgcttgtggctcactgaagcttaagtgaggatttccttgcaatgagtagaatttcccttctctcccttgtcacaggtttaaaaacctcacagcttgtataatgtaaccatttggggtccgcttttaacttggactagtgtaactccttcatgcaataaactgaaaagagccat

SEQ ID NO: 35083 - DNA, 774 bp, Homo sapiens
agcgggggttgcatcagctgggtggggcaccgcctggcagcccggactcccccgacatgtgatcggcttcccaggagggcgggaggcccgggcgttccccgagcctggggaagctggccgtcccggactgacctgctcggggagagccagcaaaggacacattcggcctggcccaagccctgacgatttcagtgttgttttctgcacgcgcaaaacacctggggaccgaggggatggcagtggcatcctatctttgacagctctgaacgagcttaaccttttttttcagacccctttgctgatgcaagtaagggtgatgacctgcttcctgctggcactgaggattatatccatataagaattcaacagagaaacggcaggaagacccttactactgtccaagggatcgctgatgattacgataaaaagaaactagtgaaggcgtttaagaaaaagtttgcctgcaatggtactgtaattgagcatccggaatatggagaagtaattcagctacagggtgaccaacgcaagaacatatgccagttcctcgtagagattggactggctaaggacgatcagctgaaggttcatgggttttaagtgcttgtggctcactgaagcttaagtgaggatttccttgcaatgagtagaatttcccttctctcccttgtcacaggtttaaaaacctcacagcttgtataatgtaaccatttggggtccgcttttaacttggactagtgtaactccttcatgcaataaactgaaaagagccat

SEQ ID NO: 35084 - DNA, 629 bp, Homo sapiens
tggcgaagcgggccccagtcactgagccgccgccgaggattcagcagcctcccccttgagccccctcgcttcccgacgttccgttcccccctgcccgccttctcccgccaccgccgccgccgccttccgcaggccgtttccaccgaggaaaaggaatcgtatcgtatgtccgctatccagaacctccactctttcgacccctttgctgatgcaagtaagggtgatgacctgcttcctgctggcactgaggattatatccatataagaattcaacagagaaacggcaggaagacccttactactgtccaagggatcgctgatgattacgataaaaagaaactagtgaaggcgtttaagaaattcagctacagggtgaccaacgcaagaacatatgccagttcctcgtagagattggactggctaaggacgatcagctgaaggttcatgggttttaagtgcttgtggctcactgaagcttaagtgaggatttccttgcaatgagtagaatttcccttctctcccttgtcacaggtttaaaaacctcacagcttgtataatgtaaccatttggggtccgcttttaacttggactagtgtaactccttcatgcaataaactgaaaagagccat

SEQ ID NO: 35085 - DNA, 366 bp, Homo sapiens
aagagacactgggaaaccatgtctagcacttacagcctcgaatgttcctgctgtcctacattcaaagacattactctgtacatattaaccttcactattcagatgaactacaactggaactggatctaggatatagggaaatgaaggaaagggggcgttggaatccagtagacatgggttggaacccaaactccagcaattgacagctgtatgcatggacatatttattgtttctccttaaaaagatttcctttttatttaaaggacttgaaatgccttttagttgtgcctgtaaagactgtgaatcttgcatttgcctgtgatccttagcagtagggtaagcccacatctggcatatgtgctggc

SEQ ID NO: 35086 - DNA, 240 bp, Homo sapiens
ccatctggagacagaggcatacagggagagtaccatgtgatgatgaaggcagaggttggagttatgcagctgcaagccaaggaatgcctaaggttgcctccaagccgccaaaagctaggaagaggaaaagaagggtttccctacaggcttcagaggaaacatggcactacagacatcttgattcagacccagccttcagaactgtgagacaataaatttctgatgttttaagccacccac

SEQ ID NO: 35087 - DNA, 1080 bp, Homo sapiens
  misc_feature (839)..(839): n is a, c, g, or t
  misc_feature (892)..(892): n is a, c, g, or t
  misc_feature (1080)..(1080): n is a, c, g, or t
ccgaggattcaagcagcctgccccttgaggccccctcgcttccctgacgttcctgttcccccacgtgcccagcgttctcccgccacgccgcgcggcttccgcaggccgtttccacgaggaaaaggaatcgtatcgtatgtccgtatccagaactccactctttcgaccctttgctgatgcaagtaagggtgatgacctgcttcctgctggcactgaggattatatccatataagaattcaacagagaaacggcaggaagacccttactactgtccaagggatcgctgatgattacgataaaaagaaactagtgaaggcgtttaagaaaaagtttgcctgcaatggtactgtaattgagcatccggaatatggagaagtaattcagctacagggtgaccaacgcaagaacatatgccagttcctcgtagagattggactggctaaggacgatcagctgaaggttcatgggttttaagtgcttgtggctcactgaagcttaagtgaggatttccttgcaatgagtagaatttcccttctctcccttgtcacaggtttaaaaacctcacagcttgtataatgtaaccatttggggtccgcttttaacttggactagtgtaactccttcatgcaataaactgaaaagagccatgctgtctagtcttgaagtccctcatttaaacagaggtcaagcaataggcgcctggcagtgtcaagcctgaaaccaagcaataccgtcatgtttcagccaagcccagagccctaagattacaaacaactatggccggaacctcctcagctctccctctgcagagttccctaccctaagagaatgttaccanctgaacagtcctcggtgaatctgagaggagaggatggggtaaggcagaagcancagctgtactactagaagggagctttggtggtagaccccctggtgtctccaacctgactaggtggaccagagctcaaagaggccctctttaccgtaggcgaggtgataggacatctggtttgccacaaaggtctgttccgccagactttcctagtaggattgtccactcaaatgtggggccacttttn

SEQ ID NO: 35088 - DNA, 1226 bp, Homo sapiens
  misc_feature (985)..(985): n is a, c, g, or t
  misc_feature (1038)..(1038): n is a, c, g, or t
  misc_feature (1226)..(1226): n is a, c, g, or t
ccgaggattcaagcagcctgccccttgaggccccctcgcttccctgacgttcctgttcccccacgtgcccagcgttctcccgccacgccgcgcggcttccgcaggccgtttccacgaggaaaaggaatcgtatcgtatgtccgtatccagaactccactctttcgaccctttgctgatgcaagtaagggtgatgacctgcttcctgctggcactgaggattatatccatataagaattcaacagagaaacggcaggaagacccttactactgtccaagggatcgctgatgattacgataaaaagaaactagtgaaggcgtttaagaaagtaggtcttcagtgagattttgggaaagtcataatggatttgtccacaagggggtgccagctgtgttgtatgtattgttagcggaaggggtgataaatgcgttcatgctcttgctaggcctaattcgttttcctttgtgcttgcagaagtttgcctgcaatggtactgtaattgagcatccggaatatggagaagtaattcagctacagggtgaccaacgcaagaacatatgccagttcctcgtagagattggactggctaaggacgatcagctgaaggttcatgggttttaagtgcttgtggctcactgaagcttaagtgaggatttccttgcaatgagtagaatttcccttctctcccttgtcacaggtttaaaaacctcacagcttgtataatgtaaccatttggggtccgcttttaacttggactagtgtaactccttcatgcaataaactgaaaagagccatgctgtctagtcttgaagtccctcatttaaacagaggtcaagcaataggcgcctggcagtgtcaagcctgaaaccaagcaataccgtcatgtttcagccaagcccagagccctaagattacaaacaactatggccggaacctcctcagctctccctctgcagagttccctaccctaagagaatgttaccanctgaacagtcctcggtgaatctgagaggagaggatggggtaaggcagaagcancagctgtactactagaagggagctttggtggtagaccccctggtgtctccaacctgactaggtggaccagagctcaaagaggccctctttaccgtaggcgaggtgataggacatctggtttgccacaaaggtctgttccgccagactttcctagtaggattgtccactcaaatgtggggccacttttn

SEQ ID NO: 35089 - DNA, 341 bp, Homo sapiens
gctggaggcagtgtgagcaacaaagacctgtgtgtccaggaggggcaaggtgacgaaaggtactcactcacccaaagaggagacttttaccctcgttaggaaagagggcaatgggtgtgttggaactggctcctaccagctctcaaatgttaaattttcagggattcagggagccagttgttaaatacagttattattaaaatttaaaatacaaagttgcaattaagtaaattatactgagaaaggtaatactcacaactcatcacttatattgatgatctacgttcttgagatgatgttctgcatctatatggcagaagtactactacacaatggtgtgc

SEQ ID NO: 35090 - DNA, 310 bp, Homo sapiens
taccttttcttttaaaagtattttatttatttttgacaaatggttatagggaatggatctagacttcaaacagcaaattaatggaaaattaatggaaatacagaggcttttagctttagttaaaatatattgtgttactcagacctttagtttgcaggtaaaaagagataacggtctattatattaatattccttcctggccgggtgcggtggctcacacttgtaatcccagcaccttgggaggccgaggcaggcggattgctttgagctcaggagttccagatcagcctgggcaacacggtgaaacccc

SEQ ID NO: 35091 - DNA, 659 bp, Homo sapiens
gaagaatgcagtatctgaaataaaatatatattggatgggattaatagcagataagacacacatcagtgggcttgaatagataacaatagtgactatccaaaatgaagcacagggtggaaggactaaagaaaaaaacagcatcagtgagctgtgggaaatatcgagtggcctaagacgtgtaattagaatcctaggagaagggaggggcaacagaaaatattataagaaataatgacttttatttattttttatttcaacagtttttgggaaacaggtggtgtttggttacatgaataagttctttagtggtgatttctgagactttggtgcacccatcacccaagcagtgtacactgtactcaatgtgtagtcttttatacctcataccactttcaccctttccccaagtccccaaagtccattgtatcattcttacacctttacatcctcacaaatttagctcccacttatgagtgagaatatatgacgtttggttttccattccagagttatttcagttagaataagtctccagttccatccaggttgctgcgaatgacattaagaaataatgactttaaacctctgttctctgtttagtagaaactataaacctgtagatgatggtaagaagtcaacctaaagtagaagaaatat

SEQ ID NO: 35092 - DNA, 593 bp, Homo sapiens
gcccaagataagaaatggcaaaaagcacagtcgtgtttttccagtctgatgggaagtcaaggaacaaagcaatctagggtactggtgagtgttactgagttaagggagcacacttgtctcatttctcagcctgacataggtgacttgtctggtgctctgcagatgctgagtagcacagtatctggcacagaagggtcaggcaataaagatttatttcactggattaaaaaaaaggcattctttaatttttatgatggactctttcatccacattcagctctgacacgtaggagtcacttttctttctttcctacatttgttctgtcgatctgatttaaaaaaaaacaagatgttttcggaatcatccctgtggagagataaggtggtgatggcaatgggaaaatgcaaagtagaaattagaaacaaatacatgaatatatttgcagtagcatttgaggaactgggaacgtttagtgactgtgtgtgtgagtgtgtgtgtgtgtgtgtgttttcttctaagcacaagtgctgatgttctgagatgaggtagtgcatcatgaatcatacacagaaaggatttatgaaccaaaaaa

SEQ ID NO: 35093 - DNA, 499 bp, Homo sapiens
gctgcaaggtaaacctcccttcgtttctgattttattagagaaacagttcttgtgttatgctctgggtaagaactactcagttgttggaagcccatcccacagcctcacctgctggaaatcagtcacctcttcttttcctccctttatacaaatagagcacttttgcccctggttggataatgatgttcctcataacaggttaagtcaatggttaagtcagtgatgaggggtaggaaactatttttattgggcatccactacgcactcaccccacttaatcctatttaacttagtatttgtcaaaggatcagaggaacagctctgactatgggaggcagaattactgggctctgctaaaaaatgtggtagagcatgctgggccttcaggcctagactggagtcctcgcactgctactaactgagaagctttgagcatgtaacttcacctctctgagactcaatgtcctcgtctgcaaaatggctttgagcagcagctat

SEQ ID NO: 35094 - DNA, 131 bp, Homo sapiens
aacctacccctaggagtgggagaagaccacaaccaaagaagcaaatggacacacggactatcagatgaaaggcagctacacaggaaaataaagcagtgcagcaggattggaggtgcttgtggtgagaggag

SEQ ID NO: 35095 - DNA, 388 bp, Homo sapiens
aaaaaggttttttttccacgctctgcagacttggtttttaaccccagaggctcggggcgatctggggcgggtagcacggagccgcatcgccacctagtgaccacacgacggcaccgtccttgcccaacgccccgtttccatctcctgctgtctggagcctcctgcttttgctttggagagaaatccagaggtgactttgcagctcagcaggtgcggcgcctgcaccgtcttttttaccccttcccgtttcccaccttccggtctgcaaagggttgtttactttaggatttttttagggagaggtggtatttaaaatatacgtaatgaaaacattttattactatctttaaataaaaacaatctgaatagcttaacaaaacaaatatag

SEQ ID NO: 35096 - DNA, 212 bp, Homo sapiens
gcctgtcgattattttaaaaagctcttaattccctgatatctatataattgggtgcatattaatgcagatggaggtgttagtttgtatcattttgttatacatgggactattcattattaattcatattaccattatttattattatttataagtgtgtgacatgaggtttatgtgtttcatactctttaatacattactgaaaaaaaaaca

SEQ ID NO: 35097 - DNA, 346 bp, Homo sapiens
agtgagaacatgcagaatttggttttccgttcctgcattagtttgctaaggataatggcctccagctccatccatgttcctgcaaaggacatgatattgttcttttttatggtatagtagccattttcaaaaagacaggaacaagcttttctttcttctaacatttggaagttttatattcgttcttttttcttccattttgttttgtttttttagagacagggtcttgctctattgactgggctggagtttaatggtaccatcctggctcactgcaacatcaaacttttggggtcaagcaatcctctgcctcagccttccaagcagctgggactacaggcatgta

SEQ ID NO: 35098 - DNA, 598 bp, Homo sapiens
tagcctggtctctatactatgtggtatgcttagtttggtgttttaaaaaatcatgtgtttttgaagcactgtggctgactttcaggagcaccattctaagtttatttgcatgacaaggtggtcatctagggttgtgccaaatttctgacctggtacttagtagtttttttttttttttcctgagatgtgtatcagaaaggaggtgaatgttgtaaatgacattgaccattgtccgatgtatttttagagtagatcattcccaaactttagtactttattttaagttgacaaactacttgtgatagagaacacagctgaccacagtatactctgagttttcacttatatctgctttgagaatgcctgtgtttattttgtagggttcctccttgcctgattttactgaaataattaagccaatgggtgctggtacgtgagagctttgggaggccaaggtaggaggatcccttgagtccaggagttcaagaccagcatggccaacatagaaagagtctatgaggccgaggtgggaaaatttcttgaggccaagagttcaagaccagcatggccaacatagagagattctatctctaaaaaa

SEQ ID NO: 35099 - DNA, 1185 bp, Homo sapiens
gtcgctggaaggctgcgtgctggtcgcgcccagctgcgtcaccccaggaactggggtctgtgggccagtgtggccgtctctacgaagactggcacgacccctaaagttaggtcggaagacctgtgggcagcttgagcgccgaggagtgccctgaacgctcaactcgccctggaaacgtttttccgtacagcaacatggcggcgcccatggactcttagaaaaggagaaagctttttctctgtggactggaaggggcatttttcatgatcactatttagatgggtgctgttttcatgaggagagtctgggaaggcggcgtccgcttttctgacaagggaagaggctactttgtccttttaaggattcaatgacttcctgacttggaggatgtggacctagtggctagacccaaggaccaaagcaagaagtcgtggggggcccaggaagacaggaggatcacattgggattccagacataagatcaggttttaaccccctttggccaaattttggctgaaaatgttgaattatcaactctgaaattaaaaagaaagtttatattaaaacattgcaattttccttagaatttctgtatatattaacatcatgaatgataaattctcttcaatgtgcatgtcaggtttttgtacttgtatatcaaatctatctgtgtgtatgaagtgtatgtttattgaaatacaagatatttaagaagctgatctggaaagttggattttcattctagttcctaattcccagaggcttttttaaaggaagggaatgtctgtggtacaccagttgtcagctgggtggttactggatcatctttcttttatcaacaagataaactatcaacttcaccagcatcatgaaccttgttgccgtaaaaaggagttcactacttctgttcactttgagtctcttcaaatggattctgtgtcctcctctggagtctgtgctgcatttattgcttctgactcttccactaagccagagaatgatgatggaggaaattatgaaatgttcacacgaaaatttgtttttcgacctgaactgtttgatgtcaccaaaccttatataactccagctgttcataaagaatgccagcaaagtaatgaaaaggaagatctgatgaatggtgttaaaaaagaaatctccatttctattattgggaaggtagaaagt

SEQ ID NO: 35100 - DNA, 587 bp, Homo sapiens
tgctcgaattcaagcttctaacgatgtacggggacatgtcaggtttttgtacttgtatatcaaatctatctgtgtgtatgaagtgtatgtttattgaaatacaagatatttaagaagctgatctggaaagttggattttcattctagttcctaattcccagaggcttttttaaaggaagggaatgtctgtggtacaccagttgtcagctgggtggttactggatcatctttcttttatcaacaagataaactatcaacttcaccagcatcatgaaccttgttgccgtaaaaaggagttcactacttctgttcactttgagtctcttcaaatggattctgtgtcctcctctggagtctgtgctgcatttattgcttctgactcttccactaagccagagaatgatgatggaggaaattatgaaatgttcacacgaaaatttgtttttcgacctgaactgtttgatgtcaccaaaccttatataactccagctgttcataaagaatgccagcaaagtaatgaaaaggaagatctgatgaatggtgttaaaaaagaaatctccatttctattattgggaaggtagaaagt

SEQ ID NO: 35101 - DNA, 1331 bp, Homo sapiens
aaatttatatccctaaaatttttagaaatctctcaaaatctttccaaatgttctggtatctttgaaaaatgtaaatagtttatttatagagaaccctacctctgaggttgactcaaaggttaaagaaggctcatcagtctatccttctgcctccatatatcctgaacatcaaactatcccaggaaaaccatctagagtagtttgtttcaaaatattagccacagaccacctacatcacaataactcagggagcttatagaagtgaagattcctgaatataaacatagtaataattcaacctactgaatggaaatctctgctgaaatccacagttttcataagctccccagatgattcctgtgtacattaaatctagaaaccattagtttgagatctctcaaaaataaaaataaaaattgctttcagagagtagcccatgaaatttcccattcttcaaggacaaattccttctgttcagccttggtcctccaactgcagtttacaatttttgttcttctcctgtaaagaatgtcaatggttatcaccttcaatagtttcaatatgtcccccaaagttatgtgtttgaaacttgcaatagtattgggagatggggcctaatgaggtgattaggtgaagtctctgccctcatgaaaagattaatcccattatctcaggagtgtgttggttataaaagcaagtttggctccctcttttcctcacacactctttttcccttctgccttcacctttgccgtgggtggacacagcaagaaggccctcatcagatgctggccccttggtcttgaatttcctagcctctacaactaagccaaataaatttctgtttattataaataacccagtctcagatattctgttacagaaacacaaaatggactaagacaccacccttttccaaaatctctccttgtgatggctccctttactaacctttcttttagctattccctttatgatagtttcttaattttttctatcaaaagctaaatatggcacacttgttctttacagaaaaataaagatattttaaacaaaatactagggccatggtatgtaataaaatttgaaacaataatttcaaataataaagattgaaaatgcttaacccagaaaaaaaacaaaaaaagaaaaaaaacaagaaaaaataagagaaacaaatagaacaataaagcagcaaaaacaacagaatcatacacaaacaagaggggggggggcgataaatatgttacacggaggggacacaatagtgtgcgacacgccagggtttgagaaagagggcagccccaaagagggggattatatagaaggcg

SEQ ID NO: 35102 - DNA, 462 bp, Homo sapiens
ttttctctgccttagaaaacttggtggtcacagaaggataggaggatactggcagcttggaaggctgaaggaagaggcttcatgggagaaagagacctaaggaatctctagtccctaggtacctggaaatccatacacatccccctgaccaaccaaagtcccagttaggaaaacatggatattgcctacaatatgcgcccctaaacccctgcccccagcgccttctccctctgcccggaccacagaccgttccaggtgtcccagagccacttgggaccatgtgaactcaatgaacaagtgagcaggttcttcttgtgggtttcaaatgaatgtatggcaggaccatcttcagacctgttgagacctgttgaaaatctcaacatcctgctaagttatactgccaggaaagagactggcccaactggatggctgtggccccttcggtagaactttctgtcactc

SEQ ID NO: 35103 - DNA, 505 bp, Homo sapiens
gtgcgatcttggctcactgcaacgtctgcctcctggttcaagtgattttcgtgcctcagcctcccaagttgagtagctgggaccacagtcacacgccaccatgcccagctaattttgtatttttagtagagacagggtttcaccatattggccaggctgggcttgaactcctggcctaaaagtgatccacccacctcagcctctcaaataaactcctttaagttacttattttgcactgtgatagggtctagtgtccttacattttatgcatgcaaaatccaaaaacctgaatattttcaaagcactgaatagttgacaaatgtacataatgatatgatattaaacattctagtaaaaattttagagtaatgtatttttgtcagtaaaattacacagcttgaagaaatattattctcttacatttttatgaaatgagacaaaatagttacctttttaaagtaatttatagtgtcaacagtttatatttattaaagtatttatact

SEQ ID NO: 35104 - DNA, 358 bp, Homo sapiens
ggcaggagaattgcttgaacccgggaggcagaggttgcagtgagctgagatcgcactactgtactccagcctgggcaacagagcgagacttcatctcaaaaaaaaagatgcctggcacttcatgaggaatagtattcatcattattatttgctttatgaaggtacaataccagaaggcatagtttttttttatcctttttttcacctaacagccatcacaagacatttcccctgtggcatcgtggagtggctgtgtcatgactcccacttgccgcatctgagtggacactttggatgcagccattagtttgatgttattaaaaatgccatgatgggcatgaagctttcatcttttggc

SEQ ID NO: 35105 - DNA, 341 bp, Homo sapiens
tttttttttaatttcaggccactgtcttctagatttgattcaacataaatgttttgataaaattagcacatggataatactatgtgtttcttactgcatcccatcagcaggttcactattggtgatcttaagtttgagtgtgtggcatggtggtgacctctagattgctccacttaaaggtacattctttccttcgtaagtaatctgtgctgtgatacttttaagaccatgtgaatgttctgttcattacaccattcaccagacggttttagtagccactgatgatccatgtttgaatcaattattatccagagtattgcaacaggatcattttctaatta

SEQ ID NO: 35106 - DNA, 508 bp, Homo sapiens
acagggctcggggagggcatcgcccttgggggttgtggggactgagagctgtccactcccctcactctctgggcagtgtcagggtttctcagatgggccagtcttcaatttaggtgaggattattagtaggacacctgcagactgttgtctggggggtctctagggactgggaatccaggaactgagttcagagcccttggggaagaaggaattgtagaaaacaatcagatagcactacttgacttacagttccttatgatttgtagtcacttctgacattattgttgctaaaacttttctcatactttttgtttggcaaacctcctcaagggggctttaagctggaggaggttaccagctctgtctcagtctacacccacatccctgcccccagtaatcctcagatgcaggaccttcccagtgcctgtgacaactaccactgcaggggtgtcccgggggctgcagactcgtggggcatgtggggttctggattccgcagcagcctag

SEQ ID NO: 35107 - DNA, 1606 bp, Homo sapiens
gttaaaattgccatttatttcatcaatactttgatttcccttaacctctgtgatacaagagttttctgatttggggttatatggactactttaggagttgaagtatttcctacacaatttttacatgaaagatcttgactaaggtgataccccatgacacatcctttgcattcaggtttatgttttggctgtggagatccctaactacttgatggctccgggttcttatttaatggtcgtcatttagccaatacatttttattaagagctggctatattcaaggacttagaagcaagattaggatgattgtgaccctttgttttggcctatataggggacttcaaatattaacttatcttagccttagatcatttgcatttatctattacaatatcatttcttttaaaatggcaatgccatattgttgattcctgttatttgtatgcccagattcctccatgtttgtagctagctagttgcttctatcagtgcaacttatttttaccaccctattctaattgttcttcacttttatttaatcattattttaaatatttggattcatttttatatttatgcatgccatttagtttgctcctaaaaatagtgatactggttttagttttttacttactaaatcagtatagccaaatgtccatcttcctagtggtaatatgcgatcagaatttctgagattatttatgtgactatttttggaaaagtttcttttgataaaacatggatttattatatgaaattcttcttgcactgtattacaatatatgctatgatatcccttttatttttttcaacttaaatatgatgttttatattgttttagacttacgaatcgtgtttttcagaatcataagggaatatctatctcctccctcactttccttttatatatattgaaaagtctatgaaattcaagtctagcatttgaattctctatgctatcattgcatttacctaattatttacttttaaattttagctattttcataaaaacagttttgagatgaaggaaacttacacaataaaaggaagatcaataagcaggaaaattagtaactgacagggaatatgaatgaatactcagtatacgtttcggtatgcttgttttctgataaattacttaattttcatttcataggccaaattttaaacaccagttaataaagttatcctaaaagagtctctaatttgaaaagtttttctaacctaggaagactcattttagacccaactgaccagtcaaatatgagtaatttataatatctgtattaaatattgagaagattaataaagttaaaagtttacagttgaatctttttttatcatggtaaaatatacataaaattgatcattttaaccattttttaagtgtacagttcagtgccattaagtacattcacattgttgtgtaaccatcaccaccatccatctccaggatgttctcatcttcccggactgaagcctgtacccattaaatggtaatgccccattccccctcctccccagtccttggtgaccactgttctactttctgtctctataaatttgatgtttctcagtacctcataaaagtgaactcatacaat

SEQ ID NO: 35108 - DNA, 585 bp, Homo sapiens
cagtgtgaattctttcatgtactcgtaaaaaactgggaaaaatgaatgcctttccacaatctttgcatttataaggtctatctccgttgtgtgttatcatgtgtgttagaacacttgtgtgggaaatgaaggctttcccacattcccttacatgcatagggtttctctccagtgtgagttctttcgtgtactcgaatagaactggaacaactgaaggctttcccacattgtttacattcatagggcttttctccagtgtgaatcctttcatgaactcgaagcgaactggaacaactaagagcttttccacattgcttacattcatagggtttttctccaatgtgagtccgctcatgtctttgaaagggctggtgatatatgaaggtttttccacattgtttacatttatagggtttttctccagtgtgactcctttcatgtctttgaaaggatttgagataactaaaggctttctcacactccttacatttatatggcttctcaaatagctcgtatccagtgtgagacctcatgtgtctagtaagggatgagagactctgtgaaggctaaagaagatagtacact

SEQ ID NO: 35109 - DNA, 461 bp, Homo sapiens
agcacttcgggaggccgaggtgggtggatcacttgaggtcaggagtttgagactagcctggccaccatagtgagaacctgcctctaataaaaatataaaaattagccaggcatagtggtgcacacctgtaacccagctatttgggaggctgaggcaggagaatcacttgaacccagctgcagagtttgcagtaagctgagattgcaccactgcactccagcctgggtgacagagcaagactctgtctcaaaacaaacaaacaaaattaaacccagagagttgtaatagtttcccagggccgccaaaacaaatcatcacaaattgggtggtttgagacaacagaaattgattctcttgcagttctggaggccagaagtcccaggtcaaggtcaggctcttggggatgatccctccttgcctcttccagcctctggtggctccaggcgtttcttggctcaggg

SEQ ID NO: 35110 - DNA, 435 bp, Homo sapiens
agagctgccgatactactactaaattcgcgcccggctgcacaaggattggtcaatacctgatatgatcccttccagtggggttgcagggaatcttttatttgatgttgttttcagttaacaaaatctccaggttgtaggccatggtctctgttacctttatctccctggagctcattgcgaaaggaatcctttattaatttggaatttatggtaggaagttttgtgagaccttggcaataatggaggatatcacctttaagaagtacaggttcataagctcttttatctagccacataggccttcttgttattatttcaaagaaagagacttgacgttttatgagtggggtggattgtaggttgagcagaactaatgggagaggtgctggctagagaaagttaaaaatttctgttagctttgcattgagcttttt

SEQ ID NO: 35111 - DNA, 331 bp, Homo sapiens
gacatgtgatttacttatatgacaaatctgtacatgtatccctaaatctaaaataaaagtttttttaaaaagacctatgtttaacttctgaaaaagtttttttctgcttgatttagcctattatcattaaagcttttaaataatgtatttggtatttccttcagtgagtttttcagttccactgtttttgtttggttctttaaaaaaaaaaatctatctccttggtaaatttcttgttcacttcctagactgattttttgagttctttgtttttcaggtttgtcttgcatctcaatgagcttctttaaaatcagtattttgaattattaac

SEQ ID NO: 35112 - DNA, 500 bp, Homo sapiens
ttctctctggtccttcatcctagaatttgcatccggtgtttctaacttctgctcagaaaccgtgaaaataatatattcatttaccgattgattcatccaaacaataattgggtacacactacataccaggtatcgggaataaagagcaatgaaaagcaagtcccttgtcctcaaggagcttagtttaacttaaaagtgttctcctatttaaggccagtgagtggctcacaccagtaatcccagcacgttaggaggctgaggcaggagaatcatttgaggccaggaatttgagaccagcctgggcaacaaagtgagacattgtttctacaaaaaaaattttttttaaaacttagcctggcacagtggtgcgtgcctgtggtccagctacccagaagactgaggcaggaggatcacttgggcccgggagttcgaggctgcagtgagctatgactgtgctactgcactccagcccgagcgacagaacaagaccccatctctta

SEQ ID NO: 35113 - DNA, 400 bp, Homo sapiens
aactagggcaattttgccccagaggatgactggcaatgtccataggcattttgggctgtcacaactggggattggtggcaggaatgctactaaatgtagtagggtacacaggacagcccctccacaccaaagtaagctggcctaaaatgtcgatattgtagaggcttagacactgtaatctaatatatcatcaaatgttatggattccacctctaaaatacagcttaaatccatcaatttctcttcatcttaactactagcatttcctaattcaagtaccattgcctctcacttgaaatactacagtacaacttccctacatccatgcttgctcaacttcaatctactctccatagtgcagtgaaaataaactttttaactcatctgtcccctgcattaa

SEQ ID NO: 35114 - DNA, 392 bp, Homo sapiens
cctttttacagataaggaaaccgaggctagagagtgtaagccccttgctcaaggtcagccagctcataaatggcaaagctgggtgggattcaaacccaggagtccagctcctaacactgctattaaccttcctgcttcctgtctctcctgctcagggcaggggctcagtagatacttgtctactaaagggatgcatggaggaataaaaataagaatagtcacatttattaagcatttgttacctgccagcctttgaccttcacacggctcccctccataatccttgccaaacgtccaatatcatggaaactgctagtgctccattttgcagacgggggcgcaaggacctggggaagtggagtggttggcccaggaggtttggagcctgggtc

SEQ ID NO: 35115 - DNA, 792 bp, Homo sapiens
tttttttttaagtcatgttctgctctggttgaagtggggagcagtgcctgtctgcccaggccctgcgggcactcccatggagatccagagccacctctctggaacccctaggtctccacagtgcagtctgtaagctaaggcaccccagcttctgtcctcagcttgagccaagtgtgtagtgtggccttgactccaagcccagccctggctgagcctctgggagtgggaacaggcagtcctccctctgccctccccacacctgcccagcctgggctccctttgtgagggtcattgtctggctgggctgcaggtgtgctcaacagcgcccggtctctccacagggtgcctattccgccttcgtgtacagctatgctgtggagaagcccctgtctgtgggacacaaggtggctggctacctccccagcctcttctggggcttcatcacactgggccggctcctctccattcccatatcctcaagaatgaagccggccaccatggttttcatcaacgtggtaagcagctgaatagcctcctctctcttctgagagacccaggagaagccgcctcctcctggccctaccccaggacgtttgcccaggcctacattctgccagcaggatgggaactcaggagtagagggaagagaggagagagaggatgacgaggaaggggtgggagcctgggaggtggagcctacctgggtgaccatgaaaagtcccttcccctctctgggctgctgatcttatacccttaaaacataaaaggaaaggtctgtaggaggtgctggct

SEQ ID NO: 35116 - DNA, 324 bp, Homo sapiens
ccatttttaaatagttgctaaaagcaaaagttattactggtgaaaagtccagaaaaaggacactatgtgacaccaagttcagctctcaccacatgtcagatcttgtaaatgttttcttacaagtcactggcatcttaggcaaattcaatctattataatagtcaatctgttgtctatttgaacattcatcaaaaaatcatggtcagtattctcaaattcttagttgcatatgatcagtttccttcaaccaggagttcttcaagggtaaaggtttatattgtatttattttttcttattaataaatgtgtcttccttctaatgcc

SEQ ID NO: 35117 - DNA, 364 bp, Homo sapiens
atgacaggtgaaatcaagtttattttttatagtctgaaagtcaaaggaaagtgagccagaagaaacctaagtattttctgaaaaggcctaaaaggtgatcaacatgggcctccattagttaaataacattttcacaatggcattgagtaagcacagctatttgtcatttctgttttgaaaaataagtgatactgttgtaagtaaagctttttctttaactcttttgacaaagtttgatgtggtaagatgtgttgaactttttgttgttgttgttttgagacagggtttcattattttgcccaggctagagtgcagtgatataatcatgcctcactgcagcctcaacctccctaggctcaggtga

SEQ ID NO: 35118 - DNA, 319 bp, Homo sapiens
ataagatgtgatgtggaacagacatgtttttgaggactggggaccttcagcctgtagaaggggtgagggggtggtggaatagctgcccctaaataaaaactcacttgtggaaaagaggtgagacttattttgtgtggctttgggtaccaaaactaaaactaaaagtggtttgaagcactaagagacagattcttcagcagaaagaataactggactgggtgcggtaatcccagcactttgggaggccgaggcgggtggatctcttgagctcaggagttcgagaccagcctgggtaacatggcaaaaccctttctttacc

SEQ ID NO: 35119 - DNA, 424 bp, Homo sapiens
gccaaaaaaaccctcagtcttactctcctgagaggtactactctatctccttcccttcttagccaaacttgttggaagttttctttgttcagtctccctttcccaagctctttcatttctcaatctaccacaaaatagccagtagaattgctggatactacttttcctcaacttatgccgccctcagcagcatttaaacttgcaacactctcctgttccctagccttctgcaagagcacacgtgcgtctcatctcaggcttttctttctgtatttctggaccgttctccattatttcctgtgtaagctccttttcaaacttcaagtgttgcagtgccctgtcgtcctaaaccctcttttcttccgtgctgtcttcctgggcaatctcaattggtcccatggctttagttatctatatgttttca

SEQ ID NO: 35120 - DNA, 322 bp, Homo sapiens
cacagtgctccccacttccccatcgattgccccatcctcatcccaggcctcagctcacacaggaagtgatggcagagtcacttcctatccaggcacctctgacctatcacctccacaccccacccgtcggaggctgatctccccacgagaaggcatcagactcacccctgtccagggagggtgcctggagagtgagccactctcaaagtcactcagacctgggctcacctggtggctctgccagtcctacctgttgacagtgaaatgttcccaaaatatctggtcaaaatctgcaaacattggagcactgagacctacctcc

SEQ ID NO: 35121 - DNA, 206 bp, Homo sapiens
atttgcctctgtatctctgaaggattttatggatttagctcttatatatagatgcttaatccattttagttaaattttgtatataatgtaaggtaagaatctaatttcattcttttgtatgtggaaatccagttgtctcattattatttgttgaaaagacaaatggtcattcttaaatggagatagttttattccttcccttctaa

SEQ ID NO: 35122 - DNA, 307 bp, Homo sapiens
tttttttaaactagtttcaacagctctgaggcttaataaaaacttgcacaaaaatgtaaatcaactagagaagcttatattcttgatttgtggtaaagaagaaaaaaataaaaaaatctgcaaaaatgcattttcttatttgcatatattttgtcccttctacagggacagaaattgaataaaaccaatcttcaaagaaaaatagaataaaaatatgtagacccaaataatgcaggagccaataaattcaacagagtttcctctttgcagagttagtgtttccacacagacaaagcttctaagtgta

SEQ ID NO: 35123 - DNA, 391 bp, Homo sapiens
accaaatgagcactccaaacagtaagagtttttgaagtatacgctttcttctgagaaatgaacgtgtcccagaggagggtgccttcagatggaccttaagagagatgtggccatcccctgagtcatacaagttttccagatgtcctttcaaaatctctgtcctttccaccgtctctgtcctcacacatagaggaacttttctcacgggaaggttgcgatgaagagcataaacccaggagtcaggcacgttgtagctttgagtacgactctgttccagatctgtaatctttggcaaatggaactcacctgcaacgatacctacttaaatatagttgtgtgatgattaaataataaatatgaaagtaaataacatagggctttgaagttcaag

SEQ ID NO: 35124 - DNA, 357 bp, Homo sapiens
ttttgtagtgagtttgtgatcccaagattttattttccttttacaatcacatggaatggcacccatttatttagaattgtttctctactgtctcctcacctgctggagactgtgagcagctttatgtctctgtgcctggcaaagcacctggcacccaccatcatataggaaataataaatgtccgctgtcctggagtcccaggggcccagaggagagtgttgtcttgctggcattctgtcccaggttgtgctcaggctgttgcattgagagtcagttctgctggccgtggactggtctctaagtatctgctagagtcttctttataacccccagtgtgagcaatacaatacactctg

SEQ ID NO: 35125 - DNA, 762 bp, Homo sapiens
tctcgtcttgacctcttcctcttgaccttgagtcccttgagtagggggactctgtgttggtcaacttctattttcaacctcaaagaaagttggagaggactcctgcatatgctgtaaagggtgtcctctcagatttactgatcgaaatagacaggggcagttggctgtgcatcaatgcagaatgacaaacagcatgtcagggcatttgtgatgccaatagtggcctttgaaagtctactttgtgcaacctaacacattgactaggcctgtgacctgacccactcctagagaaaggggaaaaactcagagcttgcctgccaggtaacatttctgcctcctccttgctccagtctgctctgagagccagcgaagtctctctcaccagcctatcatttgtctgactcaggcttttgtctgggctgaaggctattacattttgaggagaatgacatttctctgggacccctgggggtctgtatactgagtgactgcccagtgagccgggaaagcaaagtgtggttaatactttggccggaaatacgacagaaaagtgatgaaacaagtctccatcttgctccttgctcctcttccctttctcttctcccacacctttgctctgctcttccactcttcaccctaaatcagcaaccttcaagtgatgatgacaaaaccataattcaggagcacgtggtcttcagagaacttcaaagaaaatgagcaaaggtaaaggggtgtggtggggaattggatctgaaaaaaaaa

SEQ ID NO: 35126 - DNA, 171 bp, Homo sapiens
tctccctgggagaccaaaagccttcatacatctcaagttgggggacaaaaaagggggaagggggggcacgaaggcttttggtctccctgggagtgggtggaggcagccagggcttacctgtacactgacttgagaccagttgaataaaagtgcacaccttaaaaaaaaaaa

SEQ ID NO: 35127 - DNA, 771 bp, Homo sapiens
tctccctgggagaccaaaagccttcatacatctcaagttgggggacaaaaaagggggaagggggggcacgaaggcttttggtctccctgggagtgggtggaggcagccagggcttacctgtacactgacttgagaccagttgaataaaagtgcacaccttaaaaaaaaaaaaaaaaaacaaaaacaaaacaacttgtgttggggggcgcctgtgggcccttggagaaaaggctttttctagagaaccacatttgcgcgttgtgggggcgcgcggggtggcccccaagtgagagggtacaagggtgggcacacactgtggggcacaaatacggctggtgggtccccccataaaggaggagagagaatccccctgggggggccaatctgagaacacaaaaggagcgcggcacgagaggaggaaatctccatcaaccccaacaatattatagaagacaaaaacgcgcgcctccacgggggggggacaaacaccacggaggaagcgacggtgttctctgatgagagaccacaaaatatgattcttcacaagatatgttggggagcgctcttcttctgaggaggaggaggagccatcacatataataacgcgggagggggaaccttccttatatattcaaccaacgcgagggcgaagcagctgatccaccaaaagagccgcagcaggaagccgctctgcgtaagacttcatatatctcaaacaaatttattataagagacgccacacgacgtggcctcgtcgttgggtcggaatca

SEQ ID NO: 35128 - DNA, 471 bp, Homo sapiens
agacagacagacagagacagacataccaactgatctccatatgtaccttatttagatcccaattcaaatgaattaactagtaaaatctgggcatttggagatttgaaccctgattggaaatggggcaaaattaggggagagttgttaaatttttctaggtccaataataactttgtgtttttattttaaaagcacctattggctgggcgcggtggctcatgcctgtaatgccagcactttgggaggccgaggcggtgaatcacttgaggtcaggagttcgagaccagcctggccaacatgatgaaacccccatctctactaaaaatacaaaaattagctgggaatggtggcgcacgcctgtaatcccagacaggagaattgctctaaccagggaggtagaggttgcaggtgagctgaaattgcaccagtgcactccagcctgggtaacagaatgagactctgtctcaaaaa

SEQ ID NO: 35129 - DNA, 653 bp, Homo sapiens
aattctccatgattgaagctgttgtctcaactgccctgggcagagtctggggaaagttaggagcagggaggtgttatctgagcaggccctagtcctactggtgtcttgagatgaatgttctattcgggaaccccacagtgagttcactttagagcatcattttagcttatttttaggattagaaataattagttgtgccttctgagcaccctttgacactctcaagaggcgtttctcacacgtttaaattgtgtgatctgtgtttagtttctccctgccccatacatgttgatatgttttggttcagatgtcacctgtatacttagtattactttccatagcagttttcacctgtggacaggttaacatggtgtgaatggtagaaggagccggtctggttttcctagacaagtctgtaaaacaaggcgtgggttagctaatcagtgaagtcttctaggttctgggattataactgacccttaggggcccttccatgctgaagtgtgcagggttggttttgaggctgccactgagtgccaaggtctgccaacatcagcacagttgtctgccaagcatgaggagtcaggggtgcatcctccatcatggaaaggcttgggggagaccacacctgtgttcctcttaagtattttgga

SEQ ID NO: 35130 - DNA, 289 bp, Homo sapiens
gcacccccaccccagccaccacctgcacccggcccaggtctcctgcctccgactctcctttttgggtccctcggagtcgtcctggcctcgggcagcccaggctgggcacaggaggcagcgccaagtcaccaggcacaaggcatggggtggggggcagcgattctggctgtggcggacagaggaggatccctgcatccctggcccacctccacccacaaccgacaccctcgccgaaggcctccctgcgcctcagtctccccaacaacaacatgatgtcagaaggcctgag

SEQ ID NO: 35131 - DNA, 596 bp, Homo sapiens
ctcattataaatgagaaacttataaattataaatatacactcattataaatgaagattgcttggtaatggactaatggataattgtttctgcttctttaggatgttctaaatttttcccaagttttgtacattaagcacaaaattataacaggaaaataaagaaaagaatttaaaataaacatgcaaccaaattttaaacagataagtatatcgtattagataggaatcaccatactgggtcagtcacccctcctccaaatttttctttattcttttttttttattatactttaagttttagggtacatgtgcacaacgtcagcgttttgttacatatgtatacatgtgccatgttggtgtgctgtacccattaactcgtcatttaccattaggtatatctcctaatgctatccctcccccctccccccaccccacaataggccctggtgtgtgatgttccccttcctgtgtccatgtgatctcattgttcgattcccacctatgagtgagaatacgtggtgtttggttttttgtccttgtattagtttgctgagaatgatggtttccagcttcatccatgtccctacaaaggaca

SEQ ID NO: 35132 - DNA, 305 bp, Homo sapiens
gaggcattcacacattggacagctatgaggacatgtcctaagtaaacaaatctatgtaccaaaaaactgtgattcacagtatgactctaatagggaaaactgatcatctgaaagcccaacagtggattaataaaatggtcatctaatcacaatgctgaaatgatggacagccatttgaattgatgtttacaaaaacgtttttagggccgggcgcggtggcccacacctgtaatcccagcattttgggaggccaaggcgggtggattaccggaggttgggagttcgagaccagcctgaccaacatg

SEQ ID NO: 35133 - DNA, 262 bp, Homo sapiens
ttttttttttgcaatggaaatgtacggggtattcttagggatactgtccatttttaagaaaagtccattaccaagatataacaaattacataaagttaactatcatatgatatttataaagcatactacacatatatacaagtttagaaaaccaatcgactgtgaatgaactgttgagaagtgaggaaaacacgtattgagtactgaggtcaagaaagagtacattgcagttctagaggtcttatatgtatttcattgtgct

SEQ ID NO: 35134 - DNA, 502 bp, Homo sapiens
tattttctaatatcttaagcagttcagacagtgacttgcttgagtcatcttctgaagctttaaaaacaattgatgaattggccttcaagatagacctaaatagcacatcacatgtgaatattacaactcggaacttggctctcagcgtatcatccctgttaccagggacaaatgcaatttcaaattttagcattggtcttccaagcaataatgaatcgtatttccaggtaatgagccagtggtttctttcattttaattaattagttagacatataaaaacttgctgatcacttagcagttgctgcttccaagaggtcttggtccatgaagtggcaaggtctgaatgttggctaagtttaactagagcagtagccataaagtattgtgggagctcagagtgggtatgctttcataatctgggtgacaggggtggtcagcttaccttctacaagaggggttactggagctaagcatgagtaggggccaccatacttggggtga

SEQ ID NO: 35135 - DNA, 4570 bp, Homo sapiens
taaaacccaaatgagatctacagctctgtctgtaggggtttatccaggagttgcagtgactactgtagatacaaagggaagtcctggtactggctaatttgaacttgcaattgttcactcgcctaactatacatgtggaataaagttattaccattcaattatgattacttgaccaatatatctgtgtgtgtgtgacagatggattttgagagtggacaagtggatccactggcatctgtaattttgcctccaaacttacttgagaatttaagtccagaagattctgtattagttagaagagcacagtttactttcttcaacaaaactggacttttccaggatgtaggaccccaaagaaaaactttagtgagttatgtgatggcgtgcagtattggaaacattactatccagaatctgaaggatcctgttcaaataaaaatcaaacatacaagaactcaggaagtgcatcatcccatctgtgccttctgggatctgaacaaaaacaaaagttttggaggatggaacacgtcaggatgtgttgcacacagagattcagatgcaagtgagacagtctgcctgtgtaaccacttcacacactttggagttctgatggaccttccaagaagtgcctcacagttagatgcaagaaacactaaagtcctcactttcatcagctatattgggtgtggaatatctgctattttttcagcagcaactctcctgacatatgttgcttttgagaaattgcgaagggattatccctccaaaatcttgatgaacctgagcacagccctgctgttcctgaatctcctcttcctcctagatggctggatcacctccttcaatgtggatggactttgcattgctgttgcagtcctgttgcatttcttccttctggcaacctttacctggatggggctagaagcaattcacatgtacattgctctagttaaagtatttaacacttacattcgccgatacattctaaaattctgcatcattggctggggtttgcctgccttagtggtgtcagttgttctagcgagcagaaacaacaatgaagtctatggaaaagaaagttatgggaaagaaaaaggtgatgaattctgttggattcaagatccagtcatattttatgtgacctgtgctgggtattttggagtcatgttttttctgaacattgccatgttcattgtggtaatggtgcagatctgtgggaggaatggcaagagaagcaaccggaccctgagagaagaagtgttaaggaacctgcgcagtgtggttagcttgacctttctgttgggcatgacatggggttttgcattctttgcctggggacccttaaatatccccttcatgtacctcttctccatcttcaattcattacaaggcttatttatattcatcttccactgtgctatgaaggagaatgttcagaaacagtggcggcggcatctctgctgtggtagatttcggttagcagataactcagattggagtaagacagctaccaatatcatcaagaaaagttctgataatctaggaaaatctttgtcttcaagctccattggttccaactcaacctatcttacatccaaatctaaatccagctctaccacctatttcaaaaggaatagccacacagacagtgcttccatggacaagtccttgtcaaaactggcccatgctgatggagatcaaacatcaatcatccctgtccatcaggtcattgataaggtcaagggttattgcaatgctcattcagacaacttctataaaaatattatcatgtcagacaccttcagccacagcacaaagttttaatgtctttaagaaaaagaaatcaatctgcagaaatgtgaagatttgcaagcagtgtaaactgcaactagtgatgtaaatgtgctattacctaggtaactgcatatatataaggaatgtattttgttaagaaggcttttgtgaaattcagaatttttctttttaatatatttcttccatggaagagttgtcatcactaaaacttcagtactgagagtaacatgactcagtagccacagaagctatgatttgtaaaatatataattgaatcagagtaatcataatgcaggggagacattcaaattagagacaagggagaagcaatgctgaggaagaccctagatagagctcattttactccacctaatcgttatatctggatatacccattttctgcatcttctttctcaacaataaaaaatgtaactattttgaatgcccacaaatcccattccagtgttactttctgtgaatgcagtaccatattctcattttcaatgacatttcaaccacaggcagaaaagactgtttactccttgacccaaagattaaaaaggattttttattattttaaatattacaccttcagaaccataacatgcttaagaaaactttcccaaaatgttgacctagttaaatgaggctatataaatttctaatattttacttattctattcaaggcatagggccaaagcattaagtataatttaatcccatacattcgagttaagtttagtgttgatgttccatcattctggacctcccaggagttgtttaagaatgaatctcttacacctctactttgcccctctactgtatattaagcccataggcttgtgggaggaaggagaatttccattaggcaagctgtatgcagtggaattttccttttaggagacacacaattaagactctctggttctgtccttgctttggagactttaagacatttcctaaagcacaaataaaagcctcgtatttccccattgagagttttgttccaaggaatatgaagtgagacatatgggtgagtcataataatcaaaataatttatgaagagctgggtctgcaatagctagtctaaaaactacttgtgtgtcagtcctctggttatagtatataagagcctgaggaggtctggcaagatagatggtgtattatttatggatcaggctgctgcatacaaaccttgcatactattatgcagcttacctaactctcagactattctgagtaatgcttgcttgctaatgaatgtataggagaccacattgtaattgttcttagatgatggagtccatgcagtttcttagaaatcggtctcagtgcatgctgtgctttttcacatttgctctgggttatctgggaagtatcaggttctgggaggcaacagcattaagtgataagaaaaggagacattctggcaaagccaatctgcttaaaggcaaagtccagaacctggaacctagaggcctttctctctgcacgaaaaacaggtagtttgcagtctgagatatgggagagcttttaggctacacagcaacccaagggacctctcaccttttgctgagcttcaatcaggaagctatttgcctggctccagcagatgatgagataatgaggtagtgggttttttattactgttccattttgcaacatcctgcaacaccatcctgggagacaagagcattacccagcttggctttcacgggggagggttgtattcagtaaaaaagaatagtaaatataaggtcactgagattctaagtaagatagtaaatctaaggtcactgagccaaatccttttcaataggcatatattaacaggctgcttattttggcggaggttacatatggatgaaaatgaatcttagtcactgaatattcatatacatttcccccaaaaccttagacattcatagtagattttaattagttagctttctaactagtcagatttctgcccaaagtgcttagtcaatagtaattaagatatagcttcaaaaatggctttgcttttgatttctactcatattcgtatggctccagaaaaatatttttttcatatttgacaatgtcagctccactttagaaattttcaataaccagatgagaaaaaaattaagaaattgctcaagggaaacatttgtaaatggatttgaaagattgagccaaattctgttgtcagttctaagcatgcagttctcacctccatttagtcccccatcagaacagaggtcaggaatttagctggggagcctaaatttagttcagcttacctttgagaatagcatcaattcagactctcttttcattatgttttcttttctttttccctctttttaaactacattgtgttagagtcatagtctaggatcctgagagattttccattcttgtcaccattcacttgcattgtaaagattttctttgtctgttgttggcatagattcttttgtacatatttatttatttgtgtttatatatgtcaattggtttcctttcttagcttgatattgcctagctttgttgttttaattaactttctattagagagactgtatatattttttctaaatactttgtgaaatcatttttggtagcaatatctttgaatatgatgaataaaagtgactgtgagtgcaaatagaattagcagtaagaagctactctagctaatttgccattttacttaaatggaaaatgtttttcaaataaatacttatgttgttcatgttccaagtta

SEQ ID NO: 35136 - DNA, 4616 bp, Homo sapiens
taaaacccaaatgagatctacagctctgtctgtaggggtttatccaggagttgcagtgactactgtagatacaaagggaagtcctggtactggctaatttgaacttgcaattgttcactcgcctaactatacatgtggaataaagttattaccattcaattatgattacttgaccaatatatctgtgtgtgtgtgacagatggattttgagagtggacaagtggatccactggcatctgtaattttgcctccaaacttacttgagaatttaagtccagaagattctgtattagttagaagagcacagtttactttcttcaacaaaactggacttttccaggatgtaggaccccaaagaaaaactttagtgagttatgtgatggcgtgcagtattggaaacattactatccagaatctgaaggatcctgttcaaataaaaatcaaacatacaagaactcaggaagtgcatcatcccatctgtgccttctgggatctgaacaaaaacaaaagttttggaggatggaacacgtcaggatgtgttgcacacagagattcagatgcaagtgagacagtctgcctgtgtaaccacttcacacactttggagttctgatggaccttccaagaagtgcctcacagttagatgcaagaaacactaaagtcctcactttcatcagctatattgggtgtggaatatctgctattttttcagcagcaactctcctgacatatgttgcttttgagaaattgcgaagggattatccctccaaaatcttgatgaacctgagcacagccctgctgttcctgaatctcctcttcctcctagatggctggatcacctccttcaatgtggatggactttgcattgctgttgcagtcctgttgcatttcttccttctggcaacctttacctggatggggctagaagcaattcacatgtacattgctctagttaaagtatttaacacttacattcgccgatacattctaaaattctgcatcattggctggggtttgcctgccttagtggtgtcagttgttctagcgagcagaaacaacaatgaagtctatggaaaagaaagttatgggaaagaaaaaggtgatgaattctgttggattcaagatccagtcatattttatgtgacctgtgctgggtattttggagtcatgttttttctgaacattgccatgttcattgtggtaatggtgcagatctgtgggaggaatggcaagagaagcaaccggaccctgagagaagaagtgttaaggaacctgcgcagtgtggttagcttgacctttctgttgggcatgacatggggttttgcattctttgcctggggacccttaaatatccccttcatgtacctcttctccatcttcaattcattacaaggcttatttatattcatcttccactgtgctatgaaggagaatgttcagaaacagtggcggcggcatctctgctgtggtagatttcggttagcagataactcagattggagtaagacagctaccaatatcatcaagaaaagttctgataatctaggaaaatctttgtcttcaagctccattggttccaactcaacctatcttacatccaaatctaaatccagctctaccacctatttcaaaaggaatagccacacagataatgtctcctatgagcattccttcaacaaaagtggatcactcagacagtgcttccatggacaagtccttgtcaaaactggcccatgctgatggagatcaaacatcaatcatccctgtccatcaggtcattgataaggtcaagggttattgcaatgctcattcagacaacttctataaaaatattatcatgtcagacaccttcagccacagcacaaagttttaatgtctttaagaaaaagaaatcaatctgcagaaatgtgaagatttgcaagcagtgtaaactgcaactagtgatgtaaatgtgctattacctaggtaactgcatatatataaggaatgtattttgttaagaaggcttttgtgaaattcagaatttttctttttaatatatttcttccatggaagagttgtcatcactaaaacttcagtactgagagtaacatgactcagtagccacagaagctatgatttgtaaaatatataattgaatcagagtaatcataatgcaggggagacattcaaattagagacaagggagaagcaatgctgaggaagaccctagatagagctcattttactccacctaatcgttatatctggatatacccattttctgcatcttctttctcaacaataaaaaatgtaactattttgaatgcccacaaatcccattccagtgttactttctgtgaatgcagtaccatattctcattttcaatgacatttcaaccacaggcagaaaagactgtttactccttgacccaaagattaaaaaggattttttattattttaaatattacaccttcagaaccataacatgcttaagaaaactttcccaaaatgttgacctagttaaatgaggctatataaatttctaatattttacttattctattcaaggcatagggccaaagcattaagtataatttaatcccatacattcgagttaagtttagtgttgatgttccatcattctggacctcccaggagttgtttaagaatgaatctcttacacctctactttgcccctctactgtatattaagcccataggcttgtgggaggaaggagaatttccattaggcaagctgtatgcagtggaattttccttttaggagacacacaattaagactctctggttctgtccttgctttggagactttaagacatttcctaaagcacaaataaaagcctcgtatttccccattgagagttttgttccaaggaatatgaagtgagacatatgggtgagtcataataatcaaaataatttatgaagagctgggtctgcaatagctagtctaaaaactacttgtgtgtcagtcctctggttatagtatataagagcctgaggaggtctggcaagatagatggtgtattatttatggatcaggctgctgcatacaaaccttgcatactattatgcagcttacctaactctcagactattctgagtaatgcttgcttgctaatgaatgtataggagaccacattgtaattgttcttagatgatggagtccatgcagtttcttagaaatcggtctcagtgcatgctgtgctttttcacatttgctctgggttatctgggaagtatcaggttctgggaggcaacagcattaagtgataagaaaaggagacattctggcaaagccaatctgcttaaaggcaaagtccagaacctggaacctagaggcctttctctctgcacgaaaaacaggtagtttgcagtctgagatatgggagagcttttaggctacacagcaacccaagggacctctcaccttttgctgagcttcaatcaggaagctatttgcctggctccagcagatgatgagataatgaggtagtgggttttttattactgttccattttgcaacatcctgcaacaccatcctgggagacaagagcattacccagcttggctttcacgggggagggttgtattcagtaaaaaagaatagtaaatataaggtcactgagattctaagtaagatagtaaatctaaggtcactgagccaaatccttttcaataggcatatattaacaggctgcttattttggcggaggttacatatggatgaaaatgaatcttagtcactgaatattcatatacatttcccccaaaaccttagacattcatagtagattttaattagttagctttctaactagtcagatttctgcccaaagtgcttagtcaatagtaattaagatatagcttcaaaaatggctttgcttttgatttctactcatattcgtatggctccagaaaaatatttttttcatatttgacaatgtcagctccactttagaaattttcaataaccagatgagaaaaaaattaagaaattgctcaagggaaacatttgtaaatggatttgaaagattgagccaaattctgttgtcagttctaagcatgcagttctcacctccatttagtcccccatcagaacagaggtcaggaatttagctggggagcctaaatttagttcagcttacctttgagaatagcatcaattcagactctcttttcattatgttttcttttctttttccctctttttaaactacattgtgttagagtcatagtctaggatcctgagagattttccattcttgtcaccattcacttgcattgtaaagattttctttgtctgttgttggcatagattcttttgtacatatttatttatttgtgtttatatatgtcaattggtttcctttcttagcttgatattgcctagctttgttgttttaattaactttctattagagagactgtatatattttttctaaatactttgtgaaatcatttttggtagcaatatctttgaatatgatgaataaaagtgactgtgagtgcaaatagaattagcagtaagaagctactctagctaatttgccattttacttaaatggaaaatgtttttcaaataaatacttatgttgttcatgttccaagtta

SEQ ID NO: 35137 - DNA, 4103 bp, Homo sapiens
  misc_feature (3)..(4): n is a, c, g, or t
  misc_feature (8)..(8): n is a, c, g, or t
  misc_feature (11)..(11): n is a, c, g, or t
  misc_feature (17)..(18): n is a, c, g, or t
ttnnttgngtnactttnnagctttaaaaacaattgatgaattggccttcaagatagacctaaatagcacatcacatgtgaatattacaactcggaacttggctctcagcgtatcatccctgttaccagggacaaatgcaatttcaaattttagcattggtcttccaagcaataatgaatcgtatttccagatggattttgagagtggacaagtggatccactggcatctgtaattttgcctccaaacttacttgagaatttaagtccagaagattctgtattagttagaagagcacagtttactttcttcaacaaaactggacttttccaggatgtaggaccccaaagaaaaactttagtgagttatgtgatggcgtgcagtattggaaacattactatccagaatctgaaggatcctgttcaaataaaaatcaaacatacaagaactcaggaagtgcatcatcccatctgtgccttctgggatctgaacaaaaacaaaagttttggaggatggaacacgtcaggatgtgttgcacacagagattcagatgcaagtgagacagtctgcctgtgtaaccacttcacacactttggagttctgatggaccttccaagaagtgcctcacagttagatgcaagaaacactaaagtcctcactttcatcagctatattgggtgtggaatatctgctattttttcagcagcaactctcctgacatatgttgcttttgagaaattgcgaagggattatccctccaaaatcttgatgaacctgagcacagccctgctgttcctgaatctcctcttcctcctagatggctggatcacctccttcaatgtggatggactttgcattgctgttgcagtcctgttgcatttcttccttctggcaacctttacctggatggggctagaagcaattcacatgtacattgctctagttaaagtatttaacacttacattcgccgatacattctaaaattctgcatcattggctggggtttgcctgccttagtggtgtcagttgttctagcgagcagaaacaacaatgaagtctatggaaaagaaagttatgggaaagaaaaaggtgatgaattctgttggattcaagatccagtcatattttatgtgacctgtgctgggtattttggagtcatgttttttctgaacattgccatgttcattgtggtaatggtgcagatctgtgggaggaatggcaagagaagcaaccggaccctgagagaagaagtgttaaggaacctgcgcagtgtggttagcttgacctttctgttgggcatgacatggggttttgcattctttgcctggggacccttaaatatccccttcatgtacctcttctccatcttcaattcattacaaggcttatttatattcatcttccactgtgctatgaaggagaatgttcagaaacagtggcggcggcatctctgctgtggtagatttcggttagcagataactcagattggagtaagacagctaccaatatcatcaagaaaagttctgataatctaggaaaatctttgtcttcaagctccattggttccaactcaacctatcttacatccaaatctaaatccagctctaccacctatttcaaaaggaatagccacacagataatgtctcctatgagcattccttcaacaaaagtggatcactcagacagtgcttccatggacaagtccttgtcaaaactggcccatgctgatggagatcaaacatcaatcatccctgtccatcaggtcattgataaggtcaagggttattgcaatgctcattcagacaacttctataaaaatattatcatgtcagacaccttcagccacagcacaaagttttaatgtctttaagaaaaagaaatcaatctgcagaaatgtgaagatttgcaagcagtgtaaactgcaactagtgatgtaaatgtgctattacctaggtaactgcatatatataaggaatgtattttgttaagaaggcttttgtgaaattcagaatttttctttttaatatatttcttccatggaagagttgtcatcactaaaacttcagtactgagagtaacatgactcagtagccacagaagctatgatttgtaaaatatataattgaatcagagtaatcataatgcaggggagacattcaaattagagacaagggagaagcaatgctgaggaagaccctagatagagctcattttactccacctaatcgttatatctggatatacccattttctgcatcttctttctcaacaataaactgtccttgctttggagactttaagacatttcctaaagcacaaataaaagcctcgtatttccccattgagagttttgttccaaggaatatgaagtgagacatatgggtgagtcataataatcaaaataatttatgaagagctgggtctgcaatagctagtctaaaaactacttgtgtgtcagtcctctggttatagtatataagagcctgaggaggtctggcaagatagatggtgtattatttatggatcaggctgctgcatacaaaccttgcatactattatgcagcttacctaactctcagactattctgagtaatgcttgcttgctaatgaatgtataggagaccacattgtaattgttcttagatgatggagtccatgcagtttcttagaaatcggtctcagtgcatgctgtgctttttcacatttgctctgggttatctgggaagtatcaggttctgggaggcaacagcattaagtgataagaaaaggagacattctggcaaagccaatctgcttaaaggcaaagtccagaacctggaacctagaggcctttctctctgcacgaaaaacaggtagtttgcagtctgagatatgggagagcttttaggctacacagcaacccaagggacctctcaccttttgctgagcttcaatcaggaagctatttgcctggctccagcagatgatgagataatgaggtagtgggttttttattactgttccattttgcaacatcctgcaacaccatcctgggagacaagagcattacccagcttggctttcacgggggagggttgtattcagtaaaaaagaatagtaaatataaggtcactgagattctaagtaagatagtaaatctaaggtcactgagccaaatccttttcaataggcatatattaacaggctgcttattttggcggaggttacatatggatgaaaatgaatcttagtcactgaatattcatatacatttcccccaaaaccttagacattcatagtagattttaattagttagctttctaactagtcagatttctgcccaaagtgcttagtcaatagtaattaagatatagcttcaaaaatggctttgcttttgatttctactcatattcgtatggctccagaaaaatatttttttcatatttgacaatgtcagctccactttagaaattttcaataaccagatgagaaaaaaattaagaaattgctcaagggaaacatttgtaaatggatttgaaagattgagccaaattctgttgtcagttctaagcatgcagttctcacctccatttagtcccccatcagaacagaggtcaggaatttagctggggagcctaaatttagttcagcttacctttgagaatagcatcaattcagactctcttttcattatgttttcttttctttttccctctttttaaactacattgtgttagagtcatagtctaggatcctgagagattttccattcttgtcaccattcacttgcattgtaaagattttctttgtctgttgttggcatagattcttttgtacatatttatttatttgtgtttatatatgtcaattggtttcctttcttagcttgatattgcctagctttgttgttttaattaactttctattagagagactgtatatattttttctaaatactttgtgaaatcatttttggtagcaatatctttgaatatgatgaataaaagtgactgtgagtgcaaatagaattagcagtaagaagctactctagctaatttgccattttacttaaatggaaaatgtttttcaaataaatacttatgttgttcatgttccaagtta

SEQ ID NO: 35138 - DNA, 4635 bp, Homo sapiens
  misc_feature (3)..(4): n is a, c, g, or t
  misc_feature (8)..(8): n is a, c, g, or t
  misc_feature (11)..(11): n is a, c, g, or t
  misc_feature (17)..(18): n is a, c, g, or t
ttnnttgngtnactttnnagctttaaaaacaattgatgaattggccttcaagatagacctaaatagcacatcacatgtgaatattacaactcggaacttggctctcagcgtatcatccctgttaccagggacaaatgcaatttcaaattttagcattggtcttccaagcaataatgaatcgtatttccagatggattttgagagtggacaagtggatccactggcatctgtaattttgcctccaaacttacttgagaatttaagtccagaagattctgtattagttagaagagcacagtttactttcttcaacaaaactggacttttccaggatgtaggaccccaaagaaaaactttagtgagttatgtgatggcgtgcagtattggaaacattactatccagaatctgaaggatcctgttcaaataaaaatcaaacatacaagaactcaggaagtgcatcatcccatctgtgccttctgggatctgaacaaaaacaaaagttttggaggatggaacacgtcaggatgtgttgcacacagagattcagatgcaagtgagacagtctgcctgtgtaaccacttcacacactttggagttctgatggaccttccaagaagtgcctcacagttagatgcaagaaacactaaagtcctcactttcatcagctatattgggtgtggaatatctgctattttttcagcagcaactctcctgacatatgttgcttttgagaaattgcgaagggattatccctccaaaatcttgatgaacctgagcacagccctgctgttcctgaatctcctcttcctcctagatggctggatcacctccttcaatgtggatggactttgcattgctgttgcagtcctgttgcatttcttccttctggcaacctttacctggatggggctagaagcaattcacatgtacattgctctagttaaagtatttaacacttacattcgccgatacattctaaaattctgcatcattggctggggtttgcctgccttagtggtgtcagttgttctagcgagcagaaacaacaatgaagtctatggaaaagaaagttatgggaaagaaaaaggtgatgaattctgttggattcaagatccagtcatattttatgtgacctgtgctgggtattttggagtcatgttttttctgaacattgccatgttcattgtggtaatggtgcagatctgtgggaggaatggcaagagaagcaaccggaccctgagagaagaagtgttaaggaacctgcgcagtgtggttagcttgacctttctgttgggcatgacatggggttttgcattctttgcctggggacccttaaatatccccttcatgtacctcttctccatcttcaattcattacaaggcttatttatattcatcttccactgtgctatgaaggagaatgttcagaaacagtggcggcggcatctctgctgtggtagatttcggttagcagataactcagattggagtaagacagctaccaatatcatcaagaaaagttctgataatctaggaaaatctttgtcttcaagctccattggttccaactcaacctatcttacatccaaatctaaatccagctctaccacctatttcaaaaggaatagccacacagataatgtctcctatgagcattccttcaacaaaagtggatcactcagacagtgcttccatggacaagtccttgtcaaaactggcccatgctgatggagatcaaacatcaatcatccctgtccatcaggtcattgataaggtcaagggttattgcaatgctcattcagacaacttctataaaaatattatcatgtcagacaccttcagccacagcacaaagttttaatgtctttaagaaaaagaaatcaatctgcagaaatgtgaagatttgcaagcagtgtaaactgcaactagtgatgtaaatgtgctattacctaggtaactgcatatatataaggaatgtattttgttaagaaggcttttgtgaaattcagaatttttctttttaatatatttcttccatggaagagttgtcatcactaaaacttcagtactgagagtaacatgactcagtagccacagaagctatgatttgtaaaatatataattgaatcagagtaatcataatgcaggggagacattcaaattagagacaagggagaagcaatgctgaggaagaccctagatagagctcattttactccacctaatcgttatatctggatatacccattttctgcatcttctttctcaacaataaactgtccttgctttggagactttaagacatttcctaaagcacaaataaaagcctcgtatttccccattgagagttttgttccaaggaatatgaagtgagacatatgggtgagtcataataatcaaaataatttatgaagagctgggtctgcaatagctagtctaaaaactacttgtgtgtcagtcctctggttatagtatataagagcctgaggaggtctggcaagatagatggtgtattatttatggatcaggctgctgcatacaaaccttgcatactattatgcagcttacctaactctcagactattctgagtaatgcttgcttgctaatgaatgtataggagaccacattgtaattgttcttagatgatggagtccatgcagtttcttagaaatcggtctcagtgcatgctgtgctttttcacatttgctctgggttatctgggaagtatcaggttctgggaggcaacagcattaagtgataagaaaaggagacattctggcaaagccaatctgcttaaaggcaaagtccagaacctggaacctagaggcctttctctctgcacgaaaaacaggtagtttgcagtctgagatatgggagagcttttaggctacacagcaacccaagggacctctcaccttttgctgagcttcaatcaggaagctatttgcctggctccagcagatgatgagataatgaggtagtgggttttttattactgttccattttgcaacatcctgcaacaccatcctgggagacaagagcattacccagcttggctttcacgggggagggttgtattcagtaaaaaagaatagtaaatataaggtcactgagattctaagtaagatagtaaatctaaggtcactgagccaaatccttttcaataggcatatattaacaggctgcttattttggcggaggttacatatggatgaaaatgaatcttagtcactgaatattcatatacatttcccccaaaaccttagacattcatagtagattttaattagttagctttctaactagtcagatttctgcccaaagtgcttagtcaatagtaattaagatatagcttcaaaaatggctttgcttttgatttctactcatattcgtatggctccagaaaaatatttttttcatatttgacaatgtcagctccactttagaaattttcaataaccagatgagaaaaaaattaagaaattgctcaagggaaacatttgtaaatggatttgaaagattgagccaaattctgttgtcagttctaagcatgcagttctcacctccatttagtcccccatcagaacagaggtcaggaatttagctggggagcctaaatttagttcagcttacctttgagaatagcatcaattcagactctcttttcattatgttttcttttctttttccctctttttaaactacattgtgttagagtcatagtctaggatcctgagagattttccattcttgtcaccattcacttgcattgtaaagattttctttgtctgttgttggcatagattcttttgtacatatttatttatttgtgtttatatatgtcaattggtttcctttcttagcttgatattgcctagctttgttgttttaattaactttctattagagagactgtatatattttttctaaatactttgtgaaatcatttttggtagcaatatctttgaatatgatgaataaaagtgactgtgagtgcaaatagaattagcagtaagaagctactctagctaatttgccattttacttaaatggaaaatgtttttcaaataaatacttatgttgttcatgttccaagttaaaaaaaaaagaaaaaaaaaacaaaaaaaaaaaacacaaaaacaaaggaagacagacgacaaagaaaaccaacacccccacaacaacagccccgaggcaccgggcgcagcacgccagcaaagacagacacccgacccgcgaagaccggcacagccaaggaaccatcgcgacccacccagggagcagacagcgctaggaaccgcacgctagcgagacgcaccaaccgaagcagagcacacgtcggccacaccgactcgcacggccaaggcgcgcaaccacacaaccccgcatcgcggccccgagccccacgcccaccctcaggaacaaccatcatagcaacaacgcagccaaaaagtgatacgaccgtcccaagcatcgcccagacacgccacaccgcaccaagccaaccctaccagcgaaagagatgatcactgcgaagaaacacaaaaccaagaacacagaacaacaaggcaacgagggaaaaaaatagccataccacgaaggacacaacggaagcaagaagacaaaccgag

SEQ ID NO: 35139 - DNA, 1252 bp, Homo sapiens
ggtgcggtggctcacgcatgtaatcccagcactttgggaggctgaggtgagcagatcacgagctcaggagtttgagaccagcctggcaaatatggtgaagccccgcctctattaaaaatacaaaaattagccaggggtggtggcatgcgcctgtaatcccagctactcagcagattgaggcaggagacaagagcattacccagcttggctttcacgggggagggttgtattcagtaaaaaagaatagtaaatataaggtcactgagattctaagtaagatagtaaatctaaggtcactgagccaaatccttttcaataggcatatattaacaggctgcttattttggcggaggttacatatggatgaaaatgaatcttagtcactgaatattcatatacatttcccccaaaaccttagacattcatagtagattttaattagttagctttctaactagtcagatttctgcccaaagtgcttagtcaatagtaattaagatatagcttcaaaaatggctttgcttttgatttctactcatattcgtatggctccagaaaaatatttttttcatatttgacaatgtcagctccactttagaaattttcaataaccagatgagaaaaaaattaagaaattgctcaagggaaacatttgtaaatggatttgaaagattgagccaaattctgttgtcagttctaagcatgcagttctcacctccatttagtcccccatcagaacagaggtcaggaatttagctggggagcctaaatttagttcagcttacctttgagaatagcatcaattcagactctcttttcattatgttttcttttctttttccctctttttaaactacattgtgttagagtcatagtctaggatcctgagagattttccattcttgtcaccattcacttgcattgtaaagattttctttgtctgttgttggcatagattcttttgtacatatttatttatttgtgtttatatatgtcaattggtttcctttcttagcttgatattgcctagctttgttgttttaattaactttctattagagagactgtatatattttttctaaatactttgtgaaatcatttttggtagcaatatctttgaatatgatgaataaaagtgactgtgagtgcaaatagaattagcagtaagaagctactctagctaatttgccattttacttaaatggaaaatgtttttcaaataaatacttatgttgttcatgttccaagtta

SEQ ID NO: 35140 - DNA, 1417 bp, Homo sapiens
taaaacccaaatgagatctacagctctgtctgtaggggtttatccaggagttgcagtgactactgtagatacaaagggaagtcctggtactggctaatttgaacttgcaattgttcactcgcctaactatacatgtggaataaagttattaccattcaattatgattacttgaccaatatatctgtgtgtgtgtgacagatggattttgagagtggacaagtggatccactggcatctgtaattttgcctccaaacttacttgagaatttaagtccagaagattctgtattagttagaagagcacagtttactttcttcaacaaaactggacttttccaggatgtaggaccccaaagaaaaactttagtgagttatgtgatggcgtgcagtattggaaacattactatccagaatctgaaggatcctgttcaaataaaaatcaaacatacaagaactcaggaagtgcatcatcccatctgtgccttctgggatctgaacaaaaacaaaagttttggaggatggaacacgtcaggatgtgttgcacacagagattcagatgcaagtgagacagtctgcctgtgtaaccacttcacacactttggagttctgatggaccttccaagaagtgcctcacagttagatgcaagaaacactaaagtcctcactttcatcagctatattgggtgtggaatatctgctattttttcagcagcaactctcctgacatatgttgcttttgagaaattgcgaagggattatccctccaaaatcttgatgaacctgagcacagccctgctgttcctgaatctcctcttcctcctagatggctggatcacctccttcaatgtggatggactttgcattgctgttgcagtcctgttgcatttcttccttctggcaacctttacctggatggggctagaagcaattcacatgtacattgctctagttaaagtatttaacacttacattcgccgatacattctaaaattctgcatcattggctggggtttgcctgccttagtggtgtcagttgttctagcgagcagaaacaacaatgaagtctatggaaaagaaagttatgggaaagaaaaaggtgatgaattctgttggattcaagatccagtcatattttatgtgacctgtgctgggtattttggagtcatgttttttctgaacattgccatgttcattgtggtaatggtgcagatctgtgggaggaatggcaagagaagcaaccggaccctgagagaagaagtgttaaggaacctgcgcagtgtggttagcttgacctttctgttgggcatgacatggggttttgcattctttgcctggggacccttaaatatccccttcatgtacctcttctccatcttcaattcattacaaggtaagataaattgtacatgaatagtc

SEQ ID NO: 35141 - DNA, 104 bp, Homo sapiens
catttattgaaaatctttttcatataaattttttttcatgtttcaagaaggaagttaccgaattctgtaaccatctaaacatgtaaaaaaaggatactatgtta

SEQ ID NO: 35142 - DNA, 144 bp, Homo sapiens
gtctccaggaatagaatatgtacagcagaaaactaaatttctctgattttatattcatatatgtatctgtttaatgtatttttggcaatgcaatcatgtcattccagctcccctgcaacccatgcctaaggtaagtccccacac

SEQ ID NO: 35143 - DNA, 640 bp, Homo sapiens
ggaggaggcgtccgctgggctcagatccccgactccagccccggttccccggcgcctgggctgcgcggagtccctgtcccgcgtcccggacccctacgcgcagcctccacgcgctccgagctggagaagccgccagcccgccctcccagggcgtgtcgcccgctttctgtttctttgtgcggggcatgtgaaatgtgtggggccagaattgtctccctaaagaacagttaggtgagagttcacatcacaagttgcttctgtgctgctccccagccagggtccgaccggccaggctccggtgaactccaggcaactccagccttgcccagggacttgctcgctccgctgggcgccgcaaaggcacacagatgcgagggaatcctgcggcctggatcctttggggatttgtaattcctcgctgctggttttctcttttaaaccatcacgttttcttgctgagaggaaatcatctgtgatgaaagtctttgtagatgcttggaaacattgctgggcctctctctgccctcttcctctgccgttggacttttgcaataaaaactaccatttgattttaccaaaaaacgtaatgtacatccctcttacccccaccctgccgcggtctgattcttagagtctgtca

SEQ ID NO: 35144 - DNA, 1139 bp, Homo sapiens
taggaatatatacttttcagaccatttcagttaaaacagtaatgatattaatggaatctgtcttattaaggtagtgaatcaactcaacaagaagctaagagtcacagtctgtgattttgagtcacctagacagttttccagagtcatcactaaccttgtcttaagacatagcgtgttgtcttcatttatcttaaactatatcacagaatccctgagataaaattagtcatattatcattatacagccatatgctacctacgtcaagactcttctcttcatctgatcatatgatgtgtaatatgtttatttaataaaatataatccatgctaagtaaagcataacatctatgacttttacatcaatattctgagtagcaaaatgcgaagtcagatatttattactatgcatatacaaatctgtaacaaataaaacgtttccatgtggtagattgtcttttttacaactttattgaggtaaattttacttaaaaatttcacatggtaggttttggaaaaaaaaatactttttaaaaacaaaagattaactcttctgtgtggtacatgaaaaactaactaaaaccaaaaacaaaaggcagcctgggcgacatggtgagaccccaactctacaaaaaattcttttaaaactcagcctcccaagtagctgggattacaggcacgcgttgccatgcccagctaatttttatatttttggtagagatggggtttcaccatgttggccaggatggtctcaatctcctgactttgtgatctgcccaccttggcctcccaaagtgctgggattacaggtgtgagccactgcacccagcctgttttcagtttttaatatttcttttctctcattacctacttttttaagggaagatggatatcacaaatatcctagcaagaacctgtcaatagacaggtttccaaaaggaagagtcatgatcctactgcataaatctaaatgaatgatttaattttagttaaattcttctgaatataatctgctgtaaaatggggatcattcttgaagtgaacctcttaatctaaatacttcctgtttttgtttcctcttgttaaatactccccttcatgatcttcactgaagaaataagagaatacaaaaatatatggg

SEQ ID NO: 35145 - DNA, 908 bp, Homo sapiens
  misc_feature (874)..(874): n is a, c, g, or t
  misc_feature (885)..(885): n is a, c, g, or t
taggaatatatacttttcagaccatttcagttaaaacagtaatgatattaatggaatctgtcttattaaggtagtgaatcaactcaacaagaagctaagagtcacagtctgtgattttgagtcacctagacagttttccagagtcatcactaaccttgtcttaagacatagcgtgttgtcttcatttatcttaaactatatcacagaatccctgagataaaattagtcatattatcattatacagccatatgctacctacgtcaagactcttctcttcatctgatcatatgatgtgtaatatgtttatttaataaaatataatccatgctaagtaaagcataacatctatgacttttacatcaatattctgagtagcaaaatgcgaagtcagatatttattactatgcatatacaaatctgtaacaaataaaacgtttccatgtggtagattgtcttttttacaactttattgaggtaaattttacttaaaaatttcacatggtaggttttggaaaaaaaaatactttttaaaaacaaaagattaactcttctgtgtggtacatgaaaaactaactaaaaccaaaaacaaaaggcagcctgggcgacatggtgagaccccaactctacaaaaaattcttttaaaacttagcctagcatggtggcgtgcatatgtggtcctcagcctcccaagtagctgggattacaggcacgcgttgccatgcccagctaatttttatatttttggtagagatggggtttcaccatgttggccaggatggtctcaatctcctgactttgtgatcccagcaccttgggaggctgaggtgggaggatcatttgaggccaggagtttgagacctgcctgggcaacanatatgggaacncttcctttttcccagggggggaa

SEQ ID NO: 35146 - DNA, 304 bp, Homo sapiens
gagagtctagtatttaaatcaagcttaaattatgaaggatggactgaggattcaataccaaggggacaggagaaaaggggctatatcttgattcatgatgagtcattccaaaagcacttgaattgtctatgctgtagaaatgtcccttagctacagcaattctaaataatataagataaaataaaatcatgccttgcaaaatgccctgcaatcattcattcaatcatctcaataaagcttctatactctcagtttactcttctgtaaaatggaaaaatcatccccacaaagtattataggtatt

SEQ ID NO: 35147 - DNA, 284 bp, Homo sapiens
tttttttctgactcatgccatagtccaattcaataaaccctcttctgagtataaatctagaattgctagacaatgtacagaaacaagaagtcaagttatctgcctccatcccccatatacaaatatagtgcagcaaagctgggataaacagagcttccacaatgctgcaatattgtgagagagacggttatgggtgtcattgtctatggatgtgggggtacatttcctcattattcctaattttgctcctggaaagaactcccttgtctcttctctgattcatg

SEQ ID NO: 35148 - DNA, 429 bp, Homo sapiens
ttgcggtgacccgagatcacgccattgcactccagcctgggcaacagaacaagactccgtctcaaaaaaaaaaaaaaaaaattctacagaacttggtgtctcattggatgtgggcactgagggaaagggaagagtcaagaatgattctcaggtctctggcttgggtgctggagagatagataggtgttaccattctctaagtatgggtatatatcagataatcaggaggaacagaatgcgggggtcagggatcaggaaagaatgaggaactcaatttgggggttttgagttgaagtacctctaaggcatccaagtgtagatgactggtaaggcagctcagtaagagaagtctggactaaagatagagaatggatggtcattagtatgcccagggagggtatatacagtgggaaaaaaatgcatgacaga

SEQ ID NO: 35149 - DNA, 505 bp, Homo sapiens
gttccttttccccccatatggttaataaatttctttaaaataaccattttctgagtaacaagtgacatggctaatttgctgcttattagattatcttcttatatacacaaatagctgaaactcctaagtggataggttaaggagctatacagccatccagggccagtgtgacagtgaagctagaattgctcaaaaagaagacatcctctccaacctcccccaaaatttaaagcacagagaggtgactgacaagaaaaaagaagagaatgagaagcacaggaaggtgggaggcagccatttcagccagacagggaaaagctggaagaactggaattgtagaggactccccaacctgctattcccttcctttcagaagggaggaacatgcccccagtgcttttaaagatttgtgttcctactggaaacctcccctgtgtgtggtgtttattattagccatgttgtgtctgaaagtccgaagctttccctgtcactggctttctctgt

SEQ ID NO: 35150 - DNA, 416 bp, Homo sapiens
ccctgtatgtgtgtgtcctttacatgctaattcatctctgtgtgggcaccacctccctgttcccagattgcagaaaattctgttgagcgaagccagagaaaaggctgttgaggttttgggaggaggctgaagagaaaattggaaaggttgatgaggagggacaatgatgaccacaatgcagagagacagtgaaaggcccaagcttgaatcctctatcagacgagcctgatatggggcacctcctccccaacctctccacccttcagagacaaactccatgctgccttctccatgaaggctccttagagcaatctgtgctcaaactttaatgtgcataagcatcactaggaaagcttctgaaaaatataaattcctgaaatctagcctaagagattcctattcaatagatgtgggtt

SEQ ID NO: 35151 - DNA, 441 bp, Homo sapiens
agacctcatctgctgccatcttaagccccgtttcttcaatgtcgtggctccaggatcatcttcttgagatgccttctcagaccactgcatgcccacacttccccagtaccccttgtcaggggtatgggagtggagacttcactgtagctctctcatactgcattatggtttcaaagagtccatctttcccacgtagactgtgaacacaacaggatacaggcaccaagatttcttggtggagtttgatgcacataataactgcttagcaatgcttgttttgtgaatggtcacaggcttagatttatggaaagacctcaccattccaatattggtaatcattatatgtggtctaaagaggcgggcagatcacgagttcaggagatcgaggctatcttggctaacacagtgaaaccctgtctctactaaaaatacataaaaaaa

SEQ ID NO: 35152 - DNA, 316 bp, Homo sapiens
ggacaccagcaaggttaaacggttttcccagttcacgcaggccgggagtgatgagtggccacatgcctctgggattctttgctctgtatcacagtaccttggaaagcagcctaatgacgaggcatcagttttatttttatttagttttattttttgacctgccacttcaggaggcaccagttttaaatagcttcaaggtattataactctgtagggcatgaaggagttaatatactagacagaatacccagtttataccagggaatcgcttgaacccaggaggcagaggttgcagtgagcaagctgcactccagcc

SEQ ID NO: 35153 - DNA, 386 bp, Homo sapiens
tttttttttaggaattctccagatcagaaggaattggcagtaaggcctctgtcagctgcaccctgaataatctttggctgctattttatttaaggagagctaaactgtttcaattacgcaacaatatataccattctctactaaaacaattttaggaaatgaaaatgtaggcaatgggatgatatagtctgctctatatgaatgtctttcattataggtattttaatttaacttaaaatgatcaaggaaccagtcatctttcctttgtatttcaaatgcatacaaaattaaagataccgagttttttgatgcagagttcatgagacattgacttaattagttggtaggcaacttttactgaaccatctaattcctggttcagaaca

SEQ ID NO: 35154 - DNA, 386 bp, Homo sapiens
caaatgactactgagagacttcaaggaaattaaccttataatttccttaattcttcattttactgttagtcatggtaacatttgctaatttgtacatgtacagatgcttcatgttgatcccatcttagcaaagcttcagatttccgcatactacagaaccatctatgccctttacttccaaaatctgccctccctcaaaattagttgactaattaaataaattaagcaaaatgagaggcccggtgtagtggtgtgtacctgtagtcccagctactcagggaagacagctgcaggtttatcacttgagtccaggagttcaaggttacagtgagctatgatcacaccactggactccagcctgggcaatggagtgagaccctctctcc

SEQ ID NO: 35155 - DNA, 372 bp, Homo sapiens
tgctgttgttgttgaggcagggtctcactctgtcacctggcctggaatgctgtggtgcaatcacagctcactgcagatttgatctcctgggctcaagctatcctgctgcctcagcctcctgagtggctaggaccacaggcatgcaccaccacacccgacgacctttttatttttactagagataaggtctcactatgttgcccaggctggtctcaaacttttaggctcaagtgatccgcctgccttcgtctccctaagtgctgggattataagcaaagctgctacacctggccttagccaattcttttactaaactcttcatttctgacacatgccaaatttctatggcgtgtgtcagaaatgaagagctta

SEQ ID NO: 35156 - DNA, 489 bp, Homo sapiens
agagtcctcattctgcttcatgtgacatcagcaagactgaactctcctctgcttgctgtgctctgttcttgctggtttgtaagtggcagcaatcataagaggcaggaacacagcttcccatttgtttttcaggtttaagctgtggttttggaaatgacaggaagtaggaaaatgaagcttttggctggcctttgaagaaactggaagtagaggtgacagaatacatgcggattgctctggacctttttggaaaatcactcttttgcccaacacagttggcaaccatcctgggaccgataaaattcctttgcacttcatcagaatttaactttggcttaatctgtcaaagtcacaaccacatctctcaagagtaccatttggccacaagtcaaatacattatcacaaacacattagatgttcctgaatagcattcctaacccatagctgatgtccacattcatcgagcaagatcaaataccaaaagaaaa

SEQ ID NO: 35157 - DNA, 382 bp, Homo sapiens
gacaacaccaagtaagacaggagctgaggacatctcccatgctctgggccatcctattggccatccgaattttccagcactgtgtgaaagcctttgcctagaatgtactagtgtttctagtttccgatgagctgctgtggaggtaactgtctctgtgccctctactgtcagatctgctcaactgtgtagctgtcagtatttctccgttttcctggagcagagggtctgtgaagcatgcttccctgatacaccaggaccatccaacccatggaagcttgttgagacctcagcgcccttggctgctgggccagcttttcctcccaaacctgccctcagagcattttacattatagaaacaaaacaaaaccaaaaaaactgcagg

SEQ ID NO: 35158 - DNA, 507 bp, Homo sapiens
cccagggcacttgatgggaggggtaatgaagcctggaatgttcagcctgcgatgagatggctcagaggctatgggtggaggacggggcagagcttttcaaaatttgaagggtggtcatttaaagcaagggcaggcaagctttttctataaaggggcagacattttagactttgtgggcctcatggtttctgtcacgaccactcaactgagttgcggcatggaagcagccacagacaatgtgggagccaatgggttagacgtgtgccaataaaacaccgtttacagagataggtggcaggcctgctcagccctactctgagctagacccttgctcctcacaatgtggtcctcggaccaacagcatcagcatcacttgggggcatgtgagaaatgcaaaatctcaggcccagccgggtgtggtggctcacacctgtagtcccagcactttgggatgctgaggcgggcggatcatctgaggtcaggagtttgaaactagcctggccaaca

SEQ ID NO: 35159 - DNA, 828 bp, Homo sapiens
accacacctggctaatttttgtatttttagtagagacggggtttcaccatgtcggcgaggctggtcttgaactcttgatctcaggtgatctgcctgccttggcctcccgaagtgctgggattacaggcatgagccattgcacctagccctctataatcctttaaatgcttgtttatggtatcttagaatatttcaaatttatcttgtatgttctctgcctcatcctggagtcaactgtttgtctaaggaggagccattctcttgaagtggagaatagtattatagaaaccaatatcttggcactagctgtatttattgctgccaggatattgttgttttcagccctcttagtgggcagaacaagtagatctatgtgtatttatttattagacatatttattgtctatatctctgcctacacatatatataaccatgaattttaccacaaatgccaccattttgatccaacatcataggattcattttagcccttttcctttccttatttgtagctctcgtctctgacagtgagaatcttggttctcatccttaatatagttactcatttgcttaatctccctgaaagcttggcccagacatggaatccagcaaaggataaggtgaagggaattcttaaagagaaatcttgggataatagctgtgtaggcattcaccagttagtccagattggtgagtgaagacagggctccaaaggggtgttgtcaagaaataaacaaccaatagatagcctgatgtgttgagacttacacatgtagtagaagtttggaggtgaattagtgatacatatacagaaaaccaaacaagca

SEQ ID NO: 35160 - DNA, 495 bp, Homo sapiens
accacacctggctaatttttgtatttttagtagagacggggtttcaccatgtcggcgaggctggtcttgaactcttgatctcaggtgatctgcctgccttggcctcccgaagtgctgggattacaggcatgagccattgcacctagccctctataatcctttaaatgcttgtttatggtatcttagaatatttcaaatttatcttgtatgttctctgcctcatcctggagtcaactgtttgtctaaggaggagccattctcttgaagtggagaatagtattatagaaaccaatatcttggcactagctgtatttattgctgccaggatattgttgttttcagccctcttagtgggcagaacaagtagatctatgtgtatttatttattagacatatttattgtctatatctctgcctacacatatatataaccatgcatggtgataactgatgccatgcgtcttagactgtttcactgagtaagagctgtttccg

SEQ ID NO: 35161 - DNA, 536 bp, Homo sapiens
tataacaagtgaagtaagaaaagacatttgatgtgtgaaatatccagtggctattttggctggataatactggagaggcaaatctcaaacactcctctcctagctattcctattagaagtctaataccagaatatcagaaaaagggattggaatcaattggaacaaaaactagtaaaaatggtgagacaaccccaaatgaaaaggtagcagccagttttcatctctttttagaataacataaacgaaggtgactcagattgcaatcgaagaggttgagctcagacttcagggagaacttccgactactgagacactcgaggagtttggggaaattcccttctctgaagctttttaacaagagaccaagtggccaacaatgcatcttcggttaggtggttctcagggacagaggcatggacagaatgacctttcagaggtcccttcttgcctgtgctcactctatcttgttactaagccagttcacaacagcaccacctgcttgcttctcacacacagaggctgctttcagttacct

SEQ ID NO: 35162 - DNA, 274 bp, Homo sapiens
aagggaacttttctatcaagtaataatttattagtgatcacgatgatgaaatgggtcttacatatactatagctcttctactttcacactcatcatcttactagtaatcaggatgtctacataaagtaggagaaagcaggtaaactacacattttaaaaaccaaaaagaaagagaagattatatctcctcttatgtcaatactagtaatttgtaggaataagaactattaacacacttcttgaaaaaaattgaaatgagctttttaacataatt

SEQ ID NO: 35163 - DNA, 326 bp, Homo sapiens
  misc_feature (81)..(81): n is a, c, g, or t
gggcctaaatttttgtatttttggcttctttttgagatggagtcttgctccgtcgctgaggctcaaagggcaagtggtgcngatcttggctgttggggactctgcccctgggagagagaaatgcgaaacgtatttctgggagctggaagctgtttcctccatttagtctctggatgttttctaggtgaccacagcctcttataggcctgtcctggggcagagcggccaccttgaggtccatcagtcagtctgatcatctctgtagaacctcgaacctctcgcctcgcctcgcctgacgccgtttcctgccctttatctctcccttc

SEQ ID NO: 35164 - DNA, 255 bp, Homo sapiens
cttagtgtggaaaaaattgtgtaaaaatagtggtcaaaaagcatatggtttattggtcaattatcactgcataacaaccacaaaatctcagaggcatatggctgaaagcatttatttcttgttcatgcgtctgcacatccattaaggtttggctgatcgaggcttggttcatcttggcttggctctgacctctgagtccaagcagacacaactgctccagggcctggctggtggggatgtgtgtagaactcttcc

SEQ ID NO: 35165 - DNA, 739 bp, Homo sapiens
gggaggagtgcgggagcgcgccagagactggcgggcagctccgcccgcggccgggatgcactaggcaaagccagctgggctcctgagtccggtgggtacttggagaacttattacgtctagctggaggattgtaaatgcaccaatcagcatgctgtgtctagctcaagattttctccatccccttattttgggccagtggctgtcattacatatgagatgagtctcttgaagactacagatgagagcagtcatgatggcctgcactccacacaatgcaacagagtgaaggagcaggttctggttctttggtgtagtcctgaagcttcctaagaaagttcacatcaggtgatggataggagcaaccctgtaaaaccagccttagactatttttcaaacaggctggtgaattaccagatctccgtcaagtgcagtaaccagttcaagttggaagtgtgtcttttgaatgcagaaaacaaagtcgtggacaaccaggctgggacccagggccagctgaaggtgctgggtgccaacctctggtggccgtacctgatgcacgaacaccccgcctacctgtactcgtgggaggatggtgattgctcacaccaaagccttggacccctcccagcctgtgacctttgtgaccaactccacctacgcagcagacaagggggctctgtatgtggatgtgatccgtgtgaacagctactactcttggtatcgcaactacgggcacctgga

SEQ ID NO: 35166 - DNA, 779 bp, Homo sapiens
gggaggagtgcgggagcgcgccagagactggcgggcagctccgcccgcggccgggatgcactaggcaaagccagctgggctcctgagtccggtgggtacttggagaacttattacgtctagctggaggattgtaaatgcaccaatcagcatgctgtgtctagctcaagagagcagtcatgatggcctgcactccacacaatgcaacagagtgaaggagcaggttctggttctttggtgtagtcctgaagcttcctaagaaagttcacatcaggtgatggataggagcaaccctgtaaaaccagccttagactatttttcaaacactgcgcagaataccacatttcccagcattccttgcatctggatgtagctgtattaaaataagccgtgggaaacttctgagatggctccttaagtgcagttgactcattagggagggctggtgaattaccagatctccgtcaagtgcagtaaccagttcaagttggaagtgtgtcttttgaatgcagaaaacaaagtcgtggacaaccaggctgggacccagggccagctgaaggtgctgggtgccaacctctggtggccgtacctgatgcacgaacaccccgcctacctgtactcgtgggaggatggtgattgctcacaccaaagccttggacccctcccagcctgtgacctttgtgaccaactccacctacgcagcagacaagggggctctgtatgtggatgtgatccgtgtgaacagctactactcttggtatcgcaactacgggcacctgga

SEQ ID NO: 35167 - DNA, 665 bp, Homo sapiens
gggaggagtgcgggagcgcgccagagactggcgggcagctccgcccgcggccgggatgcactaggcaaagccagctgggctcctgagtccggtgggtacttggagaacttattacgtctagctggaggattgtaaatgcaccaatcagcatgctgtgtctagctcaagagagcagtcatgatggcctgcactccacacaatgcaacagagtgaaggagcaggttctggttctttggtgtagtcctgaagcttcctaagaaagttcacatcaggtgatggataggagcaaccctgtaaaaccagccttagactatttttcaaacaggctggtgaattaccagatctccgtcaagtgcagtaaccagttcaagttggaagtgtgtcttttgaatgcagaaaacaaagtcgtggacaaccaggctgggacccagggccagctgaaggtgctgggtgccaacctctggtggccgtacctgatgcacgaacaccccgcctacctgtactcgtgggaggatggtgattgctcacaccaaagccttggacccctcccagcctgtgacctttgtgaccaactccacctacgcagcagacaagggggctctgtatgtggatgtgatccgtgtgaacagctactactcttggtatcgcaactacgggcacctgga

SEQ ID NO: 35168 - DNA, 596 bp, Homo sapiens
  misc_feature (131)..(131): n is a, c, g, or t
  misc_feature (138)..(138): n is a, c, g, or t
  misc_feature (221)..(221): n is a, c, g, or t
gtgattgctcacaccaaagccttggacccctcccagcctgtgacctttgtgaccaactccacctacgcagcagacaagggggctctgtatgtggatgtgatccgtgtgaacagctactactcttggtatcncaactangggcacctggagttgattcagctgcagtggccgcccagtttgagaattggtgtaagacatcacaatcccattattcagagcgngtatggagtggaaacgcttgtagggtttcaccagggctggtgaattaccagatctccgtcaagtgcagtaaccagttcaagttggaagtgtgtcttttgaatgcagaaaacaaagtcgtggacaaccaggctgggacccagggccagctgaaggtgctgggtgccaacctctggtggccgtacctgatgcacgaacaccccgcctacctgtactcgtgggaggatggtgattgctcacaccaaagccttggacccctcccagcctgtgacctttgtgaccaactccacctacgcagcagacaagggggctctgtatgtggatgtgatccgtgtgaacagctactactcttggtatcgcaactacgggcacctgga

SEQ ID NO: 35169 - DNA, 535 bp, Homo sapiens
ctatcttaccaccactgaagctcatcacggaccccatactgaaagtacctggactttatgtgcatgaacaatccctgactttatgatgatggagaaggtggttcagggaaggctgcctggcttgattctgtagctgccggcccagaactgagctccttctcttccccgtacacagctgcttttggccctcttgacggttgtaccaccttctttcacttgtccccagtcctcttcatacccactctcttactggtccttaacagatggtcaccaaattcattctgccccctgactctcacttcagtgggtctctcttttccaaccctgaggcagtaccccgattctaatgcctgtcccctttagcccactgcttgcagaggccccgccatagtgcccagctgatcctggaacctatttttctctccctgatgtggctgttgctgtgtcttaggctgctgagagcatattgtcacatgatcaaaaagagaacatttaggatttcacaaccctgaaattatagtaagcctgttaattt

SEQ ID NO: 35170 - DNA, 402 bp, Homo sapiens
ggggacagcttggatggatgggggcagaacgaggagaggaatggggggagcatgtgggcccaagtgtctgttttgctgattgctccttttgctttcaaggagattaaactatttttagtctgcgctactgctggtgagacgccggaggaagcctttccatcgctgagatcttctggaagctgccaagtgtggtcttcagctcgattctgggagcctcccagagcaggcgggaggggtgtcaccatctgggggctgtggggacaggctggtgtgtgcttgctccctgaggtccttgttgcgctggcctccctgagccgtgtggccctggcctgcagagaacagtaatctgatgcacccgatgtttgtaacgctgtgtttaaaaaaagtaatttattttctaat

SEQ ID NO: 35171 - DNA, 418 bp, Homo sapiens
aataaaagaaatactctaaaactttatagttaacagagaaacaaaaatacaacaacaggaaagctatagtagagagaaagagacgtgtaaagatgtctataaagaaaaagatgagaaatcctttataaaagtaggggccaggtgcggtggctcacgcctgtattcccagtactttggaaggccgaggtgggccgatcacaaggtcaggagatcgagaccatcctggctaacacgtgaaaccccgtctctactaaaaatacaaaaaaattagcagggcgtggtagcgggctcctgtggtcccagctagcagaaaggctcacgcaggaaaatggcgtgaacccgcgaggcggagcttgcagtgagccaagatggcgccgctgcactccagcctgagctacagagcgagactccttctaaa

SEQ ID NO: 35172 - DNA, 2054 bp, Homo sapiens
  misc_feature (239)..(239): n is a, c, g, or t
  misc_feature (561)..(561): n is a, c, g, or t
  misc_feature (635)..(635): n is a, c, g, or t
  misc_feature (695)..(695): n is a, c, g, or t
  misc_feature (970)..(970): n is a, c, g, or t
  misc_feature (1194)..(1194): n is a, c, g, or t
  misc_feature (1262)..(1262): n is a, c, g, or t
tattcaataaggactgttatttctagtatagagaggagggctcctaggcctggctaagcagtttaagataaaatgcaaaatgacccaattcaggatgattatagttggtttaaatttggttgctgaggcacaaacaaaagtgttggattctgtagtttttgttgtgattacagaacacatgcagtatcttccagaaccctttgataaagctgaagtaaggatgggctcacatggcccangtgagtaagaagctgtgttgacagagtggacgataccttcaattatggcttaacaaaaaatgcctgaaaatggaataacttagaaggaactcttcctttaaaggatttaatggcaggtgcagtggcttacgcctgtaatcccagcactttgggagcctgaggcagaagatggcttgagcccaggagtttgaggcagcggtgagccataatcataccactgcacttaagcctgggcaacacaatgagaccctgtctcctgtctttaaaaaaaagagacagagacctacctgtatgctaggagcatccttctcactgtaggtcngatgtggtggttctgttttaaatttgctgaattgtgactttttttctttttcttttttttttttttttttttgnttttttttgaggcagggtctcactctgtcgcccaggctggagtgcagtggtgtgatctcngctcacttcaacctccacctcctgggttcaagcgattctcctgcctcagcctcctgagtagctgggattacaggcgtgcaccaccatgcctggctaatttttgtatttttagtagagatggggtttcacaatgttgcccaggttggtctcgaaccgctgaccttaagcgatccgcctgccttggcctccccaaggtgctggaattacaggcatgagccaccgcgcccggctgacttttttttttctttctttctttttgagacagagttttgctnagtctcccaggctggagtgcaatggcaacaacatggctcgctgcagcctcaatctgctgtgctcaggtattcctcctgcctcagcctcctgagtagctgggactacaggcgcatgccaccacacctggctattgtggattttaagaaattttttttgtagagacagggtcttactatgttgcccaggttgttcttgaactcttgggctccagagagcctcccanctcagcctcccaaagtgctgagattataggcgtgagccaccacacttagcctattgtgactttttagngtctctaatactttcttttagggcactaaaaacttaatcttagatccagttggtattcatttgggtgaatgaagtggtagggacctaccttaattttttttccaggtttttgtgattgaataagttccagatactcaaagcgacctagatcagtgatgaaatttttgactgcatttggacctatttctgggatctccttttactgatttctctgtatattcatgagcaaccttaaattattttagactatttaattattatgttctattttctggaaagttttgtccttcactgttctttttcaaaattttcctgattgttatttcataaatattttttcacagaatcaactggttttgaacctcaatttacttataggttaatttagagagaattgacttttaaaattatattaaaggccaggcatggtagctcatgcttataatcctggcattttggggggctgaggcagatggatcacatgatcccaggatttgagactggcctgggcaacatagtgagatctcatctcttaaaaaaaaaaaaaaaaattaagcctttctgcctaagatagaatactcctttaaacattttttattatatatataaatataaatatttatatttgtattataataaggcatatattataaatatatatttatataaaaatttttatataaatatatatatacactttttgagatggagcctcactctgttgcccaggctggagtgcagtggtgtagtcttggctcactgcaacctccgcctcccgggatcaagcgattg

SEQ ID NO: 35173 - DNA, 374 bp, Homo sapiens
gatttcaaactttacatttttactccctagtttgactctgtttttgcgtctgtagcaaattcacctcagtattcctagtaacttatctatatctgttctttagtctctttgagcctttctggttccctcattaattagtggggttaaaatgaaattttctacatgagtttattttatatttgaataagagtcaagactttaccttattgaaaattatcttttaacaggggaaacaattgtagaagcaagagaaatacaaaaccacatatatagtgggcaataaaggattatagaattatatgctttgaaaatcttagttttgttgcctcctctgtacctggaaacatgaacaataatttggttgtgaaagttct

SEQ ID NO: 35174 - DNA, 348 bp, Homo sapiens
acaaagtgcagaccatgcttcatgtggtcacttgtggaccagggtcagccagactgctgaggaaactggcctgatttcaggtcaaagtgtctgtcccttagctggacaggacacgggctgctttggagaactgccccccacctcctgctaatcccttgggactgggatatctgggattcctatcctcccaactggttctggagtcagttcaatattgccagaccacagctgggcgtggtggctcatgcctgtaattccagtactttgggaagtgaaggcgggtagatcacttgagcccaggagttctgcaccagcctggacaacgtggtgaaactccatctctacaga

SEQ ID NO: 35175 - DNA, 602 bp, Homo sapiens
tttacatcctctatatattatgactattccaaactcattcattttatagaaatggtcaaaggaaaaagccttatgtacagccttatttgaagagaaagttctttgtctgagtcaggaacatcctgttatccagctgctacatcccctttcagtgtgaattccactccttaccaaatcacttagaaaacactttgacaagttttaaactcaaacactgaatattttatgaagcatgtgtaaagaaagaaaccaaaatttggtgcaggtatttagtaatgggtagaacctgttaatatctgagtcatatataatggggccaaacatggaactacctcatcaaccccccaaaaatgtggccaactattaatattctttgtgacatttacaccaaggggcatagtaagtatttttggtattataaaatacacattcaaaatctctgttgtacaaaactcatgtaacagttgggacaaaatatccaaatgtgggttcacagttcacaggtggtgaaaattgaggccttactgctatggagtgtatatcaaaatgttcatggtgacacatttgaagcaataaatggcttaattaaatgccaaaatgag

SEQ ID NO: 35176 - DNA, 409 bp, Homo sapiens
actatactaaatacgcggaggtcgactttttttttttttttggcagagtcttgctctgtcacccaggctggagtgcagtgttgtgatctcagctcactgcaacctccgcttcctgggttcaagcaattctcatgtctcagcctcccgagtagctgggattacaggcgcccaccaccacgcctggctgatttttttgtattttcagtagagacggggttttgccaagttggccaggttggtcttgaactcctggcctcaagcaatccacacacctcggcctcccaaagtgctgggattacaggcatgagcgaccatgcccaaccaggatgcaagtaattttggagcaatgagtaaatttgaaaacaattctgttttggaccacatttaatcctgaaatccgaccattaag

SEQ ID NO: 35177 - DNA, 433 bp, Homo sapiens
tttttttttttgagagggagtctcgtcgctctgtcgcccaggctggagtgcagtggcacgatctcagctcactgcaacctctgcctcccggggtaaggcaattctgcctcagcctcctgagtcactgggattagaagcgtgtgccaccatgccaggctaatttttttgtatttttagtagagatggggttttgccatgttggtctggagctcctgaccttcatgatccatccacctcggccacccaaagtgctgggatcacaggcatgagctaccacgcctggcccacaaagctatttttgagagcctgcacaggccctgggtggggggatggggtaggacccaaagggctctttatggaggcacaggaggaaatggtagagtttcacaaaataaatggattaaaaaaatcaaccccgccaggcgcggtggct

SEQ ID NO: 35178 - DNA, 400 bp, Homo sapiens
atgcctggctaatttttttatttttagtagaggtggggtttcaccatgctggccaggctggtctcgaactcctgacctcaggtgatctgcctgcctcggcctcccaaagtgctgggattacaggggccgtgcagaccagggaatttttgttgtcttagaaagtcctatggagagtgctgctttgctgtatttgcatgtagttttatcatctccatgcagttaacagaatgttttcaggaggagaattccctaaggtgagaaactggttttctcaggagactatttggacaaatgacaaccatgttatttagtgagagtgaccaccaatgggagccctatacaactgttcactgggcactgcctggaagggaatttataaccaggagactattgctgttct

SEQ ID NO: 35179 - DNA, 576 bp, Homo sapiens
ctgatccaagtagatatttaaaaagaagaaggagaaggagaaagaaggagaaggggaagaggaagaggaagaggaagaagaaggaggaggaggaggagaaggagcaagaggaagaggaagaagaagaagaacaagaagagaagaagaagaagaggaagaggaagaagaaagaagaaagaagaaagaacaagaagaagaaggaagaaaagaagtgggaagaaagcatgaataggagtagcttcacaaagataggagataaccgagaaactgtttttattgcatcttcctgtgtaggccaccttgtaagctgtggcctcagacttaccttttatcttgtgtaatgcttttttaccactattgtgtctgcttcttatgtcttttccaggcatgtactgttgcaggggtgtccaatcatttagcttttctgagacacactggataaacacaaattgtcctgggccacacataaaatacattaacactaacaatagctgataagctcaaataaaaattaaaaaaatcttttacaaagtctcaaaatgttttcagaagcttacgaatttgcattggcccaca

SEQ ID NO: 35180 - DNA, 2093 bp, Homo sapiens
agcggagatctcattccgcctccctctgtcgtcgccccttcccaattctcgcgagacctcaaggagcacagcttctgcgcaccgcacgatactgggagtccaggcgccaagggagggggaagggaaaaggggaaacggtgcaaacggcgtggccgccatcttgcttgtgcccccgcttcgcgcgcgctccgttctccgtgacgcacacttccccctcccctccgccgcgcctgggcctctgcattgcccgactccgtaggagcgcgggggcggctcctgctcttcctggactcctgagcagagttgtcgagatgtccacagaaggaggatttggtggtactagcagcagtgatgcccagcaaagtctacagtcgttctggcctcgggtcatggaagaaatccggaatttaacagtgaaagacttccgagtgcaggaactcccactggctcgtattaagaagattatgaaactggatgaagatgtgaagatgatcagtgcagaagcgcctgtactctttgccaaggcagcccagatttttatcacagagttgactcttcgagcctggattcacacagaagataacaagcgccggactctacagagaaatgatatcgccatggcaattacaaaatttgatcagtttgattttctcatcgatattgttccaagagatgaactgaaacctccaaagcgtcaggaggaggtgcgccagtctgtaactcctgccgagccagtccagtactatttcacgctggctcagcaacccaccgctgtccaagtccagggccagcagcaaggccagcagaccaccagctccacgaccaccatccagcctgggcagatcatcatcgcacagcctcagcagggccagaccacacctgtgacaatgcaggttggagaaggtcagcaggtgcagattgtccaggctcagccacagggtcaagcccaacaggcccagagtggcactggacagaccatgcaggtgatgcagcagatcatcactaacacaggagagatccagcagatcccggtgcagctgaatgccggccagctgcagtatatccgcttagcccagcctgtatcaggcactcaagttgtgcagggacagatccagacacttgccaccaatgctcaacagattacacagacagaggtccagcaaggacagcagcagttcagccagttcacagatggacagcagctctaccagatccagcaagtcaccatgcctgcgggccaggacctcgcccagcccatgttcatccagtcagccaaccagccctccgacgggcaggccccccaggtgaccggcgactgagggcctgagctggcaaggccaaggacacccaacacaatttttgccatacagccccaggcaatgggcacagccttcctccccagaggacccggccgacctcagcgcctcctgcaggctaggacactggtgcactacaccccatgcctgggggccgagattctccagcagaaagatgcaatattttttgtttcctttttttccatttttttctctaaggaatcaatatttcaatatgttgagtgtgtgtccaatgctatgaaattaaaatattaaataacatatttatggcattttcttgaagagtgtggttgaagaaatatttctccttttgtttttctttttttttgtttgttactgccacttctttttaggagcaaatctccccaggggtgtacggtatttcttgactctgggaacagctgctacccccaagacttgccacgttgttctgccctcagatggaattaggtgaatgtgtgtagctgctttttcactcgtggtcctctccccatcccttgctctgaccccagagctctgtgtatttgcatccagaggccatggaaacattctttgcatttaagagacagatttattccctgtggagagtgggtggattcattgccacactcttttctcccagggacccaggaaactaggactttgtgtgtttgctgcccacctcccttttattttttaaatgcattaaaaactgtgctagtctcctttgcatggacttcaagctgcatgaaatgcaataaatctcattttagataa

SEQ ID NO: 35181 - DNA, 1609 bp, Homo sapiens
agcggagatctcattccgcctccctctgtcgtcgccccttcccaattctcgcgagacctcaaggagcacagcttctgcgcaccgcacgatactgggagtccaggcgccaagggagggggaagggaaaaggggaaacggtgcaaacggcgtggccgccatcttgcttgtgcccccgcttcgcgcgcgctccgttctccgtgacgcacacttccccctcccctccgccgcgcctgggcctctgcattgcccgactccgtaggagcgcgggggcggctcctgctcttcctggactcctgagcagagttgtcgagatgtccacagaaggaggatttggtggtactagcagcagtgatgcccagcaaagtctacagtcgttctggcctcgggtcatggaagaaatccggaatttaacagtgaaagacttccgagtgcaggaactcccactggctcgtattaagaagattatgaaactggatgaagatgtgaagatgatcagtgcagaagcgcctgtactctttgccaaggcagcccagatttttatcacagagttgactcttcgagcctggattcacacagaagataacaagcgccggactctacagagaaatgatatcgccatggcaattacaaaatttgatcagtttgattttctcatcgatattgttccaagagatgaactgaaacctccaaagcgtcaggaggaggtgcgccagtctgtaactcctgccgagccagtccagtactatttcacgctggctcagcaacccaccgctgtccaagtccagggccagcagcaaggccagcagaccaccagctccacgaccaccatccagcctgggcagatcatcatcgcacagcctcagcagggccagaccacacctgtgacaatgcaggttggagaaggtcagcaggtgcagattgtccaggctcagccacagggtcaagcccaacaggcccagagtggcactggacagaccatgcaggtgatgcagcagatcatcactaacacaggagagatccagcagatcccggtgcagctgaatgccggccagctgcagtatatccgcttagcccagcctgtatcaggcactcaagttgtgcagggacagatccagacacttgccaccaatgctcaacagattacacagacagaggtccagcaaggacagcagcagttcagccagttcacagatggacagcagctctaccagatccagcaagtcaccatgcctgcgggccaggacctcgcccagcccatgttcatccagtcagccaaccagccctccgacgggcaggccccccaggtgaccggcgactgagggcctgagctggcaaggccaaggacacccaacacaatttttgccatacagccccaggcaatgggcacagccttcctccccagaggacccggccgacctcagcgcctcctgcaggctaggacactggtgcactacaccccatgcctgggggccgagattctccagcagaaagatgcaatattttttgtttcctttttttccatttttttctctaaggaatcaatatttcaatatgttgagtgtgtgtccaatgctatgaaattaaaatattaaataacatatttatggca

SEQ ID NO: 35182 - DNA, 2355 bp, Homo sapiens
cattggagcctcggagtttttcactgaggcaggggtcagctgaaagacaaagaaaaatggcgaatagtttgttggggggtgggaggacagctgttcgggttttcagtggagtggacattccagactcatgtttctgcatctcctgctgccttttgtttcctccgtcctttggggggtagggataggagtgacttaaattctcccagtcggtggaggtataaataactacatgtaaaattaatgcagttcccagttgtcgagatgtccacagaaggaggatttggtggtactagcagcagtgatgcccagcaaagtctacagtcgttctggcctcgggtcatggaagaaatccggaatttaacagtgaaagacttccgagtgcaggaactcccactggctcgtattaagaagattatgaaactggatgaagatgtgaagatgatcagtgcagaagcgcctgtactctttgccaaggcagcccagatttttatcacagagttgactcttcgagcctggattcacacagaagataacaagcgccggactctacagagaaatgatatcgccatggcaattacaaaatttgatcagtttgattttctcatcgatattgttccaagagatgaactgaaacctccaaagcgtcaggaggaggtgcgccagtctgtaactcctgccgagccagtccagtactatttcacgctggctcagcaacccaccgctgtccaagtccagggccagcagcaaggccagcagaccaccagctccacgaccaccatccagcctgggcagatcatcatcgcacagcctcagcagggccagaccacacctgtgacaatgcaggttggagaaggtcagcaggtgcagattgtccaggctcagccacagggtcaagcccaacaggcccagagtggcactggacagaccatgcaggtgatgcagcagatcatcactaacacaggagagatccagcagatcccggtgcagctgaatgccggccagctgcagtatatccgcttagcccagcctgtatcaggcactcaagttgtgcagggacagatccagacacttgccaccaatgctcaacagattacacagacagaggtccagcaaggacagcagcagttcagccagttcacagatggacagaggaacagcgtgcagcaagctcgagtctctgagctaacgggagaggcagagcccagagaagtgaaagccacaggaaattcaactccctgcacctcttccctgcccaccacacaccccccctcacaccgggctggtgcctcctgtgtctgctgctcccaaccccagcagagctccacttcccctcctccttctgacgccttgcagtgggtggtggttgaggtatctgggacccccaaccagctcgagacccatagggagctgcatgcccctctcccagggatgacctcactctctcctctccacccctcgcagcagctctaccagatccagcaagtcaccatgcctgcgggccaggacctcgcccagcccatgttcatccagtcagccaaccagccctccgacgggcaggccccccaggtgaccggcgactgagggcctgagctggcaaggccaaggacacccaacacaatttttgccatacagccccaggcaatgggcacagccttcctccccagaggacccggccgacctcagcgcctcctgcaggctaggacactggtgcactacaccccatgcctgggggccgagattctccagcagaaagatgcaatattttttgtttcctttttttccatttttttctctaaggaatcaatatttcaatatgttgagtgtgtgtccaatgctatgaaattaaaatattaaataacatatttatggcattttcttgaagagtgtggttgaagaaatatttctccttttgtttttctttttttttgtttgttactgccacttctttttaggagcaaatctccccaggggtgtacggtatttcttgactctgggaacagctgctacccccaagacttgccacgttgttctgccctcagatggaattaggtgaatgtgtgtagctgctttttcactcgtggtcctctccccatcccttgctctgaccccagagctctgtgtatttgcatccagaggccatggaaacattctttgcatttaagagacagatttattccctgtggagagtgggtggattcattgccacactcttttctcccagggacccaggaaactaggactttgtgtgtttgctgcccacctcccttttattttttaaatgcattaaaaactgtgctagtctcctttgcatggacttcaagctgcatgaaatgcaataaatctcattttagataa

SEQ ID NO: 35183 - DNA, 1798 bp, Homo sapiens
acttttacattttttggcaagcatagtatatgcaataagtactcaataaacatctgtagagagacttatttagcttttttccattagctacatctgtctctacaatctcaacatactattctcttgaatctgtttttaattttatgccatttctcatgtctgaaaatgtcattataagtaactttttttttttctgagacagggcctcgcactgtcgcccatgctagagtgcagcgagacactcgtagctcttaccagtaacttctttataacacttttgcaatttacgaagcactctcacattatttcattcactctccccaacattaccaaaagttaggaattagatctttttacagatgaaggaattgagactccctgaagtcaagtgtcttatagttaggttttgttcattcattcatcaaatagagtgcctgatgtgagatttattgaaactggatttgaaaacaattttcctgaattcaagtcgagggtttactccactattctcaattactttatcaccagggttataaacccaaaggaagtgagtaacaacagtgtgattttattgaggacccatgcaacactagtctcagaaaggctccagtgtcatttgtaaaattcaaggttaccatcagcagaggcagtcattcctctctgcgcttgttacctaatgcactaactctcactgtaggtaattccattcaagacacatttgatgactatacctacaggttttgaagttattcggatggggttttgacacttactagctgtggggacttagatcaagttacttaacctttttgagcttcagttttatcatttgtaaaatggatacaatcctgatgcctttggaccaagtggtcacggaaatgaaagagataagtatgaaaaaatccatgctcatagtagctgtggtttccaactgcgtgataaaactttaaaatctgcattcaaataagaacaactatgtcgacgtaaggttacaagctaactattcttggtaagtactgttctttattctagaggacatcactttacagtttggtgctaaatgctcttttatgaatttaaggtgccagtagctgtctacttgaacggcatgcttaatctggaacgccatgtcgaccttcatcccccagttctttctccccaaattaaaaacacaaatacacacacacgcccctacttagttcctaaaactcaagggcacgcgcacacacctacttatttcctaaaattcaagctcgcaccaaggagatccacaaggataggcagggtggtggaggtcactgggcagcgcctccggatcccccgaaagggggcggggtcaaaactcagatctcgagctcccgaaagggggcggggttaaaactctcagatctcattccgcctccctctgtcgtcgccccttcccaattctcgcgagacctcaaggagcacagcttctgcgcaccgcacgatactgggagtccaggcgccaagggagggggaagggaaaaggggaaacggtgcaaacggcgtggccgccatcttgcttgtgcccccgcttcgcgcgcgctccgttctccgtgacgcacacttccccctcccctccgccgcgcctgggcctctgcattgcccgactccgtaggagcgcgggggcggctcctgctcttcctggactcctgagcagaggtgtgtgagtgtgcgggagtttctgtgcgagggtgatagggaagcggcggcggggggaggggcagcgcttcccgccttcgccagagacctcacttcctcgcgcggccgctgctgt

SEQ ID NO: 35184 - DNA, 776 bp, Homo sapiens
gggtggtgggctggtggatcagaccctgcagctgacataccaactctaccatcttgattcttacagaattacacagacagaggtccagcaaggacagcagcagttcagccagttcacagatggacaggtagggtacccaacctgggctgggcagagggtgaggatttgcggggcagggtagcaggtagtatctgggtttggatggttagggcaactgtcctgtcctctactaacagtgagtggacagaaattgttaaaacaagtacggtatttaaatcagggcacctatcctttagttttatagacttagtgggaactaaaataatcttagacatgtagcccaaattgccattttacagatgagtaaactgaaccctggagatgggaagtgccttgtccatgctcccctagatgttcattgcagagccaggactagagagcaggtttcctgtttccctctctagaactgtatttttttcccctctaagccatgatgctgttttaatagcatggactgttgagacgcagagaacacgtgacctcttgagctctctgggtgcctgaaattcagtcattttcagtccatgcgaggagagaatcttcccttttccctctgctttcccctcacagtacagtcccagagaccactgaggacatgataggatgacatgcccaaacttgtgccctctgctgctcaaaagggagaagagctggcatcagggacccacctctggcttctgccagcaccacatgctaggcttacatgccagggctcc

SEQ ID NO: 35185 - DNA, 255 bp, Homo sapiens
gtccggtgcccattgcctggggctgtatggcacagccttcctccccagaggacccggccgacctcagcgcctcctgcaggctaggacactggtgcactacaccccatgcctgggggccgagattctccagcagaaagatgcaatattttttgtttcctttttttccatttttttctctaaggaatcaatatttcaatatgttgagtgtgtgtccaatgctatgaaattaaaatattaaataacatatttatggca

SEQ ID NO: 35186 - DNA, 498 bp, Homo sapiens
ctctggatgcaaagtgtcctctggacctccaaagcgtcaggaggaggtgcgccagtctgtaactcctgccgagccagtccagtactatttcacgctggctcagcaacccaccgctgtccaagtccagggccagcagcaaggccagcagaccaccagctccacgaccaccatccagcctgggcagatcatcatcgcacagcctcagcagggccagaccacacctgtgacaatgcaggttggagaaggtcagcaggtgcagattgtccaggctcagccacagggtcaagcccaacaggcccagagtggcactggacagaccatgcaggtgatgcagcagatcatcactaacacaggagagatccagcagatcccggtgcagctgaatgccggccagctgcagtatatccgcttagcccagcctgtatcaggcactcaagttgtgcagggacagatccagaactgcatccagagacacttgcatccagaggggacctcaga

SEQ ID NO: 35187 - DNA, 906 bp, Homo sapiens
gggtggtgggctggtggatcagaccctgcagctgacataccaactctaccatcttgattcttacagaattacacagacagaggtccagcaaggacagcagcagttcagccagttcacagatggacaggggaacagctgctacccccaagacttgccacgttgttctgccctcagatggaattaggtgaatgtgtgtagctgctttttcactcgtggtcctctccccatcccttgctctgaccccagagctctgtgtatttgcatccagaggccatggaaacattctttgcatttaagagacagatttattccctgtggagagtgggtggattcattgccacactcttttctcccagggacccaggaaactaggactttgtgtgtttgctgcccacctcccttttattttttaaatgcattaaaaactgtgctagtctcctttgcatggacttcaagctgcatgaaatgcaataaatctcattttagataaaaaaaaaaaaaaaaaaaaaaaaaaaacaaaaaaaaaaaaaacaaaaaacaaaacaaaacagacacaccacgcaccacaaccacaccacaaactagacacgactcgacgcacgcacacccccatgaccggagcagcacacggaggacaaacgacacatgacgaggccacccggcgcggcccgcactaccacacaacgggtgcgcggccggcgagacgccagcgcaccgcgtcagcgccggcgctcgatggacgcggcgccaccacgacgcacagggcacggtgaggcacaggcgcggcggggcggcggtggagcgtggaattcccgctggcgcgggcgcagccgaggaggaagaaccgcagccgtcccaacttgccgcgccggcacacgaggcggcggagtagagccgcgaggaccc

SEQ ID NO: 35188 - DNA, 397 bp, Homo sapiens
tgtcacaggtgtggtctggccctgctgaggctgtgcgatgatgatctgcccaggctggatggtggtcgtggagcttggtggtcttgcttggcctttgctgctggccctggacttggacagcgggtgggttgctgagccagcgtgaaatagtactggactggctcggcaggagttacagactggcgcacctcctcctgacgctttggaggtttcagttcatctcttggaacaatatcgatgagaaaatcaaactgatcaaattttgtaattgccatggcgatatcatttctctgtagagtccggcgatttttatcacagagttgactcttcgagcctggattcacacagaagataacaagcgccggactctacaggtattattgcagacttagattag

SEQ ID NO: 35189 - DNA, 280 bp, Homo sapiens
gtccaaacggcgtggtggcaattaagaatgtgaggacgattggagagggacaaggtaaagagaagcacacttccccctcccctccgccgcgcctgggcctctgcattgcccgactccgtaggagcgcgggggcggctcctgctcttcctggactcctgagcagaggtgtgtgagtgtgcgggagtttctgtgcgagggtgatagggaagcggcggcggggggaggggcagcgcttcccgccttcgccagagacctcacttcctcgcgcggccgctgctgt

SEQ ID NO: 35190 - DNA, 2462 bp, Homo sapiens
agcggagatctcattccgcctccctctgtcgtcgccccttcccaattctcgcgagacctcaaggagcacagcttctgcgcaccgcacgatactgggagtccaggcgccaagggagggggaagggaaaaggggaaacggtgcaaacggcgtggccgccatcttgcttgtgcccccgcttcgcgcgcgctccgttctccgtgacgcacacttccccctcccctccgccgcgcctgggcctctgcattgcccgactccgtaggagcgcgggggcggctcctgctcttcctggactcctgagcagagttgtcgagatgtccacagaaggaggatttggtggtactagcagcagtgatgcccagcaaagtctacagtcgttctggcctcgggtcatggaagaaatccggaatttaacagtgaaagacttccgagtgcaggaactcccactggctcgtattaagaagattatgaaactggatgaagatgtgaagatgatcagtgcagaagcgcctgtactctttgccaaggcagcccagatttttatcacagagttgactcttcgagcctggattcacacagaagataacaagcgccggactctacagagaaatgatatcgccatggcaattacaaaatttgatcagtttgattttctcatcgatattgttccaagagatgaactgaaacctccaaagcgtcaggaggaggtgcgccagtctgtaactcctgccgagccagtccagtactatttcacgctggctcagcaacccaccgctgtccaagtccagggccagcagcaaggccagcagaccaccagctccacgaccaccatccagcctgggcagatcatcatcgcacagcctcagcagggccagaccacacctgtgacaatgcaggttggagaaggtcagcaggtgcagattgtccaggctcagccacagggtcaagcccaacaggcccagagtggcactggacagaccatgcaggtgatgcagcagatcatcactaacacaggagagatccagcagatcccggtgcagctgaatgccggccagctgcagtatatccgcttagcccagcctgtatcaggcactcaagttgtgcagggacagatccagacacttgccaccaatgctcaacaggggcaaagaaatgcaagtcaggggaagcctcgaaggtgcctgaaagaaaccttacagattacacagacagaggtccagcaaggacagcagcagttcagccagttcacagatggacagaggaacagcgtgcagcaagctcgagtctctgagctaacgggagaggcagagcccagagaagtgaaagccacaggaaattcaactccctgcacctcttccctgcccaccacacaccccccctcacaccgggctggtgcctcctgtgtctgctgctcccaaccccagcagagctccacttcccctcctccttctgacgccttgcagtgggtggtggttgaggtatctgggacccccaaccagctcgagacccatagggagctgcatgcccctctcccagggatgacctcactctctcctctccacccctcgcagcagctctaccagatccagcaagtcaccatgcctgcgggccaggacctcgcccagcccatgttcatccagtcagccaaccagccctccgacgggcaggccccccaggtgaccggcgactgagggcctgagctggcaaggccaaggacacccaacacaatttttgccatacagccccaggcaatgggcacagccttcctccccagaggacccggccgacctcagcgcctcctgcaggctaggacactggtgcactacaccccatgcctgggggccgagattctccagcagaaagatgcaatattttttgtttcctttttttccatttttttctctaaggaatcaatatttcaatatgttgagtgtgtgtccaatgctatgaaattaaaatattaaataacatatttatggcattttcttgaagagtgtggttgaagaaatatttctccttttgtttttctttttttttgtttgttactgccacttctttttaggagcaaatctccccaggggtgtacggtatttcttgactctgggaacagctgctacccccaagacttgccacgttgttctgccctcagatggaattaggtgaatgtgtgtagctgctttttcactcgtggtcctctccccatcccttgctctgaccccagagctctgtgtatttgcatccagaggccatggaaacattctttgcatttaagagacagatttattccctgtggagagtgggtggattcattgccacactcttttctcccagggacccaggaaactaggactttgtgtgtttgctgcccacctcccttttattttttaaatgcattaaaaactgtgctagtctcctttgcatggacttcaagctgcatgaaatgcaataaatctcattttagataa

SEQ ID NO: 35191 - DNA, 2150 bp, Homo sapiens
agcggagatctcattccgcctccctctgtcgtcgccccttcccaattctcgcgagacctcaaggagcacagcttctgcgcaccgcacgatactgggagtccaggcgccaagggagggggaagggaaaaggggaaacggtgcaaacggcgtggccgccatcttgcttgtgcccccgcttcgcgcgcgctccgttctccgtgacgcacacttccccctcccctccgccgcgcctgggcctctgcattgcccgactccgtaggagcgcgggggcggctcctgctcttcctggactcctgagcagagttgtcgagatgtccacagaaggaggatttggtggtactagcagcagtgatgcccagcaaagtctacagtcgttctggcctcgggtcatggaagaaatccggaatttaacagtgaaagacttccgagtgcaggaactcccactggctcgtattaagaagattatgaaactggatgaagatgtgaagatgatcagtgcagaagcgcctgtactctttgccaaggcagcccagatttttatcacagagttgactcttcgagcctggattcacacagaagataacaagcgccggactctacagagaaatgatatcgccatggcaattacaaaatttgatcagtttgattttctcatcgatattgttccaagagatgaactgaaacctccaaagcgtcaggaggaggtgcgccagtctgtaactcctgccgagccagtccagtactatttcacgctggctcagcaacccaccgctgtccaagtccagggccagcagcaaggccagcagaccaccagctccacgaccaccatccagcctgggcagatcatcatcgcacagcctcagcagggccagaccacacctgtgacaatgcaggttggagaaggtcagcaggtgcagattgtccaggctcagccacagggtcaagcccaacaggcccagagtggcactggacagaccatgcaggtgatgcagcagatcatcactaacacaggagagatccagcagatcccggtgcagctgaatgccggccagctgcagtatatccgcttagcccagcctgtatcaggcactcaagttgtgcagggacagatccagacacttgccaccaatgctcaacaggggcaaagaaatgcaagtcaggggaagcctcgaaggtgcctgaaagaaaccttacagattacacagacagaggtccagcaaggacagcagcagttcagccagttcacagatggacagcagctctaccagatccagcaagtcaccatgcctgcgggccaggacctcgcccagcccatgttcatccagtcagccaaccagccctccgacgggcaggccccccaggtgaccggcgactgagggcctgagctggcaaggccaaggacacccaacacaatttttgccatacagccccaggcaatgggcacagccttcctccccagaggacccggccgacctcagcgcctcctgcaggctaggacactggtgcactacaccccatgcctgggggccgagattctccagcagaaagatgcaatattttttgtttcctttttttccatttttttctctaaggaatcaatatttcaatatgttgagtgtgtgtccaatgctatgaaattaaaatattaaataacatatttatggcattttcttgaagagtgtggttgaagaaatatttctccttttgtttttctttttttttgtttgttactgccacttctttttaggagcaaatctccccaggggtgtacggtatttcttgactctgggaacagctgctacccccaagacttgccacgttgttctgccctcagatggaattaggtgaatgtgtgtagctgctttttcactcgtggtcctctccccatcccttgctctgaccccagagctctgtgtatttgcatccagaggccatggaaacattctttgcatttaagagacagatttattccctgtggagagtgggtggattcattgccacactcttttctcccagggacccaggaaactaggactttgtgtgtttgctgcccacctcccttttattttttaaatgcattaaaaactgtgctagtctcctttgcatggacttcaagctgcatgaaatgcaataaatctcattttagataa

SEQ ID NO: 35192 - DNA, 2509 bp, Homo sapiens
agcggagatctcattccgcctccctctgtcgtcgccccttcccaattctcgcgagacctcaaggagcacagcttctgcgcaccgcacgatactgggagtccaggcgccaagggagggggaagggaaaaggggaaacggtgcaaacggcgtggccgccatcttgcttgtgcccccgcttcgcgcgcgctccgttctccgtgacgcacacttccccctcccctccgccgcgcctgggcctctgcattgcccgactccgtaggagcgcgggggcggctcctgctcttcctggactcctgagcagagttgtcgagatgtccacagaaggaggatttggtggtactagcagcagtgatgcccagcaaagtctacagtcgttctggcctcgggtcatggaagaaatccggaatttaacagtgaaagacttccgagtgcaggaactcccactggctcgtattaagaagattatgaaactggatgaagatgtgaagatgatcagtgcagaagcgcctgtactctttgccaaggcagcccagatttttatcacagagttgactcttcgagcctggattcacacagaagataacaagcgccggactctacagagaaatgatatcgccatggcaattacaaaatttgatcagtttgattttctcatcgatattgttccaagagatgaactgaaacctccaaagcgtcaggaggaggtgcgccagtctgtaactcctgccgagccagtccagtactatttcacgctggctcagcaacccaccgctgtccaagtccagggccagcagcaaggccagcagaccaccagctccacgaccaccatccagcctgggcagatcatcatcgcacagcctcagcagggccagaccacacctgtgacaatgcaggttggagaaggtcagcaggtgcagattgtccaggctcagccacagggtcaagcccaacaggcccagagtggcactggacagaccatgcaggtgatgcagcagatcatcactaacacaggagagatccagcagatcccggtgcagctgaatgccggccagctgcagtatatccgcttagcccagcctgtatcaggcactcaagttgtgcagggacagatccagacacttgccaccaatgctcaacagattacacagacagaggtccagcaaggacagcagcagttcagccagttcacagatggacagcagctctaccagatccagcaagtcaccatgcctgcgggccaggacctcgcccagcccatgttcatccagtcagccaaccagccctccgacgggcaggccccccaggtgaccggcgactgagggcctgagctggcaaggccaaggacacccaacacaatttttgccatacagccccaggcaatgggcacagccttcctccccagaggacccggccgacctcagcgcctcctgcaggctaggacactggtgcactacaccccatgcctgggggccgagattctccagcagaaagatgcaatattttttgtttcctttttttccatttttttctctaaggaatcaatatttcaatatgttgagtgtgtgtccaatgctatgaaattaaaatattaaataacatatttatggcattttcttgaagagtgtggttgaagaaatatttctccttttgtttttctttttttttgtttgttactgccacttctttttaggagcaaatctccccaggggtgtacggtatttcttgactctgggaacagctgctacccccaagacttgccacgttgttctgccctcagatggaattaggtgaatgtgtgtagctgctttttcactcgtggtcctctccccatcccttgctctgaccccagagctctgtgtatttgcatccagaggccatggaaacattctttgcatttaagagacagatttattccctgtggagagtgggtggattcattgccacactcttttctcccagggacccaggaaactaggactttgtgtgtttgctgcccacctcccttttattttttaaatgcattaaaaactgtgctagtctcctttgcatggacttcaagctgcatgaaatgcaataaatctcattttagataaaaaaaaaaaaaaaaaaaaaaaaaaaacaaaaaaaaaaaaaacaaaaaacaaaacaaaacagacacaccacgcaccacaaccacaccacaaactagacacgactcgacgcacgcacacccccatgaccggagcagcacacggaggacaaacgacacatgacgaggccacccggcgcggcccgcactaccacacaacgggtgcgcggccggcgagacgccagcgcaccgcgtcagcgccggcgctcgatggacgcggcgccaccacgacgcacagggcacggtgaggcacaggcgcggcggggcggcggtggagcgtggaattcccgctggcgcgggcgcagccgaggaggaagaaccgcagccgtcccaacttgccgcgccggcacacgaggcggcggagtagagccgcgaggaccc

SEQ ID NO: 35193 - DNA, 2491 bp, Homo sapiens
agcggagatctcattccgcctccctctgtcgtcgccccttcccaattctcgcgagacctcaaggagcacagcttctgcgcaccgcacgatactgggagtccaggcgccaagggagggggaagggaaaaggggaaacggtgcaaacggcgtggccgccatcttgcttgtgcccccgcttcgcgcgcgctccgttctccgtgacgcacacttccccctcccctccgccgcgcctgggcctctgcattgcccgactccgtaggagcgcgggggcggctcctgctcttcctggactcctgagcagagttgtcgagatgtccacagaaggaggatttggtggtactagcagcagtgatgcccagcaaagtctacagtcgttctggcctcgggtcatggaagaaatccggaatttaacagtgaaagacttccgagtgcaggaactcccactggctcgtattaagaagattatgaaactggatgaagatgtgaagatgatcagtgcagaagcgcctgtactctttgccaaggcagcccagatttttatcacagagttgactcttcgagcctggattcacacagaagataacaagcgccggactctacagagaaatgatatcgccatggcaattacaaaatttgatcagtttgattttctcatcgatattgttccaagagatgaactgaaacctccaaagcgtcaggaggaggtgcgccagtctgtaactcctgccgagccagtccagtactatttcacgctggctcagcaacccaccgctgtccaagtccagggccagcagcaaggccagcagaccaccagctccacgaccaccatccagcctgggcagatcatcatcgcacagcctcagcagggccagaccacacctgtgacaatgcaggttggagaaggtcagcaggtgcagattgtccaggctcagccacagggtcaagcccaacaggcccagagtggcactggacagaccatgcaggtgatgcagcagatcatcactaacacaggagagatccagcagatcccggtgcagctgaatgccggccagctgcagtatatccgcttagcccagcctgtatcaggcactcaagttgtgcagggacagatccagacacttgccaccaatgctcaacagattacacagacagaggtccagcaaggacagcagcagttcagccagttcacagatggacagcagctctaccagatccagcaagtcaccatgcctgcgggccaggacctcgcccagcccatgttcatccagtcagccaaccagccctccgacgggcaggccccccaggtgaccggcgactgagggcctgagctggcaaggccaaggacacccaacacaatttttgccatacagccccaggcaatgggcacagccttcctccccagaggacccggccgacctcagcgcctcctgcaggctaggacactggtgcactacaccccatgcctgggggccgagattctccagcagaaagatgcaatattttttgtttcctttttttccatttttttctctaaggaatcaatatttcaatatgttgagtgtgtgtccaatgctatgaaattaaaatattaaataacatatttatggcattttcttgaagagtgtggttgaagaaatatttctccttttgtttttctttttttttgtttgttactgccacttctttttaggagcaaatctccccaggggtgtacggtatttcttgactctgggaacagctgctacccccaagacttgccacgttgttctgccctcagatggaattaggtgaatgtgtgtagctgctttttcactcgtggtcctctccccatcccttgctctgaccccagagctctgtgtatttgcatccagaggccatggaaacattctttgcatttaagagacagatttattccctgtggagagtgggtggattcattgccacactcttttctcccagggacccaggaaactaggactttgtgtgtttgctgcccacctcccttttattttttaaatgcattaaaaactgtgctagtctcctttaaaaaaaaaaacaaaaaagaaaaaaaaaaaaaaaaaaaaaaaaaaaaaaaaaaaaacaaaaaaaaaaaaaacaaaaaacaaaacaaaacagacacaccacgcaccacaaccacaccacaaactagacacgactcgacgcacgcacacccccatgaccggagcagcacacggaggacaaacgacacatgacgaggccacccggcgcggcccgcactaccacacaacgggtgcgcggccggcgagacgccagcgcaccgcgtcagcgccggcgctcgatggacgcggcgccaccacgacgcacagggcacggtgaggcacaggcgcggcggggcggcggtggagcgtggaattcccgctggcgcgggcgcagccgaggaggaagaaccgcagccgtcccaacttgccgcgccggcacacgaggcggcggagtagagccgcgaggaccc

SEQ ID NO: 35194 - DNA, 1908 bp, Homo sapiens
ttagcaagtgtacagagatatcgtcctggcaattgtgcatctttctcctttgaccttagcagtttgcatggcagattgtgccaagatgaggcctgtccagggacccatgcaataaaagttgtcgagatgtccacagaaggaggatttggtggtactagcagcagtgatgcccagcaaagtctacagtcgttctggcctcgggtcatggaagaaatccggaatttaacagtgaaagacttccgagtgcaggaactcccactggctcgtattaagaagattatgaaactggatgaagatgtgaagatgatcagtgcagaagcgcctgtactctttgccaaggcagcccagatttttatcacagagttgactcttcgagcctggattcacacagaagataacaagcgccggactctacagagaaatgatatcgccatggcaattacaaaatttgatcagtttgattttctcatcgatattgttccaagagatgaactgaaacctccaaagcgtcaggaggaggtgcgccagtctgtaactcctgccgagccagtccagtactatttcacgctggctcagcaacccaccgctgtccaagtccagggccagcagcaaggccagcagaccaccagctccacgaccaccatccagcctgggcagatcatcatcgcacagcctcagcagggccagaccacacctgtgacaatgcaggttggagaaggtcagcaggtgcagattgtccaggctcagccacagggtcaagcccaacaggcccagagtggcactggacagaccatgcaggtgatgcagcagatcatcactaacacaggagagatccagcagatcccggtgcagctgaatgccggccagctgcagtatatccgcttagcccagcctgtatcaggcactcaagttgtgcagggacagatccagacacttgccaccaatgctcaacagattacacagacagaggtccagcaaggacagcagcagttcagccagttcacagatggacagcagctctaccagatccagcaagtcaccatgcctgcgggccaggacctcgcccagcccatgttcatccagtcagccaaccagccctccgacgggcaggccccccaggtgaccggcgactgagggcctgagctggcaaggccaaggacacccaacacaatttttgccatacagccccaggcaatgggcacagccttcctccccagaggacccggccgacctcagcgcctcctgcaggctaggacactggtgcactacaccccatgcctgggggccgagattctccagcagaaagatgcaatattttttgtttcctttttttccatttttttctctaaggaatcaatatttcaatatgttgagtgtgtgtccaatgctatgaaattaaaatattaaataacatatttatggcattttcttgaagagtgtggttgaagaaatatttctccttttgtttttctttttttttgtttgttactgccacttctttttaggagcaaatctccccaggggtgtacggtatttcttgactctgggaacagctgctacccccaagacttgccacgttgttctgccctcagatggaattaggtgaatgtgtgtagctgctttttcactcgtggtcctctccccatcccttgctctgaccccagagctctgtgtatttgcatccagaggccatggaaacattctttgcatttaagagacagatttattccctgtggagagtgggtggattcattgccacactcttttctcccagggacccaggaaactaggactttgtgtgtttgctgcccacctcccttttattttttaaatgcattaaaaactgtgctagtctcctttgcatggacttcaagctgcatgaaatgcaataaatctcattttagataa

SEQ ID NO: 35195 - DNA, 2229 bp, Homo sapiens
agcggagatctcattccgcctccctctgtcgtcgccccttcccaattctcgcgagacctcaaggagcacagcttctgcgcaccgcacgatactgggagtccaggcgccaagggagggggaagggaaaaggggaaacggtgcaaacggcgtggccgccatcttgcttgtgcccccgcttcgcgcgcgctccgttctccgtgacgcacacttccccctcccctccgccgcgcctgggcctctgcattgcccgactccgtaggagcgcgggggcggctcctgctcttcctggactcctgagcagagacgaggtctcgctctgttgccaaggctggtgtgccaggctggagtgccgtggactgatcatgactcactgcagcctccacctcctgggcctcaagcaatcctcctacttcagcctcctgagtagctgggactacagttgtcgagatgtccacagaaggaggatttggtggtactagcagcagtgatgcccagcaaagtctacagtcgttctggcctcgggtcatggaagaaatccggaatttaacagtgaaagacttccgagtgcaggaactcccactggctcgtattaagaagattatgaaactggatgaagatgtgaagatgatcagtgcagaagcgcctgtactctttgccaaggcagcccagatttttatcacagagttgactcttcgagcctggattcacacagaagataacaagcgccggactctacagagaaatgatatcgccatggcaattacaaaatttgatcagtttgattttctcatcgatattgttccaagagatgaactgaaacctccaaagcgtcaggaggaggtgcgccagtctgtaactcctgccgagccagtccagtactatttcacgctggctcagcaacccaccgctgtccaagtccagggccagcagcaaggccagcagaccaccagctccacgaccaccatccagcctgggcagatcatcatcgcacagcctcagcagggccagaccacacctgtgacaatgcaggttggagaaggtcagcaggtgcagattgtccaggctcagccacagggtcaagcccaacaggcccagagtggcactggacagaccatgcaggtgatgcagcagatcatcactaacacaggagagatccagcagatcccggtgcagctgaatgccggccagctgcagtatatccgcttagcccagcctgtatcaggcactcaagttgtgcagggacagatccagacacttgccaccaatgctcaacagattacacagacagaggtccagcaaggacagcagcagttcagccagttcacagatggacagcagctctaccagatccagcaagtcaccatgcctgcgggccaggacctcgcccagcccatgttcatccagtcagccaaccagccctccgacgggcaggccccccaggtgaccggcgactgagggcctgagctggcaaggccaaggacacccaacacaatttttgccatacagccccaggcaatgggcacagccttcctccccagaggacccggccgacctcagcgcctcctgcaggctaggacactggtgcactacaccccatgcctgggggccgagattctccagcagaaagatgcaatattttttgtttcctttttttccatttttttctctaaggaatcaatatttcaatatgttgagtgtgtgtccaatgctatgaaattaaaatattaaataacatatttatggcattttcttgaagagtgtggttgaagaaatatttctccttttgtttttctttttttttgtttgttactgccacttctttttaggagcaaatctccccaggggtgtacggtatttcttgactctgggaacagctgctacccccaagacttgccacgttgttctgccctcagatggaattaggtgaatgtgtgtagctgctttttcactcgtggtcctctccccatcccttgctctgaccccagagctctgtgtatttgcatccagaggccatggaaacattctttgcatttaagagacagatttattccctgtggagagtgggtggattcattgccacactcttttctcccagggacccaggaaactaggactttgtgtgtttgctgcccacctcccttttattttttaaatgcattaaaaactgtgctagtctcctttgcatggacttcaagctgcatgaaatgcaataaatctcattttagataa

SEQ ID NO: 35196 - DNA, 2039 bp, Homo sapiens
agcggagatctcattccgcctccctctgtcgtcgccccttcccaattctcgcgagacctcaaggagcacagcttctgcgcaccgcacgatactgggagtccaggcgccaagggagggggaagggaaaaggggaaacggtgcaaacggcgtggccgccatcttgcttgtgcccccgcttcgcgcgcgctccgttctccgtgacgcacacttccccctcccctccgccgcgcctgggcctctgcattgcccgactccgtaggagcgcgggggcggctcctgctcttcctggactcctgagcagagttgtcgagatgtccacagaaggaggatttggtggtactagcagcagtgatgcccagcaaagtctacagtcgttctggcctcgggtcatggaagaaatccggaatttaacagtgaaagacttccgagtgcaggaactcccactggctcgtattaagaagattatgaaactggatgaagatgtgaagatgatcagtgcagaagcgcctgtactctttgccaaggcagcccagatttttatcacagagttgactcttcgagcctggattcacacagaagataacaagcgccggactctacagagaaatgatatcgccatggcaattacacctccaaagcgtcaggaggaggtgcgccagtctgtaactcctgccgagccagtccagtactatttcacgctggctcagcaacccaccgctgtccaagtccagggccagcagcaaggccagcagaccaccagctccacgaccaccatccagcctgggcagatcatcatcgcacagcctcagcagggccagaccacacctgtgacaatgcaggttggagaaggtcagcaggtgcagattgtccaggctcagccacagggtcaagcccaacaggcccagagtggcactggacagaccatgcaggtgatgcagcagatcatcactaacacaggagagatccagcagatcccggtgcagctgaatgccggccagctgcagtatatccgcttagcccagcctgtatcaggcactcaagttgtgcagggacagatccagacacttgccaccaatgctcaacagattacacagacagaggtccagcaaggacagcagcagttcagccagttcacagatggacagcagctctaccagatccagcaagtcaccatgcctgcgggccaggacctcgcccagcccatgttcatccagtcagccaaccagccctccgacgggcaggccccccaggtgaccggcgactgagggcctgagctggcaaggccaaggacacccaacacaatttttgccatacagccccaggcaatgggcacagccttcctccccagaggacccggccgacctcagcgcctcctgcaggctaggacactggtgcactacaccccatgcctgggggccgagattctccagcagaaagatgcaatattttttgtttcctttttttccatttttttctctaaggaatcaatatttcaatatgttgagtgtgtgtccaatgctatgaaattaaaatattaaataacatatttatggcattttcttgaagagtgtggttgaagaaatatttctccttttgtttttctttttttttgtttgttactgccacttctttttaggagcaaatctccccaggggtgtacggtatttcttgactctgggaacagctgctacccccaagacttgccacgttgttctgccctcagatggaattaggtgaatgtgtgtagctgctttttcactcgtggtcctctccccatcccttgctctgaccccagagctctgtgtatttgcatccagaggccatggaaacattctttgcatttaagagacagatttattccctgtggagagtgggtggattcattgccacactcttttctcccagggacccaggaaactaggactttgtgtgtttgctgcccacctcccttttattttttaaatgcattaaaaactgtgctagtctcctttgcatggacttcaagctgcatgaaatgcaataaatctcattttagataa

SEQ ID NO: 35197 - DNA, 1848 bp, Homo sapiens
agcggagatctcattccgcctccctctgtcgtcgccccttcccaattctcgcgagacctcaaggagcacagcttctgcgcaccgcacgatactgggagtccaggcgccaagggagggggaagggaaaaggggaaacggtgcaaacggcgtggccgccatcttgcttgtgcccccgcttcgcgcgcgctccgttctccgtgacgcacacttccccctcccctccgccgcgcctgggcctctgcattgcccgactccgtaggagcgcgggggcggctcctgctcttcctggactcctgagcagagttgtcgagatgtccacagaaggaggatttggtggtactagcagcagtgatgcccagcaaagtctacagtcgttctggcctcgggtcatggaagaaatccggaatttaacagtgaaagacttccgagtgcaggaactcccactggctcgtattaagaagattatgaaactggatgaagatgtgaagatgatcagtgcagaagcgcctgtactctttgccaaggcagcccagatttttatcacagagttgactcttcgagcctggattcacacagaagataacaagcgccggactctacagagaaatgatatcgccatggcaattacaaaatttgatcagtttgattttctcatcgatattgttccaagagatgaactgaaacctccaaagcgtcaggaggaggtgcgccagtctgtaactcctgccgagccagtccagtactatttcacgctggctcagcaacccaccgctgtccaagtccagggccagcagcaaggccagcagaccaccagctccacgaccaccatccagcctgggcagatcatcatcgcacagcctcagcagggccagaccacacctgtgacaatgcaggttggagaaggtcagcaggtgcagattgtccaggctcagccacagggtcaagcccaacaggcccagagtggcactggacagaccatgcaggtgatgcagcagatcatcactaacacaggagagatccagcagatcccggtgcagctgaatgccggccagctgcagtatatccgcttagcccagcctgtatcaggcactcaagttgtgcagggacagatccagacacttgccaccaatgctcaacagattacacagacagaggtccagcaaggacagcagcagttcagccagttcacagatggacaggtagggtacccaacctgggctgggcagagggtgaggatttgcggggcagggtagcaggtagtatctgggtttggatggttagggcaactgtcctgtcctctactaacagtgagtggacagaaattgttaaaacaagtacggtatttaaatcagggcacctatcctttagttttatagacttagtgggaactaaaataatcttagacatgtagcccaaattgccattttacagatgagtaaactgaaccctggagatgggaagtgccttgtccatgctcccctagatgttcattgcagagccaggactagagagcaggtttcctgtttccctctctagaactgtatttttttcccctctaagccatgatgctgttttaatagcatggactgttgagacgcagagaacacgtgacctcttgagctctctgggtgcctgaaattcagtcattttcagtccatgcgaggagagaatcttcccttttccctctgctttcccctcacagtacagtcccagagaccactgaggacatgataggatgacatgcccaaacttgtgccctctgctgctcaaaagggagaagagctggcatcagggacccacctctggcttctgccagcaccacatgctaggcttacatgccagggctcc

SEQ ID NO: 35198 - DNA, 1079 bp, Homo sapiens
attggaccccaattgaatgttaccggaaatgtccggaggcttccgggtaaccccccctccttccagcctttgtggtttgagggcaacgggaccagatcccaagacacttgccaccaatgctcaacattacacagacagaggtccagcaaggacagcagcagttcagccagttcacagatggacagcagctctaccagatccagcaagtcaccatgcctgcgggccaggacctcgcccagcccatgttcatccagtcagccaaccagccctccgacgggcaggccccccaggtgaccggcgactgagggcctgagctggcaaggccaaggacacccaacacaatttttgccatacagccccaggcaatgggcacagccttcctccccagaggacccggccgacctcagcgcctcctgcaggctaggacactggtgcactacaccccatgcctgggggccgagattctccagcagaaagatgcaatattttttgtttcctttttttccatttttttctctaaggaatcaatatttcaatatgttgagtgtgtgtccaatgctatgaaattaaaatattaaataacatatttatggcattttcttgaagagtgtggttgaagaaatatttctccttttgtttttctttttttttgtttgttactgccacttctttttaggagcaaatctccccaggggtgtacggtatttcttgactctgggaacagctgctacccccaagacttgccacgttgttctgccctcagatggaattaggtgaatgtgtgtagctgctttttcactcgtggtcctctccccatcccttgctctgaccccagagctctgtgtatttgcatccagaggccatggaaacattctttgcatttaagagacagatttattccctgtggagagtgggtggattcattgccacactcttttctcccagggacccaggaaactaggactttgtgtgtttgctgcccacctcccttttattttttaaatgcattaaaaactgtgctagtctcctttgcatggacttcaagctgcatgaaatgcaataaatctcattttagataa

SEQ ID NO: 35199 - DNA, 2756 bp, Homo sapiens
acttttacattttttggcaagcatagtatatgcaataagtactcaataaacatctgtagagagacttatttagcttttttccattagctacatctgtctctacaatctcaacatactattctcttgaatctgtttttaattttatgccatttctcatgtctgaaaatgtcattataagtaactttttttttttctgagacagggcctcgcactgtcgcccatgctagagtgcagcgagacactcgtagctcttaccagtaacttctttataacacttttgcaatttacgaagcactctcacattatttcattcactctccccaacattaccaaaagttaggaattagatctttttacagatgaaggaattgagactccctgaagtcaagtgtcttatagttaggttttgttcattcattcatcaaatagagtgcctgatgtgagatttattgaaactggatttgaaaacaattttcctgaattcaagtcgagggtttactccactattctcaattactttatcaccagggttataaacccaaaggaagtgagtaacaacagtgtgattttattgaggacccatgcaacactagtctcagaaaggctccagtgtcatttgtaaaattcaaggttaccatcagcagaggcagtcattcctctctgcgcttgttacctaatgcactaactctcactgtaggtaattccattcaagacacatttgatgactatacctacaggttttgaagttattcggatggggttttgacacttactagctgtggggacttagatcaagttacttaacctttttgagcttcagttttatcatttgtaaaatggatacaatcctgatgcctttggaccaagtggtcacggaaatgaaagagataagtatgaaaaaatccatgctcatagtagctgtggtttccaactgcgtgataaaactttaaaatctgcattcaaataagaacaactatgtcgacgtaaggttacaagctaactattcttggtaagtactgttctttattctagaggacatcactttacagtttggtgctaaatgctcttttatgaatttaaggtgccagtagctgtctacttgaacggcatgcttaatctggaacgccatgtcgaccttcatcccccagttctttctccccaaattaaaaacacaaatacacacacacgcccctacttagttcctaaaactcaagggcacgcgcacacacctacttatttcctaaaattcaagctcgcaccaaggagatccacaaggataggcagggtggtggaggtcactgggcagcgcctccggatcccccgaaagggggcggggtcaaaactcagatctcgagctcccgaaagggggcggggttaaaactctcagatctcattccgcctccctctgtcgtcgccccttcccaattctcgcgagacctcaaggagcacagcttctgcgcaccgcacgatactgggagtccaggcgccaagggagggggaagggaaaaggggaaacggtgcaaacggcgtggccgccatcttgcttgtgcccccgcttcgcgcgcgctccgttctccgtgacgcacacttccccctcccctccgccgcgcctgggcctctgcattgcccgactccgtaggagcgcgggggcggctcctgctcttcctggactcctgagcagagttgtcgagatgtccacagaaggaggatttggtggtactagcagcagtgatgcccagcaaagcctacagtcgttctggcctcgggtcatggaagaaatccggaatttaacagtgaaagacttccgagtgcaggaactcccactggctcgtattaagaagattatgaaactggatgaagatgtgaagatgatcagtgcagaagcgcctgtactctttgccaaggcagcccagatttttatcacagagttgactcttcgagcctggattcacacagaagataacaagcgccggactctacagagaaatgatatcgccatggcaattacaaaatttgatcagttgattttctcatcgatattgttccaagagatgaactgaaacctccaaagcgtcaggaggaggtgcgccagtctgtaactcctgccgagccagtccagtactatttcacgctggctcagcaacccaccgctgtccaagtccagggccagcagcaaggccagcagaccaccagctccacgaccaccatccagcctgggcagatcatcatcgcacagcctcagcagggccagaccacacctgtgacaatgcaggttggagaaggtcagcaggtgcagatgtccaggctcagccacagggtcaagcccaacaggcccagagtggcactggacagaccatgcaggtgatgcagcagatcatcactaacacaggagagatccagcagatcccggtgcagctgaatgccggcagctgcagtatatccgcttagcccagcctgtatcaggcactcaagtgtgcagcggacagatccagacacttgcacaatgtcaacagatacacagacagaggtccagcagacggcagcaagtcagccaagttcaaagatgcaaggaggtctacagatccggaagtccatgctgggggcagacctcgcccgccgtcatccagcggcaacagcctcgagggagccccaggagcggctgggggtcgtggggggaggcccaaaattggacagcccgagggggctcccaaaaggaacccgggagggaaccccgcgggccaagaaaatttctaaaa

SEQ ID NO: 35200 - DNA, 1869 bp, Homo sapiens
ttaagagtatacttggaaccctcggagtcctccatggacaagaacagggtggcccatggacttccagccaaaggccactgtggggctgctttggggagagactcacagctggacttctctatccgaccatgcaatgttagccagcaccaattacccacaatgctttgcccataagagatagaaataatggaactcacaggaagaaacagtattgataacatacacaggcttacagaggccaggcccagtaattaccatgagacagaagcctacaggtggcggtgctttgactgggctgggattattgatacattactgatacatcacttcttttataaagcatatgtaaaacgagtgctactgaaagtcgaaggacagcttccggggagtcatgaactctttcactatctcatccgtgacctccttgcgccgggcctggtgctctgcgatgaactgaaacctccaaagcgtcaggaggaggtgcgccagtctgtaactcctgccgagccagtccagtactatttcacgctggctcagcaacccaccgctgtccaagtccagggccagcagcaaggccagcagaccaccagctccacgaccaccatccagcctgggcagatcatcatcgcacagcctcagcagggccagaccacacctgtgacaatgcaggttggagaaggtcagcaggtgcagattgtccaggctcagccacagggtcaagcccaacaggcccagagtggcactggacagaccatgcaggtgatgcagcagatcatcactaacacaggagagatccagcagatcccggtgcagctgaatgccggccagctgcagtatatccgcttagcccagcctgtatcaggcactcaagttgtgcagggacagatccagacacttgccaccaatgctcaacagattacacagacagaggtccagcaaggacagcagcagttcagccagttcacagatggacagcagctctaccagatccagcaagtcaccatgcctgcgggccaggacctcgcccagcccatgttcatccagtcagccaaccagccctccgacgggcaggccccccaggtgaccggcgactgagggcctgagctggcaaggccaaggacacccaacacaatttttgccatacagccccaggcaatgggcacagccttcctccccagaggacccggccgacctcagcgcctcctgcaggctaggacactggtgcactacaccccatgcctgggggccgagattctccagcagaaagatgcaatattttttgtttcctttttttccatttttttctctaaggaatcaatatttcaatatgttgagtgtgtgtccaatgctatgaaattaaaatattaaataacatatttatggcattttcttgaagagtgtggttgaagaaatatttctccttttgtttttctttttttttgtttgttactgccacttctttttaggagcaaatctccccaggggtgtacggtatttcttgactctgggaacagctgctacccccaagacttgccacgttgttctgccctcagatggaattaggtgaatgtgtgtagctgctttttcactcgtggtcctctccccatcccttgctctgaccccagagctctgtgtatttgcatccagaggccatggaaacattctttgcatttaagagacagatttattccctgtggagagtgggtggattcattgccacactcttttctcccagggacccaggaaactaggactttgtgtgtttgctgcccacctcccttttattttttaaatgcattaaaaactgtgctagtctcctttgcatggacttcaagctgcatgaaatgcaataaatctcattttagataa

SEQ ID NO: 35201 - DNA, 1745 bp, Homo sapiens
agcggagatctcattccgcctccctctgtcgtcgccccttcccaattctcgcgagacctcaaggagcacagcttctgcgcaccgcacgatactgggagtccaggcgccaagggagggggaagggaaaaggggaaacggtgcaaacggcgtggccgccatcttgcttgtgcccccgcttcgcgcgcgctccgttctccgtgacgcacacttccccctcccctccgccgcgcctgggcctctgcattgcccgactccgtaggagcgcgggggcggctcctgctcttcctggactcctgagcagagacgaggtctcgctctgttgccaaggctggtgtgccaggctggagtgccgtggactgatcatgactcactgcagcctccacctcctgggcctcaagcaatcctcctacttcagcctcctgagtagctgggactacagttgtcgagatgtccacagaaggaggatttggtggtactagcagcagtgatgcccagcaaagtctacagtcgttctggcctcgggtcatggaagaaatccggaatttaacagtgaaagacttccgagtgcaggaactcccactggctcgtattaagaagattatgaaactggatgaagatgtgaagatgatcagtgcagaagcgcctgtactctttgccaaggcagcccagatttttatcacagagttgactcttcgagcctggattcacacagaagataacaagcgccggactctacagagaaatgatatcgccatggcaattacaaaatttgatcagtttgattttctcatcgatattgttccaagagatgaactgaaacctccaaagcgtcaggaggaggtgcgccagtctgtaactcctgccgagccagtccagtactatttcacgctggctcagcaacccaccgctgtccaagtccagggccagcagcaaggccagcagaccaccagctccacgaccaccatccagcctgggcagatcatcatcgcacagcctcagcagggccagaccacacctgtgacaatgcaggttggagaaggtcagcaggtgcagattgtccaggctcagccacagggtcaagcccaacaggcccagagtggcactggacagaccatgcaggtgatgcagcagatcatcactaacacaggagagatccagcagatcccggtgcagctgaatgccggccagctgcagtatatccgcttagcccagcctgtatcaggcactcaagttgtgcagggacagatccagacacttgccaccaatgctcaacagattacacagacagaggtccagcaaggacagcagcagttcagccagttcacagatggacagcagctctaccagatccagcaagtcaccatgcctgcgggccaggacctcgcccagcccatgttcatccagtcagccaaccagccctccgacgggcaggccccccaggtgaccggcgactgagggcctgagctggcaaggccaaggacacccaacacaatttttgccatacagccccaggcaatgggcacagccttcctccccagaggacccggccgacctcagcgcctcctgcaggctaggacactggtgcactacaccccatgcctgggggccgagattctccagcagaaagatgcaatattttttgtttcctttttttccatttttttctctaaggaatcaatatttcaatatgttgagtgtgtgtccaatgctatgaaattaaaatattaaataacatatttatggca

SEQ ID NO: 35202 - DNA, 331 bp, Homo sapiens
acatgcagcagttcagccagttcacagatggacagcagctctaccattacacagacagaggtccagcaaggacagcagcagttcagccagttcacagatggacagcagctctaccagatccagcaagtcaccatgcctgcgggccaggacctcgcccagcagtacgaggagaaggcggccgcgtatgataaactggaaaagaccaagaaccggcagcagcaggacactgcgacgacctggttgttgatcttggacaaccctgcggcaacatcgtgtccaacctggaaaagaagcagaggcaaatcttgaatccgttgttagcgcgtgctaa

SEQ ID NO: 35203 - DNA, 2043 bp, Homo sapiens
cattggagcctcggagtttttcactgaggcaggggtcagctgaaagacaaagaaaaatggcgaatagtttgttggggggtgggaggacagctgttcgggttttcagtggagtggacattccagactcatgtttctgcatctcctgctgccttttgtttcctccgtcctttggggggtagggataggagtgacttaaattctcccagtcggtggaggtataaataactacatgtaaaattaatgcagttcccagttgtcgagatgtccacagaaggaggatttggtggtactagcagcagtgatgcccagcaaagtctacagtcgttctggcctcgggtcatggaagaaatccggaatttaacagtgaaagacttccgagtgcaggaactcccactggctcgtattaagaagattatgaaactggatgaagatgtgaagatgatcagtgcagaagcgcctgtactctttgccaaggcagcccagatttttatcacagagttgactcttcgagcctggattcacacagaagataacaagcgccggactctacagagaaatgatatcgccatggcaattacaaaatttgatcagtttgattttctcatcgatattgttccaagagatgaactgaaacctccaaagcgtcaggaggaggtgcgccagtctgtaactcctgccgagccagtccagtactatttcacgctggctcagcaacccaccgctgtccaagtccagggccagcagcaaggccagcagaccaccagctccacgaccaccatccagcctgggcagatcatcatcgcacagcctcagcagggccagaccacacctgtgacaatgcaggttggagaaggtcagcaggtgcagattgtccaggctcagccacagggtcaagcccaacaggcccagagtggcactggacagaccatgcaggtgatgcagcagatcatcactaacacaggagagatccagcagatcccggtgcagctgaatgccggccagctgcagtatatccgcttagcccagcctgtatcaggcactcaagttgtgcagggacagatccagacacttgccaccaatgctcaacagattacacagacagaggtccagcaaggacagcagcagttcagccagttcacagatggacagcagctctaccagatccagcaagtcaccatgcctgcgggccaggacctcgcccagcccatgttcatccagtcagccaaccagccctccgacgggcaggccccccaggtgaccggcgactgagggcctgagctggcaaggccaaggacacccaacacaatttttgccatacagccccaggcaatgggcacagccttcctccccagaggacccggccgacctcagcgcctcctgcaggctaggacactggtgcactacaccccatgcctgggggccgagattctccagcagaaagatgcaatattttttgtttcctttttttccatttttttctctaaggaatcaatatttcaatatgttgagtgtgtgtccaatgctatgaaattaaaatattaaataacatatttatggcattttcttgaagagtgtggttgaagaaatatttctccttttgtttttctttttttttgtttgttactgccacttctttttaggagcaaatctccccaggggtgtacggtatttcttgactctgggaacagctgctacccccaagacttgccacgttgttctgccctcagatggaattaggtgaatgtgtgtagctgctttttcactcgtggtcctctccccatcccttgctctgaccccagagctctgtgtatttgcatccagaggccatggaaacattctttgcatttaagagacagatttattccctgtggagagtgggtggattcattgccacactcttttctcccagggacccaggaaactaggactttgtgtgtttgctgcccacctcccttttattttttaaatgcattaaaaactgtgctagtctcctttgcatggacttcaagctgcatgaaatgcaataaatctcattttagataa

SEQ ID NO: 35204 - DNA, 1826 bp, Homo sapiens
agcggagatctcattccgcctccctctgtcgtcgccccttcccaattctcgcgagacctcaaggagcacagcttctgcgcaccgcacgatactgggagtccaggcgccaagggagggggaagggaaaaggggaaacggtgcaaacggcgtggccgccatcttgcttgtgcccccgcttcgcgcgcgctccgttctccgtgacgcacacttccccctcccctccgccgcgcctgggcctctgcattgcccgactccgtaggagcgcgggggcggctcctgctcttcctggactcctgagcagagttgtcgagatgtccacagaaggaggatttggtggtactagcagcagtgatgcccagcaaagtctacagtcgttctggcctcgggtcatggaagaaatccggaatttaacagtgaaagacttccgagtgcaggaactcccactggctcgtattaagaagattatgaaactggatgaagatgtgaagatgatcagtgcagaagcgcctgtactctttgccaaggcagcccagatttttatcacagagttgactcttcgagcctggattcacacagaagataacaagcgccggactctacagagaaatgatatcgccatggcaattacaaaatttgatcagtttgattttctcatcgatattgttccaagagatgaactgaaacctccaaagcgtcaggaggaggtgcgccagtctgtaactcctgccgagccagtccagtactatttcacgctggctcagcaacccaccgctgtccaagtccagggccagcagcaaggccagcagaccaccagctccacgaccaccatccagcctgggcagatcatcatcgcacagcctcagcagggccagaccacacctgtgacaatgcaggttggagaaggtcagcaggtgcagattgtccaggctcagccacagggtcaagcccaacaggcccagagtggcactggacagaccatgcaggtgatgcagcagatcatcactaacacaggagagatccagcagatcccggtgcagctgaatgccggccagctgcagtatatccgcttagcccagcctgtatcaggcactcaagttgtgcagggacagatccagacacttgccaccaatgctcaacagattacacagacagaggtccagcaaggacagcagcagttcagccagttcacagatggacagcagctctaccagatccagcaagtcaccatgcctgcgggccaggacctcgcccagcccatgttcatccagtcagccaaccagccctccgacgggcaggccccccaggtgaccggcgactgagggcctgagctggcaaggccaaggacacccaacacaatttttgccatacagccccaggcaatgggcacagccttcctccccagaggacccggccgacctcagcgcctcctgcaggctaggacactggtgcactacaccccatgcctgggggccgagattctccagcagaaagatgcaatattttttgtttcctttttttccatttttttctctaaggaatcaatatttcaatatgttgagtgtgtgtccaatgctatgaaattaaaatattaaataacatatttatggcattttcttgaagagtgtggttgaagaaatatttctccttttgtttttctttttttttgtttgttactgccacttctttttaggagcaaatctccccaggggtgtacggtatttcttgactctgggaacagctgctacccccaagacttgccacgttgttctgccctcagatggaattaggtgaatgtgtgtagcaatgaacgggtcctactaagatag

SEQ ID NO: 35205 - DNA, 1921 bp, Homo sapiens
agcggagatctcattccgcctccctctgtcgtcgccccttcccaattctcgcgagacctcaaggagcacagcttctgcgcaccgcacgatactgggagtccaggcgccaagggagggggaagggaaaaggggaaacggtgcaaacggcgtggccgccatcttgcttgtgcccccgcttcgcgcgcgctccgttctccgtgacgcacacttccccctcccctccgccgcgcctgggcctctgcattgcccgactccgtaggagcgcgggggcggctcctgctcttcctggactcctgagcagagttgtcgagatgtccacagaaggaggatttggtggtactagcagcagtgatgcccagcaaagtctacagtcgttctggcctcgggtcatggaagaaatccggaatttaacagtgaaagacttccgagtgcaggaactcccactggctcgtattaagaagattatgaaactggatgaagatgtgaagatgatcagtgcagaagcgcctgtactctttgccaaggcagcccagatttttatcacagagttgactcttcgagcctggattcacacagaagataacaagcgccggactctacagagaaatgatatcgccatggcaattacaaaatttgatcagtttgattttctcatcgatattgttccaagagatgaactgaaacctccaaagcgtcaggaggaggtgcgccagtctgtaactcctgccgagccagtccagtactatttcacgctggctcagcaacccaccgctgtccaagtccagggccagcagcaaggccagcagaccaccagctccacgaccaccatccagcctgggcagatcatcatcgcacagcctcagcagggccagaccacacctgtgacaatgcaggttggagaaggtcagcaggtgcagattgtccaggctcagccacagggtcaagcccaacaggcccagagtggcactggacagaccatgcaggtgatgcagcagatcatcactaacacaggagagatccagcagatcccggtgcagctgaatgccggccagctgcagtatatccgcttagcccagcctgtatcaggcactcaagttgtgcagggacagatccagacacttgccaccaatgctcaacagattacacagacagaggtccagcaaggacagcagcagttcagccagttcacagatggacagaggaacagcgtgcagcaagctcgagtctctgagctaacgggagaggcagagcccagagaagtgaaagccacaggaaattcaactccctgcacctcttccctgcccaccacacaccccccctcacaccgggctggtgcctcctgtgtctgctgctcccaaccccagcagagctccacttcccctcctccttctgacgccttgcagtgggtggtggttgaggtatctgggacccccaaccagctcgagacccatagggagctgcatgcccctctcccagggatgacctcactctctcctctccacccctcgcagcagctctaccagatccagcaagtcaccatgcctgcgggccaggacctcgcccagcccatgttcatccagtcagccaaccagccctccgacgggcaggccccccaggtgaccggcgactgagggcctgagctggcaaggccaaggacacccaacacaatttttgccatacagccccaggcaatgggcacagccttcctccccagaggacccggccgacctcagcgcctcctgcaggctaggacactggtgcactacaccccatgcctgggggccgagattctccagcagaaagatgcaatattttttgtttcctttttttccatttttttctctaaggaatcaatatttcaatatgttgagtgtgtgtccaatgctatgaaattaaaatattaaataacatatttatggca

SEQ ID NO: 35206 - DNA, 1581 bp, Homo sapiens
agcggagatctcattccgcctccctctgtcgtcgccccttcccaattctcgcgagacctcaaggagcacagcttctgcgcaccgcacgatactgggagtccaggcgccaagggagggggaagggaaaaggggaaacggtgcaaacggcgtggccgccatcttgcttgtgcccccgcttcgcgcgcgctccgttctccgtgacgcacacttccccctcccctccgccgcgcctgggcctctgcattgcccgactccgtaggagcgcgggggcggctcctgctcttcctggactcctgagcagagttgtcgagatgtccacagaaggaggatttggtggtactagcagcagtgatgcccagcaaagtctacagtcgttctggcctcgggtcatggaagaaatccggaatttaacagtgaaagacttccgagtgcaggaactcccactggctcgtattaagaagattatgaaactggatgaagatgtgaagatgatcagtgcagaagcgcctgtactctttgccaaggcagcccagatttttatcacagagttgactcttcgagcctggattcacacagaagataacaagcgccggactctacagagaaatgatatcgccatggcaattacaaaatttgatcagtttgattttctcatcgatattgttccaagagatgaactgaaacctccaaagcgtcaggaggaggtgcgccagtctgtaactcctgccgagccagtccagtactatttcacgctggctcagcaacccaccgctgtccaagtccagggccagcagcaaggccagcagaccaccagctccacgaccaccatccagcctgggcagatcatcatcgcacagcctcagcagggccagaccacacctgtgacaatgcaggttggagaaggtcagcaggtgcagattgtccaggctcagccacagggtcaagcccaacaggcccagagtggcactggacagaccatgcaggtgatgcagcagatcatcactaacacaggagagatccagcagatcccggtgcagctgaatgccggccagctgcagtatatccgcttagcccagcctgtatcaggcactcaagttgtgcagggacagatccagacacttgccaccaatgctcaacagattacacagacagaggtccagcaaggacagcagcagttcagccagttcacagatggacaggtagggtacccaacctgggctgggcagagggtgaggatttgcggggcagggtagcaggtagtatctgggtttggatggttagggcaactgtcctgtcctctactaacagtgagtggacagaaattgttaaaacaagtacggtatttaaatcagggcacctatcctttagttttatagacttagtgggaactaaaataatcttagacatgtagcccaaattgccattttacagatgagtaaactgaaccctggagatgggaagtgccttgtccatgctcccctagatgttcattgcagagccaggactagagagcaggtttcctgtttccctctctagaactgtatttttttcccctcttccccgcccaggggatcctctagc

SEQ ID NO: 35207 - DNA, 986 bp, Homo sapiens
aacctggcccgtattccggactgtgtaaagacttccgagtgcaggaactcccactggctcgtattaagaagattatgaaactggatgaagatgtgaagatgatcagtgcagaagcgcctgtactctttgccaaggcagcccagatttttatcacagagttgactcttcgagcctggattcacacagaagataacaagcgccggactctacagagaaatgatatcgccatggcaattacaaaatttgatcagttgattttctcatcgatattgttccaagagatgaactgaaacctccaaagcgtcaggaggaggtgcgccagtctgtaactcctgccgagccagtccagtactatttcacgctggctcagcaacccaccgctgtccaagtccagggccagcagcaaggccagcagaccaccagctccacgaccaccatccagcctgggcagatcatcatcgcacagcctcagcagggccagaccacacctgtgacaatgcaggttggagaaggtcagcaggtgcagatgtccaggctcagccacagggtcaagcccaacaggcccagagtggcactggacagaccatgcaggtgatgcagcagatcatcactaacacaggagagatccagcagatcccggtgcagctgaatgccggcagctgcagtatatccgcttagcccagcctgtatcaggcactcaagtgtgcagcggacagatccagacacttgcacaatgtcaacagatacacagacagaggtccagcagacggcagcaagtcagccaagttcaaagatgcaaggaggtctacagatccggaagtccatgctgggggcagacctcgcccgccgtcatccagcggcaacagcctcgagggagccccaggagcggctgggggtcgtggggggaggcccaaaattggacagcccgagggggctcccaaaaggaacccgggagggaaccccgcgggccaagaaaatttctaaaa

SEQ ID NO: 35208 - DNA, 473 bp, Homo sapiens
gaagggcagtggggaggtgggaacagccagaattatgaggacaatgacatccatgacagttttagagactaccgttattcgttttagccttgaaatcactgaagcgggtgtaggtacaatcatcagaccagttttatggatctggggtgcagagctgtgctcagctatgtctgagtctaggggtctccctctcatccacagtgttatctgagctcccattttagagatcagaaaacggaggctagcgagagtcatcgcgggaaacttgccctctgactgccagtcagaacccgtgacatgcacctgccccagcctggtctggggctaaatccaggccacagcagggggaatgacctcgagcccttaggcaaatctgcttgagtcaatgggtcagagatccctggactgagggtcaaatggaccctctcaggtgtgggggtggcacacctgagaggacccatggccacctgcct

SEQ ID NO: 35209 - DNA, 520 bp, Homo sapiens
agcaggagaactgcttgaacctgggaggcagaggttgcggtgagccaagatcgcgccattgcactccagcctgggcaacaagagtgaaactccgtctcaaaaaaaaaagaaaaattctaaaactttaagtgaaatttattatcccttcccacttattttctgtggttttgtgtgtatagagcatcttcctttgttacccaagtacctcgaatgggttggaaactggcggtagaaggttagagtagccaattgatatgtaaaccaagtgtcagatcagatgagatgaaagaggtggagtttaaagcaagtgagatatgataaacaatgatgaaagcaaaaatagggcagttgaaccagagtcagccagttggcataactgccaataaatgaggcagtgtagaataactaataatgattggaatcaaggaaaagagagcatagaggaattatctagagaataacttctttttaatcatttgttagtcatgtaactatggataaaacatactaatttagcgtc

SEQ ID NO: 35210 - DNA, 261 bp, Homo sapiens
cttgtactgtctccctcatttgtgtcttgaatggaagagagaaagatggatgtagccactgagccaggaattttacatacccatagcctatctcatctgggctagagccgtggtttggttactggtatactatttagtagtgtgactgttgtgaactttttatagtactgtgctttcctaaaatgttgttttgagatttatcaaaatctggaccatatatttcttatgagtgtcaagaatgtgaacatccttgtcaaaagg

SEQ ID NO: 35211 - DNA, 448 bp, Homo sapiens
gctcttggacatgactaaaaaaaagaacagcctgataaaaaatagtcaaaggagatgaacaagacaaatcacaacggaagggaagtaaatggctctttgaaaacatgaaaagatgctcagccttattcatggtaagagacatgcaattgaaaataacacctgtgaaaatggcacctgtgacatttgcaaatattcataaacttcataacacactgttggcaagtccacgaggaggcaggtgcttctgtactttcctggtgggagtatcaagtggtgtagctaccgaggaaggcaatttggcagtatccatcaatattaaaaatgcatgttggctgggcgtggtggctcacgcctataatcccagcactttgggaggccgaggtgggtggatcacgaggtcaagagctcaagaccatcctggccaacatggtgaaaacccatttctact

SEQ ID NO: 35212 - DNA, 474 bp, Homo sapiens
gctgcctcctcccccgcgccggaaccctctcccctcccttgcgttgcccccctctcccgccgcctcctcccgctctcctctcgctctcctcccgcctccttcttccaggcgcggcagcggggcaagagcgaggtggctgcgaggaggcgtcactgaaagccctgacttggggaaggctgcgggctcggagccggagacgccgagctggggccgggtgagttgggaatcagactcttgagttgacagctggcctatggtttctgcattttgttaagaagcacctcatgcaagcgagggacctgggactgctcacagccaggtggcatttttctgaagttgttcattaagacttcccagcattcctacagatataaataggtgaggccgcaggcggtgctctgggtccgggagcgctgtccccagcatgaacgcggccggcggcgggagtgaatgactgcagctgcgacttccttc

SEQ ID NO: 35213 - DNA, 399 bp, Homo sapiens
atttttttttactctaaatagtcaaaatgataacactggtagatacctacttttaaggaactctaggtaaggtgacagatacaaaggcatgtacataatttcaatacaataaaagtcagtgcaagaatagacatatgcctagaatacaactaaaaagatgagccactgggagtgttggaaaagatgagggccataacaactagaataatgcctcggcccatggcagctgttcactaaaaattgttgaatttgttgaattattgagtgataaaatatgaaccatacaggaggcagttttatgtaatggaaaataatatgaagcaaaaagactcaggtctgaatttgggctttcctacaaattagtaatgctatcttggagcttttaagaagactgtttcc

SEQ ID NO: 35214 - DNA, 251 bp, Homo sapiens
taacaaactttctttcagttgtccagtgtacagaagcttactggaaggagtggccaactagttaaaggtttgacacctcaatatcaacaaaatgccaagtggatcattttgactctcacagcaatccaactggacatttgaccatgccccgtggtcagtggagagcttcttctctgaaggccacttttatctagcacatcaaggctatacacctctttcactaagaagaatttgacacttttatgttgtga

SEQ ID NO: 35215 - DNA, 546 bp, Homo sapiens
aacaaattaccaccaatttagtggtttaaaacaccaccaatttaatatcttactgttctgtaggtcagaaggccaacggtgatcttcccgggctaaaaatcaaagtgttgcaggtgttgcattcttttctggaggttttaggggagaatcaattcctggccttttccaccttctggaagccgcctgccttccttggcttgtgacttcaaagctagcaacgttgcatctctctgagccttctgtagttatagctccttctgactacagctgggaaacgtttttgcttttaaagtctcatgtgattagattggggctacctggttaatccacatctacagaagtcccttttgccttgtaaggtaacctattcacaggttcaggggtgagggagagagtgtggacacttttggaggaccagtattcttccacctacatttagtggtagaacccagaaatgatgccccccaccagaaaaaaaaaaaagctttagagcacaaagaaataagaacacctagatgttggtgaaaatgtaagcaatagttctac

SEQ ID NO: 35216 - DNA, 420 bp, Homo sapiens
gccatacattccaactttgaggattaagctgccgtcaatctattatttatttttagtaagaccaagagataaattttaatgattcaattaaaaatcataaggtcagattgatgaaatgactcaatataaactgctcgaccttccactagtacatacttgctcattgtaaaacctgtatgaaagtgtagcagaaacagccaccctatttgcagtttttctaagtaacttggtaggttgaaagatccaaggtcaaaagaacttatccagtgtagcaaataacagtaaaataagataaagtggcccgggcatggtggctcatgcctgtaatcccagcactttgggaggctgaagtgggtgcatcacatgaggtcaggagttcgagatcagcctggccaacatggtgaaatcccatctctacca

SEQ ID NO: 35217 - DNA, 640 bp, Homo sapiens
aataagtgaaaaacaaaggtcccaaacatggctctgaaacaatgcatgcccttgtcagtcttgtaacttaactctaagcttcttggcatacttaagagttatttatgcaacaaccagacatttgagaattatgatagatgaaggtgctgataataataatagctaccatgtattgagctgtgtgccaggttctttgttaggagctggggagacaatagtgaataaaacagccaaaaattcttcctctcaagtaatgttcagacaagtaaacaggctgctgagagctatgataggaaaacacaaggtgttacagaaggcacacaggactcccgggaacctaacccaggcttggggatcagtggggacaatttcctggagaaattgatatctaagctaatcacgaaggattagtaagaacagttaggtggaagatgaacaaggggaagacagtatttaaaaaaaaggaacactatgtataaaggattgaaagctacagagaacaagtttgtttgtttgtttgagacggagtctcactctactgcctaggctggagtgcaatggtgcgatcttggctcactacaacctccgcctcctgggttcatgcgattctcctgcctcagactccaaagcagctgggatt

SEQ ID NO: 35218 - DNA, 511 bp, Homo sapiens
agagaagaggctttgacaagcaaagattcctgcagtgctattgccatagagctgtatttagcaggctcccaagctctatgcttatatagaacctcttaaggtgttctagactctgagatttgggaagtgctttttctatattgagtctaaatgtgcagttcattttatgaaatgataaaaaaaattagcacagttgtcatcacttatatttttgcctttgaatcataaatccccaagatttccatatgaattattatttttttaaaagaacaacatttgtactttatatgcttccaaaaggaatgtgagccttctcatattaaaagttttctatgcagtaatatataaatagaaatgattgtatctaaatcaaaaatcaatgatacatggccagtacagtgactcctgcctgtaatcccagcactttgggaggccaaggcgggaggattgcttgagcccgggagttcaagaccagcctgggcaacatagtgagatcctgtctcttaaatta

SEQ ID NO: 35219 - DNA, 342 bp, Homo sapiens
agaggatgctaattaaaggaacagaaaactggagtagacagaagtgaaaaaggcaaaaagtgtcaaccccatcacactaacaaaattggagatgaagaaaacgaggcaaaataacttaacttgataagcatacataagcaaaagggaagaaataaaataaaacagatcattagccacaaataatatagtagcaaaaaagtaaaagttttcaattttctgattataagatacatacttaaagtatcagaggaaagttgattaaagtgatatgtgcagggagtttcaagaaaaagcaaatcaaaagaaatcaaagtatcattaatcacattagagaaagtggga

SEQ ID NO: 35220 - DNA, 374 bp, Homo sapiens
atccagcatttgcctcatgatgatctcagaaaaaatgagatgggagaagaaagagaaagtgtcagacccaaccagagtgtgagtcctgtaggaacctcacaggcaacatgggaagaggaggcagaaccaggaagcccaaatgagtgctctccagcccagcaggtccttccctatggcccatggcatcctggccctggacgtggggaagccttgcctgcgcaccactcctagttacagggagctcgcttcctcccagggtagcctcttccaaactgctgtccccattgggtataagtctctttttttttttttttttttttgtgaaacagggtctcactctatcgcccaggctggagtgcagtggcatgatctca

SEQ ID NO: 35221 - DNA, 342 bp, Homo sapiens
cagtaagttaagatgcaatatttgaataatgcaattaagaaatctcttaagggacatatatagaatactaataccgaagaccttcaaaatatgcattctctaagtacacgtgatagttttctgaaattgaccaactcaaaaaaaaagcaactctcagattataaaaggattgaaattattcagattatgttctttgatgacagtgaaaattatgctagaaatcaataataaaaaggtaactagaaaatcctcagctttttctaagttaagcagtatgcctctaaatgttactcacaggtcaaagaactcacaatggaagttagaaaatattttcaactgatt

SEQ ID NO: 35222 - DNA, 596 bp, Homo sapiens
tgagttggagtcttgctctgtcgcccaggctggagtgcagtgacccaatctcggctcactgcaagctccacctcccgggttcatgccattctcctgcctcagcctcccaagtagctgggactacaggtgcccgccaccacgcccggctaatttttttaattttagtagagtcggggtttcaccatgttggccaagatggtctcgatctgacctcgtgatctgcccgcctcggcctcccaaagtgctgggattacaggtgtgagccaccgcacccagccttattcttcccttttaaatacttaaagcacattcagattagttgaaaattcacgtgtttttggaggccaggcaggtggccttctgcagagacagcagcagctcagctcttgctgaccaaggccttggaggactgtgagccacaatcacatatgtccatgtttcaaaagaagctaaatatccagatttcctccatgggccaactaaaaggtgattgtggactatacaggctgccagtttaatcctttatcagagtctctgtggataatgtacctttgtgcctaatactttatctgtctaccaaaactcagtccagatct

SEQ ID NO: 35223 - DNA, 1271 bp, Homo sapiens
ttttaattttcagtagagatgggtttcacgttggccaggctggtttcaaattcctgacctcaagtgatccgcctgccttggcctcccaaagtgctaggattacatgtatgttttatttgttttctttcagtaagaatgtaagctcaatgaaggttaggatgttttgttttttttattcacccagttccttgaagactgcttctcacacaataagagctcaacaaatagttgctggttggctgaatgaatgaatgaatgaatggggttcaacatacaatggcagatggtgatcccttctgggaagctcgaccaaagagccctgtgaggggtcaccacagggatcacattgtggggtagagttgggaatctggtcttatcaattcccatggccccaggttagtaaggacaaacctagcactgacattgccacgcctcactctcagcagttcacaaagcctcctgcacacatgctgttatcctaaccagaatcttcacaacaccaacatgaggaaacgaactaaggcccaatactttggaatcctcattcaatgctctttcccatctctcttgggatcaacatagtcagagccctctactttggggaaaaagtgtgtcataggggcttgcgactggtacacaatctcaaaagtgggatgctcaaagtcttctctccatgccctcaaaagatgacctgggctgggcatggtggctcacacctgtaatcctaacacttgggaggccaaggtgggcagatcacttgagtctaggagctcgagaccagcctgagcaacatggtgagactctgcctctacaaaaaattacaaaaatttgccaggcatggtggtccctagtactctggaggctgaggtaggaggctcaactgatcccagggaggttgaggttgcagtgagccatgacggcaccactgcactccagcctgggcggcagagtgagacccccatctcaaaaaaataaataaataaataaataaaaccaagacctggaaactggcactccaaaaggctgcctgtgtgcgtacagaatgcacagatgtgccacagccacccagactcaggtggggaacttggggaagcaaaccacttagagaaagagaggcaccagaaagagaatcaaggaaacattttacacacaagagctccttttttaaagcctctgacaaagttttctaaccccgcgtggtgagtgaaggagcccaaaggcacactgtgttttttggctgtcccacaggctgagttgatttggaattctgc

SEQ ID NO: 35224 - DNA, 345 bp, Homo sapiens
gtctgtaaagaggtactttatatgataagtcttatgataaggactggaagaaagagaggataagacagagcgcccaagaaagagagacggaaaaagggaatggttaatgatttcagtacgtgaagaaggatcattagttctgacgccttcttttgtgcatcctgccatgtcactttatttatatgtgttttctcaattgttaacatttttatattacattgcattacagctaaccattaaggaataaaatcattcagtccgaccacaatttcatattaattttgctatgtgtttctgaataacagatagatctccatcatctgactccttttacaaaaaaaaaaa

SEQ ID NO: 35225 - DNA, 394 bp, Homo sapiens
ccaactccttgccaggttaacataaaaccacacacacactaaaggtcaatttacctcagttcataaacctgatacatcatgtctagctttctacaaaaatttgcatgacatgctaaaaggcaaagaaaaaaacagtctaaagaaacaaagcatgcatcagaactgggctacaaaatagcagagattttggagttatcagaccagaaacttccaataacaataattataagttaaagtctctaatgaaaaaagtagacaatattcaagaacagttgggtaatgtaagcacagagatggaaactatacgagttaaaagtaagtggtggaaataaaaaacactgcacaaatgaaactgctttagatgggttcatcagttagactgaatacagctaac

SEQ ID NO: 35226 - DNA, 396 bp, Homo sapiens
gaccttgtccccattttacccttgaggaaactgaagcaaaacaatgtgtccatctctctgatctaggggcagccctcaaagcctgaccccttaggctgcaaaactcttcctccctagtctcccaaagaccattgattccccccaactccatctatacctcaggatccagatggcagttcttttggaggaatagtaacccacagtttaaatgctcatgcttagaaaaggcacctcatgcccttattaaccaacactgtgaaccagctcatcaggcagcaagccgagagccaggccctgggaaaaggagacaggagctgggagttttgtttttgttttctgtttgtttttgagacggagttttgttcttgttgcccagactggagtgcaatggcgcaa

SEQ ID NO: 35227 - DNA, 369 bp, Homo sapiens
ctggcttgtccattggtgatgttgcaaagaaactgggagagatgtggaataacactgctgcagatgacaagcagccttatgaaaagaaggctgcgaagctgaaggaaaaatacgaaaaggatactgctgcatattgagctaaaggaaagcctgatgcagcaaaaaagggagttgccaaggccgaaaaagcaagaaaaacaaggaagatgaggaagatgaagaggatgaggaggaggaagatgaagaagatgatgatgatgaataagttggttctagcacagatttttttcttgtctataaagcatttaacccccctgtatacaactcactccttttaaagaaaaaaattgaaatgtaaggctgtgtaag

SEQ ID NO: 35228 - DNA, 413 bp, Homo sapiens
aagtaaacaattaaatgaaattgaatgtttcaggtgcaagagtacgttattggggatagagaggacactgcagcccctcagccccagccccaaggccctcctgtcaaaatgtgtctaaccaggatgcaggaagcccacatctgtccaggaatagagcttgcagagtggctacgtgagggtggaaatgccagattgaagtccctgaagaacttcagttttggcagctagcagtgctgcagacagccctgcccaggcaagccccacccaagaacggagggccaggcagggctgactcagttgggcaaccattggctgcactcagacaagagttacatgattcatcctctagccaagagaacagagttttaatcacaacatttccccctttcctttgtcttattttaaagccagtg

SEQ ID NO: 35229 - DNA, 505 bp, Homo sapiens
tagtggccctctcttgtcctttttgccttaattctcagcttcttgcctagctccccagaatcagcagaatcctaagagaaaataatgtcagcttagctctccatgctttccctctgatagtatttgccacttagtttttggtggccttagcactctccagtatattcaaacaagtgtgtctgtgtatctggcttttctacttgttcttgatgggagcattagtctactataagctactgagttatatcaaaagcaaaaagctagattctaatgtattcatatctttttaaaaataatgcttcttggctgggcacagtggctcacacgtgtaatcccagcactttgggaggctggggcaggcggatcacctgaggtcaggagttcgagatcaacctagccaacatggcgaaattttgtctcaacaaaaaatacaaaaattagccaggagtggtggtatgtgcctgtagtcccagctacttggagggctgaggtgggaggatcgctt

SEQ ID NO: 35230 - DNA, 350 bp, Homo sapiens
ctcaagataacccaatagcaactactgtacaaatgacaacagataatggcagtaagaatctggagagggagaggttatttttcagtttgaggcagtaaggttggctttatggcacaggtggtttttaaactatcaagtttattctgaagtttattaggtggaggggaaagatgttttctatgtgaataaaaaatcttgagtaaaagtcagtttcagaggtatattcagaaatattgagcaagtaagtttgacagaaacagtgctgaattaagtatttttgaagtttgatctgtttgggcgccgtttccagttttgctttttaattctcctctctctctctctctctctct

SEQ ID NO: 35231 - DNA, 747 bp, Homo sapiens
aggtcatgtgatgaaagcagtccaagtgcggatattttacagcagtcatcgttgggcctgaccgaggcactaacctcagctctgctgacaggtcacccagcaaccatatgtgcagttgtgagcagggtaccaggcactacagtcacagtcaccattaagagttagacctccaaaagacacagggttcctctaactattgtgacaggaacgttctggagatcaactctcttctgtatcagtaggaacattttctggttctaatccttaagccaaaactctgaatgattccagattaccaactatctccaactgaactagagatagcttacaaatgttaataaaatagcaatgaggaagctttttactttttaacttgaggttcctcccgatgtgctattactgcacgaggaaaagccattccctatcattttagccaacttagtttcaggccagtgagcaaaactttccttttttgttagaggacacaatgcccactgacttctgagttgtaaaccccatttttgagtcctacattcccaagatgaggagataaggataacgctcaggccctcacagatcctggtagctaaattactcctttccgtttattgtccacccgtggcctccagccgggctgggctgtctttcagcgccacagagttcagctgtcatacttgttaatcccatggtttcattatactgaatgactaatgcttgagagtcgataataaattaccctgttttcat

SEQ ID NO: 35232 - DNA, 399 bp, Homo sapiens
ctttaattatcattcagttctaagaattttgttaattcttttgtgggaattcttttgaagtaagttcttaggtttgcagccatatgaatagttttaaaaactgactttgccgggcatgatagctcacacaggtaatcccagcactttgggaggccaggaccagaagactgctcgagcccaggagttcaagaccagcatgggcaacatagcgagacctccatttctacaaaatattttttaaattagtcaggcatggtggcacgtacctgtagtcctggctactagagaggctgaggcaggaggatggcttaagcccaggttcaatcatagctgcagtgagctatgattgcaccactgcactccagcctaggtgacaaagtgatataccctatttctaaa

SEQ ID NO: 35233 - DNA, 429 bp, Homo sapiens
taatgcaccagaattcaaacctaggtctctatcatctcatggttggtgggttcccacttgccaagttccctccctgatcctccatgtctgtgttaacagccgggttgagctggcccactctgcctccccctaaactgcactgttcccagtccctacaatcctgccagtagactaaggacacgtatgaagaaaacactgcccttctgctgccccttccctcctcgtaccctcgatgttgctaggtcctccctttgagttccttgaaagggtctctagggtcagaagagtatgggaagatgcagatgaagtgacctgggaggtacaggcccgaggccagagcctctctgcagagcctttccccaggatccacccgctgtggtcatcttactggaatcccactgaaatcccactagctgaagagatttcttt

SEQ ID NO: 35234 - DNA, 547 bp, Homo sapiens
tctccagacccttggaagttgctgttcagttgtatgttttgttccttgtgttgtcttacttggagctcacgtctctctggaggcttcactagaagaggtggctgacctggcagttccagctccattccatgctccccctaagccccttctggcacttcatcagatactggactgtccttccccagctgtgtcacctcctctctgtattgttttgcccaatggacatctatttatttcatctttatatgtgcaatctgctgtacagaggggtgggagggataaaagtctcaagaataggatcacagaaaaaccaaaaagaattgaaagaaaatagctgataaggtccttttgttcattcacagcttaaatattttctacaaacctgtatgacaggtgcagcactagtcattgcagatgcactcttgttctctgagagcctatagcccagagacaggctcaacattaacccagcaatcccatgaggaaggtccaagccccaaaaaggccagttaaattggttctaagggtggcttatcctgcagtttct

SEQ ID NO: 35235 - DNA, 464 bp, Homo sapiens
atttatttatttatttatttagagacatagttttgctcttgttgccccaggctggagtgcaatggcgcgatcttggttcaccacaacctccatctcctgggttcaagcgattctcctgcctcagcctcctgagtagctgggattacaggcatgtgtcaccatgcccagctaattttgtatttttagtagagatggggtttctccataaattttcctattttttgtagagaccggagtctcactctgttgcccaggccggtcttgaactcctggcctcaaaccatcctcccgccgcagcctcccaaagtgctggtattacaggcgtgagccactacacctgaccgaaattttcattttataaggagggacgcttcaggcctggaggaattagctagcctagagacccaggctgtcaatggcaggtgtgggactcatatcccgttctgtgagacttgcaagcatgg

SEQ ID NO: 35236 - DNA, 232 bp, Homo sapiens
tcgggaaaggcagtagtggagatacaaatgcagtgttaggggagtccagaggagggcggcttctgtaaaagtgtccaagccaaagctgagtttcctctaacacatggcatgatgtccctttccatgcttcaatatggactttgggtgacattttggactcttcatattttatcttctcaaactcattttgactccctcatcctaacttagttctcatccaaaaacaaagaaa

SEQ ID NO: 35237 - DNA, 374 bp, Homo sapiens
aacattattaaactcctctaactagggctagctcctcttgctccaggctgtaaaaatatgacctgtgtcctgagctgcttctgttttcaacaggtccttgtcatccattctgagcagaaagggcatgcaaatgactgccccataagacatgtctcaagtgtttcttgctaaaaccagaatattctataggaaagggacgagaaaccgcactgctataacacagatttcttcctaacctggtgtggtcatggtcaccatttattctaagggaactttggcagactcttagagttcacacacacgcacacacacacacagaggagaacaaggcataacatatagaaattagatatactaagaggtacaaagaagaa

SEQ ID NO: 35238 - DNA, 759 bp, Homo sapiens
gcccactactaaggagataagtctgatttcaatcttactgtctacaaaactgcactaaatcttttcactgacattaatagccaaaaggcgagatactttaactctgggtagaattagttcctttagtaacgctggattatggctacgcccaagtgggtttttttattgttattaaaaccaacatgtgcaggaggctaaggcaggagaattgcttgaacctgggaggcagaggttgcagggaccccagatcaagccactgcactccagcctgggaatagagtgagactccatctcaaaacaaaaaaccaagccaaaaaaaaaaaaacccaacatgtgatgagttagtgtatttatgtatttacattgtattttataatcacaacacaatgtctttgtcatagaataataatccttggcagctatttgttccccaacttcataccttttctgtcttttgttgagactcaagtagtgacgtgttttgctactagttatgatgggatagctcctaaattgagttgagtctccattttcaaccctctcaaaaccaaaaaccatatgactcagcatccttcgaaattggtccccagggagtgctactacaatagtgggagggacctaaagacatcacaggaaatatgcagggagaagtgacagatgactaaggaaatccagatattagaggaatgagtaagtataaataagaaactttagccagcacggcaggtcatgcttgtaatcccagcaccttgggaggcc

SEQ ID NO: 35239 - DNA, 362 bp, Homo sapiens
caaagcggacaccaagaaacgccacacccccagaggtcatgctgaaagtacgtctaatagacagctactgtggttgagaggaaaggtgtctttttattgcttctagagacgttgaaagtgtgacctgagcacctcataatcatgtgaaaaagacactcaaaaactaccatttgaatggatggatgaaaataacctccgtatattctacgaagatgtttaataataaataggtttcgttataagagaatgtgtgtcacttcgtctcttccctcacccccgagacttagtgacagttatttttgacttttccaactatactatttgcctagaaaatgtgtctattaaatagcgtattgagaaat

SEQ ID NO: 35240 - DNA, 628 bp, Homo sapiens
gtctcctggggaagcaggccataaacacaaacaaatgaaataatgacagattagggtaaatgctatgaaggaaacatataggaaactgacacagactggaaagaaatgggggctacttgagatagtgtagtcagagattctgaggctatgggaggataaggatgttgcctgggaagagtgggcagggattgttgtttcaggtaacgggagcatactcggtatgggaaggtgtgtggtgtgtttgaggaattgaaagtctactgtgtgttgtaacgtagggcctgtcatcctctgccagttgctgtgatcatgcatcttaatagatttggttctggccagatgtggtggctcacgcctgtattcccagcactttgggaggccaaggcaggtggatcacgaggtcaggagttcgagaccagcctggccaacatagtgaaaccctgtctctactaaaaatacaaaaaatgttagctgggcgtggtggtgggcacctgtagtcccagctacttgggaggttgaggcaggagaaacacttgaacctgggaggtggaggctgtagtgagctgagatcacaccactgtactccagcctgggtgacagagtgagactccatctcaaaaaaaaaaaa

SEQ ID NO: 35241 - DNA, 1191 bp, Homo sapiens
gctaggtaccagccccgctttacaatcggcacgaggggcgaggaggagggagggccgccagtgtcgacatgctgctggaggaggttcgcgccggcgaccggctgagtggggcggcggcccggggcgacgtgcaggaggtgcgccgccttctgcaccgcgagctggtgcatcccgacgccctcaaccgcttcggcaagacggcgctgcaggtcatgatgtttggcagcaccgccatcgccctggagctgctgaagcaaggtgccagccccaatgtccaggacacctccggtaccagtccagtccatgacgcagcccgcactggattcctggacaccctgaaggtcctagtggagcacggggctgatgtcaacgtgcctgatggcaccggggcacttccaatccatctggcagttcaagagggtcacactgctgtggtcagctttctggcagctgaatctgatctccatcgcagggacgccaggggtctcacacccttggagctggcactgcagagaggggctcaggacctcgtggacatcctgcagggccacatggtggccccgctgtgatctggggtcaccctctccagcaagagaaccccgtggggttatgtatcagaagagaggggaagaaacactttctcttcttgtttctcctgcccactgctgcagtaggggaggagcacagtttgtggcttataggtgttggttttgggggtgtgagtgtttgggggacgtttctcatttgtttttctcactccttttggtgtgttggacagagaagggctcctgcaggccacagccacctaaacggttcagtttcttctgcgcctcaggctgctggggcctcagacgagacccaagggcagagcatttaagagtgaagtcatgacctccagggagcctagaagctggtggccttggccggctgtgctcagagacctgaagtgtgcacgttgcttcaggcatggggggtggggggagcgtcccaaatcaataagaaggtagaatgagttatgagttattcatattctgttggaagcttgttttccagtctcttgtacagcgttttaaaagaaatggattctatttattatgctttattggaaaaaatgttgtaataatttaatgtttttacccattaaattaagacttgtgcatgatcaaaaaaaaggtggcttctgatttttga

SEQ ID NO: 35242 - DNA, 1532 bp, Homo sapiens
atcagttgcgttcggggcgtggccgggagcacgttggctccgccccctggcggctgcctcagcggcggcggcggcgcaggctcagagcagaccccgcccggcgaggaggagggagggtgagttagggggagacccggcccccaaggggcgggcgccgggcagggccccgcgggcggccgagggttgggcccggctcccagcccctcgccgtcctccggctgacagggggaggagcccgccgggagggccggggtctcgggctggggagccgggacgggagagcagcgcagccgggtgcaccgcggccgcgccccgggagggctgttcgggccagcgcccgccggctgctccgcgctgacagcgccgggctggggcggggcggggggctttgcaggccgccagtgtcgacatgctgctggaggaggttcgcgccggcgaccggctgagtggggcggcggcccggggcgacgtgcaggaggtgcgccgccttctgcaccgcgagctggtgcatcccgacgccctcaaccgcttcggcaagacggcgctgcaggtcatgatgtttggcagcaccgccatcgccctggagctgctgaagcaaggtgccagccccaatgtccaggacacctccggtaccagtccagtccatgacgcagcccgcactggattcctggacaccctgaaggtcctagtggagcacggggctgatgtcaacgtgcctgatggcaccggggcacttccaatccatctggcagttcaagagggtcacactgctgtggtcagctttctggcagctgaatctgatctccatcgcagggacgccaggggtctcacacccttggagctggcactgcagagaggggctcaggacctcgtggacatcctgcagggccacatggtggccccgctgtgatctggggtcaccctctccagcaagagaaccccgtggggttatgtatcagaagagaggggaagaaacactttctcttcttgtttctcctgcccactgctgcagtaggggaggagcacagtttgtggcttataggtgttggttttgggggtgtgagtgtttgggggacgtttctcatttgtttttctcactccttttggtgtgttggacagagaagggctcctgcaggccacagccacctaaacggttcagtttcttctgcgcctcaggctgctggggcctcagacgagacccaagggcagagcatttaagagtgaagtcatgacctccagggagcctagaagctggtggccttggccggctgtgctcagagacctgaagtgtgcacgttgcttcaggcatggggggtggggggagcgtcccaaatcaataagaaggtagaatgagttatgagttattcatattctgttggaagcttgttttccagtctcttgtacagcgttttaaaagaaatggattctatttattatgctttattggaaaaaatgttgtaataatttaatgtttttacccattaaattaagacttgtgcatgatcaaaaaaaaggtggcttctgatttttga

SEQ ID NO: 35243 - DNA, 1254 bp, Homo sapiens
atcagttgcgttcggggcgtggccgggagcacgttggctccgccccctggcggctgcctcagcggcggcggcggcgcaggctcagagcagaccccgcccggcgaggaggagggagggccgccagtgtcgacatgctgctggaggaggttcgcgccggcgaccggctgagtggggcggcggcccggggcgacgtgcaggaggtgcgccgccttctgcaccgcgagctggtgcatcccgacgccctcaaccgcttcggcaagacggcgctgcaggtcatgatgtttggcagcaccgccatcgccctggagctgctgaagcaaggtgccagccccaatgtccaggacacctccggtaccagtccagtccatgacgcagcccgcactggattcctggacaccctgaaggtcctagtggagcacggggctgatgtcaacgtgcctgatggcaccggggcacttccaatccatctggcagttcaagagggtcacactgctgtggtcagctttctggcagctgaatctgatctccatcgcagggacgccaggggtctcacacccttggagctggcactgcagagaggggctcaggacctcgtggacatcctgcagggccacatggtggccccgctgtgatctggggtcaccctctccagcaagagaaccccgtggggttatgtatcagaagagaggggaagaaacactttctcttcttgtttctcctgcccactgctgcagtaggggaggagcacagtttgtggcttataggtgttggttttgggggtgtgagtgtttgggggacgtttctcatttgtttttctcactccttttggtgtgttggacagagaagggctcctgcaggccacagccacctaaacggttcagtttcttctgcgcctcaggctgctggggcctcagacgagacccaagggcagagcatttaagagtgaagtcatgacctccagggagcctagaagctggtggccttggccggctgtgctcagagacctgaagtgtgcacgttgcttcaggcatggggggtggggggagcgtcccaaatcaataagaaggtagaatgagttatgagttattcatattctgttggaagcttgttttccagtctcttgtacagcgttttaaaagaaatggattctatttattatgctttattggaaaaaatgttgtaataatttaatgtttttacccattaaattaagacttgtgcatgatcaaaaaaaaggtggcttctgatttttga

SEQ ID NO: 35244 - DNA, 427 bp, Homo sapiens
cggccgcgccccgggagggctgttcgggccagcgcccgccggctgctccgcgctgacagcgccgggctggggcggggcggggggctttgcaggccgccagtgtcgacatgctgctggaggaggttcgcgccggcgaccggctgagtggggcggcggcccggggcgacgtgcaggaggtgcgccgccttctgcaccgcgagctggtgcatcccgacgccctcaaccgcttcggcaagacggcgctgcaggtgaggccgggccggtccaggttggggcggggcggctaagcgggatgaggatcgagaccccagagctcctctctggtctcctggccctggtggtgacccactgggaaccggtccttcttctctaggctttcattgttcccccacagtcccccttcgaaggtgggtggtgggtgaggcta

SEQ ID NO: 35245 - DNA, 1363 bp, Homo sapiens
ctcccaggttcaagcaattctcctgcctcagcctcccgagtagctgggattacaggcacctgccaccacgcccagctaattttttgtatttttagtagagacggcatttcaccatgttggccaggctggtctcgaactcctgaccttgtgatttgcctgcctcagcctcccaaagtgttggcattacaggcgtgagctaccgcacccggccaactataaagttattttaaaggatatacaatgaactcttaacagtgatttgatattggggaggaaactgtaaaaatgtcagttctaccaaattctattataaaaacttaatgcacttccaagtaaaatttcagccagaattttttatctttcttggtgggggtgtggtggtggtgaagaggaactaaaaaggagagaaaacaattaaaaaattgaaagattcatatggaaaaagaaatctagcatagtcaaaaattttttgaaaaaaattaaaaccacatagagaggcagggcaaccaagtgagacctcatgtcttaaaaaaaaaaaaaattaatagaaaaaattaggtatggtggcgcatgcctgtaatcccaactgctcaggaggctgaggtgggaggatggcttgagtccaggagtttgaggctgcagtgagccatggtcgctccactgcactccacactgggcaacagagtaagaccctatctttaaaaaaaaaaaaaaaaagtaaaagaaaacacagaaggaacactttccttgctggatttgtaaggttactgttaagcagacactgtgcttgaaaacagagagaattgggggacagtatagagtaagatccagaaatggactcccccacagaggaattcagtgtatcacaatggaggtttttcaactcagtgaaaaagggatattattttaatgatgctatcacactgcctttgcatgagaagaaaattaaattggactgctctgtcatgccatttacaaaaataaatctcatcatgtagaggagttgcttagaagaaaaagaaaaaattcagatgaagtaaaaattaaaatgaaaaaagtaaacgaatttagaaaaactaattacgcagacactcagaagacttttagaaggaaaaggaaaccaagaagttataaggggaaagctaagcatatttgattatgtaatgttttaaaacttgagtgataaaccataaacaaagccaaaaagcaaaacagagattagggtgagtaaccataacagaagtgacagctaagagatgcctatctatgatacacaggtagctcctttacattgacgggaaaataccaatactccagtggaaaaatgagcagagaatatgaataggcaattcacaaaagaaga

SEQ ID NO: 35246 - DNA, 433 bp, Homo sapiens
atatcctcatagtcatctacagagctgagaattagacagatattgttcccattttacagatgagaaggctgagtttcagaagattcatgtaggagaaagaatgtggagttggacctacctgggttcaactcctaactccaacactgacttcagggttttcacacctaaaacagaaaataatttatctggctgtgtctttctgtaaatacagtattttttattttttattttttttgagacagggtctcactgtgtcacatgggttggagtgcagtagcatgctcacagcttactgaaatccttgacccccacctccccaaacttgccaggctcaagcaatcctcctacctcagcttcctgagtaactggtactacaggcacacaccactacacctggctaattaaaaaaaaaaaaaaaaattatagaaatggg

SEQ ID NO: 35247 - DNA, 327 bp, Homo sapiens
cgccctgccttaggaggagggaggagagagaaagagacatacacacacacaaaggctaaaggaagggaaaatgggtgattctgactcaaaaattaagtgaaaacgccaaccctgtcatccccgggatggccagacaaagggaagaggctgcctcacacccacacggtctacccgtgggtaaactggcatttctaatacttttcacctagtcttgacttgacagatgcctaaccttagctactgagtggagacaggctgatgggccttggccatacagggggaaaatttttgatgcttctcacttatgacatgattgattttctttca

SEQ ID NO: 35248 - DNA, 784 bp, Homo sapiens
gatcaagtggagggtagttcagaaaagttaataggaaatctttgtgacagcagactataatagaagtttgagtaatattttaataaatttatataattcaaatgataaaaatgtatcaatgttatccaatgatttttattaaaaaattaccttattattagaactgtgcctattacataaaaagtgctcatgtatttgaattttaaataatttatttaaatcaagaccaccataagtcattaataatttaataattgttttaaatcagtggttttcaaccctcacttcatattagaatcatctgaggacttttaatatggaatccacctcataacaattaagtctaaatttctggaagatggagccatgcttgtttttccaaaagctctttgagtgattctaatttgtagtcagagttgaagaccactgctctaaattagtgcaggaaaatgcttttatttctcccatgttaacttttaaaactagtaatgtacccagttaagtttggatggtttaaattccactaaagaacatattcttctaataactagcatttattacatgaaatttaagagtttaagttccatcaaactagcccttgtgtaagattattatttcttctctataacttcaaaatagatatttcattcaaactgttcaggtgagaaaagataatggattttttttttcctctggagctgcctgttcagtgagatggaggaggtgcacacttaaggtcaattcactaatctatggttcagatttctgatcacatggaagtttg

SEQ ID NO: 35249 - DNA, 783 bp, Homo sapiens
taaattcgcggccgcgtcgacagatgcgtgatttgcccaacatcacacaaacattaaagatatgagtttcttcctttttaactaaaaaaggtaaagtaaaaacaaaaaaagcaaaacttaaaaattcaagtattatcatataaaacctgttctcaaaccaccactcccgccacctgcctttatgccctggacccaggtcctctgactgcttcttggtggcttaggacccaccagagccacactttactcagactaagacttccttctaataacccaggatctatgacaattttgactctcaaccccatcttaaaacttacctgccctatgcttcattccctgagattattgccaaaaaattgattgtgaataagaaaatcaaacactgagatattaataaatgatgatcaaagtataatcctttctattaaagtaagataaaatggagaccagacctgaagaatccttcagagcaggcaaagccaattagacctcacaagtgatcttacctttggtttgtaaacataagtgaaacttaaatagggcattgctttttgttttgttttgttttgtttgtttttttgagacagaatttcactcttgtcacccaggctggagtgcagtggtgcaatctcggctcactgcaacctcctcctcctgggttcaggtgattctcctgcctcagcctcccgagtagctgtgactacaggcatgcaccaccatgcccgacaaattttatatttttagtagagatggggttgcaccatgttggccaggctggtc

SEQ ID NO: 35250 - DNA, 1624 bp, Homo sapiens
ccggggacccacggccccgccccgcggccgggctgggcgggcggcgaccgcggctgaggtacaggtgcctcgcggtgcagccgggtcgccttccagcccgtccgcctcccgaccagggcccgcgccccgtcccgcctctctcccgcccagccaaatgcaggccgccgccctccctgaggagatccgttggctcctggaagatgctgaagagtttctggcagaaggtttgcggaatgagaacctcagcgctgttgcaagggatcacagagaccatattctacggggctttcagcaaatcaaagccaggtactattgggattttcagccccaagggggagacattggacaggacagctctgatgataatcacagcgggactcttggcctgtccctcacatccgatgcaccctttttgtcagattatcaggatgagggaatggaagacatcgtaaaaggagctcaagaacttgataacgtaatcaagcaaggatacttggagaagaaaagcaaagatcatagtttctttggatcggagtggcagaagcgatggtgtgttgtcagcagaggtctcttctactactatgctaatgagaagagcaagcagcccaaagggaccttcctcattaagggctacagtgtacggatggccccccacctgcgaagagattccaagaaagaatcctgctttgaactgacctcccaggataggcgcagctatgagtttacagctactagtccagcagaagccagagactgggtggatcaaataagtttcttgttaaaggatctgagctccttaaccattccatatgaagaggatgaggaggaagaagaaaaagaagagacatatgatgatattgatggttttgactccccaagttgtggttcccagtgcagacccactatcttgcctgggagtgtggggataaaagagcctacagaggagaaagaagaagaagatatttatgaagtcttgccagatgaagagcatgatctagaagaggatgagagtggcactcgacgaaaaggagtagactatgccagttactaccagggcctatgggattgccatggtgaccagccagatgaactgtccttccaacggggtgacctcatccgtattctgagcaaggagtataacatgtatggctggtgggtgggagaactgaacagcctcgttgggattgttccaaaggagtatctcaccactgcctttgaagtggaagaaagatgaaacccaggaaatatattcttccctctctcctgcctttatgaggaaactgatcatcaaaagttcccactccctacttctgccaccccaccaacgccttggactcctctctttgctgaagagacccaagtctcttgacacctcagagtgactgtaagctaccagtaagacaagtgggaagaggcacgttcatcaaacctgttactaaaccagcctagtcatagctcatccccatctctaaatgtgtccacacaaccacatctgccttttccacaagcttttcacaaagaaggtgagagagaaggaaaccttgggaggaggacattactggttgttctggctggtttgaaaagcacaaataaacttgggatgtggttccttgccatgaaaaaa

SEQ ID NO: 35251 - DNA, 1710 bp, Homo sapiens
ccggggacccacggccccgccccgcggccgggctgggcgggcggcgaccgcggctgaggtacaggtgcctcgcggtgcagccgggtcgccttccagcccgtccgcctcccgaccagggcccgcgccccgtcccgcctctctcccgcccagccaaatgcaggccgccgccctccctgaggagatccgttggctcctggaagatgctgaagagtttctggcagaaggtttgcggaatgagaacctcagcgctgttgcaagggatcacagagaccatattctacggggctttcagcaaatcaaagccaggtactattgggattttcagccccaagggggagacattggacaggacagctctgatgataatcacagcgggactcttggcctgtccctcacatccgatgcaccctttttgtcagattatcaggatgagggaatggaagacatcgtaaaaggagctcaagaacttgataacgtaatcaagcaaggatacttggagaagaaaagcaaagatcatagtttctttggatcggagtggcagaagcgatggtgtgttgtcagcagaggtctcttctactactatgctaatgagaagagcaagcagcccaaagggaccttcctcattaagggctacagtgtacggatggccccccacctgcgaagagattccaagaaagaatcctgctttgaactgacctcccaggataggcgcagctatgagtttacagctactagtccagcagaagccagagactgggtggatcaaataagtttcttgttaaaggatctgagctccttaaccattccatatgaagaggatgaggaggaagaagaaaaagaagagacatatgatgatattgatggttttgactccccaagttgtggttcccagtgcagacccactatcttgcctgggagtgtggggataaaagagcctacagaggagaaagaagaagaagatatttatgaagtcttgccagatgaagagcatgatctagaagaggatgagagtggcactcgacgaaaaggagtagactatgccagttactaccagggcctatgggattgccatggtgaccagccagatgaactgtccttccaacggggtgacctcatccgtattctgagcaaggagtataacatgtatggctggtgggtgggagaactgaacagcctcgttgggattgttccaaaggagtatctcaccactgcctttgaagtggaagaaagatgaaacccaggttacctcaaggccaagacagatgctcaatctccagccatcctgtctgcaacctacacagcacagcaggaaagataaaaggagaaggaaatatattcttccctctctcctgcctttatgaggaaactgatcatcaaaagttcccactccctacttctgccaccccaccaacgccttggactcctctctttgctgaagagacccaagtctcttgacacctcagagtgactgtaagctaccagtaagacaagtgggaagaggcacgttcatcaaacctgttactaaaccagcctagtcatagctcatccccatctctaaatgtgtccacacaaccacatctgccttttccacaagcttttcacaaagaaggtgagagagaaggaaaccttgggaggaggacattactggttgttctggctggtttgaaaagcacaaataaacttgggatgtggttccttgccatgaaaaaa

SEQ ID NO: 35252 - DNA, 787 bp, Homo sapiens
ggcacgaggggcaatatcagaaccctggtttccatttgcagcaaaaacatggcgcacctcggaaaaaatagagtccttttaactttgatttctcctctctttgatcagtagactatgccagttactaccagggcctatgggattgccatggtgaccagccagatgaactgtccttccaacggggtgacctcatccgtattctgagcaaggagtataacatgtatggctggtgggtgggagaactgaacagcctcgttgggattgttccaaaggagtatctcaccactgcctttgaagtggaagaaagatgaaacccaggttacctcaaggccaagacagatgctcaatctccagccatcctgtctgcaacctacacagcacagcaggaaagataaaaggagaaggaaatatattcttccctctctcctgcctttatgaggaaactgatcatcaaaagttcccactccctacttctgccaccccaccaacgccttggactcctctctttgctgaagagacccaagtctcttgacacctcagagtgactgtaagctaccagtaagacaagtgggaagaggcacgttcatcaaacctgttactaaaccagcctagtcatagctcatccccatctctaaatgtgtccacacaaccacatctgccttttccacaagcttttcacaaagaaggtgagagagaaggaaaccttgggaggaggacattactggttgttctggctggtttgaaaagcacaaataaacttgggatgtggttccttgccatgaaaaaa

SEQ ID NO: 35253 - DNA, 1700 bp, Homo sapiens
ccggggacccacggccccgccccgcggccgggctgggcgggcggcgaccgcggctgaggtacaggtgcctcgcggtgcagccgggtcgccttccagcccgtccgcctcccgaccagggcccgcgccccgtcccgcctctctcccgcccagccaaatgcaggccgccgccctccctgaggagatccgttggctcctggaagatgctgaagagtttctggcagaaggtttgcggaatgagaacctcagcgctgttgcaagggatcacagagaccatattctacggggctttcagcaaatcaaagccaggtactattgggattttcagccccaagggggagacattggacaggacagctctgatgataatcacagcgggactcttggcctgtccctcacatccgatgcaccctttttgtcagattatcaggatgagggtattttgagaagaatgaataggagagtatagagaaaataggaattatagaagataaagccaacttatccatcagtgaatggaagacatcgtaaaaggagctcaagaacttgataacgtaatcaagcaaggatacttggagaagaaaagcaaagatcatagtttctttggatcggagtggcagaagcgatggtgtgttgtcagcagaggtctcttctactactatgctaatgagaagagcaagcagcccaaagggaccttcctcattaagggctacagtgtacggatggccccccacctgcgaagagattccaagaaagaatcctgctttgaactgacctcccaggataggcgcagctatgagtttacagctactagtccagcagaagccagagactgggtggatcaaataagtttcttgttaaaggatctgagctccttaaccattccatatgaagaggatgaggaggaagaagaaaaagaagagacatatgatgatattgatggttttgactccccaagttgtggttcccagtgcagacccactatcttgcctgggagtgtggggataaaagagcctacagaggagaaagaagaagaagatatttatgaagtcttgccagatgaagagcatgatctagaagaggatgagagtggcactcgacgaaaaggagtagactatgccagttactaccagggcctatgggattgccatggtgaccagccagatgaactgtccttccaacggggtgacctcatccgtattctgagcaaggagtataacatgtatggctggtgggtgggagaactgaacagcctcgttgggattgttccaaaggagtatctcaccactgcctttgaagtggaagaaagatgaaacccaggaaatatattcttccctctctcctgcctttatgaggaaactgatcatcaaaagttcccactccctacttctgccaccccaccaacgccttggactcctctctttgctgaagagacccaagtctcttgacacctcagagtgactgtaagctaccagtaagacaagtgggaagaggcacgttcatcaaacctgttactaaaccagcctagtcatagctcatccccatctctaaatgtgtccacacaaccacatctgccttttccacaagcttttcacaaagaaggtgagagagaaggaaaccttgggaggaggacattactggttgttctggctggtttgaaaagcacaaataaacttgggatgtggttccttgccatgaaaaaa

SEQ ID NO: 35254 - DNA, 427 bp, Homo sapiens
gagactacagggtggacagttcctgccattagggagccctccaggctaatgggaaagggcacaacattgagcagataatgccagcgatacacaaccgtggactgtgtcagctgctagaagagaaggtctaagaggggacccaatgtaggcctggaaggattgactttcaggtggagacctgaagaacaaatataaaggtttgagcagtgaagtaatgaatgagatgttattattattttaccatctaatcaagcatctctgcttacagataaagagactgggatgaaagtaaaatgaaggaccaccactatctggctgccctagaatcagaacccaaaaaggctttttgggataaagaggtcagtctatctaaagctagcaaattgttgggagatactaaggaaatctaaagctgaaatgctattgg

SEQ ID NO: 35255 - DNA, 452 bp, Homo sapiens
aacctagcaatgaggaaagaaatgcatggtgagtgcttcgtatgggcactcatcaaatgagcctttcagagctcaatagaaaaccctatcccagtgaatcttctgttgtgctgaagattgcagctgaagattgttgtcccacacagcacagtgatgttagaattggttgagctcctaatgtggcaagaccccacacatttctagatccacccagaatgaggtaaacccttccaaagaaaaagagaaatatcgaatgctgtattttgagtcttcttactctgtgggattgatagagcaagaattacaagaattcttttgagtctaagacaccactgattttaaattacacttaaagtcataccagtgatttttggagaggaggaaagaaaataccacatttaacaagtatatcaattgttagaagtagcctaatttcaaaaatgttaaaaatg

SEQ ID NO: 35256 - DNA, 804 bp, Homo sapiens
atgcatctcctcttatttcagctgctggtactcctgcctctaggaaagaccacacggcaccaggatggccgccagaatcagagttctctttcccccgtactcctgccaaggaatcaaagagagcttcccacaggcaaccatgaggaagctgaggagaagccagatctgtttgtcgcagtgccacaccttgtagccaccagccctgcaggggaaggccagaggcagagagagaagatgctgtccagatttggcaggttctggaagaagcctgagagagaaatgcatccatccagggactcagatagtgagcccttcccacctgggacccagtccctcatccagccgatagatggaatgaaaatggagaaatctcctcttcgggaagaagccaagaaattctggcaccacttcatgttcagaaaaactccggcttctcagggggtcatcttgcccatcaaaagccatgaagtacattgggagacctgcaggacagtgcccttcagccagactataacccacgaaggctgtgaaaaagtagttgttcagaacaacctttgctttgggaaatgcgggtctgttcattttcctggagccgcgcagcactcccatacctcctgctctcactgtttgcctgccaagttcaccacgatgcacttgccactgaactgcactgaactttcctccgtgatcaaggtggtgatgctggtggaggagtgccagtgcaaggtgaagacggagcatgaagatggacacatcctacatgctggctcccaggattcctttatcccaggagtttcagcttga

SEQ ID NO: 35257 - DNA, 2480 bp, Homo sapiens
taatttaaaccagtgtttgtgcggttctgattcatctgctgtggttcccgaagcttgagatctaaggagtacagggtcttttgtgatgacaatatgactaatagtaaaggaagatctattaccgataaaacaagtggtggtccaagtagtggaggaggttttgtagattggactttacgtttaaacacaattcaatccgacaagtttttaaatttactcttgagtatggttccagtgatttaccagaaaaaccaagaagacaggcacaaaaaagcaaacggcatttggcaagatggattatcaactgcagtacagacttttagtaatagatctgagcaacacatggagtatcacagtttctcagagcagtcttttcatgccaataatgggcacgcatcatcaagctgcagccaaaagtatgatgactatgccaattataattactgtgatggaagggagacttcagaaaccactgccatgttacaagatgaagatatatctagtgatggtgatgaagatgctattgtagaagtgaccccaaaattaccaaaggaatccagtggcatcatggcattgcaaatacttgtgccctttttgctagctggttttggaacagtttcagctggcatggtactggatatagtacagcactgggaggtgttcagaaaagttacagaagttttcattttagtccctgcacttcttggtctcaaagggaacttggaaatgacattggcatccagattatccactgcagtaaatattgggaagatggattcacccattgaaaagtggaacctaataattggcaacttggctttaaagcaggttcaggcaacagtagtgggttttctagcagctgtggcagcaattatattgggctggattccagaaggaaaatattaccttgatcattccatacttctgtgctctagcagtgtggcaactgccttcattgcatctcttctgcagggaataataatggttggggttatcgttggttcaaagaagactggtataaatcctgataatgttgctacacccattgctgctagttttggcgaccttataactcttgccatattggcttggataagtcagggcttatactcctgtcttgagacctattactacatttctccattagttggtgtatttttcttggctctaacccctatttggattataatagctgccaaacatccagccacaagaacagttctccactcaggctgggagcctgtcataacagctatggttataagtagcattgggggccttattctggacacaactgtatcagacccaaacttggttgggattgttgtttacacgccagttattaatggtattggtggtaatttggtggccattcaggctagcaggatttctacctacctccatttacatagcattccaggagaattgcctgatgaacccaaaggttgttactacccatttagaactttctttggtccaggagtaaataataagtctgctcaagttctactgcttttagtgattcctggacatttaattttcctctacactattcatttgatgaaaagtggtcatacttctttaactataatcttcatagtagtgtatttatttggcgctgtgttacaggtatttaccttgctgtggattgctgactggatggtccatcacttctggaggaaaggaaaggacccggatagtttctccatcccctacctaacagcattgggtgatctgctcgggacagctctgttagccttaagttttcattttctttggcttattggagatcgagatggagatgttggagactaataaattctacaaactgctctcaagttaccaaggaagaaaatacacgacaaccacttatggctctttttcaaaactcttaaatcagtagtttgacttttgccagggtaatcttcagttggccctgattcaattaaatggccttaatttttttttaaggaatttgtgtcaaaaccagaatgaagagtattcgtgctgcttttcatagaataaatgataatttgacatagacatagatataagttccagctctgaaattaattaggaaagaatataggatgtttacagtgaataattttaaaaccacaaacatagcagaaatgtactttattattaaatttgtaatgcaggattagaagaagcagagctctagtttagcctttcttgtctcacagatgtgctgtatcccaggcatactataaaacgaagagtgcccaaccaagctttgaatcgtattaacaatgcccacctctatgctagctgaggataaatttaccagttgctcatatttaaactgacctaaatatgttttgctgagcataagataaactcacttttacctccatctaaaattatcctgttctgatgccaattcaatttcagctctgcaagttcttgtcaggctaatctttaaacattgagtgatcttgagagattgttaatgaaag

SEQ ID NO: 35258 - DNA, 919 bp, Homo sapiens
  misc_feature (54)..(56): n is a, c, g, or t
  misc_feature (94)..(94): n is a, c, g, or t
gccaggcagccgccccgccaggggcacagaacccgctctcgtatcttcccccgnnnggtcgggtgttattaacactgactttgggtagtgctgnatggatggtccatcacttctggaggaaaggaaaggacccggatagtttctccatcccctacctaacagcattgggtgatctgctcgggacagctctgttagccttaagttttcattttctttggcttattggagatcgagatggagatgttggagactaataaattctacaaactgctctcaagttaccaaggaagaaaatacacgacaaccacttatggctctttttcaaaactcttaaatcagtagtttgacttttgccagggtaatcttcagttggccctgattcaattaaatggccttaatttttttttaaggaatttgtgtcaaaaccagaatgaagagtattcgtgctgcttttcatagaataaatgataatttgacatagacatagatataagttccagctctgaaattaattaggaaagaatataggatgtttacagtgaataattttaaaaccacaaacatagcagaaatgtactttattattaaatttgtaatgcaggattagaagaagcagagctctagtttagcctttcttgtctcacagatgtgctgtatcccaggcatactataaaacgaagagtgcccaaccaagctttgaatcgtattaacaatgcccacctctatgctagctgaggataaatttaccagttgctcatatttaaactgacctaaatatgttttgctgagcataagataaactcacttttacctccatctaaaattatcctgttctgatgccaattcaatttcagctctgcaagttcttgtcaggctaatctttaaacattgagtgatcttgagagattgttaatgaaag

SEQ ID NO: 35259 - DNA, 942 bp, Homo sapiens
ataggtatgcttgggctccaggccagtgatgcacagaagatgaaatgactgtctgctttattggaggcacagcatgcttgattcctgtgaggtatttaccttgctgtggattgctgactggatggtccatcacttctggaggaaaggaaaggacccggatagtttctccatcccctacctaacagcattgggtgatctgctcgggacagctctgttagccttaagttttcattttctttggcttattggagatcgagatggagatgttggagactaataaattctacaaactgctctcaagttaccaaggaagaaaatacacgacaaccacttatggctctttttcaaaactcttaaatcagtagtttgacttttgccagggtaatcttcagttggccctgattcaattaaatggccttaatttttttttaaggaatttgtgtcaaaaccagaatgaagagtattcgtgctgcttttcatagaataaatgataatttgacatagacatagatataagttccagctctgaaattaattaggaaagaatataggatgtttacagtgaataattttaaaaccacaaacatagcagaaatgtactttattattaaatttgtaatgcaggattagaagaagcagagctctagtttagcctttcttgtctcacagatgtgctgtatcccaggcatactataaaacgaagagtgcccaaccaagctttgaatcgtattaacaatgcccacctctatgctagctgaggataaatttaccagttgctcatatttaaactgacctaaatatgttttgctgagcataagataaactcacttttacctccatctaaaattatcctgttctgatgccaattcaatttcagctctgcaagttcttgtcaggctaatctttaaacattgagtgatcttgagagattgttaatgaaag

SEQ ID NO: 35260 - DNA, 2021 bp, Homo sapiens
  misc_feature (1885)..(1885): n is a, c, g, or t
taatttaaaccagtgtttgtgcggttctgattcatctgctgtggttcccgaagcttgagatctaaggagtacagggtcttttgtgatgacaatatgactaatagtaaaggaagatctattaccgataaaacaagtggtggtccaagtagtggaggaggttttgtagattggactttacgtttaaacacaattcaatccgacaagtttttaaatttactcttgagtatggttccagtgatttaccagaaaaaccaagaagacaggcacaaaaaagcaaacggcatttggcaagatggattatcaactgcagtacagacttttagtaatagatctgagcaacacatggagtatcacagtttctcagagcagtcttttcatgccaataatgggcacgcatcatcaagctgcagccaaaagtatgatgactatgccaattataattactgtgatggaagggagacttcagaaaccactgccatgttacaagatgaagatatatctagtgatggtgatgaagatgctattgtagaagtgaccccaaaattaccaaaggaatccagtggcatcatggcattgcaaatacttgtgccctttttgctagctggttttggaacagtttcagctggcatggtactggatatagtacagcactgggaggtgttcagaaaagttacagaagttttcattttagtccctgcacttcttggtctcaaagggaacttggaaatgacattggcatccagattatccactgcagtaaatattgggaagatggattcacccattgaaaagtggaacctaataattggcaacttggctttaaagcaggttcaggcaacagtagtgggttttctagcagctgtggcagcaattatattgggctggattccagaaggaaaatattaccttgatcattccatacttctgtgctctagcagtgtggcaactgccttcattgcatctcttctgcagggaataataatggttggggttatcgttggttcaaagaagactggtataaatcctgataatgttgctacacccattgctgctagttttggcgaccttataactcttgccatattggcttggataagtcagggcttatactcctgtcttgagacctattactacatttctccattagttggtgtatttttcttggctctaacccctatttggattataatagctgccaaacatccagccacaagaacagttctccactcaggctgggagcctgtcataacagctatggttataagtagcattgggggccttattctggacacaactgtatcagacccaaacttggttgggattgttgtttacacgccagttattaatgatgacatgaggaaatgaagatgcacgtgttctggcaaggcagcttctattcctgggcagctctctgccatgcggagttacaagcacacacacaggcgttagctggtcccaactaagacatgaactgaaatggtacagcaatgggatgaagatggtttctgcacctgtgagctggaagtcatcacctgttccactgtggcagttggcctggtcgtcatcacattcatccaccaagttcccgttgggagtggtcggtccagctgtaggggctgaaacaagatccaaggattattatctcacaccttggaaatgtattctcaagcctctggctgttggatctgataacgcttatgcacaaaactttaatctgcggtaagaagaccacgggcatggcttgcctctctttcaggagctggatttacatggattctgcacaatatataatagcagaggctgctttcctttggtatcagatctccatctgcccactacaccggactgccttaccctcctatacatggccatctacataaacatncttcctgtgaaaacacccacaacccccggtctctccctggccatcagagaaggaagccaccccgcgcttctcttttattgagggttacgctcatcacctcaataaccccctagttgaaattggtcaggactgcacg

SEQ ID NO: 35261 - DNA, 2042 bp, Homo sapiens
taatttaaaccagtgtttgtgcggttctgattcatctgctgtggttcccgaagcttgagatctaaggagtacagggtcttttgtgatgacaatatgactaatagtaaaggaagatctattaccgataaaacaagtggtggtccaagtagtggaggaggttttgtagattggactttacgtttaaacacaattcaatccgacaagtttttaaatttactcttgagtatggttccagtgatttaccagaaaaaccaagaagacaggcacaaaaaagcaaacggcatttggcaagatggattatcaactgcagtacagacttttagtaatagatctgagcaacacatggagtatcacagtttctcagagcagtcttttcatgccaataatgggcacgcatcatcaagctgcagccaaaagtatgatgactatgccaattataattactgtgatggaagggagacttcagaaaccactgccatgttacaagatgaagatatatctagtgatggtgatgaagatgctattgtagaagtgaccccaaaattaccaaaggaatccagtggcatcatggcattgcaaatacttgtgccctttttgctagctggttttggaacagtttcagctggcatggtactggatatagtacagcactgggaggtgttcagaaaagttacagaagttttcattttagtccctgcacttcttggtctcaaagggaacttggaaatgacattggcatccagattatccactgcagtaaatattgggaagatggattcacccattgaaaagtggaacctaataattggcaacttggctttaaagcaggttcaggcaacagtagtgggttttctagcagctgtggcagcaattatattgggctggattccagaaggaaaatattaccttgatcattccatacttctgtgctctagcagtgtggcaactgccttcattgcatctcttctgcagggaataataatggttggggttatcgttggttcaaagaagactggtataaatcctgataatgttgctacacccattgctgctagttttggcgaccttataactcttgccatattggcttggataagtcagggcttatactcctgtcttgagacctattactacatttctccattagttggtgtatttttcttggctctaacccctatttggattataatagctgccaaacatccagccacaagaacagttctccactcaggctgggagcctgtcataacagctatggttataagtagcattgggggccttattctggacacaactgtatcagacccaaacttggttgggattgttgtttacacgccagttattaatggtattggtggtaatttggtggccattcaggctagcaggatttctacctacctccatttacatagcattccaggagaattgcctgatgaacccaaaggttgttactacccatttagaactttctttggtccaggagtaaataataagtctgctcaagttctactgcttttagtgattcctggacatttaattttcctctacactattcatttgatgaaaagtggtcatacttctttaactataatcttcatagtagtgtatttatttggcgctgtgttacaggtatttaccttgctgtggattgctgactggatggtccatcacttctggaggaaaggaaaggacccggatagtttctccatcccctacctaacagcattgggtgatctgctcgggacagctctgttagccttaagttttcattttctttggcttattggagatcgagatggagatgttggagactaataaattctacaaactgctctcaagttaccaaggaagaaaatacacgacaaccacttatggctctttttcaaaactcttaaatcagtagtttgacttttgccagggtaatcttcagttggccctgattcaattaaatggccttaatttttttttaaggaatttgtgtcaaaaccagaatgaagagtattcgtgctgcttttcatagaataaatgataatttgacatag

SEQ ID NO: 35262 - DNA, 960 bp, Homo sapiens
taatttaaaccagtgtttgtgcggttctgattcatctgctgtggttcccgaagcttgagatctaaggagtacagggtcttttgtgatgacaatatgactaatagtaaaggaagatctattaccgataaaacaagtggtggtccaagtagtggaggaggttttgtagattggactttacgtttaaacacaattcaatccgacaagtttttaaatttactcttgagtatggttccagtgatttaccagaaaaaccaagaagacaggcacaaaaaagcaaacggcatttggcaagatggattatcaactgcagtacagacttttagtaatagatctgagcaacacatggagtatcacagtttctcagagcagtcttttcatgccaataatgggcacgcatcatcaagctgcagccaaaagtatgatgactatgccaattataattactgtgatggaagggagacttcagaaaccactgccatgttacaagatgaagatatatctagtgatggtgatgaagatgctattgtagaagtgaccccaaaattaccaaaggaatccagtggcatcatggcattgcaaatacttgtgccctttttgctagctggttttggaacagtttcagctggcatggtactggatatagtacaggtaaatattgggaagatggattcacccattgaaaagtggaacctaataattggcaacttggctttaaagcaggttcaggcaacagtagtgggttttctagcagctgtggcagcaattatattgggctggattccagaaggaaaatattaccttgatcattccatacttctgtgctctagcagtgtggcaactgccttcattgcatctcttctgcaggaattaaggtggggttatcgtggtcaagagacgtataatctgatagtgctaaccatgtgtattgggactatatctgcaatggtggtagcagcttac

SEQ ID NO: 35263 - DNA, 1220 bp, Homo sapiens
cggacgcgtgggccggcacacgatctcggtgagagtaaaggctgctccctactggctggacgaacccaagaaccttattctggctcctggcgaggatgggagactggtgtgtcgagccaatggaaaccccaaacccactgtccagtggatggtgaatggggaacctttgcaatcggcaccacctaacccaaaccgtgaggtggccggagacaccatcatcttccgggacacccagatcagcagcagggctgtgtaccagtgcaacacctccaacgagcatggctacctgctggccaacgcctttgtcagtgtgctggatgtgccgcctcggatgctgtcgccccggaaccagctcattcgagtgattctttacaaccggacgcggctggactgccctttctttgggtctcccatccccacactgcgatggtttaagaatgggcaaggaagcaacctggatggtggcaactaccatgtttatgagaacggcagtctggaaattaagatgatccgcaaagaggaccagggcatctacacctgtgtcgccaccaacatcctgggcaaagctgaaaaccaagtccgcctggaggtcaaagaccccaccaggatctaccggatgcccgaggaccaggtggccagaaggggcaccacggtgcagctggagtgtcgggtgaagcacgacccctccctgaaactcaccgtctcctggctgaaggatgacgagccgctctatattggaaacaggatgaagaaggaagacgactccctgaccatctttggggtggcagagcgggaccagggcagttacacgtgtgtcgccagcaccgagctagaccaagacctggccaaggcctacctcaccgtgctaggtaactgcccatgctcaccctggcactgaccagccccaccccctccccagcagccagagaagcagtggcccggggcagttccgagggcagtgcctgcagtcaagtggccgggtcaggcgtggtgatctcttcttgcctcgtgatgtcagggttagggagctgccagtttcagaacaagctgtgctggacaggttacctcctgagtggagtcattaacttccccacgtctcaactgaaaggggcctgagtgatatagagaaagtggagaggggtttctcgttgtgatcattttacctttcttacagctaactccaccactaagtcaattaaaacaatccatccttaaagcaa

SEQ ID NO: 35264 - DNA, 6120 bp, Homo sapiens
  misc_feature (4217)..(4217): n is a, c, g, or t
acgcgcacgggctggtctctgccctaatgcggcggctggcggcgagaggcgctgcaggggacgcgggggaagtggcggcgccggcagcggacagctcggacagcgcccagggccggagcccgagcccttggaggttgattgacttatgtgcaatttgggacgctggagtttaccttccctccgcagcctggaacagagcctcctctggtgttgcaaggaagaggctgaatgaggcagagaagctgagtgctgtccaggaggcccagttaaagcggctcgaggtgacaagaccccgagtgctggggagcagggagcagggccaggtgccgaggatggccaggcagccaccgccgccctgggtccatgcagccttcctcctctgcctcctcagtcttggcggagccatcgaaattcctatggatccaagcattcagaatgagctgacgcagccgccaaccatcaccaagcagtcagcgaaggatcacatcgtggacccccgtgataacatcctgattgagtgtgaagcaaaagggaaccctgcccccagcttccactggacacgaaacagcagattcttcaacatcgccaaggacccccgggtgtccatgaggaggaggtctgggaccctggtgattgacttccgcagtggcgggcggccggaggaatatgagggggaatatcagtgcttcgcccgcaacaaatttggcacggccctgtccaataggatccgcctgcaggtgtctaaatctcctctgtggcccaaggaaaacctagaccctgtcgtggtccaagagggcgctcctttgacgctccagtgcaaccccccgcctggacttccatccccggtcatcttctggatgagcagctccatggagcccatcacccaagacaaacgtgtctctcagggccataacggagacctatacttctccaacgtgatgctgcaggacatgcagaccgactacagttgtaacgcccgcttccacttcacccacaccatccagcagaagaaccctttcaccctcaaggtcctcaccacccgaggagttgcagaaagaacaccaagcttcatgtatccccagggcaccgcgagcagccagatggtgcttcgtggcatggacctcctgctggaatgcatcgcctccggggtcccaacaccagacatcgcatggtacaagaaaggtggggacctcccatctgataaggccaagtttgagaactttaataaggccctgcgtatcacaaatgtctctgaggaagactccggggagtatttctgcctggcctccaacaagatgggcagcatccggcacacgatctcggtgagagtaaaggctgctccctactggctggacgaacccaagaaccttattctggctcctggcgaggatgggagactggtgtgtcgagccaatggaaaccccaaacccactgtccagtggatggtgaatggggaacctttgcaatcggcaccacctaacccaaaccgtgaggtggccggagacaccatcatcttccgggacacccagatcagcagcagggctgtgtaccagtgcaacacctccaacgagcatggctacctgctggccaacgcctttgtcagtgtgctggatgtgccgcctcggatgctgtcgccccggaaccagctcattcgagtgattctttacaaccggacgcggctggactgccctttctttgggtctcccatccccacactgcgatggtttaagaatgggcaaggaagcaacctggatggtggcaactaccatgtttatgagaacggcagtctggaaattaagatgatccgcaaagaggaccagggcatctacacctgtgtcgccaccaacatcctgggcaaagctgaaaaccaagtccgcctggaggtcaaagaccccaccaggatctaccggatgcccgaggaccaggtggccagaaggggcaccacggtgcagctggagtgtcgggtgaagcacgacccctccctgaaactcaccgtctcctggctgaaggatgacgagccgctctatattggaaacaggatgaagaaggaagacgactccctgaccatctttggggtggcagagcgggaccagggcagttacacgtgtgtcgccagcaccgagctagaccaagacctggccaaggcctacctcaccgtgctagctgatcaggccactccaactaaccgtttggctgccctgcccaaaggacggccagaccggccccgggacctggagctgaccgacctggccgagaggagcgtgcggctgacctggatccccggggatgctaacaacagccccatcacagactacgtcgtccagtttgaagaagaccagttccaacctggggtctggcatgaccattccaagtaccccggcagcgttaactcagccgtcctccggctgtccccgtatgtcaactaccagttccgtgtcattgccatcaacgaggttgggagcagccaccccagcctcccatccgagcgctaccgaaccagtggagcaccccccgagtccaatcctggtgacgtgaagggagaggggaccagaaagaacaacatggagatcacgtggacgcccatgaatgccacctcggcctttggccccaacctgcgctacattgtcaagtggaggcggagagagactcgagaggcctggaacaacgtcacagtgtggggctctcgctacgtggtggggcagaccccagtctacgtgccctatgagatccgagtccaggctgaaaatgacttcgggaagggccctgagccagagtccgtcatcggttactccggagaagatttacccagtgcccctaggcgtttccgagtccggcagcccaacctggagacaatcaacctggaatgggatcatcctgagcatccaaatgggatcatgattggatacactctcaaatatgtggcctttaacgggaccaaagtaggaaagcagatagtggaaaacttctctcccaatcagaccaagttcacggtgcaaagaacggaccccgtgtcacgctaccgctttaccctcagcgccaggacgcaggtgggctctggggaagccgtcacagaggagtcaccagcacccccgaatgaagcttacaccaacaaccaagcggacatcgccacccagggctggttcattgggcttatgtgcgccatcgccctcctggtgctgatcctgctcatcgtctgtttcatcaagaggagtcgcggcggcaagtacccagtacgagaaaagaaggatgttccccttggccctgaagaccccaaggaagaggatggctcatttgactatagtgatgaggacaacaagcccctgcagggcagtcagacatctctggacggcaccatcaagcagcaggagagtgacgacagcctggtggactatggcgagggtggcgagggtcagttcaatgaagacggctccttcatcggccagtacacggtcaaaaaggacaaggaggaaacagagggcaacgaaagctcagaggccacgtcacctgtcaatgctatctactctctggcctaacggagcccacccaggcacagccaccactttgcaagtgggaggaggggagaaggggagacaaaaccactgcagacctaccacgaagccaccaccaccttcagtaacaagggtacgatatgggggtctgccaagctgtgaggaccagtagccaccaagccacccacaagccccctcccaatgaccccccttcagccccgggtgccaccagtgtgggagagctggagccgtggctgagctcagctggagggagcctggccccttgcccggtctcgcagccaccccgagcgttccaccacactgtccgcccttggcctcggcacacgctcaccttttctgttggttacgggacttctcattgtcttaatttcgctttgtgcatcttcccctccagacccaatgtctctgttttcttttccttttgaaaaagagtccctggaaaagaaagaataagtggattctcccccaggagaatcctttttgcaaagataggcaaaaaggattgaatccataccagaacacgtagacaggctgtaatattcaaaccacctctgggccaatgcatttccaaaggatgcctttctcgccatatgcctcccctggcccccagcccctctgcctcggccttgtcagttgctgagctgggcttggctcctttctggaaaatgacagtatttttggcagggngaaggtgcgcaggcctccttgctgctctctggtttggttgggaggtgtgtttacctcttgctcctcattcctcccctgcccttttctctggaatatctaagatgtgagctgcattgactctgaagacgtttgaggaacaggagtgggcactgatagaaaggacttcaacgccagtgactgtgtacctccagcagaagaaaatcaggtgtctggtcttgggggcactgtgctcacctctagagagaagaaaaaggctgggtttggacttcatgcctcctcactggtgaaacccaggatgtagatagagggccacacccaccctgtccagagtagagggcacctgtccacgtggccagggcccattgctgccaccctcgaggagatggaaccctgtgatgcaaaagctttgctggtgtgtttggggcataaggcactgctccccttccatctctagcagatatcatcttctcagccaattctgtaggacactgaggctcttgtttgacatggtgtgtggatggggacttgccccaagactgagcaggtctgccctttcattggggtgtatacatatcaggggaccctgaggtggcaccgtactcagtgttgtgatgcccccacctagggaggactcaatgctctttgtatgccttatgcagcgctgatctgtccctggagttcccaggttcccagctccccccctgcaagccttgaagcctccagcaacgtctatctccaggagagcagggcagcctatgcaagtgttccggcaggaccagaagtggccactcaacacacgtcctcaccagtcaccccaaatggagacactcgcagacctgcagttctcagaccgaaggtgctgccttcatcctccccacctaatgcatttttgaaaccaaaggtacctagcctcagagacagagaaggagagggggagatcttgagtctaagaggaaccctttagctgtttctgcagctgaggtcagtttcaggagggtgaagctgatccccaggaatggatcagctgccatgggcacagcctccgatttgagcctctccggctgccagccagggggcctgggccagaccagggctctgtccttccgtgactttattaaagcaacatttgccacatgtttaagccgcaaaggtattagcaatgcttgcatcattaataatcattcagttgaaggtcaagcccatagacacacactctctgctggtaagaaaccatagcccagaactgagccaataaggttgtttgaacctgagagtgtgtaatggtcatttgggccaagcctcagctagggctgctgcctggacgcctgaggggcagcttatcacagtgcaaggggacagggtaaacagcagggggtggggtgtgagcttggagggcccctcccctggatttcctccaacacctgcttggatactaggcccactgtccctgaagggaatgtcagggaagtgtgcctgtgagctgaattaaaggactggcctttccagaaaacgctttggatctgagcagagtagtcagtttctcagacactcattccatactgcaccgtacatgccagcgtacccattgcaccgaaagcaggcccttagggcaggaagggacgatgagcaagtctgccacaccacctggtgactgggaagggctgcttctctcgtaagggtcttggggagaagtaagcccgcagcctgcctctgcacctcgttccagtgtcctgccaggctctgtactgtcctttgtgtatgaagaaaatgctgttagccctctctcaggctgctgttctgtgggtgctgagagctgccccccatcaccacgcaatcacacccctctgagcagaagcaaatctgaggctgaagaattaagttttccccaagcaaggaaggcagg

SEQ ID NO: 35265 - DNA, 6011 bp, Homo sapiens
  misc_feature (4108)..(4108): n is a, c, g, or t
acgcgcacgggctggtctctgccctaatgcggcggctggcggcgagaggcgctgcaggggacgcgggggaagtggcggcgccggcagcggacagctcggacagcgcccagggccggagcccgagcccttggagctgagtgctgtccaggaggcccagttaaagcggctcgaggtgacaagaccccgagtgctggggagcagggagcagggccaggtgccgaggatggccaggcagccaccgccgccctgggtccatgcagccttcctcctctgcctcctcagtcttggcggagccatcgaaattcctatggatccaagcattcagaatgagctgacgcagccgccaaccatcaccaagcagtcagcgaaggatcacatcgtggacccccgtgataacatcctgattgagtgtgaagcaaaagggaaccctgcccccagcttccactggacacgaaacagcagattcttcaacatcgccaaggacccccgggtgtccatgaggaggaggtctgggaccctggtgattgacttccgcagtggcgggcggccggaggaatatgagggggaatatcagtgcttcgcccgcaacaaatttggcacggccctgtccaataggatccgcctgcaggtgtctaaatctcctctgtggcccaaggaaaacctagaccctgtcgtggtccaagagggcgctcctttgacgctccagtgcaaccccccgcctggacttccatccccggtcatcttctggatgagcagctccatggagcccatcacccaagacaaacgtgtctctcagggccataacggagacctatacttctccaacgtgatgctgcaggacatgcagaccgactacagttgtaacgcccgcttccacttcacccacaccatccagcagaagaaccctttcaccctcaaggtcctcaccacccgaggagttgcagaaagaacaccaagcttcatgtatccccagggcaccgcgagcagccagatggtgcttcgtggcatggacctcctgctggaatgcatcgcctccggggtcccaacaccagacatcgcatggtacaagaaaggtggggacctcccatctgataaggccaagtttgagaactttaataaggccctgcgtatcacaaatgtctctgaggaagactccggggagtatttctgcctggcctccaacaagatgggcagcatccggcacacgatctcggtgagagtaaaggctgctccctactggctggacgaacccaagaaccttattctggctcctggcgaggatgggagactggtgtgtcgagccaatggaaaccccaaacccactgtccagtggatggtgaatggggaacctttgcaatcggcaccacctaacccaaaccgtgaggtggccggagacaccatcatcttccgggacacccagatcagcagcagggctgtgtaccagtgcaacacctccaacgagcatggctacctgctggccaacgcctttgtcagtgtgctggatgtgccgcctcggatgctgtcgccccggaaccagctcattcgagtgattctttacaaccggacgcggctggactgccctttctttgggtctcccatccccacactgcgatggtttaagaatgggcaaggaagcaacctggatggtggcaactaccatgtttatgagaacggcagtctggaaattaagatgatccgcaaagaggaccagggcatctacacctgtgtcgccaccaacatcctgggcaaagctgaaaaccaagtccgcctggaggtcaaagaccccaccaggatctaccggatgcccgaggaccaggtggccagaaggggcaccacggtgcagctggagtgtcgggtgaagcacgacccctccctgaaactcaccgtctcctggctgaaggatgacgagccgctctatattggaaacaggatgaagaaggaagacgactccctgaccatctttggggtggcagagcgggaccagggcagttacacgtgtgtcgccagcaccgagctagaccaagacctggccaaggcctacctcaccgtgctagctgatcaggccactccaactaaccgtttggctgccctgcccaaaggacggccagaccggccccgggacctggagctgaccgacctggccgagaggagcgtgcggctgacctggatccccggggatgctaacaacagccccatcacagactacgtcgtccagtttgaagaagaccagttccaacctggggtctggcatgaccattccaagtaccccggcagcgttaactcagccgtcctccggctgtccccgtatgtcaactaccagttccgtgtcattgccatcaacgaggttgggagcagccaccccagcctcccatccgagcgctaccgaaccagtggagcaccccccgagtccaatcctggtgacgtgaagggagaggggaccagaaagaacaacatggagatcacgtggacgcccatgaatgccacctcggcctttggccccaacctgcgctacattgtcaagtggaggcggagagagactcgagaggcctggaacaacgtcacagtgtggggctctcgctacgtggtggggcagaccccagtctacgtgccctatgagatccgagtccaggctgaaaatgacttcgggaagggccctgagccagagtccgtcatcggttactccggagaagatttacccagtgcccctaggcgtttccgagtccggcagcccaacctggagacaatcaacctggaatgggatcatcctgagcatccaaatgggatcatgattggatacactctcaaatatgtggcctttaacgggaccaaagtaggaaagcagatagtggaaaacttctctcccaatcagaccaagttcacggtgcaaagaacggaccccgtgtcacgctaccgctttaccctcagcgccaggacgcaggtgggctctggggaagccgtcacagaggagtcaccagcacccccgaatgaagcttacaccaacaaccaagcggacatcgccacccagggctggttcattgggcttatgtgcgccatcgccctcctggtgctgatcctgctcatcgtctgtttcatcaagaggagtcgcggcggcaagtacccagtacgagaaaagaaggatgttccccttggccctgaagaccccaaggaagaggatggctcatttgactatagtgatgaggacaacaagcccctgcagggcagtcagacatctctggacggcaccatcaagcagcaggagagtgacgacagcctggtggactatggcgagggtggcgagggtcagttcaatgaagacggctccttcatcggccagtacacggtcaaaaaggacaaggaggaaacagagggcaacgaaagctcagaggccacgtcacctgtcaatgctatctactctctggcctaacggagcccacccaggcacagccaccactttgcaagtgggaggaggggagaaggggagacaaaaccactgcagacctaccacgaagccaccaccaccttcagtaacaagggtacgatatgggggtctgccaagctgtgaggaccagtagccaccaagccacccacaagccccctcccaatgaccccccttcagccccgggtgccaccagtgtgggagagctggagccgtggctgagctcagctggagggagcctggccccttgcccggtctcgcagccaccccgagcgttccaccacactgtccgcccttggcctcggcacacgctcaccttttctgttggttacgggacttctcattgtcttaatttcgctttgtgcatcttcccctccagacccaatgtctctgttttcttttccttttgaaaaagagtccctggaaaagaaagaataagtggattctcccccaggagaatcctttttgcaaagataggcaaaaaggattgaatccataccagaacacgtagacaggctgtaatattcaaaccacctctgggccaatgcatttccaaaggatgcctttctcgccatatgcctcccctggcccccagcccctctgcctcggccttgtcagttgctgagctgggcttggctcctttctggaaaatgacagtatttttggcagggngaaggtgcgcaggcctccttgctgctctctggtttggttgggaggtgtgtttacctcttgctcctcattcctcccctgcccttttctctggaatatctaagatgtgagctgcattgactctgaagacgtttgaggaacaggagtgggcactgatagaaaggacttcaacgccagtgactgtgtacctccagcagaagaaaatcaggtgtctggtcttgggggcactgtgctcacctctagagagaagaaaaaggctgggtttggacttcatgcctcctcactggtgaaacccaggatgtagatagagggccacacccaccctgtccagagtagagggcacctgtccacgtggccagggcccattgctgccaccctcgaggagatggaaccctgtgatgcaaaagctttgctggtgtgtttggggcataaggcactgctccccttccatctctagcagatatcatcttctcagccaattctgtaggacactgaggctcttgtttgacatggtgtgtggatggggacttgccccaagactgagcaggtctgccctttcattggggtgtatacatatcaggggaccctgaggtggcaccgtactcagtgttgtgatgcccccacctagggaggactcaatgctctttgtatgccttatgcagcgctgatctgtccctggagttcccaggttcccagctccccccctgcaagccttgaagcctccagcaacgtctatctccaggagagcagggcagcctatgcaagtgttccggcaggaccagaagtggccactcaacacacgtcctcaccagtcaccccaaatggagacactcgcagacctgcagttctcagaccgaaggtgctgccttcatcctccccacctaatgcatttttgaaaccaaaggtacctagcctcagagacagagaaggagagggggagatcttgagtctaagaggaaccctttagctgtttctgcagctgaggtcagtttcaggagggtgaagctgatccccaggaatggatcagctgccatgggcacagcctccgatttgagcctctccggctgccagccagggggcctgggccagaccagggctctgtccttccgtgactttattaaagcaacatttgccacatgtttaagccgcaaaggtattagcaatgcttgcatcattaataatcattcagttgaaggtcaagcccatagacacacactctctgctggtaagaaaccatagcccagaactgagccaataaggttgtttgaacctgagagtgtgtaatggtcatttgggccaagcctcagctagggctgctgcctggacgcctgaggggcagcttatcacagtgcaaggggacagggtaaacagcagggggtggggtgtgagcttggagggcccctcccctggatttcctccaacacctgcttggatactaggcccactgtccctgaagggaatgtcagggaagtgtgcctgtgagctgaattaaaggactggcctttccagaaaacgctttggatctgagcagagtagtcagtttctcagacactcattccatactgcaccgtacatgccagcgtacccattgcaccgaaagcaggcccttagggcaggaagggacgatgagcaagtctgccacaccacctggtgactgggaagggctgcttctctcgtaagggtcttggggagaagtaagcccgcagcctgcctctgcacctcgttccagtgtcctgccaggctctgtactgtcctttgtgtatgaagaaaatgctgttagccctctctcaggctgctgttctgtgggtgctgagagctgccccccatcaccacgcaatcacacccctctgagcagaagcaaatctgaggctgaagaattaagttttccccaagcaaggaaggcagg

SEQ ID NO: 35266 - DNA, 6102 bp, Homo sapiens
  misc_feature (4199)..(4199): n is a, c, g, or t
acgcgcacgggctggtctctgccctaatgcggcggctggcggcgagaggcgctgcaggggacgcgggggaagtggcggcgccggcagcggacagctcggacagcgcccagggccggagcccgagcccttggaggttgattgacttatgtgcaatttgggacgctggagtttaccttccctccgcagcctggaacagagcctcctctggtgttgcaaggaagaggctgaatgaggcagagaagctgagtgctgtccaggaggcccagttaaagcggctcgaggtgacaagaccccgagtgctggggagcagggagcagggccaggtgccgaggatggccaggcagccaccgccgccctgggtccatgcagccttcctcctctgcctcctcagtcttggcggagccatcgaaattcctatggatctgacgcagccgccaaccatcaccaagcagtcagcgaaggatcacatcgtggacccccgtgataacatcctgattgagtgtgaagcaaaagggaaccctgcccccagcttccactggacacgaaacagcagattcttcaacatcgccaaggacccccgggtgtccatgaggaggaggtctgggaccctggtgattgacttccgcagtggcgggcggccggaggaatatgagggggaatatcagtgcttcgcccgcaacaaatttggcacggccctgtccaataggatccgcctgcaggtgtctaaatctcctctgtggcccaaggaaaacctagaccctgtcgtggtccaagagggcgctcctttgacgctccagtgcaaccccccgcctggacttccatccccggtcatcttctggatgagcagctccatggagcccatcacccaagacaaacgtgtctctcagggccataacggagacctatacttctccaacgtgatgctgcaggacatgcagaccgactacagttgtaacgcccgcttccacttcacccacaccatccagcagaagaaccctttcaccctcaaggtcctcaccacccgaggagttgcagaaagaacaccaagcttcatgtatccccagggcaccgcgagcagccagatggtgcttcgtggcatggacctcctgctggaatgcatcgcctccggggtcccaacaccagacatcgcatggtacaagaaaggtggggacctcccatctgataaggccaagtttgagaactttaataaggccctgcgtatcacaaatgtctctgaggaagactccggggagtatttctgcctggcctccaacaagatgggcagcatccggcacacgatctcggtgagagtaaaggctgctccctactggctggacgaacccaagaaccttattctggctcctggcgaggatgggagactggtgtgtcgagccaatggaaaccccaaacccactgtccagtggatggtgaatggggaacctttgcaatcggcaccacctaacccaaaccgtgaggtggccggagacaccatcatcttccgggacacccagatcagcagcagggctgtgtaccagtgcaacacctccaacgagcatggctacctgctggccaacgcctttgtcagtgtgctggatgtgccgcctcggatgctgtcgccccggaaccagctcattcgagtgattctttacaaccggacgcggctggactgccctttctttgggtctcccatccccacactgcgatggtttaagaatgggcaaggaagcaacctggatggtggcaactaccatgtttatgagaacggcagtctggaaattaagatgatccgcaaagaggaccagggcatctacacctgtgtcgccaccaacatcctgggcaaagctgaaaaccaagtccgcctggaggtcaaagaccccaccaggatctaccggatgcccgaggaccaggtggccagaaggggcaccacggtgcagctggagtgtcgggtgaagcacgacccctccctgaaactcaccgtctcctggctgaaggatgacgagccgctctatattggaaacaggatgaagaaggaagacgactccctgaccatctttggggtggcagagcgggaccagggcagttacacgtgtgtcgccagcaccgagctagaccaagacctggccaaggcctacctcaccgtgctagctgatcaggccactccaactaaccgtttggctgccctgcccaaaggacggccagaccggccccgggacctggagctgaccgacctggccgagaggagcgtgcggctgacctggatccccggggatgctaacaacagccccatcacagactacgtcgtccagtttgaagaagaccagttccaacctggggtctggcatgaccattccaagtaccccggcagcgttaactcagccgtcctccggctgtccccgtatgtcaactaccagttccgtgtcattgccatcaacgaggttgggagcagccaccccagcctcccatccgagcgctaccgaaccagtggagcaccccccgagtccaatcctggtgacgtgaagggagaggggaccagaaagaacaacatggagatcacgtggacgcccatgaatgccacctcggcctttggccccaacctgcgctacattgtcaagtggaggcggagagagactcgagaggcctggaacaacgtcacagtgtggggctctcgctacgtggtggggcagaccccagtctacgtgccctatgagatccgagtccaggctgaaaatgacttcgggaagggccctgagccagagtccgtcatcggttactccggagaagatttacccagtgcccctaggcgtttccgagtccggcagcccaacctggagacaatcaacctggaatgggatcatcctgagcatccaaatgggatcatgattggatacactctcaaatatgtggcctttaacgggaccaaagtaggaaagcagatagtggaaaacttctctcccaatcagaccaagttcacggtgcaaagaacggaccccgtgtcacgctaccgctttaccctcagcgccaggacgcaggtgggctctggggaagccgtcacagaggagtcaccagcacccccgaatgaagcttacaccaacaaccaagcggacatcgccacccagggctggttcattgggcttatgtgcgccatcgccctcctggtgctgatcctgctcatcgtctgtttcatcaagaggagtcgcggcggcaagtacccagtacgagaaaagaaggatgttccccttggccctgaagaccccaaggaagaggatggctcatttgactatagtgatgaggacaacaagcccctgcagggcagtcagacatctctggacggcaccatcaagcagcaggagagtgacgacagcctggtggactatggcgagggtggcgagggtcagttcaatgaagacggctccttcatcggccagtacacggtcaaaaaggacaaggaggaaacagagggcaacgaaagctcagaggccacgtcacctgtcaatgctatctactctctggcctaacggagcccacccaggcacagccaccactttgcaagtgggaggaggggagaaggggagacaaaaccactgcagacctaccacgaagccaccaccaccttcagtaacaagggtacgatatgggggtctgccaagctgtgaggaccagtagccaccaagccacccacaagccccctcccaatgaccccccttcagccccgggtgccaccagtgtgggagagctggagccgtggctgagctcagctggagggagcctggccccttgcccggtctcgcagccaccccgagcgttccaccacactgtccgcccttggcctcggcacacgctcaccttttctgttggttacgggacttctcattgtcttaatttcgctttgtgcatcttcccctccagacccaatgtctctgttttcttttccttttgaaaaagagtccctggaaaagaaagaataagtggattctcccccaggagaatcctttttgcaaagataggcaaaaaggattgaatccataccagaacacgtagacaggctgtaatattcaaaccacctctgggccaatgcatttccaaaggatgcctttctcgccatatgcctcccctggcccccagcccctctgcctcggccttgtcagttgctgagctgggcttggctcctttctggaaaatgacagtatttttggcagggngaaggtgcgcaggcctccttgctgctctctggtttggttgggaggtgtgtttacctcttgctcctcattcctcccctgcccttttctctggaatatctaagatgtgagctgcattgactctgaagacgtttgaggaacaggagtgggcactgatagaaaggacttcaacgccagtgactgtgtacctccagcagaagaaaatcaggtgtctggtcttgggggcactgtgctcacctctagagagaagaaaaaggctgggtttggacttcatgcctcctcactggtgaaacccaggatgtagatagagggccacacccaccctgtccagagtagagggcacctgtccacgtggccagggcccattgctgccaccctcgaggagatggaaccctgtgatgcaaaagctttgctggtgtgtttggggcataaggcactgctccccttccatctctagcagatatcatcttctcagccaattctgtaggacactgaggctcttgtttgacatggtgtgtggatggggacttgccccaagactgagcaggtctgccctttcattggggtgtatacatatcaggggaccctgaggtggcaccgtactcagtgttgtgatgcccccacctagggaggactcaatgctctttgtatgccttatgcagcgctgatctgtccctggagttcccaggttcccagctccccccctgcaagccttgaagcctccagcaacgtctatctccaggagagcagggcagcctatgcaagtgttccggcaggaccagaagtggccactcaacacacgtcctcaccagtcaccccaaatggagacactcgcagacctgcagttctcagaccgaaggtgctgccttcatcctccccacctaatgcatttttgaaaccaaaggtacctagcctcagagacagagaaggagagggggagatcttgagtctaagaggaaccctttagctgtttctgcagctgaggtcagtttcaggagggtgaagctgatccccaggaatggatcagctgccatgggcacagcctccgatttgagcctctccggctgccagccagggggcctgggccagaccagggctctgtccttccgtgactttattaaagcaacatttgccacatgtttaagccgcaaaggtattagcaatgcttgcatcattaataatcattcagttgaaggtcaagcccatagacacacactctctgctggtaagaaaccatagcccagaactgagccaataaggttgtttgaacctgagagtgtgtaatggtcatttgggccaagcctcagctagggctgctgcctggacgcctgaggggcagcttatcacagtgcaaggggacagggtaaacagcagggggtggggtgtgagcttggagggcccctcccctggatttcctccaacacctgcttggatactaggcccactgtccctgaagggaatgtcagggaagtgtgcctgtgagctgaattaaaggactggcctttccagaaaacgctttggatctgagcagagtagtcagtttctcagacactcattccatactgcaccgtacatgccagcgtacccattgcaccgaaagcaggcccttagggcaggaagggacgatgagcaagtctgccacaccacctggtgactgggaagggctgcttctctcgtaagggtcttggggagaagtaagcccgcagcctgcctctgcacctcgttccagtgtcctgccaggctctgtactgtcctttgtgtatgaagaaaatgctgttagccctctctcaggctgctgttctgtgggtgctgagagctgccccccatcaccacgcaatcacacccctctgagcagaagcaaatctgaggctgaagaattaagttttccccaagcaaggaaggcagg

SEQ ID NO: 35267 - DNA, 5133 bp, Homo sapiens
acgcgcacgggctggtctctgccctaatgcggcggctggcggcgagaggcgctgcaggggacgcgggggaagtggcggcgccggcagcggacagctcggacagcgcccagggccggagcccgagcccttggaggttgattgacttatgtgcaatttgggacgctggagtttaccttccctccgcagcctggaacagagcctcctctggtgttgcaaggaagaggctgaatgaggcagagaagctgagtgctgtccaggaggcccagttaaagcggctcgaggtgacaagaccccgagtgctggggagcagggagcagggccaggtgccgaggatggccaggcagccaccgccgccctgggtccatgcagccttcctcctctgcctcctcagtcttggcggagccatcgaaattcctatggatccaagcattcagaatgagctgacgcagccgccaaccatcaccaagcagtcagcgaaggatcacatcgtggacccccgtgataacatcctgattgagtgtgaagcaaaagggaaccctgcccccagcttccactggacacgaaacagcagattcttcaacatcgccaaggacccccgggtgtccatgaggaggaggtctgggaccctggtgattgacttccgcagtggcgggcggccggaggaatatgagggggaatatcagtgcttcgcccgcaacaaatttggcacggccctgtccaataggatccgcctgcaggtgtctaaatctcctctgtggcccaaggaaaacctagaccctgtcgtggtccaagagggcgctcctttgacgctccagtgcaaccccccgcctggacttccatccccggtcatcttctggatgagcagctccatggagcccatcacccaagacaaacgtgtctctcagggccataacggagacctatacttctccaacgtgatgctgcaggacatgcagaccgactacagttgtaacgcccgcttccacttcacccacaccatccagcagaagaaccctttcaccctcaaggtcctcaccacccgaggagttgcagaaagaacaccaagcttcatgtatccccagggcaccgcgagcagccagatggtgcttcgtggcatggacctcctgctggaatgcatcgcctccggggtcccaacaccagacatcgcatggtacaagaaaggtggggacctcccatctgataaggccaagtttgagaactttaataaggccctgcgtatcacaaatgtctctgaggaagactccggggagtatttctgcctggcctccaacaagatgggcagcatccggcacacgatctcggtgagagtaaaggctgctccctactggctggacgaacccaagaaccttattctggctcctggcgaggatgggagactggtgtgtcgagccaatggaaaccccaaacccactgtccagtggatggtgaatggggaacctttgcaatcggcaccacctaacccaaaccgtgaggtggccggagacaccatcatcttccgggacacccagatcagcagcagggctgtgtaccagtgcaacacctccaacgagcatggctacctgctggccaacgcctttgtcagtgtgctggatgtgccgcctcggatgctgtcgccccggaaccagctcattcgagtgattctttacaaccggacgcggctggactgccctttctttgggtctcccatccccacactgcgatggtttaagaatgggcaaggaagcaacctggatggtggcaactaccatgtttatgagaacggcagtctggaaattaagatgatccgcaaagaggaccagggcatctacacctgtgtcgccaccaacatcctgggcaaagctgaaaaccaagtccgcctggaggtcaaagaccccaccaggatctaccggatgcccgaggaccaggtggccagaaggggcaccacggtgcagctggagtgtcgggtgaagcacgacccctccctgaaactcaccgtctcctggctgaaggatgacgagccgctctatattggaaacaggatgaagaaggaagacgactccctgaccatctttggggtggcagagcgggaccagggcagttacacgtgtgtcgccagcaccgagctagaccaagacctggccaaggcctacctcaccgtgctaggacggccagaccggccccgggacctggagctgaccgacctggccgagaggagcgtgcggctgacctggatccccggggatgctaacaacagccccatcacagactacgtcgtccagtttgaagaagaccagttccaacctggggtctggcatgaccattccaagtaccccggcagcgttaactcagccgtcctccggctgtccccgtatgtcaactaccagttccgtgtcattgccatcaacgaggttgggagcagccaccccagcctcccatccgagcgctaccgaaccagtggagcaccccccgagtccaatcctggtgacgtgaagggagaggggaccagaaagaacaacatggagatcacgtggacgcccatgaatgccacctcggcctttggccccaacctgcgctacattgtcaagtggaggcggagagagactcgagaggcctggaacaacgtcacagtgtggggctctcgctacgtggtggggcagaccccagtctacgtgccctatgagatccgagtccaggctgaaaatgacttcgggaagggccctgagccagagtccgtcatcggttactccggagaagattatcccagggctgcgcccactgaagttaaagtccgagtcatgaacagcacagccatcagccttcagtggaaccgcgtctactccgacacggtccagggccagctcagagagtaccgagcctactactggagggagagcagcttgctgaagaacctgtgggtgtctcagaagagacagcaagccagcttccctggtgaccgcctccgtggcgtggtgtcccgcctcttcccctacagtaactacaagctggagatggttgtggtcaatgggagaggtgatgggcctcgcagtgagaccaaggagttcaccaccccggaaggagtacccagtgcccctaggcgtttccgagtccggcagcccaacctggagacaatcaacctggaatgggatcatcctgagcatccaaatgggatcatgattggatacactctcaaatatgtggcctttaacgggaccaaagtaggaaagcagatagtggaaaacttctctcccaatcagaccaagttcacggtgcaaagaacggaccccgtgtcacgctaccgctttaccctcagcgccaggacgcaggtgggctctggggaagccgtcacagaggagtcaccagcacccccgaatgaaggtaggtgcatggcagcagcccctggggtaaaaggtcccagctaattccgaggcctagagaaacactgagatctgtagctggctgcctgggatggagaggaaatgagacttgcaagtcctcaagccctcggaaggtgagaacccatcttatgtgtgagaggtaggtgctggcattgtatctggagctcagctctccttggaccactgtggtcacacctgggtccccacttgccctgacttgctcagtcacttgacatctatcatctttccttcttgtagaggaataaggaagagagcatgagttgagaaatgagagaaatcataatgaactccaaagaacagtgagtgttcacctcttgagggaggcaggaatatgattgtgagtgctcccatgagggctctggggacaaccttctttcttcgaaggcacatgggttcaaggaggtaggggaaaccgtcaggatgacgctgttactggcatcatgagtagagcagagaatgtggtccttccttgcagcctgaattggatgcgttgtcaggctgcagagaggaggaggagttaggaaacagccatttgccaagccagcttcacaaagagcaaatgagttcatcacctgggtccaggcgtcatctggcagcatttcagccccaccagagctgcacctgcctgaggactccactagagggggctccaggctcacccgcacacgcactggcatcaggggaatgtgcagtctgggacctctcgaggaggcaaggctgcaaaagcctcaatactggcacaccctctgggaaaggctggggacccccgtgtgtctccagagatacaatggtctattcaacagccatttcttgagtacccacaatgtgaggtgccagacactgccacacacaagggatatacaaaggtaacaagaagctcacaccatctagagggggagtcatctataagaatatctaattgcatgtctaaatgagggggcgcagtggctgggcagagaaggggattcagtcttcacgggaagactccagagaagaggtgatgtgagtgggcactctggaagctgacaagtcatcgtgtctggtgctttccacagaagggtcaggtcccgtggcctggcccaggcccagacggggtcttctgaataccacccctacccgcattccaggagagcatcagtgctgccttctctggggctaccaggcccgctgcgtcaccccgggatcccaggcagcttcacaagctgcccacatccttccccagcccaccactctagccagtagaccagcgctgaggcaggagaagaggggccaggcagaagcagagaaaggctgacagcccgctctgcatccctctctggtctcagaaaccaggagtgagtcacacaaccagctctccctcctgctgtgctcttctgcactctcccaagcccctgggcactcgggaagtttattagggcagggggacttaggttagtggctgatgtgtgtctgtcaccaaaggccaggccaggccaggccatgatgcactttcttgattactcaattctgcaaatagatagataaagagagccccttcttccctccctatgtgcaccccaatacagaacatcagataacaaagccctattgtccagccccagtaaccaccacagagaatgttctgcagccccaggggacaaaaggacaaatagaggcttttttcttaacttagggctttgcagaaaattcaagaatttcacttagggctctcagtcca

SEQ ID NO: 35268 - DNA, 4826 bp, Homo sapiens
  misc_feature (2923)..(2923): n is a, c, g, or t
cggacgcgtgggccggcacacgatctcggtgagagtaaaggctgctccctactggctggacgaacccaagaaccttattctggctcctggcgaggatgggagactggtgtgtcgagccaatggaaaccccaaacccactgtccagtggatggtgaatggggaacctttgcaatcggcaccacctaacccaaaccgtgaggtggccggagacaccatcatcttccgggacacccagatcagcagcagggctgtgtaccagtgcaacacctccaacgagcatggctacctgctggccaacgcctttgtcagtgtgctggatgtgccgcctcggatgctgtcgccccggaaccagctcattcgagtgattctttacaaccggacgcggctggactgccctttctttgggtctcccatccccacactgcgatggtttaagaatgggcaaggaagcaacctggatggtggcaactaccatgtttatgagaacggcagtctggaaattaagatgatccgcaaagaggaccagggcatctacacctgtgtcgccaccaacatcctgggcaaagctgaaaaccaagtccgcctggaggtcaaagaccccaccaggatctaccggatgcccgaggaccaggtggccagaaggggcaccacggtgcagctggagtgtcgggtgaagcacgacccctccctgaaactcaccgtctcctggctgaaggatgacgagccgctctatattggaaacaggatgaagaaggaagacgactccctgaccatctttggggtggcagagcgggaccagggcagttacacgtgtgtcgccagcaccgagctagaccaagacctggccaaggcctacctcaccgtgctagctgatcaggccactccaactaaccgtttggctgccctgcccaaaggacggccagaccggccccgggacctggagctgaccgacctggccgagaggagcgtgcggctgacctggatccccggggatgctaacaacagccccatcacagactacgtcgtccagtttgaagaagaccagttccaacctggggtctggcatgaccattccaagtaccccggcagcgttaactcagccgtcctccggctgtccccgtatgtcaactaccagttccgtgtcattgccatcaacgaggttgggagcagccaccccagcctcccatccgagcgctaccgaaccagtggagcaccccccgagtccaatcctggtgacgtgaagggagaggggaccagaaagaacaacatggagatcacgtggacgcccatgaatgccacctcggcctttggccccaacctgcgctacattgtcaagtggaggcggagagagactcgagaggcctggaacaacgtcacagtgtggggctctcgctacgtggtggggcagaccccagtctacgtgccctatgagatccgagtccaggctgaaaatgacttcgggaagggccctgagccagagtccgtcatcggttactccggagaagatttacccagtgcccctaggcgtttccgagtccggcagcccaacctggagacaatcaacctggaatgggatcatcctgagcatccaaatgggatcatgattggatacactctcaaatatgtggcctttaacgggaccaaagtaggaaagcagatagtggaaaacttctctcccaatcagaccaagttcacggtgcaaagaacggaccccgtgtcacgctaccgctttaccctcagcgccaggacgcaggtgggctctggggaagccgtcacagaggagtcaccagcacccccgaatgaagcttacaccaacaaccaagcggacatcgccacccagggctggttcattgggcttatgtgcgccatcgccctcctggtgctgatcctgctcatcgtctgtttcatcaagaggagtcgcggcggcaagtacccagtacgagaaaagaaggatgttccccttggccctgaagaccccaaggaagaggatggctcatttgactatagtgatgaggacaacaagcccctgcagggcagtcagacatctctggacggcaccatcaagcagcaggagagtgacgacagcctggtggactatggcgagggtggcgagggtcagttcaatgaagacggctccttcatcggccagtacacggtcaaaaaggacaaggaggaaacagagggcaacgaaagctcagaggccacgtcacctgtcaatgctatctactctctggcctaacggagcccacccaggcacagccaccactttgcaagtgggaggaggggagaaggggagacaaaaccactgcagacctaccacgaagccaccaccaccttcagtaacaagggtacgatatgggggtctgccaagctgtgaggaccagtagccaccaagccacccacaagccccctcccaatgaccccccttcagccccgggtgccaccagtgtgggagagctggagccgtggctgagctcagctggagggagcctggccccttgcccggtctcgcagccaccccgagcgttccaccacactgtccgcccttggcctcggcacacgctcaccttttctgttggttacgggacttctcattgtcttaatttcgctttgtgcatcttcccctccagacccaatgtctctgttttcttttccttttgaaaaagagtccctggaaaagaaagaataagtggattctcccccaggagaatcctttttgcaaagataggcaaaaaggattgaatccataccagaacacgtagacaggctgtaatattcaaaccacctctgggccaatgcatttccaaaggatgcctttctcgccatatgcctcccctggcccccagcccctctgcctcggccttgtcagttgctgagctgggcttggctcctttctggaaaatgacagtatttttggcagggngaaggtgcgcaggcctccttgctgctctctggtttggttgggaggtgtgtttacctcttgctcctcattcctcccctgcccttttctctggaatatctaagatgtgagctgcattgactctgaagacgtttgaggaacaggagtgggcactgatagaaaggacttcaacgccagtgactgtgtacctccagcagaagaaaatcaggtgtctggtcttgggggcactgtgctcacctctagagagaagaaaaaggctgggtttggacttcatgcctcctcactggtgaaacccaggatgtagatagagggccacacccaccctgtccagagtagagggcacctgtccacgtggccagggcccattgctgccaccctcgaggagatggaaccctgtgatgcaaaagctttgctggtgtgtttggggcataaggcactgctccccttccatctctagcagatatcatcttctcagccaattctgtaggacactgaggctcttgtttgacatggtgtgtggatggggacttgccccaagactgagcaggtctgccctttcattggggtgtatacatatcaggggaccctgaggtggcaccgtactcagtgttgtgatgcccccacctagggaggactcaatgctctttgtatgccttatgcagcgctgatctgtccctggagttcccaggttcccagctccccccctgcaagccttgaagcctccagcaacgtctatctccaggagagcagggcagcctatgcaagtgttccggcaggaccagaagtggccactcaacacacgtcctcaccagtcaccccaaatggagacactcgcagacctgcagttctcagaccgaaggtgctgccttcatcctccccacctaatgcatttttgaaaccaaaggtacctagcctcagagacagagaaggagagggggagatcttgagtctaagaggaaccctttagctgtttctgcagctgaggtcagtttcaggagggtgaagctgatccccaggaatggatcagctgccatgggcacagcctccgatttgagcctctccggctgccagccagggggcctgggccagaccagggctctgtccttccgtgactttattaaagcaacatttgccacatgtttaagccgcaaaggtattagcaatgcttgcatcattaataatcattcagttgaaggtcaagcccatagacacacactctctgctggtaagaaaccatagcccagaactgagccaataaggttgtttgaacctgagagtgtgtaatggtcatttgggccaagcctcagctagggctgctgcctggacgcctgaggggcagcttatcacagtgcaaggggacagggtaaacagcagggggtggggtgtgagcttggagggcccctcccctggatttcctccaacacctgcttggatactaggcccactgtccctgaagggaatgtcagggaagtgtgcctgtgagctgaattaaaggactggcctttccagaaaacgctttggatctgagcagagtagtcagtttctcagacactcattccatactgcaccgtacatgccagcgtacccattgcaccgaaagcaggcccttagggcaggaagggacgatgagcaagtctgccacaccacctggtgactgggaagggctgcttctctcgtaagggtcttggggagaagtaagcccgcagcctgcctctgcacctcgttccagtgtcctgccaggctctgtactgtcctttgtgtatgaagaaaatgctgttagccctctctcaggctgctgttctgtgggtgctgagagctgccccccatcaccacgcaatcacacccctctgagcagaagcaaatctgaggctgaagaattaagttttccccaagcaaggaaggcagg

SEQ ID NO: 35269 - DNA, 3519 bp, Homo sapiens
  misc_feature (1616)..(1616): n is a, c, g, or t
aattcactgacacagcattattgcagtaaagaagtagtttaattaatgcaaggctggccaagaagaaggactggagttattactcaaatcagtctcatgatggagcagctcagattaactacaagctggagatggttgtggtcaatgggagaggtgatgggcctcgcagtgagaccaaggagttcaccaccccggaaggagtacccagtgcccctaggcgtttccgagtccggcagcccaacctggagacaatcaacctggaatgggatcatcctgagcatccaaatgggatcatgattggatacactctcaaatatgtggcctttaacgggaccaaagtaggaaagcagatagtggaaaacttctctcccaatcagaccaagttcacggtgcaaagaacggaccccgtgtcacgctaccgctttaccctcagcgccaggacgcaggtgggctctggggaagccgtcacagaggagtcaccagcacccccgaatgaagcttacaccaacaaccaagcggacatcgccacccagggctggttcattgggcttatgtgcgccatcgccctcctggtgctgatcctgctcatcgtctgtttcatcaagaggagtcgcggcggcaagtacccagtacgagaaaagaaggatgttccccttggccctgaagaccccaaggaagaggatggctcatttgactatagtgatgaggacaacaagcccctgcagggcagtcagacatctctggacggcaccatcaagcagcaggagagtgacgacagcctggtggactatggcgagggtggcgagggtcagttcaatgaagacggctccttcatcggccagtacacggtcaaaaaggacaaggaggaaacagagggcaacgaaagctcagaggccacgtcacctgtcaatgctatctactctctggcctaacggagcccacccaggcacagccaccactttgcaagtgggaggaggggagaaggggagacaaaaccactgcagacctaccacgaagccaccaccaccttcagtaacaagggtacgatatgggggtctgccaagctgtgaggaccagtagccaccaagccacccacaagccccctcccaatgaccccccttcagccccgggtgccaccagtgtgggagagctggagccgtggctgagctcagctggagggagcctggccccttgcccggtctcgcagccaccccgagcgttccaccacactgtccgcccttggcctcggcacacgctcaccttttctgttggttacgggacttctcattgtcttaatttcgctttgtgcatcttcccctccagacccaatgtctctgttttcttttccttttgaaaaagagtccctggaaaagaaagaataagtggattctcccccaggagaatcctttttgcaaagataggcaaaaaggattgaatccataccagaacacgtagacaggctgtaatattcaaaccacctctgggccaatgcatttccaaaggatgcctttctcgccatatgcctcccctggcccccagcccctctgcctcggccttgtcagttgctgagctgggcttggctcctttctggaaaatgacagtatttttggcagggngaaggtgcgcaggcctccttgctgctctctggtttggttgggaggtgtgtttacctcttgctcctcattcctcccctgcccttttctctggaatatctaagatgtgagctgcattgactctgaagacgtttgaggaacaggagtgggcactgatagaaaggacttcaacgccagtgactgtgtacctccagcagaagaaaatcaggtgtctggtcttgggggcactgtgctcacctctagagagaagaaaaaggctgggtttggacttcatgcctcctcactggtgaaacccaggatgtagatagagggccacacccaccctgtccagagtagagggcacctgtccacgtggccagggcccattgctgccaccctcgaggagatggaaccctgtgatgcaaaagctttgctggtgtgtttggggcataaggcactgctccccttccatctctagcagatatcatcttctcagccaattctgtaggacactgaggctcttgtttgacatggtgtgtggatggggacttgccccaagactgagcaggtctgccctttcattggggtgtatacatatcaggggaccctgaggtggcaccgtactcagtgttgtgatgcccccacctagggaggactcaatgctctttgtatgccttatgcagcgctgatctgtccctggagttcccaggttcccagctccccccctgcaagccttgaagcctccagcaacgtctatctccaggagagcagggcagcctatgcaagtgttccggcaggaccagaagtggccactcaacacacgtcctcaccagtcaccccaaatggagacactcgcagacctgcagttctcagaccgaaggtgctgccttcatcctccccacctaatgcatttttgaaaccaaaggtacctagcctcagagacagagaaggagagggggagatcttgagtctaagaggaaccctttagctgtttctgcagctgaggtcagtttcaggagggtgaagctgatccccaggaatggatcagctgccatgggcacagcctccgatttgagcctctccggctgccagccagggggcctgggccagaccagggctctgtccttccgtgactttattaaagcaacatttgccacatgtttaagccgcaaaggtattagcaatgcttgcatcattaataatcattcagttgaaggtcaagcccatagacacacactctctgctggtaagaaaccatagcccagaactgagccaataaggttgtttgaacctgagagtgtgtaatggtcatttgggccaagcctcagctagggctgctgcctggacgcctgaggggcagcttatcacagtgcaaggggacagggtaaacagcagggggtggggtgtgagcttggagggcccctcccctggatttcctccaacacctgcttggatactaggcccactgtccctgaagggaatgtcagggaagtgtgcctgtgagctgaattaaaggactggcctttccagaaaacgctttggatctgagcagagtagtcagtttctcagacactcattccatactgcaccgtacatgccagcgtacccattgcaccgaaagcaggcccttagggcaggaagggacgatgagcaagtctgccacaccacctggtgactgggaagggctgcttctctcgtaagggtcttggggagaagtaagcccgcagcctgcctctgcacctcgttccagtgtcctgccaggctctgtactgtcctttgtgtatgaagaaaatgctgttagccctctctcaggctgctgttctgtgggtgctgagagctgccccccatcaccacgcaatcacacccctctgagcagaagcaaatctgaggctgaagaattaagttttccccaagcaaggaaggcagg

SEQ ID NO: 35270 - DNA, 3107 bp, Homo sapiens
acgcgcacgggctggtctctgccctaatgcggcggctggcggcgagaggcgctgcaggggacgcgggggaagtggcggcgccggcagcggacagctcggacagcgcccagggccggagcccgagcccttggaggttgattgacttatgtgcaatttgggacgctggagtttaccttccctccgcagcctggaacagagcctcctctggtgttgcaaggaagaggctgaatgaggcagagaagctgagtgctgtccaggaggcccagttaaagcggctcgaggtgacaagaccccgagtgctggggagcagggagcagggccaggtgccgaggatggccaggcagccaccgccgccctgggtccatgcagccttcctcctctgcctcctcagtcttggcggagccatcgaaattcctatggatccaagcattcagaatgagctgacgcagccgccaaccatcaccaagcagtcagcgaaggatcacatcgtggacccccgtgataacatcctgattgagtgtgaagcaaaagggaaccctgcccccagcttccactggacacgaaacagcagattcttcaacatcgccaaggacccccgggtgtccatgaggaggaggtctgggaccctggtgattgacttccgcagtggcgggcggccggaggaatatgagggggaatatcagtgcttcgcccgcaacaaatttggcacggccctgtccaataggatccgcctgcaggtgtctaaatctcctctgtggcccaaggaaaacctagaccctgtcgtggtccaagagggcgctcctttgacgctccagtgcaaccccccgcctggacttccatccccggtcatcttctggatgagcagctccatggagcccatcacccaagacaaacgtgtctctcagggccataacggagacctatacttctccaacgtgatgctgcaggacatgcagaccgactacagttgtaacgcccgcttccacttcacccacaccatccagcagaagaaccctttcaccctcaaggtcctcaccacccgaggagttgcagaaagaacaccaagcttcatgtatccccagggcaccgcgagcagccagatggtgcttcgtggcatggacctcctgctggaatgcatcgcctccggggtcccaacaccagacatcgcatggtacaagaaaggtggggacctcccatctgataaggccaagtttgagaactttaataaggccctgcgtatcacaaatgtctctgaggaagactccggggagtatttctgcctggcctccaacaagatgggcagcatccggcacacgatctcggtgagagtaaaggctgctccctactggctggacgaacccaagaaccttattctggctcctggcgaggatgggagactggtgtgtcgagccaatggaaaccccaaacccactgtccagtggatggtgaatggggaacctttgcaatcggcaccacctaacccaaaccgtgaggtggccggagacaccatcatcttccgggacacccagatcagcagcagggctgtgtaccagtgcaacacctccaacgagcatggctacctgctggccaacgcctttgtcagtgtgctggatgtgccgcctcggatgctgtcgccccggaaccagctcattcgagtgattctttacaaccggacgcggctggactgccctttctttgggtctcccatccccacactgcgatggtttaagaatgggcaaggaagcaacctggatggtggcaactaccatgtttatgagaacggcagtctggaaattaagatgatccgcaaagaggaccagggcatctacacctgtgtcgccaccaacatcctgggcaaagctgaaaaccaagtccgcctggaggtcaaagaccccaccaggatctaccggatgcccgaggaccaggtggccagaaggggcaccacggtgcagctggagtgtcgggtgaagcacgacccctccctgaaactcaccgtctcctggctgaaggatgacgagccgctctatattggaaacaggatgaagaaggaagacgactccctgaccatctttggggtggcagagcgggaccagggcagttacacgtgtgtcgccagcaccgagctagaccaagacctggccaaggcctacctcaccgtgctagctgatcaggccactccaactaaccgtttggctgccctgcccaaaggacggccagaccggccccgggacctggagctgaccgacctggccgagaggagcgtgcggctgacctggatccccggggatgctaacaacagccccatcacagactacgtcgtccagtttgaagaagaccagttccaacctggggtctggcatgaccattccaagtaccccggcagcgttaactcagccgtcctccggctgtccccgtatgtcaactaccagttccgtgtcattgccatcaacgaggttgggagcagccaccccagcctcccatccgagcgctaccgaaccagtggagcaccccccgagtccaatcctggtgacgtgaagggagaggggaccagaaagaacaacatggagatcacgtggacgcccatgaatgccacctcggcctttggccccaacctgcgctacattgtcaagtggaggcggagagagactcgagaggcctggaacaacgtcacagtgtggggctctcgctacgtggtggggcagaccccagtctacgtgccctatgagatccgagtccaggctgaaaatgacttcgggaagggccctgagccagagtccgtcatcggttactccggagaagattatcccagggctgcgcccactgaagttaaagtccgagtcatgaacagcacagccatcagccttcagtggaaccgcgtctactccgacacggtccagggccagctcagagagtaccgagtgaggaagccagctccggactcacctaactacccagctcactaaccagggccaggggtagcaaatgcgggctataagatatttgaaagaaaccctagcgttgtttattgaatccagggttgactcaagaagataatgtctagggttagatgttcaaaaatatacccagaaaaaaaaattatatatata

SEQ ID NO: 35271 - DNA, 989 bp, Homo sapiens
acgcgcacgggctggtctctgccctaatgcggcggctggcggcgagaggcgctgcaggggacgcgggggaagtggcggcgccggcagcggacagctcggacagcgcccagggccggagcccgagcccttggaggttgattgacttatgtgcaatttgggacgctggagtttaccttccctccgcagcctggaacagagcctcctctggtgttgcaaggaagaggctgaatgaggcagagaagctgagtgctgtccaggaggcccagttaaagcggctcgaggtgacaagaccccgagtgctggggagcagggagcagggccaggtgccgaggatggccaggcagccaccgccgccctgggtccatgcagccttcctcctctgcctcctcagtcttggcggagccatcgaaattcctatggatctgacgcagccgccaaccatcaccaagcagtcagcgaaggatcacatcgtggacccccgtgataacatcctgattgagtgtgaagcaaaagggaaccctgcccccagcttccactggacacgaaacagcagattcttcaacatcgccaaggacccccgggtgtccatgaggaggaggtctgggaccctggtgattgacttccgcagtggcgggcggccggaggaatatgagggggaatatcagtgcttcgcccgcaacaaatttggcacggccctgtccaataggatccgcctgcaggtgtctaaatctcctctgtggcccaaggaaaacctagaccctgtcgtggtccaagagggcgctcctttgacgctccagtgcaaccccccgcctggacttccatccccggtcatcttctggatgagcagctccatggagcccatcacccaagacaaacgtgtctctcagggccataacggagacctatacttctccaacgtgatgctgcaggacatgcagaccgactacagttgtaacgcccgcttccaacacctcgtgctgaattcttgg

SEQ ID NO: 35272 - DNA, 606 bp, Homo sapiens
acgcgcacgggctggtctctgccctaatgcggcggctggcggcgagaggcgctgcaggggacgcgggggaagtggcggcgccggcagcggacagctcggacagcgcccagggccggagcccgagcccttggagctgagtgctgtccaggaggcccagttaaagcggctcgaggtgacaagaccccgagtgctggggagcagggagcagggccaggtgccgaggatggccaggcagccaccgccgccctgggtccatgcagccttcctcctctgcctcctcagtcttggcggagccatcgaaattcctatggatcgtcctctgtggtcttgacttgcccatgaaagcagtccagggtcaagtgtggtggagcagttcttacttgcctttctaatgtctgatatattcaaatccacacccttcgggccctcttggctggagtaatcaggaggacacaggcctgggaagggctgggagcagaattatctttgcaaaagacatggctaaatgagacattaaaatagagccccattatcatgccgcatgggagaaccaggcatggattccttctcattgttttcaactttcctgcagtaaagataaaaagt

SEQ ID NO: 35273 - DNA, 473 bp, Homo sapiens
tctctcacacctcatgataattcagagatcaagattcctttcaatttgttgttcctctttctccttaggttttgtcaaagcagagaaaccacttagtcatgactgagtcttagcccgaggaagggatgggaaaaagggaggaagaaggaggccaagcaagtgatgaggaagatacgtacatcgcttttgctcacatttcattgaagaaaacgaattgcatgggccatacctagctacagtggggaagccaggaaatatactctgtagctgggtgtcagtgtgactaactaaacctcgattactgtggaagaatgaattaagataattagcagcctaccatagataccttctaaattttcaggaacttatttctgtctgtagcttgaaaaatcaaatgaatattttttggtttttcccttttttttgttttatttggagcctgggcaacagagcaagatctagtctctgtctca

SEQ ID NO: 35274 - DNA, 146 bp, Homo sapiens
gggccatgggggaagatgctgttccaggcctctctccttggcttagaggtggtgcctgttgtctattctcttgtcactgtcttccctccacgtgtgtctggctctgtctgaatcccccatttcataaggacaccagtcatactaga

SEQ ID NO: 35275 - DNA, 224 bp, Homo sapiens
catctctcacatttatgttagaacaaggccatgaatgctgttttcttctatctcatgatccctaccatttcttcttctgtttctcacctcaataaaatggctcccatgttgatgccttgattcccggaaggagctactgttttgctttgcctcttaacatcgctcaggtgatgctgcccttgctgatactctgtctctgagctgaagcaggagaaaatcccctc

SEQ ID NO: 35276 - DNA, 350 bp, Homo sapiens
gcagtatccaaacaggcaactccgcacctcaccccagaacacccccaataaaggcacacttttaaagcaagcctgatgatttcccttccaaaattactaggtatttcagaaacagcaggttttaaaatacatcatcttaaatgcagcatcatcctcatatgaatgtcaaagagagatgaaatgcaattaaaaagagctaactgtttttttctccccctctctcatttgagtgttctggtaactacttacaaattatacttggaaatgaatcctttcataaactgatactttatttagcacatgagaactgaataaaaatgaagagcatttccccttgtatttagagacat

SEQ ID NO: 35277 - DNA, 497 bp, Homo sapiens
gtatttgcactgtctaggcatctatataaaaatgtgtgtatgcgtatataactatatgtaaacgttaagttagttattgggtatgttaagagagtgtgattaaattttttaaagagaaattgttttttcagtaattttttctttaaagtgaagaatgacttacaaaaatttatcttacatcctacttcaatacaatgtaaatgcatatatgtaaagaaggaaagaaagggagagaaaataaacctagttatgatccagagcattaaaaagattgtgcttggccgggcacggtggctcacgcctgtaatcccagcactttgggaggccgaggcaggcggatcacgaggtcaggagatcgagaccatcctggctaacacgtgaaaccccgtctctactaaaaatacaaaaaattagccgagagaggtggcgggcacctgtagtcccagctactcgaggcaggagaatggcgtgaaccccggcgggcagagcctgcagtg

SEQ ID NO: 35278 - DNA, 403 bp, Homo sapiens
taacactgcatactaactaggatgggtatgttcaaaagatcacttaataacaaatcttggtgaggattttgaaaaactgaatctttcatacattgctggtgggaaaagaaaattgtgcagtcactttgaaaaacagtctggcaatttttcaaaaggttaaacatagagttaccatatgacccagcacatgactcctaggtgcatgtgtgtctatatccatacagtggaatgttattcaggcataaaaagaaatgtagtactgatccatgctgccacatggatgaaccttgaaaacctgctaagcttagcaaagaagccagtcacaaaagaccaggtagcatatgattcccttcttcctttagttaccaactttctgtctcctcatcctcaatctctttactat

SEQ ID NO: 35279 - DNA, 519 bp, Homo sapiens
aattctagatttaaatactatccctcaagctattgtacttcattaaaaaaaaaaattacacatagagatgtccagtatttctatataagtaatgtagggtagaattatttctatcaagaaataaagcatgcatttccaaatcatcagctttatttgccattttgaaataaaatccataatatttaatgaaacagggaagaccacatgacctttggaagctttcttagcctctctgcatttcatttttcttatctgtaaaatagaatgggttgagatgggactctattaaactttgaaattctaaaactcttgacacaaaaagttgtgattcatatatgtgactattttagaataagaaatctcaacagaaaaaaatgtagtctggacttttatttaaaattccattctaaaatattcttcagacttatttaatgtcctaccgaaagattagaaatgttactggggagttaggaaagtgagcctgaagaggaaaataatctgattaaaacatttttattg

SEQ ID NO: 35280 - DNA, 212 bp, Homo sapiens
ctagactgggttctgtgtaaccttggataattgatgtccatgcattggaccttgatttttcaaactgcaaaatgagggaactgaactaaatcatctccaaggttctttcttgcaattagactccttatctctcagcaagatgatgtgtactcagcgtcttccaccccaacagggaccacctctctattttttttttttttaaggggggagcc

SEQ ID NO: 35281 - DNA, 554 bp, Homo sapiens
gtttttgtttttaggccagcacatagtaaaggcttataccttgcactgtttttttttgtctcttttcatctaggccagccccagtgccttttgaccccatagttttgatcttttgaggggccaggcgggttgttttgtagaactgtcccacattctggatttatctgattgtttccttatggtgtgatttaccttggtcttctgttagctgattgtctcaggaactagaagttaggtcaaatagtttgatgaggttaaacatttttcccaagagcacttcagaggtgatgccgcgtacctcatgtggcatcacaaggcacatcctgtgagagtgtctcacagttagtgctgctgagtttgactgtgggttacagtggtggctaccagattctctccattataagctacatctcccctttgcaattaatttttctgtaaggtgctgtgttggctctgtccagattacacattttcctgtcatcctttcatctaattgttttgataccagttttgattattgcctattttattagagttgcaaaatggcaaatgtc

SEQ ID NO: 35282 - DNA, 655 bp, Homo sapiens
gcccgtttctacctaaacacaccccactgcagggcaaactacaaggtggtttccttccagagtcccagagaggaggcagggcaccagtgctctctgcttacagggggtcgctcacctacctgggccttctatcatctcaataaccccgtaagcagaagcccaggacaactgggtgctagatctcagtgacccatccatttcttaaccctggaatcctctgaatctctgcaagctcctccttccaacccaggaagcaattttctccttcttgggctaacggaagtgatcctgtagcctccctcctccgtggcttaatgtacaatatatgccaggccttctgagatttggctgcttggaaaccacaaaccatttttcttctaacaaagcctgtctcttttaaatgaaggcttgggctaactctgttctctgaaacaggctttaagggcctgttttggaagtcaaaagctgaacaatgtcttctttgtcgttgaccatgttctgtcctccccttgaagtgatggaatccctagcttcaatgggggagactcccagggcaacagcaattaggaggaagggaaagtaaattgaataccagttcaaaatattattcccactaaactagctgctcataatgcaaggtctcagaggtcccaga

SEQ ID NO: 35283 - DNA, 623 bp, Homo sapiens
tacaatttgaagaaattttctcagttttatatgtttttttagtgggtgaagttcagtctacagtttttacatttagtcacctaactctagccaacttcttggtcatattctctggaaaacattcgaagatcatggcagcttttagataaaaacattttctattattttgcgtgcaaacttgtttactgtgttcacagagtggccagtcatgagaccataagaaacagctgcccttttagtgtctttcataccgtctgtaatatataaattgtgcatttattctgtgaagcatgacattttgaagtatatacacattgtcaaatgcttcattctaggtaattaatgctttacctaacatagttaacatttttgtggtaagagcacatgacaatgttttagcatttttcagaaatacaaatacattgttatgaactataggcaccatgcagtacaaaagcttttttgaacttatttctcctattcaactgtaattatgtatttgactgacatctttctaaacccctcttttttccaaatatgttggcatctggtggtcaccattttattctccacttcagttagattaatttttctagaatcatgtaagtgaaataatttggtta

SEQ ID NO: 35284 - DNA, 817 bp, Homo sapiens
gttcttccaggaaatatgaagtatgatagaggaaatatgaagtataatagcctcgcccagtgtttcttagccctttgccaacttaccacatccttggaaaacaacagtcatgccagtagtccaggctgccgtggcagggtctcacccatggctggggcattgcatatactcatcagggtttctcctcagaacctgcactgtgtagagggcagaaagggtgagggagatagagggggtagagcagcacaagaaaaaccaacagtgcttggcaactggaaatggaaatcaagggaaaggagtggttcagagagtaccccgtggatgaggagagagacatgtctgcccatcaagcacttagaattcttttttggaaagtaaaaccagtacatatgaaacaattgaagaatcaatgtgttatcacatgtaagtggatttggcttatgtaggaaaaagggaagttcactgttgcccagggagtcatcactgaagatgggggatttgagctgtgcccttgaagtgacacaggccttggagagcaggggtggccattgccagcgcaaggagaactgtatgaatatagacacaggatagagagtgggcagccttgtaccctctggcccgacttactggagagtagcaggagcatgaaattgaaaaggaaacatcttatcaaacttgatgttccaagaaagaagaaaggaaaaacctgtttgtgcctagtaagttacagctctcatcctgtaactttggtgtctcagattgtaaaatgtgtgctctatctagagtgtcaagatgaacattttaccatctgtggatg

SEQ ID NO: 35285 - DNA, 1249 bp, Homo sapiens
catatatattgccaaagacacatatgtgtctagggacatacaacgaatgcactgtgggggaacacaagaggaactgaagtgcaaatcaggaatgaagggaacaaataaaagaacaggaggggggcctttcatggactgatcctaacatagtgtcatgaacttaggaggaggattaactcaattctcattaattgagaattctcattaatctatgtaccaagagcaagagaaaagcccaatagcagtggtgccagcagtgccatccttaccagactgattctaacatattaccttagtttttgcagtggttcatcctctgttgattcctatctgtttcatgcctcacctccagacttcacagttctgtgaattacttattgctatccttccaataatttttctttcttttttttttttgagactgagtcttgctccatcgcccaggctggagtacagtgctgcgatctcggctcactgcaatgtccacctcctggggtcaagcaattctcttgccttagcctcctgattacaggtgtgcgccatcagagctcagctaatttttgtatttttagtagagatggggtttcaccgtgttggtcagctggtcttgaactcctgaccttgtgatccgcccaccttggcctcccacagtgctgggattacaggcaggcatgagccaccatgcccggccaatttttcttcttaaccacagtttattgtagtcaaacttatactattacagagtagatttattttacctgttgaatgtccagtccgaggttgaactttatccattacagtaggcatccttattttgttcttggcttcaatgggaatgctgcaggttttcaaagctggaaagctgttgcagaaagcccaatatgtacataaacttgctttccagcagcaacaaccaaaacagcagaaagacagcctttacctcccaaatctcaaatgaagaaatctaattggtggaactgatcttgtactcagaaccctagcttcaagggttttaatttctccaggtagcaaagaatttgaggcaaccaggtgaatggataaatttactatggtggatgctcaaatatctatggaatactcctgcagctgatggaagcaacaaactagattaacagctacatggaatacactggttatttacctattttttttcagctgctagcctttccatctctccccctgcaactcccccaattctctcctctacccacccccacccccacattct

SEQ ID NO: 35286 - DNA, 1243 bp, Homo sapiens
ctcttgtcctctggatatcctgggatggaatcctaatgaaggaaactccagtggtttactgaagccctttgtgctaggcctgaggtgagatagaattgctccatcctatgcccaggaggcctgcgtggactcacagtgcaccaccatcctcagaaatcctctctccctgtaggctgtggtctgaatctttgtgtcttcccaaaattcatatgttgaaatcctaacgccccaggtgatgatattagaagatggggcctttcaggagttgactaaaacttcagggaaaagccctcacaaatgggattagttcccttataaaataggtccaaggaaacttgctcacttctaacaccatgtgaggacacagtgagaaggcaccatctataagccagaaagcagtccctcaccagacatagatctgctggcaccttgatcttggacttctcaccctccagaactgggagaaataagtgtatattgtttataagctacacagtttatgatattatagcagcccaaacagacattgtatttcctcaatgttggtttaagagttgtctaaaccagtttcttgttatcatactgtggatgtttctagctctcactgtagcattccacctcttttctgtctcagtgacttagtcaaagcatctagttgaacactctgttatttaaagaaaccagcattcactggctgttcccagctccaggaactcaggtggattcataatttgttctgtttccttgctcttaggaaaagtactgacagctcataattggttgtatttcttaggatatttgcatttaaactagaagcaatgctttcttttcttggtataatttgtcttacatttttgaaagtaatagctattcattaaattacatttgaaaatgcaggaagaaagaaaaaattgtctataattctactactcatataaaaccactattcacatatgtgtactttcctctattaacctttcaaagcatgcctcaattttaattgtattcacacaaatacaattttatgccatacattttacttattaatatgctattagcatcaccaatgtcaatataaactccttgtaaacatcaatttaatggttgcaaagtattacatcaactggatatgccatggcttatttaatcactgtatttattgttaaatatttgcattgtttacactgtttagtattgaaaaccacgctgcaataaatatctttggatagattcttaaaaaaaa

SEQ ID NO: 35287 - DNA, 439 bp, Homo sapiens
ggtcgacggagaattgagcagagaaattggtagagacattcataaatctaataaggcatgactatgacaataatagtgatgatagttaatgggagtggcgggcaaaataagttagaaacaattactcataatccactacaatattcaaagacgggacactgaaaggtcatagagggagaaataatgtgtatagagaaagtggggggaaaagtggagacacagcaaaagacctgtttattagagcaatgcaattttcactccaatagctaccttcaccagaatgcttctcaaaatgatgcaaaagactgcgacaacaggccgggcacagtggctcacgcctgtaatcccagcactttgggaggccaaggctggcggatcacgaggtcaggagatcgagaccatcctggctaacatggtgaaaccctgtctctactaaaaa

SEQ ID NO: 35288 - DNA, 2365 bp, Homo sapiens
aacttagtgcggacacccgatcggcatagcgcactacagcccagaactcctgggttcaagcaattctcctgccttagcttcctgagtagctgggactacaggcacgtgccaccatgcccagctgatttttgtacttttagtagaaacggggtttcactatgttggctggtcttgaactcctgacatcaagtgatccgcccacctcggcctcccaaaaagtactgggattacaggcatgagccaccacgccaggctggtagcagtctttcctagaatgtggatgccttggaaaacaggggctctgccttgtttccctataacctagaatggcatctggcacacagcagatgctacatctattgtaaatgaatgaatgaaagaagtgtccttgcagccacactggcagccataacatagtggttataaatctagactctggagtctcaagtgcaaatgtcattggcctctcctccagcctcctcaaggggcactcaatgactggaagcgccctgatatgactgtggttagactgacatgactgccagatggtgggacttggtctggagcagagactacttggaatggtagaggcaaaactcaacagcccctggagctgcgcttgtggtggagctggaccctgattttagctggaccttgtttttagagacagggtttccttctgcagtctcaatctcctagccttgattgatcctcctgccttggcctcccaaagtgctgggactacaggtgcatgcaaccacacctggctaattttcttctcttctttctttctttttttttttttgatggagtcttgttctgttgcccaggctggagtgcaatggtgccatctcggctcactgcaacctctgcctcccgggttcaatccattctcctgcctcagcctcccaagtagctgggactacaggtgtgtgccaccgtgcctggctaatttttgtatttttagtagggacgagacttcaccatgttggccaggctggtctcgacctcctgacctcaggtgatccacccaccttggcctcccaaagtgctgggactacaggcacatgcaaccacgtctggctaattttcttgagtttcagtagagactgggtctcgttatgttgtccaggctggtcccgagctcctgagttcagtcgatcttcctgccttggtctcccaaagtgctgggcctacaggcgtgagccaccatccccagcccaatttttgtatattttgtagagacacagtcttgctatgttgtccaggctggtctcaaactcctgggctcaagggatcttcttgccttggcctcccggagcacttaattacaggaatgactgcatgtgctgttgtgcctatactttctggagatacgttgttaggaatttatgtagttggccgggcacggtggctcacgcctgtaatcccagcactctgggatgccgaggcaggtggatcacctgaggtcaggagttcgagaccagcctggtcaacatggtgaaaccctgtctgtactaacaatactaaaatcagaggttgcttgcagtgagccaagatcataccattgcactccagcctgggcaacagagcgagactctgtctcaaaaaaaaaaaaaaagaaaaaaaggaatttacatagttgaacaactattctttggacatcttttagtccagtagacggtgttaaacttgaagacaaataacgatttgacctgtgatatttgtttttccctcttatcttctaagcccattcatccagatcattcatcacctttaaaggcatccccaaagggaggcaggtctggacagagctgaagattgcacaggccatttgcaggctggattcgttctctggtgacccacctgtctgactcgaattatttttttcccatgtctggacaagactgacctctgcccagcaactgaggcctggatttagtccaagggccctcagtggcttttttgtttgtttgttttttcaggaagtgaagaatttagagggataaaaggcggaaataacttttcagcctctgacctttgtaacaatctggtttccttttaaaggagcattgtttgggcctggggccacctagaccttctgatgctctttccccacccttggaggaggaggaaaggaagaaaatgggccctgagcgatcaccacataccaggccctgggggtctagtggcgaaggaggcaggtagggtctcttgctttcatggagcttctagtcaagcgagacgcactaaacagtaaagggacaaataggattactggaggtagccctaactactgggacagaaacaagatggtaagatagagaaggaagagtggcctgctcagatggggtggtccagaggc

SEQ ID NO: 35289 - DNA, 2215 bp, Homo sapiens
aacttagtgcggacacccgatcggcatagcgcactacagcccagaactcctgggttcaagcaattctcctgccttagcttcctgagtagctgggactacaggcacgtgccaccatgcccagctgatttttgtacttttagtagaaacggggtttcactatgttggctggtcttgaactcctgacatcaagtgatccgcccacctcggcctcccaaaaagtactgggattacaggcatgagccaccacgccaggctggtagcagtctttcctagaatgtggatgccttggaaaacaggggctctgccttgtttccctataacctagaatggcatctggcacacagcagatgctacatctattgtaaatgaatgaatgaaagaagtgtccttgcagccacactggcagccataacatagtggttataaatctagactctggagtctcaagtgcaaatgtcattggcctctcctccagcctcctcaaggggcactcaatgactggaagcgccctgatatgactgtggttagactgacatgactgccagatggtgggacttggtctggagcagagactacttggaatggtagaggcaaaactcaacagcccctggagctgcgcttgtggtggagctggaccctgattttagctggaccttgtttttagagacagggtttccttctgcagtctcaatctcctagccttgattgatcctcctgccttggcctcccaaagtgctgggactacaggtgcatgcaaccacacctggctaattttcttctcttctttctttctttttttttttttgatggagtcttgttctgttgcccaggctggagtgcaatggtgccatctcggctcactgcaacctctgcctcccgggttcaatccattctcctgcctcagcctcccaagtagctgggactacaggtgtgtgccaccgtgcctggctaatttttgtatttttagtagggacgagacttcaccatgttggccaggctggtctcgacctcctgacctcaggtgatccacccaccttggcctcccaaagtgctgggactacaggcacatgcaaccacgtctggctaattttcttgagtttcagtagagactgggtctcgttatgttgtccaggctggtcccgagctcctgagttcagtcgatcttcctgccttggtctcccaaagtgctgggcctacaggcgtgagccaccatccccagcccaatttttgtatattttgtagagacacagtcttgctatgttgtccaggctggtctcaaactcctgggctcaagggatcttcttgccttggcctcccggagcacttaattacaggaatgactgcatgtgctgttgtgcctatactttctggagatacgttgttaggaatttatgtagttggccgggcacggtggctcacgcctgtaatcccagcactctgggatgccgaggcaggtggatcacctgaggtcaggagttcgagaccagcctggtcaacatggtgaaaccctgtctgtactaacaatactaaaatcagaggttgcttgcagtgagccaagatcataccattgcactccagcctgggcaacagagcgagactctgtctcaaaaaaaaaaaaaaagaaaaaaaggaatttacatagttgaacaactattctttggacatcttttagtccagtagacggtgttaaacttgaagacaaataacgatttgacctgtgatatttgtttttccctcttatcttctaagcccattcatccagatcattcatcacctttaaaggcatccccaaagggaggcaggtctggacagagctgaagattgcacaggccatttgcaggctggattcgttctctggtgacccacctgtctgactcgaactcctgtctcacgtgtctgtgtgaagagaccaccaaacatgctttgtgtgagcaacatggctgtttatttcacctgggtgcaggcgggctgagtccaaaaaaggagtcaacaaagggtggtgtgattatcactggttcttataggtttggggataggcggtggagttaagagcagtgttttgggggcaggaggtggatctcataaagtacattgtcaagggtgaggagaattacaaagaaacttcttaagggtgggggagatgataaagaaccttcttaagagtggggcagattacaaagtacattgatcagttagggtggggcagaaacaaatg

SEQ ID NO: 35290 - DNA, 496 bp, Homo sapiens
ggaggcaacgtggggagtcaggcaggcttgacgtcacatcctgcttctgccactcttactagactggggaatgcttagtaaattattggacttctctgagcctcaatttcctcacctgcaaaatgaaaatgatgccacatatcttacagggtagttgtgcgctttgcatgagatgatgcctggcatatatccatggatttttaaagttctttcacatgcctgccttcagatgtggactcctataataaccaatggttgtcaatgtgttccctcccaaaagcacctaattgttgcacatcagatacctgataaggagttaatatctagaatatacaaagaacccctataacttaataacaacagcaaaaccagatgtaagtatgggcaaaggacttgaacagacatttctccaaagaagatatacaggtggccagtaagcacatgaaaagatgctcaacattgctcattagagaaatgaaaatggtggttactatcc

SEQ ID NO: 35291 - DNA, 560 bp, Homo sapiens
cttgccgtaaacctagaacattttgtgccatcagtttatgcatttgctgcaattccaggacaatggggaaaatcctgttttatactaacaacaacaaccatgaaactatactactagtagctgacatttactgacttcttattaaatgccatgcatggtactgagagccttacaggcattacctcctcaaatcctcaggactatgaaatcatcccttattatctctattttccaggtaagaaaattaaggtcaccggctattctgtagtagagccagaattcaaacctggagtctgccttttgaggtactagtggtgttttccccccagattatgtattttgggcattgatactactgagtttccatctttaggtgcatcttcgctggtatcaattggaggaactggagaagatgcactggcgctgtgagacagaagtcattctcagccaggagtgtcattttctccttggagtctctaacttcaggattctgtgatttggccataaataataaatatggtttagtagaggttaataaaatgtttgttgaattactgcca

SEQ ID NO: 35292 - DNA, 434 bp, Homo sapiens
  misc_feature (261)..(261): n is a, c, g, or t
  misc_feature (424)..(424): n is a, c, g, or t
ccactgggtggtgtggggctggtttcccctaacaattcccccaccaaataaagcagctcccaaccttcctagatggttgcctcagctcagaagtccttagagaaattctgatgccctctcctcacatttgctctgtcggcaaatccctggtgtcacaagagggctcaggagggtttctggatgccaacgagaccccagccacagccggtccccagattcttgacatcatcacaagaaagaattcacagatggtgcacaagnaagtctcgccagatgctggtcttgtgatcttggacttcccagcctccagaactataatggctgctccatcagcctggttcttggaatgaggatgacataaggtagagtcccagctgaccaacagtggagatgtatcatgagcaagaaataaacctttctaatnttcagccact

SEQ ID NO: 35293 - DNA, 823 bp, Homo sapiens
ccactgggtggtgtggggctggtttcccctaacaattcccccaccaaataaagcagctcccaaccttcctagatggttgcctcagctcagaagtccttagagaaattctgatgccctctcctcacatttgctctgtcggcaaatccctggtgtcacaagagggctcaggagggtttctggatgccaacgagaccccagccacagccggtccccagattcttgacatcatcacaagaaagaattcacaggtgagtcagaatgaagtgaaatgcaagaagcttttattggaaagcaaaagtctgcacttaagagagaagtgggtgcatgctcgtgagaacgagtcacgcaaacagagtttgggtttctaattttatttggtgtttctttaattagggggtggaataatcattaggtattctggaaaaggaggggacttcagggacccctgaaattgcccatgctagagtgttgtggcacaatcctagctcactgcaaccttgacctcctggccttaagtgatcctcctgcctcagcctcctgagtagctgggactacagacgtgcaccactatgcctggctaacttctaaaaatttttagtagagacagggtctcattatgttgcctaggctggtcttgaactcctggcctcaagtgatcctcccaccttggtgggagcctgcaattacaggcatgagccaccacacccggcttctgctttattattttccaaagcactcgtccctgcctgacacattatagatgcatgtgtgtcttgtctctacaatgtgggctcccagagggcagggactttgctctgttctg

SEQ ID NO: 35294 - DNA, 653 bp, Homo sapiens
catcaattacaacacagttttacctaaggaaaaaatacagcaatattcgttaaaagcacacagtttttatggtatatacaaggagcaaaacagaactttttggtggagtataactcatatgttcacaagcaaaaccttcaattgtaaaatagcacacaccacccagtgaacagacatagaaaaagtgttaaagtcaacatgaccattactcaagtctctttccaagaggcaaaaggaattttgtagctacacaaggttatacttgacatactgctaaagaggacccagaatcttcaccaacttccattactgtcctccacctttgacaaaactgggcagccattctatgaagatgttacccattgtgacctttaatggctgtagcctttggcacagttttactttatactgataataccagcaatataattttctaatattattttccaaggccagaccttgggaagacaaggcacagaaataccatcataaacacacaactggaaacttctaggaatcaaaatagtagaggatgctgaatgtggtggcttgtgcctacaatcccagctacttgagaggctgaggtgggaggatcacttgagcccaggagtttgagaccagcctgggcaacacagcaagatcctgtctccaaa

SEQ ID NO: 35295 - DNA, 405 bp, Homo sapiens
aggctggacaggcctgctgtccccaaaccccatgggctcatttcacctgtgactccagcctcaacctgctaaggagctcacattctccagtcacttcctatagacttctggcttcctgtcaggcatataacaagcttgaaatttgtcactggtttctaacgctaagtaaaaagctgaacaaactcaaaagtcaacaacttgttaaaatccctcagagatggctgggcactccatctctgagtggactcttgaccccatcctcactcatgacgccatcctcaacctgctatggagctcacattctccggtcactttctagagagttctagcttcctgacaggcgtataacaagcttgaaatttgtcactcggttctaacactaagtaaaaagctgaacaaactcaa

SEQ ID NO: 35296 - DNA, 342 bp, Homo sapiens
gttaagagtttgagaacgtttgctgttggttggaaatagaccatggttatttcatcttatttttttcttcacattaacatagagaagttttctataaatttgtaaggtcatacatatcctatcctgtgagatagagtgaatcctaaattgtaaatatttttatttagagacaaattggaaaggcataacaaaacaaataagaaattatctcgggctcctgacaaatgtttgaattgtatccttggaattcattttgtcaaacatttactcatccttgtattggtattgacttgtcactttcatttattatagaaaaaaataaaatctcagttcataacagga

SEQ ID NO: 35297 - DNA, 1070 bp, Homo sapiens
cattagttcaaactgccttctttgagcaaaacttgattggcagtgataaaggcttaaagcccttctcaagcagagacctgtaaagactagatctgactgtagtagaaggaaggaacttagatgtttcaggcagtgagaacaccagtcttccactctaaactttgccactaacagtatgaccttgggaagttgtaactttcttcagattcttcatttgttgaatggggggattggcctagctaatttctaaatctctactgggctaaaaaattctgtgcttatactctgattatgaagtacataatctgtgcttaacattcactgacttatccttaggataatacagaagcagtacaagaaacagcccctcaagatgtttgcagtctggttagaaagacaaacttatacacagaacagtagcaaatagaccaaaataataatagctgccatttatagaacacttcttctgttctgggcattagacaaaaactgactataacggtgaacaaaaaagacttaggtcctgccctcattgaacttacagattagtaggggagaggaacattaatcaagtaattccacagatggcttagcctagattggtagtgatggaagtaaagagatgtgaacggacttgaaaaaaaattcggaggcaaaatggatagaagtttattattgattaaatatgaggtgtgagagagagggatatttaagattgatacctaccttctggcttgcctaacagaaccaaaacaggaaattatatgttcagttttgttatgttgggtgggaggtgcttttgagtcattcatttatatatgttatatatgttattttatatgcatagtaattttaaggtctgagttttaaaccaaaggttagagagtgattttttagagtctagcaaacctaagttgaaatcctgcctgttgaaatggctgtttactagctcattaacctagggcaaagtattcaacttgttttcatttttgtcttcatctctaaaatgaggaaaatatggtcttacaagattgtcctgagagatagatgaaataatatccaaaaaaaaa

SEQ ID NO: 35298 - DNA, 1587 bp, Homo sapiens
gaggttgtggagcttctcccctgcagagagtccctgatctcccaaaatttggttgagatgtaaggttgattttgctgtacaactccttttctgaagttttactcatttccaaaaaggaaggcaagttttcctgcttccatgacgatggagagcaggcatctcctttcctgagtttcagcttgcttctgacagggaaggtgagtgtaagttttttccagtttctaagatggcagagaacgatcaccagcctgagccttatttccaggtaagtagctgaattagagttttgtcttaaaatttttccttaatgaataaaatgtaagattacccaccagctgcttttaatttctccttagcattagaacactcagtaatcatatgaattgtgcatttgtttgttttgcttaactctttctgtttgtttatgtttggggttttattgttgttgtttcacttttctcccatctcttcctgacttggtcaaatccaaaggaatcttccaaattgtggggagcaaggcatctgaaatggctaaaactcctgtggctgcaaaaatagactcaacaagtttccaactaaccacccgaatgcaaccagacaaaagcacgaaagcaaaggaaaaaacccaataaatagagacgtggcgaacaaccacgcacacaaaatcaagcagcacaaaaaagggtgggccgccgcgaaactatacaactgttgggcccgagaagaaacgacagcctcacaccggcagtggttccaaagcggggctcaacgtgttactgcccacccgacaccagcaacaagcacgacagctcgcaccacaccaggagagcagagacagcggcaaggacaacacgcgagcggccaaggcgccgaccagcgaagaaacaaacaaccccagagagacacacagaagacgcagagacaagaagcaaaatcgcgacccgcgcagagacgcgacacgcgcacgcacggacgaagacagggaacggaaccgcagagcaagcacgaacacgacacacagcaagcagccaacggcggccgcaacaagggagccagcagcgggagagaaaggagagggaggacgccgaccccgagcacgaaccggagaaccccaccaggcaagacagagagaagcgagcgagacagaaggcagagagggtcgcgacggagcgcgggaagcgcgcagaccagagcgcgagagagctagaaagcccgaggacagcgggcagacggccaggcgagcagaagcacagacggacgcgcgagagaggagcagcgaaagacggccaagaggcgtagcgagcggaggcagaaggcgaagccaaaggagcagcagcaccgaagcgaaagacagagacacgaagactgacgagcagaccagaacgacgaaacgcaaggagcacgagagaggacgagcagcaggccgagccgagcagggagcggaacgcaggagcagagaggaaggcaggagcagcaaccagcacaaacggacagagggcggagaggacgaccagcacgacggcacagggggagacgcgaggacggcgcgaagcgacagcacgggcgcacgtaaagaacagaagcggt

SEQ ID NO: 35299 - DNA, 1894 bp, Homo sapiens
  misc_feature (1785)..(1785): n is a, c, g, or t
  misc_feature (1841)..(1841): n is a, c, g, or t
aaaactccacaagcccccaaagcgccaccacctctgctgtgttggaacatccacatctccaacagacagacctctgtgttccggagacaccgtgcaggatctgagtgtgtttgttatccaacgggtataagagggaaatcaaacattctttcatatcattagaagccctgtgcaaacacagccccgtgcacaaaggcctttcccgagcccataacaaggaactgtttgtcctggctgcctgtctttagcagtcggagcagggccaagccgacagtggtgtcatgggccctactgcgattttgctttcttggaccaaaattttacaggtgtcatgggacagagctcaccaggtagaagttgaatcagatcacctgctgggaaccttcagtaaatgccacactgcacaagctcggagctgtgatggaacctgacaaagagcttgcacccaaccacagaaaagtcaaatgatcattttgtacatttgcctttgtgcacgggaattgactagccacacatgccggcagccgggactcgtgtctgcctgcaaatgatgtaaccaaagagaaacctgggctcaggatcaaatgtcttcatcctcactcccttgaagaacacagacttaaccctgcagcatctgaacactatcgaggggttggtttcttcacccaagagcattttgatcagttcagcccagacccatatgtttttctggctgctgggattcattgagtccatttattctgtctcctagagtggcactgtccagtccatttgcctcatgctgcacgtggctgttgagcccctgaaagtggctagtctgaattatgatgtgctgtaaggataaaacgtgctttggatttggaaagtttagcacaaaaaaaaaaaaactgtaaactatctcattaataattatattagctatatgttggaagtatttttatctattgggttaaataacatacagtattcaaactcatttcacctgtttctttttacttcttttaatgtagctgctggaaaatttaaaatcacaaatgtagctcgtattgtttgtattagacagggctgggctagtgcttgaaggaagtttaggtttgtagtgccatctgctggctcatccggagcagacgtgaatgtaaacaagaatgaagcaatctgagctaacccacacgttgtctcttagcctggcagcacacaacctttttattccaggagcttctgaagcaggaccagactgaacccagaagctgctgaatccccaagagcctcgggaaggggagtgacaaactgctcaaaggtgcaagcctgtgtcacctcatgggtgccaaggaggctcttgagatagagtagtggtttgctgctcaccttccgcacttggggctctttcatgcagtctttttcactggttgctattcttaagaaatatttcaggccaggcaccatggttcacccctgtaagcccagcattttgggaggccaaggcgggcggatcacttgagaccaggagttcaagaccagcctggccaacatggcaaaaccgcatctctactgaaaatacaaaaattagctgggcatggtggtgcacacctgcaatcccagctactcaggaggtgaggcaggagaatcgcttgaaccagggaggtggagtttgccgtgagtcaaaatcgtgccactctactccagcctgggtgacagaccgagactccatctcaaaagaaaaaagaaaagaaatatttcaggccaggaatagtggctcccacctgtaataccaacactttgggaggntgagtagggagaatcacttgagcccaggagtttgaaaccagcctgggcaacattgngagacttcatctctttttttccccttctctgtggcgcaagacctcatctctac

SEQ ID NO: 35300 - DNA, 364 bp, Homo sapiens
ttcttagactcttggaatacttcatttcctgccctctcgctttctccaatctcatgttctgctaatttttatttgtccttaaagtcttcgttttcttagggcagcacttcagtgaaatctttcataattcccttcccccagatattattttaggtgcctcctgttttttttctttctttctttctttcttttttctttttctttttttggtagcttaaacaataagacctttattgttacaaaacccagcagcgtgaggagttcctgggttgggtgaattagaggctggaaaaattcatcgcaagcattacaagataaccaatgatacccctgatgaaagaaaacctctgcaaactgctagctg

SEQ ID NO: 35301 - DNA, 376 bp, Homo sapiens
gtcttttctggttaacattttcacatatgtggactatctgttgctgattatcatgttcccaggtcagcaggaatgcttctagcaatgtggtgtctgctttgtgtgtcctgctgtgtccactgcctgtggtcacttccgccatctgataacatgccagcaccttggcctctgactgcccacctctgcacagcatggatcctcatggaaccattgagaagtgctgacacagagggctttccaaggtctttggggctgcttgtggtgcagctggtagcatgggttggtgctcatgaaactgtccagaggaccaggatatatcctcttccttagtgtgtactttaacatattcttttggatatggagcttaggactgctc

SEQ ID NO: 35302 - DNA, 203 bp, Homo sapiens
atctggctcatggaccctaaaaactgtgttctgaaggagaagagtgtcatgagatggcccatttgctcacaggacagcagcgttacaaccccaagacgccatggcccccatccccaagcagggagtccccagatagtgttgtgaaggagtcaaccagttccggagatggaggctgagctactgtgaggtcagtggccccagct

SEQ ID NO: 35303 - DNA, 518 bp, Homo sapiens
cccaaagtgctgggatgagccactgcgactggccccacttaatgggttttcagaggtgggagcaaagaatgaagggaggaagagagctcccatcttttccattactgtatttacttaaaactggaaaaaactgaatcactgggatggtatttcatttatcttttgaaatgaagaatagatacattaatttaaatgattctctaaagactgtccttcagcatccctaaagcatttcaacactataggcacagtttttattttatctttctggcacctggtttgggctttgggcttagattaaaaagacgagccttctcctgcccctgctcccttttattctctgccatctgctaagctcgactttttatctctcaggccaaatttgactctgcaagggactttgcataacgtttcatcctcagaatcgctaatgatgggcagaggactgttacatttgttgggagggattgaagtatatgacctcagtgccacttaaaaaataaatactgtctcaacta

SEQ ID NO: 35304 - DNA, 581 bp, Homo sapiens
tacacttgaatgaaaaagaatgtacaggtgcacatgaatacagtttgattgtgggtgtatattatatccttatgacctaatttctctttttcatttctcccacaaatgatcctgttctcagacacattctcccttgggccacaatagagctgccactgctcctcataccctctcagcttcaaatttatgaactctcaatgcaggtttcattggttcccactaggtaacattctcattcctaaatcaatcccctgggaaatgcaattcagtaatgggtttaagtctggtcttaggttccgcacctgccgtatggcagtggggtgatggctatccatgcttgaacattcctggaatgttctccaagcaaaagctcagagaaatgaaggtcatgttcagggaacagtgaggtcagaataaaattgggatgaaaggcgagggtcagattaggaaatatctgaaacttcagcctaagtaatgtgccttcaaggaagctatagattgtaaaaattaaaaatatataccaggataaacaaactatggtacatccatacaatagaatattactcagcaaaaaaaaaaaa

SEQ ID NO: 35305 - DNA, 716 bp, Homo sapiens
ttttgtagagatggaggtctcactgtgttgtcccagctggtctctagcttctggcctcaaaggatcctcccgccttggcctcccaaagtagtggaattacaggcatgagcactgacccctgctgagccaggctgttttcaacattcaatggtcattgactatctttggcgtttaggagggccctccagggaccaggcgtaggggcatcagtcaccccgccctcacaccccaacctgcagccacacttggttcaatcccactgtctagcccgtctgactcagtagcccctcccgagggagcagggctaagcaaagctggtttccccactgcaaggcactgcaggccattctattctgggccttctcatccttcataaagtgaggaggcctgaacagggctccccactaaccctgagagcgcacaattcctgaagatttccaggattttcttagtatcagttatggcttaaagttatgttggtttcacatttccagggtttgtcaaccctgtcagatttaaagataagcattattagccaggtgtggccccatgcttgtagtcccagctacatcggaggctgaggcaggaagatccctccaggccgtgagtttggggcagcaatgaactgtgattgcatcactgtgctctagaccaagtgacagagcaagactcagtctctaaacccccctcccccaccactcaaaaaaaaaaaaaag

SEQ ID NO: 35306 - DNA, 483 bp, Homo sapiens
tgtaactcagtaagaaaccagctggagcagcaaagggagtgtcatccctcccccaactctggcaacacagctcacaattctgggagaattcctccagcttgaggaaaagagagagaagagtaaagagaactttgtcttgcaacttcggtaacagctcagccgtagtacaataaagcacaaatctaatccataaagaccccaatactaggacatagctcccagatgacatttctagactcaccctgggccagaagggaacctgcggccctgaaatgaaagacctaggcgtggcaggattcagtacctctgactaaagagcccttgagcatttgaatatacagcagccatagccagacactagttcaccaaaggccttgggcaagacccagtactgtgctagcctcagctgtgaccaagaagagtcccagcaatggtagtcacaggagggcttgtgacaccccttctccaacttcaggcagctca

SEQ ID NO: 35307 - DNA, 395 bp, Homo sapiens
ctaaaccttggctttctagccgtagaaccttgaggagtggagattacagaaaggagacatctgagttagatatcctttaaatgtgtgtatgaagttctgggctcatccctgagctgcacatgcataaaactgactagaatgagcacagcaaaaccttttgagaattttagaaggaccaagtctcagcataatattcaaaatctgtaggatatgaaccaaaattatccaacatacaaagaaccaggaaagcctaaaaaattctcgaggaaaaaggcaatcaacaaatgccaaccctgagaggattcaaatgttagaattattagacaaagactttaaagcaactattatgccacattctaagaagtaaaaatgagtactcttggaattaatggaaa

SEQ ID NO: 35308 - DNA, 5091 bp, Homo sapiens
  misc_feature (2613)..(2613): n is a, c, g, or t
  misc_feature (2688)..(2688): n is a, c, g, or t
accctgaggggagccgctgaccagcagcatggaggaccccgccgcgcctgggaccgggggcccgcccgcaaatggcaatggcaacggcggcggcaaagggaagcaggcggcgcccaagggccgcgaagcgttccgaagccagcggcgggagtcagagggctctgtggactgtcccactctggagtttgagtatggagatgcagatgggcatgcagccgagttgtcagaattgtatagttacactgagaacctggaattcaccaataacaggaggtgctttgaagaagatttcaagactcaagtgcagggcaaggaatggctggagttggaagaagatgcccaaaaggcctatataatgggactcttggaccggctagaggtggtcagtagggaacggcggctgaaggtggcccgggctgttctctacctggcccaaggtacttttggggaatgtgattcagaggtcgatgtgctacactggtccaggtacaactgcttcctgctgtatcagatggggaccttctccaccttcctggagctactccacatggaaattgacaacagccaggcctgtagcagtgcccttcggaaaccagctgtctccatagctgatagcacagagctcagggtgctgctgagtgttatgtacctaatggtggaaaatattcgcctggagcgagagacagacccctgtgggtggagaacagcccgggagaccttccgcactgaattaagcttctccatgcataatgaggagccttttgcccttttactcttctccatggttaccaagttctgcagtggcctggctcctcacttccccataaagaaggtcctgctcctgctctggaaggtggtcatgtttaccctcggtggatttgagcatctgcagactctcaaagtacagaagcgggcagaattgggcctgcctccactggctgaagacagtatccaggtggtgaagagcatgcgtgctgcctccccgccctcttacactcttgacctgggagagtctcagctggcacccccaccctccaagctgcgaggccgccgtggctctcgaaggcaactcctcactaagcaggacagcctggacatctacaatgaaagggatctcttcaagactgaggagcccgccacagaggaggaagaggagtctgctggtgatggagaacgaaccttggatggagagctagacctgctagagcaggaccctctggtgccacctccaccctcacaggcacccctctctgctgagcgggtggcttttcccaagggcctgccctgggccccaaaggtcagacagaaggacattgagcacttcttggagatgagcaggaacaagttcatcggattcaccctggggcaggacacagatacattggttggattacccaggcccatccatgagagtgtgaagaccctaaagcagcacaagtatatctccatcgcagatgtgcagatcaagaatgaagaggagctggagaagtgccctatgtctttgggggaagaggtggtaccagagacgccatgtgaaatcctctaccagggaatgctgtacagccttccgcagtatatgatcgctctgcttaagattctgctggctgcagctcccacctctaaggctaagacagactctatcaatatcctggcagatgtcctacctgaggagatgcccatcactgttctccagagcatgaagctgggcatcgatgtgaacaggcacaaggagattattgtaaagagtatctctaccctgcttctgctactcctcaaacacttcaaactcaaccatatctaccagtttgaatatgtatcgcaacatttggtatttgccaactgcatccccttgatcctgaagttcttcaatcaaaatatcttgtcatacatcactgccaaaaacagcatctcagtcctggattatccttgctgtaccatccaggatttgccggagcttactactgaaagtctggaagctggagacaacagccagttctgctggaggaacctcttttcctgcatcaacctcctgaggctgctcaataaactgaccaaatggaaacattcccggaccatgatgctggtagtgtttaaatcggcaccaatcttaaagcgggccctcaaggtcaaacaggccatgctgcaactttatgtcctaaagctactaaagttacagaccaagtacctggggcgccaatggaggaaaagcaacatgaaaaccatgtcagccatttaccagaaagtgcgtcaccgcatgaacgatgactgggcttacgggaatgacatcgatgccagaccatgggacttccaagcagaagaatgtaccttgagggccaacattgaggcttttaacagccgtcgctatgacagaccccaggactctgagttttcacctgtggataactgcttgcagagcgtactggggcagaggttggatctgcctgaagatttccactattcatatgagctctggctcgagagagaggtgttttcacagcccatctgttgggaggagctgctccagaatcactgactaagttcttgtcaacaagcatcaatagatagaggtcagctccaataaactgtgctctgcctaccctgtccatacaggcnctgttaccagttcagggctcttctgggggctcttgggcctaaagatggtgcaagggtgggatcctgaatcacaanaaaatgatcaacttgccctggggtcagttgggtgcccagttggccttggaaatcttttggtggatcaattctagacaagctctttggtaggaccttttcctgctttagtcttggctacaaccaggctagactttgctggctctaaaagaggaaatttgttatggcatttgacccatggcattcatcacagatagtgggaggtacaagtcataaaatagggagaaagttttcttcttgctcacactggattcctaggacttatcagagatttggaaaaaccaactttgaaattaagtttgcattttaaatttcaaatttggaagcctctttctgaaatcattagctctaagattattttagagcacctgcaccttctttgtgaaggatgatgatttactattccctcaatactgcatgttatcgaaaagtgtgttgtgtaaagtgtttttttcctcattctgtaagagatctatattcaatgtgaaaattatttccttgtgtactctgtatagggcatggaatgctctgccatttttaaagagccacaaccaatatgaaataattaggtcctctctaaggatgtttcatgtttttcttaaatgactccagtcttcaaatggctgagcatactgcagaaaattatccttttcatctaattcattttttaaatgacaagttaactacaggaggctttattcagatggtatgtccacttgtggtcgtgatcaatatatttttctaattgaaaagtaaaagcatcacagcttaccatttttctttttctgcagtgttgattaatgatttttttcccgtttattgctagcagtttcaaagtgtcatgtggagatttagcaatactgtctctacttaaaagtattgcacatttcattgaaaatgtgagagttgatataccagcctctttatatttctcttttacagcagaatcacatacttctcaagataaacaaggtttttaaaaaagtttctgatttagttaggatcatatgctttttttttttttttttttttttttgagacagagtttcgctcttgttgcccaagctggagtgcaatggcacgatctcggctcactgcaacctccgcctcccgggttcaagcgattctcctgcctcagcctcccaaggagctgggattacaggcacgcaccaccatgcctggctaattttttgtatttttagtagaaacagggtttcaccatgttagccaggctgacctcaaactcctgacctcaggtgatccgcccgcctccacctcccagggtgctgggattacaggtgtgagccaccatgcccagcctcttcaagcttttttactatacatgttgcccctctcccccaacttaggcactactgaattttttatgatggcaccaggtcactttatgctgggtgatatagtcaaaatttgcttatttactctgcccctcgtcaaccacagtatcatttcaaggacatgaataaaatacttgacagtatccaaaggagctataccaaaatctaacaagtaaattttggattttgcctctttgtgctttaaagtaccaggatttctgtctctatggataggtcttggagaatgttaagtaatggatgaaactttttaaaataatttgtaaattttacctaagtaggacagtagtccttactgcaatcaaaataatttactgagcacaactcctgtaaattaatctacagtcaggctagtatgattttaatatgatttgagtaaaaagataattttcaaggaaagagtaatcatccatcaatttattataaagccagatagtattcaatttatgtcaagaacaaagaaattgcccttttaaaagcatgtacgtgaatgctttttgaggcacagaagtatgctaagctttaacattttgtatttatttacaacccttttctaagggaaggttacttctcagtgcagatggagaaactgaagcactaaggataaatgattagtttccaatcacatcatttttttccacagacttgctgggactagctttcaggtattgacagccagccccatatattaaggtaaccaggttgaatcttccaatttgagaacccatgtatgggttgcagtgagccgagatcatgccactgcactccatcctgggcaacaagaacgaaactccgtctcaaaaacaaagaaggatataataaagttaatatataaaccatgtatgtggttaggaataaattcaaattcaccagtctccaatggtgattacttttactacatagaaaaacattttagtgacttacagaggatttttatttgtgaatatttcagtaaagtttgtgttgattgttgataacactgttcatctactgaagcactttaataaaaataaaatgagctggaattagaaaa

SEQ ID NO: 35309 - DNA, 353 bp, Homo sapiens
aaccggcccaggtcggaaacggagcaggtcaaaactcccgtgctgatcagtagtgggatcgcgcctgtgaatcatgccactgcactccatcctgggcaacaagaacgaaactccgtctcaaaaacaaagaaggatataataaagttaatatataaaccatgtatgtggttaggaataaattcaaattcaccagtctccaatggtgattacttttactacatagaaaaacattttagtgacttacagaggatttttatttgtgaatatttcagtaaagtttgtgttgattgttgataacactgttcatctactgaagcactttaataaaaataaaatgagctggaattagaaaa

SEQ ID NO: 35310 - DNA, 574 bp, Homo sapiens
atgtgaatgaggccctcagcccttgttgatgtcttcttatctttgtcagcacaagtatatctccatcgcagatgtgcagatcaagaatgaagaggagctggagaagtgccctatgtctttggtgagccaaggaagccctacacaggaggagagtagaagaaaacctgtcttcagtgttgtcacagagcatgtgtgcatgcattcattcagcatattaggctgtaactgtgttccaggcaagacaaggtccctactttcatgatatattgaagttggggaagaaagataaaaaataaaaagttaagtaaaccaaactatcagagaatggtaaataaaaaaaaaaaaagaaaaaacaacacaaaaaaaaccgtgggtggcccgacagtgggacccccgaaaaagaagcttctcgaagaacacacaatagtgatgtgaggccgccgcgaggccccccacgtagagggcacaatgagaacaagtggggcgcccaagaggaggggtacccgaagagaagaagccgcgggccacgaaacaaggaggccgggagaatccccacccagattaaaaaaaggcc

SEQ ID NO: 35311 - DNA, 4215 bp, Homo sapiens
  misc_feature (1737)..(1737): n is a, c, g, or t
  misc_feature (1812)..(1812): n is a, c, g, or t
gaacttcttgtcctgttattgggccgggtggggacagtaggttaaggtggggaattggatgttttcgcaagggctgtgttcagattccatgttccctgaaatgtggaggcctgtggatatggggtggcctcagacaaggatgcccagagtgagatctctgcatgcctaccctcccttctttcccctccagcaactcctcactaagcaggacagcctggacatctacaatgaaagggatctcttcaagactgaggagcccgccacagaggaggaagaggagtctgctggtgatggagaacgaaccttggatggagagctagacctgctagagcaggaccctctggtgccacctccaccctcacaggcacccctctctgctgagcgggtggcttttcccaagggcctgccctgggccccaaaggtcagacagaaggacattgagcacttcttggagatgagcaggaacaagttcatcggattcaccctggggcaggacacagatacattggttggattacccaggcccatccatgagagtgtgaagaccctaaagcagcacaagtatatctccatcgcagatgtgcagatcaagaatgaagaggagctggagaagtgccctatgtctttgggggaagaggtggtaccagagacgccatgtgaaatcctctaccagggaatgctgtacagccttccgcagtatatgatcgctctgcttaagattctgctggctgcagctcccacctctaaggctaagacagactctatcaatatcctggcagatgtcctacctgaggagatgcccatcactgttctccagagcatgaagctgggcatcgatgtgaacaggcacaaggagattattgtaaagagtatctctaccctgcttctgctactcctcaaacacttcaaactcaaccatatctaccagtttgaatatgtatcgcaacatttggtatttgccaactgcatccccttgatcctgaagttcttcaatcaaaatatcttgtcatacatcactgccaaaaacagcatctcagtcctggattatccttgctgtaccatccaggatttgccggagcttactactgaaagtctggaagctggagacaacagccagttctgctggaggaacctcttttcctgcatcaacctcctgaggctgctcaataaactgaccaaatggaaacattcccggaccatgatgctggtagtgtttaaatcggcaccaatcttaaagcgggccctcaaggtcaaacaggccatgctgcaactttatgtcctaaagctactaaagttacagaccaagtacctggggcgccaatggaggaaaagcaacatgaaaaccatgtcagccatttaccagaaagtgcgtcaccgcatgaacgatgactgggcttacgggaatgacatcgatgccagaccatgggacttccaagcagaagaatgtaccttgagggccaacattgaggcttttaacagccgtcgctatgacagaccccaggactctgagttttcacctgtggataactgcttgcagagcgtactggggcagaggttggatctgcctgaagatttccactattcatatgagctctggctcgagagagaggtgttttcacagcccatctgttgggaggagctgctccagaatcactgactaagttcttgtcaacaagcatcaatagatagaggtcagctccaataaactgtgctctgcctaccctgtccatacaggcnctgttaccagttcagggctcttctgggggctcttgggcctaaagatggtgcaagggtgggatcctgaatcacaanaaaatgatcaacttgccctggggtcagttgggtgcccagttggccttggaaatcttttggtggatcaattctagacaagctctttggtaggaccttttcctgctttagtcttggctacaaccaggctagactttgctggctctaaaagaggaaatttgttatggcatttgacccatggcattcatcacagatagtgggaggtacaagtcataaaatagggagaaagttttcttcttgctcacactggattcctaggacttatcagagatttggaaaaaccaactttgaaattaagtttgcattttaaatttcaaatttggaagcctctttctgaaatcattagctctaagattattttagagcacctgcaccttctttgtgaaggatgatgatttactattccctcaatactgcatgttatcgaaaagtgtgttgtgtaaagtgtttttttcctcattctgtaagagatctatattcaatgtgaaaattatttccttgtgtactctgtatagggcatggaatgctctgccatttttaaagagccacaaccaatatgaaataattaggtcctctctaaggatgtttcatgtttttcttaaatgactccagtcttcaaatggctgagcatactgcagaaaattatccttttcatctaattcattttttaaatgacaagttaactacaggaggctttattcagatggtatgtccacttgtggtcgtgatcaatatatttttctaattgaaaagtaaaagcatcacagcttaccatttttctttttctgcagtgttgattaatgatttttttcccgtttattgctagcagtttcaaagtgtcatgtggagatttagcaatactgtctctacttaaaagtattgcacatttcattgaaaatgtgagagttgatataccagcctctttatatttctcttttacagcagaatcacatacttctcaagataaacaaggtttttaaaaaagtttctgatttagttaggatcatatgctttttttttttttttttttttttttgagacagagtttcgctcttgttgcccaagctggagtgcaatggcacgatctcggctcactgcaacctccgcctcccgggttcaagcgattctcctgcctcagcctcccaaggagctgggattacaggcacgcaccaccatgcctggctaattttttgtatttttagtagaaacagggtttcaccatgttagccaggctgacctcaaactcctgacctcaggtgatccgcccgcctccacctcccagggtgctgggattacaggtgtgagccaccatgcccagcctcttcaagcttttttactatacatgttgcccctctcccccaacttaggcactactgaattttttatgatggcaccaggtcactttatgctgggtgatatagtcaaaatttgcttatttactctgcccctcgtcaaccacagtatcatttcaaggacatgaataaaatacttgacagtatccaaaggagctataccaaaatctaacaagtaaattttggattttgcctctttgtgctttaaagtaccaggatttctgtctctatggataggtcttggagaatgttaagtaatggatgaaactttttaaaataatttgtaaattttacctaagtaggacagtagtccttactgcaatcaaaataatttactgagcacaactcctgtaaattaatctacagtcaggctagtatgattttaatatgatttgagtaaaaagataattttcaaggaaagagtaatcatccatcaatttattataaagccagatagtattcaatttatgtcaagaacaaagaaattgcccttttaaaagcatgtacgtgaatgctttttgaggcacagaagtatgctaagctttaacattttgtatttatttacaacccttttctaagggaaggttacttctcagtgcagatggagaaactgaagcactaaggataaatgattagtttccaatcacatcatttttttccacagacttgctgggactagctttcaggtattgacagccagccccatatattaaggtaaccaggttgaatcttccaatttgagaacccatgtatgggttgcagtgagccgagatcatgccactgcactccatcctgggcaacaagaacgaaactccgtctcaaaaacaaagaaggatataataaagttaatatataaaccatgtatgtggttaggaataaattcaaattcaccagtctccaatggtgattacttttactacatagaaaaacattttagtgacttacagaggatttttatttgtgaatatttcagtaaagtttgtgttgattgttgataacactgttcatctactgaagcactttaataaaaataaaatgagctggaattagaaaa

SEQ ID NO: 35312 - DNA, 4911 bp, Homo sapiens
  misc_feature (2613)..(2613): n is a, c, g, or t
  misc_feature (2688)..(2688): n is a, c, g, or t
accctgaggggagccgctgaccagcagcatggaggaccccgccgcgcctgggaccgggggcccgcccgcaaatggcaatggcaacggcggcggcaaagggaagcaggcggcgcccaagggccgcgaagcgttccgaagccagcggcgggagtcagagggctctgtggactgtcccactctggagtttgagtatggagatgcagatgggcatgcagccgagttgtcagaattgtatagttacactgagaacctggaattcaccaataacaggaggtgctttgaagaagatttcaagactcaagtgcagggcaaggaatggctggagttggaagaagatgcccaaaaggcctatataatgggactcttggaccggctagaggtggtcagtagggaacggcggctgaaggtggcccgggctgttctctacctggcccaaggtacttttggggaatgtgattcagaggtcgatgtgctacactggtccaggtacaactgcttcctgctgtatcagatggggaccttctccaccttcctggagctactccacatggaaattgacaacagccaggcctgtagcagtgcccttcggaaaccagctgtctccatagctgatagcacagagctcagggtgctgctgagtgttatgtacctaatggtggaaaatattcgcctggagcgagagacagacccctgtgggtggagaacagcccgggagaccttccgcactgaattaagcttctccatgcataatgaggagccttttgcccttttactcttctccatggttaccaagttctgcagtggcctggctcctcacttccccataaagaaggtcctgctcctgctctggaaggtggtcatgtttaccctcggtggatttgagcatctgcagactctcaaagtacagaagcgggcagaattgggcctgcctccactggctgaagacagtatccaggtggtgaagagcatgcgtgctgcctccccgccctcttacactcttgacctgggagagtctcagctggcacccccaccctccaagctgcgaggccgccgtggctctcgaaggcaactcctcactaagcaggacagcctggacatctacaatgaaagggatctcttcaagactgaggagcccgccacagaggaggaagaggagtctgctggtgatggagaacgaaccttggatggagagctagacctgctagagcaggaccctctggtgccacctccaccctcacaggcacccctctctgctgagcgggtggcttttcccaagggcctgccctgggccccaaaggtcagacagaaggacattgagcacttcttggagatgagcaggaacaagttcatcggattcaccctggggcaggacacagatacattggttggattacccaggcccatccatgagagtgtgaagaccctaaagcagcacaagtatatctccatcgcagatgtgcagatcaagaatgaagaggagctggagaagtgccctatgtctttgggggaagaggtggtaccagagacgccatgtgaaatcctctaccagggaatgctgtacagccttccgcagtatatgatcgctctgcttaagattctgctggctgcagctcccacctctaaggctaagacagactctatcaatatcctggcagatgtcctacctgaggagatgcccatcactgttctccagagcatgaagctgggcatcgatgtgaacaggcacaaggagattattgtaaagagtatctctaccctgcttctgctactcctcaaacacttcaaactcaaccatatctaccagtttgaatatgtatcgcaacatttggtatttgccaactgcatccccttgatcctgaagttcttcaatcaaaatatcttgtcatacatcactgccaaaaacagcatctcagtcctggattatccttgctgtaccatccaggatttgccggagcttactactgaaagtctggaagctggagacaacagccagttctgctggaggaacctcttttcctgcatcaacctcctgaggctgctcaataaactgaccaaatggaaacattcccggaccatgatgctggtagtgtttaaatcggcaccaatcttaaagcgggccctcaaggtcaaacaggccatgctgcaactttatgtcctaaagctactaaagttacagaccaagtacctggggcgccaatggaggaaaagcaacatgaaaaccatgtcagccatttaccagaaagtgcgtcaccgcatgaacgatgactgggcttacgggaatgacatcgatgccagaccatgggacttccaagcagaagaatgtaccttgagggccaacattgaggcttttaacagccgtcgctatgacagaccccaggactctgagttttcacctgtggataactgcttgcagagcgtactggggcagaggttggatctgcctgaagatttccactattcatatgagctctggctcgagagagaggtgttttcacagcccatctgttgggaggagctgctccagaatcactgactaagttcttgtcaacaagcatcaatagatagaggtcagctccaataaactgtgctctgcctaccctgtccatacaggcnctgttaccagttcagggctcttctgggggctcttgggcctaaagatggtgcaagggtgggatcctgaatcacaanaaaatgatcaacttgccctggggtcagttgggtgcccagttggccttggaaatcttttggtggatcaattctagacaagctctttggtaggaccttttcctgctttagtcttggctacaaccaggctagactttgctggctctaaaagaggaaatttgttatggcatttgacccatggcattcatcacagatagtgggaggtacaagtcataaaatagggagaaagttttcttcttgctcacactggattcctaggacttatcagagatttggaaaaaccaactttgaaattaagtttgcattttaaatttcaaatttggaagcctctttctgaaatcattagctctaagattattttagagcacctgcaccttctttgtgaaggatgatgatttactattccctcaatactgcatgttatcgaaaagtgtgttgtgtaaagtgtttttttcctcattctgtaagagatctatattcaatgtgaaaattatttccttgtgtactctgtatagggcatggaatgctctgccatttttaaagagccacaaccaatatgaaataattaggtcctctctaaggatgtttcatgtttttcttaaatgactccagtcttcaaatggctgagcatactgcagaaaattatccttttcatctaattcattttttaaatgacaagttaactacaggaggctttattcagatggtatgtccacttgtggtcgtgatcaatatatttttctaattgaaaagtaaaagcatcacagcttaccatttttctttttctgcagtgttgattaatgatttttttcccgtttattgctagcagtttcaaagtgtcatgtggagatttagcaatactgtctctacttaaaagtattgcacatttcattgaaaatgtgagagttgatataccagcctctttatatttctcttttacagcagaatcacatacttctcaagataaacaaggtttttaaaaaagtttctgatttagttaggatcatatgctttttttttttttttttttttttttgagacagagtttcgctcttgttgcccaagctggagtgcaatggcacgatctcggctcactgcaacctccgcctcccgggttcaagcgattctcctgcctcagcctcttcaagcttttttactatacatgttgcccctctcccccaacttaggcactactgaattttttatgatggcaccaggtcactttatgctgggtgatatagtcaaaatttgcttatttactctgcccctcgtcaaccacagtatcatttcaaggacatgaataaaatacttgacagtatccaaaggagctataccaaaatctaacaagtaaattttggattttgcctctttgtgctttaaagtaccaggatttctgtctctatggataggtcttggagaatgttaagtaatggatgaaactttttaaaataatttgtaaattttacctaagtaggacagtagtccttactgcaatcaaaataatttactgagcacaactcctgtaaattaatctacagtcaggctagtatgattttaatatgatttgagtaaaaagataattttcaaggaaagagtaatcatccatcaatttattataaagccagatagtattcaatttatgtcaagaacaaagaaattgcccttttaaaagcatgtacgtgaatgctttttgaggcacagaagtatgctaagctttaacattttgtatttatttacaacccttttctaagggaaggttacttctcagtgcagatggagaaactgaagcactaaggataaatgattagtttccaatcacatcatttttttccacagacttgctgggactagctttcaggtattgacagccagccccatatattaaggtaaccaggttgaatcttccaatttgagaacccatgtatgggttgcagtgagccgagatcatgccactgcactccatcctgggcaacaagaacgaaactccgtctcaaaaacaaagaaggatataataaagttaatatataaaccatgtatgtggttaggaataaattcaaattcaccagtctccaatggtgattacttttactacatagaaaaacattttagtgacttacagaggatttttatttgtgaatatttcagtaaagtttgtgttgattgttgataacactgttcatctactgaagcactttaataaaaataaaatgagctggaattagaaaa

SEQ ID NO: 35313 - DNA, 2780 bp, Homo sapiens
accctgaggggagccgctgaccagcagcatggaggaccccgccgcgcctgggaccgggggcccgcccgcaaatggcaatggcaacggcggcggcaaagggaagcaggcggcgcccaagggccgcgaagcgttccgaagccagcggcgggagtcagagggctctgtggactgtcccactctggagtttgagtatggagatgcagatgggcatgcagccgagttgtcagaattgtatagttacactgagaacctggaattcaccaataacaggaggtgctttgaagaagatttcaagactcaagtgcagggcaaggaatggctggagttggaagaagatgcccaaaaggcctatataatgggactcttggaccggctagaggtggtcagtagggaacggcggctgaaggtggcccgggctgttctctacctggcccaaggtacttttggggaatgtgattcagaggtcgatgtgctacactggtccaggtacaactgcttcctgctgtatcagatggggaccttctccaccttcctggagctactccacatggaaattgacaacagccaggcctgtagcagtgcccttcggaaaccagctgtctccatagctgatagcacagagctcagggtgctgctgagtgttatgtacctaatggtggaaaatattcgcctggagcgagagacagacccctgtgggtggagaacagcccgggagaccttccgcactgaattaagcttctccatgcataatgaggagccttttgcccttttactcttctccatggttaccaagttctgcagtggcctggctcctcacttccccataaagaaggtcctgctcctgctctggaaggtggtcatgtttaccctcggtggatttgagcatctgcagactctcaaagtacagaagcgggcagaattgggcctgcctccactggctgaagacagtatccaggtggtgaagagcatgcgtgctgcctccccgccctcttacactcttgacctgggagagtctcagctggcacccccaccctccaagctgcgaggccgccgtggctctcgaaggcaactcctcactaagcaggacagcctggacatctacaatgaaagggatctcttcaagactgaggagcccgccacagaggaggaagaggagtctgctggtgatggagaacgaaccttggatggagagctagacctgctagagcaggaccctctggtgccacctccaccctcacaggcacccctctctgctgagcgggtggcttttcccaagggcctgccctgggccccaaaggtcagacagaaggacattgagcacttcttggagatgagcaggaacaagttcatcggattcaccctggggcaggacacagatacattggttggattacccaggcccatccatgagagtgtgaagaccctaaagcagcacaagtatatctccatcgcagatgtgcagatcaagaatgaagaggagctggagaagtgccctatgtctttgggggaagaggtggtaccagagacgccatgtgaaatcctctaccagggaatgctgtacagccttccgcagtatatgatcgctctgcttaagattctgctggctgcagctcccacctctaaggctaagacagactctatcaatatcctggcagatgtcctacctgaggagatgcccatcactgttctccagagcatgaagctgggcatcgatgtgaacaggcacaaggagattattgtaaagagtatctctaccctgcttctgctactcctcaaacacttcaaactcaaccatatctaccagtttgaatatgtatcgcaacatttggtatttgccaactgcatccccttgatcctgaagttcttcaatcaaaatatcttgtcatacatcactgccaaaaacagcatctcagtcctggattatccttgctgtaccatccaggatttgccggagcttactactgaaagtctggaagctggagacaacagccagttctgctggaggaacctcttttcctgcatcaacctcctgaggctgctcaataaactgaccaaatggaaacattcccggaccatgatgctggtagtgtttaaatcggcaccaatcttaaagcgggccctcaaggtcaaacaggccatgctgcaactttatgtcctaaagctactaaagttacagaccaagtacctggggcgccaatggaggaaaagcaacatgaaaaccatgtcagccatttaccagaaagtgcgtcaccgcatgaacgatgactgggcttacgggaatggtgagtcttcccaaagctcttgacttcctggagtttcctggggtttagacaaaactaaataaatatttatcactcctcttttggcatgaattgttacatattttagatgaaaaaatatgtgattataggtcaggcgctgatacaccaaactttaaggttatgcctcaaattctagtatgtacccttgtcctatgtaaactatgaaaatccgttttataaaacaagtaaattgagagataattaattgcctttccaaaacattcttttaaatgacagctttctccaaaagatttaaattaaaacaactttttattattacaaagcagttagaaaaaaagatagaaaatacaagtaaacaaacattttactatattatatttatgccatatttgtactatgcagaaattgccaccattaacatcttattgtatattcctccagatctttttctatgcatatacatgcatattttatcaaaatgaaagcaagttatgtatg

SEQ ID NO: 35314 - DNA, 1957 bp, Homo sapiens
accctgaggggagccgctgaccagcagcatggaggaccccgccgcgcctgggaccgggggcccgcccgcaaatggcaatggcaacggcggcggcaaagggaagcaggcggcgcccaagggccgcgaagcgttccgaagccagcggcgggagtcagagggctctgtggactgtcccactctggagtttgagtatggagatgcagatgggcatgcagccgagttgtcagaattgtatagttacactgagaacctggaattcaccaataacaggaggtgctttgaagaagatttcaagactcaagtgcagggcaaggaatggctggagttggaagaagatgcccaaaaggcctatataatgggactcttggaccggctagaggtggtcagtagggaacggcggctgaaggtggcccgggctgttctctacctggcccaaggtacttttggggaatgtgattcagaggtcgatgtgctacactggtccaggtacaactgcttcctgctgtatcagatggggaccttctccaccttcctggagctactccacatggaaattgacaacagccaggcctgtagcagtgcccttcggaaaccagctgtctccatagctgatagcacagagctcagggtgctgctgagtgttatgtacctaatggtggaaaatattcgcctggagcgagagacagacccctgtgggtggagaacagcccgggagaccttccgcactgaattaagcttctccatgcataatgaggagccttttgcccttttactcttctccatggttaccaagttctgcagtggcctggctcctcacttccccataaagaaggtcctgctcctgctctggaaggtggtcatgtttaccctcggtggatttgagcatctgcagactctcaaagtacagaagcgggcagaattgggcctgcctccactggctgaagacagtatccaggtggtgaagagcatgcgtgctgcctccccgccctcttacactcttgacctgggagagtctcagctggcacccccaccctccaagctgcgaggccgccgtggctctcgaaggcaactcctcactaagcaggacagcctggacatctacaatgaaagggatctcttcaagactgaggagcccgccacagaggaggaagaggagtctgctggtgatggagaacgaaccttggatggagagctagacctgctagagcaggaccctctggtgccacctccaccctcacaggcacccctctctgctgagcgggtggcttttcccaagggcctgccctgggccccaaaggtcagacagaaggacattgagcacttcttggagatgagcaggaacaagttcatcggattcaccctggggcaggacacagatacattggttggattacccaggcccatccatgagagtgtgaagaccctaaagcagcacaagtatatctccatcgcagatgtgcagatcaagaatgaagaggagctggagaagtgccctatgtctttggtgagccaaggaagccctacacaggaggagagtagaagaaaacctgtcttcagtgttgtcacagagcatgtgtgcatgcattcattcagcatattaggctgtaactgtgttccaggcaagacaaggtccctactttcatgatatattgaagttggggaagaaagataaaaaataaaaagttaagtaaaccaaactatcagagaatggtaaataaaaaaaaaaaaagaaaaaacaacacaaaaaaaaccgtgggtggcccgacagtgggacccccgaaaaagaagcttctcgaagaacacacaatagtgatgtgaggccgccgcgaggccccccacgtagagggcacaatgagaacaagtggggcgcccaagaggaggggtacccgaagagaagaagccgcgggccacgaaacaaggaggccgggagaatccccacccagattaaaaaaaggcc

SEQ ID NO: 35315 - DNA, 320 bp, Homo sapiens
cttgctgtaccatccaggatttgccggagcttactactgaaagtctggtaagcagatggggatttggtagcctttgaaattgctaggtagcacaggttggcatttgctctttcatttcttctccaaccccttaatgccctggtttgagagtctcagatcaatgaaggtatattggcaagagcagagatgcagcaggggtttagagttgctgacccagttgagaaagatttggaaaagtttagcgtagcatttttcagagaagaggaaacagccagtgaaaaacactaaggaggaaaaggaatttagaaacataatgggac

SEQ ID NO: 35316 - DNA, 272 bp, Homo sapiens
gacaggtttgatggtttaatctcccagggacacaagtggctatttttaacgttgctctgaaaaggaggaagctagctttggattcattggacacaggaatgtgttggaagcttcagctctttcatgccaccctctctactttgggcctcttctttaaggatctcccgaatgtgactgttctgtctttcctgccacagaattgtatagttacactgagaacctggaattcaccaataacaggaggtgctttgaagaagatttcaagactcaag

SEQ ID NO: 35317 - DNA, 197 bp, Homo sapiens
tactccactcttggtcacatctaacttatttcttagtttgtcctttgttagacaagcaatccctaaatatagcacggtttctatgggaacatacattctcctgaagattccaggaacacgttttatctgaaaaataaggaactgtcagataatacgtccaaattcaggactataacccaggttttatatttttgaat

SEQ ID NO: 35318 - DNA, 1484 bp, Homo sapiens
acggggcctgggcggcaggggcggtggctggagctcggtaaagctcgtgggaccccattgggggaatttgatccaaggaagcggtgattgccgggggaggagaagctcccagatccttgtgtccacttgcagcgggggaggcggagacggcggagcgggccttttggcgtccactgcgcggctgcaccctgccccatcctgccgggatcatggtctgcggcagcccgggagggatgctgctgctgcgggccgggctgcttgccctggctgctctctgcctgctccgggtgcccggggctcgggctgcagcctgtgagcccgtccgcatccccctgtgcaagtccctgccctggaacatgactaagatgcccaaccacctgcaccacagcactcaggccaacgccatcctggccatcgagcagttcgaaggtctgctgggcacccactgcagccccgatctgctcttcttcctctgtgccatgtacgcgcccatctgcaccattgacttccagcacgagcccatcaagccctgtaagtctgtgtgcgagcgggcccggcagggctgtgagcccatactcatcaagtaccgccactcgtggccggagaacctggcctgcgaggagctgccagtgtacgacaggggcgtgtgcatctctcccgaggccatcgttactgcggacggagctgattttcctatggattctagtaacggaaactgtagaggggcaagcagtgaacgctgtaaatgtaagcctattagagctacacagaagacctatttccggaacaattacaactatgtcattcgggctaaagttaaagagataaagactaagtgccatgatgtgactgcagtagtggaggtgaaggagattctaaagtcctctctggtaaacattccacgggacactgtcaacctctataccagctctggctgcctctgccctccacttaatgttaatgaggaatatatcatcatgggctatgaagatgaggaacgttccagattactcttggtggaaggctctatagctgagaagtggaaggatcgactcggtaaaaaagttaagcgctgggatatgaagcttcgtcatcttggactcagtaaaagtgattctagcaatagtgattccactcagagtcagaagtctggcaggaactcgaacccccggcaagcacgcaactaaatcccgaaatacaaaaagtaacacagtggacttcctattaagacttacttgcattgctggactagcaaaggaaaattgcactattgcacatcatattctattgtttactataaaaatcatgtgataactgattattacttctgtttctcttttggtttctgcttctctcttctctcaacccctttgtaatggtttgggggcagactcttaagtatattgtgagttttctatttcactaatcatgagaaaaactgttcttttgcaataataataaattaaacatgctgttaccagagc

SEQ ID NO: 35319 - DNA, 455 bp, Homo sapiens
  misc_feature (455)..(455): n is a, c, g, or t
ctagaggatcccggtacattctttgcactgcggacggagctgattttcctatggattctagtaacggaaactgtagaggggcaagcagtgaacgctgtaaatgtaagcctattagagctacacagaagacctatttccggaacaattacaactatgtcattcgggctaaagttaaagagataaagactaagtgccatgatgtgactgcagtagtggaggtgaaggagattctaaagtcctctctggtaaacattccacgggacactgtcaacctctataccagctctggctgcctctgccctccacttaatgttaatgaggaatatatcatcatgggctatgaagatgaggaacgttccagattactcttggtggaaggctctatagctgagaagtggaaggatcgactcggtaaaaaagttaagccatggatgttaaggttccgtcactttgan

SEQ ID NO: 35320 - DNA, 2766 bp, Homo sapiens
acggggcctgggcggcaggggcggtggctggagctcggtaaagctcgtgggaccccattgggggaatttgatccaaggaagcggtgattgccgggggaggagaagctcccagatccttgtgtccacttgcagcgggggaggcggagacggcggagcgggccttttggcgtccactgcgcggctgcaccctgccccatcctgccgggatcatggtctgcggcagcccgggagggatgctgctgctgcgggccgggctgcttgccctggctgctctctgcctgctccgggtgcccggggctcgggctgcagcctgtgagcccgtccgcatccccctgtgcaagtccctgccctggaacatgactaagatgcccaaccacctgcaccacagcactcaggccaacgccatcctggccatcgagcagttcgaaggtctgctgggcacccactgcagccccgatctgctcttcttcctctgtgccatgtacgcgcccatctgcaccattgacttccagcacgagcccatcaagccctgtaagtctgtgtgcgagcgggcccggcagggctgtgagcccatactcatcaagtaccgccactcgtggccggagaacctggcctgcgaggagctgccagtgtacgacaggggcgtgtgcatctctcccgaggccatcgttactgcggacggagctgattttcctatggattctagtaacggaaactgtagaggggcaagcagtgaacgctgtaaatgtaagcctattagagctacacagaagacctatttccggaacaattacaactatgtcattcgggctaaagttaaagagataaagactaagtgccatgatgtgactgcagtagtggaggtgaaggagattctaaagtcctctctggtaaacattccacgggacactgtcaacctctataccagctctggctgcctctgccctccacttaatgttaatgaggaatatatcatcatgggctatgaagatgaggaacgttccagattactcttggtggaaggctctatagctgagaagtggaaggatcgactcggtaaaaaagttaagcgctgggatatgaagcttcgtcatcttggactcagtaaaagtgattctagcaatagtgattccactcagagtcagaagtctggcaggaactcgaacccccggcaagcacgcaactaaatcccgaaatacaaaaagtaacacagtggacttcctattaagacttacttgcattgctggactagcaaaggaaaattgcactattgcacatcatattctattgtttactataaaaatcatgtgataactgattattacttctgtttctcttttggtttctgcttctctcttctctcaacccctttgtaatggtttgggggcagactcttaagtatattgtgagttttctatttcactaatcatgagaaaaactgttcttttgcaataataataaattaaacatgctgttaccagagcctctttgctggagtctccagatgttaatttactttctgcaccccaattgggaatgcaatattggatgaaaagagaggtttctggtattcacagaaagctagatatgccttaaaacatactctgccgatctaattacagccttatttttgtatgccttttgggcattctcctcatgcttagaaagttccaaatgtttataaaggtaaaatggcagtttgaagtcaaatgtcacataggcaaagcaatcaagcaccaggaagtgtttatgaggaaacaacacccaagatgaattatttttgagactgtcaggaagtaaaataaataggagcttaagaaagaacattttgcctgattgagaagcacaactgaaaccagtagccgctggggtgttaatggtagcattcttcttttggcaatacatttgatttgttcatgaatatattaatcagcattagagaaatgaattataactagacatctgctgttatcaccatagttttgtttaatttgcttccttttaaataaacccattggtgaaagtctttttttttctcttcttttaaaataaatcagaattgccgtattgaccaggaaaagattatgtatgcacgtgcaccagggttagtttttaaaagtacatggctccataaaaatgctgtagattacagagtgataaaatatgcaggtttttttgtttttgttttttctgttgtgtgtgtgtctgtatttgtgtacatgtgtgtccttgcactcacacccaaggtggattaaaatacaggcctgcaaactggcctgcactttatcatttggatttgtgctgcttaatgctcagcgaaaaatgtctagtaaaatgaattatggttgtcaggagagaggttatttcgacttttgaaccaattgcacatttctcattacccaagctgtggtgagatcccaggggctgtggtgaacaaatgatgcttttatagatggtccctagcttacaatgattcaatttacaatgcttcaatttaacaatttgttgacttacaatgggtttatcaggatgtaacccaatgcatttcaacttacgatattttcagtttcgaatgggtttatccagatgtaaccccatcgtaaatggcggagcatctgtacttccttcctctggcagagttccttagagcctgtgccaattacttgaaagtctcattctctgccatttacatgtgtgctattagtagaaccaaatttctaagctgtggcgtgctgaaaataaaatgcttatgaagcaaaaaaaaaa

SEQ ID NO: 35321 - DNA, 2322 bp, Homo sapiens
acggggcctgggcggcaggggcggtggctggagctcggtaaagctcgtgggaccccattgggggaatttgatccaaggaagcggtgattgccgggggaggagaagctcccagatccttgtgtccacttgcagcgggggaggcggagacggcggagcgggccttttggcgtccactgcgcggctgcaccctgccccatcctgccgggatcatggtctgcggcagcccgggagggatgctgctgctgcgggccgggctgcttgccctggctgctctctgcctgctccgggtgcccggggctcgggctgcagcctgtgagcccgtccgcatccccctgtgcaagtccctgccctggaacatgactaagatgcccaaccacctgcaccacagcactcaggccaacgccatcctggccatcgagcagttcgaaggtctgctgggcacccactgcagccccgatctgctcttcttcctctgtgccatgtacgcgcccatctgcaccattgacttccagcacgagcccatcaagccctgtaagtctgtgtgcgagcgggcccggcagggctgtgagcccatactcatcaagtaccgccactcgtggccggagaacctggcctgcgaggagctgccagtgtacgacaggggcgtgtgcatctctcccgaggccatcgttactgcggacggagctgattttcctatggattctagtaacggaaactgtagaggggcaagcagtgaacgctgtaaatgtaagcctattagagctacacagaagacctatttccggaacaattacaactatgtcattcgggctaaagttaaagagataaagactaagtgccatgatgtgactgcagtagtggaggtgaaggagattctaaagtcctctctggtaaacattccacgggacactgtcaacctctataccagctctggctgcctctgccctccacttaatgttaatgaggaatatatcatcatgggctatgaagatgaggaacgttccagattactcttggtggaaggctctatagctgagaagtggaaggatcgactcggtaaaaaagttaagcgctgggatatgaagcttcgtcatcttggactcagtaaaagtgattctagcaatagtgattccactcagagtcagaagtctggcaggaactcgaacccccggcaagcacgcaactaaatcccgaaatacaaaaagtaacacagtggacttcctattaagacttacttgcattgctggactagcaaaggaaaattgcactattgcacatcatattctattgtttactataaaaatcatgtgataactgattattacttctgtttctcttttggtttctgcttctctcttctctcaacccctttgtaatggtttgggggcagactcttaagtatattgtgagttttctatttcactaatcatgagaaaaactgttcttttgcaataataataaattaaacatgctgttaccagagcctctttgctggagtctccagatgttaatttactttctgcaccccaattgggaatgcaatattggatgaaaagagaggtttctggtattcacagaaagctagatatgccttaaaacatactctgccgatctaattacagccttatttttgtatgccttttgggcattctcctcatgcttagaaagttccaaatgtttataaaggtaaaatggcagtttgaagtcaaatgtcacataggcaaagcaatcaagcaccaggaagtgtttatgaggaaacaacacccaagatgaattatttttgagactgtcaggaagtaaaataaataggagcttaagaaagaacattttgcctgattgagaagcacaactgaaaccagtagccgctggggtgttaatggtagcattcttcttttggcaatacatttgatttgttcatgaatatattaatcagcattagagaaatgaattataactagacatctgctgttatcaccatagttttgtttaatttgcttccttttaaataaacccattggaactttctaagcatgaggagaatgcccaaaaggcatacaaaaataaggctgtaattagatcggcagagtatgttttaaggcatatctagctttctgtgaataccagaaacctctcttttcatccaatattgcattcccaattggggtgcagaaagtaaattaacatctggagactccagcaaagaggctctggtaacagcatgtttaatttattattattgcaaaagaacagtttttctcatgattagtgaaatagaaaactcacaatatacttaagagtctgcccgtcgacgcggccgcgaat

SEQ ID NO: 35322 - DNA, 1904 bp, Homo sapiens
acattatagagtgctggcttgaaatcagagaataatgttcatattgcatcagttttcttgttaccctgggaaatagattgatacttttggaaaagtagcaaaatgcttcagagatctgaacttgcagtctgacccagttgttagaatcatggaaataatgaccctggtgatatgtgcttgtgactattttctattttaaatttcacagcgctgggatatgaagcttcgtcatcttggactcagtaaaagtgattctagcaatagtgattccactcagagtcagaagtctggcaggaactcgaacccccggcaagcacgcaactaaatcccgaaatacaaaaagtaacacagtggacttcctattaagacttacttgcattgctggactagcaaaggaaaattgcactattgcacatcatattctattgtttactataaaaatcatgtgataactgattattacttctgtttctcttttggtttctgcttctctcttctctcaacccctttgtaatggtttgggggcagactcttaagtatattgtgagttttctatttcactaatcatgagaaaaactgttcttttgcaataataataaattaaacatgctgttaccagagcctctttgctggagtctccagatgttaatttactttctgcaccccaattgggaatgcaatattggatgaaaagagaggtttctggtattcacagaaagctagatatgccttaaaacatactctgccgatctaattacagccttatttttgtatgccttttgggcattctcctcatgcttagaaagttccaaatgtttataaaggtaaaatggcagtttgaagtcaaatgtcacataggcaaagcaatcaagcaccaggaagtgtttatgaggaaacaacacccaagatgaattatttttgagactgtcaggaagtaaaataaataggagcttaagaaagaacattttgcctgattgagaagcacaactgaaaccagtagccgctggggtgttaatggtagcattcttcttttggcaatacatttgatttgttcatgaatatattaatcagcattagagaaatgaattataactagacatctgctgttatcaccatagttttgtttaatttgcttccttttaaataaacccattggtgaaagtctttttttttctcttcttttaaaataaatcagaattgccgtattgaccaggaaaagattatgtatgcacgtgcaccagggttagtttttaaaagtacatggctccataaaaatgctgtagattacagagtgataaaatatgcaggtttttttgtttttgttttttctgttgtgtgtgtgtctgtatttgtgtacatgtgtgtccttgcactcacacccaaggtggattaaaatacaggcctgcaaactggcctgcactttatcatttggatttgtgctgcttaatgctcagcgaaaaatgtctagtaaaatgaattatggttgtcaggagagaggttatttcgacttttgaaccaattgcacatttctcattacccaagctgtggtgagatcccaggggctgtggtgaacaaatgatgcttttatagatggtccctagcttacaatgattcaatttacaatgcttcaatttaacaatttgttgacttacaatgggtttatcaggatgtaacccaatgcatttcaacttacgatattttcagtttcgaatgggtttatccagatgtaaccccatcgtaaatggcggagcatctgtacttccttcctctggcagagttccttagagcctgtgccaattacttgaaagtctcattctctgccatttacatgtgtgctattagtagaaccaaatttctaagctgtggcgtgctgaaaataaaatgcttatgaagcaaaaaaaaaa

SEQ ID NO: 35323 - DNA, 1795 bp, Homo sapiens
  misc_feature (1685)..(1685): n is a, c, g, or t
  misc_feature (1688)..(1688): n is a, c, g, or t
  misc_feature (1782)..(1782): n is a, c, g, or t
acggggcctgggcggcaggggcggtggctggagctcggtaaagctcgtgggaccccattgggggaatttgatccaaggaagcggtgattgccgggggaggagaagctcccagatccttgtgtccacttgcagcgggggaggcggagacggcggagcgggccttttggcgtccactgcgcggctgcaccctgccccatcctgccgggatcatggtctgcggcagcccgggagggatgctgctgctgcgggccgggctgcttgccctggctgctctctgcctgctccgggtgcccggggctcgggctgcagcctgtgagcccgtccgcatccccctgtgcaagtccctgccctggaacatgactaagatgcccaaccacctgcaccacagcactcaggccaacgccatcctggccatcgagcagttcgaaggtctgctgggcacccactgcagccccgatctgctcttcttcctctgtgccatgtacgcgcccatctgcaccattgacttccagcacgagcccatcaagccctgtaagtctgtgtgcgagcgggcccggcagggctgtgagcccatactcatcaagtaccgccactcgtggccggagaacctggcctgcgaggagctgccagtgtacgacaggggcgtgtgcatctctcccgaggccatcgttactgcggacggagctgattttcctatggattctagtaacggaaactgtagaggggcaagcagtgaacgctgtaaatgtaagcctattagagctacacagaagacctatttccggaacaattacaactatgtcattcgggctaaagttaaagagataaagactaagtgccatgatgtgactgcagtagtggaggtgaaggagattctaaagtcctctctggtaaacattccacgggacactgtcaacctctataccagctctggctgcctctgccctccacttaatgttaatgaggaatatatcatcatgggctatgaagatgaggaacgttccagattactcttggtggaaggctctatagctgagaagtggaaggatcgactcggtaaaaaagttaagcgctgggatatgaagcttcgtcatcttggactcagtaaaagtgattctagcaatagtgattccactcagagtcagaagtctggcaggaactcgaacccccggcaagcacgcaactaaatcccgaaatacaaaaagtaacacagtggacttcctattaagacttacttgcattgctggactagcaaaggaaaattgcactattgcacatcatattctattgtttactataaaaatcatgtgataactgattattacttctgtttctcttttggtttctgcttctctcttctctcaacccctttgtaatggtttgggggcagactcttaagtatattgtgagttttctatttcactaatcatgagaaaaactgttcttttgcaataataataaattaaacatgctgttaccagagcctctttgctggagtctccagatgttaatttactttctgcaccccaattgggaatgcaatattggatgaaaagagaggtttctggtattcacagaaagctagatatgccttaaaacatactctgccgatctaattacagccttatttttgtatgccttttgggcattctcctcatgcttagaaagttccaatgggtttattntanaggaagcaaattaaacaaaactatggtgatacagcagatgtctagttataattctttctcctaatgtggtagaatatcatgagcaatcaatgtngtggggaatagaa

SEQ ID NO: 35324 - DNA, 1787 bp, Homo sapiens
acggggcctgggcggcaggggcggtggctggagctcggtaaagctcgtgggaccccattgggggaatttgatccaaggaagcggtgattgccgggggaggagaagctcccagatccttgtgtccacttgcagcgggggaggcggagacggcggagcgggccttttggcgtccactgcgcggctgcaccctgccccatcctgccgggatcatggtctgcggcagcccgggagggatgctgctgctgcgggccgggctgcttgccctggctgctctctgcctgctccgggtgcccggggctcgggctgcagcctgtgagcccgtccgcatccccctgtgcaagtccctgccctggaacatgactaagatgcccaaccacctgcaccacagcactcaggccaacgccatcctggccatcgagcagttcgaaggtctgctgggcacccactgcagccccgatctgctcttcttcctctgtgccatgtacgcgcccatctgcaccattgacttccagcacgagcccatcaagccctgtaagtctgtgtgcgagcgggcccggcagggctgtgagcccatactcatcaagtaccgccactcgtggccggagaacctggcctgcgaggagctgccagtgtacgacaggggcgtgtgcatctctcccgaggccatcgttactgcggacggagctgattttcctatggattctagtaacggaaactgtagaggggcaagcagtgaacgctgtaaatgtaagcctattagagctacacagaagacctatttccggaacaattacaactatgtcattcgggctaaagttaaagagataaagactaagtgccatgatgtgactgcagtagtggaggtgaaggagattctaaagtcctctctggtaaacattccacgggacactgtcaacctctataccagctctggctgcctctgccctccacttaatgttaatgaggaatatatcatcatgggctatgaagatgaggaacgttccagattactcttggtggaaggctctatagctgagaagtggaaggatcgactcggtaaaaaagttaagcgctgggatatgaagcttcgtcatcttggactcagtaaaagtgattctagcaatagtgattccactcagagtcagaagtctggcaggaactcgaacccccggcaagcacgcaactaaatcccgaaatacaaaaagtaacacagtggacttcctattaagacttacttgcattgctggactagcaaaggaaaattgcactattgcacatcatattctattgtttactataaaaatcatgtgataactgattattacttctgtttctcttttggtttctgcttctctcttctctcaacccctttgtaatggtttgggggcagactcttaagtatattgtgagttttctatttcactaatcatgagaaaaactgttcttttgcaataataataaattaaacatgctgttaccagagcaaaaaaaaaaaaaaaaaaaaaaaaaaaaaaaaaaaaccttaaaaaaaaaaaaaaagaaaaaaaaaagacggggggggcccaagaggccacagaaaacttgaagaacagggggagaaggaggaccccagaggagaaggaaaagggggcaaagaggaccggagaaacaccggaaaaacaaaggggggggaatcacacaaaaaaaaagccgaggggaacaaggggttgagaaaaaccaaaggggacgcacgggaacaagaggggacaaaagaggggacaagagacgcgagaaaccccgggcggggc

SEQ ID NO: 35325 - DNA, 1520 bp, Homo sapiens
acggggcctgggcggcaggggcggtggctggagctcggtaaagctcgtgggaccccattgggggaatttgatccaaggaagcggtgattgccgggggaggagaagctcccagatccttgtgtccacttgcagcgggggaggcggagacggcggagcgggccttttggcgtccactgcgcggctgcaccctgccccatcctgccgggatcatggtctgcggcagcccgggagggatgctgctgctgcgggccgggctgcttgccctggctgctctctgcctgctccgggtgcccggggctcgggctgcagcctgtgagcccgtccgcatccccctgtgcaagtccctgccctggaacatgactaagatgcccaaccacctgcaccacagcactcaggccaacgccatcctggccatcgagcagttcgaaggtctgctgggcacccactgcagccccgatctgctcttcttcctctgtgccatgtacgcgcccatctgcaccattgacttccagcacgagcccatcaagccctgtaagtctgtgtgcgagcgggcccggcagggctgtgagcccatactcatcaagtaccgccactcgtggccggagaacctggcctgcgaggagctgccagtgtacgacaggggcgtgtgcatctctcccgaggccatcgttactgcggacggagctgattttcctatggattctagtaacggaaactgtagaggggcaagcagtgaacgctgtaaatgtaagcctattagagctacacagaagacctatttccggaacaattacaactatgtcattcgggctaaagttaaagagataaagactaagtgccatgatgtgactgcagtagtggaggtgaaggagattctaaagtcctctctggtaaacattccacgggacactgtcaacctctataccagctctggctgcctctgccctccacttaatgttaatgaggaatatatcatcatgggctatgaagatgaggaacgttccagattactcttggtggaaggctctatagctgagaagtggaaggatcgactcggtaaaaaagttaagcgctgggatatgaagcttcgtcatcttggactcagtaaaagtgattctagcaatagtgattccactcagagtcagaagtctggcaggaactcgaacccccggcaagcacgcaactaaatcccgaaatacaaaaagtaacacagtggacttcctattaagacttacttgcattgctggactagcaaaggaaaattgcactattgcacatcatattctattgtttactataaaaatcatgtgataactgattattacttctgtttctcttttggtttctgcttctctcttctctcaacccctttgtaatggtttgggggcagactcttaagtatattgtgagttttctatttcactaatcatgagaaaaactgttcttttgcaataataataaattaaacatgctgttaccagagcaaaaaaaaagtcgacgcggccgcgaatttagtagta

SEQ ID NO: 35326 - DNA, 1100 bp, Homo sapiens
  misc_feature (1100)..(1100): n is a, c, g, or t
acggggcctgggcggcaggggcggtggctggagctcggtaaagctcgtgggaccccattgggggaatttgatccaaggaagcggtgattgccgggggaggagaagctcccagatccttgtgtccacttgcagcgggggaggcggagacggcggagcgggccttttggcgtccactgcgcggctgcaccctgccccatcctgccgggatcatggtctgcggcagcccgggagggatgctgctgctgcgggccgggctgcttgccctggctgctctctgcctgctccgggtgcccggggctcgggctgcagcctgtgagcccgtccgcatccccctgtgcaagtccctgccctggaacatgactaagatgcccaaccacctgcaccacagcactcaggccaacgccatcctggccatcgagcagttcgaaggtctgctgggcacccactgcagccccgatctgctcttcttcctctgtgccatgtacgcgcccatctgcaccattgacttccagcacgagcccatcaagccctgtaagtctgtgtgcgagcgggcccggcagggctgtgagcccatactcatcaagtaccgccactcgtggccggagaacctggcctgcgaggagctgccagtgtacgacaggggcgtgtgcatctctcccgaggccatcgttactgcggacggagctgattttcctatggattctagtaacggaaactgtagaggggcaagcagtgaacgctgtaaatgtaagcctattagagctacacagaagacctatttccggaacaattacaactatgtcattcgggctaaagttaaagagataaagactaagtgccatgatgtgactgcagtagtggaggtgaaggagattctaaagtcctctctggtaaacattccacgggacactgtcaacctctataccagctctggctgcctctgccctccacttaatgttaatgaggaatatatcatcatgggctatgaagatgaggaacgttccagattactcttggtggaaggctctatagctgagaagtggaaggatcgactcggtaaaaaagttaagccatggatgttaaggttccgtcactttgan

SEQ ID NO: 35327 - DNA, 995 bp, Homo sapiens
taatggcaatatattctgttagtgcgtaagtatacattttaaaaaggcatgagccaccgctcctggctttctttaatgtaacttaaataaaatataaggttttactttatttgtgctttttggaaatgtctcctgatttttaataacagtttattatgccttgtaccagcttttttattaatatataaggtgcccactatattataccaattatgctgcttatatagttattcatatgcatctcaaaaccttccttaatgtacttataatgaggtaacaccatagcaaaattgcatctttttcattatctgcatttaatatctatagtttaccaacgatgacactgcaagcattgtgtcttctgatcgtgccagtcgtggacgaagggagagtgtggtgagcatgatttgcatgcaaagaaataagatgagttttaaatgacagcaatgcatgatcacatgaagtctgttggaaagtgaagtttgcatttgacaaaaagagcattttcctcaaatttagttatataaatattttgccttataaaacatgttgagaacacatattctctgtgggctgtgcaagctttcattaataatttgcctttttacatctcttaggagtgaatcattatttgaaaagtttttactttttcttctttgttgctgttttatgcacatacatgtgtgtgcagttcaccaaagacaaatttcttcagcaaaattaatgtttccatattgtataaaactcataactatggattacaaatcatgttaccattaattgctttctatattgttgtatttagatttaaccagtgtttatccacctgttaagacctgtaatccagtcagggtggctcatgcctataatcccagctacttgggagactgaggtgggaggattgcttgagcccaggagtttgaggctgcagtgagctatgattgcatcactgcactccagtgtgggtagcaaagtgagactgtgcctctcaaaag

SEQ ID NO: 35328 - DNA, 2433 bp, Homo sapiens
tcggccgctcaggctgcggctcctcccggggccggttcccgctgtctcagccgcggcgcagagggcacatcggcctgaccgactagccggctgccagtgccgggagccgccgcgtccatccccgcccgcctggccggggacccaggactgagtcgtccagctgcgcccctcgcccatagccccagcgggcgccgggcgggcgagcagctcttcggcccttcccggacagcgacgcagtcgcagcgcgcgccctaacacagatgtgggaagataaatgaaggggtctagatgtaaatgtcagtggaaaggagagctaccatcactaagggctgaaaacacagttaaatcactttcaaagttaaaagactattaagaacacaagatggggactcctgcttctggaaggaaaagaacacctgtgaaagaccgattttctgcagaagatgaagctttgagtaacattgccagagaggcagaggcaaggctggcagcaaaacgggctgcccgggcagaagcaagagatatacgcatgagagaactggaacgacaacaaaaagagttggatgaaaaatctgacaaacagtatgctgaaaattatacaagaccttcatctcgaaattctgcctcagcaacaacccctctaagtggaaactcatccagacgaggaagtggggacaccagcagcttaatagatccagacacttcattaagtgaattgcgggaatctttgtctgaagtggaagaaaaatacaagaaagccatggtttccaatgcacagttagacaatgagaagaacaatttgatctaccaagtagacacactcaaggatgttattgaagagcaggaggaacagatggcagaattttatagagaaaatgaagaaaaatcaaaggagttagaaaggcagaaacatatgtgtagtgtgctgcagcataagatggaagaacttaaagaaggcctgcggcaaagagatgagcttattgagaaacatggcttagttataatccccgatggcactcccaatggtgatgtcagtcatgaaccagtggctggagccatcactgttgtgtctcaggaagctgctcaggtcttggagtcagcaggagaagggccattagatgtaaggctacgaaaacttgctggagagaaggaagaactactgtcacagattagaaaactgaagcttcagttagaggaggaacgacagaaatgctccaggaatgatggcacagtgggtgacctggcaggactgcagaatggctcagacttgcagttcatcgaaatgcagagagatgccaatagacaaattagcgaatacaaatttaagctttcaaaagcagaacaggatataactaccttggagcaaagtattagccggcttgagggacaggttctgagatataaaactgctgctgagaatgctgagaaagttgaagatgaattgaaagcagaaaaacggaagctacaacgagagttacgaacagcactggacaagattgaggagatggagatgaccaacagccacctggccaagcggctggagaagatgaaggccaataggacagcacttctggcccagcagtaggaaaaccacccttcaacctgggtgatgctccttggggccctacctagagggactgacttttgtccattgacacaaaccccttttagtactgttttgagttttgtcattaaaacagccacctttgtattttataatttatgacagaatgaagtcattttgaatctacatgaatgaacactttggattttgttgtagtttgattctagggtagaaccagtccatgctgtttttattttttatctccgtaattgtagaatcatgtttactcaacgtttttccccagctgcctcagtaactgggcactcggaggccttggcacgggttctggaggacagacagcaattctatgagtgctcactgagatacttgctggagacctcagaaaacacaagtgccttctccacggtgcaattcagacttcagtgatctccagtggtcaaaagacatttacccttaatatcagacaacatttatattttagtgaagaaacaagttctcgggtggggaatctatgtttcactcagatttatatgtttggaggaaaaaagcctttttttgtaaaatatttaaatttatataagaaaatgttagaaaaaaatatggggagtgtatataaaacttgctttattgcatggggcaggggaagtccaggcctaatactcctaaagtaagagttgggtcctttttttcttcaatacaactgtgctgtaccttgtaaagtattttatctgctgcttatttgtggaatgaaacctcaaacaaacccaaagggggagggtagggcagggcaggcagattggaaatctgcctgcagattctattaaatacacccttttgccaaccacaat

SEQ ID NO: 35329 - DNA, 3396 bp, Homo sapiens
tcggccgctcaggctgcggctcctcccggggccggttcccgctgtctcagccgcggcgcagagggcacatcggcctgaccgactagccggctgccagtgccgggagccgccgcgtccatccccgcccgcctggccggggacccaggactgagtcgtccagctgcgcccctcgcccatagccccagcgggcgccgggcgggcgagcagctcttcggcccttcccggacagcgacgcagtcgcagcgcgcgccctaacacagatgtgggaagataaatgaaggggtctagatgtaaatgtcagtggaaaggagagctaccatcactaagggctgaaaacacagttaaatcactttcaaagttaaaagactattaagaacacaagatggggactcctgcttctggaaggaaaagaacacctgtgaaagaccgattttctgcagaagatgaagctttgagtaacattgccagagaggcagaggcaaggctggcagcaaaacgggctgcccgggcagaagcaagagatatacgcatgagagaactggaacgacaacaaaaagagtactctcttcattcctttgatcggaagtggggacagattcagaagtggctggaagattcggaaagggccaggtattcccaccggtccagtcaccatcgtccttatctgggagttgaggatgcattgtccattcgaagtgttggcagtcacaggtatgatatgttcaaggatagatcatcaagactttcatcattaaatcattcttacagtcactctcatggaatgaagaagaggtcttctgattctcataaagacctactgagtggcctctactttgaccagagaaactatagcagtcttagacatagcaaacccacctctgcctactacactcggcagtcttcttccctgtacagtgaccctctggcaacatataagagtgacagggcctctcctactgcaaattctggtctgctgagaagtgccagtctggcatcattgtacaatggtggattatataacccttatggtcctcgaactccatctgaatgcagttattattcatcaagaataagttcagcccgaagcagtccagggtttaccaacgatgacactgcaagcattgtgtcttctgatcgtgccagtcgtggacgaagggagagtgtggtatctgccgctgattatttcagtcgctccaatcgtaggggaagtgttgtctctgaggtggatgatatcagtatcccagatttgtccagcttggatgaaaaatctgacaaacagtatgctgaaaattatacaagaccttcatctcgaaattctgcctcagcaacaacccctctaagtggaaactcatccagacgaggaagtggggacaccagcagcttaatagatccagacacttcattaagtgaattgcgggatatctatgaccttaaggaccagatacaggatgtagaagggagatacatgcaggggcttaaagaactaaaggaatctttgtctgaagtggaagaaaaatacaagaaagccatggtttccaatgcacagttagacaatgagaagaacaatttgatctaccaagtagacacactcaaggatgttattgaagagcaggaggaacagatggcagaattttatagagaaaatgaagaaaaatcaaaggagttagaaaggcagaaacatatgtgtagtgtgctgcagcataagatggaagaacttaaagaaggcctgcggcaaagagatgagcttattgaggagaagcagcgcatgcagcagaaaatagacaccatgacaaaagaggtgtttgacctccaggagacacttctttggaaagataaaaaaattggggccctagagaaacagaaagaatacattgcctgccttaggaatgagcgagatatgctcagagaggagctggctgacctgcaggagacagtgaagacgggagagaaacatggcttagttataatccccgatggcactcccaatggtgatgtcagtcatgaaccagtggctggagccatcactgttgtgtctcaggaagctgctcaggtcttggagtcagcaggagaagggccattagatgtaaggctacgaaaacttgctggagagaaggaagaactactgtcacagattagaaaactgaagcttcagttagaggaggaacgacagaaatgctccaggaatgatggcacagtgggtgacctggcaggactgcagaatggctcagacttgcagttcatcgaaatgcagagagatgccaatagacaaattagcgaatacaaatttaagctttcaaaagcagaacaggatataactaccttggagcaaagtattagccggcttgagggacaggttctgagatataaaactgctgctgagaatgctgagaaagttgaagatgaattgaaagcagaaaaacggaagctacaacgagagttacgaacagcactggacaagattgaggagatggagatgaccaacagccacctggccaagcggctggagaagatgaaggccaataggacagcacttctggcccagcagtaggaaaaccacccttcaacctgggtgatgctccttggggccctacctagagggactgacttttgtccattgacacaaaccccttttagtactgttttgagttttgtcattaaaacagccacctttgtattttataatttatgacagaatgaagtcattttgaatctacatgaatgaacactttggattttgttgtagtttgattctagggtagaaccagtccatgctgtttttattttttatctccgtaattgtagaatcatgtttactcaacgtttttccccagctgcctcagtaactgggcactcggaggccttggcacgggttctggaggacagacagcaattctatgagtgctcactgagatacttgctggagacctcagaaaacacaagtgccttctccacggtgcaattcagacttcagtgatctccagtggtcaaaagacatttacccttaatatcagacaacatttatattttagtgaagaaacaagttctcgggtggggaatctatgtttcactcagatttatatgtttggaggaaaaaagcctttttttgtaaaatatttaaatttatataagaaaatgttagaaaaaaatatggggagtgtatataaaacttgctttattgcatggggcaggggaagtccaggcctaatactcctaaagtaagagttgggtcctttttttcttcaatacaactgtgctgtaccttgtaaagtattttatctgctgcttatttgtggaatgaaacctcaaacaaacccaaagggggagggtagggcagggcaggcagattggaaatctgcctgcagattctattaaatacacccttttgccaaccacaat

SEQ ID NO: 35330 - DNA, 3785 bp, Homo sapiens
tcggccgctcaggctgcggctcctcccggggccggttcccgctgtctcagccgcggcgcagagggcacatcggcctgaccgactagccggctgccagtgccgggagccgccgcgtccatccccgcccgcctggccggggacccaggactgagtcgtccagctgcgcccctcgcccatagccccagcgggcgccgggcgggcgagcagctcttcggcccttcccggacagcgacgcagtcgcagcgcgcgccctaacacagatgtgggaagataaatgaaggggtctagatgtaaatgtcagtggaaaggagagctaccatcactaagggctgaaaacacagttaaatcactttcaaagttaaaagactattaagaacacaagatggggactcctgcttctggaaggaaaagaacacctgtgaaagaccgattttctgcagaagatgaagctttgagtaacattgccagagaggcagaggcaaggctggcagcaaaacgggctgcccgggcagaagcaagagatatacgcatgagagaactggaacgacaacaaaaagagtactctcttcattcctttgatcggaagtggggacagattcagaagtggctggaagattcggaaagggccaggtattcccaccggtccagtcaccatcgtccttatctgggagttgaggatgcattgtccattcgaagtgttggcagtcacaggtatgatatgttcaaggatagatcatcaagactttcatcattaaatcattcttacagtcactctcatggaatgaagaagaggtcttctgattctcataaagacctactgagtggcctctactttgaccagagaaactatagcagtcttagacatagcaaacccacctctgcctactacactcggcagtcttcttccctgtacagtgaccctctggcaacatataagagtgacagggcctctcctactgcaaattctggtctgctgagaagtgccagtctggcatcattgtacaatggtggattatataacccttatggtcctcgaactccatctgaatgcagttattattcatcaagaataagttcagcccgaagcagtccagggtttaccaacgatgacactgcaagcattgtgtcttctgatcgtgccagtcgtggacgaagggagagtgtggtatctgccgctgattatttcagtcgctccaatcgtaggggaagtgttgtctctgaggtggatgatatcagtatcccagatttgtccagcttggatgaaaaatctgacaaacagtatgctgaaaattatacaagaccttcatctcgaaattctgcctcagcaacaacccctctaagtggaaactcatccagacgaggaagtggggacaccagcagcttaatagatccagacacttcattaagtgaattgcgggatatctatgaccttaaggaccagatacaggatgtagaagggagatacatgcaggggcttaaagaactaaaggaatctttgtctgaagtggaagaaaaatacaagaaagccatggtttccaatgcacagttagacaatgagaagaacaatttgatctaccaagtagacacactcaaggatgttattgaagagcaggaggaacagatggcagaattttatagagaaaatgaagaaaaatcaaaggagttagaaaggcagaaacatatgtgtagtgtgctgcagcataagatggaagaacttaaagaaggcctgcggcaaagagatgagcttattgaggagaagcagcgcatgcagcagaaaatagacaccatgacaaaagaggtgtttgacctccaggagacacttctttggaaagataaaaaaattggggccctagagaaacagaaagaatacattgcctgccttaggaatgagcgagatatgctcagagaggagctggctgacctgcaggagacagtgaagacgggagagaaacatggcttagttataatccccgatggcactcccaatggtgatgtcagtcatgaaccagtggctggagccatcactgttgtgtctcaggaagctgctcaggtcttggagtcagcaggagaagggccattagatgtaaggctacgaaaacttgctggagagaaggaagaactactgtcacagattagaaaactgaagcttcagttagaggaggaacgacagaaatgctccaggaatgatggcacagtgggtgacctggcaggactgcagaatggctcagacttgcagttcatcgaaatgcagagagatgccaatagacaaattagcgaatacaaatttaagctttcaaaagcagaacaggatataactaccttggagcaaagtattagccggcttgagggacaggttctgagatataaaactgctgctgagaatgctgagaaagttgaagatgaattgaaagcagaaaaacggaagctacaacgagagttacgaacagcactggacaagattgaggagatggagatgaccaacagccacctggccaagcggctggagaagatgaaggccaataggacagcacttctggcccagcagtaggaaaaccacccttcaacctgggtgatgctccttggggccctacctagagggactgacttttgtccattgacacaaaccccttttagtactgttttgagttttgtcattaaaacagccacctttgtattttataatttatgacagaatgaagtcattttgaatctacatgaatgaacactttggattttgttgtagtttgattctagggtagaaccagtccatgctgtttttattttttatctccgtaattgtagaatcatgtttactcaacgtttttccccagctgcctcagtaactgggcactcggaggccttggcacgggttctggaggacagacagcaattctatgagtgctcactgagatacttgctggagacctcagaaaacacaagtgccttctccacggtgcaattcagacttcagtgatctccagtggtcaaaagacatttacccttaatatcagacaacatttatattttagtgaagaaacaagttctcgggtggggaatctatgtttcactcagatttatatgtttggaggaaaaaagcctttttttgtaaaatatttaaatttatataagaaaatgttagaaaaaaatatggggagtgtatataaaacttgctttattgcatggggcaggggaagtccaggcctaatactcctaaagtaagagttgggtcctttttttcttcaatacaactgtgctgtaccttgtaaagtattttatctgctgcttatttgtggaatgaaacctcaaacaaacccaaagggggagggtagggcagggcaggcagattggaaatctgcctgcagattctattaaatacacccttttgccaaccacaattggctactgacatgttcattttgttataggagactttaaaacaaatcatggcaaccacatccctcttcttttgtctccttctcaaggaaaaacaatctggaatgtagaacttttaaagacttgagtttcacctttagaggtaccctgtccaagaggtttttttaaaatcatggagtgcaactactttgcagaatttatgattctcttttgctcttagtacccaggtggttttatagaaatgattattgtatctttaaagtgcttacacagaaaatatattgggggaaaatctagtgactaaaggcacataagataataaaactagactttaaaaaggtaactcaaaagtgaataaaatctctaatatttgttccttttttaattagccc

SEQ ID NO: 35331 - DNA, 3549 bp, Homo sapiens
tcggccgctcaggctgcggctcctcccggggccggttcccgctgtctcagccgcggcgcagagggcacatcggcctgaccgactagccggctgccagtgccgggagccgccgcgtccatccccgcccgcctggccggggacccaggactgagtcgtccagctgcgcccctcgcccatagccccagcgggcgccgggcgggcgagcagctcttcggcccttcccggacagcgacgcagtcgcagcgcgcgccctaacacagatgtgggaagataaatgaaggggtctagatgtaaatgtcagtggaaaggagagctaccatcactaagggctgaaaacacagttaaatcactttcaaagttaaaagactattaagaacacaagatggggactcctgcttctggaaggaaaagaacacctgtgaaagaccgattttctgcagaagatgaagctttgagtaacattgccagagaggcagaggcaaggctggcagcaaaacgggctgcccgggcagaagcaagagatatacgcatgagagaactggaacgacaacaaaaagagtactctcttcattcctttgatcggaagtggggacagattcagaagtggctggaagattcggaaagggccaggtattcccaccggtccagtcaccatcgtccttatctgggagttgaggatgcattgtccattcgaagtgttggcagtcacaggtatgatatgttcaaggatagatcatcaagactttcatcattaaatcattcttacagtcactctcatggaatgaagaagaggtcttctgattctcataaagacctactgagtggcctctactttgaccagagaaactatagcagtcttagacatagcaaacccacctctgcctactacactcggcagtcttcttccctgtacagtgaccctctggcaacatataagagtgacagggcctctcctactgcaaattctggtctgctgagaagtgccagtctggcatcattgtacaatggtggattatataacccttatggtcctcgaactccatctgaatgcagttattattcatcaagaataagttcagcccgaagcagtccagggtttaccaacgatgacactgcaagcattgtgtcttctgatcgtgccagtcgtggacgaagggagagtgtggtatctgccgctgattatttcagtcgctccaatcgtaggggaagtgttgtctctgaggtggatgatatcagtatcccagatttgtccagcttggatgaaaaatctgacaaacagtatgctgaaaattatacaagaccttcatctcgaaattctgcctcagcaacaacccctctaagtggaaactcatccagacgaggaagtggggacaccagcagcttaatagatccagacacttcattaagtgaattgcgggatatctatgaccttaaggaccagatacaggatgtagaagggagatacatgcaggggcttaaagaactaaaggaatctttgtctgaagtggaagaaaaatacaagaaagccatggtttccaatgcacagttagacaatgagaagaacaatttgatctaccaagtagacacactcaaggatgttattgaagagcaggaggaacagatggcagaattttatagagaaaatgaagaaaaatcaaaggagttagaaaggcagaaacatatgtgtagtgtgctgcagcataagatggaagaacttaaagaaggcctgcggcaaagagatgagcttattgaggagaagcagcgcatgcagcagaaaatagacaccatgacaaaagaggtgtttgacctccaggagacacttctttggaaagataaaaaaattggggccctagagaaacagaaagaatacattgcctgccttaggaatgagcgagatatgctcagagaggagctggctgacctgcaggagacagtgaagacgggagagaaacatggcttagttataatccccgatggcactcccaatggtgatgtcagtcatgaaccagtggctggagccatcactgttgtgtctcaggaagctgctcaggtcttggagtcagcaggagaagggccattagatgtaaggctacgaaaacttgctggagagaaggaagaactactgtcacagattagaaaactgaagcttcagttagaggaggaacgacagaaatgctccaggaatgatggcacagtgggtgacctggcaggactgcagaatggctcagacttgcagttcatcgaaatgcagagagatgccaatagacaaattagcgaatacaaatttaagctttcaaaagcagaacaggatataactaccttggagcaaagtattagccggcttgagggacaggttctgagatataaaactgctgctgagaatgctgagaaagttgaagatgaattgaaagcagaaaaacggaagctacaacgagagttacgaacagcactggacaagattgaggagatggagatgaccaacagccacctggccaagcggctggagaagatgaaggccaataggacagcacttctggcccagcagtaggaaaaccacccttcaacctgggtgatgctccttggggccctacctagagggactgacttttgtccattgacacaaaccccttttagtactgttttgagttttgtcattaaaacagccacctttgtattttataatttatgacagaatgaagtcattttgaatctacatgaatgaacactttggattttgttgtagtttgattctagggtagaaccagtccatgctgtttttattttttatctccgtaattgtagaatcatgtttactcaacgtttttccccagctgcctcagtaactgggcactcggaggccttggcacgggttctggaggacagacagcaattctatgagtgctcactgagatacttgctggagacctcagaaaacacaagtgccttctccacggtgcaattcagacttcagtgatctccagtggtcaaaagacatttacccttaatatcagacaacatttatattttagtgaagaaacaagttctcgggtggggaatctatgtttcactcagatttatatgtttggaggaaaaaagcctttttttgtaaaatatttaaatttatataagaaaatgttagaaaaaaatatggggagtgtatataaaacttgctttattgcatggggcaggggaagtccaggcctaatactcctaaagtaagagttgggtcctttttttcttcaatacaactgtgctgtaccttgtaaagtattttatctgctgcttatttgtggaatgaaacctcaaacaaacccaaagggggagggtagggcagggcaggcagattggaaatctgcctgcagattctattaaatacacccttttgccaaccacaataaaatataataaaaaaaaaaatttataaaaatataaaaaatacaatattaaaaatatttacgtaactaatttattaataaattagtctatttattttaaattatatgtattttttatagacattgtttttcatcaattatatgggggatccct

SEQ ID NO: 35332 - DNA, 3716 bp, Homo sapiens
atcctgtacacatactcagttcctaattgtaagctcaattttggtattagcaaaagcatctgtcagtttttcctcaattactcgcacctcttcttgcctaaataaaacaaagaaacaaagaaaacaagtgtggtgtcattacacgtctcgggagttccccctggagggggaactccagagaaggggaacattaaatgttggagagatttgttaccatacattcatttatttaattaaagccgttttagttccttagcaaagcaactaatgctcacgctcacaactgaaggagaaataatatgccacaacacctaaaaacaccttggaacgcagtggagtggaaagggcagggactttaaataatgatgcttgggcttgtatccacttctactacctgttagtgtgtaaatggcagtgtctttatttgtacattggggatgttaatactatctttgtaggtaggtttaatatatggattaaatggaatactatatagaaaatgcctatcaaaattctcaaataggtgccaataaatattaatatctataaatgcaatcattattattattattgtgaataaaaataccattgcttgattttatcagtccttagcaaaacttcatacttgtaagcctgttttatctctgtggatgggcttctgaattcccttccttgagaagtattttaaagcaaggcaaacagtcagctgaagtaaggaatagatgatgaatgaggttaaaaaaaaatcacttattttaaaattaaataaatgtttgtggagtacctgttgtattcaaagccctgtgttaagtgctaggaatactattttaagccagtcagactagatttctgactttatggaatttatatcctcgtgaaagagatggaaaataagctagtaaagaaacaaaaagaaagaaatgtcagggactgtgaagagaacagataatgtgatagggaacctggaggggtctatgtgtgtgggttaccctttggatggggtgattagagatgcttctctgagaaactgacctttgagctgagacctgaaatgtgaggagccagttgcttgaagagctgggaggggagcgttctaggccagtgccaaggcctaaggtgagggagaactggtgtgtttggggaactaaaaagaggccggtatagtttatttccttcattattttgtcttacatttcctggtctttgggaatataaaaaaaggggaactgtgtaaactgagaaaaggtgcagtaaacaccctgcaaataattctgcattcagcatatatattcttaacagagttgatagctataatgaattataaattttgagaattatagtagaggtatatactgacctagaaatgcctctgttcagggtgataaatatcttaaacatgagagatttgctggtcctcaggaagtaaatgttctctgtagcataggactctagttaagatgagtaaaaaagctgattgtagagctgtgatttcatttaggaaccccttttcttttttatttttttgagtaggttaattgcagcagtttcctcattttatttcttggtactttatcacccatcaaaattttaaaaaacttttccctaattggccaatgttcttatttttttctttcttttttcttaaccttgaaagcatcttgttttttttctgaccgaaaggtatctgccgctgattatttcagtcgctccaatcgtaggggaagtgttgtctctgaggtggatgatatcagtatcccagatttgtccagcttggatgaaaaatctgacaaacagtatgctgaaaattatacaagaccttcatctcgaaattctgcctcagcaacaacccctctaagtggaaactcatccagacgaggaagtggggacaccagcagcttaatagatccagacacttcattaagtgaattgcgggatatctatgaccttaaggaccagatacaggatgtagaagggagatacatgcaggggcttaaagaactaaaggaatctttgtctgaagtggaagaaaaatacaagaaagccatggtttccaatgcacagttagacaatgagaagaacaatttgatctaccaagtagacacactcaaggatgttattgaagagcaggaggaacagatggcagaattttatagagaaaatgaagaaaaatcaaaggagttagaaaggcagaaacatatgtgtagtgtgctgcagcataagatggaagaacttaaagaaggcctgcggcaaagagatgagcttattgagaaacatggcttagttataatccccgatggcactcccaatggtgatgtcagtcatgaaccagtggctggagccatcactgttgtgtctcaggaagctgctcaggtcttggagtcagcaggagaagggccattagatgtaaggctacgaaaacttgctggagagaaggaagaactactgtcacagattagaaaactgaagcttcagttagaggaggaacgacagaaatgctccaggaatgatggcacagtgggtgacctggcaggactgcagaatggctcagacttgcagttcatcgaaatgcagagagatgccaatagacaaattagcgaatacaaatttaagctttcaaaagcagaacaggatataactaccttggagcaaagtattagccggcttgagggacaggttctgagatataaaactgctgctgagaatgctgagaaagttgaagatgaattgaaagcagaaaaacggaagctacaacgagagttacgaacagcactggacaagattgaggagatggagatgaccaacagccacctggccaagcggctggagaagatgaaggccaataggacagcacttctggcccagcagtaggaaaaccacccttcaacctgggtgatgctccttggggccctacctagagggactgacttttgtccattgacacaaaccccttttagtactgttttgagttttgtcattaaaacagccacctttgtattttataatttatgacagaatgaagtcattttgaatctacatgaatgaacactttggattttgttgtagtttgattctagggtagaaccagtccatgctgtttttattttttatctccgtaattgtagaatcatgtttactcaacgtttttccccagctgcctcagtaactgggcactcggaggccttggcacgggttctggaggacagacagcaattctatgagtgctcactgagatacttgctggagacctcagaaaacacaagtgccttctccacggtgcaattcagacttcagtgatctccagtggtcaaaagacatttacccttaatatcagacaacatttatattttagtgaagaaacaagttctcgggtggggaatctatgtttcactcagatttatatgtttggaggaaaaaagcctttttttgtaaaatatttaaatttatataagaaaatgttagaaaaaaatatggggagtgtatataaaacttgctttattgcatggggcaggggaagtccaggcctaatactcctaaagtaagagttgggtcctttttttcttcaatacaactgtgctgtaccttgtaaagtattttatctgctgcttatttgtggaatgaaacctcaaacaaacccaaagggggagggtagggcagggcaggcagattggaaatctgcctgcagattctattaaatacacccttttgccaaccacaat

SEQ ID NO: 35333 - DNA, 2505 bp, Homo sapiens
tcggccgctcaggctgcggctcctcccggggccggttcccgctgtctcagccgcggcgcagagggcacatcggcctgaccgactagccggctgccagtgccgggagccgccgcgtccatccccgcccgcctggccggggacccaggactgagtcgtccagctgcgcccctcgcccatagccccagcgggcgccgggcgggcgagcagctcttcggcccttcccggacagcgacgcagtcgcagcgcgcgccctaacacagatgtgggaagataaatgaaggggtctagatgtaaatgtcagtggaaaggagagctaccatcactaagggctgaaaacacagttaaatcactttcaaagttaaaagactattaagaacacaagatggggactcctgcttctggaaggaaaagaacacctgtgaaagaccgattttctgcagaagatgaagctttgagtaacattgccagagaggcagaggcaaggctggcagcaaaacgggctgcccgggcagaagcaagagatatacgcatgagagaactggaacgacaacaaaaagagttggatgaaaaatctgacaaacagtatgctgaaaattatacaagaccttcatctcgaaattctgcctcagcaacaacccctctaagtggaaactcatccagacgaggaagtggggacaccagcagcttaatagatccagacacttcattaagtgaattgcgggatatctatgaccttaaggaccagatacaggatgtagaagggagatacatgcaggggcttaaagaactaaaggaatctttgtctgaagtggaagaaaaatacaagaaagccatggtttccaatgcacagttagacaatgagaagaacaatttgatctaccaagtagacacactcaaggatgttattgaagagcaggaggaacagatggcagaattttatagagaaaatgaagaaaaatcaaaggagttagaaaggcagaaacatatgtgtagtgtgctgcagcataagatggaagaacttaaagaaggcctgcggcaaagagatgagcttattgagaaacatggcttagttataatccccgatggcactcccaatggtgatgtcagtcatgaaccagtggctggagccatcactgttgtgtctcaggaagctgctcaggtcttggagtcagcaggagaagggccattagatgtaaggctacgaaaacttgctggagagaaggaagaactactgtcacagattagaaaactgaagcttcagttagaggaggaacgacagaaatgctccaggaatgatggcacagtgggtgacctggcaggactgcagaatggctcagacttgcagttcatcgaaatgcagagagatgccaatagacaaattagcgaatacaaatttaagctttcaaaagcagaacaggatataactaccttggagcaaagtattagccggcttgagggacaggttctgagatataaaactgctgctgagaatgctgagaaagttgaagatgaattgaaagcagaaaaacggaagctacaacgagagttacgaacagcactggacaagattgaggagatggagatgaccaacagccacctggccaagcggctggagaagatgaaggccaataggacagcacttctggcccagcagtaggaaaaccacccttcaacctgggtgatgctccttggggccctacctagagggactgacttttgtccattgacacaaaccccttttagtactgttttgagttttgtcattaaaacagccacctttgtattttataatttatgacagaatgaagtcattttgaatctacatgaatgaacactttggattttgttgtagtttgattctagggtagaaccagtccatgctgtttttattttttatctccgtaattgtagaatcatgtttactcaacgtttttccccagctgcctcagtaactgggcactcggaggccttggcacgggttctggaggacagacagcaattctatgagtgctcactgagatacttgctggagacctcagaaaacacaagtgccttctccacggtgcaattcagacttcagtgatctccagtggtcaaaagacatttacccttaatatcagacaacatttatattttagtgaagaaacaagttctcgggtggggaatctatgtttcactcagatttatatgtttggaggaaaaaagcctttttttgtaaaatatttaaatttatataagaaaatgttagaaaaaaatatggggagtgtatataaaacttgctttattgcatggggcaggggaagtccaggcctaatactcctaaagtaagagttgggtcctttttttcttcaatacaactgtgctgtaccttgtaaagtattttatctgctgcttatttgtggaatgaaacctcaaacaaacccaaagggggagggtagggcagggcaggcagattggaaatctgcctgcagattctattaaatacacccttttgccaaccacaat

SEQ ID NO: 35334 - DNA, 2966 bp, Homo sapiens
tcggccgctcaggctgcggctcctcccggggccggttcccgctgtctcagccgcggcgcagagggcacatcggcctgaccgactagccggctgccagtgccgggagccgccgcgtccatccccgcccgcctggccggggacccaggactgagtcgtccagctgcgcccctcgcccatagccccagcgggcgccgggcgggcgagcagctcttcggcccttcccggacagcgacgcagtcgcagcgcgcgccctaacacagatgtgggaagataaatgaaggggtctagatgtaaatgtcagtggaaaggagagctaccatcactaagggtctcactctgatgcccacgctggagtccagtggtatgaacacagatcactgcagcctcgacttcctgggctcgggtgattctcccacctcagcctcccaagtagctgagactacatgcatacatcatcacacagggccaatttttgtattttttgtagaaacggggtgtccgcatgttgcccacgctggtctctaactcctgggctcacatcgttcacccaccttggcctcccaaagtgctgggattacaggcatgagccaccgctcctggctttctttaatgtaacttaaataaaatataaggttttactttatttgtgctttttggaaatgtctcctgatttttaataacagtttattatgccttgtaccagcttttttattaatatataaggtgcccactatattataccaattatgctgcttatatagttattcatatgcatctcaaaaccttccttaatgtacttataatgaggtaacaccatagcaaaattgcatctttttcattatctgcatttaatatctatagtttaccaacgatgacactgcaagcattgtgtcttctgatcgtgccagtcgtggacgaagggagagtgtggtatctgccgctgattatttcagtcgctccaatcgtaggggaagtgttgtctctgaggtggatgatatcagtatcccagatttgtccagcttggatgaaaaatctgacaaacagtatgctgaaaattatacaagaccttcatctcgaaattctgcctcagcaacaacccctctaagtggaaactcatccagacgaggaagtggggacaccagcagcttaatagatccagacacttcattaagtgaattgcgggatatctatgaccttaaggaccagatacaggatgtagaagggagatacatgcaggggcttaaagaactaaaggaatctttgtctgaagtggaagaaaaatacaagaaagccatggtttccaatgcacagttagacaatgagaagaacaatttgatctaccaagtagacacactcaaggatgttattgaagagcaggaggaacagatggcagaattttatagagaaaatgaagaaaaatcaaaggagttagaaaggcagaaacatatgtgtagtgtgctgcagcataagatggaagaacttaaagaaggcctgcggcaaagagatgagcttattgagaaacatggcttagttataatccccgatggcactcccaatggtgatgtcagtcatgaaccagtggctggagccatcactgttgtgtctcaggaagctgctcaggtcttggagtcagcaggagaagggccattagatgtaaggctacgaaaacttgctggagagaaggaagaactactgtcacagattagaaaactgaagcttcagttagaggaggaacgacagaaatgctccaggaatgatggcacagtgggtgacctggcaggactgcagaatggctcagacttgcagttcatcgaaatgcagagagatgccaatagacaaattagcgaatacaaatttaagctttcaaaagcagaacaggatataactaccttggagcaaagtattagccggcttgagggacaggttctgagatataaaactgctgctgagaatgctgagaaagttgaagatgaattgaaagcagaaaaacggaagctacaacgagagttacgaacagcactggacaagattgaggagatggagatgaccaacagccacctggccaagcggctggagaagatgaaggccaataggacagcacttctggcccagcagtaggaaaaccacccttcaacctgggtgatgctccttggggccctacctagagggactgacttttgtccattgacacaaaccccttttagtactgttttgagttttgtcattaaaacagccacctttgtattttataatttatgacagaatgaagtcattttgaatctacatgaatgaacactttggattttgttgtagtttgattctagggtagaaccagtccatgctgtttttattttttatctccgtaattgtagaatcatgtttactcaacgtttttccccagctgcctcagtaactgggcactcggaggccttggcacgggttctggaggacagacagcaattctatgagtgctcactgagatacttgctggagacctcagaaaacacaagtgccttctccacggtgcaattcagacttcagtgatctccagtggtcaaaagacatttacccttaatatcagacaacatttatattttagtgaagaaacaagttctcgggtggggaatctatgtttcactcagatttatatgtttggaggaaaaaagcctttttttgtaaaatatttaaatttatataagaaaatgttagaaaaaaatatggggagtgtatataaaacttgctttattgcatggggcaggggaagtccaggcctaatactcctaaagtaagagttgggtcctttttttcttcaatacaactgtgctgtaccttgtaaagtattttatctgctgcttatttgtggaatgaaacctcaaacaaacccaaagggggagggtagggcagggcaggcagattggaaatctgcctgcagattctattaaatacacccttttgccaaccacaat

SEQ ID NO: 35335 - DNA, 2461 bp, Homo sapiens
ggttggttatgttgtcccaggcttgtgactaacagctaatatgttagctattttataataaaagtgggattacaggcatgagccaccgctcctggctttctttaatgtaacttaaataaaatataaggttttactttatttgtgctttttggaaatgtctcctgatttttaataacagtttattatgccttgtaccagcttttttattaatatataaggtgcccactatattataccaattatgctgcttatatagttattcatatgcatctcaaaaccttccttaatgtacttataatgaggtaacaccatagcaaaattgcatctttttcattatctgcatttaatatctatagtttaccaacgatgacactgcaagcattgtgtcttctgatcgtgccagtcgtggacgaagggagagtgtggtatctgccgctgattatttcagtcgctccaatcgtaggggaagtgttgtctctgaggtggatgatatcagtatcccagatttgtccagcttggatgaaaaatctgacaaacagtatgctgaaaattatacaagaccttcatctcgaaattctgcctcagcaacaacccctctaagtggaaactcatccagacgaggaagtggggacaccagcagcttaatagatccagacacttcattaagtgaattgcgggatatctatgaccttaaggaccagatacaggatgtagaagggagatacatgcaggggcttaaagaactaaaggaatctttgtctgaagtggaagaaaaatacaagaaagccatggtttccaatgcacagttagacaatgagaagaacaatttgatctaccaagtagacacactcaaggatgttattgaagagcaggaggaacagatggcagaattttatagagaaaatgaagaaaaatcaaaggagttagaaaggcagaaacatatgtgtagtgtgctgcagcataagatggaagaacttaaagaaggcctgcggcaaagagatgagcttattgagaaacatggcttagttataatccccgatggcactcccaatggtgatgtcagtcatgaaccagtggctggagccatcactgttgtgtctcaggaagctgctcaggtcttggagtcagcaggagaagggccattagatgtaaggctacgaaaacttgctggagagaaggaagaactactgtcacagattagaaaactgaagcttcagttagaggaggaacgacagaaatgctccaggaatgatggcacagtgggtgacctggcaggactgcagaatggctcagacttgcagttcatcgaaatgcagagagatgccaatagacaaattagcgaatacaaatttaagctttcaaaagcagaacaggatataactaccttggagcaaagtattagccggcttgagggacaggttctgagatataaaactgctgctgagaatgctgagaaagttgaagatgaattgaaagcagaaaaacggaagctacaacgagagttacgaacagcactggacaagattgaggagatggagatgaccaacagccacctggccaagcggctggagaagatgaaggccaataggacagcacttctggcccagcagtaggaaaaccacccttcaacctgggtgatgctccttggggccctacctagagggactgacttttgtccattgacacaaaccccttttagtactgttttgagttttgtcattaaaacagccacctttgtattttataatttatgacagaatgaagtcattttgaatctacatgaatgaacactttggattttgttgtagtttgattctagggtagaaccagtccatgctgtttttattttttatctccgtaattgtagaatcatgtttactcaacgtttttccccagctgcctcagtaactgggcactcggaggccttggcacgggttctggaggacagacagcaattctatgagtgctcactgagatacttgctggagacctcagaaaacacaagtgccttctccacggtgcaattcagacttcagtgatctccagtggtcaaaagacatttacccttaatatcagacaacatttatattttagtgaagaaacaagttctcgggtggggaatctatgtttcactcagatttatatgtttggaggaaaaaagcctttttttgtaaaatatttaaatttatataagaaaatgttagaaaaaaatatggggagtgtatataaaacttgctttattgcatggggcaggggaagtccaggcctaatactcctaaagtaagagttgggtcctttttttcttcaatacaactgtgctgtaccttgtaaagtattttatctgctgcttatttgtggaatgaaacctcaaacaaacccaaagggggagggtagggcagggcaggcagattggaaatctgcctgcagattctattaaatacacccttttgccaaccacaat

SEQ ID NO: 35336 - DNA, 4054 bp, Homo sapiens
atcctgtacacatactcagttcctaattgtaagctcaattttggtattagcaaaagcatctgtcagtttttcctcaattactcgcacctcttcttgcctaaataaaacaaagaaacaaagaaaacaagtgtggtgtcattacacgtctcgggagttccccctggagggggaactccagagaaggggaacattaaatgttggagagatttgttaccatacattcatttatttaattaaagccgttttagttccttagcaaagcaactaatgctcacgctcacaactgaaggagaaataatatgccacaacacctaaaaacaccttggaacgcagtggagtggaaagggcagggactttaaataatgatgcttgggcttgtatccacttctactacctgttagtgtgtaaatggcagtgtctttatttgtacattggggatgttaatactatctttgtaggtaggtttaatatatggattaaatggaatactatatagaaaatgcctatcaaaattctcaaataggtgccaataaatattaatatctataaatgcaatcattattattattattgtgaataaaaataccattgcttgattttatcagtccttagcaaaacttcatacttgtaagcctgttttatctctgtggatgggcttctgaattcccttccttgagaagtattttaaagcaaggcaaacagtcagctgaagtaaggaatagatgatgaatgaggttaaaaaaaaatcacttattttaaaattaaataaatgtttgtggagtacctgttgtattcaaagccctgtgttaagtgctaggaatactattttaagccagtcagactagatttctgactttatggaatttatatcctcgtgaaagagatggaaaataagctagtaaagaaacaaaaagaaagaaatgtcagggactgtgaagagaacagataatgtgatagggaacctggaggggtctatgtgtgtgggttaccctttggatggggtgattagagatgcttctctgagaaactgacctttgagctgagacctgaaatgtgaggagccagttgcttgaagagctgggaggggagcgttctaggccagtgccaaggcctaaggtgagggagaactggtgtgtttggggaactaaaaagaggccggtatagtttatttccttcattattttgtcttacatttcctggtctttgggaatataaaaaaaggggaactgtgtaaactgagaaaaggtgcagtaaacaccctgcaaataattctgcattcagcatatatattcttaacagagttgatagctataatgaattataaattttgagaattatagtagaggtatatactgacctagaaatgcctctgttcagggtgataaatatcttaaacatgagagatttgctggtcctcaggaagtaaatgttctctgtagcataggactctagttaagatgagtaaaaaagctgattgtagagctgtgatttcatttaggaaccccttttcttttttatttttttgagtaggttaattgcagcagtttcctcattttatttcttggtactttatcacccatcaaaattttaaaaaacttttccctaattggccaatgttcttatttttttctttcttttttcttaaccttgaaagcatcttgttttttttctgaccgaaaggtatctgccgctgattatttcagtcgctccaatcgtaggggaagtgttgtctctgaggtggatgatatcagtatcccagatttgtccagcttggatgaaaaatctgacaaacagtatgctgaaaattatacaagaccttcatctcgaaattctgcctcagcaacaacccctctaagtggaaactcatccagacgaggaagtggggacaccagcagcttaatagatccagacacttcattaagtgaattgcgggatatctatgaccttaaggaccagatacaggatgtagaagggagatacatgcaggggcttaaagaactaaaggaatctttgtctgaagtggaagaaaaatacaagaaagccatggtttccaatgcacagttagacaatgagaagaacaatttgatctaccaagtagacacactcaaggatgttattgaagagcaggaggaacagatggcagaattttatagagaaaatgaagaaaaatcaaaggagttagaaaggcagaaacatatgtgtagtgtgctgcagcataagatggaagaacttaaagaaggcctgcggcaaagagatgagcttattgagaaacatggcttagttataatccccgatggcactcccaatggtgatgtcagtcatgaaccagtggctggagccatcactgttgtgtctcaggaagctgctcaggtcttggagtcagcaggagaagggccattagatgtaaggctacgaaaacttgctggagagaaggaagaactactgtcacagattagaaaactgaagcttcagttagaggaggaacgacagaaatgctccaggaatgatggcacagtgggtgacctggcaggactgcagaatggctcagacttgcagttcatcgaaatgcagagagatgccaatagacaaattagcgaatacaaatttaagctttcaaaagcagaacaggatataactaccttggagcaaagtattagccggcttgagggacaggttctgagatataaaactgctgctgagaatgctgagaaagttgaagatgaattgaaagcagaaaaacggaagctacaacgagagttacgaacagcactggacaagattgaggagatggagatgaccaacagccacctggccaagcggctggagaagatgaaggccaataggacagcacttctggcccagcagtaggaaaaccacccttcaacctgggtgatgctccttggggccctacctagagggactgacttttgtccattgacacaaaccccttttagtactgttttgagttttgtcattaaaacagccacctttgtattttataatttatgacagaatgaagtcattttgaatctacatgaatgaacactttggattttgttgtagtttgattctagggtagaaccagtccatgctgtttttattttttatctccgtaattgtagaatcatgtttactcaacgtttttccccagctgcctcagtaactgggcactcggaggccttggcacgggttctggaggacagacagcaattctatgagtgctcactgagatacttgctggagacctcagaaaacacaagtgccttctccacggtgcaattcagacttcagtgatctccagtggtcaaaagacatttacccttaatatcagacaacatttatattttagtgaagaaacaagttctcgggtggggaatctatgtttcactcagatttatatgtttggaggaaaaaagcctttttttgtaaaatatttaaatttatataagaaaatgttagaaaaaaatatggggagtgtatataaaacttgctttattgcatggggcaggggaagtccaggcctaatactcctaaagtaagagttgggtcctttttttcttcaatacaactgtgctgtaccttgtaaagtattttatctgctgcttatttgtggaatgaaacctcaaacaaacccaaagggggagggtagggcagggcaggcagattggaaatctgcctgcagattctattaaatacacccttttgccaaccacaattggctactgacatgttcattttgttataggagactttaaaacaaatcatggcaaccacatccctcttcttttgtctccttctcaaggaaaaacaatctggaatgtagaacttttaaagacttgagtttcacctttagaggtaccctgtccaagaggtttttttaaaatcatggagtgcaactactttgcagaatttatgattctcttttgctcttagtacccaggtggttttatagaaatgattattgtatctttaaagtgcttacacagaaaatatattgggggaaaatctagtgactaaaggcacataagataataaaactagactttaaaaaggt

SEQ ID NO: 35337 - DNA, 1916 bp, Homo sapiens
taaaaatgcacttaggcagtcagtaaggaaagctttattttactctggcttctctctttatcttccttttcctgttttatttttttcattgactggaaaagatttatttccctgcttgatgtgattaaacatgttttgccaaattgatgcatgagaaccagtttctatgagaagtctcttctggagatgtatatccatgtaactctgtatttcctcccatatctgactgtttgtttccaatcttttgactgctttcttgctttttatgcctttatctttgcttatttgaattaggtacttctctgctacctttcacctgctctttttctgtgccattgtttcccttgctaccttacctaaaaccaggccctagagaaacagaaagaatacattgcctgccttaggaatgagcgagatatgctcagagaggagctggctgacctgcaggagacagtgaagacgggagagaaacatggcttagttataatccccgatggcactcccaatggtgatgtcagtcatgaaccagtggctggagccatcactgttgtgtctcaggaagctgctcaggtcttggagtcagcaggagaagggccattagatgtaaggctacgaaaacttgctggagagaaggaagaactactgtcacagattagaaaactgaagcttcagttagaggaggaacgacagaaatgctccaggaatgatggcacagtgggtgacctggcaggactgcagaatggctcagacttgcagttcatcgaaatgcagagagatgccaatagacaaattagcgaatacaaatttaagctttcaaaagcagaacaggatataactaccttggagcaaagtattagccggcttgagggacaggttctgagatataaaactgctgctgagaatgctgagaaagttgaagatgaattgaaagcagaaaaacggaagctacaacgagagttacgaacagcactggacaagattgaggagatggagatgaccaacagccacctggccaagcggctggagaagatgaaggccaataggacagcacttctggcccagcagtaggaaaaccacccttcaacctgggtgatgctccttggggccctacctagagggactgacttttgtccattgacacaaaccccttttagtactgttttgagttttgtcattaaaacagccacctttgtattttataatttatgacagaatgaagtcattttgaatctacatgaatgaacactttggattttgttgtagtttgattctagggtagaaccagtccatgctgtttttattttttatctccgtaattgtagaatcatgtttactcaacgtttttccccagctgcctcagtaactgggcactcggaggccttggcacgggttctggaggacagacagcaattctatgagtgctcactgagatacttgctggagacctcagaaaacacaagtgccttctccacggtgcaattcagacttcagtgatctccagtggtcaaaagacatttacccttaatatcagacaacatttatattttagtgaagaaacaagttctcgggtggggaatctatgtttcactcagatttatatgtttggaggaaaaaagcctttttttgtaaaatatttaaatttatataagaaaatgttagaaaaaaatatggggagtgtatataaaacttgctttattgcatggggcaggggaagtccaggcctaatactcctaaagtaagagttgggtcctttttttcttcaatacaactgtgctgtaccttgtaaagtattttatctgctgcttatttgtggaatgaaacctcaaacaaacccaaagggggagggtagggcagggcaggcagattggaaatctgcctgcagattctattaaatacacccttttgccaaccacaat

SEQ ID NO: 35338 - DNA, 1587 bp, Homo sapiens
  misc_feature (48)..(48): n is a, c, g, or t
  misc_feature (50)..(51): n is a, c, g, or t
  misc_feature (70)..(70): n is a, c, g, or t
  misc_feature (77)..(77): n is a, c, g, or t
  misc_feature (111)..(111): n is a, c, g, or t
  misc_feature (115)..(115): n is a, c, g, or t
gggacccttcccaaggggaagaacaaccttcttttgggaaaagaatanannatgggctaagacagaaatnattgctncttaggaatgacgagatatctcagagaggactgnctgnctcaggagcagtgaagcgggagagaaacatggcttagttataatccccgatggcactcccaatggtgatgtcagtcatgaaccagtggctggagccatcactgttgtgtctcaggaagctgctcaggtcttggagtcagcaggagaagggccattagatgtaaggctacgaaaacttgctggagagaaggaagaactactgtcacagattagaaaactgaagcttcagttagaggaggaacgacagaaatgctccaggaatgatggcacagtgggtgacctggcaggactgcagaatggctcagacttgcagttcatcgaaatgcagagagatgccaatagacaaattagcgaatacaaatttaagctttcaaaagcagaacaggatataactaccttggagcaaagtattagccggcttgagggacaggttctgagatataaaactgctgctgagaatgctgagaaagttgaagatgaattgaaagcagaaaaacggaagctacaacgagagttacgaacagcactggacaagattgaggagatggagatgaccaacagccacctggccaagcggctggagaagatgaaggccaataggacagcacttctggcccagcagtaggaaaaccacccttcaacctgggtgatgctccttggggccctacctagagggactgacttttgtccattgacacaaaccccttttagtactgttttgagttttgtcattaaaacagccacctttgtattttataatttatgacagaatgaagtcattttgaatctacatgaatgaacactttggattttgttgtagtttgattctagggtagaaccagtccatgctgtttttattttttatctccgtaattgtagaatcatgtttactcaacgtttttccccagctgcctcagtaactgggcactcggaggccttggcacgggttctggaggacagacagcaattctatgagtgctcactgagatacttgctggagacctcagaaaacacaagtgccttctccacggtgcaattcagacttcagtgatctccagtggtcaaaagacatttacccttaatatcagacaacatttatattttagtgaagaaacaagttctcgggtggggaatctatgtttcactcagatttatatgtttggaggaaaaaagcctttttttgtaaaatatttaaatttatataagaaaatgttagaaaaaaatatggggagtgtatataaaacttgctttattgcatggggcaggggaagtccaggcctaatactcctaaagtaagagttgggtcctttttttcttcaatacaactgtgctgtaccttgtaaagtattttatctgctgcttatttgtggaatgaaacctcaaacaaacccaaagggggagggtagggcagggcaggcagattggaaatctgcctgcagattctattaaatacacccttttgccaaccacaat

SEQ ID NO: 35339 - DNA, 1373 bp, Homo sapiens
  misc_feature (35)..(36): n is a, c, g, or t
cggatctcgggaatcgtggtgctgctcaggtctgnnagtagcaggagaagggcattagatgtaaggctacgaaaacttgctggagagaaggaagaactactgtcacagattagaaaactgaagcttcagttagaggaggaacgacagaaatgctccaggaatgatggcacagtgggtgacctggcaggactgcagaatggctcagacttgcagttcatcgaaatgcagagagatgccaatagacaaattagcgaatacaaatttaagctttcaaaagcagaacaggatataactaccttggagcaaagtattagccggcttgagggacaggttctgagatataaaactgctgctgagaatgctgagaaagttgaagatgaattgaaagcagaaaaacggaagctacaacgagagttacgaacagcactggacaagattgaggagatggagatgaccaacagccacctggccaagcggctggagaagatgaaggccaataggacagcacttctggcccagcagtaggaaaaccacccttcaacctgggtgatgctccttggggccctacctagagggactgacttttgtccattgacacaaaccccttttagtactgttttgagttttgtcattaaaacagccacctttgtattttataatttatgacagaatgaagtcattttgaatctacatgaatgaacactttggattttgttgtagtttgattctagggtagaaccagtccatgctgtttttattttttatctccgtaattgtagaatcatgtttactcaacgtttttccccagctgcctcagtaactgggcactcggaggccttggcacgggttctggaggacagacagcaattctatgagtgctcactgagatacttgctggagacctcagaaaacacaagtgccttctccacggtgcaattcagacttcagtgatctccagtggtcaaaagacatttacccttaatatcagacaacatttatattttagtgaagaaacaagttctcgggtggggaatctatgtttcactcagatttatatgtttggaggaaaaaagcctttttttgtaaaatatttaaatttatataagaaaatgttagaaaaaaatatggggagtgtatataaaacttgctttattgcatggggcaggggaagtccaggcctaatactcctaaagtaagagttgggtcctttttttcttcaatacaactgtgctgtaccttgtaaagtattttatctgctgcttatttgtggaatgaaacctcaaacaaacccaaagggggagggtagggcagggcaggcagattggaaatctgcctgcagattctattaaatacacccttttgccaaccacaat

SEQ ID NO: 35340 - DNA, 4286 bp, Homo sapiens
atcctgtacacatactcagttcctaattgtaagctcaattttggtattagcaaaagcatctgtcagtttttcctcaattactcgcacctcttcttgcctaaataaaacaaagaaacaaagaaaacaagtgtggtgtcattacacgtctcgggagttccccctggagggggaactccagagaaggggaacattaaatgttggagagatttgttaccatacattcatttatttaattaaagccgttttagttccttagcaaagcaactaatgctcacgctcacaactgaaggagaaataatatgccacaacacctaaaaacaccttggaacgcagtggagtggaaagggcagggactttaaataatgatgcttgggcttgtatccacttctactacctgttagtgtgtaaatggcagtgtctttatttgtacattggggatgttaatactatctttgtaggtaggtttaatatatggattaaatggaatactatatagaaaatgcctatcaaaattctcaaataggtgccaataaatattaatatctataaatgcaatcattattattattattgtgaataaaaataccattgcttgattttatcagtccttagcaaaacttcatacttgtaagcctgttttatctctgtggatgggcttctgaattcccttccttgagaagtattttaaagcaaggcaaacagtcagctgaagtaaggaatagatgatgaatgaggttaaaaaaaaatcacttattttaaaattaaataaatgtttgtggagtacctgttgtattcaaagccctgtgttaagtgctaggaatactattttaagccagtcagactagatttctgactttatggaatttatatcctcgtgaaagagatggaaaataagctagtaaagaaacaaaaagaaagaaatgtcagggactgtgaagagaacagataatgtgatagggaacctggaggggtctatgtgtgtgggttaccctttggatggggtgattagagatgcttctctgagaaactgacctttgagctgagacctgaaatgtgaggagccagttgcttgaagagctgggaggggagcgttctaggccagtgccaaggcctaaggtgagggagaactggtgtgtttggggaactaaaaagaggccggtatagtttatttccttcattattttgtcttacatttcctggtctttgggaatataaaaaaaggggaactgtgtaaactgagaaaaggtgcagtaaacaccctgcaaataattctgcattcagcatatatattcttaacagagttgatagctataatgaattataaattttgagaattatagtagaggtatatactgacctagaaatgcctctgttcagggtgataaatatcttaaacatgagagatttgctggtcctcaggaagtaaatgttctctgtagcataggactctagttaagatgagtaaaaaagctgattgtagagctgtgatttcatttaggaaccccttttcttttttatttttttgagtaggttaattgcagcagtttcctcattttatttcttggtactttatcacccatcaaaattttaaaaaacttttccctaattggccaatgttcttatttttttctttcttttttcttaaccttgaaagcatcttgttttttttctgaccgaaaggtatctgccgctgattatttcagtcgctccaatcgtaggggaagtgttgtctctgaggtggatgatatcagtatcccagatttgtccagcttggatgaaaaatctgacaaacagtatgctgaaaattatacaagaccttcatctcgaaattctgcctcagcaacaacccctctaagtggaaactcatccagacgaggaagtggggacaccagcagcttaatagatccagacacttcattaagtgaattgcgggatatctatgaccttaaggaccagatacaggatgtagaagggagatacatgcaggggcttaaagaactaaaggaatctttgtctgaagtggaagaaaaatacaagaaagccatggtttccaatgcacagttagacaatgagaagaacaatttgatctaccaagtagacacactcaaggatgttattgaagagcaggaggaacagatggcagaattttatagagaaaatgaagaaaaatcaaaggagttagaaaggcagaaacatatgtgtagtgtgctgcagcataagatggaagaacttaaagaaggcctgcggcaaagagatgagcttattgagaaacatggcttagttataatccccgatggcactcccaatggtgatgtcagtcatgaaccagtggctggagccatcactgttgtgtctcaggaagctgctcaggtcttggagtcagcaggagaagggccattagatgtaaggctacgaaaacttgctggagagaaggaagaactactgtcacagattagaaaactgaagcttcagttagaggaggaacgacagaaatgctccaggaatgatggcacagtgggtgacctggcaggactgcagaatggctcagacttgcagttcatcgaaatgcagagagatgccaatagacaaattagcgaatacaaatttaagctttcaaaagcagaacaggatataactaccttggagcaaagtgtaagtacttctatatggtactaagttatttaaatgtccttcctgcatctaagtggctaacaacccatgagtgcctgggttgcctttgcagttggatcaataatagttctgtattaaaatagaaaagccagcagagagcacttgttgggacattttagccttctgttttctctaaaaccataggaaactatagctatcagtttttgtagatatttcaggagaattcaagatcatcatttgtaataaaatcccttacgcattccaaaaagtgtaagaacttttccatttagtgtctcttcctatattgctttggcacttaaacaatatggtcataataaaacttagcatgggaaattggccctaaaatgactctacagctgtaatcctctctggggacattacttgatttataaatagcaactgagttctgagaggacttatgagtcacccttaggggacttgttagtagattacttggcatttataatgacattgtatttccatcctggctaccaaaaagtggtgacttctagtgcccagtactagaggcctatgttctcatacttacagattagccggcttgagggacaggttctgagatataaaactgctgctgagaatgctgagaaagttgaagatgaattgaaagcagaaaaacggaagctacaacgagagttacgaacagcactggacaagattgaggagatggagatgaccaacagccacctggccaagcggctggagaagatgaaggccaataggacagcacttctggcccagcagtaggaaaaccacccttcaacctgggtgatgctccttggggccctacctagagggactgacttttgtccattgacacaaaccccttttagtactgttttgagttttgtcattaaaacagccacctttgtattttataatttatgacagaatgaagtcattttgaatctacatgaatgaacactttggattttgttgtagtttgattctagggtagaaccagtccatgctgtttttattttttatctccgtaattgtagaatcatgtttactcaacgtttttccccagctgcctcagtaactgggcactcggaggccttggcacgggttctggaggacagacagcaattctatgagtgctcactgagatacttgctggagacctcagaaaacacaagtgccttctccacggtgcaattcagacttcagtgatctccagtggtcaaaagacatttacccttaatatcagacaacatttatattttagtgaagaaacaagttctcgggtggggaatctatgtttcactcagatttatatgtttggaggaaaaaagcctttttttgtaaaatatttaaatttatataagaaaatgttagaaaaaaatatggggagtgtatataaaacttgctttattgcatggggcaggggaagtccaggcctaatactcctaaagtaagagttgggtcctttttttcttcaatacaactgtgctgtaccttgtaaagtattttatctgctgcttatttgtggaatgaaacctcaaacaaacccaaagggggagggtagggcagggcaggcagattggaaatctgcctgcagattctattaaatacacccttttgccaaccacaat

SEQ ID NO: 35341 - DNA, 3429 bp, Homo sapiens
atcctgtacacatactcagttcctaattgtaagctcaattttggtattagcaaaagcatctgtcagtttttcctcaattactcgcacctcttcttgcctaaataaaacaaagaaacaaagaaaacaagtgtggtgtcattacacgtctcgggagttccccctggagggggaactccagagaaggggaacattaaatgttggagagatttgttaccatacattcatttatttaattaaagccgttttagttccttagcaaagcaactaatgctcacgctcacaactgaaggagaaataatatgccacaacacctaaaaacaccttggaacgcagtggagtggaaagggcagggactttaaataatgatgcttgggcttgtatccacttctactacctgttagtgtgtaaatggcagtgtctttatttgtacattggggatgttaatactatctttgtaggtaggtttaatatatggattaaatggaatactatatagaaaatgcctatcaaaattctcaaataggtgccaataaatattaatatctataaatgcaatcattattattattattgtgaataaaaataccattgcttgattttatcagtccttagcaaaacttcatacttgtaagcctgttttatctctgtggatgggcttctgaattcccttccttgagaagtattttaaagcaaggcaaacagtcagctgaagtaaggaatagatgatgaatgaggttaaaaaaaaatcacttattttaaaattaaataaatgtttgtggagtacctgttgtattcaaagccctgtgttaagtgctaggaatactattttaagccagtcagactagatttctgactttatggaatttatatcctcgtgaaagagatggaaaataagctagtaaagaaacaaaaagaaagaaatgtcagggactgtgaagagaacagataatgtgatagggaacctggaggggtctatgtgtgtgggttaccctttggatggggtgattagagatgcttctctgagaaactgacctttgagctgagacctgaaatgtgaggagccagttgcttgaagagctgggaggggagcgttctaggccagtgccaaggcctaaggtgagggagaactggtgtgtttggggaactaaaaagaggccggtatagtttatttccttcattattttgtcttacatttcctggtctttgggaatataaaaaaaggggaactgtgtaaactgagaaaaggtgcagtaaacaccctgcaaataattctgcattcagcatatatattcttaacagagttgatagctataatgaattataaattttgagaattatagtagaggtatatactgacctagaaatgcctctgttcagggtgataaatatcttaaacatgagagatttgctggtcctcaggaagtaaatgttctctgtagcataggactctagttaagatgagtaaaaaagctgattgtagagctgtgatttcatttaggaaccccttttcttttttatttttttgagtaggttaattgcagcagtttcctcattttatttcttggtactttatcacccatcaaaattttaaaaaacttttccctaattggccaatgttcttatttttttctttcttttttcttaaccttgaaagcatcttgttttttttctgaccgaaaggtatctgccgctgattatttcagtcgctccaatcgtaggggaagtgttgtctctgaggtggatgatatcagtatcccagatttgtccagcttggatgaaaaatctgacaaacagtatgctgaaaattatacaagaccttcatctcgaaattctgcctcagcaacaacccctctaagtggaaactcatccagacgaggaagtggggacaccagcagcttaatagatccagacacttcattaagtgaattgcgggatatctatgaccttaaggaccagatacaggatgtagaagggagatacatgcaggggcttaaagaactaaaggaatctttgtctgaagtggaagaaaaatacaagaaagccatggtttccaatgcacagttagacaatgagaagaacaatttgatctaccaagtagacacactcaaggatgttattgaagagcaggaggaacagatggcagaattttatagagaaaatgaagaaaaatcaaaggagttagaaaggcagaaacatatgtgtagtgtgctgcagcataagatggaagaacttaaagaaggcctgcggcaaagagatgagcttattgagaaacatggcttagttataatccccgatggcactcccaatggtgatgtcagtcatgaaccagtggctggagccatcactgttgtgtctcaggaagctgctcaggtcttggagtcagcaggagaagggccattagatgtaaggctacgaaaacttgctggagagaaggaagaactactgtcacagattagaaaactgaagcttcagttagaggaggaacgacagaaatgctccaggaatgatggcacagtgggtgacctggcaggactgcagaatggctcagacttgcagttcatcgaaatgcagagagatgccaatagacaaattagcgaatacaaatttaagctttcaaaagcagaacaggatataactaccttggagcaaagtattagccggcttgagggacaggttctgagatataaaactgctgctgagaatgctgagaaagttgaagatgaattgaaagcagaaaaacggaagctacaacgagagttacgaacagcactggacaagattgaggagatggagatgaccaacagccacctggccaagcggctggagaagatgaaggccaataggacagcacttctggcccagcactgcctcagtaactgggcactcggaggccttggcacgggttctggaggacagacagcaattctatgagtgctcactgagatacttgctggagacctcagaaaacacaagtgccttctccacggtgcaattcagacttcagtgatctccagtggtcaaaagacatttacccttaatatcagacaacatttatattttagtgaagaaacaagttctcgggtggggaatctatgtttcactcagatttatatgtttggaggaaaaaagcctttttttgtaaaatatttaaatttatataagaaaatgttagaaaaaaatatggggagtgtatataaaacttgctttattgcatggggcaggggaagtccaggcctaatactcctaaagtaagagttgggtcctttttttcttcaatacaactgtgctgtaccttgtaaagtattttatctgctgcttatttgtggaatgaaacctcaaacaaacccaaagggggagggtagggcagggcaggcagattggaaatctgcctgcagattctattaaatacacccttttgccaaccacaat

SEQ ID NO: 35342 - DNA, 2177 bp, Homo sapiens
atcctgtacacatactcagttcctaattgtaagctcaattttggtattagcaaaagcatctgtcagtttttcctcaattactcgcacctcttcttgcctaaataaaacaaagaaacaaagaaaacaagtgtggtgtcattacacgtctcgggagttccccctggagggggaactccagagaaggggaacattaaatgttggagagatttgttaccatacattcatttatttaattaaagccgttttagttccttagcaaagcaactaatgctcacgctcacaactgaaggagaaataatatgccacaacacctaaaaacaccttggaacgcagtggagtggaaagggcagggactttaaataatgatgcttgggcttgtatccacttctactacctgttagtgtgtaaatggcagtgtctttatttgtacattggggatgttaatactatctttgtaggtaggtttaatatatggattaaatggaatactatatagaaaatgcctatcaaaattctcaaataggtgccaataaatattaatatctataaatgcaatcattattattattattgtgaataaaaataccattgcttgattttatcagtccttagcaaaacttcatacttgtaagcctgttttatctctgtggatgggcttctgaattcccttccttgagaagtattttaaagcaaggcaaacagtcagctgaagtaaggaatagatgatgaatgaggttaaaaaaaaatcacttattttaaaattaaataaatgtttgtggagtacctgttgtattcaaagccctgtgttaagtgctaggaatactattttaagccagtcagactagatttctgactttatggaatttatatcctcgtgaaagagatggaaaataagctagtaaagaaacaaaaagaaagaaatgtcagggactgtgaagagaacagataatgtgatagggaacctggaggggtctatgtgtgtgggttaccctttggatggggtgattagagatgcttctctgagaaactgacctttgagctgagacctgaaatgtgaggagccagttgcttgaagagctgggaggggagcgttctaggccagtgccaaggcctaaggtgagggagaactggtgtgtttggggaactaaaaagaggccggtatagtttatttccttcattattttgtcttacatttcctggtctttgggaatataaaaaaaggggaactgtgtaaactgagaaaaggtgcagtaaacaccctgcaaataattctgcattcagcatatatattcttaacagagttgatagctataatgaattataaattttgagaattatagtagaggtatatactgacctagaaatgcctctgttcagggtgataaatatcttaaacatgagagatttgctggtcctcaggaagtaaatgttctctgtagcataggactctagttaagatgagtaaaaaagctgattgtagagctgtgatttcatttaggaaccccttttcttttttatttttttgagtaggttaattgcagcagtttcctcattttatttcttggtactttatcacccatcaaaattttaaaaaacttttccctaattggccaatgttcttatttttttctttcttttttcttaaccttgaaagcatcttgttttttttctgaccgaaaggtatctgccgctgattatttcagtcgctccaatcgtaggggaagtgttgtctctgaggtggatgatatcagtatcccagatttgtccagcgtgagtgtattgcatggggtggttggttatgttgtcccaggcttgtgactaacagctaatatgttagctattttataataaaagtgggaacttgatttattgtcttaagaaatatttgtttgggccgggcatggtggctcacacttgtaatcccagcactttgagagaccagaacaggcagatcacctgaggtcaggagttcgagaccagcctggccaacgtggtgaaactctgtctctattaaaaatacaaaaaaaattagctgggtgtgggggcgcacacctgtaatcccagctactctggaggctgaggcaggaatatcgcttgaacctaggaggtggaggttgcagtgagccgagaccacaccactgcactgtatcctgggcaacagagtgagactccatctc

SEQ ID NO: 35343 - DNA, 2901 bp, Homo sapiens
atcctgtacacatactcagttcctaattgtaagctcaattttggtattagcaaaagcatctgtcagtttttcctcaattactcgcacctcttcttgcctaaataaaacaaagaaacaaagaaaacaagtgtggtgtcattacacgtctcgggagttccccctggagggggaactccagagaaggggaacattaaatgttggagagatttgttaccatacattcatttatttaattaaagccgttttagttccttagcaaagcaactaatgctcacgctcacaactgaaggagaaataatatgccacaacacctaaaaacaccttggaacgcagtggagtggaaagggcagggactttaaataatgatgcttgggcttgtatccacttctactacctgttagtgtgtaaatggcagtgtctttatttgtacattggggatgttaatactatctttgtaggtaggtttaatatatggattaaatggaatactatatagaaaatgcctatcaaaattctcaaataggtgccaataaatattaatatctataaatgcaatcattattattattattgtgaataaaaataccattgcttgattttatcagtccttagcaaaacttcatacttgtaagcctgttttatctctgtggatgggcttctgaattcccttccttgagaagtattttaaagcaaggcaaacagtcagctgaagtaaggaatagatgatgaatgaggttaaaaaaaaatcacttattttaaaattaaataaatgtttgtggagtacctgttgtattcaaagccctgtgttaagtgctaggaatactattttaagccagtcagactagatttctgactttatggaatttatatcctcgtgaaagagatggaaaataagctagtaaagaaacaaaaagaaagaaatgtcagggactgtgaagagaacagataatgtgatagggaacctggaggggtctatgtgtgtgggttaccctttggatggggtgattagagatgcttctctgagaaactgacctttgagctgagacctgaaatgtgaggagccagttgcttgaagagctgggaggggagcgttctaggccagtgccaaggcctaaggtgagggagaactggtgtgtttggggaactaaaaagaggccggtatagtttatttccttcattattttgtcttacatttcctggtctttgggaatataaaaaaaggggaactgtgtaaactgagaaaaggtgcagtaaacaccctgcaaataattctgcattcagcatatatattcttaacagagttgatagctataatgaattataaattttgagaattatagtagaggtatatactgacctagaaatgcctctgttcagggtgataaatatcttaaacatgagagatttgctggtcctcaggaagtaaatgttctctgtagcataggactctagttaagatgagtaaaaaagctgattgtagagctgtgatttcatttaggaaccccttttcttttttatttttttgagtaggttaattgcagcagtttcctcattttatttcttggtactttatcacccatcaaaattttaaaaaacttttccctaattggccaatgttcttatttttttctttcttttttcttaaccttgaaagcatcttgttttttttctgaccgaaaggtatctgccgctgattatttcagtcgctccaatcgtaggggaagtgttgtctctgaggtggatgatatcagtatcccagatttgtccagcttggatgaaaaatctgacaaacagtatgctgaaaattatacaagaccttcatctcgaaattctgcctcagcaacaacccctctaagtggaaactcatccagacgaggaagtggggacaccagcagcttaatagatccagacacttcattaagtgaattgcgggatatctatgaccttaaggaccagatacaggatgtagaagggagatacatgcaggggcttaaagaactaaaggaatctttgtctgaagtggaagaaaaatacaagaaagccatggtttccaatgcacagttagacaatgagaagaacaatttgatctaccaagtagacacactcaaggatgttattgaagagcaggaggaacagatggcagaattttatagagaaaatgaagaaaaatcaaaggagttagaaaggcagaaacatatgtgtagtgtgctgcagcataagatggaagaacttaaagaaggcctgcggcaaagagatgagcttattgagaaacatggcttagttataatccccgatggcactcccaatggtgatgtcagtcatgaaccagtggctggagccatcactgttgtgtctcaggaagctgctcaggtcttggagtcagcaggagaagggccattagatgtaaggctacgaaaacttgctggagagaaggaagaactactgtcacagattagaaaactgaagcttcagttagaggaggaacgacagaaatgctccaggaatgatggcacagtgggtgacctggcaggactgcagaatggctcagacttgcagttcatcgaaatgcagagagatgccaatagacaaattagcgaatacaaatttaagctttcaaaagcagaacaggatataactaccttggagcaaagtattagccggcttgagggacaggttctgagatataaaactgctgctgagaatgctgagaaagttgaagatgaattgaaagcagaaaaacggaagctacaacgagagttgcgaacagcactggactgatgggagaagatgccagtcttctcccatcagccagtcttgctcccatctacgtcattgtgtgacacgtcattggactgctgttattgataaccaacagaggtcatgtatagaatccgctgatgg

SEQ ID NO: 35344 - DNA, 1529 bp, Homo sapiens
tcggccgctcaggctgcggctcctcccggggccggttcccgctgtctcagccgcggcgcagagggcacatcggcctgaccgactagccggctgccagtgccgggagccgccgcgtccatccccgcccgcctggccggggacccaggactgagtcgtccagctgcgcccctcgcccatagccccagcgggcgccgggcgggcgagcagctcttcggcccttcccggacagcgacgcagtcgcagcgcgcgccctaacacagatgtgggaagataaatgaaggggtctagatgtaaatgtcagtggaaaggagagctaccatcactaagggtctcactctgatgcccacgctggagtccagtggtatgaacacagatcactgcagcctcgacttcctgggctcgggtgattctcccacctcagcctcccaagtagctgagactacatgcatacatcatcacacagggccaatttttgtattttttgtagaaacggggtgtccgcatgttgcccacgctggtctctaactcctgggctcacatcgttcacccaccttggcctcccaaagtgctgggattacaggcatgagccaccgctcctggctttctttaatgtaacttaaataaaatataaggttttactttatttgtgctttttggaaatgtctcctgatttttaataacagtttattatgccttgtaccagcttttttattaatatataaggtgcccactatattataccaattatgctgcttatatagttattcatatgcatctcaaaaccttccttaatgtacttataatgaggtaacaccatagcaaaattgcatctttttcattatctgcatttaatatctatagtttaccaacgatgacactgcaagcattgtgtcttctgatcgtgccagtcgtggacgaagggagagtgtggtgagcatgatttgcatgcaaagaaataagatgagttttaaatgacagcaatgcatgatcacatgaagtctgttggaaagtgaagtttgcatttgacaaaaagagcattttcctcaaatttagttatataaatattttgccttataaaacatgttgagaacacatattctctgtgggctgtgcaagctttcattaataatttgcctttttacatctcttaggagtgaatcattatttgaaaagtttttactttttcttctttgttgctgttttatgcacatacatgtgtgtgcagttcaccaaagacaaatttcttcagcaaaattaatgtttccatattgtataaaactcataactatggattacaaatcatgttaccattaattgctttctatattgttgtatttagatttaaccagtgtttatccacctgttaagacctgtaatccagtcagggtggctcatgcctataatcccagctacttgggagactgaggtgggaggattgcttgagcccaggagtttgaggctgcagtgagctatgattgcatcactgcactccagtgtgggtagcaaagtgagactgtgcctctcaaaag

SEQ ID NO: 35345 - DNA, 180 bp, Homo sapiens
aggactgcagaatggctcagacttgcagttcatcgaaatgcagagtaggtaccaggggacaggccagtcccagtctgtatatagactgtgtcccaggggtgggtttgtcagcaggttgctggtatcttgtaatacacttttcttttttttttttttttgagatgggagtctcactctgtc

SEQ ID NO: 35346 - DNA, 304 bp, Homo sapiens
tgtatttcctcccatatctgactgtttgtttccaatcttttgactgctttcttgctttttatgcctttatctttgcttatttgaattaggtacttctctgctacctttcacctgctctttttctgtgccattgtttcccttgctaccttacctaaaaccaggccctagagaaacagaaagaatacattgcctgccttaggaatgagcgagatatgctcagagaggagctggctgacctgcaggagacagtgaagacgggagaggtatgttagcattagcctggaattcaggtccctcactgttt

SEQ ID NO: 35347 - DNA, 256 bp, Homo sapiens
taggcttcaaacatcattgaacttggaaaactcaagatcacttttttcctcccaaaaaaagtcaacttgctaagcatctttactgatttttatctttgttcttttctagttggatgaaaaatctgacaaacagtatgctgaaaattatacaagagtgagtatgtaaattcctaagggaaattctcaaggtcaattaaacttgctatctgtaacttgttcattatttattttacaacaattggtctgatgtagctgc

SEQ ID NO: 35348 - DNA, 497 bp, Homo sapiens
ttttttttgagatggagtcttgctctgtcgcccaggctggagtgcagtggcacgatctcagctcattgcaacctccgcctcccaggttcaagtgattcttctgcctcagcctcccgagtacctgggactacaggcgctcgccaccaagcccagctaatttttgcatttttagtagagacagggtttcaccatattggccaggctggtctcgaactcctgacctcgtgatccacccactttggcttcccaaaatgcagggattacaggtgtgagccaccgcgcctggctgtaacacaataatttaagatgacaacattcgaggaagttagaactgagaagagggtacacagcattttctgcgagattgactcaactttgattccatcaaggaaacaaaaatattgtatagaaatttactcttcattctctcccaaaacatttaagagtttttcatttttctttgtaagaatataaaaggttttcctaaactctttgca

SEQ ID NO: 35349 - DNA, 628 bp, Homo sapiens
aggtggtagaaatcataactgcctccagaaatcaggagggcccacgcagtacaggacttggcaggccctggtggcctaaggtcagccagagtgcagatgcaatgcagcaactatagtaccagcattattctagaaagttcttacttcttggaagtactgacttgtaagtaaaagagcattttaacttgatcatattcactctggagtcttctacatctgaatctaaaggggaactgtattcttcctgcaaatttgggattctctaaataaagttccagggcaccagaggttccactgggttagacctttgatttattttaatgaagagcccttcttctttgttgatgtctgacagcacattcacagtgatccagtcatttttggggtaagatagaaggaatccaggtagaatacaatataaaaatgtctcaaactaggcaagagaagagtctagtcctgtggtaggtcatatttgtcaaaatatttgctaccctcttagctgttcatcctcactgagcctctctcttcaaaagattatccttcatatcccaacactgtgaggcttgagcacgtgctttgctttgaacaatgaaatacaagggaagcaatgtaatccatttctgagcca

SEQ ID NO: 35350 - DNA, 380 bp, Homo sapiens
atatgaaacaaaaagtggcaattattgcaggtttccttttagtttacaaaagtactggaaactaaatcatatttcttccctccaaatttcacccattcctgactttgaatcaattgcagaaatgcaggtgtgttactttgttgatcaataactttggaacaattatggatcaattctatggtcactctgaattttcatgtcattaatcacataaaaattgataatacctcattctgtattacaatatgattttattttgccaaaggcaagacacctatagttgagctgtattttgggggattgggtgaggaaggacttctgatcttatctcaacaaaaaactggccagtatttttgttaatgtaaagcttccttttcttt

SEQ ID NO: 35351 - DNA, 179 bp, Homo sapiens
gtctctaccaaaaaaattttttttaaaagttagccaggcatggtggcacgtgcctgtagtcccagttacttgggaagagtgggagaatccgttaagcctgggaggttgaggctgctgtaggctgaaatcacatcactgcactccagcctgggtgacagagtgagaccctgtctcttaaa

SEQ ID NO: 35352 - DNA, 856 bp, Homo sapiens
acacaccccagctgtggctgccctgaatagtggactgcagtggttgatggcacgtgttaaattgtgtctttgttatgggaggtgagaatttggctggggacaggaagttgaccgaaattttcctattaagatcagccacttctggtgatagtagctttgtccaacctcatccacctgggcacaggaatacacttttatgaaaaggcttttgcccttgagcctgtggtagttgactcttttggagaactgggctggaccacccagaagatccattttacaatgacgaatggcataaccaagtacccttaaccaaagcaagctgagtgacttccccctttcattgacgaccttgattccactctggtggaaagagaagttaaattcgaggaaactttgccaagaaagagtagccaaggcaagggggaagagtgaattactccctgaagcctggaggtgagtgctcctcccaccttcaggagacatgtctttctgccagccaccagagaagaagcatgggggtgtggcttttggctgtttttttaataacctcccaggttttgtctgcttatagaaaatgaaaggcttagtaccagtgaatgaccaaatgttatttagcccatctgtagaataccacactctctctacatctagattttttcctctttccaaatatatttatcaatacagatgttagtactttcttctcttttaatattttctaattatatttaatcagtactctaaatataattcaacaggtgactttgcagaagtagactgtcagagtaacctacatattaaaaattgacagtaataaaaatggtaaagagttttaaccttgatgtttattgttatg

SEQ ID NO: 35353 - DNA, 717 bp, Homo sapiens
ggaggaaagaggtgagcctaattagcgcccatgttcccttccaagcctgttctgcagttgtcactaatacacagtagacatcactttttgctgttagtgtgttcccgaacaaactcttttttaatccaactattgtaaaggctgtaaatggctttgctggttcagtaaccccatgctaaattctttttttccttgttttcaatcctgctccttctgtatgtaaattattttttaaagaaaaaaaaataccttgagaaataggatagcacaatggttaaggagcatggactttgcagctagactgcctagtttagaatcctggctctgccatgtattagtcatgtggccttggtcatgttacttaacctttctatacttctgttacctcacctgtaaaatggggataataacagtacctgtctcatagagttgtgagggttaaatgaatatgtaaaagtgtttggcacatggcttggcatgtagtaagtgctataaaatgtttgctctgattactgttattgttgctataatttactctgttgacctgggcctttcatatgttggtaggctttaaaggatttttctccaagcattcgtcattctgctgcgtgagcacataccttgtgattagatgtttgactatttaaacaggcaaaactaggaatacatttctgcatatatatcaattttacattcttagagggatcagaatgtttg

SEQ ID NO: 35354 - DNA, 490 bp, Homo sapiens
cacataagagcctgccaatgaccacagattctcagaggaaccttttttttaaaactccacccacagctaacactaagattacttccttcctgaatacatatcaccagacgctctcctttgtcccattgtcgctatattgccaaatgccttctctcgatttttggtcaaagtcctaatcatttcaggtccaattaaaaactcagtatctcttgagccttccccacaccatatgttgcaaaattatctggtctttccacattcacagcgttcacaggccactgttgcattacctattagtctgtgagtgtacacgttcggaccccacactggattctgagctttttgaaagcccagagctgtatcatttatttctggagccccagttcctggctcactgttgtgcagagtagttgtttcatagatatttattgatcaaatagaatttatggcaaaaccagtacttctcttctttttgaatagtaataaaaaa

SEQ ID NO: 35355 - DNA, 517 bp, Homo sapiens
ctgcaggtcaccatctccttgtccaccgctgtggtcccagtacctaggctggggcctgacaggtggtagatgctccacagaggtgctcgctgccctccccgcattctcttgtttcatcttcacagctccactgtgtgagtgctgccgttatccccactttccgaatgcagaaaccgagactcagaaggggaggtggcttgccagagccaggcaggtaggcaaggggtggggagaatggtgggaatcacgattttaacccaggtctttttgactccaaagtccgaacagcatgcctcaccctctggacaggtgtttaaacaggcatgtgcatgtcacccagtcagagccagtgactcatcagcaacgttggttggagcttccaggaaagagatgccatctgccccactggagagcctcgggttgaaggcgaagccgtggaagacggaccagagcctggaggggatcaggcctgcagtggcatcgtcggaggcactgcatcacgcctcacctgaacgag

SEQ ID NO: 35356 - DNA, 647 bp, Homo sapiens
tcacaaatattttcgaggtccttgcccccaagagggtagacagaataaaaaggaggaaggaagtgacttggaaaaaattaagttgggtaaggaatataagagaatgctacgtagaaggatgtgtgttgtgaatgcaatagtttctgtagtattgtcaaagttctctgatcatttcagtatgtgaaggtaaacttagataactgggggaaggaactatatatttactacattgtaaaagaataattgtagacagaagatctactttgggtgattaaatgttgaaaacaagtggtgggagagagaagttagtgttgattgtgatcacacacttttctatacagtaatttgtttgatcactcatgataatgccttacattttgtatgtactaaataaatgagttctctagaaattctatgttgtggtgataaagaattacgttcagattgaagattcgaacagctgtgcaaccttctcaacatttaagaaactgcgaacaagcatagaaagaagattaaagccttttaaataagattcttttttttcagcctctttttggaacattttattgtgaaaaggtttcataaatactgtcaatacatcacgttcagtcatttgcaattgtatttcaaaaattcagttggcctgc

SEQ ID NO: 35357 - DNA, 1165 bp, Homo sapiens
gcaatgatgatgaaaactggaaacaagcaggtggccattaccgcaattaaggctaaaatctaggttaagaaaggggagagagaactgcaaatgaaaagggcaaagatgcagtgaggatgagaagttacaaaagctaaaaagaaggaagtaatactaagaggtgttacagagtccagctcaaaggacagaaaaaaggaggaacttcagataacaatttttaaaatacttattaacagccaattatgagtcaggtactttacaaggtgttcaatggacattatctattttacttatttttattttatctttttggtttactttttttctttttttttcattttacattatctattttaatcctcacaatatccctgtaaggtaggtatattaccttcagtttccagatcaagaaactgaagtgcacagaagtttgaagtaacttactcaaaccacttcactaataaccagggtaggcaggactcaaatacagacagtttgcctccaaaatacatggtcctaatcacctccctatgttgtgtccatgcagtcacgagtttggcatgaggagagctggaggaagagcccaggagacagtgaagaggaagcaagaggctgtatatgtagccagctgggtttgggggcacctcatgagtatcccatagcacaaacgggcaaactctgttactggcacattaactaaaagacaaaactccacataaacctgagtccttccaaccaacccggagacttacccaaatctaatctaaataacaacaacaaaaaagaaaaaatcactatgagcctgtaagtcattaagggggtacatcttcaaatgacatgctatcactaaccatggcttaaaaccccacagatccctaaaacttaaagtataataataaataaaaataaaaaaatttaaaaattaaaaaaaaattttacatttatctttaagaatttgtgtttgagaataattagctcttgccattctactactctgtatgtatgtgggttatcattcttgtgtctttcttctgcttgagtaaataaaaagcaagaacaacaacaaaaaaccccacagaggagaagacttagcaattgtagtgaatatgggctgaattcaaaaagtggcctggagattttgccttgaattacttgggtgggataa

SEQ ID NO: 35358 - DNA, 264 bp, Homo sapiens
cgcacaaccaaccaggccctcaaaaccttcgccctggtggcggctggccgctccctcctggccagctcctccgtggggtcctcgtagcaaaggcgaatttaagggttgcccgggcgcccctcgctccaggcgggtagctgtggggacctacacccgcggtactccctgagcggccggtccctgcctggagtgccctggtagggccggcggcggctccgtttgggacggatcctgcgttgaatttgacttttcgagggcggccgc

SEQ ID NO: 35359 - DNA, 280 bp, Homo sapiens
gaaacctaaagtattttgcagtgacttagtcttattatctgaaatgtaattgttaaaggctgatcttaatttgcttcctctactgatggcagagagctaagagagtatacctagcaacttaaatttaccttttccatgacctttcccaccacacacacacacacacacacacacgcaatcaagatctggactagatgaattgctgcatgctcagctggcccagtttaacccttttgggagaatttgtatttgtcaaggaatgctgagtaactatattgca

SEQ ID NO: 35360 - DNA, 303 bp, Homo sapiens
tctgcaatgcccatcctccatgtctctcttcctgtctctgtgtcactgtctctctcgtcttgttgcacctagttctatccatctaccaacgacaaagaggctatcaaacccacactgctttcacagcatcatccccctgcctaagaacctcccatggctccctcctgcctcacagataccatctacacctcctggtttgacattcaagtgcttctgccacccaccatacccaggtccttcttcagcctcatctctacacacttggccagtcctctaacttcctcccaccctgaatcttataag

SEQ ID NO: 35361 - DNA, 531 bp, Homo sapiens
aatcaaggtaattagcacatcgcctcatgcatttagcacttctttgtcttgtgaacattcaaaatcctctcttctagctttgtaaaaatgcacaataaattatagttaactatattcaccttacagtactacagaaacatttaaaacattatttcttgagatcttggttctttaggtgactgttgtggtggtgattaatcagtatcatgaaaatacttatgtttgtctatcatggtatttcagaagactacagttatagagctggggtgcatacaattgcccaaccacaatgatatccatttacatatttcaccttttgacctatttcttcatgaatatagttcatctgtttataactcttatacttgtgtgactgttgatagaaggcctgaatgtttatgcttgcaaaaatgtgtgttatcgcttattttattgtgtaaggtgatctttgaagtgttctgttgtgtttttatttttgtgtttttatatgttactcaaataaataccttttaaaaatgtaaataaatatat

SEQ ID NO: 35362 - DNA, 360 bp, Homo sapiens
gagttcgagaccagtcaggccaacatggtgaaacctcatctctactaaaaatacaaaaattacctgggcgtggtggtgcacacctgtagtcccagctactcaggaggctgaggtatgagaatcgcttgaacctgggaggcagaggttgcagtgagcaaagatcatgccactgcaccccagcctgggtgacagagcaagactccattttgaaaaaaaaaaaaagtgacttaattataaaaaaagagaatgagacttgaatatagaaggacaggatagaaataatctaattaggctgggcaaggtggcccacgcctgtaatcccagcacttggggaggccaaggcaggcagatcactggagg

SEQ ID NO: 35363 - DNA, 562 bp, Homo sapiens
cagcctgggcaacagagtgagactccatctcaaaaaaaagaaagatactatgccagtgctatcagacagatgaaacacttcagcctggtgtgcccaagtaaggctttctggtagatgatgcctgaactgagtcctaaaggacggagtaaatgttcatcaggaaagagggagggaaagggtattgtagacagtgtagccagtaaaaaagacttggaaatgtgagcatggagtgtgaatccggtctaagaagaggagtaagacgaaaaaagactggctgggcttggtggctcacacctgtaatcccaacaggttgggaggccaaggctggtcgattatttgcgtccaggagttcaagaccagtttgggcaacagggcaaaaccctgtctctactaaaaacataaaaaattagctgggcatggtggtatacgcctgtggtcccagatactcaagaggccgaggtgggaagatcacttcagcccgggaggcagaggttgcagtgagctgagatcacaccactgaactccaatgtgggtgacagagtgagaccatgtctcaaaaaaa

SEQ ID NO: 35364 - DNA, 368 bp, Homo sapiens
agaaagagagccctcaccacaaactgaccttgccagaccttgatctgggacttcgaacatccacagctgtgagaaaattaatgttctgttgtttaagccccctagtctgtatctgcaatattttgctatcacagcctaagcagactaatgcaggctccaaattggtttccttctccataattaccctagcgccatgtccaaaccatctgaagcactattccagagtgacctttataaaaatgccattttgatcacattattcctatatgtaagaaaaaaaaaatcaatcaatggctgtctccactgccagagtccaaacagtttcctctctaatggccttatctaccctcactacatcattgcctacc

SEQ ID NO: 35365 - DNA, 321 bp, Homo sapiens
gtgtagacattgcatcatgtttatttgaaatggataaatagaaaaagggactgaatggattagtattctagatgtgtgccttatagtaaagaagaggataacgatgacactatggaattacgtttttttaggaatatagaaccccaagaagattttgttcattaggttttattctgttgatctgatatggataagatctctgggaaatcatatatggtataactatatagattgaattatagtttaaggtacatagatttagtttctagccctaactcattttgtaaaaacaatttcttctgcctccttttcagagagtac

SEQ ID NO: 35366 - DNA, 816 bp, Homo sapiens
caggattcaataaaagaagtgctaagagggaaatgttacagtgataaatacctacattaaaaaataagaaagatctaactcgaacaacctaactttacaaataaacaattagaaaaagagaaactaactaaacccaaagttagcataatgaagtaaataataaagattagaatataaataaaataactataaaatagaaaacaatagaaaaatcaacaaagttagagttgaatttttggaaatacaaacaaaaataacagacccttagctacactaagaaaaaaagagaaactcaagtaaatataatcagaaatgaaaatggagacattataggaaatgtacaggaatacaaatgattataaaggacaattaagcgattatatgccaataaattggataacctagaataaatggataaattcttagaaagatgcaatctaccaaaatggaacaaaaaagaaatagaacagaccaaaagcaagcaaagagatttaatcagtaatcaataatttcccaacaaagaaaagcccaggtgcagatgctttcatgggcaacttctaccaaacattcaaagaagaactaacaccaaaacttcttaaactcttcagaaaaaatagaagagagaatactctcaaactcatttcatgaggccgatgttaccatgacttaaaagctagacgaagacaacacaagaaaaaataattacagaccagtatccttaacgaatatagatgcaaaaattctcagtaaaatactaactagcaaactgaattcaaaagcacattgaaaaggtcatacaccatgaccaattgtaac

SEQ ID NO: 35367 - DNA, 2115 bp, Homo sapiens
agaaaaccacagggcgcggggccagggcggcggcccccagggagttggcaggatggcagagggcaaggcaggcggcgcggccggcctcttcgccaagcaggtgcagaagaagtttagcagggcccaggagaaggtgctgcagaaattggggaaagctgtagaaaccaaagatgaacgatttgaacaaagcgctagcaacttctaccaacaacaggcagaaggccacaagctgtacaaggacctgaagaacttccttagtgcagtcaaagtgatgcatgaaagttcaaaaagagtgtcagaaaccctgcaggagatctacagcagcgagtgggacggtcatgaggagctgaaggccatcgtatgggagagaattgccaagcggggtcggaaactcgtggactatgacagtgcccgacaccacctggaggcagtgcagaatgccaagaagaaagatgaggccaagactgccaaggcagaggaagagttcaacaaagcccagactgtgtttgaagatctgaaccaagaactactagaggagctgcctattctttataatagtcgtattggctgctatgtgaccatcttccaaaacatttccaacttgagggatgtcttctacagggaaatgagcaagctgaaccacaatctctacgaggtgatgagcaaactggagaagcaacattccaataaagtctttgtggtgaagggactgtcaagcagcagcaggcgctctttagtcatttctcccccagttcgaacagctacagtctccagtcctcttacctcacctactagtccctctacactttccttgaagagtgagagtgaatctgtctcagcaactgaagatctggcacctgatgcagcccaaggggaagacaattctgagatcaaggagctcttagaagaggaggaaatagagaaggaaggatctgaagcaagctcctctgaggaagatgagcctctaccagcctgcaatggccccgcccaggcccagccctctcctaccactgaaagggccaagtcccaggaggaagttctccccagctccacaactccatcaccaggcggagccctgagcccttcagggcagccttcatcatctgccacagaagtagtcctccgaacccgcaccgcaagtgaaggatctgaacaaccaaagaagagagcctctatccagaggacctcagcaccccctagtaggcctcctccacccagagccactgcaagccccaggccctcctcagggaacataccttccagccctacagcctctggagggggttcacccaccagccctagggcctccttggggactgggactgcaagtcctaggacctccctagaggtctctcctaatccagaaccaccagagaagccagtaagaactcctgaggccaaagaaaatgaaaacatccacaatcagaaccctgaagaactttgtacttcccccaccttaatgacatctcaggttgcttcagagcctggagaggcaaagaagatggaagacaaggaaaaggataataagcttatctcagctgactcctcggagggccaagaccagcttcaagtctccatggtaccagaaaacaacaacctcacagcacctgaacctcaagaagaggtatccacaagtgaaaatccacaactctgaagagaaactaccaagactcctcctgccccaaacctcgccagagaagctcttcaaccagagggtataggtcagagggatataagagccagcatccatccctgggttctcagtaggaatgctggtgctgtctaaagacctggcattaatggaggcggaggagcagccttacgggagggatggagggaggcaggctggggagaagagaacattagactcagggaatatttaattctggttttagcattattagaataagactttatacattaactaaagtggagctttaatcactataaaaagcaaaagtatctatagacacagacacttgcctatacagagacataaccacacacactcagaggatagtgaacaaatctgtctttgacttacgacccattttgcaagacttaaagccggaagaacacattttcagattgttaaataaagtctgattctgacta

SEQ ID NO: 35368 - DNA, 1008 bp, Homo sapiens
agaaaaccacagggcgcggggccagggcggcggcccccagggagttggcaggatggcagagggcaaggcaggcggcgcggccggcctcttcgccaagcaggtgcagaagaagtttagcagggcccaggagaagaatattttctttgcttctaacctgagcctctgctctccacctaccaaccctctagtagacaaggcggtttgggaagacatgtcagccagaagaaagagcgagggaagaaagacaagaaggacctgagatagagtttcggttttcctttttttctctctctctttattaagcccaacctgccttctacaacggagaagttttggttttctaagagctgatggacttagaagcatttggatgaacagctctgcttaccaactgaaatatccctattatcttctaaaagtggagcactgctttgagccctgggaaggcttaaaggcaaccagctctcccgagttgatttatcagcagaaaactgatggaatgtagatgtagctcctgactttaagagaccacaatggaagggaggttattttctatcatttgaggtcatgtgaaagagaggaggaaaagggaaagagttcgtgtagccagacttcgttacttcacttaccctaacttcaccttgatcctagtttcagcctctctgaagacttacaaatctggtagacccgagagcagggcctatgggaaggtctagctcgaaacagtgtgggcgagcaggaggtactggagagaaggccacactgtggttgaaaaaaaaaaaaccctaaaagacaaaacactcatgaatgatagtaattttaaaaagacataccagccaggcacagtggctcactcctgtaatcccagcactttgggaggccaaggtgggaggactgcttgagcccaggagatcaagactgcagtgagcagtgatcacaccacaccacactcaagcagagggagactctgtctcaaaaaataaaaataaatacataaaaataaaagac

SEQ ID NO: 35369 - DNA, 859 bp, Homo sapiens
agaaaaccacagggcgcggggccagggcggcggcccccagggagttggcaggatggcagagggcaaggcaggcggcgcggccggcctcttcgccaagcaggtgcagaagaagtttagcagggcccaggagaaggtgctgcagaaattggggaaagctgtagaaaccaaagatgaacgatttgaacaaagcgctagcaacttctaccaacaacaggcagaaggccacaagctgtacaaggacctgaagaacttccttagtgcagtcaaagtgatgcatgaaagttcaaaaagagtgtcagaaaccctgcaggagatctacagcagcgagtgggacggtcatgaggagctgaaggccatcgtatgggtaagagtggcttgagttttacaacttattggcacttactcctgtttgcatctcaacctcagcttagcttctctatccaagaaaataggaaaacaaaggagccagttcacactgtgcatttgtgtagcctcagtcactgggtggtaggaagaagctacaactgttaaggtaaaaacaagttttccctaatctgtggatccctctaattttgaccctcttctcctctttaaaacattatgggaagttttacctcctaaagattggttgttttttaaaacaaacttcatgcagttatacactcttaaactttcccatctaagctctggagtccaaggctttgaccttgtgccctgttcttaatctctgaatgtatgttcagactcccatagagcagttccttggggtaggggctgtctcttttcttcctctgactagtccccagaatccaacatggtattctaaatacggtgctacaaaaaaggtttttgcagggag

SEQ ID NO: 35370 - DNA, 418 bp, Homo sapiens
accagcctctgactctatcctacagaataatgatctcctttgggaagactacgaggagaaactggctgaccaggctgtaaggaccatggaaatctatgttgcccagttcagtgaaattaaggagagaattgccaagcggggtcggaaactcgtggactatgacagtgcccgacaccacctggaggcagtgcagaatgccaagaagaaagatgaggccaagactgccaagctgccccctctctcctcgggatcgggtccccagagccaccatctcctgagcctcccaccccgctgcctgggccctgtggttgctgggcctcccacctcaaggaggggaaggttgtacagcccgaacccgtggagcaatgccctgtctggcctccaaaaccaaaataaaactgggtcactttaaaaaaaa

SEQ ID NO: 35371 - DNA, 2357 bp, Homo sapiens
agaaaaccacagggcgcggggccagggcggcggcccccagggagttggcaggatggcagagggcaaggcaggcggcgcggccggcctcttcgccaagcaggtgcagaagaagtttagcagggcccaggagaaggtgctgcagaaattggggaaagctgtagaaaccaaagatgaacgatttgaacaaagcgctagcaacttctaccaacaacagtttgtttgtttgttttgagatggagtcttgctctgtcaccgaggctggagtacagtggcgtgatccgatctcagctcactgcagtcttcgcctcccaggttcaagcgatccttctacctcagcctcctgcgtagctgggactacaggcagaaggccacaagctgtacaaggacctgaagaacttccttagtgcagtcaaagtgatgcatgaaagttcaaaaagagtgtcagaaaccctgcaggagatctacagcagcgagtgggacggtcatgaggagctgaaggccatcgtatggaataatgatctcctttgggaagactacgaggagaaactggctgaccaggctgtaaggaccatggaaatctatgttgcccagttcagtgaaattaaggagagaattgccaagcggggtcggaaactcgtggactatgacagtgcccgacaccacctggaggcagtgcagaatgccaagaagaaagatgaggccaagactgccaaggcagaggaagagttcaacaaagcccagactgtgtttgaagatctgaaccaagaactactagaggagctgcctattctttataatagtcgtattggctgctatgtgaccatcttccaaaacatttccaacttgagggatgtcttctacagggaaatgagcaagctgaaccacaatctctacgaggtgatgagcaaactggagaagcaacattccaataaagtctttgtggtgaagggactgtcaagcagcagcaggcgctctttagtcatttctcccccagttcgaacagctacagtctccagtcctcttacctcacctactagtccctctacactttccttgaagagtgagagtgaatctgtctcagcaactgaagatctggcacctgatgcagcccaaggggaagacaattctgagatcaaggagctcttagaagaggaggaaatagagaaggaaggatctgaagcaagctcctctgaggaagatgagcctctaccagcctgcaatggccccgcccaggcccagccctctcctaccactgaaagggccaagtcccaggaggaagttctccccagctccacaactccatcaccaggcggagccctgagcccttcagggcagccttcatcatctgccacagaagtagtcctccgaacccgcaccgcaagtgaaggatctgaacaaccaaagaagagagcctctatccagaggacctcagcaccccctagtaggcctcctccacccagagccactgcaagccccaggccctcctcagggaacataccttccagccctacagcctctggagggggttcacccaccagccctagggcctccttggggactgggactgcaagtcctaggacctccctagaggtctctcctaatccagaaccaccagagaagccagtaagaactcctgaggccaaagaaaatgaaaacatccacaatcagaaccctgaagaactttgtacttcccccaccttaatgacatctcaggttgcttcagagcctggagaggcaaagaagatggaagacaaggaaaaggataataagcttatctcagctgactcctcggagggccaagaccagcttcaagtctccatggtaccagaaaacaacaacctcacagcacctgaacctcaagaagaggtatccacaagtgaaaatccacaactctgaagagaaactaccaagactcctcctgccccaaacctcgccagagaagctcttcaaccagagggtataggtcagagggatataagagccagcatccatccctgggttctcagtaggaatgctggtgctgtctaaagacctggcattaatggaggcggaggagcagccttacgggagggatggagggaggcaggctggggagaagagaacattagactcagggaatatttaattctggttttagcattattagaataagactttatacattaactaaagtggagctttaatcactataaaaagcaaaagtatctatagacacagacacttgcctatacagagacataaccacacacactcagaggatagtgaacaaatctgtctttgacttacgacccattttgcaagacttaaagccggaagaacacattttcagattgttaaataaagtctgattctgacta

SEQ ID NO: 35372 - DNA, 1743 bp, Homo sapiens
catgttagccaggatggtcttgatctcctgacttcatgatacgcccaccttggcctcccaaagtgctgggattacaggcgtgagccactgtgcccagcgggatggctttcatttaggagccttggtggctggttttggcttaagtcctactttgtatttcaaacaaagaactcctttcccatgccttactcgtatgtgtttgtggttttgcttcctaatagtcgtattggctgctatgtgaccatcttccaaaacatttccaacttgagggatgtcttctacagggaaatgagcaagctgaaccacaatctctacgaggtgatgagcaaactggagaagcaacattccaataaagtctttgtggtgaagggactgtcaagttcgaacagctacagtctccagtcctcttacctcacctactagtccctctacactttccttgaagagtgagagtgaatctgtctcagcaactgaagatctggcacctgatgcagcccaaggggaagacaattctgagatcaaggagctcttagaagaggaggaaatagagaaggaaggatctgaagcaagctcctctgaggaagatgagcctctaccagcctgcaatggccccgcccaggcccagccctctcctaccactgaaagggccaagtcccaggaggaagttctccccagctccacaactccatcaccaggcggagccctgagcccttcagggcagccttcatcatctgccacagaagtagtcctccgaacccgcaccgcaagtgaaggatctgaacaaccaaagaagagagcctctatccagaggacctcagcaccccctagtaggcctcctccacccagagccactgcaagccccaggccctcctcagggaacataccttccagccctacagcctctggagggggttcacccaccagccctagggcctccttggggactgggactgcaagtcctaggacctccctagaggtctctcctaatccagaaccaccagagaagccagtaagaactcctgaggccaaagaaaatgaaaacatccacaatcagaaccctgaagaactttgtacttcccccaccttaatgacatctcaggttgcttcagagcctggagaggcaaagaagatggaagacaaggaaaaggataataagcttatctcagctgactcctcggagggccaagaccagcttcaagtctccatggtaccagaaaacaacaacctcacagcacctgaacctcaagaagaggtatccacaagtgaaaatccacaactctgaagagaaactaccaagactcctcctgccccaaacctcgccagagaagctcttcaaccagagggtataggtcagagggatataagagccagcatccatccctgggttctcagtaggaatgctggtgctgtctaaagacctggcattaatggaggcggaggagcagccttacgggagggatggagggaggcaggctggggagaagagaacattagactcagggaatatttaattctggttttagcattattagaataagactttatacattaactaaagtggagctttaatcactataaaaagcaaaagtatctatagacacagacacttgcctatacagagacataaccacacacactcagaggatagtgaacaaatctgtctttgacttacgacccattttgcaagacttaaagccggaagaacacattttcagattgttaaataaagtctgattctgacta

SEQ ID NO: 35373 - DNA, 1168 bp, Homo sapiens
tgcactgcaaccttgatactcctggcctcaagtgatcctcctgcctcagcctctcaaggagctgggactacaggtgtgcacccctgcacgtggtctagactgggcttcctacaccttgggttcccatctcagaacctaaaatttttcccaaagaaattattttaccacttgcttctcctaactgcgtgtcatgaattaggatcacttaagtgtgagagttgcagtacattcttgaggacggttcatctaaaagtggcaggtagtaattttaagacctcgcactcccttatagatacacatccacaccatgtcacacagattacatggtgtttgatcatggaaacaactcaggaattcaaagacctggtttcctgtcccagcaagtctttttaccctttgaatcttagtttattcatctgtaaaagaggatggatgaaagcctttcccgatgccttcaggctctggtgaaacaacactgtattttgccctttgtaatagtacaaatactgagacccttgtaaagtataaggcacagaagacacttctatgctgagaggctggaaaggttgagccacctcttactggcagaactcttctctttgtagggccaagaccagcttcaagtctccatggtaccagaaaacaacaacctcacagcacctgaacctcaagaagaggtatccacaagtgaaaatccacaactctgaagagaaactaccaagactcctcctgccccaaacctcgccagagaagctcttcaaccagagggtataggtcagagggatataagagccagcatccatccctgggttctcagtaggaatgctggtgctgtctaaagacctggcattaatggaggcggaggagcagccttacgggagggatggagggaggcaggctggggagaagagaacattagactcagggaatatttaattctggttttagcattattagaataagactttatacattaactaaagtggagctttaatcactataaaaagcaaaagtatctatagacacagacacttgcctatacagagacataaccacacacactcagaggatagtgaacaaatctgtctttgacttacgacccattttgcaagacttaaagccggaagaacacattttcagattgttaaataaagtctgattctgacta

SEQ ID NO: 35374 - DNA, 2211 bp, Homo sapiens
agaaaaccacagggcgcggggccagggcggcggcccccagggagttggcaggatggcagagggcaaggcaggcggcgcggccggcctcttcgccaagcaggtgcagaagaagtttagcagggcccaggagaaggtgctgcagaaattggggaaagctgtagaaaccaaagatgaacgatttgaacaaagcgctagcaacttctaccaacaacaggcagaaggccacaagctgtacaaggacctgaagaacttccttagtgcagtcaaagtgatgcatgaaagttcaaaaagagtgtcagaaaccctgcaggagatctacagcagcgagtgggacggtcatgaggagctgaaggccatcgtatggaataatgatctcctttgggaagactacgaggagaaactggctgaccaggctgtaaggaccatggaaatctatgttgcccagttcagtgaaattaaggagagaattgccaagcggggtcggaaactcgtggactatgacagtgcccgacaccacctggaggcagtgcagaatgccaagaagaaagatgaggccaagactgccaaggcagaggaagagttcaacaaagcccagactgtgtttgaagatctgaaccaagaactactagaggagctgcctattctttataatagtcgtattggctgctatgtgaccatcttccaaaacatttccaacttgagggatgtcttctacagggaaatgagcaagctgaaccacaatctctacgaggtgatgagcaaactggagaagcaacattccaataaagtctttgtggtgaagggactgtcaagcagcagcaggcgctctttagtcatttctcccccagttcgaacagctacagtctccagtcctcttacctcacctactagtccctctacactttccttgaagagtgagagtgaatctgtctcagcaactgaagatctggcacctgatgcagcccaaggggaagacaattctgagatcaaggagctcttagaagaggaggaaatagagaaggaaggatctgaagcaagctcctctgaggaagatgagcctctaccagcctgcaatggccccgcccaggcccagccctctcctaccactgaaagggccaagtcccaggaggaagttctccccagctccacaactccatcaccaggcggagccctgagcccttcagggcagccttcatcatctgccacagaagtagtcctccgaacccgcaccgcaagtgaaggatctgaacaaccaaagaagagagcctctatccagaggacctcagcaccccctagtaggcctcctccacccagagccactgcaagccccaggccctcctcagggaacataccttccagccctacagcctctggagggggttcacccaccagccctagggcctccttggggactgggactgcaagtcctaggacctccctagaggtctctcctaatccagaaccaccagagaagccagtaagaactcctgaggccaaagaaaatgaaaacatccacaatcagaaccctgaagaactttgtacttcccccaccttaatgacatctcaggttgcttcagagcctggagaggcaaagaagatggaagacaaggaaaaggataataagcttatctcagctgactcctcggagggccaagaccagcttcaagtctccatggtaccagaaaacaacaacctcacagcacctgaacctcaagaagaggtatccacaagtgaaaatccacaactctgaagagaaactaccaagactcctcctgccccaaacctcgccagagaagctcttcaaccagagggtataggtcagagggatataagagccagcatccatccctgggttctcagtaggaatgctggtgctgtctaaagacctggcattaatggaggcggaggagcagccttacgggagggatggagggaggcaggctggggagaagagaacattagactcagggaatatttaattctggttttagcattattagaataagactttatacattaactaaagtggagctttaatcactataaaaagcaaaagtatctatagacacagacacttgcctatacagagacataaccacacacactcagaggatagtgaacaaatctgtctttgacttacgacccattttgcaagacttaaagccggaagaacacattttcagattgttaaataaagtctgattctgacta

SEQ ID NO: 35375 - DNA, 647 bp, Homo sapiens
catgttagccaggatggtcttgatctcctgacttcatgatacgcccaccttggcctcccaaagtgctgggattacaggcgtgagccactgtgcccagcgggatggctttcatttaggagccttggtggctggttttggcttaagtcctactttgtatttcaaacaaagaactcctttcccatgccttactcgtatgtgtttgtggttttgcttcctaatagtcgtattggctgctatgtgaccatcttccaaaacatttccaacttgagggatgtcttctacagggaaatgagcaagctgaaccacaatctctacgaggtgatgagcaaactggagaagcaacattccaataaagtctttgtggtgaagggactgtcaagcagcagcaggcgctctttagtcatttctcccccagttcgaacagctacagtctccagtcctcttacctcacctactagtccctctacactttccttgaagagtgagagtgaatctgtctcagcaactgaagatctggcacctgatgcagcccaaggggaagacaggaggtggtggagctattgttagctcgaggggcaaataaagagcacaggaatgtttctgattacacacctctaagtctggctgcttctggtggctatgtgaac

SEQ ID NO: 35376 - DNA, 371 bp, Homo sapiens
tacagtccacagtcctgaagtcaggttccagaacgtcagatgtctggccttaaattcccaaccaactcttcaaaatgagtttacacataggaaggagaccaaaatgggaagagggcctaaacaccataaggaacaattgaggaaacctgtgagaaaggcttggtcaagggcacatgcaagttgtcttcaagcatgtgtggaagagaaattagatctactctatgagtacagaaggccaacccaagactaataggaaaaagtttgtttgtttgttttgagatggagtcttgctctagtctcgctctgtcgcccaggctggagtgcagtggcacgatctcggctcactgcaacctctgcctaccaggttcaag

SEQ ID NO: 35377 - DNA, 2135 bp, Homo sapiens
agaaaaccacagggcgcggggccagggcggcggcccccagggagttggcaggatggcagagggcaaggcaggcggcgcggccggcctcttcgccaagcaggtgcagaagaagtttagcagggcccaggagaaggtgctgcagaaattggggaaagctgtagaaaccaaagatgaacgatttgaacaaagcgctagcaacttctaccaacaacaggcagaaggccacaagctgtacaaggacctgaagaacttccttagtgcagtcaaagtgatgcatgaaagttcaaaaagagtgtcagaaaccctgcaggagatctacagcagcgagtgggacggtcatgaggagctgaaggccatcgtatggaataatgatctcctttgggaagactacgaggagaaactggctgaccaggctgtaaggaccatggaaatctatgttgcccagttcagtgaaattaaggagagaattgccaagcggggtcggaaactcgtggactatgacagtgcccgacaccacctggaggcagtgcagaatgccaagaagaaagatgaggccaagactgccaaggcagaggaagagttcaacaaagcccagactgtgtttgaagatctgaaccaagaactactagaggagctgcctattctttataatagctgaaccacaatctctacgaggtgatgagcaaactggagaagcaacattccaataaagtctttgtggtgaagggactgtcaagcagcagcaggcgctctttagtcatttctcccccagttcgaacagctacagtctccagtcctcttacctcacctactagtccctctacactttccttgaagagtgagagtgaatctgtctcagcaactgaagatctggcacctgatgcagcccaaggggaagacaattctgagatcaaggagctcttagaagaggaggaaatagagaaggaaggatctgaagcaagctcctctgaggaagatgagcctctaccagcctgcaatggccccgcccaggcccagccctctcctaccactgaaagggccaagtcccaggaggaagttctccccagctccacaactccatcaccaggcggagccctgagcccttcagggcagccttcatcatctgccacagaagtagtcctccgaacccgcaccgcaagtgaaggatctgaacaaccaaagaagagagcctctatccagaggacctcagcaccccctagtaggcctcctccacccagagccactgcaagccccaggccctcctcagggaacataccttccagccctacagcctctggagggggttcacccaccagccctagggcctccttggggactgggactgcaagtcctaggacctccctagaggtctctcctaatccagaaccaccagagaagccagtaagaactcctgaggccaaagaaaatgaaaacatccacaatcagaaccctgaagaactttgtacttcccccaccttaatgacatctcaggttgcttcagagcctggagaggcaaagaagatggaagacaaggaaaaggataataagcttatctcagctgactcctcggagggccaagaccagcttcaagtctccatggtaccagaaaacaacaacctcacagcacctgaacctcaagaagaggtatccacaagtgaaaatccacaactctgaagagaaactaccaagactcctcctgccccaaacctcgccagagaagctcttcaaccagagggtataggtcagagggatataagagccagcatccatccctgggttctcagtaggaatgctggtgctgtctaaagacctggcattaatggaggcggaggagcagccttacgggagggatggagggaggcaggctggggagaagagaacattagactcagggaatatttaattctggttttagcattattagaataagactttatacattaactaaagtggagctttaatcactataaaaagcaaaagtatctatagacacagacacttgcctatacagagacataaccacacacactcagaggatagtgaacaaatctgtctttgacttacgacccattttgcaagacttaaagccggaagaacacattttcagattgttaaataaagtctgattctgacta

SEQ ID NO: 35378 - DNA, 523 bp, Homo sapiens
caggcttttccttaaagcatacatagtaaacattttgggttttgcaggccaaaaagcaaatgaacaactatacgtaataggtccttacaaaaccatttaaaaatgtgaagactattcttagttcatgggcaggaaaaatacaggcaactggcgagatgtggtgccatagtttgctgactcttgcttttaagtatttgtatcgttgacaagaaaattgttttgtttagccatccccaaagttagtattttattctgatttgggcctataagaaatatctgggccgaggcgagtggatcacaaggtcaggagatcgagaccatcctggctaacatggtgaaaccccgtctctactaaaaatacaaaaaaattagccgggcatggtggcgggcgcctgtagtcccagctactcgggaggctgaggcaggagaatggcgtgaacccgggaagcggagcttgcagtgagccgagattgcgccactgcactccagcatgggcgacaaagcaagactccatctcaaaaaa

SEQ ID NO: 35379 - DNA, 154 bp, Homo sapiens
taagcaacccacagattgctccctgtgaagaggagcctgccaggggagcagcattccaccagaccctgatttagcaagatatttccgtatcattcccccaaccagctggaagtcctccactgctcttgtgtaaaaatctaactcatctcgctga

SEQ ID NO: 35380 - DNA, 438 bp, Homo sapiens
attactcctattttacaaactgaaaactgagacattacaaggttaataagtctaaggtctaaaagctaaaatgatgctatactttatgactatgtggagaaagcttacatattggcaatcaaggaatcatcagtttatctcctactcggaggatctctcaactttctttcttaaatatgcagatattatagctctaataagcaactttaatataacactcatgacattggggcaacatagtgagactcccactctttaccaaaaaaaaaatttaaaaattagccaggcagggtggcacgcacctgtagtcccagctactcgggaggctgagatgggaggattgcttgagcccaggagatcaaggctgcagtgagctgtgatcacatcactgcactccagcctgggtgacagtgtaagactctctctttttaaaaaaaa

SEQ ID NO: 35381 - DNA, 411 bp, Homo sapiens
gtttaaaattacatgcctagttatttgcagagttgggcatagagtccattttgactgatcccagattcagttatctttccccactgaaataggtctcttatccctcactaagcttggcctaaaggtaactctaatgtatcctggtcagagaggcaacaaatttcagttgtcactcagccctgccactcactagagaagttatagtggcaaattcacattaagccttgacttcatcccatgtaacatgttgctagtacccgtgttataaggccctatggggaattaaattgtgtagtgtgtgtgttacgaagcccaacatattctaagccttcatacatgatggtatgcttatgtaactcctttaaaaattattctcttaatgttcattgtgaaatgtataatatgtagatt

SEQ ID NO: 35382 - DNA, 264 bp, Homo sapiens
gcctcaagtgattgtcccaccttggcctcccaaagcactgggattacagacctgagccacagcacctgacccagcaattaattgctttttgtttttgtttttacttctgaggcagggtctcaccatcacccaggctggagtacagtggtgcgataatggctcattgcagccttgacctccctggcctcaggtgatcctcccacctcagcctcctgagtagctgggcctacaggtgtgtgccatcatgcccagctaatttttgta

SEQ ID NO: 35383 - DNA, 407 bp, Homo sapiens
tgaatgtgtcttaatctctttgtcactcagttgcttcatttttaaagtgggtataacacctgatctttctactggttaggactattccaagaatagaaggagaacctgtacataaaaaagtccttacaaacagaaaaagtgctatttaactctaaatattatcagtattatttctgctatgactattttattatttctgaccttggtcatggggcaatgtgtacagcacatgcataatgtgcagatgagaaacagagatgtttatcccaataattcaagaccccccaagcccagattacctctgttattcaaatctcaatttattaagatttaaatcctcatgcttatattggaagggcctcgagacagcttacaggataaaacagtgcaaaataaacaggagagaa

SEQ ID NO: 35384 - DNA, 465 bp, Homo sapiens
aacccaaccgtgtcgactggcatcctgatctgactttcagcctctacgctgtgttctgctgtgtaagccaccaggtccatgattttttttttctggcagcctgagctgactaatacaagtggctttgatggaattatccctaaaatcctttccagctccaaattctttgaacctatgtgtaattcataaatgtcttcttgtgttggtgcgggcggtagatgggtaggggtgagtgaaattgttaaaagttagataattttaaaaaatgacataacgataacctatcaaaactctcaaaggtggcaaagccctgttctgagacttatcagatgcaacttctaccttaactccttcaaatatgagttctcactattagaatcttctgattggccaaactttcgatgctttggtggccccttacctaaatgcacactactgataaaccaaacaaacaaacaaaaatac

SEQ ID NO: 35385 - DNA, 108 bp, Homo sapiens
gtgacctggggcaaatgttttaccccccagtaatagtcacaggtttcagagagttagaggtgagtttggagaaacgaggcatggcacggaagtggtgacaggaggaac

SEQ ID NO: 35386 - DNA, 3872 bp, Homo sapiens
  misc_feature (1313)..(1313): n is a, c, g, or t
tctgctgtgaaaatgctccttcgattagtttataactgagtgtaaaatttggcatttcactcttgattatagtctttttctgtatattcacccccaattctttgagaatgaggagtaccctaattttgtaagcaaaattttggggggctttggggtgaaaactaatttaaatgcttattttctcagttgcctacctccatttaaaaatcagttttgagggctataaaaaaaccttatgatattaaggcctttttttctgtataaaaataacatacaatttattttttccatttattcaaaagactgaattacactagccaagaaatgatcagtctcgtgtaaaagaataacacacgttctccttgaatcaagactactctgagattcagaaatgccagtagcggagggtggggtgtgaccccttaagtaagtgtgactagttaaaggtgtatggatattctttgtggaaagcgggctgccagatacaatttcaggctgtttcatattacttcacacggtgctttcaaactgtttattttctctcttggcactagtgagtacagctcataactggccagataatatctaagtctaggaccaggacagtgaatgggttttaccatgatttgatcaaaagtaaacaagaaaacaaaagcagaggaaaaaaaaaaaaagagaaggcatcacatttttctcattgtggggctaaaatgctgcatgttgaattttcactttctgattagaacccacagttgaacagatctgatttatttttttggggtcaggaagaaactgtcaaattttagtttgactgttcttttctttaggtctcccccctttcttcccctaccttttttttttttttaagcattactatattaatcagatagcagccactgtttgacatgtccttctgtggtggctgcagattaagtctgaaccgtgccagaaatctcgttgcattttttgatgtagcagaaatgaacctggttcattccatcttaacagctttagccaaatggctcagaagggatctacccgatttcataaagaagagttaatgtgcagtctggtttaatacaggtgcccttaaaatacatttttgttttgttttgttttctcacttccaagtttaacatgtccatggacattggctttagtttccccaagatgagtccatgaatgaccttgttccagtatcccttgctgatttgagttcccaagtaataagcctgggaatgttttcagtgcagcagccgggagaagaagggggattcagcagttgctgttcaatgcatttactctctacctgntggcttcaaacagtattaactttatgtgctccttgtgcattgtgtttaattaaaagcagttctcttcacagaggcacttgtaggatttttttttttttttttttttgccctgaaacgaataaaacaaataggcgtctggtatttgttttgtataacacaatccccataaaatgaagagtaataaaacataattatctgtaaaggcttgttttataagcctgagaatgggcttgtttctaccaggtttttatgttcattcataggagaaagaatctctttgtacattaatatgtaacaacaataagaacaaatgcttcccaattacatgcatgaatcaaacttatcttttattaaaaaattttttttctgttgtagtaaaagtttgtcattaaattctttctgtgtaaacacattagattgaaggaaaatgttttccttcaatattctgttcaactggcataactttatgatttttttctccccagcataattaaagaaacaactttatggttggttattgacttttttaggtcagagagcactctgtggattctaaaaccgccttccagaaaagtacacatcaaacttctacgtacgtttttatagggtttgtagagctctgatccttggttaaagatccctgacaatgtctaatagctgttttgaaaactgtacctccaatctgaagctaaggttttagttttagttttagtatgtgaatatctgatgaaacgattcaatggttttgtagcattggattcaatttcagggttgggctcctttctaggaatagaggaatattcttatctcaggaaaaaaaattcagagtgtgggaagtacgaaaattattaattcaaaggtgtatttgctgtcagattggatggcagtacccacatccctaggggctcctgttcccaagactgttttcattgtttctatccagcgctgggcacgagccttgaagtggcgaattcatcctctgaagttgtgtgtccattgctgcaagaataaaagaagcagtaacagaatcatgcagcgcagtatttcatggtgacagttttatgtggttgtgtgatgttgcagagtcttgtaggtgatatctacccttttcttttgaatcaaaacacggggttttactggaggagggaagtttcagaaacaacctagtctaacacaaaattaagctcctaaatagttatcccattctgtctactacaaaactaattgcttacaggaagtagaagtacacatatctaatatttatatcctgtttgagtagtggtttctaattttagatttctaacccctttttacattatctttttgcattgaaattatactgaaacattcatattattatgaatgcaagctgaattaaatagaccaagattctcggtttctcccttcatgttgtcatctactagagaatgaacagcttaaaataagtgcatcagttcctcatccaaagggaagctgaatattccaattcaagatcactttgcgtgcttactggaaataccatttttgaacgtacttggcaacttaaagtgcccaattaaaagctctgttgaaagaggaagtctgtggatgtgcaattagtccttaggattcagagcatttcctttatgtgtggaaggccataatatgaaatcactggtcacaatagctttatgccaggtgcttagactagaaggcattttcaggatggattatttctgtactcttgctcctaaaatggtttacctaaagaggctcccaagtccataaaaatactggtgatgtcaagaaattttggaggtggcctttcacaaattttaggcagtcaataaatataactagccatgtacgtgataggcaatacacaagacttgcttatattcctagactttctattttatctgattgacagtgttcctcttcccacctttttattcatttatttatttttaaaagatgaggattgggtaccagaaaattagccagtattgtgtgcttttccttactaaaaaaatgaggcctcgctgagtagggccagatgagctgtatattctgagattatttatagtgtttatgatagagagaccaaaaacagtaagcacttaatagctttccttatttacaagtcagattcatctaagggatatttttcttttatttttctggtgcttgaaatgttcctttaaaatagattatcagaggatacacagtgacacaaaatttgttgcttgtgaaaatgcagagtggattaagcttttctttttcaaggctctgcaacaaaacaggtacatttttatttcagtaaaaacactgctttttttttttgcctccgtcacacacacgagtaacataggatagatatgtgtatgtgaacatgtggctcttgttcccagttgtgtaatggatgcattcccttaaagtttgcagtaaagtgaatgtttattaagcaaattgtttttccccagtgacttctactgtaaaaatggcattgtctttcagtaggctctgaatatagtatgttcccatattctttggtaagatgaccaatcaaccaaaaaaaaa

SEQ ID NO: 35387 - DNA, 1445 bp, Homo sapiens
atcagaacacagttatgacgtgagagtaggaatttcacagagagaacctagtatctaccaggagatcggtctcctaaatagttatcccattctgtctactacaaaactaattgcttacaggaagtagaagtacacatatctaatatttatatcctgtttgagtagtggtttctaattttagatttctaacccctttttacattatctttttgcattgaaattatactgaaacattcatattattatgaatgcaagctgaattaaatagaccaagattctcggtttctcccttcatgttgtcatctactagagaatgaacagcttaaaataagtgcatcagttcctcatccaaagggaagctgaatattccaattcaagatcactttgcgtgcttactggaaataccatttttgaacgtacttggcaacttaaagtgcccaattaaaagctctgttgaaagaggaagtctgtggatgtgcaattagtccttaggattcagagcatttcctttatgtgtggaaggccataatatgaaatcactggtcacaatagctttatgccaggtgcttagactagaaggcattttcaggatggattatttctgtactcttgctcctaaaatggtttacctaaagaggctcccaagtccataaaaatactggtgatgtcaagaaattttggaggtggcctttcacaaattttaggcagtcaataaatataactagccatgtacgtgataggcaatacacaagacttgcttatattcctagactttctattttatctgattgacagtgttcctcttcccacctttttattcatttatttatttttaaaagatgaggattgggtaccagaaaattagccagtattgtgtgcttttccttactaaaaaaatgaggcctcgctgagtagggccagatgagctgtatattctgagattatttatagtgtttatgatagagagaccaaaaacagtaagcacttaatagctttccttatttacaagtcagattcatctaagggatatttttcttttatttttctggtgcttgaaatgttcctttaaaatagattatcagaggatacacagtgacacaaaatttgttgcttgtgaaaatgcagagtggattaagcttttctttttcaaggctctgcaacaaaacaggtacatttttatttcagtaaaaacactgctttttttttttgcctccgtcacacacacgagtaacataggatagatatgtgtatgtgaacatgtggctcttgttcccagttgtgtaatggatgcattcccttaaagtttgcagtaaagtgaatgtttattaagcaaattgtttttccccagtgacttctactgtaaaaatggcattgtctttcagtaggctctgaatatagtatgttcccatattctttggtaagatgaccaatcaaccaaaaaaaaa

SEQ ID NO: 35388 - DNA, 107 bp, Homo sapiens
ctgaggtcacactatgtgtggcaaatgcaaaccagagccctccaagagcccagggccctcactgggacatgctgccagccaccaagacctcaagatcctgaggctca

SEQ ID NO: 35389 - DNA, 347 bp, Homo sapiens
aatgcaagtaatggatttaatatcagcaatgtaaatgtttcatttatagtaattcttttaattttgtttttgttaatgttttatttaccataaatggtagatttttatgaagttaagtcatttttacttaaggaaaatttgtttaaaataatatagatttaaaatagaaggaagccatgaaagcacaaatttaggaatttgtaaatttaggaattatttcataattggtcaggctaatattattagtttttgcaaaagaaaaaatcagtgcttgcaaatcagattaattgcttctggagagcacaattattctagctgggatatcattatcacttagagaaaaaaaa

SEQ ID NO: 35390 - DNA, 232 bp, Homo sapiens
cctccaaattaggtgttcattttgtctgtgacatattgcattcacccttttgtgattttatgatctccttcacttattagatgcctggagaagttctgcactttacagaatttatatgcctggcacagtgtcttgtgccagctacttgtgaggctgagattggaggactgtttgaggccaggagtttgagaccagactggacaacatagagagaccctgtctaaaaaaaata

SEQ ID NO: 35391 - DNA, 457 bp, Homo sapiens
tcatttctccccactaaagtctcccaaattcagttctattctgacacttcttgctaaaaaaatatttaaaataaagcttattttccttcaatccaaacctctaagataggtggtattaccatcgttttacaagtcaaaaaaatgaatcgttccctgtgtctccagccatagatgttgctggcatttgtgttcaaggttttcccattgcaaatgcactttctgccattccacaccacctagacagtcctgctgtgtttctctccaccatatgtaagccagattttgtttctattaactttctatgactatcttaggtctttctcttttatctgtctttgacaccatggtctaatggtttcaatcaaacaatcacatccagcacaattttatggataaaggacagaaaattagtcatcctctgccttcaggacacacagaaaagcagaatatctgtcca

SEQ ID NO: 35392 - DNA, 410 bp, Homo sapiens
ctggaagtggcagaactgagatttgcgttccaagtccattcccatccttccatatcaccctgattttctcgggttcagagtcctggttcatttcctggctgttccgcagacatgtcacaaactccagaaccttcatttctccatctgcaaatggcaattgtaattcttgctctgtcaacctcacagatttctctcgaaggcatacacacacacacacacacacacacacacacacacacacacacacactagaaaactgtaaagagatgtaaaccttaccgaataattacagggtattttgattggtatttttactatgattatttttgctaatcaaagaaaccagacaggtagtgtcagggaattgtctaaagcaatgagacattcttgaaaagtctgtatcagatctc

SEQ ID NO: 35393 - DNA, 408 bp, Homo sapiens
gtgaatagtgcctcagtgaacagggggtgttaatatctctgagattccgatttcagttattttgggtatatacccacatatgtcttgaattcttaaagaaaaccaactttgctcacattggcatttctttttgtcttgcccttcccttcacagtcccttctgagcaagtgtcatcaacactgtaacctctgtttccctgcctctttcctctgctcctcaaccatgtgtgtcttaaccttgcatgtcacccagtacaaagcgacctctcctcatttcccctcgtgcaagacacatcacagattcccacctgtttcctggagttcttgcttcccttgacttcttgggccacagcaatcagccacctacccatctgatgagcagccctgacttgacacttcagcattcata

SEQ ID NO: 35394 - DNA, 1050 bp, Homo sapiens
actgttctcagcctatgatggtttctctttctaaacctgttcttctaggttcagctcaaacatcctctcctatagaaacctttccccaacctcccagtcagaactaataatttcttttcacttcaactgtacttagtttataatttatatgactataatttaataactgagactcttctgatagtacaaacaggtgctatcataattacctctgggcaacaggcaaaaatcaagattgtccttagtaaaccaggattcataccaggtcatctgatgtttacctctagtatagcactcacccgactctgccttacattgcttatttaaaatgtctgcctccccttctaggttttataaaagttcttggctcacagtaactcttagtataagtttctgaaataaacactttgttatcacttttgaattgatggcttacatttttgttttggcatttaacttcacatttgtgcattcatgtgtatgcatttcaactcatctgcaagcttatatccctcaaagtttgctgctgggctaagagcagccactcaaaaaataataataggccaggcgcagtggctcacgcctgtaatcccagcgctttgggaagctgaggctggtggatcacttgaggtcaggagttcaagaccagcctggccaacatgatgaaacctcatctctactaaaaatacataaattagccgggcgtggtggtgggagcccagctactcagggctcctcagctactcagctattcagctactcaggaggctgaggcaggagaattgcttgaacccaggaggcggaggtttcggtgagcgaagattgcgccactgcactccagcctgggcaagagtgagattccgtctcaaaaaaataaataaataaataaaaacaaaaaagaaataaatagtttttaaaaaatcttgacagcataccagcatacattcattgataaagtcgacaagaaagtattggagattaaagattgccaaaacctaagtgcttttcttggcatcattgtccttgacctcaaggagttctcagtgtaat

SEQ ID NO: 35395 - DNA, 244 bp, Homo sapiens
ttttttctttcaaaaggggtctttctagatagaaagaaaatatatatgtctctgtgtgtataatctgattgcatagatgtttggctgttttaaaacagtaacacagaaaaagggaaaaacaagagctcttgagataagaaaatagacacaattgtagactgagtatacaaattgcacagagaatcttaagaaaacataaaaaggcatagatatttccttgtgtttgtttttcatttaattactc

SEQ ID NO: 35396 - DNA, 305 bp, Homo sapiens
ggtttcaccatgttggccaggatggtctcaatctcttgaccttgtgatccgcccgtctaggcttcccaaagtgctgggattacaggtgtgagcccccgcgccctgctgcaacctattttttaacaagccctccctgtgattctgatgcccactaaagtttgagaaacaatatctttagagtagtggccctgtgaggtccttaacagctcaggaaaattaagatgaacctaagtcgggctaccagagtagataccttgaatagataaagactattggagagatgtacttaacaaaatacagcaacg

SEQ ID NO: 35397 - DNA, 491 bp, Homo sapiens
catttgatgggaatacctggtttaaataccaagttttaagggccacaggtaggctcaaaatttgggctgcagagagccaaaggtttggagtcagacagaagcaaggactttagagggagaaaaaaggttcagcgtgacagcaggccaggaataaaagaaggtgtccacaatgactgctgcgaaggtgcacccctttctcagctcctcaaccaaccccatcaggaggctacgtgaaaggctctggtgagagtcgagggtatgtaaataggctggtaaatagttatgctgggtcttaagcttgcaatggatatatggatgtttattatgttgtaatttaatttacttcccccccaatgtgaacataaactccatgaagacagttgtttttttttttttaagagacagggtcttgctctgaccctgtctggagtgcagtggtgtgactgtaactaactcactgtaagctcaaactcctgggtttaagccatcct

SEQ ID NO: 35398 - DNA, 103 bp, Homo sapiens
gtgcttccatacaaaggggacagaagagatgatggaaggcctcagtactgcaggaggggagacggatgtcatctacaatcacacaatacatgggaggtcacag

SEQ ID NO: 35399 - DNA, 442 bp, Homo sapiens
tcacaaggccgtggtgagatgagaaattacacgaggagtacttggtccacttcaggtcagcatacagcacttcttagatccagatgtcctgtttccctgacccaacaaggtggccaatggaacagatcccaccacagccttgtgaggtagatattgtcatgccattttacaggacagccacacatatgccaagtgccagagagtaaatggcaacagcaggaccagacccagatttactgtccagtgcagttttgctgagagcggtgagaagtggaggaggcatctaaagggcttgctttacaatgttgcctggagccagtccacatctgagccatgggaggtcacaagaaatgtgagttgggagatcctttaacggagtgggatgggtggatttacaaagaagcttccataacccgccacgttctccaagtaaccttgggtg

SEQ ID NO: 35400 - DNA, 406 bp, Homo sapiens
aaactcaggaagaaacacagggtcgctggcagcaaaggtggtacccccagaaaatgtctccccctctctccaagtaaattttgtcaataaaactgcaggagctgctaagtaatttcatcactgcctctcttttattagatttctaattaatcacaatctgatatgtccagggtcatctacatccaacaggtggatgaatttctaaaatgatgcttgtaggtatcacccacagggctgcctacagcagagtagccaagtccaatagcaataacacataacaagacgcaagatgaaagaaaatctttctgattccaaccccgttgccaagctttgaaaaaacgttaaagttccccaatgataggaatactctgatgccatcgtccaaataagaaatacacagttttat

SEQ ID NO: 35401 - DNA, 654 bp, Homo sapiens
cttcatgcaaaggaagcctagttccttcagacacttcttgtttgacactgtcttgccttcttctgcatgacctcctctgtggcggtgtttcccaaaaattattatagatgagagaattgaatgtgacataagttctactatacgcgtgacttctttgggtacgatttcactactacatttttaggaaacctttatgaaaggaattacttagcactggagattctgtattgtagtgacaataaccctgtgaaaatgtaggaaggtttcaaagacattttggaagaaagaggaaatcagagtctgatttttaaaaattcgtttttgtagctgaagcttcttcatttaatttgatgtggccacctccctgaccctcatatttgtaaggccgtttctggttctttgccaccaggagctccttggaatatcacaggccttaggctggaagaggttgacagcagtttaattatttataattataacctaatttccaatgtttaggaataacaaattatgaagaatactccttaatccaagaaactattgaagaaaagaaagaggaaggaacgggcacactcaaaaaagacaggacactgttacgagatgagaggaaaatggagaagttgaaggccaagctgcacacagatgatgaccgta

SEQ ID NO: 35402 - DNA, 384 bp, Homo sapiens
cttctgactatggactctttctttcggatgaagacccgaggaaagggatttggctggaagcgggcagaacactggattactacatgttgcggaatggggatattttggaatataaaaagaaacagagacctcagaaaatccggatgctggatggatctgtgaagacagtgatggtggatgattccaagactgtgggggagctcctggtcactatttgtagcagaataggaataacaaattatgaagaatactccttaatccaagaaactattgaagaaaagaaagaggaaggaacgggcacactcaaaaaagacaggacactgttacgagatgagaggaaaatggagaagttgaaggccaagctgcacacagatgatgaccgta

SEQ ID NO: 35403 - DNA, 393 bp, Homo sapiens
ttttttgttttaaggctgtgtatgtgtgtgtgtgtgtgtgtggttgtgtgtataagatagttggcaatccttggcacatgtgccaaatgagtttatgtgctgaaaaaggtatgtataccagcacaaatgcacgtgccaaatgaggtaaggagatagcatctgaagttaggattcaaaattgtggaatccttgcgggcagttaactgtttcttgcttatcttttgattatgagaagatacctccatgcctgactcagaacacataaccagtgattgttggttgggtgagtaaatgactgaacttatcaatgagcttatgcaagggccctccccactttttgccaacccccacggtggggcaactgcacacactatatacctaaagggtgaaggt

SEQ ID NO: 35404 - DNA, 450 bp, Homo sapiens
gttctcgtctcctctgaagtgcagacgacgctggcccacatccttgtcgggcagaggggctgccgactggcccctggccatggctcttgctgggagccgtgtggcctgggcttggacccacatccacctcttgctggttacttatcagttacaaagggcaaagtggtaactttactgtgagaagcttgtggatgccagtttaaccagaggatcaaaggtaccgttgccgctggtgggcagccagcgtcccgagtgctgggaaggatgcctggctcttggtgccaatctgttcatgcagaaatgtcaggaacgctcaatgcggggacaatctacaaaacaaccggtttgcattcttcaaaagtttcagtgtcataaaagatttttaaaaagacaggcccaatgtatataccgtgaaaatagtaaaacaataaaatataaaagtaaaaagac

SEQ ID NO: 35405 - DNA, 891 bp, Homo sapiens
gaaattatattttgtaactataaatgatgtttcacagaccttcacaatgtttgggtccatttaaggggaaaaaatccctacaaattccaatattgatttaaattatatttattataatattatttaaatatgtataaacaaaaaccagctataaattcttgtgctcttgcacaattctacagccaaaccaagagagccacaaaatcagtgaaactcaagtaaatgttaatttggtagatactgttgttggggttttaaaaatgtattattactgtactgttaaatatcatgagataacttgttctcccaccaattttcttttctttcttaaatgatgtcccttaagtcatatcccactaactttctatatatttctatatttccaacattaatttttatgatgcattacttgatttgcccagaatgtattatggatatatgttcttatcacctttttttctccattaacctgatgtatttatttagccagatatgctgtttatcaacaaagaaaatatatgtggtttatccttgacctcacctggtctttatttggatgccggtagaatccctttctgagatctatagggagggtgggttatgtgcatagcttttgagccagagtctaatgtttagattctagatactaaaatagattatttttctgtttcacatctgttggactaaactagaatcttctataactgtgggagtacaaagaaagatttcctatcactccattggttgtttggttgattgactaattgattgggagccacgcctccctgaaaggatcacaccattgcatgcctatctggcctcctcatctttccccactcccaagctcttggcctagcatttactgggagttgtagtctgaaaaattactag

SEQ ID NO: 35406 - DNA, 614 bp, Homo sapiens
gagtaattatcaaaactccatatttgtgttctgaaattggcagaatttgaatttgcagtccataggtcagcagatttctctgactttccttattttctttgcttagccacagaaaaacagaaaaatcagtgagtttacatgcacagaattaaatgtacagactattctctgaaagagctcagttctatgtgaaaatgaataatgtaataaatattcttatgagtgtagtaatagtagctattgtttattgagtacttcttatgtgcatggcactttatactgcatgctttatgtcatttgagcctaacaaaatactatcattattattatctcatttttatagatattttctttttttaataaactcttttatttgcacgtttgtgtcttgggttattcgtggggtgagaaacctccacacttccaatcccagccatctggtacaatctggtgttgtggtccagctgtcggcaaagggtagaggtgggtgcagggctggccccccagtctgcaccaacctcttcagagcagggagctcagaccatggttgtacttgcactgcttcagggcctcgctgaagccttcacacagggacaggtcactctgcgtggtcg

SEQ ID NO: 35407 - DNA, 454 bp, Homo sapiens
agatgacattccctacaccccttcctctatgaagagtttcacaaaagacgtctttagaaggtaaatctagcctatgaaatattttaagcaaaagacagaaagaagtctcaaatgtatgtggtgtatgtggggtgtgtgtgtgtgtgagagagagaaagagagagggaaagaaagacacagagacagagacagacagacactacagtcatgtcatttttacccgagcataacccaggcatcctggtgggtacagttggatttacacactcctcaaagacatgctgaacatgcaaataatgggtattcaagagtttcaaaatgagctaacattgcaacccaaactcagcctccaaaataagccattttttaaaaaatcactaaaaacttatgaaagatatttccatgtacaaactctcattggctgttgtttcaacagtgtaaccttaattacaga

SEQ ID NO: 35408 - DNA, 473 bp, Homo sapiens
atagattcctggagaatgttgctctccagctccatccccacccaatgaaatatgatccagagagtcttgcaaagagacaagcctcattttccacaattagctctaaagtgcctccaggaaatgattttctcagctcatctctctgtattccctgttttggatcacagggcaatctgtttaaatgactaattacagaaatcattaaaggcaccaagcaaatgtcatctctgaatacacacatcccaagctttacaaatcctgcctggcttgacagtgatgaggccacttaacagtccagcgcaggcggatgttaaaaaaaataaaaaggtgaccatctgcggtttagttttttaactttctgatttcacacttaacgtctgtcattctgttactgggcacctgtttaaattctattttaaaatgttaatgtgtgttgtttaaaataaaatcaagaaagagagaaaaaaaaataa

SEQ ID NO: 35409 - DNA, 1616 bp, Homo sapiens
agagtgtgcaaatcctgcagcagcaactgacatatccaggttctatgatcaggactgactaggtggttgccgtgacccatagagaacaaggaaagatgggctggtggattggcccacctgggagccacatggggcaaggggagccctcaccctcagccagccaagggaggcagtgagtgagcatgctacccagcctgggaaactgctttttccatggatctttgcaatccacagatcagaagatcccactcatgagaccacaccacgagggccttgggtgccaaccacagagccatgcagattctcaacagccactcagctggagtctgcctaaaactaccgagttcccaagttggggaggggtggtcatcatcactgtggctgcctgctgcctaaaccctctgagttccctgggggagggggagcaatcatcactgtggttgctggctgcctaagacaactgagcttcccaagagaggggcagtcatcatcactgcagctgcctgctgcctgaggaaactgagctccctaagaagggacagcagccatcactgtggctgctagctgcctaagacactgaactcctggggaggaagggcggcagccatttctacagatccaggctgctgtttttcctttgctgatgccaggaagactggacggcttggtcccaagaggtattccccacagcgcagcatactggctgtggcagatcatggccagactgcctctttaggctgaccctgacccatccctcctcactgggtggggcctccctgcaggaactccagcaactcaagccagggaattagggagagaactctgatctctctaggtctgagtccctagtgggaggggtggctggctgttgtctccacaaaccggaagacttgttctttccccctgctcactctgaggattccaggcagcccagatgagtgggattttccccggcacagcatacccccttcccaaagggacaatcaaagtgcttcattaagcaagtcctggatcctgtgcccctcaactgggtgaaacaccccagtgggtcaccagacaccttatacaggagcatttctactggcatcaggtgggtgcccctcaaggacagagatcccagaggaaggagtggggtcccatctttgctgttctccagcaccctctggtgacatcttcaggtgtgggagggacccagataaatagggcttgaagtgaatccccagcaaaccacagcagccctacagaagaggtacctgactgtcgaaagaaaaacagaaagcaacaacaacatcaaccaaaaagtccccacgaaaacctcatctaaaggtcagcagcctcaaagatcaaaatgagacaaactcatgaagatgagaaaggaatgaaaaacccctaacaactcaaaaggccagagtgacttgtttactccaaatgatcacaacacctctacagcaagggcacagtcctgggtggaggttgagatggatgaattgacagaagtaggcttcagaaggtgggtagtagcaaacttcactgagctaaaggagtacgctctaacccaacatattggaacgaatcccagaacttaaagattggttctctaaaataagacagacaaa

SEQ ID NO: 35410 - DNA, 521 bp, Homo sapiens
cggtacccttgtatcagcacgctggagtctgcctaaaactaccgagttcccaagttggggaggggtggtcatcatcactgtggctgcctgctgcctaaaccctctgagttccctgggggagggggagcaatcatcactgtggttgctggctgcctaagacaactgagcttcccaagagaggggcagtcatcatcactgcagctgcctgctgcctgaggaaactgagctccctaagaagggacagcagccatcactgtggctgctagctgcctaagacactgaactcctggggaggaagggcggcagccatttctacagatccaggctgctgtttttcctttgctgatgccaggaagactggacggcttggtcccaagaggtattccccacagcgcagcatactggctgtggcagatcatggccagactgcctctttaggctgaccctgacccatccctcctcactgggtggggcctccctgcaggaactccagcgtgctataaaagggatgctctagatca

SEQ ID NO: 35411 - DNA, 817 bp, Homo sapiens
tacagattcaatgcaatctacagattcaatgcaatcccgactgaaatgccagtcagtttttacatgaacaggaaaaaaaatcctaaaatttgtaggaaaccataaaaaatgccaaatagccaatgcaatctgtagcgaaagaacaaaagtggaagaatcaaacttcaaaatatactacaaagctgtcgtaaccaaaacagcatggtactgtcataaaaatagacccaaagaccaatggaacagaagagagaacccacaaataaatccatgtatttatagtcaactgatggttgacaaaggtgccaagaacagacatagggaaaaggacacgctgttcaataaatggtgctgggaaaactggttatccatatagtgaagaatgaaactagactgtatctctcaccatatacaaaaataaactcaaaatgaattaaatacttaactataagaccccaaattataaagctactgcaggaaaacataggggaaacacttcagaagaataggcaaatatattttagataagacctcaaagatattttcaataagggtcaacaacaaaaaaatagacaaattggactatattgaactaaaatgcttctgcacagcaaaggaaacaatcagcagagtgaagagacctgtagaatgggagaaaatatttgcaaactcttcacctgaggaagggactaatatccaggaattaacaagggaagcaaaaaaacttaataggcagtgccatagcggctcttaactgttattcccagcacattggggagggccaagtcaggaggatcacttgaggccaggagttcaagac

SEQ ID NO: 35412 - DNA, 319 bp, Homo sapiens
ggcctgttttctttattggggattatctttgctcagctgcttggtatcatttgacactgaacagcacgtcacatgatgacttcctggctgtcccctcctgttagatgatacatgaccagtgacttggtttaggtggtgctcaggttctgtgagagcacagagggccccccgaccatgactaggtgtgtccacttaaagccagaatacctaatgaaattagactaggtcttaaatattttgatttgtatcctaactatatttccaaaaggaagtgagagacaaatgcaaattgcagataccacagaagcatgaaaacaaa

SEQ ID NO: 35413 - DNA, 1448 bp, Homo sapiens
tgcagtttggtagctcagtgcgaatatcttggtcagatttggccagttctctcttatcgtttttaatgtaatttccgtaaagggagagccatatgtataacaaggcttttgggctgatttccttttgtggtgactcagaacgtctcctcaatcattatattgagaataaaagtaaaaccttctaagattttgctcctcaagaacatttaggtcttagtataatgttcttgtagattgcaggccccccactggttaatgcttaccaacatgttcacacttagcttcactattttgcatttttctttcttccttccttcctttcattctttttacttgttctatgaagaggcctaacttgaaaatgtgacatatggcaaataggagaaaattattcttgcaaataaaaatcatccttttaaggaatccctgcatgtgagtatagggcagaagtggcaaacaaggagcccataaaccaaagtaagcttaaaggcagctgttatttgactattgccagaaaataaaaaataaaactatttaagttagttattgacagttaaaaattcaagagattttatatgaacatcagtatttctggcctcttttggaagattctgaatatctggcagccctaggtctgcgttcacgcatgtcaacacctgttggagctctgtagtggctgctgctgttagggcaagcttcgcactttgccacagtcaccactcctccttattacttatacccagcctgctatcctcatttctattctctcctggcccctcctgtagtctttgagtttgccaccgttgaaatagaattttttttttcattttaccttaattcctttttgcaaacctcagcctttggatctctaatactttccttatctgattcatgaagtcagcctactgattgggattaaaagatgtggtgtagaaactgatagtgcatttcacgttctaaaggtgtttgaggaaattggtagtgataatgagttggaatggtgtaatagccaaaatatacaccctaagaagaaaaaaagtaaaaactgcttggtgtttttaatttcataactgatttcctattgttttagacctccttggaaggtaccttgaagtattctgtgaatcaccaaagtggtaatgatttatcaggatacctaactcggataaaacccacaagtcttctttttagtgttccaaatggatttagtagcactatctactggaacttagaaaagaaattggtatgattaataaataactcctattgctgtttaattaaaaagataacatctcaataaggttaaaaattaataatcaatgttaacaacaataactgttttcatttttgtatgactggtttttgtttacatgaatatatactttatattgttatcattacattgtttaagccatgaacattatatcacaagcttttccatgttgcta

SEQ ID NO: 35414 - DNA, 574 bp, Homo sapiens
tttttttttttttgagatggagtcttgctctgtcacccagggtaggactttttaaaactcaagtttaggccgggtgcggtggctcacgcctgtaatcccagcactctgggaggccaaggcgggtggatcacgaggtcaggagatcgagaccatcctggccccgtctctactaaaaatacaaaaaaattagctgggcttcgtggcaggcgcctgtagtcccagctacttgggaggctgaggcaggagaatggtgtgaacccaggaggtggagcttgcagtgagccgagacagcaccactgcactccagcctgggcaacagagcgagactctgtctcaaaaaaaaaaaaaaaaaaaagtcaagttcattggctgggcacatggctcacccaaattttaccattctatttcatcaacaaaggatcttgtagtgattgctgctgtaacagactgaagcagccttacaaagtttcagagggcaatattacatttttaaaaatcgtgttaaaatacattctaagatccaattattttaaaataggtcaaaatagtttagaaaatccacttttacaatctg

SEQ ID NO: 35415 - DNA, 344 bp, Homo sapiens
tcctctcaaagccctatgagctggctctttatcactaggctcagagaggttgagtgactcgtccaagatcacacagccccaggtcttcctgctttgggagctcaaccctgtttactcctttctagggaagattactattattttccacatttctttcaagtctgttattcaccgaatcaagttgagtaacagaggctttatgtccaaatcacacgggctttgcattgctatttcgtaaggaggatggggtagaccggattcttggctcctagttggatttcccttcttgggttccatttctttttacctacaacccagaccctgacagccccgaactgcccgca

SEQ ID NO: 35416 - DNA, 181 bp, Homo sapiens
ctctgccccattgttgaacattatggactgtacattgtgttccttggtctgaagaaatgatagttggccctctaactccatacactgtcttatctttctttctttttttttttatggcactctgagcatttttgtattccattgcataagcaaagcccggtccagagtcaatgtctattcc

SEQ ID NO: 35417 - DNA, 503 bp, Homo sapiens
aaaccccaaggggtagcattttcttccttttcataatgagaagccagagccaggaatattttttcccctttgtcattgtgtctttctacctgtgggaaaccacttgaaacttctgggtagagcatcaggaaatgacctcacagatgaactgcaactacggactaaaaacaatggcactcgaaaacaattcaggattagacctgaagatactgagtaagttcggtggaaaactgcagtggaggaagttaagtgggtggattgaaaccaatgcagctggcctctgggagagtcctggagacaaagaaaatcaactgcacatgacacaagttagaaagaagtccttcagaaatgcctctttggggagtcacatgtgcagggccctccctggagattctaaaattgacttggttcaggatgtggatcctgctcgccctctgcctcccacactcacagagcagtgaagcattcttgttttcctaagagtttctgctcctcaatatgcc

SEQ ID NO: 35418 - DNA, 291 bp, Homo sapiens
aaaagacagattagatgttgtaaattattcaaaaatgttttgttagcactaacgcaacagagaagttatgatggtagtggaaggcaagcaaatttaaaacagtagtaagatacagaaggactataccaacaaaatgtaatacagcatccacagacatgtaaagaaaataaaggtaggcaggttcagtggctctcatctgtaatctcagtactctgggaagccaatgcaagaggaatgcttgaagccaagagttcaagaccaacctgggcaacacagcaagacccctgtctc

SEQ ID NO: 35419 - DNA, 143 bp, Homo sapiens
tgtgtgattcacacgtgtccatgtgcctttgcttgcggctctgttcaccttcctgatgcctgaatttcgagctcctgaaaaggaaactttctggtattcactggcattgaataaagacaggaaataagtgtctcagcacagaa

SEQ ID NO: 35420 - DNA, 644 bp, Homo sapiens
  misc_feature (20)..(20): n is a, c, g, or t
  misc_feature (26)..(26): n is a, c, g, or t
  misc_feature (562)..(562): n is a, c, g, or t
  misc_feature (602)..(602): n is a, c, g, or t
tggatcccttcgacggtgtnctgggngatgaaacagaggaagaagaaacaaagcccattgagctccctgtcaaagaggaagaaccccctgaaaaaactgttgatgtggcagcagagaagaaagtggtgaaaattacatctgaaataccacagactgagagaatgcagaagagggctgaacgattcaatgtacctgtgagcttggagagtaagaaagctgctcgggcagctaggtttgggatttcttcagttccaacaaaaggtctgtcatctgataacaaacctatggttaacttggataagctgaaggaaagagctcaaagatttggtttgaatgtctcttcaatctccagaaagtctgaagatgatgagaaactgaaaaagaggaaggagcgatttgggattgtcacaagttcagctggaactggaaccacagaggatacagaggcaaagaagaggaaaagagcagagcgctttggcattgcctgatgaagaggttcttgatactttctgttctccagtgttttccatttctctccttcttcttggtcacatatatgccnaatgcacgtcatgtgcctacgtcctgcctcgcatgagggngcatgtaccccacggtacatcctgtctgcgcagcgttgacgt

SEQ ID NO: 35421 - DNA, 1548 bp, Homo sapiens
caagtttgaatgcttcatttgcataaatgaacctgattgggaacctgggtgtgaattttctctataaaagcaaaactctccctttgttctctggatggcacctttcctttacattgaagtttgcatcttccaagtttgcaatcacttctctggaataaagtctctttcctcaaaattcctttttagagaacttttgttcacatgtgcccagggtaacaaagctaggaagtggtaagcttgggagttaacctagactggtttactctcatattgcttatgtggtcagattcaccaaattggattttgtttcttcagatttttcttttaccaaagttacactgcagtaaagtaactgcttccctttttctcagactaaactttttacagccccaatatttatttattgggtgcttccaacacaccctattatattctgcaaatttatattctgcaaatcactatttggtggatatttacaaattctctacaaatggcttgtatgtgaagacctcagtccggtgggcaccagttccactttctcagagcagtggatttgggggccagtgtgcctctgtttgcatctgagggagggtggcctcgagacagatacctggggtgagagttactgctgtggtttcagtccatttcttggaagatgtcctggcttctccaactggtggactccttgtccttccctaacaacgtgtctctaatgtttgtgtgactctgggtcatagttccttctgtttcatgtaccatgaatgctgtttcttgactctttgcatgtaaaaactcactcaaagcctagctcaaatgttacatttattttctgggtttttatagtcctttgactaactcttcacctttcttcatgtgggcacagtttttctgaagtatacagttagttgaggagtgtttgtcagtctctcaacttcaaatctctgctactagctatgcaatactgagaaggccacttaatccttccatgcctatgtttctgtgttgataattttggagatgatatttacttcatggctaagaatgttatgcagcaatgttggttgtgaaagtgcttggcagattagaaggtgtggtattcactgctgggtggctgatccaacctttattcccaattctttcctcccctggcttcccttttacctcctaataggcctagaaatgctaaatgctcactctcccagcttccccttggcagctaaggctggcctatggaacctaggaagaaccaaaggagcacacacggaggtcctctgggaggctctgcacagtgcttgaagtgaaagcagttatatgatagcaatgcaacaagttaacacaaaaacaatgatctctagcctttttgtcatgtgatataactaatgtctttaagccactattatttgtgtattccattacttgtggttaaaaagcattcctgatagtgtagattcccaataagtgtttactgaatatgaatctgtattgcattgtgagtcttgggggcaaaattcaataaaattatcatctctgctctctacaaaaaaaaat

SEQ ID NO: 35422 - DNA, 412 bp, Homo sapiens
catatactgaggacttacaaatgtatatactcagcgcagacctctcctctgaattctagactcatatatccgaatgtcttcttgacaaattcttttcaatgtctagtaattcaaacttagctaatatgtccaaaacctgagctttaacccccaacaagatcctccagtttttctcatttcagtaaataattccattcttcccttacagttattgagcccaaaaaccttggagctattcttgactccctaactctctctcctcccccaggccagtatgcgagcaaatcctgttggctttaaaatgtagccaaaatcagccaggagcggtggctcacccctgtaatcccagcactttgagatgcagaggcgggcggatcatttgaggccaggagttcgagaccaacctgccaac

SEQ ID NO: 35423 - DNA, 1012 bp, Homo sapiens
aaaaagcagctgtaccgtccgaatcccggatgcgcgagccagcggcagcggcggcggcgatgagacagaagcactaccttgaggctgcagcgcggggactgcacgacagctgcccgggccaagcccgctacctcctctgggcctacacttcgtcgcacgatgataagagcacttttgaagaaacgtgtccatactgtttccagctgttggttctggataactctcgagtgcgtctcaaacccaaagccaggttgacacccaaaatacagaaacttcttaatcgagaagcgagaaactatacactcagttttaaagaagcaaaaatggtgaaaaagttcaaagactccaaaagtgtattgttgatcacttgtaaaacatgcaacagaacagtgaaacatcatggtaaaagtagaagctttgtgtcaacattgaagagcaatcctgccactcctacaagtaaactcagcctgaagacaccagagagaaggactgcaaacccaaatcatgacatgtctggctcgaaaggcaagagcccagcatcggttttcagaacacctacatctggacagtcagtatctacttgctcctcaaagaacaccagcaaaacaaagaaacacttctctcaactaaaaatgttacttagtcagaatgaatcccaaaagattccaaaggtggacttcagaaatttcttatcttctctgaagggtggacttttaaaataagaaatgcctgatgtcaattctgaaactaaagttggtaaaacaactttttaaactcttattcattttttgaatacatggaaactagatctgaatgcaaacttttcttggcatccttcagtgtttatggggaaaatacctcattagtgtgaatacctgaaacctgcctacctcataggacagctgtgaggatcaaaaaatatatgaaagttccttgtagatacatatctatagatatatatgtgtatgtatataaagatagatatatacattgagtagtggcattactgttt

SEQ ID NO: 35424 - DNA, 1057 bp, Homo sapiens
agcttgagtccggacaccaacgacggggacgctgggaagccgacttccggcgccctattttctcacctggttcccgcggcgagccagcggcagcggcggcggcgatgagacagaagcactaccttgaggctgcagcgcggggactgcacgacagctgcccgggccaagcccgctacctcctctgggcctacacttcgtcgcacgatgataagagcacttttgaagaaacgtgtccatactgtttccagctgttggttctggataactctcgagtgcgtctcaaacccaaagccaggttgacacccaaaatacagaaacttcttaatcgagaagcgagaaactatacactcagttttaaagaagcaaaaatggtgaaaaagttcaaagactccaaaagtgtattgttgatcacttgtaaaacatgcaacagaacagtgaaacatcatggtaaaagtagaagctttgtgtcaacattgaagagcaatcctgccactcctacaagtaaactcagcctgaagacaccagagagaaggactgcaaacccaaatcatgacatgtctggctcgaaaggcaagagcccagcatcggttttcagaacacctacatctggacagtcagtatctacttgctcctcaaagaacaccagcaaaacaaagaaacacttctctcaactaaaaatgttacttagtcagaatgaatcccaaaagattccaaaggtggacttcagaaatttcttatcttctctgaagggtggacttttaaaataagaaatgcctgatgtcaattctgaaactaaagttggtaaaacaactttttaaactcttattcattttttgaatacatggaaactagatctgaatgcaaacttttcttggcatccttcagtgtttatggggaaaatacctcattagtgtgaatacctgaaacctgcctacctcataggacagctgtgaggatcaaaaaatatatgaaagttccttgtagatacatatctatagatatatatgtgtatgtatataaagatagatatatacattgagtagtggcattactgttt

SEQ ID NO: 35425 - DNA, 916 bp, Homo sapiens
taaaaatacaaaaaaattacctggcatggtggtgcacgcctgtaatcccagctactcgagaggatgataagagcacttttgaagaaacgtgtccatactgtttccagctgttggttctggataactctcgagtgcgtctcaaacccaaagccaggttgacacccaaaatacagaaacttcttaatcgagaagcgagaaactatacactcagttttaaagaagcaaaaatggtgaaaaagttcaaagactccaaaagtgtattgttgatcacttgtaaaacatgcaacagaacagtgaaacatcatggtaaaagtagaagctttgtgtcaacattgaagagcaatcctgccactcctacaagtaaactcagcctgaagacaccagagagaaggactgcaaacccaaatcatgacatgtctggctcgaaaggcaagagcccagcatcggttttcagaacacctacatctggacagtcagtatctacttgctcctcaaagaacaccagcaaaacaaagaaacacttctctcaactaaaaatgttacttagtcagaatgaatcccaaaagattccaaaggtggacttcagaaatttcttatcttctctgaagggtggacttttaaaataagaaatgcctgatgtcaattctgaaactaaagttggtaaaacaactttttaaactcttattcattttttgaatacatggaaactagatctgaatgcaaacttttcttggcatccttcagtgtttatggggaaaatacctcattagtgtgaatacctgaaacctgcctacctcataggacagctgtgaggatcaaaaaatatatgaaagttccttgtagatacatatctatagatatatatgtgtatgtatataaagatagatatatacattgagtagtggcattactgttt

SEQ ID NO: 35426 - DNA, 1091 bp, Homo sapiens
aaaaagcagctgtaccgtccgaatcccggatgcgcgagccagcggcagcggcggcggcgatgagacagaagcactaccttgaggctgcagcgcggggactgcacgacagctgcccgggccaagcccgctacctcctgtaagaggactggaggggaagcgggaggcgagcgggtaggtgttcctttgctcctcacaagtctctttctcttttacagctgggcctacacttcgtcgcacgatgataagagcacttttgaagaaacgtgtccatactgtttccagctgttggttctggataactctcgagtgcgtctcaaacccaaagccaggttgacacccaaaatacagaaacttcttaatcgagaagcgagaaactatacactcagttttaaagaagcaaaaatggtgaaaaagttcaaagactccaaaagtgtattgttgatcacttgtaaaacatgcaacagaacagtgaaacatcatggtaaaagtagaagctttgtgtcaacattgaagagcaatcctgccactcctacaagtaaactcagcctgaagacaccagagagaaggactgcaaacccaaatcatgacatgtctggctcgaaaggcaagagcccagcatcggttttcagaacacctacatctggacagtcagtatctacttgctcctcaaagaacaccagcaaaacaaagaaacacttctctcaactaaaaatgttacttagtcagaatgaatcccaaaagattccaaaggtggacttcagaaatttcttatcttctctgaagggtggacttttaaaataagaaatgcctgatgtcaattctgaaactaaagttggtaaaacaactttttaaactcttattcattttttgaatacatggaaactagatctgaatgcaaacttttcttggcatccttcagtgtttatggggaaaatacctcattagtgtgaatacctgaaacctgcctacctcataggacagctgtgaggatcaaaaaatatatgaaagttccttgtagatacatatctatagatatatatgtgtatgtatataaagatagatatatacattgagtagtggcattactgttt

SEQ ID NO: 35427 - DNA, 722 bp, Homo sapiens
taggctcgggcctggttggctcgggttagcagaaatggtgaaaaagttcaaagatccaaaagtgtattgttgatcacttgtaaaacatgcaacagaacagtgaaacatcatggtaaaagtagaagctttgtgtcaacattgaagagcaatcctgccactcctacaagtaaactcagcctgaagacaccagagagaaggactgcaaacccaaatcatgacatgtctggctcgaaaggcaagagcccagcatcggttttcagaacacctacatctggacagtcagtatctacttgctcctcaaagaacaccagcaaaacaaagaaacacttctctcaactaaaaatgttacttagtcagaatgaatcccaaaagattccaaaggtggacttcagaaatttcttatcttctctgaagggtggacttttaaaataagaaatgcctgatgtcaattctgaaactaaagttggtaaaacaactttttaaactcttattcattttttgaatacatggaaactagatctgaatgcaaacttttcttggcatccttcagtgtttatggggaaaatacctcattagtgtgaatacctgaaacctgcctacctcataggacagctgtgaggatcaaaaaatatatgaaagttccttgtagatacatatctatagatatatatgtgtatgtatataaagatagatatatacattgagtagtggcattactgttt

SEQ ID NO: 35428 - DNA, 315 bp, Homo sapiens
aaaaagcagctgtaccgtccgaatcccggatgcgcgagccagcggcagcggcggcggcgatgagacagaagcactaccttgaggctgcagcgcggggactgcacgacagctgcccgggccaagcccgctacctcctgtaagaggactggaggggaagcgggaggcgagcgggccagtatgcgagcaaatcctgttggctttaaaatgtagccaaaatcagccaggagcggtggctcacccctgtaatcccagcactttgagatgcagaggcgggcggatcatttgaggccaggagttcgagaccaacctgccaac

SEQ ID NO: 35429 - DNA, 373 bp, Homo sapiens
atagttgtcaaaacttcgggtactattttaacatacatcagcacttgttaatttgctgtaattccctcaatagaacaccaagctttagttttcagtatgtttcttgggcaagtgaggtggtaggtggccatgtactagatcaaacttgattttctagggattgttttcccacttttagagaataccattcttaggctaaactcaattacagaatctactgcatgctatacagccctctatagaaatattcaccctgagtagttaattatgtttcttaatgggtaaatgttttatctagtccctctttttttttaatttcataaaatccagatctctcagagcttaaatacacttcctcttattttccctacaa

SEQ ID NO: 35430 - DNA, 258 bp, Homo sapiens
tgcaggtctgccccgtgccatcactgctgttggtatcactgttccccctgcttgcccctgggacccagcccaaaaggccgcaaagtacaacagaaagggcacgtttgctgtgggaatacatcgaaaagaaaaaggaggcacctgctgcaactattttttcgtggtttttgtttctcaaatattgacaattatgccttcaagaatgcttccaaaattgttaaaaaaaaaattctttaaataaaattttaattaaccctt

SEQ ID NO: 35431 - DNA, 539 bp, Homo sapiens
caaagaaatacctgtgcaagtagaatagcttgcttcaaacagatgagatttgtcctcccaacatcaaaacatatcacaaaactacagtaattaagtccctttgaggccagcactgactgagataagcaaatagataaatgggatgtaacaggccttatttcaaactaataggttgttcaccaactcctagttggataccctgctatccattatgaaaaagaaaaaaaggtaagttctcatcttacaccatacttaaatttcagatgaattaagtattaaacataaaaattaaatgaaacatgggtttccctgggtattctaagcctaactccaaacttggaagctgcaaagtttggctttgtggctctacatggaaaaaaaaaatagaagctgcaaaggagaatattttacctatttgactacataaaagcttaaaattactacatgacaaggtactgtaaaaatagttaaaggataaatggcaaactaatagaaaacacttgcaacaaagggttaataaaacataaagagaaaaaaaa

SEQ ID NO: 35432 - DNA, 383 bp, Homo sapiens
tctcagctcactgcaaccaccacttcccagctcaaatgatcctccagcctcagcctcctgagtagctgggactataggcacaagccactatgcccagataatttttgtattttttgcagagatggggttttgcccaggctggtcttgaactactgagcttaaagtgatctgcccacttctgcctcccaaagtgctaggattacatatgtgagtcaccatacccagcccataatattcttttattatacttttaatgtccatgagatctgtagtgatgtctcctctttcacttgtgacattagtaatttgtttttttttcttagttagcatggcttagaggcttatcaatcttactgatctttttaaagaaacagcttttggtc

SEQ ID NO: 35433 - DNA, 739 bp, Homo sapiens
catcaacatcacctggcaacttgttagaaattccaattctacgggtaaaatcaaggtctaggggtagggcccagtgatcacggttctaaagcccttcaggtgattctaatgtttgcttaagtttgagagttacagactagtttcataaagctcaggctgctttgtcctgcaaggagcaggaaatcctaaagagcaggaaagctatgtgtcccaggtatatggcctctacagcacctagcacagtatcatacacacggtaggcattcacacttgctgaataggttaattcagtctcacataaccgatgactgactagacaacagcatcatcagtttcacagaggtcagaaatttgggggactatttgcattaactaataataagtacatgatgcacacatatcagtaactgttaaataactgggaaagccctgggcctctggtactttggccaataacattaccaggcttacgaagtgtcatatcctttgaaattcaggtgaaaaatatgtttctcattttgccagtatagaaaaaggatgtatccgtggctccatataactatagaacataaactgaaatgcaaactgtttggttgcctttaaaaagcatattttgaccaggtacagtggctcacgcctgtaatcccagcactttgggaggccaaggcgggcggatcacctgaggtcaggagtttgagaacagcctggccaacatggcgaaaccccatctctactaaaa

SEQ ID NO: 35434 - DNA, 377 bp, Homo sapiens
agtaggagggaagagggccagagctgagagctctggggtggagtccagtgccagtcctaccactgactcatcatgtgagtcacctctcttgagacccagtcacctctacttgtccattttatagtacccttggaaagttcccatgagttaatgggtatggaaggacctggtaaataaatcaagtgcccctgagttgtagggtgctataactatcattagctgagcaaggaggttaccaacagccccatcccattcctgatgcatcttggggctatttatggcgagtccccaggcctgctaccgccatcgtgtcctcagcacatcagggcttgcttgttcacatacccctccctgtgtacaagcctgaaactcaggga

SEQ ID NO: 35435 - DNA, 668 bp, Homo sapiens
ggtttcaccatcttggccaggatggtctctatctcctgaccttgtgatctgcccaccttggcctcccaaagtgctgggatcctaagtacagacgtgagccaccgtgcccggccattcttaacctcttgaaactccttaagactttggtgaaagccatagacctctcttcccagaagaatgaacacgtggtttgccggcaccttaggaacccccaaagcccatgagacaaagccctggatctataaggccctgtcccatctgacccccggccttcccctgggcacatacctccagctacacagggctttcatacacactgcccctttgcctggtccagctctgctcatccttcaagtctcacccttccctgacttccagcttagattaggtcgccctgctagacatgcgtcccccaccctgaatttagcactgatcaccgggataactaagtgattcttcgtgcatgttatccgaccctccccaagctccgtgttggtatttgttgagtaaatctctgaggcccctccagctatgacattctgagactgatctataagtttgcagatgtgtcataagagagtccctgagcttgtatttcctatgacattcgacacgtggtggcctttgccttcgatgatttcctccaggcctggacaggaaagttactt

SEQ ID NO: 35436 - DNA, 1176 bp, Homo sapiens
agaatgaagctgctctggtggtgtgactggcttccagaaaggtctcatgtgttcactcagaggtagttatgtgtactgattctgtgatctgtgaagtttgtcagtctctgaatgtaatttgtgtctggcttgcatttatgaaaatgagaagaaaaatcacgaatataccttacatatttttagatttagcctctttaaaaatagtggatttataacttaggatctttttttttctattaacctgattatatagcctttcgggatatttattagtttataaaatgtaatgcaaggagatagtcttaaaaagttgaaacacaggttgtaggctaaacgttttttttaacccatttgtaactcaaaactcattgttccacagaaccatgttgataggaatcttgagttttccacaccagcctgttaattctgtttacctgaaaagtgtattactgctaataatgtaggctctaaccgctatggaaattttatttctatggggaattgtgtctggattctaatgcagtatgctgggaatgcaccttctttttagcaggacagggctcttgagtgtgggggcttcctttggcctctttttcgcagttggggaggacaggggtttctattttgtcctggactgttacagaacatgactaagtcttagagacttctacctcccctctactccggcgcctaaggcaagccttgtaaagccttctgtggactcacgctcccagatttgcaagaacagaggaaggcttatcccacatctcctaccatagccccactctagtcagcaccactcctgccccacctgaaaccagcttttacttagaccagaggttctcaaccgtctatgtctcacttgtggcgtacactaaaaagtttacttaacatgctgttttcatacgctgttgatccatcagcaagtcctgttagctctacctccaaaagatatctgaaatctgtccatgtttctcccatcaccattactaagtcctggaggctataacctcgtcaaaaccagtgtcattttttgcctggaacactacagaaaccacctaacttacttcctgttctggccctcttacagtctatttaccagatcactcaacagtttttaaaagtataaatcaggtcatgccatttccctgtttaaaataaccctgtggaaaagca

SEQ ID NO: 35437 - DNA, 347 bp, Homo sapiens
ggcacgagaccatgagtcaataccctgtagtcacgctgttgcgacgagcgggagccgggccagatcgcgaggtcactcgtggagttccgggtacctcctgcaaggccgtccaccgagcctcgagtcccgcccatggggctacattctgagcccgtcgcgcacagacgcgccacatagtgccaccaaccccccacacccctctctgaactggtagcagtttcccaggatctccaggctgtttcttccatccttccatgcctccacatatgctttcctcttacttccctgttgtgcctggctcctctgccatcacctgaagacccccacggcgagccctatgcagtctt

SEQ ID NO: 35438 - DNA, 488 bp, Homo sapiens
gatttgaggctgcacgacgttcaccatggtcttgtgtgggaggatcctggcgtaacgggccagaacattggcattttccatgatggcgagggctgagggggtgtgttccccaatcttcagcagtgatcaagcttcggcaaggtgctgcttggagagctgaagggcagaggagagtactttgccatcaaggccctcaagaaggatgtggtcctgatcgacgacgacgtggagtgcaccatggttgagaagcgggtgctgacacttgccgcagagaatccctttctcacccacctcatctgcaccttccagaccaagaccacctgtctttgtgatgagtcctcacggggggactgatgtacacatcagacaagcccccttgacttacgtgcacgtttatgcctgaatatgtgtgatgcattctacacacaggcatcattacaggacctcaactgacatgtgctgtgacggatgcaatcagatcgacttga

SEQ ID NO: 35439 - DNA, 2611 bp, Homo sapiens
cgtgacgcgtgggtcgacccacgtcgtcgacccccggcgcccgcccgccgcgcggaggcccgggccacacctcactggccgcttggcccatcccagtcagcgccgcgccgaaccccgtccgcgcgcgccggggagcggcgcccccgccgctgccgccgcgacccttggcgcctgcccctgcaacgggagccccactgcaggccccaccatggcgccgttcctgcgcatcgccttcaactcctatgagctgggctccctgcaggccgaggacgaggcgaaccagcccttctgtgccgtgaagatgaaggaggcgctcagcacagagcgtgggaaaacactggtgcagaagaagccgaccatgtatcctgagtggaagtcgacgttcgatgcccacatctatgaggggcgcgtcatccagattgtgctaatgcgggcagcagaggagccagtgtctgaggtgaccgtgggtgtgtcggtgctggccgagcgctgcaagaagaacaatggcaaggctgagttctggctggacctgcagcctcaggccaaggtgttgatgtctgttcagtatttcctggaggacgtggattgcaaacagtctatgcgcagtgaggacgaggccaagttcccaacgatgaaccgccgcggagccatcaaacaggccaaaatccactacatcaagaaccatgagtttatcgccaccttctttgggcaacccaccttctgttctgtgtgcaaagactttgtctggggcctcaacaagcaaggctacaaatgcaggcaatgtaacgctgccatccacaagaaatgcatcgacaagatcatcggcagatgcactggcaccgcggccaacagccgggacactatattccagaaagaacgcttcaacatcgacatgccgcaccgcttcaaggttcacaactacatgagccccaccttctgtgaccactgcggcagcctgctctggggactggtgaagcagggattaaagtgtgaagactgcggcatgaatgtgcaccataaatgccgggagaaggtggccaacctctgcggcatcaaccagaagcttttggctgaggccttgaaccaagtcacccagagagcctcccggagatcagactcagcctcctcagagcctgttgggatatatcagggtttcgagaagaagaccggagttgctggggaggacatgcaagacaacagtgggacctacggcaagatctgggagggcagcagcaagtgcaacatcaacaacttcatcttccacaaggtcctgggcaaaggcagcttcgggaaggtgctgcttggagagctgaagggcagaggagagtactttgccatcaaggccctcaagaaggatgtggtcctgatcgacgacgacgtggagtgcaccatggttgagaagcgggtgctgacacttgccgcagagaatccctttctcacccacctcatctgcaccttccagaccaaggaccacctgttctttgtgatggagttcctcaacgggggggacctgatgtaccacatccaggacaaaggccgctttgaactctaccgtgccacgttttatgccgctgagataatgtgtggactgcagtttctacacagcaagggcatcatttacagggacctcaaactggacaatgtgctgttggaccgggatggccacatcaagattgccgactttgggatgtgcaaagagaacatattcggggagagccgggccagcaccttctgcggcacccctgactatatcgcccctgagatcctacagggcctgaagtacacattctctgtggactggtggtctttcggggtccttctgtacgagatgctcattggccagtcccccttccatggtgatgatgaggatgaactcttcgagtccatccgtgtggacacgccacattatccccgctggatcaccaaggagtccaaggacatcctggagaagctctttgaaagggaaccaaccaagaggctgggagtgacgggaaacatcaaaatccaccccttcttcaagaccataaactggactctgctggaaaagcggaggttggagccacccttcaggcccaaagtgaagtcacccagagactacagtaactttgaccaggagttcctgaacgagaaggcgcgcctctcctacagcgacaagaacctcatcgactccatggaccagtctgcattcgctggcttctcctttgtgaaccccaaattcgagcacctcctggaagattgaggttcctggacagatcaggctagccctgccctccacccacacctgcccgctccccacgataagcaccagtgggactgtggtgacttctgctgctggccccgcccctgcccccagagcgtccttggctgccgtctggccgggctctcatggtacttcctctgtgaactgtgtgtgaatctgcttttcctctgccttcggagggaaattgtaaatcctgtgtttcattacttgaatgtagttatctattgaaaatatatattatatacatagacatatatatatatataataggctgtatatattgctcagtagagaaaaaccatgggggactggtgatatgttgatctttttcaaaaaaatatatatatgaca

SEQ ID NO: 35440 - DNA, 2706 bp, Homo sapiens
tgccgcggcgccggagcccgaggcggctgtagcccacatctcccgagcgacccccggcgcccgcccgccgcgcggaggcccgggccacacctcactggccgcttggcccatcccagtcagcgccgcgccgaaccccgtccgcgcgcgccggggagcggcgcccccgccgctgccgccgcgacccttggcgcctgcccctgcaacgggagccccactgcaggccccaccatggcgccgttcctgcgcatcgccttcaactcctatgagctgggctccctgcaggccgaggacgaggcgaaccagcccttctgtgccgtgaagatgaaggaggcgctcagcacagagcgtgggaaaacactggtgcagaagaagccgaccatgtatcctgagtggaagtcgacgttcgatgcccacatctatgaggggcgcgtcatccagattgtgctaatgcgggcagcagaggagccagtgtctgaggtgaccgtgggtgtgtcggtgctggccgagcgctgcaagaagaacaatggcaaggctgagttctggctggacctgcagcctcaggccaaggtgttgatgtctgttcagtatttcctggaggacgtggattgcaaacagtctatgcgcagtgaggacgaggccaagttcccaacgatgaaccgccgcggagccatcaaacaggccaaaatccactacatcaagaaccatgagtttatcgccaccttctttgggcaacccaccttctgttctgtgtgcaaagactttgtctggggcctcaacaagcaaggctacaaatgcaggcaatgtaacgctgccatccacaagaaatgcatcgacaagatcatcggcagatgcactggcaccgcggccaacagccgggacactatattccagaaagaacgcttcaacatcgacatgccgcaccgcttcaaggttcacaactacatgagccccaccttctgtgaccactgcggcagcctgctctggggactggtgaagcagggattaaagtgtgaagactgcggcatgaatgtgcaccataaatgccgggagaaggtggccaacctctgcggcatcaaccagaagcttttggctgaggccttgaaccaagtcacccagagagcctcccggagatcagactcagcctcctcagagcctgttgggatatatcagggtttcgagaagaagaccggagttgctggggaggacatgcaagacaacagtgggacctacggcaagatctgggagggcagcagcaagtgcaacatcaacaacttcatcttccacaaggtcctgggcaaaggcagcttcgggaaggtgctgcttggagagctgaagggcagaggagagtactttgccatcaaggccctcaagaaggatgtggtcctgatcgacgacgacgtggagtgcaccatggttgagaagcgggtgctgacacttgccgcagagaatccctttctcacccacctcatctgcaccttccagaccaaggaccacctgttctttgtgatggagttcctcaacgggggggacctgatgtaccacatccaggacaaaggccgctttgaactctaccgtgccacgttttatgccgctgagataatgtgtggactgcagtttctacacagcaagggcatcatttacagggacctcaaactggacaatgtgctgttggaccgggatggccacatcaagattgccgactttgggatgtgcaaagagaacatattcggggagagccgggccagcaccttctgcggcacccctgactatatcgcccctgagatcctacagggcctgaagtacacattctctgtggactggtggtctttcggggtccttctgtacgagatgctcattggccagtcccccttccatggtgatgatgaggatgaactcttcgagtccatccgtgtggacacgccacattatccccgctggatcaccaaggagtccaaggacatcctggagaagctctttgaaagggaaccaaccaagaggctgggagtgacgggaaacatcaaaatccaccccttcttcaagaccataaactggactctgctggaaaagcggaggttggagccacccttcaggcccaaagtgaagtcacccagagactacagtaactttgaccaggagttcctgaacgagaaggcgcgcctctcctacagcgacaagaacctcatcgactccatggaccagtctgcattcgctggcttctcctttgtgaaccccaaattcgagcacctcctggaagattgaggttcctggacagatcaggctagccctgccctccacccacacctgcccgctccccacgataagcaccagtgggactgtggtgacttctgctgctggccccgcccctgcccccagagcgtccttggctgccgtctggccgggctctcatggtacttcctctgtgaactgtgtgtgaatctgcttttcctctgccttcggagggaaattgtaaatcctgtgtttcattacttgaatgtagttatctattgaaaatatatattatatacatagacatatatatatatataataggctgtatatattgctcagtagagaaaaaccatgggggactggtgatatgttgatctttttcaaaaaaatatatatatgacaaaaaaaaaaaaggagcacaagctgtttgaaccaccaggtttatttgtgtgtctaaataaacaccaaatagtacca

SEQ ID NO: 35441 - DNA, 2713 bp, Homo sapiens
tgccgcggcgccggagcccgaggcggctgtagcccacatctcccgagcgacccccggcgcccgcccgccgcgcggaggcccgggccacacctcactggccgcttggcccatcccagtcagcgccgcgccgaaccccgtccgcgcgcgccggggagcggcgcccccgccgctgccgccgcgacccttggcgcctgcccctgcaacgggaggctggagtgcagtggcaagatctcggctcactgcaacctctacctcccgggttcaagtgattcttctgcctcagcctcccagccccactgcaggccccaccatggcgccgttcctgcgcatcgccttcaactcctatgagctgggctccctgcaggccgaggacgaggcgaaccagcccttctgtgccgtgaagatgaaggaggcgctcagcacagagcgtgggaaaacactggtgcagaagaagccgaccatgtatcctgagtggaagtcgacgttcgatgcccacatctatgaggggcgcgtcatccagattgtgctaatgcgggcagcagaggagccagtgtctgaggtgaccgtgggtgtgtcggtgctggccgagcgctgcaagaagaacaatggcaaggctgagttctggctggacctgcagcctcaggccaaggtgttgatgtctgttcagtatttcctggaggacgtggattgcaaacagtctatgcgcagtgaggacgaggccaagttcccaacgatgaaccgccgcggagccatcaaacaggccaaaatccactacatcaagaaccatgagtttatcgccaccttctttgggcaacccaccttctgttctgtgtgcaaagactttgtctggggcctcaacaagcaaggctacaaatgcaggcaatgtaacgctgccatccacaagaaatgcatcgacaagatcatcggcagatgcactggcaccgcggccaacagccgggacactatattccagaaagaacgcttcaacatcgacatgccgcaccgcttcaaggttcacaactacatgagccccaccttctgtgaccactgcggcagcctgctctggggactggtgaagcagggattaaagtgtgaagactgcggcatgaatgtgcaccataaatgccgggagaaggtggccaacctctgcggcatcaaccagaagcttttggctgaggccttgaaccaagtcacccagagagcctcccggagatcagactcagcctcctcagagcctgttgggatatatcagggtttcgagaagaagaccggagttgctggggaggacatgcaagacaacagtgggacctacggcaagatctgggagggcagcagcaagtgcaacatcaacaacttcatcttccacaaggtcctgggcaaaggcagcttcgggaaggtgctgcttggagagctgaagggcagaggagagtactttgccatcaaggccctcaagaaggatgtggtcctgatcgacgacgacgtggagtgcaccatggttgagaagcgggtgctgacacttgccgcagagaatccctttctcacccacctcatctgcaccttccagaccaaggaccacctgttctttgtgatggagttcctcaacgggggggacctgatgtaccacatccaggacaaaggccgctttgaactctaccgtgccacgttttatgccgctgagataatgtgtggactgcagtttctacacagcaagggcatcatttacagggacctcaaactggacaatgtgctgttggaccgggatggccacatcaagattgccgactttgggatgtgcaaagagaacatattcggggagagccgggccagcaccttctgcggcacccctgactatatcgcccctgagatcctacagggcctgaagtacacattctctgtggactggtggtctttcggggtccttctgtacgagatgctcattggccagtcccccttccatggtgatgatgaggatgaactcttcgagtccatccgtgtggacacgccacattatccccgctggatcaccaaggagtccaaggacatcctggagaagctctttgaaagggaaccaaccaagaggctgggagtgacgggaaacatcaaaatccaccccttcttcaagaccataaactggactctgctggaaaagcggaggttggagccacccttcaggcccaaagtgaagtcacccagagactacagtaactttgaccaggagttcctgaacgagaaggcgcgcctctcctacagcgacaagaacctcatcgactccatggaccagtctgcattcgctggcttctcctttgtgaaccccaaattcgagcacctcctggaagattgaggttcctggacagatcaggctagccctgccctccacccacacctgcccgctccccacgataagcaccagtgggactgtggtgacttctgctgctggccccgcccctgcccccagagcgtccttggctgccgtctggccgggctctcatggtacttcctctgtgaactgtgtgtgaatctgcttttcctctgccttcggagggaaattgtaaatcctgtgtttcattacttgaatgtagttatctattgaaaatatatattatatacatagacatatatatatatataataggctgtatatattgctcagtagagaaaaaccatgggggactggtgatatgttgatctttttcaaaaaaatatatatatgaca

SEQ ID NO: 35442 - DNA, 2155 bp, Homo sapiens
ccagccggcccgtaagatcgcagacgtaagcccggcaagccaaggcgcgccgcatcgccccgcgccccgcgtcgggtccatccggcccatcgtgcgctgcccacggtgggccggatgggaccgagtggattgcaaacagtctatgcgcagtgaggacgaggccaagttcccaacgatgaaccgccgcggagccatcaaacaggccaaaatccactacatcaagaaccatgagtttatcgccaccttctttgggcaacccaccttctgttctgtgtgcaaagactttgtctggggcctcaacaagcaaggctacaaatgcaggcaatgtaacgctgccatccacaagaaatgcatcgacaagatcatcggcagatgcactggcaccgcggccaacagccgggacactatattccagaaagaacgcttcaacatcgacatgccgcaccgcttcaaggttcacaactacatgagccccaccttctgtgaccactgcggcagcctgctctggggactggtgaagcagggattaaagtgtgaagactgcggcatgaatgtgcaccataaatgccgggagaaggtggccaacctctgcggcatcaaccagaagcttttggctgaggccttgaaccaagtcacccagagagcctcccggagatcagactcagcctcctcagagcctgttgggatatatcagggtttcgagaagaagaccggagttgctggggaggacatgcaagacaacagtgggacctacggcaagatctgggagggcagcagcaagtgcaacatcaacaacttcatcttccacaaggtcctgggcaaaggcagcttcgggaaggtgctgcttggagagctgaagggcagaggagagtactttgccatcaaggccctcaagaaggatgtggtcctgatcgacgacgacgtggagtgcaccatggttgagaagcgggtgctgacacttgccgcagagaatccctttctcacccacctcatctgcaccttccagaccaaggaccacctgttctttgtgatggagttcctcaacgggggggacctgatgtaccacatccaggacaaaggccgctttgaactctaccgtgccacgttttatgccgctgagataatgtgtggactgcagtttctacacagcaagggcatcatttacagggacctcaaactggacaatgtgctgttggaccgggatggccacatcaagattgccgactttgggatgtgcaaagagaacatattcggggagagccgggccagcaccttctgcggcacccctgactatatcgcccctgagatcctacagggcctgaagtacacattctctgtggactggtggtctttcggggtccttctgtacgagatgctcattggccagtcccccttccatggtgatgatgaggatgaactcttcgagtccatccgtgtggacacgccacattatccccgctggatcaccaaggagtccaaggacatcctggagaagctctttgaaagggaaccaaccaagaggctgggagtgacgggaaacatcaaaatccaccccttcttcaagaccataaactggactctgctggaaaagcggaggttggagccacccttcaggcccaaagtgaagtcacccagagactacagtaactttgaccaggagttcctgaacgagaaggcgcgcctctcctacagcgacaagaacctcatcgactccatggaccagtctgcattcgctggcttctcctttgtgaaccccaaattcgagcacctcctggaagattgaggttcctggacagatcaggctagccctgccctccacccacacctgcccgctccccacgataagcaccagtgggactgtggtgacttctgctgctggccccgcccctgcccccagagcgtccttggctgccgtctggccgggctctcatggtacttcctctgtgaactgtgtgtgaatctgcttttcctctgccttcggagggaaattgtaaatcctgtgtttcattacttgaatgtagttatctattgaaaatatatattatatacatagacatatatatatatataataggctgtatatattgctcagtagagaaaaaccatgggggactggtgatatgttgatctttttcaaaaaaatatatatatgaca

SEQ ID NO: 35443 - DNA, 1977 bp, Homo sapiens
ttcatatatatatttttttgaaaaagatcaacatatcaccagtcccccatggtttttctctactgagcaatatatacagcctattatatatatatatatgtctatgtatataatatatattttcaatagataactacattcaagtaatgaaacacaggatttacaatttccctccgaaggcagaggaaaagcagatgcactggcaccgcggccaacagccgggacactatattccagaaagaacgcttcaacatcgacatgccgcaccgcttcaaggttcacaactacatgagccccaccttctgtgaccactgcggcagcctgctctggggactggtgaagcagggattaaagtgtgaagactgcggcatgaatgtgcaccataaatgccgggagaaggtggccaacctctgcggcatcaaccagaagcttttggctgaggccttgaaccaagtcacccagagagcctcccggagatcagactcagcctcctcagagcctgttgggatatatcagggtttcgagaagaagaccggagttgctggggaggacatgcaagacaacagtgggacctacggcaagatctgggagggcagcagcaagtgcaacatcaacaacttcatcttccacaaggtcctgggcaaaggcagcttcgggaaggtgctgcttggagagctgaagggcagaggagagtactttgccatcaaggccctcaagaaggatgtggtcctgatcgacgacgacgtggagtgcaccatggttgagaagcgggtgctgacacttgccgcagagaatccctttctcacccacctcatctgcaccttccagaccaaggaccacctgttctttgtgatggagttcctcaacgggggggacctgatgtaccacatccaggacaaaggccgctttgaactctaccgtgccacgttttatgccgctgagataatgtgtggactgcagtttctacacagcaagggcatcatttacagggacctcaaactggacaatgtgctgttggaccgggatggccacatcaagattgccgactttgggatgtgcaaagagaacatattcggggagagccgggccagcaccttctgcggcacccctgactatatcgcccctgagatcctacagggcctgaagtacacattctctgtggactggtggtctttcggggtccttctgtacgagatgctcattggccagtcccccttccatggtgatgatgaggatgaactcttcgagtccatccgtgtggacacgccacattatccccgctggatcaccaaggagtccaaggacatcctggagaagctctttgaaagggaaccaaccaagaggctgggagtgacgggaaacatcaaaatccaccccttcttcaagaccataaactggactctgctggaaaagcggaggttggagccacccttcaggcccaaagtgaagtcacccagagactacagtaactttgaccaggagttcctgaacgagaaggcgcgcctctcctacagcgacaagaacctcatcgactccatggaccagtctgcattcgctggcttctcctttgtgaaccccaaattcgagcacctcctggaagattgaggttcctggacagatcaggctagccctgccctccacccacacctgcccgctccccacgataagcaccagtgggactgtggtgacttctgctgctggccccgcccctgcccccagagcgtccttggctgccgtctggccgggctctcatggtacttcctctgtgaactgtgtgtgaatctgcttttcctctgccttcggagggaaattgtaaatcctgtgtttcattacttgaatgtagttatctattgaaaatatatattatatacatagacatatatatatatataataggctgtatatattgctcagtagagaaaaaccatgggggactggtgatatgttgatctttttcaaaaaaatatatatatgaca

SEQ ID NO: 35444 - DNA, 1458 bp, Homo sapiens
gatttgaggctgcacgacgttcaccatggtcttgtgtgggaggatcctggcgtaacgggccagaacattggcattttccatgatggcgagggctgagggggtgtgttccccaatcttcagcagtgatcaagcttcggcaaggtgctgcttggagagctgaagggcagaggagagtactttgccatcaaggccctcaagaaggatgtggtcctgatcgacgacgacgtggagtgcaccatggttgagaagcgggtgctgacacttgccgcagagaatccctttctcacccacctcatctgcaccttccagaccaaggaccacctgttctttgtgatggagttcctcaacgggggggacctgatgtaccacatccaggacaaaggccgctttgaactctaccgtgccacgttttatgccgctgagataatgtgtggactgcagtttctacacagcaagggcatcatttacagggacctcaaactggacaatgtgctgttggaccgggatggccacatcaagattgccgactttgggatgtgcaaagagaacatattcggggagagccgggccagcaccttctgcggcacccctgactatatcgcccctgagatcctacagggcctgaagtacacattctctgtggactggtggtctttcggggtccttctgtacgagatgctcattggccagtcccccttccatggtgatgatgaggatgaactcttcgagtccatccgtgtggacacgccacattatccccgctggatcaccaaggagtccaaggacatcctggagaagctctttgaaagggaaccaaccaagaggctgggagtgacgggaaacatcaaaatccaccccttcttcaagaccataaactggactctgctggaaaagcggaggttggagccacccttcaggcccaaagtgaagtcacccagagactacagtaactttgaccaggagttcctgaacgagaaggcgcgcctctcctacagcgacaagaacctcatcgactccatggaccagtctgcattcgctggcttctcctttgtgaaccccaaattcgagcacctcctggaagattgaggttcctggacagatcaggctagccctgccctccacccacacctgcccgctccccacgataagcaccagtgggactgtggtgacttctgctgctggccccgcccctgcccccagagcgtccttggctgccgtctggccgggctctcatggtacttcctctgtgaactgtgtgtgaatctgcttttcctctgccttcggagggaaattgtaaatcctgtgtttcattacttgaatgtagttatctattgaaaatatatattatatacatagacatatatatatatataataggctgtatatattgctcagtagagaaaaaccatgggggactggtgatatgttgatctttttcaaaaaaatatatatatgaca

SEQ ID NO: 35445 - DNA, 2494 bp, Homo sapiens
tgccgcggcgccggagcccgaggcggctgtagcccacatctcccgagcgacccccggcgcccgcccgccgcgcggaggcccgggccacacctcactggccgcttggcccatcccagtcagcgccgcgccgaaccccgtccgcgcgcgccggggagcggcgcccccgccgctgccgccgcgacccttggcgcctgcccctgcaacgggagccccactgcaggccccaccatggcgccgttcctgcgcatcgccttcaactcctatgagctgggctccctgcaggccgaggacgaggcgaaccagcccttctgtgccgtgaagatgaaggaggcgctcagcacagagcgtgggaaaacactggtgcagaagaagccgaccatgtatcctgagtggaagtcgacgttcgatgcccacatctatgaggggcgcgtcatccagattgtgctaatgcgggcagcagaggagccagtgtctgaggtgaccgtgggtgtgtcggtgctggccgagcgctgcaagaagaacaatggcaaggctgagttctggctggacctgcagcctcaggccaaggtgttgatgtctgttcagtatttcctggaggacgtggattgcaaacagtctatgcgcagtgaggacgaggccaagttcccaacgatgaaccgccgcggagccatcaaacaggccaaaatccactacatcaagaaccatgagtttatcgccaccttctttgggcaacccaccttctgttctgtgtgcaaagactttgtctggggcctcaacaagcaaggctacaaatgcaggcaatgtaacgctgccatccacaagaaatgcatcgacaagatcatcggcagatgcactggcaccgcggccaacagccgggacactatattccagaaagaacgcttcaacatcgacatgccgcaccgcttcaaggttcacaactacatgagccccaccttctgtgaccactgcggcagcctgctctggggactggtgaagcagggattaaagtgtgaagactgcggcatgaatgtgcaccataaatgccgggagaaggtggccaacctctgcggcatcaaccagaagcttttggctgaggccttgaaccaagtcacccagagagcctcccggagatcagactcagcctcctcagagcctgttgggatatatcagggtttcgagaagaagaccggagttgctggggaggacatgcaagacaacagtgggacctacggcaagatctgggagggcagcagcaagtgcaacatcaacaacttcatcttccacaaggtcctgggcaaaggcagcttcgggaaggtgctgcttggagagctgaagggcagaggagagtactttgccatcaaggccctcaagaaggatgtggtcctgatcgacgacgacgtggagtgcaccatggttgagaagcgggtgctgacacttgccgcagagaatccctttctcacccacctcatctgcaccttccagaccaaggaccacctgttctttgtgatggagttcctcaacgggggggacctgatgtaccacatccaggacaaaggccgctttgaactctaccgtgccacgttttatgccgctgagataatgtgtggactgcagtttctacacagcaagggcatcatttacagggacctcaaactggacaatgtgctgttggaccgggatggccacatcaagattgccgactttgggatgtgcaaagagaacatattcggggagagccgggccagcaccttctgcggcacccctgactatatcgcccctgagatcctacagggcctgaagtacacattctctgtggactggtggtctttcggggtccttctgtacgagatgctcattggccagtcccccttccatggtgatgatgaggatgaactcttcgagtccatccgtgtggacacgccacattatccccgctggatcaccaaggagtccaaggacatcctggagaagctctttgaaagggaaccaaccaagaggctgggagtgacgggaaacatcaaaatccaccccttcttcaagaccataaactggactctgctggaaaagcggaggttggagccacccttcaggcccaaagtgaagtcacccagagactacagtaactttgaccaggagttcctgaacgagaaggcgcgcctctcctacagcgacaagaacctcatcgactccatggaccagtctgcattcgctgggctggccccgcccctgcccccagagcgtccttggctgccgtctggccgggctctcatggtacttcctctgtgaactgtgtgtgaatctgcttttcctctgccttcggagggaaattgtaaatcctgtgtttcattacttgaatgtagttatctattgaaaatatatattatatacatagacatatatatatatataataggctgtatatattgctcagtagagaaaaaccatgggggactggtgatatgttgatctttttcaaaaaaatatatatatgaca

SEQ ID NO: 35446 - DNA, 810 bp, Homo sapiens
ttcatatatatatttttttgaaaaagatcaacatatcaccagtcccccttccatggtgatgatgaggatgaactcttcgagtccatccgtgtggacacgccacattatccccgctggatcaccaaggagtccaaggacatcctggagaagctctttgaaagggaaccaaccaagaggctgggagtgacgggaaacatcaaaatccaccccttcttcaagaccataaactggactctgctggaaaagcggaggttggagccacccttcaggcccaaagtgaagtcacccagagactacagtaactttgaccaggagttcctgaacgagaaggcgcgcctctcctacagcgacaagaacctcatcgactccatggaccagtctgcattcgctggcttctcctttgtgaaccccaaattcgagcacctcctggaagattgaggttcctggacagatcaggctagccctgccctccacccacacctgcccgctccccacgataagcaccagtgggactgtggtgacttctgctgctggccccgcccctgcccccagagcgtccttggctgccgtctggccgggctctcatggtacttcctctgtgaactgtgtgtgaatctgcttttcctctgccttcggagggaaattgtaaatcctgtgtttcattacttgaatgtagttatctattgaaaatatatattatatacatagacatatatatatatataataggctgtatatattgctcagtagagaaaaaccatgggggactggtgatatgttgatctttttcaaaaaaatatatatatgaca

SEQ ID NO: 35447 - DNA, 2088 bp, Homo sapiens
tgccgcggcgccggagcccgaggcggctgtagcccacatctcccgagcgacccccggcgcccgcccgccgcgcggaggcccgggccacacctcactggccgcttggcccatcccagtcagcgccgcgccgaaccccgtccgcgcgcgccggggagcggcgcccccgccgctgccgccgcgacccttggcgcctgcccctgcaacgggagccccactgcaggccccaccatggcgccgttcctgcgcatcgccttcaactcctatgagctgggctccctgcaggccgaggacgaggcgaaccagcccttctgtgccgtgaagatgaaggaggcgctcagcacagagcgtgggaaaacactggtgcagaagaagccgaccatgtatcctgagtggaagtcgacgttcgatgcccacatctatgaggggcgcgtcatccagattgtgctaatgcgggcagcagaggagccagtgtctgaggtgaccgtgggtgtgtcggtgctggccgagcgctgcaagaagaacaatggcaaggctgagttctggctggacctgcagcctcaggccaaggtgttgatgtctgttcagtatttcctggaggacgtggattgcaaacagtctatgcgcagtgaggacgaggccaagttcccaacgatgaaccgccgcggagccatcaaacaggccaaaatccactacatcaagaaccatgagtttatcgccaccttctttgggcaacccaccttctgttctgtgtgcaaagactttgtctggggcctcaacaagcaaggctacaaatgcaggcaatgtaacgctgccatccacaagaaatgcatcgacaagatcatcggcagatgcactggcaccgcggccaacagccgggacactatattccagaaagaacgcttcaacatcgacatgccgcaccgcttcaaggttcacaactacatgagccccaccttctgtgaccactgcggcagcctgctctggggactggtgaagcagggattaaagtgtgaagactgcggcatgaatgtgcaccataaatgccgggagaaggtggccaacctctgcggcatcaaccagaagcttttggctgaggccttgaaccaagtcacccagagagcctcccggagatcagactcagcctcctcagagcctgttgggatatatcagggtttcgagaagaagaccggagttgctggggaggacatgcaagacaacagtgggacctacggcaagatctgggagggcagcagcaagtgcaacatcaacaacttcatcttccacaaggtcctgggcaaaggcagcttcgggaaggtgctgcttggagagctgaagggcagaggagagtactttgccatcaaggccctcaagaaggatgtggtcctgatcgacgacgacgtggagtgcaccatggttgagaagcgggtgctgacacttgccgcagagaatccctttctcacccacctcatctgcaccttccagaccaaggaccacctgttctttgtgatggagttcctcaacgggggggacctgatgtaccacatccaggacaaaggccgctttgaactctaccgtgccacgttttatgccgctgagataatgtgtggactgcagtttctacacagcaagggcatcatttacagggacctcaaactggacaatgtgctgttggaccgggatggccacatcaagattgccgactttgggatgtgcaaagagaacatattcggggagagccgggccagcaccttctgcggcacccctgactatatcgcccctgagatcctacagggcctgaagtacacattctctgtggactggtggtctttcggggtccttctgtacgagatgctcattggctcatggtacttcctctgtgaactgtgtgtgaatctgcttttcctctgccttcggagggaaattgtaaatcctgtgtttcattacttgaatgtagttatctattgaaaatatatattatatacatagacatatatatatatataataggctgtatatattgctcagtagagaaaaaccatgggggactggtgatatgttgatctttttcaaaaaaatatatatatgaca

SEQ ID NO: 35448 - DNA, 1695 bp, Homo sapiens
tgccgcggcgccggagcccgaggcggctgtagcccacatctcccgagcgacccccggcgcccgcccgccgcgcggaggcccgggccacacctcactggccgcttggcccatcccagtcagcgccgcgccgaaccccgtccgcgcgcgccggggagcggcgcccccgccgctgccgccgcgacccttggcgcctgcccctgcaacgggagccccactgcaggccccaccatggcgccgttcctgcgcatcgccttcaactcctatgagctgggctccctgcaggccgaggacgaggcgaaccagcccttctgtgccgtgaagatgaaggaggcgctcagcacagagcgtgggaaaacactggtgcagaagaagccgaccatgtatcctgagtggaagtcgacgttcgatgcccacatctatgaggggcgcgtcatccagattgtgctaatgcgggcagcagaggagccagtgtctgaggtgaccgtgggtgtgtcggtgctggccgagcgctgcaagaagaacaatggcaaggctgagttctggctggacctgcagcctcaggccaaggtgttgatgtctgttcagtatttcctggaggacgtggattgcaaacagtctatgcgcagtgaggacgaggccaagttcccaacgatgaaccgccgcggagccatcaaacaggccaaaatccactacatcaagaaccatgagtttatcgccaccttctttgggcaacccaccttctgttctgtgtgcaaagactttgtctggggcctcaacaagcaaggctacaaatgcaggcaatgtaacgctgccatccacaagaaatgcatcgacaagatcatcggcagatgcactggcaccgcggccaacagccgggacactatattccagaaagaacgcttcaacatcgacatgccgcaccgcttcaaggttcacaactacatgagccccaccttctgtgaccactgcggcagcctgctctggggactggtgaagcagggattaaagtgtgaagactgcggcatgaatgtgcaccataaatgccgggagaaggtggccaacctctgcggcatcaaccagaagcttttggctgaggccttgaaccaagtcacccagagagcctcccggagatcagactcagcctcctcagagcctgttgggatatatcagggtttcgagaagaagaccggagttgctggggaggacatgcaagacaacagtgggacctacggcaagatctgggagggcagcagcaagtgcaacatcaacaacttcatcttccacaaggtcctgggcaaaggcagcttcgggaaggtgctgcttggagagctgaagggcagaggagagtactttgccatcaaggccctcaagaaggatgtggtcctgatcgacgacgacgtggagtgcaccatggttgagaagcgggtgctgacacttgccgcagagaatccctttctcacccacctcatctgcaccttccagaccaaggaccacctgttctttgtgatggagttcctcaacgggggggacctgatgtaccacatccaggacaaaggccgctttgaactctaccgtgccacgtacgtaagggccatggtggggaagggcccagtgtggaggaagggctactggctcagagcccacttccagtctgccctccatgccttcttccctctccctagaaaagccagcctg

SEQ ID NO: 35449 - DNA, 1301 bp, Homo sapiens
tgccgcggcgccggagcccgaggcggctgtagcccacatctcccgagcgacccccggcgcccgcccgccgcgcggaggcccgggccacacctcactggccgcttggcccatcccagtcagcgccgcgccgaaccccgtccgcgcgcgccggggagcggcgcccccgccgctgccgccgcgacccttggcgcctgcccctgcaacgggagccccactgcaggccccaccatggcgccgttcctgcgcatcgccttcaactcctatgagctgggctccctgcaggccgaggacgaggcgaaccagcccttctgtgccgtgaagatgaaggaggcgctcagcacagagcgtgggaaaacactggtgcagaagaagccgaccatgtatcctgagtggaagtcgacgttcgatgcccacatctatgaggggcgcgtcatccagattgtgctaatgcgggcagcagaggagccagtgtctgaggtgaccgtgggtgtgtcggtgctggccgagcgctgcaagaagaacaatggcaaggctgagttctggctggacctgcagcctcaggccaaggtgttgatgtctgttcagtatttcctggaggacgtggattgcaaacagtctatgcgcagtgaggacgaggccaagttcccaacgatgaaccgccgcggagccatcaaacaggccaaaatccactacatcaagaaccatgagtttatcgccaccttctttgggcaacccaccttctgttctgtgtgcaaagactttgtctggggcctcaacaagcaaggctacaaatgcaggcaatgtaacgctgccatccacaagaaatgcatcgacaagatcatcggcagatgcactggcaccgcggccaacagccgggacactatattccagaaagaacgcttcaacatcgacatgccgcaccgcttcaaggttcacaactacatgagccccaccttctgtgaccactgcggctgcccgctccccacgataagcaccagtgggactgtggtgacttctgctgctggccccgcccctgcccccagagcgtccttggctgccgtctggccgggctctcatggtacttcctctgtgaactgtgtgtgaatctgcttttcctctgccttcggagggaaattgtaaatcctgtgtttcattacttgaatgtagttatctattgaaaatatatattatatacatagacatatatatatatataataggctgtatatattgctcagtagagaaaaaccatgggggactggtgatatgttgatctttttcaaaaaaatatatatatgaca

SEQ ID NO: 35450 - DNA, 490 bp, Homo sapiens
gggtggagggcagggctagcctgatctgtccaagaacctcatcgactccatggaccagtctgcattcgctggcttctcctttgtgaaccccaaattcgagcacctcctggaagattgaggttcctggacagatcaggctagccctgccctccacccacacctgcccgctccccacgataagcaccagtgggactgtggtgacttctgctgctggccccgcccctgcccccagagcgtccttggctgccgtctggccgggctctcatggtacttcctctgtgaactgtgtgtgaatctgcttttcctctgccttcggagggaaattgtaaatcctgtgtttcattacttgaatgtagttatctattgaaaatatatattatatacatagacatatatatatatataataggctgtatatattgctcagtagagaaaaaccatgggggactggtgatatgttgatctttttcaaaaaaatatatatatgaca

SEQ ID NO: 35451 - DNA, 584 bp, Homo sapiens
cgtacgtggatgaagcttgcataagtgtgatgactgcggcatgaatgtgcaccataaatgccgggagaaggtggccaacctctgcggcatcaaccagaagcttttggctgaggccttgaaccaagtcacccagagagcctcccggagatcagactcagcctcctcagagcctgttgggatatatcagggtttcgagaagaagaccggagttgctggggaggacatgcaaggctagccctgccctccacccacacctgcccgctccccacgataagcaccagtgggactgtggtgacttctgctgctggccccgcccctgcccccagagcgtccttggctgccgtctggccgggctctcatggtacttcctctgtgaactgtgtgtgaatctgcttttcctctgccttcggagggaaattgtaaatcctgtgtttcattacttgaatgtagttatctattgaaaatatatattatatacatagacatatatatatatataataggctgtatatattgctcagtagagaaaaaccatgggggactggtgatatgttgatctttttcaaaaaaatatatatatgaca

SEQ ID NO: 35452 - DNA, 879 bp, Homo sapiens
tgccgcggcgccggagcccgaggcggctgtagcccacatctcccgagcgacccccggcgcccgcccgccgcgcggaggcccgggccacacctcactggccgcttggcccatcccagtcagcgccgcgccgaaccccgtccgcgcgcgccggggagcggcgcccccgccgctgccgccgcgacccttggcgcctgcccctgcaacgggaggctggagtgcagtggcaagatctcggctcactgcaacctctacctcccgggttcaagtgattcttctgcctcagcctcccagccccactgcaggccccaccatggcgccgttcctgcgcatcgccttcaactcctatgagctgggctccctgcaggccgaggacgaggcgaaccagcccttctgtgccgtgaagatgaaggaggcgctcagcacagagcgtgggaaaacactggtgcagaagaagccgaccatgtatcctgagtggaagtcgacgttcgatgcccacatctatgaggggcgcgtcatccagattgctggccccgcccctgcccccagagcgtccttggctgccgtctggccgggctctcatggtacttcctctgtgaactgtgtgtgaatctgcttttcctctgccttcggagggaaattgtaaatcctgtgtttcattacttgaatgtagttatctattgaaaatatatattatatacatagacatatatatatatataataggctgtatatattgctcagtagagaaaaaccatgggggactggtgatatgttgatctttttcaaaaaaatatatatatgacaaaaaaaaaaaaggagcacaagctgtttgaaccaccaggtttatttgtgtgtctaaataaacaccaaatagtacca

SEQ ID NO: 35453 - DNA, 322 bp, Homo sapiens
cgactctagagtatcccaaatctctcagcgtgggaaaacactggtgcagaagaagccgaccatgtatcctgagtggaagtcgacgttcgatgcccacatctatgaggggcgcgtcatccagattgtgctaatgcgggcagcagaggagccagtgtctgaggtgaccgtgggtgtgtcggtgctggccgagcgctgcaagaagaacaatggcaaggctgagttctggctggacctgcagcctcaggccaaggtgttgatgtctgttcagtatttcctggaggacgtggatttgcaaacagtctatgcgcaaatggggtacgga

SEQ ID NO: 35454 - DNA, 2631 bp, Homo sapiens
tgccgcggcgccggagcccgaggcggctgtagcccacatctcccgagcgacccccggcgcccgcccgccgcgcggaggcccgggccacacctcactggccgcttggcccatcccagtcagcgccgcgccgaaccccgtccgcgcgcgccggggagcggcgcccccgccgctgccgccgcgacccttggcgcctgcccctgcaacgggagccccactgcaggccccaccatggcgccgttcctgcgcatcgccttcaactcctatgagctgggctccctgcaggccgaggacgaggcgaaccagcccttctgtgccgtgaagatgaaggaggcgctcagcacagagcgtgggaaaacactggtgcagaagaagccgaccatgtatcctgagtggaagtcgacgttcgatgcccacatctatgaggggcgcgtcatccagattgtgctaatgcgggcagcagaggagccagtgtctgaggtgaccgtgggtgtgtcggtgctggccgagcgctgcaagaagaacaatggcaaggctgagttctggctggacctgcagcctcaggccaaggtgttgatgtctgttcagtatttcctggaggacgtggattgcaaacagtctatgcgcagtgaggacgaggccaagttcccaacgatgaaccgccgcggagccatcaaacaggccaaaatccactacatcaagaaccatgagtttatcgccaccttctttgggcaacccaccttctgttctgtgtgcaaagactttgtctggggcctcaacaagcaaggctacaaatgcaggcaatgtaacgctgccatccacaagaaatgcatcgacaagatcatcggcagatgcactggcaccgcggccaacagccgggacactatattccagaaagaacgcttcaacatcgacatgccgcaccgcttcaaggttcacaactacatgagccccaccttctgtgaccactgcggcagcctgctctggggactggtgaagcagggattaaagtgtgaagactgcggcatgaatgtgcaccataaatgccgggagaaggtggccaacctctgcggcatcaaccagaagcttttggctgaggccttgaaccaagtcacccagagagcctcccggagatcagactcagcctcctcagagcctgttgggatatatcagggtttcgagaagaagaccggagttgctggggaggacatgcaagacaacagtgggacctacggcaagatctgggagggcagcagcaagtgcaacatcaacaacttcatcttccacaaggtcctgggcaaaggcagcttcgggaaggtgctgcttggagagctgaagggcagaggagagtactttgccatcaaggccctcaagaaggatgtggtcctgatcgacgacgacgtggagtgcaccatggttgagaagcgggtgctgacacttgccgcagagaatccctttctcacccacctcatctgcaccttccagaccaaggaccacctgttctttgtgatggagttcctcaacgggggggacctgatgtaccacatccaggacaaaggccgctttgaactctaccgtgccacgttttatgccgctgagataatgtgtggactgcagtttctacacagcaagggcatcatttacagggacctcaaactggacaatgtgctgttggaccgggatggccacatcaagattgccgactttgggatgtgcaaagagaacatattcggggagagccgggccagcaccttctgcggcacccctgactatatcgcccctgagatcctacagggcctgaagtacacattctctgtggactggtggtctttcggggtccttctgtacgagatgctcattggccagtcccccttccatggtgatgatgaggatgaactcttcgagtccatccgtgtggacacgccacattatccccgctggatcaccaaggagtccaaggacatcctggagaagctctttgaaagggaaccaaccaagaggctgggagtgacgggaaacatcaaaatccaccccttcttcaagaccataaactggactctgctggaaaagcggaggttggagccacccttcaggcccaaagtgaagtcacccagagactacagtaactttgaccaggagttcctgaacgagaaggcgcgcctctcctacagcgacaagaacctcatcgactccatggaccagtctgcattcgctggcttctcctttgtgaaccccaaattcgagcacctcctggaagattgaggttcctggacagatcaggctagccctgccctccacccacacctgcccgctccccacgataagcaccagtgggactgtggtgacttctgctgctggccccgcccctgcccccagagcgtccttggctgccgtctggccgggctctcatggtacttcctctgtgaactgtgtgtgaatctgcttttcctctgccttcggagggaaattgtaaatcctgtgtttcattacttgaatgtagttatctattgaaaatatatattatatacatagacatatatatatatataataggctgtatatattgctcagtagagaaaaaccatgggggactggtgatatgttgatctttttcaaaaaaatatatatatgaca

SEQ ID NO: 35455 - DNA, 2534 bp, Homo sapiens
tgccgcggcgccggagcccgaggcggctgtagcccacatctcccgagcgacccccggcgcccgcccgccgcgcggaggcccgggccacacctcactggccgcttggcccatcccagtcagcgccgcgccgaaccccgtccgcgcgcgccggggagcggcgcccccgccgctgccgccgcgacccttggcgcctgcccctgcaacgggagccccactgcaggccccaccatggcgccgttcctgcgcatcgccttcaactcctatgagctgggctccctgcaggccgaggacgaggcgaaccagcccttctgtgccgtgaagatgaaggaggcgctcagcacagagcgtgggaaaacactggtgcagaagaagccgaccatgtatcctgagtggaagtcgacgttcgatgcccacatctatgaggggcgcgtcatccagattgtgctaatgcgggcagcagaggagccagtgtctgaggtgaccgtgggtgtgtcggtgctggccgagcgctgcaagaagaacaatggcaaggctgagttctggctggacctgcagcctcaggccaaggtgttgatgtctgttcagtatttcctggaggacgtggattgcaaacagtctatgcgcagtgaggacgaggccaagttcccaacgatgaaccgccgcggagccatcaaacaggccaaaatccactacatcaagaaccatgagtttatcgccaccttctttgggcaacccaccttctgttctgtgtgcaaagactttgtctggggcctcaacaagcaaggctacaaatgcaggcaatgtaacgctgccatccacaagaaatgcatcgacaagatcatcggcagatgcactggcaccgcggccaacagccgggacactatattccagaaagaacgcttcaacatcgacatgccgcaccgcttcaaggttcacaactacatgagccccaccttctgtgaccactgcggcagcctgctctggggactggtgaagcagggattaaagtgtgaagactgcggcatgaatgtgcaccataaatgccgggagaaggtggccaacctctgcggcatcaaccagaagcttttggctgaggccttgaaccaagtcacccagagagcctcccggagatcagactcagcctcctcagagcctgttgggatatatcagggtttcgagaagaagaccggagttgctggggaggacatgcaagacaacagtgggacctacggcaagatctgggagggcagcagcaagtgcaacatcaacaacttcatcttccacaaggtcctgggcaaaggcagcttcgggaaggtgctgcttggagagctgaagggcagaggagagtactttgccatcaaggccctcaagaaggatgtggtcctgatcgacgacgacgtggagtgcaccatggttgagaagcgggtgctgacacttgccgcagagaatccctttctcacccacctcatctgcaccttccagaccaaggaccacctgttctttgtgatggagttcctcaacgggggggacctgatgtaccacatccaggacaaaggccgctttgaactctaccgtgccacgttttatgccgctgagataatgtgtggactgcagtttctacacagcaagggcatcatttacagggacctcaaactggacaatgtgctgttggaccgggatggccacatcaagattgccgactttgggatgtgcaaagagaacatattcggggagagccgggccagcaccttctgcggcacccctgactatatcgcccctgagatcctacagggcctgaagtacacattctctgtggactggtggtctttcggggtccttctgtacgagatgctcattggccagtcccccttccatggtgatgatgaggatgaactcttcgagtccatccgtgtggacacgccacattatccccgctggatcaccaaggagtccaaggacatcctggagaagctctttgaaagggaaccaaccaagaggctgggagtgacgggaaacatcaaaatccaccccttcttcaagaccataaactggactctgctggaaaagcggaggttggagccacccttcaggcccaaagtgaagtcacccagagactacagtaactttgaccaggagttcctgaacgagaaggcgcgcctctcctacagcgacaagaacctcatcgactccatggaccagtctgcattcgctggcttctcctttgtgaaccccaaattcgagcacctcctggaagattgaggttcctggacagatcaggctagccctgccctccacccacacctgcccgctccccacgataagcaccagtgggactgtggtgacttctgctgctggccccgcccctgcccccagagcgtccttggctgccgtctggccgggctctcatggtacttcctctgtgaactgtgtgtgaatctgcttttcctctgccttcggagggaaattgtaaatcctgtgtttcattacttgaatgtagttatctattgaaaatatatattatatacatagacata

SEQ ID NO: 35456 - DNA, 2743 bp, Homo sapiens
tgccgcggcgccggagcccgaggcggctgtagcccacatctcccgagcgacccccggcgcccgcccgccgcgcggaggcccgggccacacctcactggccgcttggcccatcccagtcagcgccgcgccgaaccccgtccgcgcgcgccggggagcggcgcccccgccgctgccgccgcgacccttggcgcctgcccctgcaacgggaggtctgcagggaactggccaggcaagggggcaggcccgtttctcctggtggttggtgcgttgtagcagcagcgggagccaggactaaggacaagcaggagctgggagccccagccccactgcaggccccaccatggcgccgttcctgcgcatcgccttcaactcctatgagctgggctccctgcaggccgaggacgaggcgaaccagcccttctgtgccgtgaagatgaaggaggcgctcagcacagagcgtgggaaaacactggtgcagaagaagccgaccatgtatcctgagtggaagtcgacgttcgatgcccacatctatgaggggcgcgtcatccagattgtgctaatgcgggcagcagaggagccagtgtctgaggtgaccgtgggtgtgtcggtgctggccgagcgctgcaagaagaacaatggcaaggctgagttctggctggacctgcagcctcaggccaaggtgttgatgtctgttcagtatttcctggaggacgtggattgcaaacagtctatgcgcagtgaggacgaggccaagttcccaacgatgaaccgccgcggagccatcaaacaggccaaaatccactacatcaagaaccatgagtttatcgccaccttctttgggcaacccaccttctgttctgtgtgcaaagactttgtctggggcctcaacaagcaaggctacaaatgcaggcaatgtaacgctgccatccacaagaaatgcatcgacaagatcatcggcagatgcactggcaccgcggccaacagccgggacactatattccagaaagaacgcttcaacatcgacatgccgcaccgcttcaaggttcacaactacatgagccccaccttctgtgaccactgcggcagcctgctctggggactggtgaagcagggattaaagtgtgaagactgcggcatgaatgtgcaccataaatgccgggagaaggtggccaacctctgcggcatcaaccagaagcttttggctgaggccttgaaccaagtcacccagagagcctcccggagatcagactcagcctcctcagagcctgttgggatatatcagggtttcgagaagaagaccggagttgctggggaggacatgcaagacaacagtgggacctacggcaagatctgggagggcagcagcaagtgcaacatcaacaacttcatcttccacaaggtcctgggcaaaggcagcttcgggaaggtgctgcttggagagctgaagggcagaggagagtactttgccatcaaggccctcaagaaggatgtggtcctgatcgacgacgacgtggagtgcaccatggttgagaagcgggtgctgacacttgccgcagagaatccctttctcacccacctcatctgcaccttccagaccaaggaccacctgttctttgtgatggagttcctcaacgggggggacctgatgtaccacatccaggacaaaggccgctttgaactctaccgtgccacgttttatgccgctgagataatgtgtggactgcagtttctacacagcaagggcatcatttacagggacctcaaactggacaatgtgctgttggaccgggatggccacatcaagattgccgactttgggatgtgcaaagagaacatattcggggagagccgggccagcaccttctgcggcacccctgactatatcgcccctgagatcctacagggcctgaagtacacattctctgtggactggtggtctttcggggtccttctgtacgagatgctcattggccagtcccccttccatggtgatgatgaggatgaactcttcgagtccatccgtgtggacacgccacattatccccgctggatcaccaaggagtccaaggacatcctggagaagctctttgaaagggaaccaaccaagaggctgggagtgacgggaaacatcaaaatccaccccttcttcaagaccataaactggactctgctggaaaagcggaggttggagccacccttcaggcccaaagtgaagtcacccagagactacagtaactttgaccaggagttcctgaacgagaaggcgcgcctctcctacagcgacaagaacctcatcgactccatggaccagtctgcattcgctggcttctcctttgtgaaccccaaattcgagcacctcctggaagattgaggttcctggacagatcaggctagccctgccctccacccacacctgcccgctccccacgataagcaccagtgggactgtggtgacttctgctgctggccccgcccctgcccccagagcgtccttggctgccgtctggccgggctctcatggtacttcctctgtgaactgtgtgtgaatctgcttttcctctgccttcggagggaaattgtaaatcctgtgtttcattacttgaatgtagttatctattgaaaatatatattatatacatagacatatatatatatataataggctgtatatattgctcagtagagaaaaaccatgggggactggtgatatgttgatctttttcaaaaaaatatatatatgaca

SEQ ID NO: 35457 - DNA, 2341 bp, Homo sapiens
agagctcgccacctgtttttggattctgaagatgcaggacgcgctcagtacagagcgtgggaaaacactggtgcagaagaagccgaccatgtatcctgagtggaagtcgacgttcgatgcccacatctatgaggggcgcgtcatccagattgtgctaatgcgggcagcagaggagccagtgtctgaggtgaccgtgggtgtgtcggtgctggccgagcgctgcaagaagaacaatggcaaggctgagttctggctggacctgcagcctcaggccaaggtgttgatgtctgttcagtatttcctggaggacgtggattgcaaacagtctatgcgcagtgaggacgaggccaagttcccaacgatgaaccgccgcggagccatcaaacaggccaaaatccactacatcaagaaccatgagtttatcgccaccttctttgggcaacccaccttctgttctgtgtgcaaagactttgtctggggcctcaacaagcaaggctacaaatgcaggcaatgtaacgctgccatccacaagaaatgcatcgacaagatcatcggcagatgcactggcaccgcggccaacagccgggacactatattccagaaagaacgcttcaacatcgacatgccgcaccgcttcaaggttcacaactacatgagccccaccttctgtgaccactgcggcagcctgctctggggactggtgaagcagggattaaagtgtgaagactgcggcatgaatgtgcaccataaatgccgggagaaggtggccaacctctgcggcatcaaccagaagcttttggctgaggccttgaaccaagtcacccagagagcctcccggagatcagactcagcctcctcagagcctgttgggatatatcagggtttcgagaagaagaccggagttgctggggaggacatgcaagacaacagtgggacctacggcaagatctgggagggcagcagcaagtgcaacatcaacaacttcatcttccacaaggtcctgggcaaaggcagcttcgggaaggtgctgcttggagagctgaagggcagaggagagtactttgccatcaaggccctcaagaaggatgtggtcctgatcgacgacgacgtggagtgcaccatggttgagaagcgggtgctgacacttgccgcagagaatccctttctcacccacctcatctgcaccttccagaccaaggaccacctgttctttgtgatggagttcctcaacgggggggacctgatgtaccacatccaggacaaaggccgctttgaactctaccgtgccacgttttatgccgctgagataatgtgtggactgcagtttctacacagcaagggcatcatttacagggacctcaaactggacaatgtgctgttggaccgggatggccacatcaagattgccgactttgggatgtgcaaagagaacatattcggggagagccgggccagcaccttctgcggcacccctgactatatcgcccctgagatcctacagggcctgaagtacacattctctgtggactggtggtctttcggggtccttctgtacgagatgctcattggccagtcccccttccatggtgatgatgaggatgaactcttcgagtccatccgtgtggacacgccacattatccccgctggatcaccaaggagtccaaggacatcctggagaagctctttgaaagggaaccaaccaagaggctgggagtgacgggaaacatcaaaatccaccccttcttcaagaccataaactggactctgctggaaaagcggaggttggagccacccttcaggcccaaagtgaagtcacccagagactacagtaactttgaccaggagttcctgaacgagaaggcgcgcctctcctacagcgacaagaacctcatcgactccatggaccagtctgcattcgctggcttctcctttgtgaaccccaaattcgagcacctcctggaagattgaggttcctggacagatcaggctagccctgccctccacccacacctgcccgctccccacgataagcaccagtgggactgtggtgacttctgctgctggccccgcccctgcccccagagcgtccttggctgccgtctggccgggctctcatggtacttcctctgtgaactgtgtgtgaatctgcttttcctctgccttcggagggaaattgtaaatcctgtgtttcattacttgaatgtagttatctattgaaaatatatattatatacatagacatatatatatatataataggctgtatatattgctcagtagagaaaaaccatgggggactggtgatatgttgatctttttcaaaaaaatatatatatgaca

SEQ ID NO: 35458 - DNA, 1401 bp, Homo sapiens
aaggctagtgcgaggctggtgtgtgaatcggccgaggaacacttcatcttccacaaggtcctgggcaaaggcagcttcgggaaggtgctgcttggagagctgaagggcagaggagagtactttgccatcaaggccctcaagaaggatgtggtcctgatcgacgacgacgtggagtgcaccatggttgagaagcgggtgctgacacttgccgcagagaatccctttctcacccacctcatctgcaccttccagaccaaggaccacctgttctttgtgatggagttcctcaacgggggggacctgatgtaccacatccaggacaaaggccgctttgaactctaccgtgccacgttttatgccgctgagataatgtgtggactgcagtttctacacagcaagggcatcatttacagggacctcaaactggacaatgtgctgttggaccgggatggccacatcaagattgccgactttgggatgtgcaaagagaacatattcggggagagccgggccagcaccttctgcggcacccctgactatatcgcccctgagatcctacagggcctgaagtacacattctctgtggactggtggtctttcggggtccttctgtacgagatgctcattggccagtcccccttccatggtgatgatgaggatgaactcttcgagtccatccgtgtggacacgccacattatccccgctggatcaccaaggagtccaaggacatcctggagaagctctttgaaagggaaccaaccaagaggctgggagtgacgggaaacatcaaaatccaccccttcttcaagaccataaactggactctgctggaaaagcggaggttggagccacccttcaggcccaaagtgaagtcacccagagactacagtaactttgaccaggagttcctgaacgagaaggcgcgcctctcctacagcgacaagaacctcatcgactccatggaccagtctgcattcgctggcttctcctttgtgaaccccaaattcgagcacctcctggaagattgaggttcctggacagatcaggctagccctgccctccacccacacctgcccgctccccacgataagcaccagtgggactgtggtgacttctgctgctggccccgcccctgcccccagagcgtccttggctgccgtctggccgggctctcatggtacttcctctgtgaactgtgtgtgaatctgcttttcctctgccttcggagggaaattgtaaatcctgtgtttcattacttgaatgtagttatctattgaaaatatatattatatacatagacatatatatatatataataggctgtatatattgctcagtagagaaaaaccatgggggactggtgatatgttgatctttttcaaaaaaatatatatatgaca

SEQ ID NO: 35459 - DNA, 1305 bp, Homo sapiens
tcatcttcacagtcggtgatgaagggcagaggaactacagctcagaaggatgtggtcctgatcgacgacgacgtggagtgcaccatggttgagaagcgggtgctgacacttgccgcagagaatccctttctcacccacctcatctgcaccttccagaccaaggaccacctgttctttgtgatggagttcctcaacgggggggacctgatgtaccacatccaggacaaaggccgctttgaactctaccgtgccacgttttatgccgctgagataatgtgtggactgcagtttctacacagcaagggcatcatttacagggacctcaaactggacaatgtgctgttggaccgggatggccacatcaagattgccgactttgggatgtgcaaagagaacatattcggggagagccgggccagcaccttctgcggcacccctgactatatcgcccctgagatcctacagggcctgaagtacacattctctgtggactggtggtctttcggggtccttctgtacgagatgctcattggccagtcccccttccatggtgatgatgaggatgaactcttcgagtccatccgtgtggacacgccacattatccccgctggatcaccaaggagtccaaggacatcctggagaagctctttgaaagggaaccaaccaagaggctgggagtgacgggaaacatcaaaatccaccccttcttcaagaccataaactggactctgctggaaaagcggaggttggagccacccttcaggcccaaagtgaagtcacccagagactacagtaactttgaccaggagttcctgaacgagaaggcgcgcctctcctacagcgacaagaacctcatcgactccatggaccagtctgcattcgctggcttctcctttgtgaaccccaaattcgagcacctcctggaagattgaggttcctggacagatcaggctagccctgccctccacccacacctgcccgctccccacgataagcaccagtgggactgtggtgacttctgctgctggccccgcccctgcccccagagcgtccttggctgccgtctggccgggctctcatggtacttcctctgtgaactgtgtgtgaatctgcttttcctctgccttcggagggaaattgtaaatcctgtgtttcattacttgaatgtagttatctattgaaaatatatattatatacatagacatatatatatatataataggctgtatatattgctcagtagagaaaaaccatgggggactggtgatatgttgatctttttcaaaaaaatatatatatgaca

SEQ ID NO: 35460 - DNA, 1886 bp, Homo sapiens
tgccgcggcgccggagcccgaggcggctgtagcccacatctcccgagcgacccccggcgcccgcccgccgcgcggaggcccgggccacacctcactggccgcttggcccatcccagtcagcgccgcgccgaaccccgtccgcgcgcgccggggagcggcgcccccgccgctgccgccgcgacccttggcgcctgcccctgcaacgggagccccactgcaggccccaccatggcgccgttcctgcgcatcgccttcaactcctatgagctgggctccctgcaggccgaggacgaggcgaaccagcccttctgtgccgtgaagatgaaggaggcgctcagcacagagcgtgggaaaacactggtgcagaagaagccgaccatgtatcctgagtggaagtcgacgttcgatgcccacatctatgaggggcgcgtcatccagattgtgctaatgcgggcagcagaggagccagtgtctgaggtgaccgtgggtgtgtcggtgctggccgagcgctgcaagaagaacaatggcaaggctgagttctggctggacctgcagcctcaggccaaggtgttgatgtctgttcagtatttcctggaggacgtggattgcaaacagtctatgcgcagtgaggacgaggccaagttcccaacgatgaaccgccgcggagccatcaaacaggccaaaatccactacatcaagaaccatgagtttatcgccaccttctttgggcaacccaccttctgttctgtgtgcaaagactttgtctggggcctcaacaagcaaggctacaaatgcaggcaatgtaacgctgccatccacaagaaatgcatcgacaagatcatcggcagatgcactggcaccgcggccaacagccgggacactatattccagaaagaacgcttcaacatcgacatgccgcaccgcttcaaggttcacaactacatgagccccaccttctgtgaccactgcggcagcctgctctggggactggtgaagcagggattaaagtgtgaagactgcggcatgaatgtgcaccataaatgccgggagaaggtggccaacctctgcggcatcaaccagaagcttttggctgaggccttgaaccaagtcacccagagagcctcccggagatcagactcagcctcctcagagcctgttgggatatatcagggtttcgagaagaagaccggagttgctggggaggacatgcaagacaacagtgggacctacggcaagatctgggagggcagcagcaagtgcaacatcaacaaatcaaaatccaccccttcttcaagaccataaactggactctgctggaaaagcggaggttggagccacccttcaggcccaaagtgaagtcacccagagactacagtaactttgaccaggagttcctgaacgagaaggcgcgcctctcctacagcgacaagaacctcatcgactccatggaccagtctgcattcgctggcttctcctttgtgaaccccaaattcgagcacctcctggaagattgaggttcctggacagatcaggctagccctgccctccacccacacctgcccgctccccacgataagcaccagtgggactgtggtgacttctgctgctggccccgcccctgcccccagagcgtccttggctgccgtctggccgggctctcatggtacttcctctgtgaactgtgtgtgaatctgcttttcctctgccttcggagggaaattgtaaatcctgtgtttcattacttgaatgtagttatctattgaaaatatatattatatacatagacatatatatatatataataggctgtatatattgctcagtagagaaaaaccatgggggactggtgatatgttgatctttttcaaaaaaatatatatatgaca

SEQ ID NO: 35461 - DNA, 1791 bp, Homo sapiens
tgccgcggcgccggagcccgaggcggctgtagcccacatctcccgagcgacccccggcgcccgcccgccgcgcggaggcccgggccacacctcactggccgcttggcccatcccagtcagcgccgcgccgaaccccgtccgcgcgcgccggggagcggcgcccccgccgctgccgccgcgacccttggcgcctgcccctgcaacgggagccccactgcaggccccaccatggcgccgttcctgcgcatcgccttcaactcctatgagctgggctccctgcaggccgaggacgaggcgaaccagcccttctgtgccgtgaagatgaaggaggcgctcagcacagagcgtgggaaaacactggtgcagaagaagccgaccatgtatcctgagtggaagtcgacgttcgatgcccacatctatgaggggcgcgtcatccagattgtgctaatgcgggcagcagaggagccagtgtctgaggtgaccgtgggtgtgtcggtgctggccgagcgctgcaagaagaacaatggcaaggctgagttctggctggacctgcagcctcaggccaaggtgttgatgtctgttcagtatttcctggaggacgtggattgcaaacagtctatgcgcagtgaggacgaggccaagttcccaacgatgaaccgccgcggagccatcaaacaggccaaaatccactacatcaagaaccatgagtttatcgccaccttctttgggcaacccaccttctgttctgtgtgcaaagactttgtctggggcctcaacaagcaaggctacaaatgcaggcaatgtaacgctgccatccacaagaaatgcatcgacaagatcatcggcagatgcactggcaccgcggccaacagccgggacactatattccagaaagaacgcttcaacatcgacatgccgcaccgcttcaaggttcacaactacatgagccccaccttctgtgaccactgcggcagcctgctctggggactggtgaagcagggattaaagtgtgaagactgcggcatgaatgtgcaccataaatgccgggagaaggtggccaacctctgcggcatcaaccagaagcttttggctgaggccttgaaccaagtcacccagagagcctcccggagatcagactcagcctcctcagagcctgttgggatatatcagggtttcgagaagaagaccggagttgctggggaggacatgcaagacaacagtgggacctacggcaagatctgggagggcagcagcaagtgcaacatcaacaacttcatcttccacaaggtcctgggcaaaggcagcttcgggaaggtgctgcttggagagctgaagggcagaggagagtactttgccatcaaggccctcaagaaggatgtggtcctgatcgacgacgacgtggagtgcaccatggttgagaagcgggtgctgacacttgccgcagagaatccctttctcacccacctcatctgcaccttccagaccaaggaccacctgttctttgtgatggagttcctcaacgggggggacctgatgtaccacatccaggacaaaggccgctttgaactctaccgtgccacgttttatgccgctgagataatgtgtggactgcagtttctacacagcaagggcatcatttacagggacctcaaactggacaatgtgctgttggaccgggatggccacatcaagattgccgactttgggatgtgcaaagagaacatattcggggagagccgggccagcaccttctgcggcactgtttggactctgggcactgtttggactctg

SEQ ID NO: 35462 - DNA, 1565 bp, Homo sapiens
tgccgcggcgccggagcccgaggcggctgtagcccacatctcccgagcgacccccggcgcccgcccgccgcgcggaggcccgggccacacctcactggccgcttggcccatcccagtcagcgccgcgccgaaccccgtccgcgcgcgccggggagcggcgcccccgccgctgccgccgcgacccttggcgcctgcccctgcaacgggagccccactgcaggccccaccatggcgccgttcctgcgcatcgccttcaactcctatgagctgggctccctgcaggccgaggacgaggcgaaccagcccttctgtgccgtgaagatgaaggaggcgctcagcacagagcgtgggaaaacactggtgcagaagaagccgaccatgtatcctgagtggaagtcgacgttcgatgcccacatctatgaggggcgcgtcatccagattgtgctaatgcgggcagcagaggagccagtgtctgaggtgaccgtgggtgtgtcggtgctggccgagcgctgcaagaagaacaatggcaaggctgagttctggctggacctgcagcctcaggccaaggtgttgatgtctgttcagtatttcctggaggacgtggattgcaaacagtctatgcgcagtgaggacgaggccaagttcccaacgatgaaccgccgcggagccatcaaacaggccaaaatccactacatcaagaaccatgagtttatcgccaccttctttgggcaacccaccttctgttctgtgtgcaaagactttgtctggggcctcaacaagcaaggctacaaatgcaggcaatgtaacgctgccatccacaagaaatgcatcgacaagatcatcggcagatgcactggcaccgcggccaacagccgggacactatattccagaaagaacgcttcaacatcgacatgccgcaccgcttcaaggttcacaactacatgagccccaccttctgtgaccactgcggcagcctgctctggggactggtgaagcagggattaaagtgtgaagactgcggcatgaatgtgcaccataaatgccgggagaaggtggccaacctctgcggcatcaaccagaagcttttggctgaggccttgaaccaagtcacccagagagcctcccggagatcagactcagcctcctcagagcctgttgggatatatcagggtttcgagaagaagaccggagttgctggggaggacatgcaagacaacagtgggacctacggcaagatctgggagggcagcagcaagtgcaacatcaacaacttcatcttccacaaggtcctgggcaaaggcagcttcgggaaggtgctgcttggagagctgaagggcagaggagagtactgtgatgaaggacgtgggagctgcccatttggagggaactgtttttacaagcatgcgtaccctgatgccgtagagaggagccacagagacagaaagtgggaacatcaagcagataccgggcccaacgaaggataccacttctgggaactcattgaggaaagagagaacagcaacccctttgacatacgatgatagaagatggttgtcacctgtga

SEQ ID NO: 35463 - DNA, 1327 bp, Homo sapiens
tgccgcggcgccggagcccgaggcggctgtagcccacatctcccgagcgacccccggcgcccgcccgccgcgcggaggcccgggccacacctcactggccgcttggcccatcccagtcagcgccgcgccgaaccccgtccgcgcgcgccggggagcggcgcccccgccgctgccgccgcgacccttggcgcctgcccctgcaacgggaggtctgcagggaactggccaggcaagggggcaggcccgtttctcctggtggttggtgcgttgtagcagcagcgggagccaggactaaggacaagcaggagctgggagccccagccccactgcaggccccaccatggcgccgttcctgcgcatcgccttcaactcctatgagctgggctccctgcaggccgaggacgaggcgaaccagcccttctgtgccgtgaagatgaaggaggcgctcagcacagagcgtgggaaaacactggtgcagaagaagccgaccatgtatcctgagtggaagtcgacgttcgatgcccacatctatgaggggcgcgtcatccagattgtgctaatgcgggcagcagaggagccagtgtctgaggtgaccgtgggtgtgtcggtgctggccgagcgctgcaagaagaacaatggcaaggctgagttctggctggacctgcagcctcaggccaaggtgttgatgtctgttcagtatttcctggaggacgtggattgcaaacagtctatgcgcagtgaggacgaggccaagttcccaacgatgaaccgccgcggagccatcaaacaggccaaaatccactacatcaagaaccatgagtttatcgccaccttctttgggcaacccaccttctgttctgtgtgcaaagactttgtctggggcctcaacaagcaaggctacaaatgcaggcaatgtaacgctgccatccacaagaaatgcatcgacaagatcatcggcagatgcactggcaccgcggccaacagccgggacactatactgcccgctccccacgataagcaccagtgggactgtggtgacttctgctgctggccccgcccctgcccccagagcgtccttggctgccgtctggccgggctctcatggtacttcctctgtgaactgtgtgtgaatctgcttttcctctgccttcggagggaaattgtaaatcctgtgtttcattacttgaatgtagttatctattgaaaatatatattatatacatagacatatatatatatataataggctgtatatattgctcagtagagaaaaaccatgggggactggtgatatgttgatctttttcaaaaaaatatatatatgaca

SEQ ID NO: 35464 - DNA, 311 bp, Homo sapiens
tatccttacagtatcgagtagtaacattgttttatgaagttacttagatcagctccttttgttttcctctctgaggttatatcagacgtttgtaatgcagttagatttcatttgttacagtctgtagtctatcctgggttcccagatattctggttattttaaaaaatttgcatacagtggccagctgcagtggttcacacctctaatccaagcactttgggatgccaaggagggaagattgcttgagcctagaagtttgagatcagcttgggtaacatggtgagagcccatctctacaaaaaaaaaaaaa

SEQ ID NO: 35465 - DNA, 466 bp, Homo sapiens
accccacctgccagagaatgaagccagcccggaagacagaggaactgggtgaaaaggacaaagattccagacagcctgtgtgagccctaaaaccagctatgtctcaaggcagtctatacccgcccttgttttctaggttatataagccaattcattttcttttcttgctgggcctgatggctcacacctgtaatcccagcaatttgagaggccgaggcaggcagatcacttgaggtgaggcattcgagaccagcctggccaacatggtgaaaccctgtctctactaaaaatacaaaaattagctgatggcgcgcctgttatcccagctactcaggaggctgaggcaggagaatctgagaggcagaggttgcagtgatttgagcccgggaggcagacattgcagtgagctgtgattgtgccactgcactacagcctgggcaatagagtgagactctgtctcaaaaaa

SEQ ID NO: 35466 - DNA, 145 bp, Homo sapiens
cagcgagactccatctcaaaaaaaaaaagaaagaaagtccagctaagtgtcacaaacaagaggagtctaaggagaaagaagacatcactactaaatgttctgtggtatcttggatgggatcctaggttagaaaaggacattaggt

SEQ ID NO: 35467 - DNA, 561 bp, Homo sapiens
agatcagtggctctcaaagtgtggtcccttgagcccaggagtttgagaccagcctgggcaacacagccaaagagtggttcctggaccagcatcaccaacaatatctgggagcttgctagaagtcccaattcttggatcccactcatgaccttctgagtcaataactctgggggtggagcccagcaacctgtgttattaataagtccttaaggtgactcagaggcacattaaagtttaagaaccactatctaggccattgcaacaattctctaactggtctcctgactttattcatatctcttctgatcaatttccaacttccacaagagtgactggaccatgttacctccctactgaaaactttcctagggctccccatgacccatcttcgggggaaaaaaagtttaaacattctaatgagcattccagactctgcagttgtgactaacttacttttcctctttcaggaactgcttcacaagattaaaggagaaacagaaaatgtatctagcgctgtgcttggggcatggcaggaactcaatgaatgcttattaaatactg

SEQ ID NO: 35468 - DNA, 841 bp, Homo sapiens
gggccctgcgagctccaggtgcctctgccccgcggcgctggcgaagtcgaagcccgagaacgcccaccgcagcgatgcgaaggccgcttctggggtggggctgaggctgcagctgcctccctttcgcaccaaggaccccaaccttcagcgacgcagccgccgctcccgcccaggctgggaggcactgtagggatccgacgcttcaggtggccaaagagcgactttctctgattccagggccctggcggggcaggctccagtaccgcactcggcggaggccgaaggtctgtggggcaggacaggagttcctcgtgccgtcggaagggccgaggacgaaggagggcgctaattcactccccactgggctggcggcaacgccgaatcccgcagtgaccgcggagggccaaggtgcaggctgccccatggatgccacacgtggcagcggggagaaaagaagtgattcggtccctgccgagggttgctgccacccacgcactgctggcggactcagtgccaggcagccttgatggccaggcaacgtctaacccaggaggtgggacacatcctcggagtcaccagtgagatgtggcgagctgggagaaaagtcggcttcctgcatttgtcaccttctgcctccagccatggtagtaaaccaccgcggccagtcccgacccatcccggatccctcgggtctcacctgcaggtcctccagaccgggggccgccgccagccccggaaggccgagaggaactgcttcacaagattaaaggagaaacagaaaatgtatctagcgctgtgcttggggcatggcaggaactcaatgaatgcttattaaatactg

SEQ ID NO: 35469 - DNA, 1090 bp, Homo sapiens
ataataataatgataattaaaaataaacactgaggcatattagtagtagtagtatttactgtaaatattttggaaagaaagacttgcagaaaaatataacacccatacacatactacccaacttaataaataaaaactttacagatactgttgaagttcttttctacttttctttttttcaattttttatttttatttttttttagtggagatgaggtctcactgtgttgcccaggctggttttgaactcctgtcctcaagtgatccttctgcctcagcctccttcttttttattgagctataacttacttctttaagtgtaaggcattataaattgttttgggtacactcatgaaaccactactcatattaggatgtggacctgtccaaatcttcagggagtcctccctccccaggccaggcaatttctccagcaccaaggtaaccactgttttgttctctattgctatggattggttttgcttatttgtaaatttatttgtagacttggtccctatcactacgaattggttttgcttatttgtaaacttcatataattagaaatcatgaggcattttcataagtgtgttttcaacttctataaagagaaacacaatgtaccttcttttttgtgtcctaaaccttctttttctcagtccccttccctgtacatgcacttttcaaagtgattagaggtacagagaactcttcctctaatctaataaacaaaatgatacaaactcaataataggtggaaatgcccctcaggttcaatgctagagagaaactgcagggaatggtggggactatggcaaactatggaaaacacagttgttgtttttctgcttccaaagggggacagcattagccaagtgcagcaatgtggaaatgtgggcctcctgtggccaaatttttcattttttcttgggtacaagaaatctggagttcttaaaatttgaaatctctttctttttttaaaaagtttggcaactaattttgactttttttaaacacttgtatgccaaacaaaacatttctgtggtttgtgtagcctagaagctgttggcttgcaacctttggatgagatag

SEQ ID NO: 35470 - DNA, 360 bp, Homo sapiens
ttcatttgtctgaatcatcactattatcttttttatattcctttaccgttctccataatgcttttccaagaaactggtttattccacaattttattgcagaggcagctgcaggatatcataatcttatctttatacgaaggaagaattgcctaatccctcaagtaaactaaaaatgttttatacagtcatttctcattcatccaatgttccaggcagtcccagtccaagactgccccttcacacacacaacaactcttcacaagacttcactgtccttcagactctcctgcagcacagacattcgaggttgctgagtcgacattgcagttatttcactcttgattttgctgctcaatttt

SEQ ID NO: 35471 - DNA, 1701 bp, Homo sapiens
  misc_feature (540)..(540): n is a, c, g, or t
cttctgaacactatcactttacaggttaggatgctgacatgtaaattctgggggtatgcaaacattcagtccactgcactatgtttgtttgttttatgtatattttaaccctgaggtaactatgcctaccatgatgtattatattcagactgtagggttgaattattctcacttttttcatatgaattttcccttgaaggcaattcctttaaatatagtacaattttaatactaatttgtcaccttactataatgaattagcatttgctgtcttttcttataggaaatgataaggcattaaaagagtacccagagtctatgcagaggggtgttacataacattttgtctttcgacggatgttcaggtgacctaagaatgtaatttaagagtcatggtagtgggaactaatacttctggcacttaatttgtgccagatgttttcaaagcactttacatatattgacaaatttattattcaagtgaaaatgttatgagtgaggtcctcttattagtgacatcaaagatcttgtaactgattntatgtcaatctttacactgggtttacaaaactcagagagaaatggtgatcctcagctaaacagtgtagcaagatattgtactttatgtcatattattaaaccattatttatgtacaataaagtccatgcattaaagttcaatgatttttgataagtgtatatagtctcatatttctataagtgtatagaaagaactaccacaatctagttatgaaatattttcatcccccgtagagttctttcttgcctttctatagtcaatccccctcctccacttccagtccagtccttggaaaccactgatttcatttttatcactgatttgccttttcaacaaagtagtacaaatggaatcatacaagttatagttttttcatgtctggctacttttacttaacatagtgttttgtaattcatccgtgttggtagatacatcaagtttgtctctttttatttgtgactagaatcttgtatggaatctagcttaatttgataattaaattatttcaggcttcatctcctccacccttccccatggcttctttactgctttatttatttttttatcttatttggtaccatatctatctttgcaaataaccttgaattatttttggtgcaggtaagaaatagatggttggatgacagagggataaattataccttatactaaagttgacctgggatcacaggcgtgagccacggcgtctggcctatttcccttttaagtaaatatctgggtaggtggtctgagaatagtctgatgtgaaagaccttggctcccagaaactggtacatgatatttctcacatctcattggccagaaaacagtcacatggacaggtaacagcaaacaggctaggaaatgcaatcttgattatgaaaggccatttaaccatctaaaattggggtctctaacaaaacagaagagggcaaaggattttgagaaaaactaactgcagtctctaaatatgtaggctcaatcattaccttccttttccaaatgaggaaagtgagacatagagatgttaaggctcatgcctggcattgtacaatattcccttccgtttttattcatcctgttacaaatgcttgttgaaaggtcaagaccagcctggccaacatagtgaaaccctgtctctactaaaaatacaaaaaaaa

SEQ ID NO: 35472 - DNA, 430 bp, Homo sapiens
aaacgtgtaatttatcctgaaagatttaatagctataaacatgtacaactgcagtttaaaaaattatgggtaacttgaagtgtatgacaatgttacccttaaaaccaatataaaaatgcagcaaaacatgtatgtatgtaggtgcccacaaaatgtgaatggtacagaaatggagtccagtgcagggagaaggtttagccctgcactcttagatttgcaagcatctgtcattgttttgagtcttctccatatcattgtttccttctcctttggtatttctctaccaaagttgttattaggaagcatatctggccaggcgcagtgcctcgtgcctgtaatcctagcactttgggaggctgaggagggaggattgcttgagaccaagagttcaaggccaatcaagccaacatagtgagacccgtctctttta

SEQ ID NO: 35473 - DNA, 400 bp, Homo sapiens
tgatggaaaagcgtggaatttagaagcattgctcgctccttcagtttctaacaatctggttcccactgctccccgctgcagacagcccatagctggttgcatcttgtcagaggcaaacacccggagatggagatgtgtgtctcagtcctaagcccaagtctccagagaagagcatctggagggccctccagggtccatcccaacccaaatcttctgtagtcaagaacaaggagccagtggtgcagacacagatgcagttccatcgcttgggccccaccaaggagagaagaagttctcagagactagagtggaggatggagacaggctgggcccacacccccatgccccacaggtacctactacgactccccagaaataaacatttccccagtcctgaaac

SEQ ID NO: 35474 - DNA, 395 bp, Homo sapiens
agtgcttagaaaattaaattaactcatttaattttactaaaaacctgtgagataagggactattgttatgcccatttttcagatgaggaaagtgggacagagtttactgagtggtagagatgagatttgaacccaggcaagcaggctctaggtctggactcttggtcactctgctctgtccccacactaagccaggtatctgggcttgtgtacatagtcaggtaagtggaaatcacaggaattgctagaggactccagtagagggatgattttcatgaatgttctttcatctcaagaaagcaaaggctgctttttgggtgcaaaggagtttggctagaaggaagatctggagatagagcaaaaaaaaagaaagaaagaaagaaagaaaaatacac

SEQ ID NO: 35475 - DNA, 889 bp, Homo sapiens
tggggagaagaacagagagaaagcaaaccaatagtggttcttaatataatttcaggaataaatttgttcagtaaccacttttctccttcccctcatcttttggctctcaggcccaagaagccatacaggaataatcaaaatgatcaactctttccaacaggactcaacttaccaactgatttcaagaaaagtccttctaaacttcctgtctctctccctttccccaaacatacacacattcccaaactctggtcaattttcagtatttatggtggtggagccccagctcatgcccccatcaaaagtaaaggaggatatcaatttagtgtcatagtatgatgtatatggggttttttgggatggggggatggtcaggtgcttcctccagcttttgaggagacagctgactctgacaaaggagccctcccagtgggccacatttcagggaacaactgcgtctctgcactcattgcctttaaattccagacaattgctattcaagttctaaagatgacaaagactttatatagtccatttctttcaagctgctcatgagtggtgggtggtaagctaggcacactaatgcaatcaaccacaaagtgaaccgtgatgcaccaactacaaaccctggttacttaactgctaagtatattcatccccagcaatatcagattttctgagatcaaacaattcagaaggcagaagaaagggggcaaaagacaggtatttagaactacttgtggtgagtgagtctgagtgtagaaaggcaccccacgtacctggcgtagactatagtgcctaagtttccttactccaaatctccagcacaaaaccatgtatttcaagagtaaatacaaacaccatttgcaaatactagctgctgattttg

SEQ ID NO: 35476 - DNA, 413 bp, Homo sapiens
ggtagttgaaatcatggtcctaggaaattgctcatgaaaggaatatagtgcccaaagcaggtctactcttattccttaagaaattctgatatttaatagccaggtagagaaagatgagacagaaaagaaaacagaaatgagcagcctgagagcaggaggaaagcaaggggagtgtggttcccagaagctggggtgagagtgtttcaaataggatggaatagtgccaagtgctgccgagacatctgaaaagaggaggcctgggaaacacccattggatttagcaacatgggggtcttggtgagctaattttaaatttcctcaatggaatgatggaggcagaagccagattggagatggttgaggaattagtgggaagtgagaaaatggtagacattatatggaccacttttttt

SEQ ID NO: 35477 - DNA, 238 bp, Homo sapiens
ggacacacgagtactgacagatttaactggaagattatagaatgcaccccctctgccaccatcccagcagagccgcagtgcaacagcgctgggttatagcagacagagccacagactgtccccgaggaggaccatttggggaaattcagttacaagtggagatgaaagcaaggatactagaggaatttgaagcccctggcacctatggctaggcaatttctacctaaattaatataaa

SEQ ID NO: 35478 - DNA, 337 bp, Homo sapiens
ttttgagacagagtcttgctgtgtcacccaggctggagtgcaatggcatgatctcagctcactgcaacctctgcctcctgggctcaaatgattctcctgcctcagcctcctgagcagctgggattacaagtgcccaccaccatgctcagctgatttttgtatttttagtagagacggggtttcaccatgttggccaggctggtcttgaactcctgacctagtgatctgcccacctcagcctcccaaagtactggactagaggtgtgagccaccacgcccagccaagggggcactttttaactgggtagggacactgacttacccaagggcactcagc

SEQ ID NO: 35479 - DNA, 2528 bp, Homo sapiens
gggtgatagaggcactgaggccaggccccgggggtgccctgctgcaccgactccgggcggagattggctgtcctcggcccgcaatgctgtgcgccccgccccgcgcgccgcttccggcggagtcaggcttggctaatcgagcgcgcgggctggcggctcggcgttcgtttggccgcgcctgcccgtgtggtggtttccggcggaggtggtgagagtcgcacgcgcagcggggaaggtgtgagtcgtgaacggcccgggtctccgccatggcctctctactcgccaaggacgcctacctgcagagcctggccaagaagatctgctcccattcggccccggaacagcaggcgcgcacgcgggctggcaaaactcaaggctcagaaactgcagggcccccaaaaaagaaaaggaagaaaacacaaaagaaattccggaagcgagaagagaaggctgctgagcacaaggccaagtccttgggggagaaatctccagcagcctctggggccaggaggcctgaggcagccaaagaggaagcagcttgggcttccagctcagcagggaaccctgcagatggcctggccactgagcctgagtctgtctttgctctggatgttctgcgacagcgactgcatgagaagatccaggaggcccggggccagggcagtgccaaggagctgtcccctgccgccttggagaaaaggcggcggagaaagcaggaacgggaccggaagaagaggaagcgaaaggagctgcgggcgaaagagaaggccaggaaggctgaggaggccacggaggcccaggaggtggtggaggcaaccccagagggggcctgcacggagccgcgggagccgcccgggctgatcttcaataaggtggaggtgagcgaagacgagccggccagcaaggcgcagcgcagaaaagagaagaggcagagggtgaaggggaacctcacgccgctgaccgggaggaactaccggcagctgctggagcgcctgcaggcacggcagagccggctggacgagctgcgcggccaggatgaggggaaggcgcaggagctggaggcgaagatgaagtggaccaacctcctctacaaggcggagggcgtgaagatccgtgacgacgaacgcctgctgcaggaggccctgaagcgcaaggagaagcgcagggcgcagcggcagcgccggtgggagaagcgcacggccggcgtggtggagaagatgcagcagcgccaggaccggcggcggcagaacctgcgcaggaagaaggcggcccgcgccgagcgccgcctgctcagagcccgcaagaagggccgcatcctgccgcaggacctggagcgcgcaggcctggtctgagtctttcccacctggggccgccgtcttccgtcctaggagactccaggacaccctctgagtccttgacgctggctctgtcccaggatctccacagacctcggcctctccatgtgagggggacacagtggtgctctgctgagttgtgagggcccagatcacagatcccatgtgagaaagagagagtttcagcgtcatccttgaacgcaggatccgggaccttcagacccagggaaagggtgagggagactggggcctggtctgctttcccgggcctgaaagcttccccgaggtttgcagggtcagggaggaggaacggtgggggtgggcagtcactgcctgttccccactgcctgtgttcgcaggagccacgggacagaagacggtggcctctgctgccgggccacgttagtccgcagctcacccgaacagaggacaaccctgaggtgtggcatatgggcacctggcactgggagtcgggggagcacgtccaggcgtggtgcatcctggggcagaacgccatggctcctccccgctctcttggcttctgcctgttggggtctcattcctttctgttccccagtgccccggggcggcattttactgctcagaatttggagggagggagcagtaccttcccggagtccacgcatgtgagttgggtcaagtgcattggacctagggaaagagaaagaaagaataaaagctggagagagagtgaagtgaatgcaagatacaaagtgggatggaagaattaaatccagagttccaggcaatcaaaatgagtgcaggttgaaagaaaacaggtgaattttagtggcatatggatgataaagctgtaaataaaattcttttgatgaaactctccggttatgagacaaagactgtaactgaacaggagctggtgtgactgttaccagacagaggcaactgatgaaaaagccctgtgaaagataggatgtgaggtgagcatgagcttgagctgagagacagacacaacagtatctgaaaagaatacatactctttccatgcatatatggaacatggatggaaactgaccacctactttgtccagaaaagaagtcttaagatatttcaaggaatcagtgtcgttatctgaccgtatcccaatgtcattaaaaaaaatttgagctatttttttttgttttttagataga

SEQ ID NO: 35480 - DNA, 2274 bp, Homo sapiens
tccagctcagcagggaaccctgcagatggcctggccactgagcctgagtctgtctttgctctggatgttctgcgacagcgactgcatgagaagatccaggaggcccggggccagggcagtgccaaggagctgtcccctgccgccttggagaaaaggaagaaaacacaaaagaaattccggaagcgagaagagaaggctgctgagcacaaggccaagtccttgggggagaaatctccagcagcctctggggccaggaggcctgaggcagccaaagaggaagcagcttgggcttccagctcagcagggaaccctgcagatggcctggccactgagcctgagtctgtctttgctctggatgttctgcgacagcgactgcatgagaagatccaggaggcccggggccagggcagtgccaaggagctgtcccctgccgccttggagaaaaggcggcggagaaagcaggaacgggaccggaagaagaggaagcgaaaggagctgcgggcgaaagagaaggccaggaaggctgaggaggccacggaggcccaggaggtggtggaggcaaccccagagggggcctgcacggagccgcgggagccgcccgggctgatcttcaataaggtggaggtgagcgaagacgagccggccagcaaggcgcagcgcagaaaagagaagaggcagagggtgaaggggaacctcacgccgctgaccgggaggaactaccggcagctgctggagcgcctgcaggcacggcagagccggctggacgagctgcgcggccaggatgaggggaaggcgcaggagctggaggcgaagatgaagtggaccaacctcctctacaaggcggagggcgtgaagatccgtgacgacgaacgcctgctgcaggaggccctgaagcgcaaggagaagcgcagggcgcagcggcagcgccggtgggagaagcgcacggccggcgtggtggagaagatgcagcagcgccaggaccggcggcggcagaacctgcgcaggaagaaggcggcccgcgccgagcgccgcctgctcagagcccgcaagaagggccgcatcctgccgcaggacctggagcgcgcaggcctggtctgagtctttcccacctggggccgccgtcttccgtcctaggagactccaggacaccctctgagtccttgacgctggctctgtcccaggatctccacagacctcggcctctccatgtgagggggacacagtggtgctctgctgagttgtgagggcccagatcacagatcccatgtgagaaagagagagtttcagcgtcatccttgaacgcaggatccgggaccttcagacccagggaaagggtgagggagactggggcctggtctgctttcccgggcctgaaagcttccccgaggtttgcagggtcagggaggaggaacggtgggggtgggcagtcactgcctgttccccactgcctgtgttcgcaggagccacgggacagaagacggtggcctctgctgccgggccacgttagtccgcagctcacccgaacagaggacaaccctgaggtgtggcatatgggcacctggcactgggagtcgggggagcacgtccaggcgtggtgcatcctggggcagaacgccatggctcctccccgctctcttggcttctgcctgttggggtctcattcctttctgttccccagtgccccggggcggcattttactgctcagaatttggagggagggagcagtaccttcccggagtccacgcatgtgagttgggtcaagtgcattggacctagggaaagagaaagaaagaataaaagctggagagagagtgaagtgaatgcaagatacaaagtgggatggaagaattaaatccagagttccaggcaatcaaaatgagtgcaggttgaaagaaaacaggtgaattttagtggcatatggatgataaagctgtaaataaaattcttttgatgaaactctccggttatgagacaaagactgtaactgaacaggagctggtgtgactgttaccagacagaggcaactgatgaaaaagccctgtgaaagataggatgtgaggtgagcatgagcttgagctgagagacagacacaacagtatctgaaaagaatacatactctttccatgcatatatggaacatggatggaaactgaccacctactttgtccagaaaagaagtcttaagatatttcaaggaatcagtgtcgttatctgaccgtatcccaatgtcattaaaaaaaatttgagctatttttttttgttttttagataga

SEQ ID NO: 35481 - DNA, 1954 bp, Homo sapiens
tccagctcagcagggaaccctgcagatggcctggccactgagcctgagtctgtctttgctctggatgttctgcgacagcgactgcatgagaagatccaggaggcccggggccagggcagtgccaaggagctgtcccctgccgccttggagaaaaggaagaaaacacaaaagaaattccggaagcgagaagagaaggctgctgagcacaaggccaagtccttgggggagaaatctccagcagcctctggggccaggaggcctgaggcagccaaagaggaagcagcttgggcttccagctcagcagggaaccctgcagatggcctggccactgagcctgagtctgtctttgctctggatgttctgcgacagcgactgcatgagaagatccaggaggcccggggccagggcagtgccaaggagctgtcccctgccgccttggagaaaaggcggcggagaaagcaggaacgggaccggaagaagaggaagcgaaaggagctgcgggcgaaagagaaggccaggaaggctgaggaggccacggaggcccaggaggtggtggaggcaaccccagagggggcctgcacggagccgcgggagccgcccgggctgatcttcaataaggtggaggtgagcgaagacgagccggccagcaaggcgcagcgcagaaaagagaagaggcagagggtgaaggggaacctcacgccgctgaccgggaggaactaccggcagctgctggagcgcctgcaggcacggcagagccggctggacgagctgcgcggccaggatgaggggaaggcgcaggagctggaggcgaagatgaagtggaccaacctcctctacaaggcggagggcgtgaagatccgtgacgacgaacgcctgctgcaggaggccctgaagcgcaaggagaagcgcagggcgcagcggcagcgccggtgggagaagcgcacggccggcgtggtggagaagatgcagcagcgccaggaccggcggcggcagaacctgcgcaggaagaaggcggcccgcgccgagcgccgcctgctcagagcccgcaagaagggccgcatcctgccgcaggacctggagcgcgcaggcctggtctgagtctttcccacctggggccgccgtcttccgtcctaggagactccaggacaccctctgagtccttgacgctggctctgtcccaggatctccacagacctcggcctctccatgtgagggggacacagtggtgctctgctgagttgtgagggcccagatcacagatcccatgtgagaaagagagagtttcagcgtcatccttgaacgcaggatccgggaccttcagacccagggaaagggtgagggagactggggcctggtctgctttcccgggcctgaaagcttccccgaggtttgcagggtcagggaggaggaacggtgggggtgggcagtcactgcctgttccccactgcctgtgttcgcaggagccacgggacagaagacggtggcctctgctgccgggccacgttagtccgcagctcacccgaacagaggacaaccctgaggtgtggcatatgggcacctggcactgggagtcgggggagcacgtccaggcgtggtgcatcctggggcagaacgccatggctcctccccgctctcttggcttctgcctgttggggtctcattcctttctgttccccagtgccccggggcggcattttactgctcagaatttggagggagggagcagtaccttcccggagtccacgcatgtgagttgggtcaagtgcattggacctagggaaagagaaagaaagaataaaagctggagagagagtgaagtgaatgcaagatacaaagtgggatggaagaattaaatccagagttccaggcaatcaaaatgagtgcaggttgaaagaaaacaggtgaattttagtggcatatggatgataaagctgtaaataaaattcttttgatg

SEQ ID NO: 35482 - DNA, 2392 bp, Homo sapiens
tccagctcagcagggaaccctgcagatggcctggccactgagcctgagtctgtctttgctctggatgttctgcgacagcgactgcatgagaagatccaggaggcccggggccagggcagtgccaaggagctgtcccctgccgccttggagaaaaggaagaaaacacaaaagaaattccggaagcgagaagagaaggctgctgagcacaaggccaagtccttgggggagaaatctccagcagcctctggggccaggaggcctgaggcagccaaagaggaagcagcttgggcttccagctcagcagggaaccctgcagatggcctggccactgagcctgagtctgtctttgctctggatgttctgcgacagcgactgcatgagaagatccaggaggcccggggccagggcagtgccaaggagctgtcccctgccgccttggagaaaaggcggcggagaaagcaggaacgggaccggaagaagaggaagcgaaaggagctgcgggcgaaagagaaggccaggaaggctgaggaggccacggaggcccaggaggtggtggaggcaaccccagagggggcctgcacggagccgcgggagccgcccgggctgatcttcaataaggtggaggtgagcgaagacgagccggccagcaaggcgcagcgcagaaaagagaagaggcagagggtgaaggggaacctcacgccgctgaccgggaggaactaccggcagctgctggagcgcctgcaggcacggcagagccggctggacgagctgcgcggccaggatgaggggaaggcgcaggagctggaggcgaagatgaagtggaccaacctcctctacaaggcggagggcgtgaagatccgtgacgacgaacgcctgctgcaggaggccctgaagcgcaaggagaagcgcagggcgcagcggcagcgccggtgggagaagcgcacggccggcgtggtggagaagatgcagcagcgccaggaccggcggcggcagaacctgcgcaggaagaaggcggcccgcgccgagcgccgcctgctcagagcccgcaagaagggccgcatcctgccgcaggacctggagcgcgcaggcctggtctgagtctttcccacctggggccgccgtcttccgtcctaggagactccaggacaccctctgagtccttgacgctggctctgtcccaggatctccacagacctcggcctctccatgtgagggggacacagtggtgctctgctgagttgtgagggcccagatcacagatcccatgtgagaaagagagagtttcagcgtcatccttgaacgcaggatccgggaccttcagacccagggaaagggtgagggagactggggcctggtctgctttcccgggcctgaaagcttccccgaggtttgcagggtcagggaggaggaacggtgggggtgggcagtcactgcctgttccccactgcctgtgttcgcaggagccacgggacagaagacggtggcctctgctgccgggccacgttagtccgcagctcacccgaacagaggacaaccctgaggtgtggcatatgggcacctggcactgggagtcgggggagcacgtccaggcgtggtgcatcctggggcagaacgccatggctcctccccgctctcttggcttctgcctgttggggtctcattcctttctgttccccagtgccccggggcggcattttactgctcagaatttggagggagggagcagtaccttcccggagtccacgcatgtgagttgggtcaagtgcattggacctagggaaagagaaagaaagaataaaagctggagagagagtgaagtgaatgcaagatacaaagtgggatggaagaattaaatccagagttccaggcaatcaaaatgagtgcaggttgaaagaaaacaggtgaattttagtggcatatggatgataaagctgtaaataaaattcttttgatgaaactctccggttatgagacaaagactgtaactgaacaggagctggtgtgactgttaccagacagaggcaactgatgaaaaagccctgtgaaagataggatgtgaggtgagcatgagcttgagctgagagacagacacaacagtatctgaaaagaatacatactctttccatgcatatatggaacatggatggaaactgaccacctactttgtccagaaaagaagtcttaagatatttcaaggaatcagtgtcgttatctgaccgtatcccaatgtcattaaaaaaaatttgagctatttttttttgttttttagatagaagcaagactgtctcaaaaagaaaaaatttaagatttgtggaacagagctaaagcagcacaaaaaaacatagcccctaaatgtatgtgcatctacagataaatagtgccatttatacac

SEQ ID NO: 35483 - DNA, 1941 bp, Homo sapiens
  misc_feature (1920)..(1921): n is a, c, g, or t
  misc_feature (1928)..(1929): n is a, c, g, or t
tccagctcagcagggaaccctgcagatggcctggccactgagcctgagtctgtctttgctctggatgttctgcgacagcgactgcatgagaagatccaggaggcccggggccagggcagtgccaaggagctgtcccctgccgccttggagaaaaggaagaaaacacaaaagaaattccggaagcgagaagagaaggctgctgagcacaaggccaagtccttgggggagaaatctccagcagcctctggggccaggaggcctgaggcagccaaagaggaagcagcttgggcttccagctcagcagggaaccctgcagatggcctggccactgagcctgagtctgtctttgctctggatgttctgcgacagcgactgcatgagaagatccaggaggcccggggccagggcagtgccaaggagctgtcccctgccgccttggagaaaaggcggcggagaaagcaggaacgggaccggaagaagaggaagcgaaaggagctgcgggcgaaagagaaggccaggaaggctgaggaggccacggaggcccaggaggtggtggaggcaaccccagagggggcctgcacggagccgcgggagccgcccgggctgatcttcaataaggtggaggtgagcgaagacgagccggccagcaaggcgcagcgcagaaaagagaagaggcagagggtgaaggggaacctcacgccgctgaccgggaggaactaccggcagctgctggagcgcctgcaggcacggcagagccggctggacgagctgcgcggccaggatgaggggaaggcgcaggagctggaggcgaagatgaagtggaccaacctcctctacaaggcggagggcgtgaagatccgtgacgacgaacgcctgctgcaggaggccctgaagcgcaaggagaagcgcagggcgcagcggcagcgccggtgggagaagcgcacggccggcgtggtggagaagatgcagcagcgccaggaccggcggcggcagaacctgcgcaggaagaaggcggcccgcgccgagcgccgcctgctcagagcccgcaagaagggccgcatcctgccgcaggacctggagcgcgcaggcctggtctgagtctttcccacctggggccgccgtcttccgtcctaggagactccaggacaccctctgagtccttgacgctggctctgtcccaggatctccacagacctcggcctctccatgtgagggggacacagtggtgctctgctgagttgtgagggcccagatcacagatcccatgtgagaaagagagagtttcagcgtcatccttgaacgcaggatccgggaccttcagacccagggaaagggtgagggagactggggcctggtctgctttcccgggcctgaaagcttccccgaggtttgcagggtcagggaggaggaacggtgggggtgggcagtcactgcctgttccccactgcctgtgttcgcaggagccacgggacagaagacggtggcctctgctgccgggccacgttagtccgcagctcacccgaacagaggacaaccctgaggtgtggcatatgggcacctggcactgggagtcgggggagcacgtccaggcgtggtgcatcctggggcagaacgccatggctcctccccgctctcttggcttctgcctgttggggtctcattcctttctgttccccagtgccccggggcggcattttactgctcagaatttggagggagggagcagtaccttcccggagtccacgcatgtgagttgggtcaagtgcattggacctagggaaagagaaagaaagaataaaagctggagagagagtgaagtgaatgcaagatacaaagtgggatggaagaattaaatccagagttccaggcaatcaaaatgagtgcaggttgaaagaaaacaggtgattcgcgaatgggtcnnagctcgnntcgtatcatgta

SEQ ID NO: 35484 - DNA, 212 bp, Homo sapiens
ggtctcagagacgtccactgactgctctgcctcttttctcctctgactgagcgtccacgcagccctgattttttcagcctcctgtgtgagcccctgtgtggcttctggtcacctccaggataaagtagtacagagcacatgccaagcgcccaacgtaaccgaccccatggcctccctgccaccctgctgctgctcccccatcgccatggggt

SEQ ID NO: 35485 - DNA, 258 bp, Homo sapiens
ccttggggttcaatcctgagtcatcttctctaagttgtctcatccattcccatcacttcaaataccatcaacatgttaataactaccaagttacacccctagcagagacctctccccatgctccaatatgactacttagctgtcacacaagcatgtcaaactcaacatgcccaaaattgggtccttaattctccaccatcaccacccttgaagtcccctggtactacctgacaattatgaaagccagaaacccttcct

SEQ ID NO: 35486 - DNA, 319 bp, Homo sapiens
tttttttttgtcaaagccaaaggataccaacctaacttatgcttttagaagatccaaaaggggctgcttttgaatactaattttgaaagaaggaaggagaaaaaataatcctcccaaaccaaaagtgtcaaaccggcatcagttcatgagccaatgccaagtgatgaggagtgactgctttgaacactgagttaagaaggattctggggttacacctgggaccaaaagacaaggggctatgttcgatgataacttgaaaatacaggatgacccagtttagaccatcatgtactctaccacagcccatctctccccagct

SEQ ID NO: 35487 - DNA, 205 bp, Homo sapiens
tttgctctcactagcctgggcaacgtagtgagaccgtatctctatcaatcaaaaaaacaaacagaaaacatttagccgagtgtggtggtgcacagtggtggtcccagctacttgggaagttgaggggtgggaggattaccttagcctaggaggtcaaggctatgtgagccttgattgtaccactgcactccagcttgggtaacag

SEQ ID NO: 35488 - DNA, 332 bp, Homo sapiens
taaatttttatttgttgcagaacattgttatgttgttgaatgttatgatgtagttttctttctttaaagaatgcttaatttatttggcaggtagttatgttacttgcagagcagactgattcaatgcataattttaaactctttagcctgggcaacatagggacacctggtctctataaagaaaaaaaaaatgatccagttgtggtggcacccacttttggtcccagctactcagtggggaagaccctttgagtccggggatttgagactgcagtgagctgtgatcatgctacttatgcttcagcccgggtgacagaacaagaccctgtcta

SEQ ID NO: 35489 - DNA, 721 bp, Homo sapiens
attcatcccttgtgatatcatgggccacttttagtcttttatttggaccctgactttgagtttttgctatgcctgttttttaagtaaacacagccttcttatttgaacgtaacactgcagaattgcaggaagagaaaagggcagttagttatttcactttctgtaagttttaggaagattcttatatcctacgaggtgactcatgtttcattttagaccatgatagcacattgttgttaactttggtaatcttccatgcagtttgcagtgttcccttgcaagtcacaagcatatatgcattaagattttaaaatctaagatgcttaagatgttggtggcattgctctttctgaaaagaaagacaaaatactagaccttgctgaaaattggatatcttatttactttgcccatttatgcccgaatggtgtaatgcaagactcaagacttttcaatgtagtatatcaaatgagttgtgcattgattcatttgggggacatgaacaaaaattatcaaccagccagaactgtaatatttaattagttcatctttttctttcattcactctatcacatttgcattagccaaagagataagaacattagtaattcatatgtgtaaacaacccagaagtgaatattaaatcagtgagccaaaaagcaataaacaactcgagcatgggaaatcctgctaacagtggggagtctgatatagaaaaaaaaa

SEQ ID NO: 35490 - DNA, 218 bp, Homo sapiens
ttattactgtcccttgcttaggtcacaagaggagctcaaaataatttcataaacatgaattggcttccctagacacaacaaaggataagatcaaaagaattaacccatttaaaaaaatcagtctaggctggtcaagtgcagtagtgaacaggaggaaagagtagatcaaggagttcgatctgtaactgactttgatcaattgataacacactacctta

SEQ ID NO: 35491 - DNA, 372 bp, Homo sapiens
gtaaccagttgaattggacaaagtgttagtctgttatttattggaaattttataaaaagaataacatgatactgctccttcaccgcaggtggtttgagaagcaccaagctagattattctggaggttatgtgaaagttaaagtgaaggtatacacatgttcttacttataagtggaagctaagctatgggtgtgcagaggcaaacagggtggtataatagacactggagactcagaagggggaaagttggaagggttgaggggtgaaaaatcacttatttggtacagtgtgtactgtttggatgatgagtacactaaaagcccagactttaccattatacaattcattcatgtaaccaaaaaccaccagtac

SEQ ID NO: 35492 - DNA, 408 bp, Homo sapiens
tttctctatcaatttttttctctgtcctgaatcttttaatttctccactttcttcatcttatgaccatattcatttcttgaccctgcacccctctaactccatctatttgttaaggaaggcttttgtagtcaagcttctagagaagtggctagcaaacatcatctttgtttcctctccagtcatgcacacctcttaatcccactgaaactgtggtacggttatcaattacctttatagagatgaatttgaattttattggggcatttatgtcgtaaaatattaactactccatcatttcctttccttactccatcactgtcctccctgggcttctgagacatccttttctgggttctcctaatgtgaccgctctttcttaactcactgtctcaatatgtagtgattcc

SEQ ID NO: 35493 - DNA, 400 bp, Homo sapiens
ttgctgctggggtggttggaatcaaggttttctaattatttttctgtcatacataagtagcataggagacaaaagcccagagttaacttcctccaggtgcatttgatagatgtttgaatatctgatcattgctatcctaatttttaaaaatgcacataagtgttgcaaatactaatttcgtgtagttaaaatgtaacccttctcctacacgcatatcttaatgtgcctaaagtgaatttttaaactctaattattaaactcagggcatcttctggaattggaggctcatttcatgcattgagtaatcgctggtgttgtcatggtaacatataatgttggtgcaatttcctttatgtaataggtttttgcttggaaaattgtgggtagatcaaaattttct

SEQ ID NO: 35494 - DNA, 449 bp, Homo sapiens
tgaatgtttaatttcatctaattacatttccatatagttcgtatattaacagtacagatctagagatgcccattattgcagctgaggctcacttgagcttcccctgcaaccttcaccgtggttaaaagcacagactcttggccaggcacggtggctcatgcctgtaatcccaacactttgggaggctgaggcaggcagaccacctgaggtcaggagtttgagaccatcctgaccaacatggagaaaccccgtctctgctaaaaatataaaattggccaggcatggtggcacgtgcctgtaatcccagctactcgggaggctgaggcaaggagagtcccttgaacctgggaggtggaggttgcggtgagccaagattgcaccattgcactccagcctgggcaacaagagggaacaagagtgaaactccatctcaaaaaaaaaaaaaaaaa

SEQ ID NO: 35495 - DNA, 338 bp, Homo sapiens
tggaagaattgtctttggtcacacataaaatacactaatactaacgatagctgatgagctaaaaaaagaaaaggtctgtgcataaatctcatgttttaagaaggtttacaatttgtgatgggcggcattctaagccatcctaggctgcgggttggacgagcttgctgtaaagggttagaaaagatatttcctgtagctatcagtaggaccttccttaaaggggaaggtgagtgcttttaatccatataaaatgttttatttaattccaaggtatttttcttatttatatataaaaaataaaataacatttatcacaaagaataaataggtcatttcat

SEQ ID NO: 35496 - DNA, 431 bp, Homo sapiens
atgacacattagtatgtgtaacactaagcaacaaaccgtggaaaagtcaattagaaaagcagctgaaggcccatttggcaatgtgagatcatctttacagtttgcctggtatctgttgaaaaccagttttccatataaagagcctggtgcacttaaagtcatatagtgtggaggcaaagtttcacgttacaaagcagttctttatcctccattagcgtacagcccctatggatcttattatcactgttttccttttaatctaataattataaagaacaaaaagcattaaaaaatgctttactgctcccatttgaatttgtctttcctatagtttagtgaattttgcaggaaaatatttatatacattgtcttaaataagcccatctctataaagctgtccctcctctatttattgggctgaattctcagcg

SEQ ID NO: 35497 - DNA, 324 bp, Homo sapiens
tcagtatttagaaatttttatttcataaataatcctaagtatcctaaggaaaatttgacccaagtggaaacatttttagcatataatccaccaaattggcaacccacaagtaaataatggaagatagctgttcatctaataggagagaattcaaaaaacactgtgcttcaactagactctgttagaagtatgtcagagtctagagcaatcaccacatagttaagatgctattaattctgtatgaatagaaaaaactgaagagtaagtgttttttagacaagagcatagcagtataatgtgaaatgataaaaagcacagatgctg

SEQ ID NO: 35498 - DNA, 866 bp, Homo sapiens
  misc_feature (801)..(801): n is a, c, g, or t
  misc_feature (810)..(810): n is a, c, g, or t
  misc_feature (815)..(815): n is a, c, g, or t
  misc_feature (831)..(831): n is a, c, g, or t
  misc_feature (847)..(847): n is a, c, g, or t
  misc_feature (856)..(856): n is a, c, g, or t
gcttttaaagatttacctagaagagataataaaacagataaaactgatctgctcaggggcctgtcttcagtcttttcaggctcgtttactgtggtgttcatgccagcgcagcctggtagacagtgttgctgtggctgtagaaataacactgctcatttttatggaggatattgctgtatgccagttaaagaaattcaagttgaaagacctttaaattttttttaataatacacttccttccccacccccaagctgtcaccatgattatgatgccaggaaagcagtgcggtggctccaggattgttctcccatgggctgtgtgccaggtggatgaagtagtcaggagggccacagttgggtttatgtacaacctagatatcatctacttgtgctggttgaccctccattttctaaaggcaatttccaaagggagttgcttttgttgttactattagaacggttgcctattttccatatgatctcttctctgtcacttaggttctgtattctatatagaaaagtatggagggaaagggaagaatcaggaaagatagtgaatgcaagaatattgggggttatgatgtggttaagttagattgtgcctcaaaacactgaaaagattggagtttcgggtcaggagctctggattaaaggccaacgggaatcttttaaacttcttggttgtgtgtgtgtgtcggtgtgtgaagtcagaggcagacgatgagaggaaataaattgagatgggagagaaaataatatggaatgcttaggaaggatttttaaaattccaggggctggggnttacaggcntgccngttgttaccccagccncttgtgttttattttnaaaaagaantactggcctt

SEQ ID NO: 35499 - DNA, 1273 bp, Homo sapiens
cctgattctattggagcaggtttgatcatctaggcagaaattaggatgagaaaaaaggagatccaataatacaaccttatagtcacagaagtaagaaaaaaagggtagttgttttgaagaagccaggataggtgtggaaagtactcaaaaagaaatcttcagggataaaataaagtgataatttaaaagaaatcaatggattaaacatattgaaactgttctataggcagtggtcattgagtcagctttcagtgcattaggaagaagatgcataggtgtcaactcttttctgacagcatttactagagaagagaaaaagctggggactacatcttcaaggaagggactttttttggatgagcagttttgagtgtgtttgtcagttaaagagaggaattaggttggttttcatttgggaaaaattgtatatatatttaatgtaagttatcacattgcatcttaaaaatattcttatttaatacatatatttcctacatgtatatgtggtagcatgatagcaaataacatttgtttggtatttccaaaggactttcatgtacattgcctcattttacctttacagctactctgaaatacacaggcattatcccttttattcagctgagaaaactgagcttcattgaggtggaggtcaaaaatcacaaaatttgtgatgaattaagatttgaacatatgttttgtgactccagttttcctttcagattttaaaattaattaaagggatcttcattatacttttattgttaactttttgttaacataatttattcatacattcagtgaaaattttgttgaggtactgggacaggttaaaaaatacagttgtagccctcaggatatttaatatccagtgaaaagtgacagtcagtaaaccaacaatctcaatactttgatatatgttgtgaggttgtgataaccgattcttgtttagtttaattctatatctcccttagaccagtgttaaatttaaataaaacacctcattttttccaattcagggaaggcactaaacataaagcataggatagaaatgttgaactcatccaaaatattattttgtttaatgaaaatgatgaagattaaggaatacttccatgtattgagtaaggttgataattttctaattcttcactgtgcattattttgtttgaagttggtaaatttggagtatcctgcagacacattttgctttatgtactacaacattctacaaccaaataaaaattattttgattatctgaaaaaaaaaaat

SEQ ID NO: 35500 - DNA, 398 bp, Homo sapiens
attggaccaaaaattcacagcttataagtaatacttactattccctagttgctatggtcagggatctgagagaatctgtccagtttgattcaaggtccctccctcgtatgagtttataatcaagtcgttggcctagcctgcagtcatctgggcctggaggatccacgtaattttacttatatagttgttgacaagcctcagtttctccctggctgttggccagatgctttagtttctcactttgagagccttccctccttccttccttccttccttctttgcttccttccttccttctttgcttccttccttccttcctctccttccacccctcatttcctttttgcacacattacaggtggtgtgttctgtgataatgaaaagcatcagaaaaaaaa

SEQ ID NO: 35501 - DNA, 302 bp, Homo sapiens
agcattgcataacatttctgaaataagagtctgaggagaagtttgcctctgaaagaaaattacaggagaacctccgtgagtcttctcttacccagacattacaaggcgaagataaatcgcaagatgaaatgtttggttaaaattctatcaaaatgagaatgttaactacagaaggtcaaaatatcagtgagtaaattcctagagaagtcttcaatgcaaccaaaaagatttctcctcccaaaacagaaaagctatatatgcacagatacattaaaaacatacaaaaaagatgttatcctacc

SEQ ID NO: 35502 - DNA, 463 bp, Homo sapiens
ctggggcttgaggaataatttttctaaggtgcaggtttttaaaaggaagatccctagaggtcaaggtatggagtccaagtggttttgaaatctctgtcatggtattgctatcctgagggtttggtgggttagatgcagttggtttcttggcaaaggtagcacttgcaattgagcaggtaatagattagagtttcaggagggtcttctagtttaaaaggttgaagttaatgcctagccagtaaccagagagacaggaagaatgttttaacctctggaggattggggagagctattcagagtgaagggtgaagtagaacagaggtttgcctctgctttatgatgaatgaagcagagactgtgaaagtgttttggaattgtcctagggtgctatacaaaccttggcataaaatctaatatgctatctctcttttgtttccagtcctaaagaaaggaacaaggcatt

SEQ ID NO: 35503 - DNA, 381 bp, Homo sapiens
aactctcatacatactcttaaagacccagatgaaatggcagaacgcctgtgaacttcatctaatgtacacactcagaatcttgggaaccttggggtctgaaagggcatgaatgttttttgtttgtattgtgaagataaaatccggccacagaactgggcgtggtggtcacgcctataatcccaacactttgggaggccaaggtgggcagatcacctgaggtcaggagctcgagaccagcctgaccaacatggacaaaccctgtctctactaaaaatacaaaaattagccaggcatggtggcatgcacctgtaatcccaactacttgggaggctgagacaggagaatcgcttgaacccaggaggcggaggttgcagtgagcc

SEQ ID NO: 35504 - DNA, 462 bp, Homo sapiens
actttacataaacagaaacattatataattctatttataattgcttatcttattaaacatattttaaagattaaactatgttaacatgtttgagttggcatctgagttactcatttttcattgctctataacgaattcctatgtatgaatttaggtcagtttctcccctagaattcatgagttgaaaccctaatccccaatgtgattgtatttgaagtaaggaagtaattaaggttaaacaagatcatatgggtggggccctgatgatactagtgttcttataagaagagacacaagagagattactccctttctctctgccatgtgaggacactgagagaagatgtggccatctacaagccaggaagagagccctcttcagaacctgaccttgttggcactctgctatcagacttccagcctccaaaaccgttaaaataaatttctgttgtttaagccacc

SEQ ID NO: 35505 - DNA, 535 bp, Homo sapiens
ccaaggctgcctcatgctcttcgtgacttactgcttgctataatcctgagtctgtggatgatcacatcagaaaacgccctcagtttactgttgcgtcccactgcttcccatcttctgaattaagactgcacattctggctctttgccttgggtaatcttttcccccaataacttgggagctttgattccaagtggcttaggagagttgttctccacacagctgggtaccagaagcagccagctgaatgggaccaaggcatgaagactgaaaacctcgcaggtgacttggatcctcatcccaggttgagaatctctagcttaggagtctcttttgagtcctaaaggaaatactcaatttcccccatctgtcaggtccctgccacatctaccgacatgtgcaatgggattaattcttaagaaattcatatacagcttagattgttgctcagagactcctgccactctgtgaaccacccctatggacactgatgcacaatttcctttgggttgatctcataagttgcatccaaaaaaa

SEQ ID NO: 35506 - DNA, 398 bp, Homo sapiens
tagaaatgcctttttatgtctacatcaaagtagacataaaaagtttgctccttggggagaccacaaaaatagaagctgggcccctttcatctcctgcagatagctgtccatgccagggccttggtaaggaaaggggtcatttcagattcatgagtgtgcacttcttggccctttatcaaactaatgcatttaatgtgagaatcaaaccattattgccaagcaagaacaatgggtctaggtcccagacaaaggcatctagagtttcacagaccagagtggtgttattcaaagttggacaccccacccctgattcagtttatttattcagccagggacttggggaatatataatttaagttgaaaaacaagactgggaagggtattatatgtcaatctgg

SEQ ID NO: 35507 - DNA, 378 bp, Homo sapiens
atataaaaaataaaaaaacttagccagttgtggtagcacgtgcctgtagtcccagctactcaggaggctgaggtcaaaggattgcctgggctcaggagtttgaggctgcaataagctatgattgtgccactgcacttcagcgtgggtgacagagtgaagccctgtctctatttaaaacaacagcaataaataaacaaagggaatcacttccaagttgacatcccaagctggaaacattgactccacactttccttaagctgctcagcatcaaaagctgctattgttatgttcatactatgtgccaggcactgttttcacaagtatgtatatacgtgtgtgtgtgtgtgtgtgtgtgtgtgtgtgtataaaatgtccat

SEQ ID NO: 35508 - DNA, 470 bp, Homo sapiens
atcagagaaggcatgataaaagtttgagaggctgggtgtggtggctcacagctgttatcccagcactttgggaggctgagactggagagttcgagaccagcctgggcaacatagcaaaacccaatctctacaaaaagcgcaagaattagctgggtgcggtggcatgtgcctgtagacccagctacttgcggggctgaggccagaggattgcttgagccctggaggtcgaggctgcagtgagctgtgttcatgccaccgcactccaggctgggtgacaaagtgagactccatctcaaaaaacaacaacaacaacaacaacaacaaaacagtacaagaactgtgtggctcagatcagtgctactcaaataagccagttggtggattgcctattacttacctgtaagggcatcaggagcttacagagaatataaatgatccttgtttctttcatcaaaaaagtcttgctgcca

SEQ ID NO: 35509 - DNA, 512 bp, Homo sapiens
gcgtatcaaatgtcagaaactaaaataggggaaacattgaaaaccaggcggcattggtgaataaatcccacacaaacagctgagcttcctcccaaagcgtgacgcacagatggctcccctgacccgaggcctcctcctccgtggacgccgcctgcccagctcacggaaggccttgccttctcccacccgaaaccgtcagcccaggcctcgctctcgcctgctgtggccacaggtcagcacccttcctgcagcccagagtctggtatacagcaggcgcctaataaatactggctgggcaaacaccactcatcccagctgctcagacgtgggggtcgggctcattgcggaatgcagaccggctccaccgtgccttctggccctgaagggctgggcaggtccacgccctgcaccctggagctccccggggagggcgggtgtaggaatgtttgcccagtgagtggacagacgtttacacagcgggatttataacccacatcagacgtcaactccgg

SEQ ID NO: 35510 - DNA, 546 bp, Homo sapiens
gctactccaccagctgcagcgagggcttctggcagagatccccagctgtcagccctcatcggaattgcttcaaatgaagagtgtcatctcacccaccaccatgccctcttcccagggtgcccacagccaagaactggtttataaggagatataaaggtctggcccccactttgtctagagctggccatgtggttgctctctgttgaggctgaatcataggctgtgatggttaagattgagtgtcaacttgattgaattgaaagatgcaaggtattgttcctgggtgtgtctgggagggtgttgtcaaaggagattaacatttgagtcagtggactgggagaggcagacccacctgcagtctgggtgggcaccatctaatcagctgctagaataaagcaggctgaaaaaggtagaaagagcagacttactgagtcttctggccttccatctttctctcttgctgaatccttcctgctcttgaacatcagactccaagctcttcagcttttggactcttggacttagaccagtggtttgccaggggct

SEQ ID NO: 35511 - DNA, 348 bp, Homo sapiens
attccctgattatttttctttttttgcacatatcaccatataatatgctctgtacctcctccccctccacctgtgatgtaggctctgtgaggactggggttttgtttggtaccttatccttaatacttggtatgtaggtgataaataaatactgggtaaaaaaggaatgaatatttcctctattcttgtataatctatactgactcttagcatttttttcctgatatggagaattttagaaagttcatcttcctgtctcagtgtttatttatctctgactaggtgatttcctcctcccccaattgtctgagaaatgaacttttatttttttgagacagagtcttgctt

SEQ ID NO: 35512 - DNA, 389 bp, Homo sapiens
ttttagaaccaaggaattttatagctagacaagatcttggaagtcttccaatctagcctctttattttgtacatatggaaactgaggcacaaagaggttcagcaacttccccaaggtcacatagctggtagaggtaggctgggactagaacccaggtctgtgtgactccaaagtctgtgctcctcccactatactgcttcacagataggagctgatctgcctcaaatcttctgccccttggcctttccacaactctgcattgctgccatctaacagtgccttccactggtgccatgctaaagctcgttaggaggcaacttaacattgttctgtaaaagctctacagatgtaggatgctagctatctgttctccccggaaatcttttcaa

SEQ ID NO: 35513 - DNA, 488 bp, Homo sapiens
gactcaaagaacactatcaaccagcatgacctcattgatatttatagaacattccatacagtaagagcataatacacattttattcatgtctacatagaacatacgccgagatagaccatataccaggccataaaattagttgcaatacatttaaaatatttaaatcatacacaatatgttctttgtctacaacagaaataataacataaatatttccagaaaatccccaaatatttggaaattatcacactgttaaatagctcatggtcaaaaacaaataaaaatatataaaaatactttgaatggaattaaaatgaaaatgcacatgttaaaatctgtgagatgcaagccgggcatggtgatgagtgtctatatagtcctagctactcaggagactgaggcaggaagatcacccgggcccaggagtttgagttcagtctgggcaacatagtgagaatctgccccccacaaaagtaaataaataaat

SEQ ID NO: 35514 - DNA, 434 bp, Homo sapiens
cctgggcccctttactcttgttgctctaccatttctaacactcagctgctacttcatggttctgtttggctgctatagctatagccatcctttttacattctagtcaacagggaggaaaaagaggagatactttctccttttaaagaaacttcccagcagttgtccagaacttttagtccagttggccatacccagttgtaagggagcccggaaaataagtttttattttaggcagccttgtgtgcagatagtttctaccactgtagggaaaggagagaacatatgtggcagggataacagcctctaccaggataagctcttgggagctttgaatggctcaatcagtaaacaatattgcttattataagtagtgcactatgaaagatgaattgtgggaaaatgagggagattgggggaaggagaacagaattga

SEQ ID NO: 35515 - DNA, 534 bp, Homo sapiens
caggccatcgaccggaagcagtctgtggcttggaggttggggatccctgctatatgggccagaaatgtgaaagaggtgttcagtggggagtatacttctaacttgaatacattcttttcagcatttctacttattttatcaaaaggtaattttttttctcaggaaataaagcaataggcaattgttttttatagtttttctgtacagagccttattcaattatactaccaatgtaatcctattgcactgctcaacagaatcagaataagaagaacttccaagtacaatttgaaaataaaagtatctttcaagaatttgcactgtactgcattatttgatttgaaaaaaaaaaaaaatcagaccacttccatttcttgatgaaacaactaactcattggctaactttcaactggctctcttcagtggctttgagaatgtggcacttccatcataccttgcctgtagtaccaccctaggacttttttaaatggaaaatattttaaaagataattgattcgtatgcttccggtcgaa

SEQ ID NO: 35516 - DNA, 692 bp, Homo sapiens
aacgtgccccaccctaggcccgggcctgctggcttcatagctctcatcattcccacggaaccttaagacctgaggacagaaaggaaggaaacaagcccagtagtccgtgaaaatccagggtcccgccactccaggtgtctgcagcagagctgaacacacgtaggctcttgccaggaggggcatttgtatgtgctgagcattccttatattctcaatatgacgcctttgaaagatctgtggtttgcaaatatttactctcagtccataacttatctttccaacctcttaccaggctcttttgctgaataaaagttttaaattttgaagtctaatatatttttaatttttttattttatggatcatactttttgtgtcaggtttgagaagtctgcaccaaagtatgtcctgtggttttcccttaggtcatcttcaacaagtttcatagtattttgtttagatgtaaatctgtggcccattttgagttagtttttgcacaagagttgaggtcaaggttctttttttgcctgtgatgttcagtggctctggcaccatttgttgaaaacatgatagccaatgtcaagacttaatagttataataatcaggagcttttgtttctttttgttttgtttttagtaactgccagtcactgcttgtggtatacatacacaatggaatactattcagtcttaa

SEQ ID NO: 35517 - DNA, 545 bp, Homo sapiens
ctgttcccagccaaatgtggtcgttaatagataacaatttcttagtaactttaagaaataattaaaatttagttgtcagaattaaaactacaacaaggtatcactgtacaccttaattagaatggctaaaatgagaaaaattctggcaaagatacataccaacttaaaccatcatatactgttaatataaggaatgtggtgcacttccttggaaaacttcatagtttcttaaaaggcgaaatatactatccagtgatccagtcagttcacttctaggtatttacccaagagaaatgaaagcagggctgggcgtggtggctcacccctgttatcctttgggaggccaagccagaaggatttctggaggccaggaattcaagaccagcctggcaacatagcccaatcctatctctattgaaaagaaggaaagaaagaaatgaaagcatatgtccatacaggtgttcacagcagctttatttgtaacagctgaaaattgacaacgcaaatattcaatggatgatgagataaacacattgttatatagc

SEQ ID NO: 35518 - DNA, 341 bp, Homo sapiens
ttgaaagagaattggagagagaaaacctttctcaccatgtggtacccaaggagttcaagctgaatctgtgtccacgtgagatctgctcggcgtcactaagcactcatctctcactgctagagatgcccggcagagcgaatgctagtggggcttcccaatacatccatatctggaatttccacctggctccactatttaccagcacacaccacccaggacaagtctgttttcttcccggtaaaccaggattcacagcacgcactgcacagtgtggttgtgagattatgataaaatgccagaaacactcagatattagggagctggtgaaagtggatttgact

SEQ ID NO: 35519 - DNA, 297 bp, Homo sapiens
aagttcttgagcctttattaaccctgtgcccaaacaaggctgccaaatgaaagcagcaaagacatttattaaaaatttatctgactttccccttcatatgcaagaaaaaccaagaacacttccactgcagtttagtgtgactggttatcccctgaaatttatcaactaccttcttcattaacacaagagataatgcagggaaatagcctaaacagtcaaaacttcatcttcaaggctttcacaacagaaccataaaatcctcttccacttgtgaatcaagtaagtatacaaaccctg

SEQ ID NO: 35520 - DNA, 733 bp, Homo sapiens
cagtcacttgttattctgacaagtcatttgttttcagttcatctgtcgcatctgtcaagaaaaacacagactgtcttctaaaagtccgtttttaactattttattttttttcaatgacaaattccacttgtaccatagaagccatattctgcatgttggagaggcccctttgtggtccctcatccctgggttcttcctgggcatcctatggcctcccctctggtgacaggcagcaccccgaagacttaattttgattcttaaaaagggacagatccctccttccacccttgtccaggtacttccagagggtgggtccccttctcatgggaacatactacccccactcaccagaccacagtgatgagtccagcccagactgtgggccatgaaagcctaagctcccaaaacaaacaagatgccagggacactgcagccatctcagaggacaccgaaagacattttaaagccaagggaagcacagcagaacatcagctgctggacaccaagggagccacagctcgagggggttcgtgctccaacagcagatggagctacacccttcccgatgacgtcacatcctaataaagccctgtttgcagtggctgctgtgataaaaaagcaagctctgcatgaaatcaacatggaacaggaaacaaggggtggggtgggacggagtccaatctgattctgaagtttgagaagctgtacaacccattagtaattgtggctatt

SEQ ID NO: 35521 - DNA, 191 bp, Homo sapiens
taacttatcttcctgcagtacagagcccacttggattatatttgagaaaaaaaaaaaaaaacctccctttcacgctgaggcactgggataggtgacagtgactaaggtcagggcctttactcacctgcccctcctctgggtcatgatcatgtggtgaaaactcagagcagtaatgtttgcattggcctgga

SEQ ID NO: 35522 - DNA, 540 bp, Homo sapiens
catttcaccaaaagtgtgacagaaggaaaccaagtacaccatctctctcttaccaaaccaaagctattgcatgtgcattctgggagaaaaaaatggtccaaatatgttatggagggggtgccagcccagtgtcatcctcttactattgccataggatcttggctgatggcatcagacgaaaaacaagtttatcgattactttcaaccattaagctcactcctccatgaaaaataagtcacaagtccaatgtctcttattaaaataagcactgcaaaatataaaggactcacagttttaaaatgggacacacgttctctaagcggtgaaccactttagaggtgtactgtttacattgtataaagtcccctggagccagggttaggaagcgcatctgttctttggtgttctgggatgaaggagaaaggaaaatgtgctgccagaagtgagtgggaaggagcccatgagataaaggaagtaaatccatttgctgattgcaataataatggtaatacacgaagctatacatacatacatacata

SEQ ID NO: 35523 - DNA, 243 bp, Homo sapiens
ttggcaggcgaatctgggaaaggtctcatggaagaaatgttactgaccttgaagaatgagtaattttgattgggggagagggagaagcagcatgggcaggagacagggaagcgtgtaagtgcacggcacatccaagagagccaggagagtgcagcgaagtgcaggcttcatagaaagccaacggaggacgatgaggatgggaagggaagttggagcccatcaccaaagcattaaattccatag

SEQ ID NO: 35524 - DNA, 769 bp, Homo sapiens
aagaaatcccctgatctaagaaaatggctataaaagacatacagggattagagtaatttagactacagagtgagttaaaaatagaactgggttgttaaattttctgattttgataactactagaattgtgtgagaaaatggccttgttcttaagacatacacactgaagaatgtaggagtaaaaaggcctcgtgtctgcaacttactctcaaatggttccaaaacatatgcactgatataaatatattagcaagggtatggatggtaaatcacaaggagcaaagtgttaaccactttgaatctgggtaagggcatatgggagtttgttctagttttaaaaggtttcccaacacttggggaggttgaggtgggccgatcacttaagcccaggagtttgagaccagcctgggcaacacagggcttgagctgccatgctcggcctaaattttaaaattgaagtattttaaatgtaaatgtaatgtgaaagtattttgaatgtaaaatattttttgttacacaacttcattgttttagtaggactgtattgcattttacctgttaaaaatttggcatctgaattaagatgtgctgtaagtgtgaaatacacactagatttcaaagacttagtaagaaaaacagattgtaaaagatctcattatttttatattgactacatattgaagtgataatattttagacatgtcaggttaaatagaatataagttaaattattaaaattaatccatttttactgttttaaaaaaaaaaa

SEQ ID NO: 35525 - DNA, 756 bp, Homo sapiens
tgggctcctgagtagctgggattacaggcatgtgccatgtccagctaattttttggaattttttgtagtgataaggtcttgctatgttgtccaggctaatctcaaactcctggtctcaagcaatcctcccaccttagcctcccaaagcattgggattacaggtgtaagccactgtgcctagccctgtaagaggctttaatgggcagctatagtttattggatgcttattatgagatgagcattggctaaatgcttgaccagcactatttaatcatggcaaatacctatgagataggtaccgctattatacttatctgacatatcaactacaaacacagagaggtgaagtaacttacagtcacacatctacacctgcttaaagaacagaataagaggccaggcatggtggcttaatgtctggtcaatcgcggcagcgactttggaaggctgaggtgggaggattgcttgagcctaggagttcgagaccagcctaggcaacacagtgagaccacatctgtatttaaaacaaaacaaaacaaaacaaaacagagtaaggataggaactcaattctgcctattctaaccaactatagaatatttgagtttgcttctcatcaacatctctgcctagtggcagtcatcctgctattcttgcatacctcactgcgtgacaaggtaatcacctccttcatagccagcccattccagtggtggacagttctggccctcagaaagtcagttctaattctactgagc

SEQ ID NO: 35526 - DNA, 1026 bp, Homo sapiens
atctccgggccagagcccctcccctcggcccgcgcgggaggagtgtgacccaggtgccgcttcctctcgccgccgagggtcaggagcccgggagcgcgaccctcccccggcccggcctggcccggcctggccagtccccgcggtctctgcccgggctgacgcccaggaatgtggtcgacgagaagccccaacagcacggcgtggcctctcagcctcgagcctgatccagggatgtctggatggccggatggcagaatggagacctccacccccaccataatggacattgtcgtcattgcaggtgtgattgctgctgtggccatcgtcctagtctccctcctcttcgtcatgctgcgctacatgtaccggcacaagggcacgtaccacaccaatgaggccaagggcacggagtttgctgagagtgcagatgcagccctgcagggagaccctgccctccaagatgctggtgatagcagcagaaaggagtactttatttgagggacaacagacttcacttccctgaatgcctcccccatctccatcaggaaaaatacaccccatcgcccagcacccctgctgataccaccagacagagagagagagcacttgattcttcccgagatagccacctggaaacactaggtgcctgcccagggaggaacggaggaggactcgcgctacaagaggccactcccagggacccagggaggcgatggccaccccagaggccaccttttgctccacggaggtgggagaaaatctgggcacatggggccccctgggcagtgcaggacaacatcagctcactggcaggaaagtccttgttgagggtgagggggtgctggggtacccgggggctggggaagcaaggaaataagtcatctgtatgctgactggggataatggcatcaaatgtcagtccttgacatttggggggaacagcaggtgccagagctaaaaggtacctttgtctgccattgatccagctcagaacgattggaaataaatttgaaatgtaaccgagca

SEQ ID NO: 35527 - DNA, 1556 bp, Homo sapiens
atctccgggccagagcccctcccctcggcccgcgcgggaggagtgtgacccaggtgccgcttcctctcgccgccgagggtcaggagcccgggagcgcgaccctcccccggcccggcctggcccggcctggccagtccccgcggtctctgcccgggctgacgcccaggaatgtggtcgacgagaagccccaacagcacggcgtggcctctcagcctcgagcctgatccggggatggcctctgcctccaccacaatgcatactaccaccattgcagagcctgatccagggatgtctggatggccggatggcagaatggagacctccacccccaccataatggacattgtcgtcattgcaggtgtgattgctgctgtggccatcgtcctagtctccctcctcttcgtcatgctgcgctacatgtaccggcacaagggcacgtaccacaccaatgaggccaagggcacggagtttgctgagagtgcagatgcagccctgcagggagaccctgccctccaagatgctggtgatagcagcagaaaggagtactttatttgagggacaacagacttcacttccctgaatgcctcccccatctccatcaggaaaaatacaccccatcgcccagcacccctgctgataccaccagacagagagagagagcacttgattcttcccgagatagccacctggaaacactaggtgcctgcccagggaggaacggaggaggactcgcgctacaagaggccactcccagggacccagggaggcgatggccaccccagaggccaccttttgctccacggaggtgggagaaaatctgggcacatggggccccctgggcagtgcaggacaacatcagctcactggcaggaaagtccttgttgagggtgagggggtgctggggtacccgggggctggggaagcaaggaaataagtcatctgtatgctgactggggataatggcatcaaatgtcagtccttgacatttggggggaacagcaggtgccagagctaaaaggtacctttgtctgccattgatccagctcagaacgattggaaataaatttgaaatgtaaccgagcaaaaaaaaaaataaaaaaaaaaaaaaaaaaaaaaagaaaaaaaaaaaaaaaaaaaaaaaaaaaaaacatgaaaaacagtatagaaccaacaaaatttagactaaaacaagtttatgcatgcgtccgccaattgagtttacttgtcaaaaagcccttatagggagccgaatttcagggccactgggcccaatttaacatatgaggggcggggaaaaacttgggggtccccattttaaaccttttgcaaaagaaccccctttgggcagctcaataaataggctgggggctgtaccaattgtccttcgcggaaatgccggggactgactgcctaatggaaatttgttgccaaaatattttggccaaattggcgtaaaaaattggccccccactattttttaacacaaaaggcaaaattgtaaaatccttttaaatttaacgcatcacctgtattggataagggctttttcttttgga

SEQ ID NO: 35528 - DNA, 1388 bp, Homo sapiens
atctccgggccagagcccctcccctcggcccgcgcgggaggagtgtgacccaggtgccgcttcctctcgccgccgagggtcaggagcccgggagcgcgaccctcccccggcccggcctggcccggcctggccagtccccgcggtctctgcccgggctgacgcccaggaatgtggtcgacgagaagccccaacagcacggcgtggcctctcagcctcggtcctgggttaaagggacaggagccactgtcattattccaattcagtcactgaggaggtgaggctgagaggcattctcatgtctgaagaggatgggcttgcctgacccccgcccccgtgcccagcccagcccagcagcccaagcagttctccaggactcaggtttcagaccttcaacacttgccttgggagacaaacagcggtgcagcccttgcttgcaagccattccacattagacttcggattgatttatggcaggatccctgctgtgcgagaaactgcagggaggggtggggggcggctatttcttgctgctaactcaggcaggatgtgtctatatcctgtctcagtttatgtagctgctcatcagagccagaggttagagcggagaggacccacttccgccaggccggcctgctctgctcagctcagctgggctaggcccaatgccacagttactgcgcgtgagtcatgcacagcaatccattgccttgcccttggatggaaggggtcaaggctcagtgagaagacggccaggtttggcagctttatatagaattcaccgcctctggcagaagcagaggattgcattaagtgccaaatgaaattccacctcagccattgctcaattcctccagatgtcactggcactgggagtcacatgatgctggtggtcagcagctggacccttccaagggtgcccgtggttgggcaagtatttctggggacttgcagagctccctggggagcaaagggttgtgaagtacaaggcattctgcgcttgtggtgggaacaagtgaaccccatctgcagtgagtaggaagaggtcccctcaacagaggtgagaggttgggccaagtcaagtcagtttgcctcttcaggtggcagacctgtatgtacatctatgcctcaagtgcctgtctgaggccacagccaaaacatcttccagtaactgagcatacccagtgggccaacaagcacgctctaaatacaaaaccaaacaaacagtaaagttaacagtgaatgaagagttaaaaataggagaaagacaccttctccctacctcaatggcaattactttatttattgaggataatccttctagaagtaaatttgctgatacaaatatttcttattttacataataaaaatgcattttatatattttactt

SEQ ID NO: 35529 - DNA, 810 bp, Homo sapiens
atctccgggccagagcccctcccctcggcccgcgcgggaggagtgtgacccaggtgccgcttcctctcgccgccgagggtcaggagcccgggagcgcgaccctcccccggcccggcctggcccggcctggccagtccccgcggtctctgcccgggctgacgcccaggaatgtggtcgacgagaagccccaacagcacggcgtggcctctcagcctcggaagtctccaaggacccccatgaaacacctgcatttcctgtcatgattttgaggctgaaatcatcttcctcctcccagaacacctaggtgttctagtctgaagccatcctcactctcaactcccctccttcgagccctcaccctgtgcctgaattcttccttctttgctgggacagatggacaggaggaagacaggaagtggggaaccccttcaacaactcctatggcagaggggagccataggagatgggccgggaaatgtaaagaccagcccacgcaggaaaaaaagagaactttttagcacagtgtcatctgaaaatgcaagagaagagaggctcttggtggcaacagaggagtgtgacttccagcctcagggctagcacctgacccctgctctccgtccacatctgaaaaataccactggccctgagaatccattgcaactgaggttctgcaccccaacagctgcactcaagctgccaactgaagcagagagcactgcccgcactgcagggttgtgcctgtgtgccccgctgcctccaggggtggctgccttctgccagagaatggacagctgacatcctgaggacata

SEQ ID NO: 35530 - DNA, 234 bp, Homo sapiens
cgtgtggttctccgtgtggttcttgtctggttcttgtctggttcttgtgctggggtacccgggggctggggaagcaaggaaataagtcatctgtatgctgactggggataatggcatcaaatgtcagtccttgacatttggggggaacagcaggtgccagagctaaaaggtacctttgtctgccattgatccagctcagaacgattggaaataaatttgaaatgtaaccgagca

SEQ ID NO: 35531 - DNA, 1083 bp, Homo sapiens
atctccgggccagagcccctcccctcggcccgcgcgggaggagtgtgacccaggtgccgcttcctctcgccgccgagggtcaggagcccgggagcgcgaccctcccccggcccggcctggcccggcctggccagtccccgcggtctctgcccgggctgacgcccaggaatgtggtcgacgagaagccccaacagcacggcgtggcctctcagcctcgagcctgatccggggatggcctctgcctccaccacaatgcatactaccaccattgcagagcctgatccagggatgtctggatggccggatggcagaatggagacctccacccccaccataatggacattgtcgtcattgcaggtgtgattgctgctgtggccatcgtcctagtctccctcctcttcgtcatgctgcgctacatgtaccggcacaagggcacgtaccacaccaatgaggccaagggcacggagtttgctgagagtgcagatgcagccctgcagggagaccctgccctccaagatgctggtgatagcagcagaaaggagtactttatttgagggacaacagacttcacttccctgaatgcctcccccatctccatcaggaaaaatacaccccatcgcccagcacccctgctgataccaccagacagagagagagagcacttgattcttcccgagatagccacctggaaacactaggtgcctgcccagggaggaacggaggaggactcgcgctacaagaggccactcccagggacccagggaggcgatggccaccccagaggccaccttttgctccacggaggtgggagaaaatctgggcacatggggccccctgggcagtgcaggacaacatcagctcactggcaggaaagtccttgttgagggtgagggggtgctggggtacccgggggctggggaagcaaggaaataagtcatctgtatgctgactggggataatggcatcaaatgtcagtccttgacatttggggggaacagcaggtgccagagctaaaaggtacctttgtctgccattgatccagctcagaacgattggaaataaatttgaaatgtaaccgagca

SEQ ID NO: 35532 - DNA, 1027 bp, Homo sapiens
ccagcatgttacggaggcgatacgctgggtttgtcattccattccacggggcgggcgttttccttgttctgttccatgtccccgcggtctctgcccgggctgacgcccaggaatgtggtcgacgagaagccccaacagcacggcgtggcctctcagcctcgagcctgatccggggatggcctctgcctccaccacaatgcatactaccaccattgcagagcctgatccagggatgtctggatggccggatggcagaatggagacctccacccccaccataatggacattgtcgtcattgcaggtgtgattgctgctgtggccatcgtcctagtctccctcctcttcgtcatgctgcgctacatgtaccggcacaagggcacgtaccacaccaatgaggccaagggcacggagtttgctgagagtgcagatgcagccctgcagggagaccctgccctccaagatgctggtgatagcagcagaaaggagtactttatttgagggacaacagacttcacttccctgaatgcctcccccatctccatcaggaaaaatacaccccatcgcccagcacccctgctgataccaccagacagagagagagagcacttgattcttcccgagatagccacctggaaacactaggtgcctgcccagggaggaacggaggaggactcgcgctacaagaggccactcccagggacccagggaggcgatggccaccccagaggccaccttttgctccacggaggtgggagaaaatctgggcacatggggccccctgggcagtgcaggacaacatcagctcactggcaggaaagtccttgttgagggtgagggggtgctggggtacccgggggctggggaagcaaggaaataagtcatctgtatgctgactggggataatggcatcaaatgtcagtccttgacatttggggggaacagcaggtgccagagctaaaaggtacctttgtctgccattgatccagctcagaacgattggaaataaatttgaaatgtaaccgagca

SEQ ID NO: 35533 - DNA, 829 bp, Homo sapiens
cctctcaagcgtttcagggtgtgtaggtgggttccatttacagtgaactggtacagttcctgatcagcgggtgaagcaatctcataaatgttcatgtcattcaggtgtgattgctgctgtggccatcgtcctagtctccctcctcttcgtcatgctgcgctacatgtaccggcacaagggcacgtaccacaccaatgaggccaagggcacggagtttgctgagagtgcagatgcagccctgcagggagaccctgccctccaagatgctggtgatagcagcagaaaggagtactttatttgagggacaacagacttcacttccctgaatgcctcccccatctccatcaggaaaaatacaccccatcgcccagcacccctgctgataccaccagacagagagagagagcacttgattcttcccgagatagccacctggaaacactaggtgcctgcccagggaggaacggaggaggactcgcgctacaagaggccactcccagggacccagggaggcgatggccaccccagaggccaccttttgctccacggaggtgggagaaaatctgggcacatggggccccctgggcagtgcaggacaacatcagctcactggcaggaaagtccttgttgagggtgagggggtgctggggtacccgggggctggggaagcaaggaaataagtcatctgtatgctgactggggataatggcatcaaatgtcagtccttgacatttggggggaacagcaggtgccagagctaaaaggtacctttgtctgccattgatccagctcagaacgattggaaataaatttgaaatgtaaccgagca

SEQ ID NO: 35534 - DNA, 1536 bp, Homo sapiens
atctccgggccagagcccctcccctcggcccgcgcgggaggagtgtgacccaggtgccgcttcctctcgccgccgagggtcaggagcccgggagcgcgaccctcccccggcccggcctggcccggcctggccagtccccgcggtctctgcccgggctgacgcccaggaatgtggtcgacgagaagccccaacagcacggcgtggcctctcagcctcgagcctgatccggggatggcctctgcctccaccacaatgcatactaccaccattgcagagcctgatccagggatgtctggatggccggatggcagaatggagacctccacccccaccataatggacattgtcgtcattgcaggtgtgattgctgctgtggccatcgtcctagtctccctcctcttcgtcatgctgcgctacatgtaccggcacaagggcacgtaccacaccaatgaggccaagggcacggagtttgctgagagtgcagatgcagccctgcagggagaccctgccctccaagatgctggtgatagcagcagaaaggagtactttatttgagggacaacagacttcacttccctgaatgcctcccccatctccatcaggaaaaatacaccccatcgcccagcacccctgctgataccaccagacagagagagagagcacttgattcttcccgagatagccacctggaaacactaggtgcctgcccagggaggaacggaggaggactcgcgctacaagaggccactcccagggacccagggaggcgatggccaccccagaggccaccttttgctccacggaggtgggagaaaatctgggcacatggggccccctgggcagtgcaggacaacatcagctcactggcaggaaagtccttgttgagggtgagggggtgctggggtacccgggggctggggaagcaaggaaataagtcatctgtatgctgactggggataatggcatcaaatgtcagtccttgacatttggggggaacagcaggtgccagagctaaaaggtacctttgtctgccattgatccagctcagaacgattggaaataaatttgaaatgtaaccgagcactaatcgtatacagacaataaggactatcgaatgaccacatttataagttgctaatgaaaagagagctgagcagggtagcacaagctgtaagacatgacactgtgagaaagagttaggtgcaagtgtaaaagatgtaggatgcatcagacacagtgatttgaggcactgtcatgatgaaacacgctgtgacctacatacaacagttgagtcaggacaagcttgcatgaacagtggtacagacagcttgcgtaaactgacgctttaggccgttgagttcgtacttgcatggccacagaaatatgagctatataaccatacctgaggctacagagtgctcttaggttgaacaagaaaatgttttctgaggcaaccgaatgatatattggaagctcaaaatctgtttgtttaccactggaagagatccatggttcctaaacatgccaactcaaagg

SEQ ID NO: 35535 - DNA, 980 bp, Homo sapiens
atctccgggccagagcccctcccctcggcccgcgcgggaggagtgtgacccaggtgccgcttcctctcgccgccgagggtcaggagcccgggagcgcgaccctcccccggcccggcctggcccggcctggccagtccccgcggtctctgcccgggctgacgcccaggaatgtggtcgacgagaagccccaacagcacggcgtggcctctcagcctcgagcctgatccggggatggcctctgcctccaccacaatgcatactaccaccattgcagagcctgatccagggatgtctggatggccggatggcagaatggagacctccacccccaccataatggacattgtcgtcattgcaggtgtgattgctgctgtggccatcgtcctagtctccctcctcttcgtcatgctgcgctacatgtaccggcacaagggcacgtaccacaccaatgaggccaagggcacggagtttgctgagagtgcagatgcagccctgcagggagaccctgccctccaagatgctggtgatagcagcagaaaggagtactttatttgagggacaacagacttcacttccctgaatgcctcccccatctccatcaggaaaaatacaccccatcgcccagcacccctgctgataccaccagacagagagagagagcacttgattcttcccgagatagccaccttttgctccacggaggtgggagaaaatctgggcacatggggccccctgggcagtgcaggacaacatcagctcactggcaggaaagtccttgttgagggtgagggggtgctggggtacccgggggctggggaagcaaggaaataagtcatctgtatgctgactggggataatggcatcaaatgtcagtccttgacatttggggggaacagcaggtgccagagctaaaaggtacctttgtctgccattgatccagctcagaacgattggaaataaatttgaaatgtaaccgagca

SEQ ID NO: 35536 - DNA, 939 bp, Homo sapiens
atctccgggccagagcccctcccctcggcccgcgcgggaggagtgtgacccaggtgccgcttcctctcgccgccgagggtcaggagcccgggagcgcgaccctcccccggcccggcctggcccggcctggccagtccccgcggtctctgcccgggctgacgcccaggaatgtggtcgacgagaagccccaacagcacggcgtggcctctcagcctcgagcctgatccggggatggcctctgcctccaccacaatgcatactaccaccattgcagagcctgatccagggatgtctggatggccggatggcagaatggagacctccacccccaccataatggacattgtcgtcattgcaggtgtgattgctgctgtggccatcgtcctagtctccctcctcttcgtcatgctgcgctacatgtaccggcacaagggcacgtaccacaccaatgaggccaagggcacggagtttgctgagagtgcagatgcagccctgcagggagaccctgccctccaagatgctggtgatagcagcagaaaggagtactttatttgagggacaacagacttcacttccctgaatgcctcccccatctccatcaggaaaacagggacccagggaggcgatggccaccccagaggccaccttttgctccacggaggtgggagaaaatctgggcacatggggccccctgggcagtgcaggacaacatcagctcactggcaggaaagtccttgttgagggtgagggggtgctggggtacccgggggctggggaagcaaggaaataagtcatctgtatgctgactggggataatggcatcaaatgtcagtccttgacatttggggggaacagcaggtgccagagctaaaaggtacctttgtctgccattgatccagctcagaacgattggaaataaatttgaaatgtaaccgagca

SEQ ID NO: 35537 - DNA, 968 bp, Homo sapiens
agcagagaaagggaggaacggaggaggactcgcgctacaagaggccactcccagggacccagggaggcgatggccaccccagaggccaccttttgctccacggaggtgggagaaaatctgggcacatggggctgacgcccaggaatgtggtcgacgagaagccccaacagcacggcgtggcctctcagcctcgagcctgatccggggatggcctctgcctccaccacaatgcatactaccaccattgcagagcctgatccagggatgtctggatggccggatggcagaatggagacctccacccccaccataatggacattgtcgtcattgcaggtgtgattgctgctgtggccatcgtcctagtctccctcctcttcgtcatgctgcgctacatgtaccggcacaagggcacgtaccacaccaatgaggccaagggcacggagtttgctgagagtgcagatgcagccctgcagggagaccctgccctccaagatgctggtgatagcagcagaaaggagtactttatttgagggacaacagacttcacttccctgaatgcctcccccatctccatcaggaaaaatacaccccatcgcccagcacccctgctgataccaccagacagagagagagagcacttgattcttcccgagatagccacctggaaacactaggtgcctgcccagggaggaacggaggaggactcgcgctacaagaggccactccgtgcaggacaacatcagctcactggcaggaaagtccttgttgagggtgagggggtgctggggtacccgggggctggggaagcaaggaaataagtcatctgtatgctgactggggataatggcatcaaatgtcagtccttgacatttggggggaacagcaggtgccagagctaaaaggtacctttgtctgccattgatccagctcagaacgattggaaataaatttgaaatgtaaccgagca

SEQ ID NO: 35538 - DNA, 820 bp, Homo sapiens
atctccgggccagagcccctcccctcggcccgcgcgggaggagtgtgacccaggtgccgcttcctctcgccgccgagggtcaggagcccgggagcgcgaccctcccccggcccggcctggcccggcctggccagtccccgcggtctctgcccgggctgacgcccaggaatgtggtcgacgagaagccccaacagcacggcgtggcctctcagcctcgagcctgatccggggatggcctctgcctccaccacaatgcatactaccaccattgcagagcctgatccagggatgtctggatggccggatggcagaatggagacctccacccccaccataatggacattgtcgtcattgcaggtgtgattgctgctgtggccatcgtcctagtctccctcctcttcgtcatgctgcgctacatgtaccggcacaagggcacgtaccacaccaatgaggccaagggcacggagtttgctgagagtgcagatgcagccctgcagggagaccctgccctccaagatgctggtgatagcagcagaaaggagtactttatttgagggacaacagacttcacttccctgaatgcctcccccatctccatcaggaaaagaaagtccttgttgagggtgagggggtgctggggtacccgggggctggggaagcaaggaaataagtcatctgtatgctgactggggataatggcatcaaatgtcagtccttgacatttggggggaacagcaggtgccagagctaaaaggtacctttgtctgccattgatccagctcagaacgattggaaataaatttgaaatgtaaccgagca

SEQ ID NO: 35539 - DNA, 726 bp, Homo sapiens
cctctcaagcgtttcagggtgtgtaggtgggttccatttacagtgaactggtacagttcctgatcagcgggtgaagcaatctcataaatgttcatgtcattcaggtgtgattgctgctgtggccatcgtcctagtctccctcctcttcgtcatgctgcgctacatgtaccggcacaagggcacgtaccacaccaatgaggccaagggcacggagtttgctgagagtgcagatgcagccctgcagggagaccctgccctccaagatgctggtgatagcagcagaaaggagtactttatttgagggacaacagacttcacttccctgaatgcctcccccatctccatcaggaaaaatacaccccatcgcccagcacccctgctgataccaccagacagagagagagagcacttgattcttcccgagatagccaccttttgctccacggaggtgggagaaaatctgggcacatggggccccctgggcagtgcaggacaacatcagctcactggcaggaaagtccttgttgagggtgagggggtgctggggtacccgggggctggggaagcaaggaaataagtcatctgtatgctgactggggataatggcatcaaatgtcagtccttgacatttggggggaacagcaggtgccagagctaaaaggtacctttgtctgccattgatccagctcagaacgattggaaataaatttgaaatgtaaccgagca

SEQ ID NO: 35540 - DNA, 699 bp, Homo sapiens
  misc_feature (450)..(450): n is a, c, g, or t
ccagcatgttacggaggcgatacgctgggtttgtcattccattccacggggcgggcgttttccttgttctgttccatgtccccgcggtctctgcccgggctgacgcccaggaatgtggtcgacgagaagccccaacagcacggcgtggcctctcagcctcgttccctgaatgcctcccccatctccatcaggaaaaatacaccccatcgcccagcacccctgctgataccaccagacagagagagagagcacttgattcttcccgagatagccacctggaaacactaggtgcctgcccagggaggaacggaggaggactcgcgctacaagaggccactcccagggacccagggaggcgatggccaccccagaggccaccttttgctccacggaggtgggagaaaatctgggcacatggggccccctgggcaaggttgcaggacaacatcnagctcactgtgcaggacaacatcagctcactggcaggaaagtccttgttgagggtgagggggtgctggggtacccgggggctggggaagcaaggaaataagtcatctgtatgctgactggggataatggcatcaaatgtcagtccttgacatttggggggaacagcaggtgccagagctaaaaggtacctttgtctgccattgatccagctcagaacgattggaaataaatttgaaatgtaaccgagca

SEQ ID NO: 35541 - DNA, 696 bp, Homo sapiens
tgggtttccggccgaggctgcggccatggcagcatcttccctgacggtcaccttagggcggctggcgtccgcgtgcagccacagcatcctgagaccttcggggcccggagcagcctccctttggtctgcttctcgaaggttcaattcacagagcacttcatatctaccaggatatgttcctaaaacatccctgagttcaccaccttggccagaagttgttctgccagacccagttgaggagaccagacaccatgcagaggtcgtgaagaaggtgaatgagatgatcgtcacggggcagtatggcaggctctttgccgtggtgcactttgccagccgccagtggaaggtgacctctgaagacctgatcttaattggaaatgaactagaccttgcgtgtggagagagaattcgactggagaaggtcctgctggttggggcagacaacttcacgctgcttggcaagccactcctcggaaaggatcttgttcgagtagaagccacagtcattgaaaagacagaatcatggccaagaatcattatgagattcaggaaaaggaaaaacttcaagaagaaaagaatcgtcacgaccccgcagactgtcctccggataaacagcattgagattgctccgtgtttgttgtgattaccgagttaatacttacaaaaggataaaaataaactcctgcttcccaagga

SEQ ID NO: 35542 - DNA, 788 bp, Homo sapiens
tgggtttccggccgaggctgcggccatggcagcatcttccctgacggtcaccttagggcggctggcgtccgcgtgcagccacagcatcctgagaccttcggggcccggagcagcctccctttggtctgcttctcgaaggttcaattcacagagcacttcatatctaccaggatatgttcctaaaacatccctgagttcaccaccttggccagaagttgttctgccagacccagttgaggagaccagacaccatgcagaggtcgtgaagaaggtgaatgagatgatcgtcacggggcagtatggcaggctctttgccgtggtgcactttgccagccgccagtggaaggtgacctctgaagacctgatcttaattggaaatgaactagaccttgcgtgtggagagagaattcgactggagaaggtcctgctggttggggcagacaacttcacgctgcttggcaagccactcctcggaaaggatcttgttcgagtagaagccacagtcattgaaaagacagaatcatggccaagaatcattatgagattcaggaaaaggaaaaacttcaagaagaaaagaatcgtcacgaccccgcagactgtcctccggataaacagcattgagattgctccgtgtttgttgtgattaccgagttaatacttacaaaaggataaaaataaactcctgcttcccaaggaaaaaaaaaaaaaaaaaattgggggcggggaaatttaaaaattgggggggggccaggaatgaaggaggtaaaacggggaagggggtccaaaag

SEQ ID NO: 35543 - DNA, 1006 bp, Homo sapiens
tgggtttccggccgaggctgcggccatggcagcatcttccctgacggtcaccttagggcggctggcgtccgcgtgcagccacagcatcctgagaccttcggggcccggagcagcctccctttggtctgcttctcgaaggttcaattcacagagcacttcatatctaccaggatatgttcctaaaacatccctgagttcaccaccttggccagaagttgttctgccagacccagttgaggagaccagacaccatgcagaggtcgtgaagaaggtgaatgagatgatcgtcacggggcagtatggcaggctctttgccgtggtgcactttgccagccgccagtggaaggtgacctctgaagacctgatcttaattggaaatgaactagaccttgcgtgtggagagagaattcgactggagaaggtcctgctggttggggcagacaacttcacgctgcttggcaagccactcctcggaaaggatcttgttcgagtagaagccacagtcattgaaaagacagaatcatggccaagaatcattatgagattcaggaaaaggaaaaacttcaagaagaaaagaatcgtcacgaccccgcagactgtcctccggataaacagcattgagattgctccgtgtttgttgtgattaccgagttaatacttacaaaaggataaaaataaactcctgcttcccaaggagaaaaaaaaaaaaaaaaaaaaaaaaaaaaaaaaaaaaaaaaaaaaaacaaagaaaaaaagacaaagcaaagaaaaagaggaggagactaaaagacccaggggagccaaagagagaagagagagagggaagaggaggcacagaaggaagaaaaaaaacaaagagggagaacaccataaaacagacagaggaaaacaaaacagggaactaggaagagaacacaaagagaagcaaaggagaaaaacaaagaaaacgcgagaaaaaaggagaaaaagcgaaaacaaaaaaaaaggagacacgagaagaaaaacg

SEQ ID NO: 35544 - DNA, 663 bp, Homo sapiens
tgggtttccggccgaggctgcggccatggcagcatcttccctgacggtcaccttagggcggctggcgtccgcgtgcagccacagcatcctgagaccttcggggcccggagcagcctccctttggtctgcttctcgaagatatgttcctaaaacatccctgagttcaccaccttggccagaagttgttctgccagacccagttgaggagaccagacaccatgcagaggtcgtgaagaaggtgaatgagatgatcgtcacggggcagtatggcaggctctttgccgtggtgcactttgccagccgccagtggaaggtgacctctgaagacctgatcttaattggaaatgaactagaccttgcgtgtggagagagaattcgactggagaaggtcctgctggttggggcagacaacttcacgctgcttggcaagccactcctcggaaaggatcttgttcgagtagaagccacagtcattgaaaagacagaatcatggccaagaatcattatgagattcaggaaaaggaaaaacttcaagaagaaaagaatcgtcacgaccccgcagactgtcctccggataaacagcattgagattgctccgtgtttgttgtgattaccgagttaatacttacaaaaggataaaaataaactcctgcttcccaagga

SEQ ID NO: 35545 - DNA, 357 bp, Homo sapiens
ccagcgcagggcactcctggccatgaggcgtctggtgtcccagcctctgcacctgccaacagagtgaacgaacaagctagcgaggcagtcagtgcacacctggagataaacacggccatgtgcagcaggggacgttgccggggtcgcgctggctggggagggctgtgtgcagagcccctgctgtaactgatgacaacagtcagggtctgtggtcaagcctgtgacatcctttctttcagtcgtcacgaccccgcagactgtcctccggataaacagcattgagattgctccgtgtttgttgtgattaccgagttaatacttacaaaaggataaaaataaactcctgcttcccaagga

SEQ ID NO: 35546 - DNA, 234 bp, Homo sapiens
gcggccgcctactactactactactgctcgaattcaagcttctaacgatgtacgggaatcatggccaagaatcattatgagattcaggaaaaggaaaaacttcaagaagaaaagaatcgtcacgaccccgcagactgtcctccggataaacagcattgagattgctccgtgtttgttgtgattaccgagttaatacttacaaaaggataaaaataaactcctgcttcccaagga

SEQ ID NO: 35547 - DNA, 642 bp, Homo sapiens
tgggtttccggccgaggctgcggccatggcagcatcttccctgacggtcaccttagggcggctggcgtccgcgtgcagccacagcatcctgagaccttcggggcccggagcagcctccctttggtctgcttctcgaaggttcaattcacagagcacttcatatctaccaggatatgttcctgaggagaccagacaccatgcagaggtcgtgaagaaggtgaatgagatgatcgtcacggggcagtatggcaggctctttgccgtggtgcactttgccagccgccagtggaaggtgacctctgaagacctgatcttaattggaaatgaactagaccttgcgtgtggagagagaattcgactggagaaggtcctgctggttggggcagacaacttcacgctgcttggcaagccactcctcggaaaggatcttgttcgagtagaagccacagtcattgaaaagacagaatcatggccaagaatcattatgagattcaggaaaaggaaaaacttcaagaagaaaagaatcgtcacgaccccgcagactgtcctccggataaacagcattgagattgctccgtgtttgttgtgattaccgagttaatacttacaaaaggataaaaataaactcctgcttcccaagga

SEQ ID NO: 35548 - DNA, 792 bp, Homo sapiens
gacaccacaagcccagccttcttggatgggcacccttccagcactgagaagtacccaagtgagggctcttttgcagaacaatgagagttcctgctttgattattgaatgatgagccattgttccctgtggttctaaaaggatacagggagcctgtcctcggggttaccccagaggggcggggcctgtccgaaagagcgagccttttgttgccggggatcccttcctaacatttgtgtgtggccatttcttagaggatttgagctgccttttcaggtgcttgtgacatttgtctacgaaatgtgttttacagatatgttcctatatgttcctgaggagaccagacaccatgcagaggtcgtgaagaaggtgaatgagatgatcgtcacggggcagtatggcaggctctttgccgtggtgcactttgccagccgccagtggaaggtgacctctgaagacctgatcttaattggaaatgaactagaccttgcgtgtggagagagaattcgactggagaaggtcctgctggttggggcagacaacttcacgctgcttggcaagccactcctcggaaaggatcttgttcgagtagaagccacagtcattgaaaagacagaatcatggccaagaatcattatgagattcaggaaaaggaaaaacttcaagaagaaaagaatcgtcacgaccccgcagactgtcctccggataaacagcattgagattgctccgtgtttgttgtgattaccgagttaatacttacaaaaggataaaaataaactcctgcttcccaagga

SEQ ID NO: 35549 - DNA, 671 bp, Homo sapiens
gataagcaggccaggcaggctccagtctcccagcgaagcaagaaggtccaggtatgccagcatacctggacttctgggcccggagcagcctccctttggtctgcttctcgaaggttcaattcacagagcacttcatatctaccaggatatgttcctaaaacatccctgagttcaccaccttggccagaagttgttctgccagacccagttgaggagaccagacaccatgcagaggtcgtgaagaaggtgaatgagatgatcgtcacggggcagtatggcaggctctttgccgtggtgcactttgccagccgccagtggaaggtgacctctgaagacctgatcttaattggaaatgaactagaccttgcgtgtggagagagaattcgactggagaaggtcctgctggttggggcagacaacttcacgctgcttggcaagccactcctcggaaaggatcttgttcgagtagaagccacagtcattgaaaagacagaatcatggccaagaatcattatgagattcaggaaaaggaaaaacttcaagaagaaaagaatcgtcacgaccccgcagactgtcctccggataaacagcattgagattgctccgtgtttgttgtgattaccgagttaatacttacaaaaggataaaaataaactcctgcttcccaagga

SEQ ID NO: 35550 - DNA, 599 bp, Homo sapiens
ctctttctgcttcatcttcttcagaaggtccaggtatgccggttcaattcacagagcacttcatatctaccaggatatgttcctaaaacatccctgagttcaccaccttggccagaagttgttctgccagacccagttgaggagaccagacaccatgcagaggtcgtgaagaaggtgaatgagatgatcgtcacggggcagtatggcaggctctttgccgtggtgcactttgccagccgccagtggaaggtgacctctgaagacctgatcttaattggaaatgaactagaccttgcgtgtggagagagaattcgactggagaaggtcctgctggttggggcagacaacttcacgctgcttggcaagccactcctcggaaaggatcttgttcgagtagaagccacagtcattgaaaagacagaatcatggccaagaatcattatgagattcaggaaaaggaaaaacttcaagaagaaaagaatcgtcacgaccccgcagactgtcctccggataaacagcattgagattgctccgtgtttgttgtgattaccgagttaatacttacaaaaggataaaaataaactcctgcttcccaagga

SEQ ID NO: 35551 - DNA, 777 bp, Homo sapiens
tgggtttccggccgaggctgcggccatggcagcatcttccctgacggtcaccttagggcggctggcgtccgcgtgcagccacagcatcctgagaccttcggggcccggagcagcctccctttggtctgcttctcgaaggttcaattcacagagcacttcatatctaccaggatatgttcctaaaacatccctgagttcaccaccttggccagaagttgttctgccagacccagttgaggagaccagacaccatgcagaggtcgtgaagaaggtgaatgagatgatcgtcacggggcagtatggcaggctctttgccgtggtgcactttgccagccgccagtggaaggtgacctctgaagacctgatcttaattggaaatgaactagaccttgcgtgtggagagagaattcgactggagaaggtcctgctggttggggcagacaacttcacgctgcttggcaagccactcctcgggtaatggctgtgaagtgctgggctttgtctggggctccagggctggacatgcagacagtggtcacagtgcaattaggccagaaaggatcttgttcgagtagaagccacagtcattgaaaagacagaatcatggccaagaatcattatgagattcaggaaaaggaaaaacttcaagaagaaaagaatcgtcacgaccccgcagactgtcctccggataaacagcattgagattgctccgtgtttgttgtgattaccgagttaatacttacaaaaggataaaaataaactcctgcttcccaagga

SEQ ID NO: 35552 - DNA, 679 bp, Homo sapiens
tgactcaggaatcggctctggaaggtgaagctagaggaaccagacctcatcagcccaacatcaaagacaccatcggaacagcagcgcccgcagcacccaccccgcaccggcgactccatcttcatggccaccccctgcggcggacggttgaccaccagccaccacatcaccacagcatcctgagaccttcggggcccggagcagcctccctttggtctgcttctcgaaggttcaattcacagagcacttcatatctaccaggatatgttcctaaaacatccctgagttcaccaccttggccagaagttgttctgccagacccagttgaggtgacctctgaagacctgatcttaattggaaatgaactagaccttgcgtgtggagagagaattcgactggagaaggtcctgctggttggggcagacaacttcacgctgcttggcaagccactcctcggaaaggatcttgttcgagtagaagccacagtcattgaaaagacagaatcatggccaagaatcattatgagattcaggaaaaggaaaaacttcaagaagaaaagaatcgtcacgaccccgcagactgtcctccggataaacagcattgagattgctccgtgtttgttgtgattaccgagttaatacttacaaaaggataaaaataaactcctgcttcccaagga

SEQ ID NO: 35553 - DNA, 399 bp, Homo sapiens
ggcgcttgtagatgatgtggctaactgatctcaacacatataaccagtagctgtaagtgacgttcttgtagttttgctcacctaggtgtttctgtgggcaggctgtcatgcagtggttcataccatgtaccaggagcagcagctgtgcatttagcatcataaagggcagtttgcatttgtagtattaatggtaatgatctgtgtttctcttcttccctcagcctccctttggtctgcttctcgaaggttcaattcacagagcacttcatatctaccaggtaatatcaaaatgtgggttttggtgcctcttttcctttcatttgtagaaccatctttctaaagtcaaaacttcctaccttttggttctcaataatatttaaatttcctcttttgttttta

SEQ ID NO: 35554 - DNA, 1540 bp, Homo sapiens
aattatatatttttactctatgtttctctacatgtttttttctttccgggctggcggaagaggcacgtgcgctgctgaatggagctggtcgctggttgctacgagcaggtcctctttgggttcgctgtacacccggagcccgaggcttgcggcgaccacgagcaatggactcttgtggctgacttcactcaccatgctcacactgcctccttgtcagcagtagctgtaaatagtcgttttgtggtcactgggagcaaagatgaaacaattcacatttatgacatgaaaaagaagattgagcatggggctctagtgcatcacagtggtacaataacttgcctgaaattctatggcaacaggcatttaatcagtggagcggaagatggactcatctgtatctgggatgcaaagaaatgggaatgcctgaagtcaattaaagctcacaaaggacaggtgaccttcctttctattcacccatctggcaagttggccctgtcggttggtacagataaaactttaagaacgtggaatcttgtagaaggaagatcagcattcataaaaaatataaaacaaaatgctcacatagtagaatggtccccaagaggagagcagtatgtagttatcatacagaataaaatagacatctatcagcttgacactgcatccattagtggcaccatcacaaatgaaaagagaatttcctctgttaaatttctttcagagtctgtccttgcagtggctggagatgaagaagttataaggttttttgactgtgattcactagtgtgcctctgcgaatttaaagctcatgaaaacagggtaaaggacatgttcagttttgaaattccagagcatcatgttattgtttcagcatcgagtgatggtttcatcaaaatgtggaagcttaagcaggataagaaagttcccccatctttactctgtgaaataaacactaatgccaggctgacgtgtcttggagtgtggctagacaaagtggcagacatgaaagaaagccttcctccagctgcagagccttctcctgtaagtaaagaacagtccaaaattggcaaaaaggagcctggtgacacagtgcacaaagaagaaaagcggtcaaaacctaacacaaagaaacgcggtttaacaggtgacagtaagaaagcaacaaaagaaagtggcctgatatcaaccaagaagaggaaaatggtagaaatgttggaaaagaagaggaaaaagaagaaaataaaaacaatgcagtgaatcacagatgtctcctgaaagaactcttttagatgaaatcattctactcaaatgtaccttaattttttttttttccctgagtaaaagcaagaaatttcttcctttggaaaaaatatatatattaaaaaaccacttttagatggttttttttaaaaaaaaaaaaaaaactggtaaaattacttttggcagacagtgttttatgaattatgtatcatgttgatatataatatgttaatgtgtcatgtaatttttactttgtacaaagcaaataaagatctttctc

SEQ ID NO: 35555 - DNA, 859 bp, Homo sapiens
aaaggcaggcaaaagctaaggtcgaagccgggtgtaaatcggccgaggtgagcatggggctctagtgcatcacagtggtacaataacttgcctgaaattctatggcaacaggcatttaatcagtggagcggaagatggactcatctgtatctgggatgcaaagaaatgggaatgcctgaagtcaattaaagctcacaaaggacaggtgaccttcctttctattcacccatctggcaagttggccctgtcggttggtacagataaaactttaagaacgtggaatcttgtagaaggaagatcagcattcataaaaaatataaaacaaaatgctcacatagtagaatggtccccaagaggagagcagtatgtagttatcatacagaataaaatagacatctatcagcttgacactgcatccattagtggcaccatcacaaatgaaaagagaatttcctctgttaaatttctttcagagtctgtccttgcagtggctggagatgaagaagttataaggttttttgactgtgattcactagtgtgcctctgcgaatttaaagctcatgaaaacagggtaaaggacatgttcagttttgaaattccagagcatcatgttattgtttcagcatcgagtgatggtttcatcaaaatgtggaagcttaagcaggataagaaagtttccccccatctttactctggtgaataaaccactaaatggcaggtgaacgtgttgttgggaggtgggctagacaaagggggcgaacttgtaagaaaagacttcctcccacaggaaaagccagttcccgggtagataaaaaacgtcccaatggcgaaaagggccggcggcacaggccaaaaaaag

SEQ ID NO: 35556 - DNA, 638 bp, Homo sapiens
caacattggttgtttcttggcagctgcagatttcacaagaatgagattaaatggctttttacatcctgtatttggaaagagaataggaggatttacaggaagttatgctcagttccaatccagttaaacagtacttaaattgtagcaggacaagccgcagacaaaacccctcagccagcgagtttaagaaagaagggctttattcggccgggatcttcggcaagactcacgtctccaacaaccaagctccccaaagacggggtttcaccatgtttggccagggatggtctcgatctcttgatctcgtcaaaagtgcttgggattacaaggcatgcgtgagccactgcgtctggccattttattttattttttgagacagagtcctgacctcaagcaatccgcctgcctaggcctcgcaaagtgctgggattacaggagtgagccaccgtgcccagccaagaaagattttggaagagtgaatgaatacaaggatttccactagactgagaattagtttgtcaacagcatttcagtgtcttgagaagtgtttacatttggcgtggacaaagctggcagatgacgtagaaagtaaaaagttgcctcttcaaagtttcccttcttgttaaagaataaatcat

SEQ ID NO: 35557 - DNA, 1621 bp, Homo sapiens
gctggcaccttcctgagatatgcctgcttgcccccgatttttttctccttgcagtgagaacctcctcatgtggcatctttacttattctcttcttggaaaatccatgtgacctccccgcgcttaaagtgtttccacgttacaggcgacttaaaggcagccctggagcctgacgtataattcgagcgccgatgcagaaaggagtcaggtgtttttttttttttttttttggtttccggttctgtcacctccaggctgagccgggctggcggaagaggcacgtgcgctgctgaatggagctggtcgctggttgctacgagcaggtcctctttgggttcgctgtacacccggagcccgaggcttgcggcgaccacgagcaatggactcttgtggctgacttcactcaccatgctcacactgcctccttgtcagcagtagctgtaaatagtcgttttgtggtcactgggagcaaagatgaaacaattcacatttatgacatgaaaaagaagattgagcatggggctctagtgcatcacagtggtacaataacttgcctgaaattctatggcaacaggcatttaatcagtggagcggaagatggactcatctgtatctgggatgcaaagaaatgggaatgcctgaagtcaattaaagctcacaaaggacaggtgaccttcctttctattcacccatctggcaagttggccctgtcggttggtacagataaaactttaagaacgtggaatcttgtagaaggaagatcagcattcataaaaaatataaaacaaaatgctcacatagtagaatggtccccaagaggagagcagtatgtagttatcatacagaataaaatagacatctatcagcttgacactgcatccattagtggcaccatcacaaatgaaaagagaatttcctctgttaaatttctttcagagtctgtccttgcagtggctggagatgaagaagttataaggttttttgactgtgattcactagtgtgcctctgcgaatttaaagctcatgaaaacagggtaaaggacatgttcagttttgaaattccagagcatcatgttattgtttcagcatcgagtgatggtttcatcaaaatgtggaagcttaagcaggataagaaagttcccccatctttactctgtgaaataaacactaatgccaggctgacgtgtcttggagtgtggctagacaaagtggcagacatgaaagaaagccttcctccagctgcagagccttctcctgtaagtaaagaacagtccaaaattggcaaaaaggagcctggtgacacagtgcacaaagaagaaaagcggtcaaaacctaacacaaagaaacgcggtttaacaggtgacagtaagaaagcaacaaaagaaagtggcctgatatcaaccaagaagaggaaaatggtagaaatgttggaaaagaagaggaaaaagaagaaaataaaaacaatgcagtgaatcacagatgtctcctgaaagaactcttttagatgaaatcattctactcaaatgtaccttaattttttttttttccctgagtaaaagcaagaaatttcttcctttggaaaaaatatatatattaaaaaaccacttttagatggtttttttt

SEQ ID NO: 35558 - DNA, 1810 bp, Homo sapiens
gctggcaccttcctgagatatgcctgcttgcccccgatttttttctccttgcagtgagaacctcctcatgtggcatctttacttattctcttcttggaaaatccatgtgacctccccgcgcttaaagtgtttccacgttacaggcgacttaaaggcagccctggagcctgacgtataattcgagcgccgatgcagaaaggagtcaggtgtttttttttttttttttttggtttccggttctgtcacctccaggctgagccgggctggcggaagaggcacgtgcgctgctgaatggagctggtcgctggttgctacgagcaggtcctctttgggttcgctgtacacccggagcccgaggcttgcggcgaccacgagcaatggactcttgtggctgacttcactcaccatgctcacactgcctccttgtcagcagtagctgtaaatagtcgttttgtggtcactgggagcaaagatgaaacaattcacatttatgacatgaaaaagaagattgagcatggggctctagtgcatcacagtggtacaataacttgcctgaaattctatggcaacaggcatttaatcagtggagcggaagatggactcatctgtatctgggatgcaaagaaatgggaatgcctgaagtcaattaaagctcacaaaggacaggtgaccttcctttctattcacccatctggcaagttggccctgtcggttggtacagataaaactttaagaacgtggaatcttgtagaaggaagatcagcattcataaaaaatataaaacaaaatgctcacatagtagaatggtccccaagaggagagcagtatgtagttatcatacagaataaaatagacatctatcagcttgacactgcatccattagtggcaccatcacaaatgaaaagagaatttcctctgttaaatttctttcagagtctgtccttgcagtggctggagatgaagaagttataaggttttttgactgtgattcactagtgtgcctctgcgaatttaaagctcatgaaaacagggtaaaggacatgttcagttttgaaattccagagcatcatgttattgtttcagcatcgagtgatggtttcatcaaaatgtggaagcttaagcaggataagaaagttcccccatctttactctgtgaaataaacactaatgccaggctgacgtgtcttggagtgtggctagacaaagtggcagacatgaaagaaagccttcctccagctgcagagccttctcctgtaagtaaagaacagtccaaaattggcaaaaaggagcctggtgacacagtgcacaaagaagaaaagcggtcaaaacctaacacaaagaaacgcggtttaacaggtgacagtaagaaagcaacaaaagaaagtggcctgatatcaaccaagaagaggaaaatggtagaaatgttggaaaagaagaggaaaaagaagaaaataaaaacaatgcagtgaatcacagatgtctcctgaaagaactcttttagatgaaatcattctactcaaatgtaccttaattttttttttttccctgagtaaaagcaagaaatttcttcctttggaaaaaatatatatattaaaaaaccacttttagatggttttttttaaaaaaaaaaaaaaaactggtaaaattacttttggcagacagtgttttatgaattatgtatcatgttgatatataatatgttaatgtgtcatgtaatttttactttgtacaaagcaaataaagatctttctcaaaatatactgtaaaataatataaaatattgaacacattctttatcaaaaggatgaa

SEQ ID NO: 35559 - DNA, 1629 bp, Homo sapiens
caatgaaaatccgcaatctaagacctgaaactactgccacagccatgcataaaatgaaatgctgctgctttcctctctgttaaagagaatgttcaaggccgaggacacataaaaaagagcagcattgctggctctgttatttagctgtgtgttcttgaaaaagtcacttctccagacatatctcagcatttataacctaagactgaatcactgcattttacccttaatgaggtacgcttacactaatctttttgaaacagtacttaaattgtagcaggacaagccgcagacaaaacccctcagccagcgagtttaagaaagaagggctttattcggccgggatcttcggcaagactcacgtctccaacaaccaagctccccaacaatggactcttgtggctgacttcactcaccatgctcacactgcctccttgtcagcagtagctgtaaatagtcgttttgtggtcactgggagcaaagatgaaacaattcacatttatgacatgaaaaagaagattgagcatggggctctagtgcatcacagtggtacaataacttgcctgaaattctatggcaacaggcatttaatcagtggagcggaagatggactcatctgtatctgggatgcaaagaaatgggaatgcctgaagtcaattaaagctcacaaaggacaggtgaccttcctttctattcacccatctggcaagttggccctgtcggttggtacagataaaactttaagaacgtggaatcttgtagaaggaagatcagcattcataaaaaatataaaacaaaatgctcacatagtagaatggtccccaagaggagagcagtatgtagttatcatacagaataaaatagacatctatcagcttgacactgcatccattagtggcaccatcacaaatgaaaagagaatttcctctgttaaatttctttcagagtctgtccttgcagtggctggagatgaagaagttataaggttttttgactgtgattcactagtgtgcctctgcgaatttaaagctcatgaaaacagggtaaaggacatgttcagttttgaaattccagagcatcatgttattgtttcagcatcgagtgatggtttcatcaaaatgtggaagcttaagcaggataagaaagttcccccatctttactctgtgaaataaacactaatgccaggctgacgtgtcttggagtgtggctagacaaagtggcagacatgaaagaaagccttcctccagctgcagagccttctcctgtaagtaaagaacagtccaaaattggcaaaaaggagcctggtgacacagtgcacaaagaagaaaagcggtcaaaacctaacacaaagaaacgcggtttaacaggtgacagtaagaaagcaacaaaagaaagtggcctgatatcaaccaagaagaggaaaatggtagaaatgttggaaaagaagaggaaaaagaagaaaataaaaacaatgcagtgaatcacagatgtctcctgaaagaactcttttagatgaaatcattctactcaaatgtaccttaattttttttttttccctgagtaaaagcaagaaatttcttcctttggaaaaaatatatatattaaaaaaccacttttagatggtttttttt

SEQ ID NO: 35560 - DNA, 1160 bp, Homo sapiens
aaaggcaggcaaaagctaaggtcgaagccgggtgtaaatcggccgaggtgagcatggggctctagtgcatcacagtggtacaataacttgcctgaaattctatggcaacaggcatttaatcagtggagcggaagatggactcatctgtatctgggatgcaaagaaatgggaatgcctgaagtcaattaaagctcacaaaggacaggtgaccttcctttctattcacccatctggcaagttggccctgtcggttggtacagataaaactttaagaacgtggaatcttgtagaaggaagatcagcattcataaaaaatataaaacaaaatgctcacatagtagaatggtccccaagaggagagcagtatgtagttatcatacagaataaaatagacatctatcagcttgacactgcatccattagtggcaccatcacaaatgaaaagagaatttcctctgttaaatttctttcagagtctgtccttgcagtggctggagatgaagaagttataaggttttttgactgtgattcactagtgtgcctctgcgaatttaaagctcatgaaaacagggtaaaggacatgttcagttttgaaattccagagcatcatgttattgtttcagcatcgagtgatggtttcatcaaaatgtggaagcttaagcaggataagaaagttcccccatctttactctgtgaaataaacactaatgccaggctgacgtgtcttggagtgtggctagacaaagtggcagacatgaaagaaagccttcctccagctgcagagccttctcctgtaagtaaagaacagtccaaaattggcaaaaaggagcctggtgacacagtgcacaaagaagaaaagcggtcaaaacctaacacaaagaaacgcggtttaacaggtgacagtaagaaagcaacaaaagaaagtggcctgatatcaaccaagaagaggaaaatggtagaaatgttggaaaagaagaggaaaaagaagaaaataaaaacaatgcagtgaatcacagatgtctcctgaaagaactcttttagatgaaatcattctactcaaatgtaccttaattttttttttttccctgagtaaaagcaagaaatttcttcctttggaaaaaatatatatattaaaaaaccacttttagatggtttttttt

SEQ ID NO: 35561 - DNA, 1271 bp, Homo sapiens
ggtcttgatctcctgacctcatgatccgcccgcctcagcctccgaaagtgctgggattacaggcgtgagccaccacgcccagccaacaagctccgttttcaaacatgcaattatgctgcagtcatcatagctgtgaattgaagattttagaaagggaaaccttttgaaaatacaatggatacgagatgttaaagggatatgggaatgaagcaagtcttaatcctgcctcataatatttcaaaatattgctgtaaggaagatagcaggtcttctaaatagccaatatttagtaaaatgtcacttaagtcttcattatgcttgttcttttacgcttagtaaaagttagttggtgatcacaccgtaagtgagcttcctgttttgcagaacgtggaatcttgtagaaggaagatcagcattcataaaaaatataaaacaaaatgctcacatagtagaatggtccccaagaggagagcagtatgtagttatcatacagaataaaatagacatctatcagcttgacactgcatccattagtggcaccatcacaaatgaaaagagaatttcctctgttaaatttctttcagagtctgtccttgcagtggctggagatgaagaagttataaggttttttgactgtgattcactagtgtgcctctgcgaatttaaagctcatgaaaacagggtaaaggacatgttcagttttgaaattccagagcatcatgttattgtttcagcatcgagtgatggtttcatcaaaatgtggaagcttaagcaggataagaaagttcccccatctttactctgtgaaataaacactaatgccaggctgacgtgtcttggagtgtggctagacaaagtggcagacatgaaagaaagccttcctccagctgcagagccttctcctgtaagtaaagaacagtccaaaattggcaaaaaggagcctggtgacacagtgcacaaagaagaaaagcggtcaaaacctaacacaaagaaacgcggtttaacaggtgacagtaagaaagcaacaaaagaaagtggcctgatatcaaccaagaagaggaaaatggtagaaatgttggaaaagaagaggaaaaagaagaaaataaaaacaatgcagtgaatcacagatgtctcctgaaagaactcttttagatgaaatcattctactcaaatgtaccttaattttttttttttccctgagtaaaagcaagaaatttcttcctttggaaaaaatatatatattaaaaaaccacttttagatggtttttttt

SEQ ID NO: 35562 - DNA, 634 bp, Homo sapiens
tcggacggaaaagatcttttatggtgttaatatttctatcctagggtaaaggacatgttcagttttgaaattccagagcatcatgttattgtttcagcatcgagtgatggtttcatcaaaatgtggaagcttaagcaggataagaaagttcccccatctttactctgtgaaataaacactaatgccaggctgacgtgtcttggagtgtggctagacaaagtggcagacatgaaagaaagccttcctccagctgcagagccttctcctgtaagtaaagaacagtccaaaattggcaaaaaggagcctggtgacacagtgcacaaagaagaaaagcggtcaaaacctaacacaaagaaacgcggtttaacaggtgacagtaagaaagcaacaaaagaaagtggcctgatatcaaccaagaagaggaaaatggtagaaatgttggaaaagaagaggaaaaagaagaaaataaaaacaatgcagtgaatcacagatgtctcctgaaagaactcttttagatgaaatcattctactcaaatgtaccttaattttttttttttccctgagtaaaagcaagaaatttcttcctttggaaaaaatatatatattaaaaaaccacttttagatggtttttttt

SEQ ID NO: 35563 - DNA, 1052 bp, Homo sapiens
  misc_feature (934)..(934): n is a, c, g, or t
  misc_feature (937)..(937): n is a, c, g, or t
  misc_feature (939)..(939): n is a, c, g, or t
  misc_feature (941)..(941): n is a, c, g, or t
  misc_feature (945)..(945): n is a, c, g, or t
  misc_feature (949)..(949): n is a, c, g, or t
gctggcaccttcctgagatatgcctgcttgcccccgatttttttctccttgcagtgagaacctcctcatgtggcatctttacttattctcttcttggaaaatccatgtgacctccccgcgcttaaagtgtttccacgttacaggcgacttaaaggcagccctggagcctgacgtataattcgagcgccgatgcagaaaggagtcaggtgtttttttttttttttttttggtttccggttctgtcacctccaggctgagccgggctggcggaagaggcacgtgcgctgctgaatggagctggtcgctggttgctacgagcaggtcctctttgggttcgctgtacacccggagcccgaggcttgcggcgaccacgagcaatggactcttgtggctgacttcactcaccatgctcacactgcctccttgtcagcagtagctgtaaatagtcgttttgtggtcactgggagcaaagatgaaacaattcacatttatgacatgaaaaagaagattgagcatggggctctagtgcatcacagtggtacaataacttgcctgaaattctatggcaacaggcatttaatcagtggagcggaagatggactcatctgtatctgggatgcaaagaaatgggaatgcctgaagtcaattaaagctcacaaaggacaggtgaccttcctttctattcacccatctggcaagttggccctgtcggttggtacagataaaactttaagaacgtggaatcttgtagaaggaagatcagcattcataaaaaatataaaacaaaatgctcacatagtagaatggtccccaagaggagagcagtatgtagttatcatacagaataaaatagacatctatcagcttgacactgcatccattagtggcaccatcacaaatgaaaagagaatttcctctgttaaatttctttcanagntngnctgngggntgggatgaagaagttagggggcgcggggagtcccagggcccggagtaagcctgaacaggtagacattgcgttgaccaccaccttttttccccgggttcacagg

SEQ ID NO: 35564 - DNA, 531 bp, Homo sapiens
  misc_feature (18)..(18): n is a, c, g, or t
gtcgcacccccggaaaancacgcacagtggtgcagcctagtgttggtgctgctgctgggccagtggttcctccatgtccggggaggatcagacacttcaaggtgtggctagacaaagtggcagacatgaaagaaagccttcctccagctgcagagccttctcctgtaagtaaagaacagtccaaaattggcaaaaaggagcctggtgacacagtgcacaaagaagaaaagcggtcaaaacctaacacaaagaaacgcggtttaacaggtgacagtaagaaagcaacaaaagaaagtggcctgatatcaaccaagaagaggaaaatggtagaaatgttggaaaagaagaggaaaaagaagaaaataaaaacaatgcagtgaatcacagatgtctcctgaaagaactcttttagatgaaatcattctactcaaatgtaccttaattttttttttttccctgagtaaaagcaagaaatttcttcctttggaaaaaatatatatattaaaaaaccacttttagatggtttttttt

SEQ ID NO: 35565 - DNA, 984 bp, Homo sapiens
gctggcaccttcctgagatatgcctgcttgcccccgatttttttctccttgcagtgagaacctcctcatgtggcatctttacttattctcttcttggaaaatccatgtgacctccccgcgcttaaagtgtttccacgttacaggcgacttaaaggcagccctggagcctgacgtataattcgagcgccgatgcagaaaggagtcaggtgtttttttttttttttttttggtttccggttctgtcacctccaggctgagccgggctggcggaagaggcacgtgcgctgctgaatggagctggtcgctggttgctacgagcaggtcctctttgggttcgctgtacacccggagcccgaggcttgcggcgaccacgagcaatggactcttgtggctgacttcactcaccatgctcacactgcctccttgtcagcagtagctgtaaatagtcgttttgtggtcactgggagcaaagatgaaacaattcacatttatgacatgaaaaagaagattgagcatggggctctagtgcatcacagtggtacaataacttgcctgaaattctatggcaacaggcatttaatcagtggagcggaagatggactcatctgtatctgggatgcaaagaaatgggaatgcctgaagtcaattaaagctcacaaaggacaggtgaccttcctttctattcacccatctggcaagttggccctgtcggttggtacagataaaactttaagaacgtggaatcttgtagaaggaagatcagcattcataaaaaatataaaacaaaatgctcacatagtagaatggtccccaagaggagagcagtatgtagttatcatacagaataaaatagacatctatcagcttgacactgcatccattagtggcaccatcacaaatgaaaagagaatttcctctgttaaatttctttcagagtctggccttgcaggggctggaaagaccatgaaacagggaaaggcctta

SEQ ID NO: 35566 - DNA, 1060 bp, Homo sapiens
gctggcaccttcctgagatatgcctgcttgcccccgatttttttctccttgcagtgagaacctcctcatgtggcatctttacttattctcttcttggaaaatccatgtgacctccccgcgcttaaagtgtttccacgttacaggcgacttaaaggcagccctggagcctgacgtataattcgagcgccgatgcagaaaggagtcaggtgtttttttttttttttttttggtttccggttctgtcacctccaggctgagccgggctggcggaagaggcacgtgcgctgctgaatggagctggtcgctggttgctacgagcaggtcctctttgggttcgctgtacacccggagcccgaggcttgcggcgaccacgagcaatggactcttgtggctgacttcactcaccatgctcacactgcctccttgtcagcagtagctgtaaatagtcgttttgtggtcactgggagcaaagatgaaacaattcacatttatgacatgaaaaagaagattgagcatggggctctagtgcatcacagtggtacaataacttgcctgaaattctatggcaacaggcatttaatcagtggagcggaagatggactcatctgtatctgggatgcaaagaaatgggaatgcctgaagtcaattaaagctcacaaaggacaggtgaccttcctttctattcacccatctggcaagttggccctgtcggttggtacagataaaactttaagaacgtggaatcttgtagaaggaagatcagcattcataaaaaatataaaacaaaatgctcacatagtagaatggtccccaagaggagagcagtatgtagttatcatacagaataaaatagacatctatcagcttgacactgcatccattagtggcaccatcacaaaaaaaaaaaaaaaaaaaaaaaaattgggggcggccgggctgaaaatttaaaccattggtggggcgggcccgagttaggaccgtccaggggcccaaaaacgggcgaagggcgggtcccaaaaagcggggcccggcggaaccgggcggcgccgttaaggccgct

SEQ ID NO: 35567 - DNA, 486 bp, Homo sapiens
tatctcttaaattgtagaagtggaggagatccagataatttcactttattgacagcttgtgtttatttcattcaaaggggaaaacagtctttttttaaaagcactctcttttgtgttttagtaagtaaagaacagtccaaaattggcaaaaaggagcctggtgacacagtgcacaaagaagaaaagcggtcaaaacctaacacaaagaaacgcggtttaacaggtgacagtaagaaagcaacaaaagaaagtggcctgatatcaaccaagaagaggaaaatggtagaaatgttggaaaagaagaggaaaaagaagaaaataaaaacaatgcagtgaatcacagatgtctcctgaaagaactcttttagatgaaatcattctactcaaatgtaccttaattttttttttttccctgagtaaaagcaagaaatttcttcctttggaaaaaatatatatattaaaaaaccacttttagatggttttttt

SEQ ID NO: 35568 - DNA, 501 bp, Homo sapiens
gaatagtgccagacacatagtaggcactcattatttgaaagaataaattcaaataaaaatgtgaatatctgaaaaaataaattaagtctcacatataaagtaaatacactaaagagttaaagatttgtgtaggatctaaaagtcttccttagtccagtctccattactgtgttctagagtgatgatacccagtgttgcctgcccacctccttgctttaccttcctcatcaagtctcaagtcctttgtggtaaactacatgtcattttgtagtttaacatatcatttttccatttataggatccattgatagttttcatgaatcgtggaatgatttatcttttcagaaacagataaatggttccgtgattcatgaaaactaccagtggatagagttggtagaactgtggtgtgactggcattaattgtatgttttcatcttcagcacaatggactcttgtggctgacttcactcaccatgctcacactgcctccttgtcagc

SEQ ID NO: 35569 - DNA, 430 bp, Homo sapiens
aagaaagaagggctttattcggccgggatcttcggcaagactcacgtctccaacaaccaagctccccaagtgagtaattcctgtcccttttaagggcttacaactctaaggaggtccgtgtgagagggtcgtgattgactgagcaagcgggggtacatgactggggggctgcatgcaccggtaattagaacggaacagaacaggacagggattttcacagtgcttttctatacaatgtctctaatctacagataacataaccgattaggtcaggggtcgatctttaccaggcccagagtgtggtgccgagctgtctgcttgtggatttcatttctgccttttagtttttacttcttctttggaggcagaaattgggcataagacaatatgaggggtggtctccctcccttaaaatcctaatgctctcctc

SEQ ID NO: 35570 - DNA, 1601 bp, Homo sapiens
acaaggcacagaagctgcagagcaacacaaaggatcctgcgggcttgaacaaggggctcgaacaaaaagcagttactccacagaagaccagaggggtcctcccagcattgtggctctatgaggaaactgagacccagagatggaactgggattcaaaacaatgtctagtgtgactccagagcctttcctaactcctacttaaagcctctgaggaatgctgaaaagagcacaggacatagaatccagattaaaatgatgaaagtcatcaaccttaaaagaagcaaaaaagaagagaattagctcctctgtgtaatttttttaaatatagcatcaaaccatcttcccgtcagcaacaggcactgcagtattgaagatcatcacatgagggcagagggcgtaaaaaaggatggtgtgttgagaccagaagcagcagcagtcctcgacatcaactacaactttccttcgcacagtgcataccctctgatatactgaacccaacgcctatcctccagccccctaagaactagagagggagcctcacaacattccaatttaatccttcagaaaattcattactcttcaaagttgtctgtggttttgtgacaacgatatgactaggtgcaaaatggcttgcaactaattaacaaacatagaagcatccaacaaacatatacgtgcacaatctgaggatttagggatgaaatcagttatccaggttagatatcaacaaaagagcagtaattataaagtttcatgaagaaagtggctgttgaggtgtggattatgtaagtaagactgacaacaagaaatgattttgttataatccagaagtaaaactaaataaatgttctttaaattgatggataaataagaaagaatttatttacaacagtaaataaatccaatacttgttataaataagataaagctggctataaattcacattttcatgtgagcgttttgaagtatgtggacataaaaaacacacacctcaagcatacttctcaatgatttctgataaagaacacacctttgtaaccagcacatggtgtaaaaccagaaacagaacattaccagattcctaaacaagccttctttgtgcccctttttagtcactaccctcccccattcaaggtaacttctatcttgacttctaacaccacacttttagttttgcctattgttaacttgatataaatagaatgatactgtatattttgtgtgtgtttggcttcttctgctccaacttttgttggtaaggtttatacagattattaaatatagctatagttcatttatttctattactatgcagtatacttggattcaggaatacaccataacttaatcatccattctattgttgactggtttggcaattttctaaacatacgcaaattctatgaaccagcaattctatcccgtgtatgtgtatatatacacacatgttaaatatatacacagaaacatgctgtgaaagtgctttgcaaatggcaaaatgtaaaatgtaaggaatgttaccaaagagctgaaacgcactgtgtctttcttgcaacacagattcttggacatatcagataataaatgtattttgtattga

SEQ ID NO: 35571 - DNA, 1606 bp, Homo sapiens
tgaaaagcacttcttaccccattagtcattctcctgagtttaaaaccagaaaatctagaaagggtcaccactaacaagcatttttatgacaaggtaaaacaataagagtacagtcactctttgggcacaacgctccctactctgctatcactgtttctttattttggcttaacgtttttaactgcttaacaaatgcacatggccgggcgcagtggctcacgcctgtaatcccagcactttgggaggccaaggcgggcggatcatgaggtcaggagttgcttccaccaacttcttagctaaagggttgagaaaattgttaagaatttaaggtactacaactgcttaaacaatattagtaatttccttccaaataatttttaaaattattctcttttctctcctcctaaaacaacttccagttgagaccagaagcagcagcagtcctcgacatcaactacaactttccttcgcacagtgcataccctctgatatactgaacccaacgcctatcctccagccccctaagaactagagagggagcctcacaacattccaatttaatccttcagaaaattcattactcttcaaagttgtctgtggttttgtgacaacgatatgactaggtgcaaaatggcttgcaactaattaacaaacatagaagcatccaacaaacatatacgtgcacaatctgaggatttagggatgaaatcagttatccaggttagatatcaacaaaagagcagtaattataaagtttcatgaagaaagtggctgttgaggtgtggattatgtaagtaagactgacaacaagaaatgattttgttataatccagaagtaaaactaaataaatgttctttaaattgatggataaataagaaagaatttatttacaacagtaaataaatccaatacttgttataaataagataaagctggctataaattcacattttcatgtgagcgttttgaagtatgtggacataaaaaacacacacctcaagcatacttctcaatgatttctgataaagaacacacctttgtaaccagcacatggtgtaaaaccagaaacagaacattaccagattcctaaacaagccttctttgtgcccctttttagtcactaccctcccccattcaaggtaacttctatcttgacttctaacaccacacttttagttttgcctattgttaacttgatataaatagaatgatactgtatattttgtgtgtgtttggcttcttctgctccaacttttgttggtaaggtttatacagattattaaatatagctatagttcatttatttctattactatgcagtatacttggattcaggaatacaccataacttaatcatccattctattgttgactggtttggcaattttctaaacatacgcaaattctatgaaccagcaattctatcccgtgtatgtgtatatatacacacatgttaaatatatacacagaaacatgctgtgaaagtgctttgcaaatggcaaaatgtaaaatgtaaggaatgttaccaaagagctgaaacgcactgtgtctttcttgcaacacagattcttggacatatcagataataaatgtattttgtattga

SEQ ID NO: 35572 - DNA, 1626 bp, Homo sapiens
acaaggcacagaagctgcagagcaacacaaaggatcctgcgggcttgaacaaggggctcgaacaaaaagcagttactccacagaagaccagaggggtcctcccagcattgtggctctgtaagacagactgcagcatatagagatgaggaaactgagacccagagatggaactgggattcaaaacaatgtctagtgtgactccagagcctttcctaactcctacttaaagcctctgaggaatgctgaaaagagcacaggacatagaatccagattaaaatgatgaaagtcatcaaccttaaaagaagcaaaaaagaagagaattagctcctctgtgtaatttttttaaatatagcatcaaaccatcttcccgtcagcaacaggcactgcagtattgaagatcatcacatgagggcagagggcgtaaaaaaggatggtgtgttgagaccagaagcagcagcagtcctcgacatcaactacaactttccttcgcacagtgcataccctctgatatactgaacccaacgcctatcctccagccccctaagaactagagagggagcctcacaacattccaatttaatccttcagaaaattcattactcttcaaagttgtctgtggttttgtgacaacgatatgactaggtgcaaaatggcttgcaactaattaacaaacatagaagcatccaacaaacatatacgtgcacaatctgaggatttagggatgaaatcagttatccaggttagatatcaacaaaagagcagtaattataaagtttcatgaagaaagtggctgttgaggtgtggattatgtaagtaagactgacaacaagaaatgattttgttataatccagaagtaaaactaaataaatgttctttaaattgatggataaataagaaagaatttatttacaacagtaaataaatccaatacttgttataaataagataaagctggctataaattcacattttcatgtgagcgttttgaagtatgtggacataaaaaacacacacctcaagcatacttctcaatgatttctgataaagaacacacctttgtaaccagcacatggtgtaaaaccagaaacagaacattaccagattcctaaacaagccttctttgtgcccctttttagtcactaccctcccccattcaaggtaacttctatcttgacttctaacaccacacttttagttttgcctattgttaacttgatataaatagaatgatactgtatattttgtgtgtgtttggcttcttctgctccaacttttgttggtaaggtttatacagattattaaatatagctatagttcatttatttctattactatgcagtatacttggattcaggaatacaccataacttaatcatccattctattgttgactggtttggcaattttctaaacatacgcaaattctatgaaccagcaattctatcccgtgtatgtgtatatatacacacatgttaaatatatacacagaaacatgctgtgaaagtgctttgcaaatggcaaaatgtaaaatgtaaggaatgttaccaaagagctgaaacgcactgtgtctttcttgcaacacagattcttggacatatcagataataaatgtattttgtattga

SEQ ID NO: 35573 - DNA, 358 bp, Homo sapiens
cttctcttttctactaaactttgtctcctaaagcccacacattgtcatgacttaagaaaatcatgttctcttctaggtagattttgatatctgatttttagctgaaattagagccaatgtctctggaagtgacgtgcaatgggaacattaaccgtaatttattttttttatttttattttttttgagacaaagtctcactctgttgccaaggctggagtgcaatggcgtggtctcggctcactgcaacctccacatcccaggttcaagagattctcctgcctcagcctcccaagtagctgggattacaggtgcccgccaccatgcccgactaatttttatatttttagtagagacgtg

SEQ ID NO: 35574 - DNA, 589 bp, Homo sapiens
tgaacccaggaggcggagcttgcagtgagcctggatcatgccactgcactccagcctggcagacagagtgagactccatctcaaaaaaaaaaaaaaaaaggtgtgcctattctgagccagacttcctaaattccaatctcactctgcctcttattgactaggtggccttggacaagttacaataacatctttgtgccttagttttctcatctgaaaactgagcataacctaccatatagaattgttatgaggattaaattaactcatatatagaaagcccttaaactagtgcctcacatatagtaagcctcaaatatatttcattaggattatttaggcttgttaacataagagcttttctttataaactatataaaattaaataacccccagaattgcgtttaaaagttaccactgttattcattgttctggaagagttggccaatttagttaagaatacaaaatcagggccaggcacggtggtcacgcctgtaatcccaacactttgggaggctgaggtgggcatatcatttgaggtcaggagttttagaccagcctgaccaacatggtgaaaccccgtctctacta

SEQ ID NO: 35575 - DNA, 94 bp, Homo sapiens
aatacccagaaacgtgccgatctcttttggcgccaggagtggagacgttttcaatgatccggcgtgtctcttgttctaagggccctttaaggat

SEQ ID NO: 35576 - DNA, 385 bp, Homo sapiens
aatttttgtatttttagagacaaggtctccccatgttgcccaggctggtcttgaacttttgggctcaagcaattcgcctgcctcagcctcccaaattattgggattacaggtgtgagccaccatgccaggccactgtatcattttagaaagggagattgtggacttccatggcctcctgtgtcaaataaatagggtgagattagtttttctcctacagtcccttcagcaggattattctgtacaagtgtgagttaactgtttatgttggtgaccacacatgtattagcattcaggctgaggtctgagaggagagcgtagaaacaacatatttgtcctttctcctctatcaaagctacatgcttttcctcacaaagtagtatgtac

SEQ ID NO: 35577 - DNA, 377 bp, Homo sapiens
gagttgctggtggccacctcggacccacacaggcagagcttgcttgagaacaaagccaacatgcaggaggaagaggaggagagttggatgcatatcaatccatccatagacaaggagcctggaggcatccttaggcccaggatgcagctctgctgcaacaggaagcatctttgcatttccaggttacgccaggcaacagactccctctttgactagttcagcctcttgggaaagcatcttgacccattcagtgctcagtacatgctacagaaagactgtttttatgtgcttataagtgagaacatgctttattcagtttactattcctgtgttagtttgctaaggataatggttccagttccatccatgtccctgtg

SEQ ID NO: 35578 - DNA, 423 bp, Homo sapiens
ataatcagtcagtatagttaattgacaaaaagtcccagtccacatcctgacaatctatataaatattcaaaacagcttttttatacagtgaacaattagtacaggaaacagataatcgttcagaagacttattaatatttatggatattgaaatgcagtgaggaggtgtgattattatgtcaaagctttgttacaggacttagggcaagtacacatccaacactaaaattgcgcctcatctcaatgaaccaaatggccggctctgtcaccccctgtgggatggcaaattcttggccccatggaccttccccagaaactctagttcagcaggaaagttcccataatttagaatatcataaggaaggaaaaaaaaagcccaaaatatatttccttgacataattggagattatataaacagagcc

SEQ ID NO: 35579 - DNA, 413 bp, Homo sapiens
tgcctactttgtgtgctttacaatatatattgttcaaggctagaataatgagccccatgagcagggtttcatagcatttaagattccaacgccaaccttcaatcatggacacaggtggcctgtgccatctagctagctgcgctgcctccaggctgggtggcctgctcctctgttggataaaaatagcctgactcctcactgaaacaaccaccatgttatttgcgtccttgggaagctgaaagtaatagaactctaagtctggcgttgccagctgtcagcagaatgaaatgcaaagtgtgacgtgtctacactgtacccactggccttcaagtcccaactcccgttcccccatcttgatttttttccattctcaaattaattatttcccctataggtgatttgtggaatggaaa

SEQ ID NO: 35580 - DNA, 324 bp, Homo sapiens
ttctcccacaaagaagccctcaatatatttccaaagagtagaaaacctttcctgcatccccagagagcaatgatttttatcattgaacagtggaagtgtttatttcccaaactatttaagtgctgcacatgaccccaaagtttatcttgaaattagttactacactgagacacaattctgtgagaaatggaagtaaattttaagtgatcccatctcaggctaagtagcttgctgagagttgtgagacaaacatctctatactttgatgcttttctgtgaagaaaatcatgattataaatatggactatatataaatatagtaaa

SEQ ID NO: 35581 - DNA, 841 bp, Homo sapiens
tattctaggatggaagatactgccttagacacaacatgctagagctgggacacattgcttagatgaaggtactttaaaaggtgaccctctgctcaaccatctggacatgtcagaaatgcttcttgatgcttggttaaaggcttgtttgtaaagaatctgctcctatgttccatctctcattttgtatttgccctattctacagaaacacttcaaggaagctggggttgatgagcggtgagcttgggcatggagatgagaatcgggtataatctggctctgccactcagcagagtgcttctcggagcatgttagtctcctcatctacaacatgggaagcccctttcttccaaggagtttgtgaatatcacaaaagaatggctatgaaagtctttccttgtaaagggaatcttaccgtgatgtttctatacccagtccatggcccaacaccaggcggcagcacccaatcactgtacaaagaacccgaagcagattcctcatgactgggttctacccaaaccaaatcagttcctcagcctaggccacagcttctctgcttgtggagggtgtcttgagtactggagcataacactgtcctttatcatttttcaaagacatcaagtgtttaggtaatgcttgggattcattcggagcctctgatgaacactaaatttgagcacatggtttggcacacagtaaggcctcaatgttaagatggtttaggattttaggactgctttctaatacttacctaaaattgcttggcaactatgagctcaaagtaaaatctaggattagacagctatttacctttatatcaaggaggctaattgttgaaaccct

SEQ ID NO: 35582 - DNA, 833 bp, Homo sapiens
caggaggcacatggtcagcgtggggtccaagctgaggatcagcttcccggacaaactgcatcacatcctcgactgtccatgaggaggggtcccggccactcagtcgagaggcatcgcggctctccagaccaggttggtgtcaccatctccagtttgcacatgaggaacattctgcatatgaggaagacctgagagaaacacttcaaggaagctggggttgatgagcggtgagcttgggcatggagatgagaatcgggtataatctggctctgccactcagcagagtgcttctcggagcatgttagtctcctcatctacaacatgggaagcccctttcttccaaggagtttgtgaatatcacaaaagaatggctatgaaagtctttccttgtaaagggaatcttaccgtgatgtttctatacccagtccatggcccaacaccaggcggcagcacccaatcactgtacaaagaacccgaagcagattcctcatgactgggttctacccaaaccaaatcagttcctcagcctaggccacagcttctctgcttgtggagggtgtcttgagtactggagcataacactgtcctttatcatttttcaaagacatcaagtgtttaggtaatgcttgggattcattcggagcctctgatgaacactaaatttgagcacatggtttggcacacagtaaggcctcaatgttaagatggtttaggattttaggactgctttctaatacttacctaaaattgcttggcaactatgagctcaaagtaaaatctaggattagacagctatttacctttatatcaaggaggctaattgttgaaaccct

SEQ ID NO: 35583 - DNA, 680 bp, Homo sapiens
agctgcggcgttcgggtgggggaggggaggctcacaccctgcggcggcttaagcctggatttacgcactggaggagggaattagccctgagatgtcagccctgtgcccctggcgctgtccacccggacgcccgcggagcgccaggcgccgcagcggaccgcgcgcgcactgattgccgcagctactctccctgccgtcgccgcccgggaccgggtgacattgaggttttcgtctatcgccgctgggccgatagggcttctttttaagatttggctttccaagtaagatttttgtttgcctgcttttctcctggaatttttttgtttttggtcgaagaagcaggtaacttgcatatcttaaggaaaacattgtttttgctttgcttttgttgtttaaagatcctaaaacgtaccgtgattcctttacgttactaataattggaaagtgtgttaaatcaagggttcgcttaatgttctttagcctttgtacatagaatatataaatgtcgtgagtcatctttacgaggtttatgagtttgtgttcgggtttggcttttttgttgtgtgtgcgtggtttttttttcttttcttgtaacaccgttaggcgtttcattaaggtgtataaaaagtaattttatacacctattaaaaattcccgctgctcggctggagactggatta

SEQ ID NO: 35584 - DNA, 638 bp, Homo sapiens
agctgcggcgttcgggtgggggaggggaggctcacaccctgcggcggcttaagcctggatttacgcactggaggagggaattagccctgagatgtcagccctgtgcccctggcgctgtccacccggacgcccgcggagcgccaggcgccgcagcggaccgcgcgcgcactgattgccgcagctactctccctgccgtcgccgcccgggaccgggtgacattgaggttttcgtctatcgccgctgggccgatagggcttctttttaagatttggctttccaagtaagatttttgtttgcctgcttttctcctggaatttttttgtttttggtcgaagaagcagctcccactttgcagttgtgtcagccaatcacgacagcttcccagacttccgtgcaagtgcctgctttgaggccaaggtggccataaatggcagctcctcaggctcctccacaatctctggtttcttatgtttctccatgagctcagctttttcatcaactccaatgcttcaagccgaagtcattagtgaatgttctacaatccttcagctgcagctccagaccttcactcctccagcttctcctacatccatctaaccctcaattcctacattaaatctctttattccagaatact

SEQ ID NO: 35585 - DNA, 298 bp, Homo sapiens
tgagacagagtcttactctgtcacccaggctggagtgcagtggcacgatctctgctcactgcaacctccacctcctgggttcaagtgatcctcctgcctcagcctctggagtagctggaagattgtctaatattcgggttaatctggtatttgtggaataaatgactgaatggatgaacagatgaatataggaccagctctgagtatgtagacacctgggtgcccaagagcgaagttgctctggaagccctgggccactccctcacagttcactagggccccaggatcattctctact

SEQ ID NO: 35586 - DNA, 712 bp, Homo sapiens
aggaaaagtaaatgatctcaataaatgcaggggaaaatatgataaaattcagcagtcaagtgctagaaatgtttagcgaactaggaaaaacggaagctatcttaatcttataaatattattttaaaactacagcaaacgcatcatacttaaaatatcaaaagctttcattctgagatcagaagcaaaaaaaaggatgtctattatcacttctattcaaaatgtcgctaggtgatgctatgcatgcctaagtatttagtggggagtgtactggtaccttaaattactttgaaatgcattatgaaaagggaaaaaaggatggcttgatggatagatatatatgtgataaagcagatatagtaaacttggtaaaatctagaatggtagaatccagatggtgggtatacaaatgtacactgtacaatattcaattttgctatacgttgaggaaactatcacctgagttcctggcctagtatggcaagatttccttttaaattaattgggtagggtcagaagaaaatgaactatcattatttgtaaatgacatgattgaggatatagataatttaaagaattagccaataaactagtaaaattaacaaggcttctggacacaaggtcacagacaaaaataacgtgtatttctgatgctagcaataaacaattagacaatgaaattgcaaaggatatgaacagatacttctcaaaaga

SEQ ID NO: 35587 - DNA, 448 bp, Homo sapiens
caatcaatcatccactcatctaaccatccagccactcctactttcgaggcttcttcctgggccaggccctgagctatgctctggagcgacagaggctggtgacctggtgcctgtccttgaggagaaggcccctaagctaaggagagaaggtctatagacaggaggtccctggctgagtcacaggcccctagcaggccagagaaggaggaggtcttagaggagcggcaaagcctctctcttgcagataagaatgttgcagcccaggtttggaaggacacgtacagctcacctggcccagccctctccccagtggccatatagcctaatggttaggaactctgcccgatgtcgacagtcctatccctgctcagcagacacgaccggaggcttttctcagtcactggccccaggtcatcacggactattagagttaggagagacatcagca

SEQ ID NO: 35588 - DNA, 385 bp, Homo sapiens
tgttgatcataaactttcaatacctgcaaaattgcactgatcctatttaccttcaccatggtgatcgccttccctaccaacaccaaatctaaattctcgccttgtcaataaacttttaaaaacatgagcactccttttagctgaaaagacgtccctaaagcttcttaccctgccgtcaaaagaaggtaatcaatgagccagaggaatgtcccatcttttttctacaaacatcctccttagcgttactaaatttaacaccaatgtaagttttaccgctgagcaggtccatggttgcctgcagactaggtggggggtttaagggtgggaaagagggatttcaaagaaggatgaggagattttcaggggtcttgaatgtggtcatggg

SEQ ID NO: 35589 - DNA, 392 bp, Homo sapiens
cctcagaaggttgttctaaagattaagtgggattttataatgtacttaacataactactgcaacatactgttacttttgataattttttgacaactgtggggtaattttgaagaaataggagaaaatgagagagactgaataatagatatatctaagagaggtaaagaactgagaacgttttgaaatgcattgtattataaaaagtgatcttggccaggcacagtggctcaagcccgtaatcccagcactttgggaggccgaggcgggtggatcacctgaggtcaggagttcgagaccaaccggaccaatatggtgaaaccctgtctctactaaaaatagaaaaattagctgggcatgatggcaggtgcctgtaatcctagcttcctgggtg

SEQ ID NO: 35590 - DNA, 511 bp, Homo sapiens
ccagtaatgagactcttccccctcacccagccaaatacctccaatgacagacatcaaatacctccaatgacagacattgagatttatactataaaacaaaatgtcaccccaccatcctgataccaaaaatctgatcttataggggtagaggattaggaaaaccatgaggagcccaaaagaagaatacattgtgtgcctttacatttcctgttagggcatccttccatccccagataactagcgtgggatgtcccttgctctggtctctgtgctatctcctagagacctggccacacctacagcattttgcaggtcagaggccagaagaacatgaatcctggctctgtcagagtcttcagaaaagaacatctataagaaagacatctttttcttgccacttctcataatcataattttgatgcactttgggccaaaagttcctttttttcatggggaatggaggtgagtgagggaagaataaagatgtgggttgataaaaataaaaaaaaaa

SEQ ID NO: 35591 - DNA, 154 bp, Homo sapiens
cttggaatcacttcctcattgaccatgctgcctgtatcctctgaatatttaaggtttgtggagaggctcccatggtgatttgaagtactgcgcttccattttcaaattttatgtaggctgagagcctgtgaactcaccctcaccctgatctcat

SEQ ID NO: 35592 - DNA, 1754 bp, Homo sapiens
tctttgttgtcctcaggtgggctgtgggggaagtagcggagaaatgaagtgacgccaggggccaggcatgggtgttcttttccgtgttgttcacattttctctctttctctctctctccactaatcatgtttctctctctctcctcgttttgttgcatgacttgtgccggttctcgtgattgttccctgctcgtgtctcacagactgtccccatttagcctgagacttttttcctgagtccccagctgggcagatccctcagggctaaacccaaggaaatgcccagcaacccccaacccaccccagccccgcgtgcgcccctccggtgcccgcagctggtgtgaacagtaagtactttggcggtgcctgggagaccagggcagaaaagccagctgtgctgactgagggcccagcctcgggttctccttgctccaaagtttaaaaaaaaatgaccctctcgcagatgctcatctcagcccatttcaagcctggaaaccatctctgagacgctgcccatgctgccatttcatcactgcaggcctgtgggtctagtgggggcctgggggccttgggggctgggggaggcagggcccccagccttctggaaagcaggtgggaatggaggctcctagccactatctcatccaaaggatggggcaggggcgggggctcacacctttgaccctattcatgggttccccagatttatacagttggcccctcgttggtttctctttcttcaagccacccctctggagttggggagggagaatgccccagtttctgaaagcatcttaaaccatagatagacgaacagcccaggggcctgggccccttcacagagcaagacttaagcttccccacccaatcattagtccctcctcaaaggttagggttgagagaagcagtaggccctaggggtgtcccgggaatcccccaggagggaaaggtgccaggctatcatccctccagggatccctgatggatgttccttgtcccctgcccaaaaccatcccgaactttgggccctttagtgattgtgagagctgggagcccccagggcctgggggcttgtggacagaaccagtgggcgggggcccagcattcaaagccagagaagggtctcaggcggcaccatctccacagaggcagaggcagagagaaggcacccccctctgacccacccctccccaggcaagaactgcaggctgtggacacctcccctggcagaggatggccaacagagactcagcaagtcctcactcccctcccaaaaggagacgctgcctgggaggacccactgttctccccttgaggaaaatcccatgcagggtgctatgggcctcaaccccccacatcgtcatccgcgtcctctcccatactgtttcccctcccctctcccaacacccctcctccctcagccccggagacccttggatggaagactgggccagcccagagtgggaggcaggaccagcgtgtctgcgagcacacgtgtgtgcctgcagacatgccccaagaccccagagacgccccggccccagtcacatggtgtcagagttaccttggcaactggcctttttggttcagagtaaattgggaagtgaagcccctgggatttgtcgagaaacgcactgtacgtgaaatgctttgccatcttgtacgaaagactttttttttaagttccaaaattatgatgggatttttttggatttgctttacgaataaatctgattggtccatttaaaaaaaaa

SEQ ID NO: 35593 - DNA, 980 bp, Homo sapiens
agaaggccagccacaccaaggcactggagctccacgactcctggccttcgattggaggcccctctctgccagctctgccccttggggcaccaggcaggactgccagccgctctcctggcaggtgacatcagccttcaagctcactgtgccctcaccatttcatgctcccccaaggtcctggtcatgtcttctcttgggtatcttcccaggacaggcactggcactggagccctggcacttgtttctgggttccatgcttcccaggtgtgatggtgaatgctgagtgtcagcttgactggattgaaggatgcaaagtattggtcactgggtgtgtctgtgagggtgttgccagaggagattcccatttgagtcagtgggctgggagaggcagacccaccctcaatccaggtgggcaccacctaatcggctgccagcacagccaggatacaagcaggcagaggaacgtggaaagactagactggctgaatctggcctccatctttctcccatgctggatgcttcccgccctcgcacgtcggcctccaggttcttcagcttttggactctcggacctacaccagtggcttgcaggggctctgcagcctttggccacaggatgaaggctgcactatcggcttctctacttttgttttgggactcagactggcttccttgctcctcaccttgcacatggcttattgtgggacttcaccttgtgatcacgtgagtcaatactcccaataaactcttcatatatactcttcatatagagtcctgtctctctagagaaccctgacacagatttcaggtgaggcctggtctactcctcaggttgctgtgaggaagggtcaagagacactgggcacgggtcactggccccatgaatgccaagggctccctaggttactggagacacagcctgtgctctgtccagaagcagcctgagatgccggggctgccactcccccagcggccccttc

SEQ ID NO: 35594 - DNA, 394 bp, Homo sapiens
tttttttttacacaaaagtcactgaaccatcaataatccaattggaaagaccctttactgttttaaagaaaccatacaaacataggcaaatatgttgagaggtacagctagtgtctggccacggtggagtacactcccacatccctaatgccagctgtagaacagcaacattcaagcagctgccttaattggagatgcagaccaacacatgctaatttagctgggccaactaattggtgggtatgctacatttttaacaaaatatccacccatattacagatgtttttctctatcagagtaaacgactggtaacaaacagtaatgaagttgaaataagctacacttagagaaaacgtttagttagacagttttacaacatggtctcatattggc

SEQ ID NO: 35595 - DNA, 271 bp, Homo sapiens
gaagctttcctcagattatctttggttgtctgtttgcatttaagagggagactgcacaaagctatttggaagctggtttataatgttttttgagaggttgctgaaagacaagcactccactaagcactttatatgcattgtcttaactgacctttacactgctcctgtgaggttcttatttcacagatgagggacatcttgaggcttagatgatacaaccagaagaaggggaaccaggattcaaacccagatctgactgtcttcatgtgat

SEQ ID NO: 35596 - DNA, 373 bp, Homo sapiens
gttttattaaaattttccctcctttagtggttatttgtgatatagccctgttgttccccatctcactgaccccaaattcaacacatgccacagctgctggccacagtgaaaactaatgatcaacaccagtcatgtgaataagacgtcccttcatgtgttttctttaagctagcctatccacagccccatgggaaagcctaaagaatagtacctgtggattataataaagacgtctcactggttcttgctctctatccctctctctacacactggtcaagtacactcttgtctccagacttcccattggcctcctgtcaacacctgtacccactctggacctgggaataataaacttctttttttttttaatgt

SEQ ID NO: 35597 - DNA, 744 bp, Homo sapiens
atgctaggcaggaggaggaaggaagaagaaaggggccaacccacacagtggctttgacttgcatctcattggccagaactgtgtcacatggtcactatctgaaagggagactgggaaatgtgtaagttgggtacactgtaaatgtgttgtaaaagttgtaaatgtatagatgggtacatcgatactctgaacaaaattgagggtcagtttgcaaggaagtggggggagaatagatgttgggtagacgatgacagtatctgccaccgaatacataataccaaaagtaacctctctctcagaaactctgtaattctagtcttctttccattttattttacttaatcatttcctaatggaaaagagctaagtattttatggaaagcacatttttaaaatccaaatattggagaagtagaggtatgtctcatatattaaaagacaatacatttgtgtgagatatcagattacagtcaaaattgcttcacgtttattatatttttcctgaaacgttcttaaacttttaaattccaaacttgaggaaacttattctcactaatcgcagctattcagatatcttcttttgttgaactaagttacctgaattttccttctaattttccagtcctggccaggtgcagtggttacgcctgtagtcctaacactttgggatgccaaggcaggcggatcacttgaggtcaggagctggagaccagcctggctaacatggtgaaaacccgtctctac

SEQ ID NO: 35598 - DNA, 438 bp, Homo sapiens
cctttcttttcttttcttttttattataagttctagggtacatgtgcacaacgtgcaggtttgtacatatgtatacatgtgccaggttggtgtgctgcacccattaactcgtcatttacattaggtgtatctcctaatgctatccctccccactcctgccaccccatgacaggccccggtgtgtggaactcaaacaaatttgtaaaaaaaaagcaaattcacctttgaaatgcaaaatcatcagtacagagctcctaccccagcatctcctctgtggggctctcacactctgggctactatcctcctgccctgaccactcaagggctaggtaccagacatctagggacagccactgctccaaatgtgacctggagcagaccaaatgcgaccccagagcccactgaaattattcaaaccacgccgaccctatgcagtct

SEQ ID NO: 35599 - DNA, 305 bp, Homo sapiens
caagacacattaaaataaaactgtcaagagatcaggaaagaatcttgaaagcagcaagagagacgtgattcaacatgtagaagaaatcctcagtaagattaatagccagttgctcattagaggccattaaggcagaaaggcattttacagtgctaaaagaaaccatcggccaagaattctgtacctggcaaagttatccttttaaaatgaaggataaagtagtaccttcccagaaaaaagagtctgttctacatagacctataccataaaacatgcttcagcatgttggaaaatactcctcaaat

SEQ ID NO: 35600 - DNA, 1208 bp, Homo sapiens
agtctcgaactcctgacttcaagtgatctgctcacctcggcctcacaaagttctgggattacaggtgtgagccactgcgcctggcctcccccattacattttaattccacagatacacttgagctgtttatggactatgccccattccgaaggcgacaaatcgttgtaatagctaagacttttttcacctgtcacagaaccaatttttgccccctgggagatgatactgcctcaccccactcagcaataggagtgatatcaagtatcctgttagggaagaataacaatctatgcaaaaggctgcatacacatggcttctagctatagaggatgggtttctaaggctgcaagggtttgctatagggtttgtttctgggttttagacaagagggtaaaactcccttgaatcaagtgaaagatgcccagactgttcttcagcccccagcccaagctctctgcagaaatctgaccctggggctggaggctgttaggaccctatagctcttattgctagtcacaaggtaggagccacccagttgcctttctttcctcatttcccatttgtcctgtgtcatcctccatctatctgccctagcaaagacagtcggagggcctctgagaatcttctgctggcaagattacagtttcacgatagaaaacataagtggagtcaaattacagagtacgcacactgtttcccttgattttcctctcacatcttctgtgcgtggtgagaagagagaggggaggggtataagtgggttcctgggtgagagagggaggtaccagagtaaatacagtgccacttggatggtgacaccccattaccttcagacacaaagatgtaagctgagggaaatgaattcttggattcagggaaatgaattcttggattctgaacatgagggtcagatttacattcctgtctcaattgttgacgcttatcccaaggactagtcattctgcaacatctgtgggaaattcccagattgaacttcccagggagaaacatcatatgacatattgggaaaatggctgacaatggttttccttagtaagttcattgagaagaaaagtgggcggatgatttcccagtcttcactctttcagaagcccctaaaacaatctgacatgctctagttggagcctgctttctatcccatcagtttgatttctgaatgccttatgatcattagcattcttcatta

SEQ ID NO: 35601 - DNA, 797 bp, Homo sapiens
gagcaggaaagggctcagcagaagctccaggctacaacacaagtggccatgcggtgtgggacagatgagctggcagagcccaaagtacccgaggtatctgtggtgggaacagatgcctgtgaagtttatgacaagaccctacaggagaatcacaatgtagacacctggggttctggagcagggccatgccatctgtagccaagaattttatacttcttaagaaacaactcttgatgctacagggttctggtagagacagatcatcagaccatggatcatcaagttgaccatgtgaccaaagctgttcatcatgagctggattctgccatatccaccaagtcataaggtcaggcaaagccagcagcaattcctaagatagaaataatacaactggggttgggcatagcagggccagagggcagaagatagttacgtgagcaggtggcccagacatctatgtcatccactacctttgcaccagtacctgcctgttcctcatttcacacctttggctgcctggggagctctttataatatccagctgatagaagagaaaaaaagccatgccttatccttagataggtcagctcagtgtgtgtgagcaagacaaaaaaagaccgtggctgcactgcagccccacacaggggcatccttgaaagacagcagagtggggagtccttctagtgggcataggttgtgcatcatgcacctagccatccactgtatgtggaaagagaaggagcctgagcttagactatacatggatctcatgggcagtggtgaatggcttggctggt

SEQ ID NO: 35602 - DNA, 227 bp, Homo sapiens
gacatcactgacacccctagaaaatgttaaggtcccctcccttaaggtctcaaagttcttagttctttcactgacctattccttccaccttctagatattcacttttctcttctaaaacacaatgctgactttttctttttttagtacataatacctatgcatggttcaaaatatttcgaaaagggtacagctgatgtgcttgctcccacctgtgtttcttatctgc

SEQ ID NO: 35603 - DNA, 377 bp, Homo sapiens
ttttttagttctttttccaaaaattcttcccttttatttgcaacacattttcctttaatttcttgccaagaaagtggaattgcttgcggactccagccatttcctgatatcagcgtttccagaagctgaacttcctgcaactacaaagaaacacctttcccagccaaatggatgctctcagcagcctttctcttcctttcccgactgaagcccctttggacgtcacttgcagagactgccttttcggaaaagactgtctcagaacccaaggaaacaatggctacgtgtctcagcacttgctctcctgaaggcactattgcaaacacttgctatatattatctcatttaatcttcaccacaatcttaacgactgtagc

SEQ ID NO: 35604 - DNA, 440 bp, Homo sapiens
gactatattttccaaaaaaatgtgagaaggtgagaagagtggcatcatttgatacttttgcaaatctgcttaatgtctgacataatagaaggcagatggattctcatttctgtctctgcattcaaattgttgctgtatcacatgtcatatagcttctggaaaactccactgtgtattcattagagtaaaaaaggcaaataacattttagtatttatcctgaaaatagctttgacctcatggaccatccattaggatctcagaaatttccaggggtccctaaaccgtattttgagaactgcggatatatactgttaaagacacagtgatacacacctttaaggaagaaaaggaaatttaaattaatttgaagacactgtgcaaatcagtactaaatcttagagtgaattatctaggctgtctttgaaacagtttttatgct

SEQ ID NO: 35605 - DNA, 488 bp, Homo sapiens
gaaaatcttcaaaccttggtaatcaatttaaggagcaaatttttaccaaataagaatctctacaaaaacaatgctgcagtatctatttattacaatacataatcagggatgttactgttgaagtcacactatttttgttacttgaaatgcaagacctcttctggtgagacctctataaatgatgaatgtgaacccctgattcttcacaatccttggaggagatagatggttaattgagattaaatatagttgttgctgatatcaccaccaaaatggaaatcattatcatgatcagaaaccgaatttagcaaatgtagtaaaagaaacgttgaactagaaatcggtgcgccccagtaggccattggttgtttagtaatcctgaataaatgaatcattttctcatctatgaaacaagaggcttggccttgctcagtgactccccattgctggttggagtaacatttttaggctatgaaaaagttttcagg

SEQ ID NO: 35606 - DNA, 399 bp, Homo sapiens
gtattttaagtacgaagattttattattcataaaaacactagtttatgctttgggaagagcagagcagaggttcagataacaacaaatgctctttaaggatgtaaaatgtgaactttgttcacagacctcagtgatgtgagcactgttgcttaggagtaacaagttgctaaaatgcagaagggatgggtagtgtttcttgcttctcatgatgaatgtttctgtatgttagtgacttgctgggtaactagtaaggtactagaattgataaatgtgtacagggtcctttgcaataaaactggttatgacttgatccaggtgtttaaaaatcggggctgttaagtctgaccatacatcactgtgatagaatgtgggctttttcaaggatgaagacacaagtc

SEQ ID NO: 35607 - DNA, 903 bp, Homo sapiens
actttatttaatagaaatgggaataaggaacttttcccttgtgtgtatattaaattataggaaaaatattgtttgtatataaagacctgaggttctctttctatagctttttcccccctttgtcccatccccatttctgacctgtttcataagcattccaagcaaaattatagttttacctctgctctcttttattcttctttaatttgaattcgtggttaagttattagaggcagtttttaattttttgttaaaaatctaaaatgcatgtgatagattgtgaaaaaatggctgcccatcaaagagggtaggatgaaggaaaaataaagtgacaggttcttcttctgtcacagacaaattggtttgtggaaaggtctttgtaatcagaagcaaaaatatggtataatgtagtttcaacccagaaatgtgtttgagtccatcatgtgttctgataaagcattgaaaaaaataaaatatggtaaacagagtccatgtgtgctcataatctcctaagaagaacacagcatatacaggaaagctcagaatggcatcaggaatttaaggtggtttcttctgcctgttctttccctatatactttaagctcctcctcatgctccttcttgagatactctatcagatcaacttcttcagatatttatgatggtatggaataatctaattagaaagtactatttaatgactattatcctaaatcctcaactcataaactgaacaaataattttctagttcactaccttattctgttcctttcattcacgttacctgttatcctcaaaggctgtgaaatagctgtcttcaggctgctcccagttagttgtccttgttgcacaactggagggagcacagtattgtttataggtccccaggaaagggtcaaggc

SEQ ID NO: 35608 - DNA, 366 bp, Homo sapiens
atgtttgagaggcagaaatagaacctaaggaggaaattacagctgtcatatactgagtacctgctgtatatctagctttgcaccagacactttgtatcatcatctcatttaaccctcaaatccaagtaaatgttactgtttcacaaactgccctgagtcttagcagcttagtacaagaactggaatgagcttgtgattctttggattggcagtgtgggctagactctgctgggctcattcctgtgtctgccgtaaactaggtagcttttcgggggtttgtctggctatcagcagggaccatgggaacgccagggcaaggtggtgtagggctagttcacatggcggcaggtacaagccggttgtctc

SEQ ID NO: 35609 - DNA, 557 bp, Homo sapiens
tggttgaatactgtcacgttattaatttaaacatactcaaattaccttaagaggacaagctctgaagtgcagtcatgagaattgatttgtggggaaaaaaaaaatgggacacttttagttggagctgggtggggtgacaagtgcagaggctttgagtgtcatgagagcatcagacaggatgtaaaggaagcaacgggcagcagacattggtccctgatcctccattataaccaattttttgcaaacgtatgttgattttgagaataattagctttgactctaaaatgctgtcttccctgaaggagacctaggatttttcttactgggaaacttggctcctggacttaatccacattcgttaaactgtcaccttggcagtttagtggccatctacacaatgatctgacttgttggcattaaaaagtccaaacatagtcatcaaaggaagaagaaagtaaaactgaaaccccttatataaaatatgcttgctttagggtgacccaggctgagtactaagttgtaaagtcaatttccaataaaaattttatgtgccaatt

SEQ ID NO: 35610 - DNA, 234 bp, Homo sapiens
ttacttgccttccctgtaactgtggtttctcgtctgaaaactaagggtgcctcatacggcaattaaattatatagtatctaaaaagtgcttagctctctaattgttcagtaaataacagctgtgctaggttttgaggcagagaaagcccatgaatttgtcaccatttaaaaaggaatcttctctttggtccggcagagatctcatcacatctgcattaccatctgacggctccc

SEQ ID NO: 35611 - DNA, 324 bp, Homo sapiens
agtagagatggggtttctccatgttgatcaggctggtcttgaactcccaacctcaggtgatctgcccgcctcaacctcccaaagttctgggattacaggcgtgagccactgcgcccggtcgagttttttttttttagcagctttaaagacacatgaaaaatgatttcctgtgtttctaccatttctagcacaattctgtaaatctttatacagtcagctctttgtatgtgtggttcccacagccataaattcaaccaaccttggattgaaaatatttggaaactgggcatggctgcacgcgcctataatcccagatgcttggga

SEQ ID NO: 35612 - DNA, 643 bp, Homo sapiens
tttttaagagagtaatattaattagttcattgatcatgctccctgaggaaagggccatagcttgaacttcttgttatctaatagggaatcttgttttcctgtcagaatctgtttcatgcattatggctcagtgagcagctggctgggcctctgccagggagccacagaagaggaaactaaaaatcattttgccttttacaaaagatgaagtccagagtcggccgttttatgattaataatgacctaggtattcccctttggccccaagatagctagattagccacctgctttgatcaggtgactccacagctgtgcatgtgtgctttgtgctgaagaagccaaaactaagacaggggtccaggggtttctaacagtgaaattacaggcattcaaggagagctacattaaattaattttggtgccatcctatgaaggatgagtttacactcccaaaatgaaccagcctgtttttctgctcattgcttaacggtataactgctgcttggctgtctccccaaatgtgcttttacctcctgttttaatccccacccccatcttctgagtccctcccttttaccccctccagtcactcccactcccccacccccgtgggccagttttaaatgtcagcctttgtttaaa

SEQ ID NO: 35613 - DNA, 296 bp, Homo sapiens
gggaactttctgaaatggactggcaatcaggtgagctggattctaatgcctgccttactggtggctttttaatcacacttaagtccctctgcttatctgagatttcattttcttgtctgtgtctagtccgttaccagactccttttcctacacaaatatttgtttcataacagtggaagggacctcagatcattaagttgctatcaccttggggtgacaggtacactaaaatctcagaagtcaccactaaagatcttattcatgtaaccaaataacacctgttccccaaaaccctg

SEQ ID NO: 35614 - DNA, 441 bp, Homo sapiens
aaaaataaataaataaaatataggttcaaattccattaaaacccagtacaagccgaaatgattgtacttgccagttcagtttggctgaagggccaccagcttgcggtctttctatattaccatcccatcatatcctcaggagcagagaatcagcaaatttctcctgtaaacagcctgatagtatatattttaggcttttcaggcttgatggtctcaaagcaggcatagacagtatgtcaacaaatgggcatggttgtgtattacaaaagctttatttatggaaagtgaaatttgaatttcacctaattttcatgtcatgaaatatttttcttttgattttttttccaaccatttaaaaatgtgaaagccattcttagcttgtggtccccacaaaaacaggtggtaagtgagcctccctgggctgtgattcggtggtctctg

SEQ ID NO: 35615 - DNA, 1086 bp, Homo sapiens
atttgtggatcctggtttgttctgtggtaataccctcactgttcatagcttgtcagaaatggtgatttctaggcttgaaagtcatctgagagagagattttctgcccgagagcttatttgagagacagcttgtgtcttgagaacatataggaaaaggcccacattgggctcctggagggatgaaagtgagccatagtagctattttccagtgcatggatttgtatgtaggtgatcatattcacctggcttcttaaaatgccatatgaccagcaagaagattgtcacttaagtcacagttgttctataattgagcagacaagccagttgaatggcccaacgtgaagcaagaaagaatctctgtggttaggcctcggtctctgaaaatttatgttggtactcagttatacagttaatgtgaaatgatgagggagactgggaaccaacactgatgctgtcagaagacctgttctctgggagccccatcacttgctccccagttcctaccctggggtaattgtaatgaggtctcccctggaggcaggggaatgaataataagacactgttacccttaagacccttgccagtcttctaggttttgtgacttttgctgtttccttttgttttattataaggaaataaaaggaaatattgcttaccaaaaacacagttctctttaagacattgataccaggtgcagtggctcatgcctgggtaatctcagcactttgggaggacacgatggatggatcacctgagctcgggagtttgagaccagcctgggcaacatggtgaaatcccatgtctacaaaaaatacaaaaattccctgggcacagtggcatgattacatgattaatttgaagttgtttcttggttggctgccagttttagctattttgtctctactaaaaaggggaaaaaaattagcacctgccagagattaaataagaatgtattcagcttatgatttatttattagggaggtgaaattttcaggtggttagtaaggtgactttgggagtcactcttggattttgagtccctagctttgtcatttaccagctttgtgaccctgggcggactaac

SEQ ID NO: 35616 - DNA, 2108 bp, Homo sapiens
agccgcgcgctcgctcgcaggagggtgggtagtttgcccagcgtaggggggctgggcccataaaagaggaagtgcacttaagacacggccccgctggacgctgttagaaaccgtcctggctgggaaggcaagaggtgtgtgactggacaagacttgtttctggcggtcagtcttgccatcctcacagaggttggcggcccgagagagtgtgaggcagaggcggggagtggcaagggagtgaccatctcggggaacgaaggagtaaacgcggtgatgggacgcacggaaacgggagtggagaaagtcatggagagaaccctaggcggggcggtccccgcggaaaggcggctgctccagggtctccgcacccaagtaggagctggcaggcccggccccgccccgcaggccccaccccgggccccgcccccgaggcttaagccgcgccgccgcctgcgcggagccccactgcgaagcccagctgcgcgcgccttgggattgactgtccacgctcgcccggctcgtccgacgcgccctccgccagccgacagacacagccgcacgcactgccgtgttctccctgcggctcggacacatagtatgaccattaggtgtttcgtctcccacccattttctatggaaaaccaaggggatcgggccatgatagccactggcagctttgaagaacgggacacctttagagaagcttgatcttggaggcctcaccgtgagaccttacaaagccggattccggcagagttcctctatctcgtcttgttgctgattaaaggtgcccctgtctccagtttttctccatctcctgggacgtagcaggaaatcagcatcatggttgggttcaaggccacagatgtgccccctactgccactgtgaagtttcttggggctggcacagctgcctgcatcgcagatctcatcacctttcctctggatactgctaaagtccggttacagatccaaggagaaagtcaggggccagtgcgcgctacagccagcgcccagtaccgcggtgtgatgggcaccattctgaccatggtgcgtactgagggcccccgaagcctctacaatgggctggttgccggcctgcagcgccaaatgagctttgcctctgtccgcatcggcctgtatgattctgtcaaacagttctacaccaagggctctgagcatgccagcattgggagccgcctcctagcaggcagcaccacaggtgccctggctgtggctgtggcccagcccacggatgtggtaaaggtccgattccaagctcaggcccgggctggaggtggtcggagataccaaagcaccgtcaatgcctacaagaccattgcccgagaggaagggttccggggcctctggaaagggacctctcccaatgttgctcgtaatgccattgtcaactgtgctgagctggtgacctatgacctcatcaaggatgccctcctgaaagccaacctcatgacagatgacctcccttgccacttcacttctgcctttggggcaggcttctgcaccactgtcatcgcctcccctgtagacgtggtcaagacgagatacatgaactctgccctgggccagtacagtagcgctggccactgtgcccttaccatgctccagaaggaggggccccgagccttctacaaagggttcatgccctcctttctccgcttgggttcctggaacgtggtgatgttcgtcacctatgagcagctgaaacgagccctcatggctgcctgcacttcccgagaggctcccttctgagcctctcctgctgctgacctgatcacctctggctttgtctctagccgggccatgctttccttttcttccttctttctcttccctccttcccttctctccttccctctttccccacctcttccttccgctcctttacctaccaccttccctctttctacattctcatctactcattgtctcagtgctggtggagttgacatttgacagtgtgggaggcctcgtaccagccaggatcccaagcgtcccgtcccttggaaagttcagccagaatcttcgtcctgcccccgacagcccagcctagcccacttgtcatccataaagcaagctcaaccttg

SEQ ID NO: 35617 - DNA, 335 bp, Homo sapiens
acttagagaggaagaagctattactgcgaagcccagctgcgcgcgccttgggattgactgtccacgctcgcccggctcgtccgacgcgccctccgccagccgacagacacagccgcacgcactgccgtgttctccctgcggctcggacacatagtatgaccattaggtgtttcgtctcccacccattttctatggaaaaccaaggggatcgggccatgatagccactggcagctttgaagaacgggacacctttagagaagcttgatcttggaggcctcaccgtgagaccttacaaagccggctctccagatgaaccacagaagcaggaatgtgg

SEQ ID NO: 35618 - DNA, 277 bp, Homo sapiens
catgaaccctttgtagaaggctacggggccgttcatgccctcctttctccgcttgggttcctggaacgtggtgatgttcgtcacctatgagcagctgaaacgagccctcatggctgcctgcacttcccgagaggctcccttctgagcctctcctgctgctgacctgatcacctctggctttgtctctagccgggccatgctttccttttcttccttctttctcttccctccttcccttctctccttccgtccagagcttgggatcctctaggagtcg

SEQ ID NO: 35619 - DNA, 1666 bp, Homo sapiens
acttagagaggaagaagctattactgcgaagcccagctgcgcgcgccttgggattgactgtccacgctcgcccggctcgtccgacgcgccctccgccagccgacagacacagccgcacgcactgccgtgttctccctgcggctcggacacatagtatgaccattaggtgtttcgtctcccacccattttctatggaaaaccaaggggatcgggccatgatagccactggcagctttgaagaacgggacacctttagagaagcttgatcttggaggcctcaccgtgagaccttacaaagccggattccggcagagttcctctatctcgtcttgttgctgattaaaggtgcccctgtctccagtttttctccatctcctgggacgtagcaggaaatcagcatcatggttgggttcaaggccacagatgtgccccctactgccactgtgaagtttcttggggctggcacagctgcctgcatcgcagatctcatcacctttcctctggatactgctaaagtccggttacagatccaaggagaaagtcaggggccagtgcgcgctacagccagcgcccagtaccgcggtgtgatgggcaccattctgaccatggtgcgtactgagggcccccgaagcctctacaatgggctggttgccggcctgcagcgccaaatgagctttgcctctgtccgcatcggcctgtatgattctgtcaaacagttctacaccaagggctctgagcatgccagcattgggagccgcctcctagcaggcagcaccacaggtgccctggctgtggctgtggcccagcccacggatgtggtaaaggtccgattccaagctcaggcccgggctggaggtggtcggagataccaaagcaccgtcaatgcctacaagaccattgcccgagaggaagggttccggggcctctggaaagggacctctcccaatgttgctcgtaatgccattgtcaactgtgctgagctggtgacctatgacctcatcaaggatgccctcctgaaagccaacctcatgacagatgacctcccttgccacttcacttctgcctttggggcaggcttctgcaccactgtcatcgcctcccctgtagacgtggtcaagacgagatacatgaactctgccctgggccagtacagtagcgctggccactgtgcccttaccatgctccagaaggaggggccccgagccttctacaaagggttcatgccctcctttctccgcttgggttcctggaacgtggtgatgttcgtcacctatgagcagctgaaacgagccctcatggctgcctgcacttcccgagaggctcccttctgagcctctcctgctgctgacctgatcacctctggctttgtctctagccgggccatgctttccttttcttccttctttctcttccctccttcccttctctccttccctctttccccacctcttccttccgctcctttacctaccaccttccctctttctacattctcatctactcattgtctcagtgctggtggagttgacatttgacagtgtgggaggcctcgtaccagccaggatcccaagcgtcccgtcccttggaaagttcagccagaatcttcgtcctgcccccgacagcccagcctagcccacttgtcatccataaagcaagctcaaccttg

SEQ ID NO: 35620 - DNA, 2461 bp, Homo sapiens
agccgcgcgctcgctcgcaggagggtgggtagtttgcccagcgtaggggggctgggcccataaaagaggaagtgcacttaagacacggccccgctggacgctgttagaaaccgtcctggctgggaaggcaagaggtgtgtgactggacaagacttgtttctggcggtcagtcttgccatcctcacagaggttggcggcccgagagagtgtgaggcagaggcggggagtggcaagggagtgaccatctcggggaacgaaggagtaaacgcggtgatgggacgcacggaaacgggagtggagaaagtcatggagagaaccctaggcggggcggtccccgcggaaaggcggctgctccagggtctccgcacccaagtaggagctggcaggcccggccccgccccgcaggccccaccccgggccccgcccccgaggcttaagccgcgccgccgcctgcgcggagccccactgcgaagcccagctgcgcgcgccttgggattgactgtccacgctcgcccggctcgtccgacgcgccctccgccagccgacagacacagccgcacgcactgccgtgttctccctgcggctcggacacatagtatgaccattaggtgtttcgtctcccacccattttctatggaaaaccaaggggatcgggccatgatagccactggcagctttgaagaacgggacacctttagagaagcttgatcttggaggcctcaccgtgagaccttacaaagccggattccggcagagttcctctatctcgtcttgttgctgattaaaggtgcccctgtctccagtttttctccatctcctgggacgtagcaggaaatcagcatcatggttgggttcaaggccacagatgtgccccctactgccactgtgaagtttcttggggctggcacagctgcctgcatcgcagatctcatcacctttcctctggatactgctaaagtccggttacagatccaaggagaaagtcaggggccagtgcgcgctacagccagcgcccagtaccgcggtgtgatgggcaccattctgaccatggtgcgtactgagggcccccgaagcctctacaatgggctggttgccggcctgcagcgccaaatgagctttgcctctgtccgcatcggcctgtatgattctgtcaaacagttctacaccaagggctctgagcatgccagcattgggagccgcctcctagcaggcagcaccacaggtgccctggctgtggctgtggcccagcccacggatgtggtaaaggtccgattccaagctcaggcccgggctggaggtggtcggagataccaaagcaccgtcaatgcctacaagaccattgcccgagaggaagggttccggggcctctggaaagggacctctcccaatgttgctcgtaatgccattgtcaactgtgctgagctggtgacctatgacctcatcaaggatgccctcctgaaagccaacctcatgacagatgacctcccttgccacttcacttctgcctttggggcaggcttctgcaccactgtcatcgcctcccctgtagacgtggtcaagacgagatacatgaactctgccctgggccagtacagtagcgctggccactgtgcccttaccatgctccagaaggaggggccccgagccttctacaaagggttcatgccctcctttctccgcttgggttcctggaacgtggtgatgttcgtcacctatgagcagctgaaacgagccctcatggctgcctgcacttcccgagaggctcccttctgagcctctcctgctgctgacctgatcacctctggctttgtctctagccgggccatgctttccttttcttccttctttctcttccctccttcccttctctccttccctctttccccacctcttccttccgctcctttacctaccaccttccctctttctacattctcatctactcattgtctcagtgctggtggagttgacatttgacagtgtgggaggcctcgtaccagccaggatcccaagcgtcccgtcccttggaaagttcagccagaatcttcgtcctgcccccgacagcccagcctagcccacttgtcatccataaagcaagctcaaccttgaaaaaaaaaaaaaaacaaaaaaaaaaaaaaaaaaaaaaaaaaaaaaaaaagaaaaaaaaaaaaaaaaaaaacaacacaaaaaacaacaaaaacaacaaacaaacaaaaaaagggggggggacccacaaaacaacccccacgcagggggcaaccaaaaacggcacgcaaaccaccttattgacaaaaaaaagagacgcccaccataaaagagacacgaccaacaaaaacaacaggaccgcgagcgcaccctaaaacaacaaggcctgacagaaaacaaaccactagcggaccacacagagaaaacagcacacaacggggagaaacaacacgagagcgacaaaacagccacagaa

SEQ ID NO: 35621 - DNA, 2485 bp, Homo sapiens
agccgcgcgctcgctcgcaggagggtgggtagtttgcccagcgtaggggggctgggcccataaaagaggaagtgcacttaagacacggccccgctggacgctgttagaaaccgtcctggctgggaaggcaagaggtgtgtgactggacaagacttgtttctggcggtcagtcttgccatcctcacagaggttggcggcccgagagagtgtgaggcagaggcggggagtggcaagggagtgaccatctcggggaacgaaggagtaaacgcggtgatgggacgcacggaaacgggagtggagaaagtcatggagagaaccctaggcggggcggtccccgcggaaaggcggctgctccagggtctccgcacccaagtaggagctggcaggcccggccccgccccgcaggccccaccccgggccccgcccccgaggcttaagccgcgccgccgcctgcgcggagccccactgcgaagcccagctgcgcgcgccttgggattgactgtccacgctcgcccggctcgtccgacgcgccctccgccagccgacagacacagccgcacgcactgccgtgttctccctgcggctcggacacatagtatgaccattaggtgtttcgtctcccacccattttctatggaaaaccaaggggatcgggccatgatagccactggcagctttgaagaacgggacacctttagagaagcttgatcttggaggcctcaccgtgagaccttacaaagccggattccggcagagttcctctatctcgtcttgttgctgattaaaggtgcccctgtctccagtttttctccatctcctgggacgtagcaggaaatcagcatcatggttgggttcaaggccacagatgtgccccctactgccactgtgaagtttcttggggctggcacagctgcctgcatcgcagatctcatcacctttcctctggatactgctaaagtccggttacagatccaaggagaaagtcaggggccagtgcgcgctacagccagcgcccagtaccgcggtgtgatgggcaccattctgaccatggtgcgtactgagggcccccgaagcctctacaatgggctggttgccggcctgcagcgccaaatgagctttgcctctgtccgcatcggcctgtatgattctgtcaaacagttctacaccaagggctctgagcatgccagcattgggagccgcctcctagcaggcagcaccacaggtgccctggctgtggctgtggcccagcccacggatgtggtaaaggtccgattccaagctcaggcccgggctggaggtggtcggagataccaaagcaccgtcaatgcctacaagaccattgcccgagaggaagggttccggggcctctggaaagggacctctcccaatgttgctcgtaatgccattgtcaactgtgctgagctggtgacctatgacctcatcaaggatgccctcctgaaagccaacctcatgacagatgacctcccttgccacttcacttctgcctttggggcaggcttctgcaccactgtcatcgcctcccctgtagacgtggtcaagacgagatacatgaactctgccctgggccagtacagtagcgctggccactgtgcccttaccatgctccagaaggaggggccccgagccttctacaaagggttcatgccctcctttctccgcttgggttcctggaacgtggtgatgttcgtcacctatgagcagctgaaacgagccctcatggctgcctgcacttcccgagaggctcccttctgagcctctcctgctgctgacctgatcacctctggctttgtctctagccgggccatgctttccttttcttccttctttctcttccctccttcccttctctccttccctctttccccacctcttccttccgctcctttacctaccaccttccctctttctacattctcatctactcattgtctcagtgctggtggagttgacatttgacagtgtgggaggcctcgtaccagccaggatcccaagcgtcccgtcccttggaaagttcagccagaatcttcgtcctgcccccgacagcccagcctagcccacttgtcatccataaagcaagctcaaccttgtggcgtctcctccctctcttgtagctcttaccagaggtcttggtccaatggcctttttgggtacctggtgggcaggggaggaaccacctgactttgaaaatgggtgtgatccaccttccacctccagcatccaatctgaagcccgtgtaggtcatctggtccatttctctctagacccaggccctgtactaacatggggagtgcaggagccacctgagagacagcagtgcctccccttcctttgccgggccacttgagctcttactcagaatctggtactctagtgcctgccatcccaaccccccacccacaccgcaggccttgtttatctgcacaacaagagtgctcctgtgtgccctgcatctcctgcagttcca

SEQ ID NO: 35622 - DNA, 2165 bp, Homo sapiens
  misc_feature (2153)..(2153): n is a, c, g, or t
agccgcgcgctcgctcgcaggagggtgggtagtttgcccagcgtaggggggctgggcccataaaagaggaagtgcacttaagacacggccccgctggacgctgttagaaaccgtcctggctgggaaggcaagaggtgtgtgactggacaagacttgtttctggcggtcagtcttgccatcctcacagaggttggcggcccgagagagtgtgaggcagaggcggggagtggcaagggagtgaccatctcggggaacgaaggagtaaacgcggtgatgggacgcacggaaacgggagtggagaaagtcatggagagaaccctaggcggggcggtccccgcggaaaggcggctgctccagggtctccgcacccaagtaggagctggcaggcccggccccgccccgcaggccccaccccgggccccgcccccgaggcttaagccgcgccgccgcctgcgcggagccccactgcgaagcccagctgcgcgcgccttgggattgactgtccacgctcgcccggctcgtccgacgcgccctccgccagccgacagacacagccgcacgcactgccgtgttctccctgcggctcggacacatagtatgaccattaggtgtttcgtctcccacccattttctatggaaaaccaaggggatcgggccatgatagccactggcagctttgaagaacgggacacctttagagaagcttgatcttggaggcctcaccgtgagaccttacaaagccggattccggcagagttcctctatctcgtcttgttgctgattaaaggtgcccctgtctccagtttttctccatctcctgggacgtagcaggaaatcagcatcatggttgggttcaaggccacagatgtgccccctactgccactgtgaagtttcttggggctggcacagctgcctgcatcgcagatctcatcacctttcctctggatactgctaaagtccggttacagatccaaggagaaagtcaggggccagtgcgcgctacagccagcgcccagtaccgcggtgtgatgggcaccattctgaccatggtgcgtactgagggcccccgaagcctctacaatgggctggttgccggcctgcagcgccaaatgagctttgcctctgtccgcatcggcctgtatgattctgtcaaacagttctacaccaagggctctgagcatgccagcattgggagccgcctcctagcaggcagcaccacaggtgccctggctgtggctgtggcccagcccacggatgtggtaaaggtccgattccaagctcaggcccgggctggaggtggtcggagataccaaagcaccgtcaatgcctacaagaccattgcccgagaggaagggttccggggcctctggaaagggacctctcccaatgttgctcgtaatgccattgtcaactgtgctgagctggtgacctatgacctcatcaaggatgccctcctgaaagccaacctcatgacagatgacctcccttgccacttcacttctgcctttggggcaggcttctgcaccactgtcatcgcctcccctgtagacgtggtcaagacgagatacatgaactctgccctgggccagtacagtagcgctggccactgtgcccttaccatgctccagaaggaggggccccgagccttctacaaagggttcatgccctcctttctccgcttgggttcctggaacgtggtgatgttcgtcacctatgagcagctgaaacgagccctcatggctgcctgcacttcccgagaggctcccttctgagcctctcctgctgctgacctgatcacctctggctttgtctctagccgggccatgctttccttttcttccttctttctcttccctccttcccttctctccttccctctttccccacctcttccttccgctcctttacctaccaccttccctctttctacattctcatctactcattgtctcagtgctggtggagttgacatttgacagtgtgggaggcctcgtaccagccaggatcccaagcgtcccgtcccttggaaagttcagccagaatcttcgtcctgcccccgacagcccagcctagcccacttgtcatccataaagcaagctcaaccttgagaatcttcgtcctgcccccgacaagtgggctaggctgggctgtnccgggctagttc

SEQ ID NO: 35623 - DNA, 2119 bp, Homo sapiens
agccgcgcgctcgctcgcaggagggtgggtagtttgcccagcgtaggggggctgggcccataaaagaggaagtgcacttaagacacggccccgctggacgctgttagaaaccgtcctggctgggaaggcaagaggtgtgtgactggacaagacttgtttctggcggtcagtcttgccatcctcacagaggttggcggcccgagagagtgtgaggcagaggcggggagtggcaagggagtgaccatctcggggaacgaaggagtaaacgcggtgatgggacgcacggaaacgggagtggagaaagtcatggagagaaccctaggcggggcggtccccgcggaaaggcggctgctccagggtctccgcacccaagtaggagctggcaggcccggccccgccccgcaggccccaccccgggccccgcccccgaggcttaagccgcgccgccgcctgcgcggagccccactgcgaagcccagctgcgcgcgccttgggattgactgtccacgctcgcccggctcgtccgacgcgccctccgccagccgacagacacagccgcacgcactgccgtgttctccctgcggctcggacacatagtatgaccattaggtgtttcgtctcccacccattttctatggaaaaccaaggggatcgggccatgatagccactggcagctttgaagaacgggacacctttagagaagcttgatcttggaggcctcaccgtgagaccttacaaagccggattccggcagagttcctctatctcgtcttgttgctgattaaaggtgcccctgtctccagtttttctccatctcctgggacgtagcaggaaatcagcatcatggttgggttcaaggccacagatgtgccccctactgccactgtgaagtttcttggggctggcacagctgcctgcatcgcagatctcatcacctttcctctggatactgctaaagtccggttacagatccaaggagaaagtcaggggccagtgcgcgctacagccagcgcccagtaccgcggtgtgatgggcaccattctgaccatggtgcgtactgagggcccccgaagcctctacaatgggctggttgccggcctgcagcgccaaatgagctttgcctctgtccgcatcggcctgtatgattctgtcaaacagttctacaccaagggctctgagcatgccagcattgggagccgcctcctagcaggcagcaccacaggtgccctggctgtggctgtggcccagcccacggatgtggtaaaggtccgattccaagctcaggcccgggctggaggtggtcggagataccaaagcaccgtcaatgcctacaagaccattgcccgagaggaagggttccggggcctctggaaagggacctctcccaatgttgctcgtaatgccattgtcaactgtgctgagctggtgacctatgacctcatcaaggatgccctcctgaaagccaacctcatgacagatgacctcccttgccacttcacttctgcctttggggcaggcttctgcaccactgtcatcgcctcccctgtagacgtggtcaagacgagatacatgaactctgccctgggccagtacagtagcgctggccactgtgcccttaccatgctccagaaggaggggccccgagccttctacaaagggttcatgccctcctttctccgcttgggttcctggaacgtggtgatgttcgtcacctatgagcagctgaaacgagccctcatggctgcctgcacttcccgagaggctcccttctgagcctctcctgctgctgacctgatcacctctggctttgtctctagccgggccatgctttccttttcttccttctttctcttccctccttcccttctctccttccctctttccccacctcttccttccgctcctttacctaccaccttccctctttctacattctcatctactcattgtctcagtgctggtggagttgacatttgacagtgtgggaggcctcgtaccagccaggatcccaagcgtcccgtcccttggaaagttcagccagaatcttcgtactgaacccgtcaccaacagactgactgtcttgcccagcgtttatcctctagagtcagctatcagcggt

SEQ ID NO: 35624 - DNA, 2153 bp, Homo sapiens
agccgcgcgctcgctcgcaggagggtgggtagtttgcccagcgtaggggggctgggcccataaaagaggaagtgcacttaagacacggccccgctggacgctgttagaaaccgtcctggctgggaaggcaagaggtgtgtgactggacaagacttgtttctggcggtcagtcttgccatcctcacagaggttggcggcccgagagagtgtgaggcagaggcggggagtggcaagggagtgaccatctcggggaacgaaggagtaaacgcggtgatgggacgcacggaaacgggagtggagaaagtcatggagagaaccctaggcggggcggtccccgcggaaaggcggctgctccagggtctccgcacccaagtaggagctggcaggcccggccccgccccgcaggccccaccccgggccccgcccccgaggcttaagccgcgccgccgcctgcgcggagccccactgcgaagcccagctgcgcgcgccttgggattgactgtccacgctcgcccggctcgtccgacgcgccctccgccagccgacagacacagccgcacgcactgccgtgttctccctgcggctcggacacatagtatgaccattaggtgtttcgtctcccacccattttctatggaaaaccaaggggatcgggccatgatagccactggcagctttgaagaacgggacacctttagagaagcttgatcttggaggcctcaccgtgagaccttacaaagccggattccggcagagttcctctatctcgtcttgttgctgattaaaggtgcccctgtctccagtttttctccatctcctgggacgtagcaggaaatcagcatcatggttgggttcaaggccacagatgtgccccctactgccactgtgaagtttcttggggctggcacagctgcctgcatcgcagatctcatcacctttcctctggatactgctaaagtccggttacagatccaaggagaaagtcaggggccagtgcgcgctacagccagcgcccagtaccgcggtgtgatgggcaccattctgaccatggtgcgtactgagggcccccgaagcctctacaatgggctggttgccggcctgcagcgccaaatgagctttgcctctgtccgcatcggcctgtatgattctgtcaaacagttctacaccaagggctctgagcatgccagcattgggagccgcctcctagcaggcagcaccacaggtgccctggctgtggctgtggcccagcccacggatgtggtaaaggtccgattccaagctcaggcccgggctggaggtggtcggagataccaaagcaccgtcaatgcctacaagaccattgcccgagaggaagggttccggggcctctggaaagggacctctcccaatgttgctcgtaatgccattgtcaactgtgctgagctggtgacctatgacctcatcaaggatgccctcctgaaagccaacctcatgacagatgacctcccttgccacttcacttctgcctttggggcaggcttctgcaccactgtcatcgcctcccctgtagacgtggtcaagacgagatacatgaactctgccctgggccagtacagtagcgctggccactgtgcccttaccatgctccagaaggaggggccccgagccttctacaaagggttcatgccctcctttctccgcttgggttcctggaacgtggtgatgttcgtcacctatgagcagctgaaacgagccctcatggctgcctgcacttcccgagaggctcccttctgagcctctcctgctgctgacctgatcacctctggctttgtctctagccgggccatgctttccttttcttccttctttctcttccctccttcccttctctccttccctctttccccacctcttccttccgctcctttacctaccaccttccctctttccccacctcttccttccgctcctttacctaccaccttccctctttctacattctcatctactcattgtctcagtgctggtggagttgacatttgacagtgtgggaggcctcgtaccagccaggatcccaagcgtcccgtcccttggaaagttcagccagaatcttcgtcctgcccccgacagcccagcctagcccacttgtcatccataaagcaagctcaaccttg

SEQ ID NO: 35625 - DNA, 2008 bp, Homo sapiens
  misc_feature (1887)..(1888): n is a, c, g, or t
  misc_feature (1893)..(1893): n is a, c, g, or t
agccgcgcgctcgctcgcaggagggtgggtagtttgcccagcgtaggggggctgggcccataaaagaggaagtgcacttaagacacggccccgctggacgctgttagaaaccgtcctggctgggaaggcaagaggtgtgtgactggacaagacttgtttctggcggtcagtcttgccatcctcacagaggttggcggcccgagagagtgtgaggcagaggcggggagtggcaagggagtgaccatctcggggaacgaaggagtaaacgcggtgatgggacgcacggaaacgggagtggagaaagtcatggagagaaccctaggcggggcggtccccgcggaaaggcggctgctccagggtctccgcacccaagtaggagctggcaggcccggccccgccccgcaggccccaccccgggccccgcccccgaggcttaagccgcgccgccgcctgcgcggagccccactgcgaagcccagctgcgcgcgccttgggattgactgtccacgctcgcccggctcgtccgacgcgccctccgccagccgacagacacagccgcacgcactgccgtgttctccctgcggctcggacacatagtatgaccattaggtgtttcgtctcccacccattttctatggaaaaccaaggggatcgggccatgatagccactggcagctttgaagaacgggacacctttagagaagcttgatcttggaggcctcaccgtgagaccttacaaagccggattccggcagagttcctctatctcgtcttgttgctgattaaaggtgcccctgtctccagtttttctccatctcctgggacgtagcaggaaatcagcatcatggttgggttcaaggccacagatgtgccccctactgccactgtgaagtttcttggggctggcacagctgcctgcatcgcagatctcatcacctttcctctggatactgctaaagtccggttacagatccaaggagaaagtcaggggccagtgcgcgctacagccagcgcccagtaccgcggtgtgatgggcaccattctgaccatggtgcgtactgagggcccccgaagcctctacaatgggctggttgccggcctgcagcgccaaatgagctttgcctctgtccgcatcggcctgtatgattctgtcaaacagttctacaccaagggctctgagcatgccagcattgggagccgcctcctagcaggcagcaccacaggtgccctggctgtggctgtggcccagcccacggatgtggtaaaggtccgattccaagctcaggcccgggctggaggtggtcggagataccaaagcaccgtcaatgcctacaagaccattgcccgagaggaagggttccggggcctctggaaagggacctctcccaatgttgctcgtaatgccattgtcaactgtgctgagctggtgacctatgacctcatcaaggatgccctcctgaaagccaacctcatgacagatgacctcccttgccacttcacttctgcctttggggcaggcttctgcaccactgtcatcgcctcccctgtagacgtggtcaagacgagatacatgaactctgccctgggccagtacagtagcgctggccactgtgcccttaccatgctccagaaggaggggccccgagccttctacaaagggttcatgccctcctttctccgcttgggttcctggaacgtggtgatgttcgtcacctatgagcagctgaaacgagccctcatggctgcctgcacttcccgagaggctcccttctgagcctctcctgctgctgacctgatcacctctggctttgtctctagccgggccatgctttccttttcttccttctttctcttccctccttcccttctctccttccgtctctttctnntactntctctcttctctatactctccttcctttctttcttccttcctctctgtctctctttccctctctctctctatttctcacttactctccttccttccttcatctcgtctcttctct

SEQ ID NO: 35626 - DNA, 1861 bp, Homo sapiens
agccgcgcgctcgctcgcaggagggtgggtagtttgcccagcgtaggggggctgggcccataaaagaggaagtgcacttaagacacggccccgctggacgctgttagaaaccgtcctggctgggaaggcaagaggtgtgtgactggacaagacttgtttctggcggtcagtcttgccatcctcacagaggttggcggcccgagagagtgtgaggcagaggcggggagtggcaagggagtgaccatctcggggaacgaaggagtaaacgcggtgatgggacgcacggaaacgggagtggagaaagtcatggagagaaccctaggcggggcggtccccgcggaaaggcggctgctccagggtctccgcacccaagtaggagctggcaggcccggccccgccccgcaggccccaccccgggccccgcccccgaggcttaagccgcgccgccgcctgcgcggagccccactgcgaagcccagctgcgcgcgccttgggattgactgtccacgctcgcccggctcgtccgacgcgccctccgccagccgacagacacagccgcacgcactgccgtgttctccctgcggctcggacacatagtatgaccattaggtgtttcgtctcccacccattttctatggaaaaccaaggggatcgggccatgatagccactggcagctttgaagaacgggacacctttagagaagcttgatcttggaggcctcaccgtgagaccttacaaagccggattccggcagagttcctctatctcgtcttgttgctgattaaaggtgcccctgtctccagtttttctccatctcctgggacgtagcaggaaatcagcatcatggttgggttcaaggccacagatgtgccccctactgccactgtgaagtttcttggggctggcacagctgcctgcatcgcagatctcatcacctttcctctggatactgctaaagtccggttacagatccaaggagaaagtcaggggccagtgcgcgctacagccagcgcccagtaccgcggtgtgatgggcaccattctgaccatggtgcgtactgagggcccccgaagcctctacaatgggctggttgccggcctgcagcgccaaatgagctttgcctctgtccgcatcggcctgtatgattctgtcaaacagttctacaccaagggctctgagcatgccagcattgggagccgcctcctagcaggcagcaccacaggtgccctggctgtggctgtggcccagcccacggatgtggtaaaggtccgattccaagctcaggcccgggctggaggtggtcggagataccaaagcaccgtcaatgcctacaagaccattgcccgagaggaagggttccggggcctctggaaagggacctctcccaatgttgctcgtaatgccattgtcaactgtgctgagctggtgacctatgacctcatcaaggatgccctcctgaaagccaacctcatgacagatgacctcccttgccacttcacttctgcctttggggcaggcttctgcaccactgtcatcgcctcccctgtagacgtggtcaagacgagatacatgaactctgccctgggccagtacagtagcgctggccactgtgcccttaccatgctccagaaggaggggccccgagccttctacaaagggttcatgccctcctttctccgcttgggttcctggaacgtggtgatgttcgtcacctatgagcagctgaaacgagccctcatggctgcctgcacttcccgagaggctcccttctgagcctctcctgctgctgacctgatcacctctggctttgggcacggacacatcgctcagcacgcggatgggatcctctaaagcgcgcaga

SEQ ID NO: 35627 - DNA, 2007 bp, Homo sapiens
  misc_feature (102)..(102): n is a, c, g, or t
  misc_feature (104)..(105): n is a, c, g, or t
  misc_feature (118)..(118): n is a, c, g, or t
gcgctgcgcgatgctacttggaatagttcacagcctcgtcccgcgactcgttgcccgaacgtctgctactctcgtacgagtacgacaatgaacacagacgcntnntactgccgagatncatccctgcggctcggacacatagtatgaccattaggtgtttcgtctcccacccattttctatggaaaaccaaggggatcgggccatgatagccactggcagctttgaagaacgggacacctttagagaagcttgatcttggaggcctcaccgtgagaccttacaaagccggattccggcagagttcctctatctcgtcttgttgctgattaaaggtgcccctgtctccagtttttctccatctcctgggacgtagcaggaaatcagcatcatggttgggttcaaggccacagatgtgccccctactgccactgtgaagtttcttggggctggcacagctgcctgcatcgcagatctcatcacctttcctctggatactgctaaagtccggttacagatccaaggagaaagtcaggggccagtgcgcgctacagccagcgcccagtaccgcggtgtgatgggcaccattctgaccatggtgcgtactgagggcccccgaagcctctacaatgggctggttgccggcctgcagcgccaaatgagctttgcctctgtccgcatcggcctgtatgattctgtcaaacagttctacaccaagggctctgagcatgccagcattgggagccgcctcctagcaggcagcaccacaggtgccctggctgtggctgtggcccagcccacggatgtggtaaaggtccgattccaagctcaggcccgggctggaggtggtcggagataccaaagcaccgtcaatgcctacaagaccattgcccgagaggaagggttccggggcctctggaaagggacctctcccaatgttgctcgtaatgccattgtcaactgtgctgagctggtgacctatgacctcatcaaggatgccctcctgaaagccaacctcatgacagatgacctcccttgccacttcacttctgcctttggggcaggcttctgcaccactgtcatcgcctcccctgtagacgtggtcaagacgagatacatgaactctgccctgggccagtacagtagcgctggccactgtgcccttaccatgctccagaaggaggggccccgagccttctacaaagggttcatgccctcctttctccgcttgggttcctggaacgtggtgatgttcgtcacctatgagcagctgaaacgagccctcatggctgcctgcacttcccgagaggctcccttctgagcctctcctgctgctgacctgatcacctctggctttgtctctagccgggccatgctttccttttcttccttctttctcttccctccttcccttctctccttccctctttccccacctcttccttccgctcctttacctaccaccttccctctttctacattctcatctactcattgtctcagtgctggtggagttgacatttgacagtgtgggaggcctcgtaccagccaggatcccaagcgtcccgtcccttggaaagttcagccagaatcttcgtcctgcccccgacagcccagcctagcccacttgtcatccataaagcaagctcaaccttgaaaaaaaaaaaaaaacaaaaaaaaaaaaaaaaaaaaaaaaaaaaaaaaaagaaaaaaaaaaaaaaaaaaaacaacacaaaaaacaacaaaaacaacaaacaaacaaaaaaagggggggggacccacaaaacaacccccacgcagggggcaaccaaaaacggcacgcaaaccaccttattgacaaaaaaaagagacgcccaccataaaagagacacgaccaacaaaaacaacaggaccgcgagcgcaccctaaaacaacaaggcctgacagaaaacaaaccactagcggaccacacagagaaaacagcacacaacggggagaaacaacacgagagcgacaaaacagccacagaa

SEQ ID NO: 35628 - DNA, 1997 bp, Homo sapiens
  misc_feature (92)..(92): n is a, c, g, or t
  misc_feature (94)..(95): n is a, c, g, or t
  misc_feature (108)..(108): n is a, c, g, or t
gggctgcgcagatgcggatatggaatgttcacgctctcccggatccgtccgaacgtcgctactctgtacgagtcacgacatacacagacgcntnntactgccgagatncatccctgcggctcggacacatagtatgaccattaggtgtttcgtctcccacccattttctatggaaaaccaaggggatcgggccatgatagccactggcagctttgaagaacgggacacctttagagaagcttgatcttggaggcctcaccgtgagaccttacaaagccggattccggcagagttcctctatctcgtcttgttgctgattaaaggtgcccctgtctccagtttttctccatctcctgggacgtagcaggaaatcagcatcatggttgggttcaaggccacagatgtgccccctactgccactgtgaagtttcttggggctggcacagctgcctgcatcgcagatctcatcacctttcctctggatactgctaaagtccggttacagatccaaggagaaagtcaggggccagtgcgcgctacagccagcgcccagtaccgcggtgtgatgggcaccattctgaccatggtgcgtactgagggcccccgaagcctctacaatgggctggttgccggcctgcagcgccaaatgagctttgcctctgtccgcatcggcctgtatgattctgtcaaacagttctacaccaagggctctgagcatgccagcattgggagccgcctcctagcaggcagcaccacaggtgccctggctgtggctgtggcccagcccacggatgtggtaaaggtccgattccaagctcaggcccgggctggaggtggtcggagataccaaagcaccgtcaatgcctacaagaccattgcccgagaggaagggttccggggcctctggaaagggacctctcccaatgttgctcgtaatgccattgtcaactgtgctgagctggtgacctatgacctcatcaaggatgccctcctgaaagccaacctcatgacagatgacctcccttgccacttcacttctgcctttggggcaggcttctgcaccactgtcatcgcctcccctgtagacgtggtcaagacgagatacatgaactctgccctgggccagtacagtagcgctggccactgtgcccttaccatgctccagaaggaggggccccgagccttctacaaagggttcatgccctcctttctccgcttgggttcctggaacgtggtgatgttcgtcacctatgagcagctgaaacgagccctcatggctgcctgcacttcccgagaggctcccttctgagcctctcctgctgctgacctgatcacctctggctttgtctctagccgggccatgctttccttttcttccttctttctcttccctccttcccttctctccttccctctttccccacctcttccttccgctcctttacctaccaccttccctctttctacattctcatctactcattgtctcagtgctggtggagttgacatttgacagtgtgggaggcctcgtaccagccaggatcccaagcgtcccgtcccttggaaagttcagccagaatcttcgtcctgcccccgacagcccagcctagcccacttgtcatccataaagcaagctcaaccttgaaaaaaaaaaaaaaacaaaaaaaaaaaaaaaaaaaaaaaaaaaaaaaaaagaaaaaaaaaaaaaaaaaaaacaacacaaaaaacaacaaaaacaacaaacaaacaaaaaaagggggggggacccacaaaacaacccccacgcagggggcaaccaaaaacggcacgcaaaccaccttattgacaaaaaaaagagacgcccaccataaaagagacacgaccaacaaaaacaacaggaccgcgagcgcaccctaaaacaacaaggcctgacagaaaacaaaccactagcggaccacacagagaaaacagcacacaacggggagaaacaacacgagagcgacaaaacagccacagaa

SEQ ID NO: 35629 - DNA, 1844 bp, Homo sapiens
agccgcgcgctcgctcgcaggagggtgggtagtttgcccagcgtaggggggctgggcccataaaagaggaagtgcacttaagacacggccccgctggacgctgttagaaaccgtcctggctgggaaggcaagaggtgtgtgactggacaagacttgtttctggcggtcagtcttgccatcctcacagaggttggcggcccgagagagtgtgaggcagaggcggggagtggcaagggagtgaccatctcggggaacgaaggagtaaacgcggtgatgggacgcacggaaacgggagtggagaaagtcatggagagaaccctaggcggggcggtccccgcggaaaggcggctgctccagggtctccgcacccaagtaggagctggcaggcccggccccgccccgcaggccccaccccgggccccgcccccgaggcttaagccgcgccgccgcctgcgcggagccccactgcgaagcccagctgcgcgcgccttgggattgactgtccacgctcgcccggctcgtccgacgcgccctccgccagccgacagacacagccgcacgcactgccgtgttctccctgcggctcggacacatagtatgaccattaggtgtttcgtctcccacccattttctatggaaaaccaaggggatcgggccatgatagccactggcagctttgaagaacgggacacctttagagaagcttgatcttggaggcctcaccgtgagaccttacaaagccggattccggcagagttcctctatctcgtcttgttgctgattaaaggtgcccctgtctccagtttttctccatctcctgggacgtagcaggaaatcagcatcatggttgggttcaaggccacagatgtgccccctactgccactgtgaagtttcttggggctggcacagctgcctgcatcgcagatctcatcacctttcctctggatactgctaaagtccggttacagatccaaggagaaagtcaggggccagtgcgcgctacagccagcgcccagtaccgcggtgtgatgggcaccattctgaccatggtgcgtactgagggcccccgaagcctctacaatgggctggttgccggcctgcagcgccaaatgagctttgcctctgtccgcatcggcctgtatgattctgtcaaacagttctacaccaagggctctgagcatgccagcattgggagccgcctcctagcaggcagcaccacaggtgccctggctgtggctgtggcccagcccacggatgtggtaaaggtccgattccaagctcaggcccgggctggaggtggtcggagataccaaagcaccgtcaatgcctacaagaccattgcccgagaggaagggttccggggcctctggaaagggacctctcccaatgttgctcgtaatgccattgtcaactgtgctgagctggtgacctatgacctcatcaaggatgccctcctgaaagccaacctcatgacagatgacctcccttgccacttcacttctgcctttggggcaggcttctgcaccactgtcatcgcctcccctgtagacgtggtcaagacgagatacatgaactctgccctgggccagtacagtagcgctggccactgtgcccttaccatgctccagaaggaggggccccgagccttctacaaagggttcatgccctcctttctccgcttgggttcctggaacgtggtgatgttcgtcacctatgagcagctgaaacgagccctcatggctgcctgcacttcccgagaggctcccttctgagcctctcctgctgctgacctgatcacctctggctttggccaatgccgagaatggtctgaagtacatcgagg

SEQ ID NO: 35630 - DNA, 1990 bp, Homo sapiens
gtctttgggcagcagctgggtcttattcttctctggccttcacaacatcctgcaacccagctcaaggtcaggaatgtgacagactcatgtcatcatatctctgatgcccagagaagggataccatttgcctgagccttctcagtactgtttaatcagcctgtgagaactttccttgtgaaaggccctgtctgtgcctggggctgataaaacagcaagaacgaactgaggagctgggcagcagtgcaaagcaaatactaccagctttggtgcctattccggcagagttcctctatctcgtcttgttgctgattaaaggtgcccctgtctccagtttttctccatctcctgggacgtagcaggaaatcagcatcatggttgggttcaaggccacagatgtgccccctactgccactgtgaagtttcttggggctggcacagctgcctgcatcgcagatctcatcacctttcctctggatactgctaaagtccggttacagatccaaggagaaagtcaggggccagtgcgcgctacagccagcgcccagtaccgcggtgtgatgggcaccattctgaccatggtgcgtactgagggcccccgaagcctctacaatgggctggttgccggcctgcagcgccaaatgagctttgcctctgtccgcatcggcctgtatgattctgtcaaacagttctacaccaagggctctgagcatgccagcattgggagccgcctcctagcaggcagcaccacaggtgccctggctgtggctgtggcccagcccacggatgtggtaaaggtccgattccaagctcaggcccgggctggaggtggtcggagataccaaagcaccgtcaatgcctacaagaccattgcccgagaggaagggttccggggcctctggaaagggacctctcccaatgttgctcgtaatgccattgtcaactgtgctgagctggtgacctatgacctcatcaaggatgccctcctgaaagccaacctcatgacagatgacctcccttgccacttcacttctgcctttggggcaggcttctgcaccactgtcatcgcctcccctgtagacgtggtcaagacgagatacatgaactctgccctgggccagtacagtagcgctggccactgtgcccttaccatgctccagaaggaggggccccgagccttctacaaagggttcatgccctcctttctccgcttgggttcctggaacgtggtgatgttcgtcacctatgagcagctgaaacgagccctcatggctgcctgcacttcccgagaggctcccttctgagcctctcctgctgctgacctgatcacctctggctttgtctctagccgggccatgctttccttttcttccttctttctcttccctccttcccttctctccttccctctttccccacctcttccttccgctcctttacctaccaccttccctctttctacattctcatctactcattgtctcagtgctggtggagttgacatttgacagtgtgggaggcctcgtaccagccaggatcccaagcgtcccgtcccttggaaagttcagccagaatcttcgtcctgcccccgacagcccagcctagcccacttgtcatccataaagcaagctcaaccttgaaaaaaaaaaaaaaacaaaaaaaaaaaaaaaaaaaaaaaaaaaaaaaaaagaaaaaaaaaaaaaaaaaaaacaacacaaaaaacaacaaaaacaacaaacaaacaaaaaaagggggggggacccacaaaacaacccccacgcagggggcaaccaaaaacggcacgcaaaccaccttattgacaaaaaaaagagacgcccaccataaaagagacacgaccaacaaaaacaacaggaccgcgagcgcaccctaaaacaacaaggcctgacagaaaacaaaccactagcggaccacacagagaaaacagcacacaacggggagaaacaacacgagagcgacaaaacagccacagaa

SEQ ID NO: 35631 - DNA, 1725 bp, Homo sapiens
agccgcgcgctcgctcgcaggagggtgggtagtttgcccagcgtaggggggctgggcccataaaagaggaagtgcacttaagacacggccccgctggacgctgttagaaaccgtcctggctgggaaggcaagaggtgtgtgactggacaagacttgtttctggcggtcagtcttgccatcctcacagaggttggcggcccgagagagtgtgaggcagaggcggggagtggcaagggagtgaccatctcggggaacgaaggagtaaacgcggtgatgggacgcacggaaacgggagtggagaaagtcatggagagaaccctaggcggggcggtccccgcggaaaggcggctgctccagggtctccgcacccaagtaggagctggcaggcccggccccgccccgcaggccccaccccgggccccgcccccgaggcttaagccgcgccgccgcctgcgcggagccccactgcgaagcccagctgcgcgcgccttgggattgactgtccacgctcgcccggctcgtccgacgcgccctccgccagccgacagacacagccgcacgcactgccgtgttctccctgcggctcggacacatagtatgaccattaggtgtttcgtctcccacccattttctatggaaaaccaaggggatcgggccatgatagccactggcagctttgaagaacgggacacctttagagaagcttgatcttggaggcctcaccgtgagaccttacaaagccggattccggcagagttcctctatctcgtcttgttgctgattaaaggtgcccctgtctccagtttttctccatctcctgggacgtagcaggaaatcagcatcatggttgggttcaaggccacagatgtgccccctactgccactgtgaagtttcttggggctggcacagctgcctgcatcgcagatctcatcacctttcctctggatactgctaaagtccggttacagatccaaggagaaagtcaggggccagtgcgcgctacagccagcgcccagtaccgcggtgtgatgggcaccattctgaccatggtgcgtactgagggcccccgaagcctctacaatgggctggttgccggcctgcagcgccaaatgagctttgcctctgtccgcatcggcctgtatgattctgtcaaacagttctacaccaagggctctgagcatgccagcattgggagccgcctcctagcaggcagcaccacaggtgccctggctgtggctgtggcccagcccacggatgtggtaaaggtccgattccaagctcaggcccgggctggaggtggtcggagataccaaagcaccgtcaatgcctacaagaccattgcccgagaggaagggttccggggcctctggaaagggacctctcccaatgttgctcgtaatgccattgtcaactgtgctgagctggtgacctatgacctcatcaaggatgccctcctgaaagccaacctcatgacagatgacctcccttgccacttcacttctgcctttggggcaggcttctgcaccactgtcatcgcctcccctgtagacgtggtcaagacgagatacatgaactctgccctgggccagtacagtagcgctggccactgtgccctcctgaaagccaacctcatgacagatgacctcccttgccacttcacttctgcctttgggcagattgcactgactccctgtaacgtgtcagacgaaacatcgtcaatagct

SEQ ID NO: 35632 - DNA, 2431 bp, Homo sapiens
agccgcgcgctcgctcgcaggagggtgggtagtttgcccagcgtaggggggctgggcccataaaagaggaagtgcacttaagacacggccccgctggacgctgttagaaaccgtcctggctgggaaggcaagaggtgtgtgactggacaagacttgtttctggcggtcagtcttgccatcctcacagaggttggcggcccgagagagtgtgaggcagaggcggggagtggcaagggagtgaccatctcggggaacgaaggagtaaacgcggtgatgggacgcacggaaacgggagtggagaaagtcatggagagaaccctaggcggggcggtccccgcggaaaggcggctgctccagggtctccgcacccaagtaggagctggcaggcccggccccgccccgcaggccccaccccgggccccgcccccgaggcttaagccgcgccgccgcctgcgcggagccccactgcgaagcccagctgcgcgcgccttgggattgactgtccacgctcgcccggctcgtccgacgcgccctccgccagccgacagacacagccgcacgcactgccgtgttctccctgcggctcggacacatagtatgaccattaggtgtttcgtctcccacccattttctatggaaaaccaaggggatcgggccatgatagccactggcagctttgaagaacgggacacctttagagaagcttgatcttggaggcctcaccgtgagaccttacaaagccggattccggcagagttcctctatctcgtcttgttgctgattaaaggtgcccctgtctccagtttttctccatctcctgggacgtagcaggaaatcagcatcatggttgggttcaaggccacagatgtgccccctactgccactgtgaagtttcttggggctggcacagctgcctgcatcgcagatctcatcacctttcctctggatactgctaaagtccggttacagatccaaggagaaagtcaggggccagtgcgcgctacagccagcgcccagtaccgcggtgtgatgggcaccattctgaccatggtgcgtactgagggcccccgaagcctctacaatgggctggttgccggcctgcagcgccaaatgagctttgcctctgtccgcatcggcctgtatgattctgtcaaacagttctacaccaagggctctgagcatgccagcattgggagccgcctcctagcaggcagcaccacaggtgccctggctgtggctgtggcccagcccacggatgtggtaaaggtccgattccaagctcaggcccgggctggaggtggtcggagataccaaagcaccgtcaatgcctacaagaccattgcccgagaggaagggttccggggcctctggaaagggacctctcccaatgttgctcgtaatgccattgtcaactgtgctgagctggtgacctatgacctcatcaaggatgccctcctgaaagccaacctcatgacagttggggcaggcttctgcaccactgtcatcgcctcccctgtagacgtggtcaagacgagatacatgaactctgccctgggccagtacagtagcgctggccactgtgcccttaccatgctccagaaggaggggccccgagccttctacaaagggttcatgccctcctttctccgcttgggttcctggaacgtggtgatgttcgtcacctatgagcagctgaaacgagccctcatggctgcctgcacttcccgagaggctcccttctgagcctctcctgctgctgacctgatcacctctggctttgtctctagccgggccatgctttccttttcttccttctttctcttccctccttcccttctctccttccctctttccccacctcttccttccgctcctttacctaccaccttccctctttctacattctcatctactcattgtctcagtgctggtggagttgacatttgacagtgtgggaggcctcgtaccagccaggatcccaagcgtcccgtcccttggaaagttcagccagaatcttcgtcctgcccccgacagcccagcctagcccacttgtcatccataaagcaagctcaaccttgaaaaaaaaaaaaaaacaaaaaaaaaaaaaaaaaaaaaaaaaaaaaaaaaagaaaaaaaaaaaaaaaaaaaacaacacaaaaaacaacaaaaacaacaaacaaacaaaaaaagggggggggacccacaaaacaacccccacgcagggggcaaccaaaaacggcacgcaaaccaccttattgacaaaaaaaagagacgcccaccataaaagagacacgaccaacaaaaacaacaggaccgcgagcgcaccctaaaacaacaaggcctgacagaaaacaaaccactagcggaccacacagagaaaacagcacacaacggggagaaacaacacgagagcgacaaaacagccacagaa

SEQ ID NO: 35633 - DNA, 2078 bp, Homo sapiens
agccgcgcgctcgctcgcaggagggtgggtagtttgcccagcgtaggggggctgggcccataaaagaggaagtgcacttaagacacggccccgctggacgctgttagaaaccgtcctggctgggaaggcaagaggtgtgtgactggacaagacttgtttctggcggtcagtcttgccatcctcacagaggttggcggcccgagagagtgtgaggcagaggcggggagtggcaagggagtgaccatctcggggaacgaaggagtaaacgcggtgatgggacgcacggaaacgggagtggagaaagtcatggagagaaccctaggcggggcggtccccgcggaaaggcggctgctccagggtctccgcacccaagtaggagctggcaggcccggccccgccccgcaggccccaccccgggccccgcccccgaggcttaagccgcgccgccgcctgcgcggagccccactgcgaagcccagctgcgcgcgccttgggattgactgtccacgctcgcccggctcgtccgacgcgccctccgccagccgacagacacagccgcacgcactgccgtgttctccctgcggctcggacacatagtatgaccattaggtgtttcgtctcccacccattttctatggaaaaccaaggggatcgggccatgatagccactggcagctttgaagaacgggacacctttagagaagcttgatcttggaggcctcaccgtgagaccttacaaagccggattccggcagagttcctctatctcgtcttgttgctgattaaaggtgcccctgtctccagtttttctccatctcctgggacgtagcaggaaatcagcatcatggttgggttcaaggccacagatgtgccccctactgccactgtgaagtttcttggggctggcacagctgcctgcatcgcagatctcatcacctttcctctggatactgctaaagtccggttacagatccaaggagaaagtcaggggccagtgcgcgctacagccagcgcccagtaccgcggtgtgatgggcaccattctgaccatggtgcgtactgagggcccccgaagcctctacaatgggctggttgccggcctgcagcgccaaatgagctttgcctctgtccgcatcggcctgtatgattctgtcaaacagttctacaccaagggctctgagcatgccagcattgggagccgcctcctagcaggcagcaccacaggtgccctggctgtggctgtggcccagcccacggatgtggtaaaggtccgattccaagctcaggcccgggctggaggtggtcggagataccaaagcaccgtcaatgcctacaagaccattgcccgagaggaagggttccggggcctctggaaagggacctctcccaatgttgctcgtaatgccattgtcaactgtgctgagctggtgacctatgacctcatcaaggatgccctcctgaaagccaacctcatgacagttggggcaggcttctgcaccactgtcatcgcctcccctgtagacgtggtcaagacgagatacatgaactctgccctgggccagtacagtagcgctggccactgtgcccttaccatgctccagaaggaggggccccgagccttctacaaagggttcatgccctcctttctccgcttgggttcctggaacgtggtgatgttcgtcacctatgagcagctgaaacgagccctcatggctgcctgcacttcccgagaggctcccttctgagcctctcctgctgctgacctgatcacctctggctttgtctctagccgggccatgctttccttttcttccttctttctcttccctccttcccttctctccttccctctttccccacctcttccttccgctcctttacctaccaccttccctctttctacattctcatctactcattgtctcagtgctggtggagttgacatttgacagtgtgggaggcctcgtaccagccaggatcccaagcgtcccgtcccttggaaagttcagccagaatcttcgtcctgcccccgacagcccagcctagcccacttgtcatccataaagcaagctcaaccttg

SEQ ID NO: 35634 - DNA, 2280 bp, Homo sapiens
agccgcgcgctcgctcgcaggagggtgggtagtttgcccagcgtaggggggctgggcccataaaagaggaagtgcacttaagacacggccccgctggacgctgttagaaaccgtcctggctgggaaggcaagaggtgtgtgactggacaagacttgtttctggcggtcagtcttgccatcctcacagaggttggcggcccgagagagtgtgaggcagaggcggggagtggcaagggagtgaccatctcggggaacgaaggagtaaacgcggtgatgggacgcacggaaacgggagtggagaaagtcatggagagaaccctaggcggggcggtccccgcggaaaggcggctgctccagggtctccgcacccaagtaggagctggcaggcccggccccgccccgcaggccccaccccgggccccgcccccgaggcttaagccgcgccgccgcctgcgcggagccccactgcgaagcccagctgcgcgcgccttgggattgactgtccacgctcgcccggctcgtccgacgcgccctccgccagccgacagacacagccgcacgcactgccgtgttctccctgcggctcggacacatagtatgaccattaggtgtttcgtctcccacccattttctatggaaaaccaaggggatcgggccatgatagccactggcagctttgaagaacgggacacctttagagaagcttgatcttggaggcctcaccgtgagaccttacaaagccggattccggcagagttcctctatctcgtcttgttgctgattaaaggtgcccctgtctccagtttttctccatctcctgggacgtagcaggaaatcagcatcatggttgggttcaaggccacagatgtgccccctactgccactgtgaagtttcttggggctggcacagctgcctgcatcgcagatctcatcacctttcctctggatactgctaaagtccggttacagatccaaggagaaagtcaggggccagtgcgcgctacagccagcgcccagtaccgcggtgtgatgggcaccattctgaccatggtgcgtactgagggcccccgaagcctctacaatgggctggttgccggcctgcagcgccaaatgagctttgcctctgtccgcatcggcctgtatgattctgtcaaacagttctacaccaagggctctgagcatgccagcattgggagccgcctcctagcaggcagcaccacaggtgccctggctgtggctgtggcccagcccacggatgtggtaaaggtccgattccaagctcaggcccgggctggaggtggtcggagataccaaagcaccgtcaatgcctacaagaccattgcccgagaggaagggttccggggcctctggaaagggacctctcccaatgttgctcgtaatgccattgtcaactgtgctgagctggtgacctatgacctcatcaaggatgccctcctgaaagccaacctcatgacaggttcatgccctcctttctccgcttgggttcctggaacgtggtgatgttcgtcacctatgagcagctgaaacgagccctcatggctgcctgcacttcccgagaggctcccttctgagcctctcctgctgctgacctgatcacctctggctttgtctctagccgggccatgctttccttttcttccttctttctcttccctccttcccttctctccttccctctttccccacctcttccttccgctcctttacctaccaccttccctctttctacattctcatctactcattgtctcagtgctggtggagttgacatttgacagtgtgggaggcctcgtaccagccaggatcccaagcgtcccgtcccttggaaagttcagccagaatcttcgtcctgcccccgacagcccagcctagcccacttgtcatccataaagcaagctcaaccttgaaaaaaaaaaaaaaacaaaaaaaaaaaaaaaaaaaaaaaaaaaaaaaaaagaaaaaaaaaaaaaaaaaaaacaacacaaaaaacaacaaaaacaacaaacaaacaaaaaaagggggggggacccacaaaacaacccccacgcagggggcaaccaaaaacggcacgcaaaccaccttattgacaaaaaaaagagacgcccaccataaaagagacacgaccaacaaaaacaacaggaccgcgagcgcaccctaaaacaacaaggcctgacagaaaacaaaccactagcggaccacacagagaaaacagcacacaacggggagaaacaacacgagagcgacaaaacagccacagaa

SEQ ID NO: 35635 - DNA, 1680 bp, Homo sapiens
tgactacgctgctgctgagttttcaccgggatttggagctgagtctgggcctctaccacttgcggctgctgtgcaaactgcagcgcagaggagagggctgcagtgggaacaccggctgggggcagcctcccgggcagctgcggcagtggggtgtgcaagctggcagcgttctgcacgggaggccccgtggaggggtcatactgctgctgactctgcctctgtccagcgagctgcgcgggcgcggtgtgatgggcaccattctgaccatggtgcgtactgagggcccccgaagcctctacaatgggctggttgccggcctgcagcgccaaatgagctttgcctctgtccgcatcggcctgtatgattctgtcaaacagttctacaccaagggctctgagcatgccagcattgggagccgcctcctagcaggcagcaccacaggtgccctggctgtggctgtggcccagcccacggatgtggtaaaggtccgattccaagctcaggcccgggctggaggtggtcggagataccaaagcaccgtcaatgcctacaagaccattgcccgagaggaagggttccggggcctctggaaagggacctctcccaatgttgctcgtaatgccattgtcaactgtgctgagctggtgacctatgacctcatcaaggatgccctcctgaaagccaacctcatgacagatgacctcccttgccacttcacttctgcctttggggcaggcttctgcaccactgtcatcgcctcccctgtagacgtggtcaagacgagatacatgaactctgccctgggccagtacagtagcgctggccactgtgcccttaccatgctccagaaggaggggccccgagccttctacaaagggttcatgccctcctttctccgcttgggttcctggaacgtggtgatgttcgtcacctatgagcagctgaaacgagccctcatggctgcctgcacttcccgagaggctcccttctgagcctctcctgctgctgacctgatcacctctggctttgtctctagccgggccatgctttccttttcttccttctttctcttccctccttcccttctctccttccctctttccccacctcttccttccgctcctttacctaccaccttccctctttctacattctcatctactcattgtctcagtgctggtggagttgacatttgacagtgtgggaggcctcgtaccagccaggatcccaagcgtcccgtcccttggaaagttcagccagaatcttcgtcctgcccccgacagcccagcctagcccacttgtcatccataaagcaagctcaaccttgaaaaaaaaaaaaaaacaaaaaaaaaaaaaaaaaaaaaaaaaaaaaaaaaagaaaaaaaaaaaaaaaaaaaacaacacaaaaaacaacaaaaacaacaaacaaacaaaaaaagggggggggacccacaaaacaacccccacgcagggggcaaccaaaaacggcacgcaaaccaccttattgacaaaaaaaagagacgcccaccataaaagagacacgaccaacaaaaacaacaggaccgcgagcgcaccctaaaacaacaaggcctgacagaaaacaaaccactagcggaccacacagagaaaacagcacacaacggggagaaacaacacgagagcgacaaaacagccacagaa

SEQ ID NO: 35636 - DNA, 1652 bp, Homo sapiens
agccgcgcgctcgctcgcaggagggtgggtagtttgcccagcgtaggggggctgggcccataaaagaggaagtgcacttaagacacggccccgctggacgctgttagaaaccgtcctggctgggaaggcaagaggtgtgtgactggacaagacttgtttctggcggtcagtcttgccatcctcacagaggttggcggcccgagagagtgtgaggcagaggcggggagtggcaagggagtgaccatctcggggaacgaaggagtaaacgcggtgatgggacgcacggaaacgggagtggagaaagtcatggagagaaccctaggcggggcggtccccgcggaaaggcggctgctccagggtctccgcacccaagtaggagctggcaggcccggccccgccccgcaggccccaccccgggccccgcccccgaggcttaagccgcgccgccgcctgcgcggagccccactgcgaagcccagctgcgcgcgccttgggattgactgtccacgctcgcccggctcgtccgacgcgccctccgccagccgacagacacagccgcacgcactgccgtgttctccctgcggctcggacacatagtatgaccattaggtgtttcgtctcccacccattttctatggaaaaccaaggggatcgggccatgatagccactggcagctttgaagaacgggacacctttagagaagcttgatcttggaggcctcaccgtgagaccttacaaagccggattccggcagagttcctctatctcgtcttgttgctgattaaaggtgcccctgtctccagtttttctccatctcctgggacgtagcaggaaatcagcatcatggttgggttcaaggccacagatgtgccccctactgccactgtgaagtttcttggggctggcacagctgcctgcatcgcagatctcatcacctttcctctggatactgctaaagtccggttacagatccaaggagaaagtcaggggccagtgcgcgctacagccagcgcccagtaccgcggtgtgatgggcaccattctgaccatggtgcgtactgagggcccccgaagcctctacaatgggctggttgccggcctgcagcgccaaatgagctttgcctctgtccgcatcggcctgtatgattctgtcaaacagttctacaccaagggctctgagcatgccagcattgggagccgcctcctagcaggcagcaccacaggtgccctggctgtggctgtggcccagcccacggatgtggtaaaggtccgattccaagctcaggcccgggctggaggtggtcggagataccaaagcaccgtcaatgcctacaagaccattgcccgagaggaagggttccggggcctctggaaagggacctctcccaatgttgctcgtaatgccattgtcaactgtgctgagctggtgacctatgacctcatcaaggatgccctcctgaaagccaacctcatgacagatgacctcccttgccacttcacttctgcctttggggcaggcttctgcaccactgtcatcgcctcccctgaattttgcttcctttgggagctcattctttttcccaaggctcacatgctccttgcctctgctctgtgcactcatgctcatacgcggatgggatcctctagaaccgc

SEQ ID NO: 35637 - DNA, 2123 bp, Homo sapiens
agccgcgcgctcgctcgcaggagggtgggtagtttgcccagcgtaggggggctgggcccataaaagaggaagtgcacttaagacacggccccgctggacgctgttagaaaccgtcctggctgggaaggcaagaggtgtgtgactggacaagacttgtttctggcggtcagtcttgccatcctcacagaggttggcggcccgagagagtgtgaggcagaggcggggagtggcaagggagtgaccatctcggggaacgaaggagtaaacgcggtgatgggacgcacggaaacgggagtggagaaagtcatggagagaaccctaggcggggcggtccccgcggaaaggcggctgctccagggtctccgcacccaagtaggagctggcaggcccggccccgccccgcaggccccaccccgggccccgcccccgaggcttaagccgcgccgccgcctgcgcggagccccactgcgaagcccagctgcgcgcgccttgggattgactgtccacgctcgcccggctcgtccgacgcgccctccgccagccgacagacacagccgcacgcactgccgtgttctccctgcggctcggacacatagtatgaccattaggtgtttcgtctcccacccattttctatggaaaaccaaggggatcgggccatgatagccactggcagctttgaagaacgggacacctttagagaagcttgatcttggaggcctcaccgtgagaccttacaaagccggattccggcagagttcctctatctcgtcttgttgctgattaaaggtgcccctgtctccagtttttctccatctcctgggacgtagcaggaaatcagcatcatggttgggttcaaggccacagatgtgccccctactgccactgtgaagtttcttggggctggcacagctgcctgcatcgcagatctcatcacctttcctctggatactgctaaagtccggttacagatccaaggagaaagtcaggggccagtgcgcgctacagccagcgcccagtaccgcggtgtgatgggcaccattctgaccatggtgcgtactgagggcccccgaagcctctacaatgggctggttgccggcctgcagcgccaaatgagctttgcctctgtccgcatcggcctgtatgattctgtcaaacagttctacaccaagggctctgagcatgccagcattgggagccgcctcctagcaggcagcaccacaggtgccctggctgtggctgtggcccagcccacggatgtggtaaaggtccgattccaagctcaggcccgggctggaggtggtcggagataccaaagcaccgtcaatgcctacaagaccattgcccgagaggaagggttccggggcctctggaaagggacctctcccaatgttgctcgtaatgccattgtcaactgtgctgagctggtgacctatgacctcatcaaggatgccctcctgaaagccaacctcatgacagttggggcaggcttctgcaccactgtcatcgcctcccctgtagacgtggtcaagacgagatacatgaactctgccctgggccagtacagtagcgctggccactgtgcccttaccatgctccagaaggaggggccccgagccttctacaaagggttcatgccctcctttctccgcttgggttcctggaacgtggtgatgttcgtcacctatgagcagctgaaacgagccctcatggctgcctgcacttcccgagaggctcccttctgagcctctcctgctgctgacctgatcacctctggctttgtctctagccgggccatgctttccttttcttccttctttctcttccctccttcccttctctccttccctctttccccacctcttccttccgctcctttacctaccaccttccctctttccccacctcttccttccgctcctttacctaccaccttccctctttctacattctcatctactcattgtctcagtgctggtggagttgacatttgacagtgtgggaggcctcgtaccagccaggatcccaagcgtcccgtcccttggaaagttcagccagaatcttcgtcctgcccccgacagcccagcctagcccacttgtcatccataaagcaagctcaaccttg

SEQ ID NO: 35638 - DNA, 1730 bp, Homo sapiens
agccgcgcgctcgctcgcaggagggtgggtagtttgcccagcgtaggggggctgggcccataaaagaggaagtgcacttaagacacggccccgctggacgctgttagaaaccgtcctggctgggaaggcaagaggtgtgtgactggacaagacttgtttctggcggtcagtcttgccatcctcacagaggttggcggcccgagagagtgtgaggcagaggcggggagtggcaagggagtgaccatctcggggaacgaaggagtaaacgcggtgatgggacgcacggaaacgggagtggagaaagtcatggagagaaccctaggcggggcggtccccgcggaaaggcggctgctccagggtctccgcacccaagtaggagctggcaggcccggccccgccccgcaggccccaccccgggccccgcccccgaggcttaagccgcgccgccgcctgcgcggagccccactgcgaagcccagctgcgcgcgccttgggattgactgtccacgctcgcccggctcgtccgacgcgccctccgccagccgacagacacagccgcacgcactgccgtgttctccctgcggctcggacacatagtatgaccattaggtgtttcgtctcccacccattttctatggaaaaccaaggggatcgggccatgatagccactggcagctttgaagaacgggacacctttagagaagcttgatcttggaggcctcaccgtgagaccttacaaagccggattccggcagagttcctctatctcgtcttgttgctgattaaaggtgcccctgtctccagtttttctccatctcctgggacgtagcaggaaatcagcatcatggttgggttcaaggccacagatgtgccccctactgccactgtgaagtttcttggggctggcacagctgcctgcatcgcagatctcatcacctttcctctggatactgctaaagtccggttacagatccaaggagaaagtcaggggccagtgcgcgctacagccagcgcccagtaccgcggtgtgatgggcaccattctgaccatggtgcgtactgagggcccccgaagcctctacaatgggctggttgccggcctgcagcgccaaatgagctttgcctctgtccgcatcggcctgtatgattctgtcaaacagttctacaccaagggctctgagcatgccagcattgggagccgcctcctagcaggcagcaccacaggtgccctggctgtggctgtggcccagcccacggatgtggtaaaggtccgattccaagctcaggcccgggctggaggtggtcggagataccaaagcaccgtcaatgcctacaagaccattgcccgagaggaagggttccggggcctctggaaagggacctctcccaatgttgctcgtaatgccattgtcaactgtgctgagctggtgacctatgacctcatcaaggatgccctcctgaaagccaacctcatgacaggttcatgccctcctttctccgcttgggttcctggaacgtggtgatgttcgtcacctatgagcagctgaaacgagccctcatggctgcctgcacttcccgagaggctcccttctgagcctctcctgctgctgacctgatcacctctggctttgtctctagccgggccatgctttccttttcttccttctttctcttccctccttcccttctctccttccgagccacagtcgaagggatccatcaagagtcacac

SEQ ID NO: 35639 - DNA, 1559 bp, Homo sapiens
agccgcgcgctcgctcgcaggagggtgggtagtttgcccagcgtaggggggctgggcccataaaagaggaagtgcacttaagacacggccccgctggacgctgttagaaaccgtcctggctgggaaggcaagaggtgtgtgactggacaagacttgtttctggcggtcagtcttgccatcctcacagaggttggcggcccgagagagtgtgaggcagaggcggggagtggcaagggagtgaccatctcggggaacgaaggagtaaacgcggtgatgggacgcacggaaacgggagtggagaaagtcatggagagaaccctaggcggggcggtccccgcggaaaggcggctgctccagggtctccgcacccaagtaggagctggcaggcccggccccgccccgcaggccccaccccgggccccgcccccgaggcttaagccgcgccgccgcctgcgcggagccccactgcgaagcccagctgcgcgcgccttgggattgactgtccacgctcgcccggctcgtccgacgcgccctccgccagccgacagacacagccgcacgcactgccgtgttctccctgcggctcggacacatagtatgaccattaggtgtttcgtctcccacccattttctatggaaaaccaaggggatcgggccatgatagccactggcagctttgaagaacgggacacctttagagaagcttgatcttggaggcctcaccgtgagaccttacaaagccggattccggcagagttcctctatctcgtcttgttgctgattaaaggtgcccctgtctccagtttttctccatctcctgggacgtagcaggaaatcagcatcatggttgggttcaaggccacagatgtgccccctactgccactgtgaagtttcttggggctggcacagctgcctgcatcgcagatctcatcacctttcctctggatactgctaaagtccggttacagatccaaggagaaagtcaggggccagtgcgcgctacagccagcgcccagtaccgcggtgtgatgggcaccattctgaccatggtgcgtactgagggcccccgaagcctctacaatgggctggttgccggcctgcagcgccaaatgagctttgcctctgtccgcatcggcctgtatgattctgtcaaacagttctacaccaagggctctgagcatgccagcattgggagccgcctcctagcaggcagcaccacaggtgccctggctgtggctgtggcccagcccacggatgtggtaaaggtccgattccaagctcaggcccgggctggaggtggtcggagataccaaagcaccgtcaatgcctacaagaccattgcccgagaggaagggttccggggcctctggaaagggacctctcccaatgttgctcgtaatgccattgtcaactgtgctgagctggtgacctatgacctcatcaaggatgccctcctgaaagccaacctcatgacagcctcccttgccacttcacttctgcctttgggcagattgcactgactccctgtaacgtgtcagacgaaacatcgtcaatagct

SEQ ID NO: 35640 - DNA, 1328 bp, Homo sapiens
aaatgagtgcaagcccgctggccactgaccccatggctcgcccacagatgccagcattgggagccgcctcctagcaggcagcaccacaggtgccctggctgtggctgtggcccagcccacggatgtggtaaaggtccgattccaagctcaggcccgggctggaggtggtcggagataccaaagcaccgtcaatgcctacaagaccattgcccgagaggaagggttccggggcctctggaaagggacctctcccaatgttgctcgtaatgccattgtcaactgtgctgagctggtgacctatgacctcatcaaggatgccctcctgaaagccaacctcatgacagatgacctcccttgccacttcacttctgcctttggggcaggcttctgcaccactgtcatcgcctcccctgtagacgtggtcaagacgagatacatgaactctgccctgggccagtacagtagcgctggccactgtgcccttaccatgctccagaaggaggggccccgagccttctacaaagggttcatgccctcctttctccgcttgggttcctggaacgtggtgatgttcgtcacctatgagcagctgaaacgagccctcatggctgcctgcacttcccgagaggctcccttctgagcctctcctgctgctgacctgatcacctctggctttgtctctagccgggccatgctttccttttcttccttctttctcttccctccttcccttctctccttccctctttccccacctcttccttccgctcctttacctaccaccttccctctttctacattctcatctactcattgtctcagtgctggtggagttgacatttgacagtgtgggaggcctcgtaccagccaggatcccaagcgtcccgtcccttggaaagttcagccagaatcttcgtcctgcccccgacagcccagcctagcccacttgtcatccataaagcaagctcaaccttgaaaaaaaaaaaaaaacaaaaaaaaaaaaaaaaaaaaaaaaaaaaaaaaaagaaaaaaaaaaaaaaaaaaaacaacacaaaaaacaacaaaaacaacaaacaaacaaaaaaagggggggggacccacaaaacaacccccacgcagggggcaaccaaaaacggcacgcaaaccaccttattgacaaaaaaaagagacgcccaccataaaagagacacgaccaacaaaaacaacaggaccgcgagcgcaccctaaaacaacaaggcctgacagaaaacaaaccactagcggaccacacagagaaaacagcacacaacggggagaaacaacacgagagcgacaaaacagccacagaa

SEQ ID NO: 35641 - DNA, 1567 bp, Homo sapiens
agccgcgcgctcgctcgcaggagggtgggtagtttgcccagcgtaggggggctgggcccataaaagaggaagtgcacttaagacacggccccgctggacgctgttagaaaccgtcctggctgggaaggcaagaggtgtgtgactggacaagacttgtttctggcggtcagtcttgccatcctcacagaggttggcggcccgagagagtgtgaggcagaggcggggagtggcaagggagtgaccatctcggggaacgaaggagtaaacgcggtgatgggacgcacggaaacgggagtggagaaagtcatggagagaaccctaggcggggcggtccccgcggaaaggcggctgctccagggtctccgcacccaagtaggagctggcaggcccggccccgccccgcaggccccaccccgggccccgcccccgaggcttaagccgcgccgccgcctgcgcggagccccactgcgaagcccagctgcgcgcgccttgggattgactgtccacgctcgcccggctcgtccgacgcgccctccgccagccgacagacacagccgcacgcactgccgtgttctccctgcggctcggacacatagtatgaccattaggtgtttcgtctcccacccattttctatggaaaaccaaggggatcgggccatgatagccactggcagctttgaagaacgggacacctttagagaagcttgatcttggaggcctcaccgtgagaccttacaaagccggattccggcagagttcctctatctcgtcttgttgctgattaaaggtgcccctgtctccagtttttctccatctcctgggacgtagcaggaaatcagcatcatggttgggttcaaggccacagatgtgccccctactgccactgtgaagtttcttggggctggcacagctgcctgcatcgcagatctcatcacctttcctctggatactgctaaagtccggttacagatccaaggagaaagtcaggggccagtgcgcgctacagccagcgcccagtaccgcggtgtgatgggcaccattctgaccatggtgcgtactgagggcccccgaagcctctacaatgggctggttgccggcctgcagcgccaaatgagctttgcctctgtccgcatcggcctgtatgattctgtcaaacagttctacaccaagggctctgagcatgccagcattgggagccgcctcctagcaggcagcaccacaggtgccctggctgtggctgtggcccagcccacggatgtggtaaaggtccgattccaagctcaggcccgggctggaggtggtcggagataccaaagcaccgtcaatgcctacaagaccattgcccgagaggaagggttccggggcctctggaaagggacctctcccaatgttgctcgtaatgccattgtctcagtgctggtggagttgacatttgacagtgtgggaggcctcgtaccagccaggatcccaagcgtcccgtcccttggaaagttcagccagaatcttcgtcctgcccccgacagcccagcctagcccacttgtcatccataaagcaagctcaaccttg

SEQ ID NO: 35642 - DNA, 1930 bp, Homo sapiens
agccgcgcgctcgctcgcaggagggtgggtagtttgcccagcgtaggggggctgggcccataaaagaggaagtgcacttaagacacggccccgctggacgctgttagaaaccgtcctggctgggaaggcaagaggtgtgtgactggacaagacttgtttctggcggtcagtcttgccatcctcacagaggttggcggcccgagagagtgtgaggcagaggcggggagtggcaagggagtgaccatctcggggaacgaaggagtaaacgcggtgatgggacgcacggaaacgggagtggagaaagtcatggagagaaccctaggcggggcggtccccgcggaaaggcggctgctccagggtctccgcacccaagtaggagctggcaggcccggccccgccccgcaggccccaccccgggccccgcccccgaggcttaagccgcgccgccgcctgcgcggagccccactgcgaagcccagctgcgcgcgccttgggattgactgtccacgctcgcccggctcgtccgacgcgccctccgccagccgacagacacagccgcacgcactgccgtgttctccctgcggctcggacacatagtatgaccattaggtgtttcgtctcccacccattttctatggaaaaccaaggggatcgggccatgatagccactggcagctttgaagaacgggacacctttagagaagcttgatcttggaggcctcaccgtgagaccttacaaagccggattccggcagagttcctctatctcgtcttgttgctgattaaaggtgcccctgtctccagtttttctccatctcctgggacgtagcaggaaatcagcatcatggttgggttcaaggccacagatgtgccccctactgccactgtgaagtttcttggggctggcacagctgcctgcatcgcagatctcatcacctttcctctggatactgctaaagtccggttacagatccaaggagaaagtcaggggccagtgcgcgctacagccagcgcccagtaccgcggtgtgatgggcaccattctgaccatggtgcgtactgagggcccccgaagcctctacaatgggctggttgccggcctgcagcgccaaatgagctttgcctctgtccgcatcggcctgtatgattctgtcaaacagttctacaccaagggctctgagcatgccagcattgggagccgcctcctagcaggcagcaccacaggtgccctggctgtggctgtggcccagcccacggatgtggtaaaggtccgattccaagtctctagccgggccatgctttccttttcttccttctttctcttccctccttcccttctctccttccctctttccccacctcttccttccgctcctttacctaccaccttccctctttctacattctcatctactcattgtctcagtgctggtggagttgacatttgacagtgtgggaggcctcgtaccagccaggatcccaagcgtcccgtcccttggaaagttcagccagaatcttcgtcctgcccccgacagcccagcctagcccacttgtcatccataaagcaagctcaaccttgaaaaaaaaaaaaaaacaaaaaaaaaaaaaaaaaaaaaaaaaaaaaaaaaagaaaaaaaaaaaaaaaaaaaacaacacaaaaaacaacaaaaacaacaaacaaacaaaaaaagggggggggacccacaaaacaacccccacgcagggggcaaccaaaaacggcacgcaaaccaccttattgacaaaaaaaagagacgcccaccataaaagagacacgaccaacaaaaacaacaggaccgcgagcgcaccctaaaacaacaaggcctgacagaaaacaaaccactagcggaccacacagagaaaacagcacacaacggggagaaacaacacgagagcgacaaaacagccacagaa

SEQ ID NO: 35643 - DNA, 1409 bp, Homo sapiens
agccgcgcgctcgctcgcaggagggtgggtagtttgcccagcgtaggggggctgggcccataaaagaggaagtgcacttaagacacggccccgctggacgctgttagaaaccgtcctggctgggaaggcaagaggtgtgtgactggacaagacttgtttctggcggtcagtcttgccatcctcacagaggttggcggcccgagagagtgtgaggcagaggcggggagtggcaagggagtgaccatctcggggaacgaaggagtaaacgcggtgatgggacgcacggaaacgggagtggagaaagtcatggagagaaccctaggcggggcggtccccgcggaaaggcggctgctccagggtctccgcacccaagtaggagctggcaggcccggccccgccccgcaggccccaccccgggccccgcccccgaggcttaagccgcgccgccgcctgcgcggagccccactgcgaagcccagctgcgcgcgccttgggattgactgtccacgctcgcccggctcgtccgacgcgccctccgccagccgacagacacagccgcacgcactgccgtgttctccctgcggctcggacacatagtatgaccattaggtgtttcgtctcccacccattttctatggaaaaccaaggggatcgggccatgatagccactggcagctttgaagaacgggacacctttagagaagcttgatcttggaggcctcaccgtgagaccttacaaagccggattccggcagagttcctctatctcgtcttgttgctgattaaaggtgcccctgtctccagtttttctccatctcctgggacgtagcaggaaatcagcatcatggttgggttcaaggccacagatgtgccccctactgccactgtgaagtttcttggggctggcacagctgcctgcatcgcagatctcatcacctttcctctggatactgctaaagtccggttacagatccaaggagaaagtcaggggccagtgcgcgctacagccagcgcccagtaccgcggtgtgatgggcaccattctgaccatggtgcgtactgagggcccccgaagcctctacaatgggctggttgccggcctgcagcgccaaatgagctttgcctctgtccgcatcggcctgtatgattctgtcaaacagttctacaccaagggctctgagcatgccagcattgggagccgcctcctagcaggcagcaccacaggtgccctggctgtggctgtggcccagcccacggatgtggtaaaggtccgattccaagctcaggcccgggctggaggtggtcggagataccaaagcaccgtcccttggaaagttcagccagaatcttcgtcctgcccccgacagcccagcctagcccacttgtcatccataaagcaagctcaaccttg

SEQ ID NO: 35644 - DNA, 1182 bp, Homo sapiens
aggccggataccttcctctcgggcatggtcttgtaggcattgacgggtgctttggtatctccgaccacctccagcccgggcctgagcttggaaaggggacctctcccaatgttgctcgtaatgccattgtcaactgtgctgagctggtgacctatgacctcatcaaggatgccctcctgaaagccaacctcatgacagatgacctcccttgccacttcacttctgcctttggggcaggcttctgcaccactgtcatcgcctcccctgtagacgtggtcaagacgagatacatgaactctgccctgggccagtacagtagcgctggccactgtgcccttaccatgctccagaaggaggggccccgagccttctacaaagggttcatgccctcctttctccgcttgggttcctggaacgtggtgatgttcgtcacctatgagcagctgaaacgagccctcatggctgcctgcacttcccgagaggctcccttctgagcctctcctgctgctgacctgatcacctctggctttgtctctagccgggccatgctttccttttcttccttctttctcttccctccttcccttctctccttccctctttccccacctcttccttccgctcctttacctaccaccttccctctttctacattctcatctactcattgtctcagtgctggtggagttgacatttgacagtgtgggaggcctcgtaccagccaggatcccaagcgtcccgtcccttggaaagttcagccagaatcttcgtcctgcccccgacagcccagcctagcccacttgtcatccataaagcaagctcaaccttgaaaaaaaaaaaaaaacaaaaaaaaaaaaaaaaaaaaaaaaaaaaaaaaaagaaaaaaaaaaaaaaaaaaaacaacacaaaaaacaacaaaaacaacaaacaaacaaaaaaagggggggggacccacaaaacaacccccacgcagggggcaaccaaaaacggcacgcaaaccaccttattgacaaaaaaaagagacgcccaccataaaagagacacgaccaacaaaaacaacaggaccgcgagcgcaccctaaaacaacaaggcctgacagaaaacaaaccactagcggaccacacagagaaaacagcacacaacggggagaaacaacacgagagcgacaaaacagccacagaa

SEQ ID NO: 35645 - DNA, 1105 bp, Homo sapiens
aggggaggtctagattctgcatctgctcaaagaacttgtaggttggatttacgtagggtttcgagtgaagtgacctatgacctcatcaaggatgccctcctgaaagccaacctcatgacagatgacctcccttgccacttcacttctgcctttggggcaggcttctgcaccactgtcatcgcctcccctgtagacgtggtcaagacgagatacatgaactctgccctgggccagtacagtagcgctggccactgtgcccttaccatgctccagaaggaggggccccgagccttctacaaagggttcatgccctcctttctccgcttgggttcctggaacgtggtgatgttcgtcacctatgagcagctgaaacgagccctcatggctgcctgcacttcccgagaggctcccttctgagcctctcctgctgctgacctgatcacctctggctttgtctctagccgggccatgctttccttttcttccttctttctcttccctccttcccttctctccttccctctttccccacctcttccttccgctcctttacctaccaccttccctctttctacattctcatctactcattgtctcagtgctggtggagttgacatttgacagtgtgggaggcctcgtaccagccaggatcccaagcgtcccgtcccttggaaagttcagccagaatcttcgtcctgcccccgacagcccagcctagcccacttgtcatccataaagcaagctcaaccttgaaaaaaaaaaaaaaacaaaaaaaaaaaaaaaaaaaaaaaaaaaaaaaaaagaaaaaaaaaaaaaaaaaaaacaacacaaaaaacaacaaaaacaacaaacaaacaaaaaaagggggggggacccacaaaacaacccccacgcagggggcaaccaaaaacggcacgcaaaccaccttattgacaaaaaaaagagacgcccaccataaaagagacacgaccaacaaaaacaacaggaccgcgagcgcaccctaaaacaacaaggcctgacagaaaacaaaccactagcggaccacacagagaaaacagcacacaacggggagaaacaacacgagagcgacaaaacagccacagaa

SEQ ID NO: 35646 - DNA, 1185 bp, Homo sapiens
agccgcgcgctcgctcgcaggagggtgggtagtttgcccagcgtaggggggctgggcccataaaagaggaagtgcacttaagacacggccccgctggacgctgttagaaaccgtcctggctgggaaggcaagaggtgtgtgactggacaagacttgtttctggcggtcagtcttgccatcctcacagaggttggcggcccgagagagtgtgaggcagaggcggggagtggcaagggagtgaccatctcggggaacgaaggagtaaacgcggtgatgggacgcacggaaacgggagtggagaaagtcatggagagaaccctaggcggggcggtccccgcggaaaggcggctgctccagggtctccgcacccaagtaggagctggcaggcccggccccgccccgcaggccccaccccgggccccgcccccgaggcttaagccgcgccgccgcctgcgcggagccccactgcgaagcccagctgcgcgcgccttgggattgactgtccacgctcgcccggctcgtccgacgcgccctccgccagccgacagacacagccgcacgcactgccgtgttctccctgcggctcggacacatagtatgaccattaggtgtttcgtctcccacccattttctatggaaaaccaaggggatcgggccatgatagccactggcagctttgaagaacgggacacctttagagaagcttgatcttggaggcctcaccgtgagaccttacaaagccggattccggcagagttcctctatctcgtcttgttgctgattaaaggtgcccctgtctccagtttttctccatctcctgggacgtagcaggaaatcagcatcatggttgggttcaaggccacagatgtgccccctactgccactgtgaagtttcttggggctggcacagctgcctgcatcgcagatctcatcacctttcctctggatactgctaaagtccggttacagatccaaggagaaagtcaggggccagtgcgcgctacagccagcgcccagtaccgcggtgtgatgggcaccattctgaccatggtgcgtactgagggcccccgaagcctctacaatgggctggttgccggcctgcagcgccaaatgagctttgcctctgtcctgcccccgacagcccagcctagcccacttgtcatccataaagcaagctcaaccttg

SEQ ID NO: 35647 - DNA, 849 bp, Homo sapiens
atcaaaagtttggtgaaatttgagactttagtatccatcttaatgatagtggcaggaggcagacaaatcctagggagacaagggtgggtccctggtgaaaccccaccttcaaaccaaagacagtttaaagcatgaaagccaagctacaagtctccagtaaatccacggaccggattaagaatctctcttcccctttagcacacttccctctgattgatccacacacttccttctttctcttccctccttcccttctctccttccctctttccccacctcttccttccgctcctttacctaccaccttccctctttctacattctcatctactcattgtctcagtgctggtggagttgacatttgacagtgtgggaggcctcgtaccagccaggatcccaagcgtcccgtcccttggaaagttcagccagaatcttcgtcctgcccccgacagcccagcctagcccacttgtcatccataaagcaagctcaaccttgaaaaaaaaaaaaaaacaaaaaaaaaaaaaaaaaaaaaaaaaaaaaaaaaagaaaaaaaaaaaaaaaaaaaacaacacaaaaaacaacaaaaacaacaaacaaacaaaaaaagggggggggacccacaaaacaacccccacgcagggggcaaccaaaaacggcacgcaaaccaccttattgacaaaaaaaagagacgcccaccataaaagagacacgaccaacaaaaacaacaggaccgcgagcgcaccctaaaacaacaaggcctgacagaaaacaaaccactagcggaccacacagagaaaacagcacacaacggggagaaacaacacgagagcgacaaaacagccacagaa

SEQ ID NO: 35648 - DNA, 682 bp, Homo sapiens
tccaagggttgagcttgcttatggataacaatctctagccgggccatgctttccttttcttccttctttctcttccctccttcccttctctccttccctctttccccacctcttccttccgctcctttacctaccaccttccctctttctacattctcatctactcattgtctcagtgctggtggagttgacatttgacagtgtgggaggcctcgtaccagccaggatcccaagcgtcccgtcccttggaaagttcagccagaatcttcgtcctgcccccgacagcccagcctagcccacttgtcatccataaagcaagctcaaccttgaaaaaaaaaaaaaaacaaaaaaaaaaaaaaaaaaaaaaaaaaaaaaaaaagaaaaaaaaaaaaaaaaaaaacaacacaaaaaacaacaaaaacaacaaacaaacaaaaaaagggggggggacccacaaaacaacccccacgcagggggcaaccaaaaacggcacgcaaaccaccttattgacaaaaaaaagagacgcccaccataaaagagacacgaccaacaaaaacaacaggaccgcgagcgcaccctaaaacaacaaggcctgacagaaaacaaaccactagcggaccacacagagaaaacagcacacaacggggagaaacaacacgagagcgacaaaacagccacagaa

SEQ ID NO: 35649 - DNA, 1222 bp, Homo sapiens
  misc_feature (976)..(976): n is a, c, g, or t
  misc_feature (979)..(979): n is a, c, g, or t
  misc_feature (983)..(983): n is a, c, g, or t
  misc_feature (987)..(990): n is a, c, g, or t
  misc_feature (994)..(994): n is a, c, g, or t
  misc_feature (996)..(996): n is a, c, g, or t
  misc_feature (998)..(998): n is a, c, g, or t
  misc_feature (1000)..(1000): n is a, c, g, or t
  misc_feature (1006)..(1006): n is a, c, g, or t
  misc_feature (1010)..(1010): n is a, c, g, or t
  misc_feature (1012)..(1012): n is a, c, g, or t
  misc_feature (1017)..(1017): n is a, c, g, or t
  misc_feature (1022)..(1022): n is a, c, g, or t
  misc_feature (1024)..(1025): n is a, c, g, or t
  misc_feature (1027)..(1027): n is a, c, g, or t
  misc_feature (1029)..(1029): n is a, c, g, or t
  misc_feature (1032)..(1034): n is a, c, g, or t
  misc_feature (1044)..(1044): n is a, c, g, or t
  misc_feature (1049)..(1052): n is a, c, g, or t
  misc_feature (1055)..(1055): n is a, c, g, or t
  misc_feature (1060)..(1060): n is a, c, g, or t
  misc_feature (1062)..(1064): n is a, c, g, or t
  misc_feature (1070)..(1070): n is a, c, g, or t
  misc_feature (1073)..(1073): n is a, c, g, or t
  misc_feature (1084)..(1086): n is a, c, g, or t
  misc_feature (1089)..(1090): n is a, c, g, or t
  misc_feature (1093)..(1093): n is a, c, g, or t
  misc_feature (1096)..(1097): n is a, c, g, or t
  misc_feature (1101)..(1101): n is a, c, g, or t
  misc_feature (1125)..(1125): n is a, c, g, or t
  misc_feature (1127)..(1127): n is a, c, g, or t
  misc_feature (1133)..(1133): n is a, c, g, or t
  misc_feature (1139)..(1139): n is a, c, g, or t
  misc_feature (1146)..(1146): n is a, c, g, or t
  misc_feature (1151)..(1151): n is a, c, g, or t
  misc_feature (1159)..(1160): n is a, c, g, or t
  misc_feature (1162)..(1162): n is a, c, g, or t
  misc_feature (1202)..(1202): n is a, c, g, or t
agccgcgcgctcgctcgcaggagggtgggtagtttgcccagcgtaggggggctgggcccataaaagaggaagtgcacttaagacacggccccgctggacgctgttagaaaccgtcctggctgggaaggcaagaggtgtgtgactggacaagacttgtttctggcggtcagtcttgccatcctcacagaggttggcggcccgagagagtgtgaggcagaggcggggagtggcaagggagtgaccatctcggggaacgaaggagtaaacgcggtgatgggacgcacggaaacgggagtggagaaagtcatggagagaaccctaggcggggcggtccccgcggaaaggcggctgctccagggtctccgcacccaagtaggagctggcaggcccggccccgccccgcaggccccaccccgggccccgcccccgaggcttaagccgcgccgccgcctgcgcggagccccactgcgaagcccagctgcgcgcgccttgggattgactgtccacgctcgcccggctcgtccgacgcgccctccgccagccgacagacacagccgcacgcactgccgtgttctccctgcggctcggacacatagtatgaccattaggtgtttcgtctcccacccattttctatggaaaaccaaggggatcgggccatgatagccactggcagctttgaagaacgggacacctttagagaagcttgatcttggaggcctcaccgtgagaccttacaaagccggattccggcagagttcctctatctcgtcttgttgctgattaaaggtgcccctgtctccagtttttctccatctcctgggacgtagcaggaaatcagcatcatggttgggttcaaggccacagatgtgccccctactgccactgtgaagtttcttggggctggcacagctgcctgcatcgcagatctcatcacctttcctctggatactgctaaagtccggttacagatccaanganaaantcannnnccantncncnctacantcancncccantaccncnntntnatnnncaccattctnaccannnntcntaccnannncccccnaancctccacaaannnctnntcnccnncccncatctccaaaatatcctttcctcntncctcancttccnttaatantcttncaaacatnncnacaccaatttctcttatcattccatcatttttatcctccncctatcattcatcaccacat

SEQ ID NO: 35650 - DNA, 1206 bp, Homo sapiens
agccgcgcgctcgctcgcaggagggtgggtagtttgcccagcgtaggggggctgggcccataaaagaggaagtgcacttaagacacggccccgctggacgctgttagaaaccgtcctggctgggaaggcaagaggtgtgtgactggacaagacttgtttctggcggtcagtcttgccatcctcacagaggttggcggcccgagagagtgtgaggcagaggcggggagtggcaagggagtgaccatctcggggaacgaaggagtaaacgcggtgatgggacgcacggaaacgggagtggagaaagtcatggagagaaccctaggcggggcggtccccgcggaaaggcggctgctccagggtctccgcacccaagtaggagctggcaggcccggccccgccccgcaggccccaccccgggccccgcccccgaggcttaagccgcgccgccgcctgcgcggagccccactgcgaagcccagctgcgcgcgccttgggattgactgtccacgctcgcccggctcgtccgacgcgccctccgccagccgacagacacagccgcacgcactgccgtgttctccctgcggctcggacacatagtatgaccattaggtgtttcgtctcccacccattttctatggaaaaccaaggggatcgggccatgatagccactggcagctttgaagaacgggacacctttagagaagcttgatcttggaggcctcaccgtgagaccttacaaagccgggtaagagtccagtccaaggaagaggtctcttgctgcctcctaaccctgtggtctaggggcaggagtcagcagggcattaacaaaaataattaccatccccacccccgacagtgaagtggctctttccagttcacagagcactctcacacctccccgctctcattctggcccttcagctgactcggacaagccaaggatcttggtccccattttataaaggagaaaactgaggcccacgtgtaacagtgattggccccaagtcatcccgggagccagcagaagagctaggacaggaacctattgttctaacttcatattgatgctagcttttgactatccctgaaaccgagattggtaatcagcccggctctgaaactggttatttgctggggactgtaaaataggattaactatttctagtcctgcattttaattgctgttagtagggccatcttacccacc

SEQ ID NO: 35651 - DNA, 537 bp, Homo sapiens
ctcaggatcatacagacagtaaatgactgatccaaaatctaaacccacttctgttcccaaggcccatcagttcctcactgggcagctgccttagagaaggatgtgcagaggaggtggtaggaggagggataaacctgagctaaaagaatcagtaaaactctcacacttcattctatgatggatacttgtaaaaacatgagctttctagactgttatatgggttacagaatgggcaaacccaaatgacttcgtgtaatcggctttcatattaggatatgaagccgggtgtggtgattcacgtctgtaatcccagcactttgagaggctgagctgggaggatcagttgagcccagttcaagaccagcctgggcaacatggcaaaaacctgtctctcctaaaaaattaataaatttagctgggtgtggtggtgtgtgcctatagtcccagctgcactggaggctgaggtgggcagatcacctgagtccaggaggtcaagactgcaatgagccatgattgcgctactgcgctccagcctgg

SEQ ID NO: 35652 - DNA, 681 bp, Homo sapiens
ctcaaatgcaaaaatcctcttgaacttttctgggtagcctactctactctttcctaatagtaccactacagtatacagcactgtaaaattttttgctttaaaagtttgtttataaactggcatttataagtatactttttgagctgatttaagaatcaagtttttttttctagggaaatgcttctttgtaattatctgtcactagcaaaatttgttttaacatatatttttctaaaaatatgatatgtaaactgtgttgtagttgtacaattaaaggtttttggtcgaacagttattacatgatgtaaaatcatgtgtaacactttaatattaattacattgtaacctaaaattcattttaaaactttttatgtggcttgaacaggaattttcttatccaaagctttgtatgtatgctttattgcctcctttgttattagcatggagaccatgggttttctgttattgttgtttcatttaaacagttcatgaatatattaagcacctgaaagaaactgttagatgctgttaataggaagaggagttaaaaacctcgtccttgcccttatctacatgtgtacatgtagaacttactgtagttccctagatgtagcaggtgctcaggaaacatttttgtagtagtaaaaaagaaatgccagtaacaaatgccagtaaataagg

SEQ ID NO: 35653 - DNA, 1517 bp, Homo sapiens
atgaaatagtaccctctaaaaaagagaaaaaaaaaatcaggcggtcaaacttagagcaacattgtcttattaaagcatagtttatttcactagaaaaaatttaatatcaaggactattacatacttcattactaggaagttctttttaaaatgacacttaaaacaatcactgaaaacttgatccacatcacaccctgtttattttccttaaacatcttggaagcctaagcttctgagaatcatgtggcaagtgtgatgggcagtaaaataccagagaagatgtttagtagcaattaaaggctgtttgcacctttaaggaccagctgggctgtagtgattcctggggccagagtggcattatgtttttacaaaataatgacatatgtcacatgtttgcatgtttgtttgcttgttgaatttttgaacagccagttgaccaatcatagaaagtattactttctttcatatggtttttggttcactggcttaagaggtttctcagaatatctatggccacagcagcataccagtttccatcctaataggaatgaaattaattttgtatctactgataacagaatctgggtcacatgaaaaaaaatcattttatccgtcttttaagtatatgtttaaaataataatttatgtgtctgcatattgcagaacagctctgagagcaacagtttcccattaactctttctgaccaatagtgctggcaccgttgcttcctctttgggaagaggaaagggtgtgtgaacatggctaacaatcttcaaatacccaaattgtgatagcataaataaagtatttattttatgcctcagtatattattatttaattttttaggtaatgcctatctcttggtctattaaggaaagaagcaatcagtagagaattcaggatagttttgtttaaattcttgcagattacatgtttttacagtggcctgctattgaggaaaggtattcttctatacaacttgttttaacctttgagaacattgacagaaattatgcaatggtttgttgagatacggacttgatggtgctgtttaatcagtttgcttccaaagtggcctactcaagaggccctaagactggtagaaattaaaaggatttcaaaaactttctattcctttcttaaacctaccagcaaactaggattgtgatagcaatgaatggtatgatgaagaaagtttgaccaaatttgtttttttgttgttgttgttgttttgaatttgaaatcattcttattccctttaagaatgtttatgtatgagtgtgaagatgctagcgaacctatgctcagatattcatcgtaagtctcccttcacctgttacagagtttcagatcggtcactgatagtatgtatttctttagtaagaatgtgttaaaattacaatgatcttttaaaaagatgatgcagttctgtatttattgtgctgtgtctggtcctaagtggagccaattaaacaagtttcatatgtatttttccagtgttgaatctcacacact

SEQ ID NO: 35654 - DNA, 622 bp, Homo sapiens
gttacagtatttcagatagttcttatcatgcaactgagatctacatttgtgataaacaaggatattgaggagattgttttgactcaaggaatcatatgtaactcaaataaacatgtttggaataataatgtctgaaaattataattattgatgacattacatagcaaatacagttaaatatttaatgtgttaggcaataaagctagacctgcagtggatggcttattctaggaaattgtcaaactgacttaaatttaaatttctgatccttagaattaggtgttaaggacatgctttttttttttttttgatagagtctagctctgtcgccaggctggagtgcagtggcgtgatcttggctcactgcaaccgctgcctcctgggttcaagcaattctcctgcctcagtctcccgagtagctgggactacaggcatgcgcccctatgcccatctctactaaaaatacaaaaaattagctggacgtggtggcgggtacctctaatccagcttctaggaaagctgaggcaggagaatcacttgaatcggggaggtggaggttgcagtgagccaagatggtgccattgcactccagcctgggcaacaagcatgaaaatctgtctca

SEQ ID NO: 35655 - DNA, 503 bp, Homo sapiens
cataaacaaagttattgattcaggttctgaaatcccaaagacgttagtacaaatcacagtactgctacttactggccctgcaaccatacccaaacaatgatctctctaattctcatgtgttaaacagtattgatagcacctatttcaaagtttatatgaggattaaattagctaacacatgcaaacggctggcacactgtgcctggcccatagtaagcacccaatgctatctattacctcatgaccattattctggctttagtagggaaacaaaaacttactgatcattttttatatatctgtttattctgtatagtgataaattaagtagcttcagaaaacttataacattattataaaataaagattttaaagtcacttcatgattcttacattatgtttttttgtttgttttcttttgttttgagacagagtctcactctgccacccaggctggagtggagtggtgcaatcagagtggctcactacaaagcctcaatctc

SEQ ID NO: 35656 - DNA, 1653 bp, Homo sapiens
  misc_feature (1)..(1): n is a, c, g, or t
  misc_feature (3)..(3): n is a, c, g, or t
  misc_feature (614)..(614): n is a, c, g, or t
  misc_feature (947)..(947): n is a, c, g, or t
ngnggagaagatatgaggtaattaagggtacaagaagttgagattcaaacatcctccaccttcccaccccccactgccagtgggtgataaggaaatgatcacagacgactgaagtgagctaacatgattgtggatatacccatattaattcataccggaaacacagatgagaaggttgagaaggaatagtaaagaccatgagttcggtttagattcacagagtgtggaagtccaagaggaaggtaaaaaggactgaaggcccagagtcaactgtacagtagtacaagctacggaggtggatataatcactcaagaaagatatggcaaaatggtaagtggtggggtgatggtaaaaagagacaagggtctagtgtggtggttgaaagaagcagctgaagtcagattagtcacttaaattacttgattttctgagccttcgtttcaactgcaagataaagcttacaatggcatcaacttgagatggctggtgcattaaagatataattcatataaagccattagaccaaaccctgcatgagagctcaatgaatgtcagcaattcttaccatagtgtaccattataatgttggcataaaattagattttcagaaaanataagcttattaacatgtattagttatagaggcttattactaaaaatgcatgatgaaaaacctatgggcaagcaaaaatattttagaattctccacctcttctctcaatacccatactcttaagagttatattaaaggcagacttgtttaaatgtcaggacatttaccttagcttctttcctttagttagcctagtggctcttaaattttagtttgcttaagaataacaatagcaacacagtgtttagtacgaagtcatgcatgtatttcaactaagtagatattttaaggaattttctgcagtaattttgaaaaaacttttatcaccataantggtgattttggaattgaattacccatgtgcccatccacctcccactgcatctcccagttgcagcgggaggtgaacgggcacatgggtaaaattatatattgggtacacatatatatatgatgaaatttaacagactaaaacaaggtttaagaagagttatcttgtccaacatcatatagtcgataagaaacaggatttgaactcgggtctgccttactcaaaggcaaggtctcttttcagttttctctatgctacatctgtaggatagggagatcccaagcaggtttagtacggtgcttcactgaaggaatatcaacatttaagaagatggtggagagataatcgtagactatggtgtgcagaagccaacaaaggctgaagtaacatacaatcttcaatttctactgaaatgggaaattttgaagacactaataacccttacaaaggagggtgaaaataaaatatgaggcaaacagtaaatctcaggaatgaggtagacgaaaaaataagcgcagcatattgactaaagcacatttcttcctctatagtttgggaactgtgtcacagtcggaccaatatatggctctaaccaacatgtagcttttcttttcttttctttttttttttttttggtcttcttaatttgaggatttagcattccagttgtcatgtttgatgccattctgaaataaatctcttaggaag

SEQ ID NO: 35657 - DNA, 2594 bp, Homo sapiens
  misc_feature (1)..(1): n is a, c, g, or t
  misc_feature (3)..(3): n is a, c, g, or t
  misc_feature (614)..(614): n is a, c, g, or t
  misc_feature (947)..(947): n is a, c, g, or t
ngnggagaagatatgaggtaattaagggtacaagaagttgagattcaaacatcctccaccttcccaccccccactgccagtgggtgataaggaaatgatcacagacgactgaagtgagctaacatgattgtggatatacccatattaattcataccggaaacacagatgagaaggttgagaaggaatagtaaagaccatgagttcggtttagattcacagagtgtggaagtccaagaggaaggtaaaaaggactgaaggcccagagtcaactgtacagtagtacaagctacggaggtggatataatcactcaagaaagatatggcaaaatggtaagtggtggggtgatggtaaaaagagacaagggtctagtgtggtggttgaaagaagcagctgaagtcagattagtcacttaaattacttgattttctgagccttcgtttcaactgcaagataaagcttacaatggcatcaacttgagatggctggtgcattaaagatataattcatataaagccattagaccaaaccctgcatgagagctcaatgaatgtcagcaattcttaccatagtgtaccattataatgttggcataaaattagattttcagaaaanataagcttattaacatgtattagttatagaggcttattactaaaaatgcatgatgaaaaacctatgggcaagcaaaaatattttagaattctccacctcttctctcaatacccatactcttaagagttatattaaaggcagacttgtttaaatgtcaggacatttaccttagcttctttcctttagttagcctagtggctcttaaattttagtttgcttaagaataacaatagcaacacagtgtttagtacgaagtcatgcatgtatttcaactaagtagatattttaaggaattttctgcagtaattttgaaaaaacttttatcaccataantggtgattttggaattgaattacccatgtgcccatccacctcccactgcatctcccagttgcagcgggaggtgaacgggcacatgggtaaaattatatattgggtacacatatatatatgatgaaatttaacagactaaaacaaggtttaagaagagttatcttgtccaacatcatatagtcgataagaaacaggatttgaactcgggtctgccttactcaaaggcaaggtctcttttcagttttctctatgctacatctgtaggatagggagatcccaagcaggtttagtacggtgcttcactgaaggaatatcaacatttaagaagatggtggagagataatcgtagactatggtgtgcagaagccaacaaaggctgaagtaacatacaatcttcaatttctactgaaatgggaaattttgaagacactaataacccttacaaaggagggtgaaaataaaatatgaggcaaacagtaaatctcaggaatgaggtagacgaaaaaataagcgcagcatattgactaaagcacatttcttcctctatagtttgggaactgtgtcacagtcggaccaatatatggctctaaccaacatgtagcttttcttttcttttctttttttttttttttggtcttcttaatttgaggatttagcattccagttgtcatgtttgatgccattctgaaataaatctcttaggaagaaaaactgctttttgactctagattttgtttatagcattaaatattatttaaacactatgtcactgaaactttcaaatcctaagcttaattagaaatatacaacactttaaaagcttacaaattttgcatttttaaattattttcatcatatcacaaattatatgacagcttatatcacaactcatgagaagatactgatcttgggttaaacagctgaagagggcaattagctttagactgcacctattttcatctagccatctggaaaatgtaagctgtggtcacacagtggacagacagagaaggagactaaattactaaaattcaaactgcattcctgattactcataacgtatacatatggatcagaaacatcaaaatgaaaacatattgtggatgccaaagtcaagtcttggtttctaaaaatgttcaggatgggattcggatgtttttaaaactgtcctccccacactaagtctccttaatctagtatttgatctttgctgggagccccaaggagccgttccatgggtctatgtgtttatcttccataatatgtgcctactactcctaacctgtcactacatcttcaatgtaattcctttttccctctattaatgtatctaaacttatcagcttatgctaattgtacagaccccagttttaaagttagaaatagaatccttgagcatatcctaggattccgtgtgttttaaataaactatgacagtaaaatccaatgtgtgacctaaataaaacagaagcttatactagagtctgtcatttctttctaatcaatctatttcacctttatgttttaaatgaagtacagggttgctctctggtgctaactagttgtactctatttcacatttatactttaaatggggtacatggttgtactctggccatgccgctaactagctgtgtgaccttgaat

SEQ ID NO: 35658 - DNA, 609 bp, Homo sapiens
tctaggtatgcaggattaaagagttaaatatgtgaaagtaagaagctattgactggtcacctctcttacagacaaacctaaagtacaagcattgtcacctctaggttatattcagagaattcatcaatgttagtgtaagagacattggggattatgtgtagtcttgtaatttatttatcccagttttccttattagccctggctttccatttcctggttgaggctccgttaatttccttttaggccctacctcttatacttatgctattgaattatttgtcattgttccctagcgccccacctcatctccaaatgaattgatcattttcttcttcccaccttgtgcttgctcctgccatcaacctttgtcaaggtccctttacacattcatctttcctgttgctttcagtacttttagaaatattcagccaagtttagcttcaaattactttattgtgatgactttgacacagaaggtactgaataaatattttttaccatgggctgggcatggtcacttatgcctgtaatcccaacaacttgggaggctgaggtgggaagatccttgagcccaggagttgaagaccagcctgggcaacatagtgagac

SEQ ID NO: 35659 - DNA, 364 bp, Homo sapiens
cctctcctggtatacaaattttgtagaggtgtaagttgccatacgttcctcctcaggcctgagctctaacttcctagtaatctcctagatccatgaaatgtgagagagagaaaaaggaagaactgagcctgtgataaatattacacaaacaagttgaaattaatacttctgcaaagaaatattttcattcagccagctggatttgagtacttatagtggaacaggaattaaaagaaattttaaaaatgtataagcaaaaactcagttgtatgtaagaaaaaccagttccccctgaggaagagaaagatctgaagtcctttaaaaattgactgcctatttttctgtagctagtgagccttatctc

SEQ ID NO: 35660 - DNA, 303 bp, Homo sapiens
gcccatttcaagtcgtcttcaaggtaaagtgccatatttgtttgtagtgcttatatatttcttaaatgtttaacatgtgtaaacccactgtttttaaatgtgtcactggtgaagttttaaagtgctatgccctaataccatttttcatataagccctgtggtttgtatttgtgggacttttcatagtgtagtgatttttagaaactaaaatggaattcagtttcctaaaaggttgtataggctggcctttttcctttctgtatgaaatgtttgcttaataaaatattttgttgttcaacataa

SEQ ID NO: 35661 - DNA, 315 bp, Homo sapiens
ctcctgggttcaagcaattatcttgcctcagcatccgaagtagcctcccaagtagctgggactataggtgcatgccaccatgcctggctaatttttgtatatttaggagagacaaggtttcaccatgttggccaggctggttttgaactcctgacctcaagtgatctgcccacctcggtctcccaaagtgctgggattacaggcgtgagccgccccgcccagccacaatgtgctattttggttgaagcaaatgaaaatctaatctcacacagataaggagttggaaaagggaagatcatgcagacccgttttagg

SEQ ID NO: 35662 - DNA, 315 bp, Homo sapiens
tgttgttgttttaaatacaattatttatttaagcaattattaagcaaataatgcaaattgttaagcaaaagagctttcataacaatgcttgttcttctggcttggaaagctctgcagcctaatcagagagcctgtgttttactactttaatcaacttcccttgtgtactctggacagcctcaaaattattcaattatcacatctctcaaactgcattttcttaaatcaggcacagaaactcactttggtgagaaagtaagagggccttgtgcaaaaagccttttcttttgtaaagcagtacagccaagtttagga

SEQ ID NO: 35663 - DNA, 489 bp, Homo sapiens
tgttggttgtcttttctaattctggattgtgtttgaatgtatctgagatgcattgaacttgcttagagtttccatggactcattgtacttagagcagaaggaatgagaacatggtcaactattaatatcctctagcttgaaactatctacagtctgaaactttagtcatcttagggaaggaggatatggaagtatagaagtctctgatgagggccatgtgcagtgtctcacgcctgtaatcccagcactttgggaggctgaggcgggtggatcacctgaggttaggagttcgagaccagcctggacaacatggtgaaaccctgtctctactaaaaatacaaaaatttagccaggcatggtagtgggcacctgtaatcccagctacttgggaggctgaggcaggagaatcacttgaacccaggaggcagagattgcagtgagctgaggtcgcaccactgcactctagcctgggcaacaagagcgaaaatc

SEQ ID NO: 35664 - DNA, 657 bp, Homo sapiens
ctacaattaactgttaggtgataataaattcactgtcaatggggacattgatttatgtcatggggtccatctagcaaagaagtggcatttagttaaaatatgagctatgtaagcatctttcctgagcctgagataccgtgacttgatgaccactaaaatatctgaccatccatggctttgactccttggaaggtttcagattctattatcatgcttcttcatgtaagcagaaaacaggtgttatagtgtctttctctgtggctagttactttagttggttattttatgtttctaattaccattgaattattgggttcagggcaatgtatttattacactgtgagcaagtaagctttgtgttctacgaccctagggtaaatcccttaaattcatcaagattcccttgaaatgcaagtatggataaatgaactccaatcccatttcccaattctgggaaccagactaagatatatgcactaataaaggcactctggtaactttattttttattcaaaaaatattaatccctgggtagaaacaactcattacaaaaaaaaaagtgctacattttgcagaaggtcatttcagttttattagtcctaatgttggatctcctttcctaaaatctgaaataaacttgcaatttctgaattgata

SEQ ID NO: 35665 - DNA, 720 bp, Homo sapiens
ccaggcttagtaattctgacttttgaaatctcctgtcgtgaacaaatctacactgcactttatttcttgccccgtcctggaattcagccactcctgcactacatttcttaaggtgaagaagtgaaagacgaagacaccaatccaagtgaacgtgtgttattctcttctataatgctattgtattatattccctcttttttttttttaaattctcttgatttctctgcacaaaagagggaaattcttccaaagcaacggaaagtttccttgaaatacttttatctagtcacacttacatagtgtaatgtctctctcttacagcattgtacagtttgggatttgtttttaatcctgtggaaaatgtcctaacagggctttggtgtatctttgttccaatttctacattgcttggggagggggagaagctttctttgtattaaatgaaatacacctctacttcattaaataaatagacacctcaaccattagttgctaatgaaacaaaaatctaagtaaaacatctaactatccaaatactacattttctctacctttgccccaaaatgtgcctcatctccctgcacctccaaataatatttctagtgttttcattttattagttttgcaatgtcactgtccagatagaattattcgatgacttaaaacaactttcgtaagattttcaagccctaaattaaaaaatcatatttcaatacaaaa

SEQ ID NO: 35666 - DNA, 479 bp, Homo sapiens
gcagagcccccgtctgctcattgctatcatcatcaggggtatagtcagggacaccttgggcagctccctgcagcaaaaggagccaggtagaagaaccagtgtgggtgggctgggagctggaggaagagatggaagagtccagaacctgctctttctcacaacccacgtcatcttcatggacccacaggcatctgtcaccacagccctgatccatgctcatcggttatcctggggccacctttgaaaagcgttcatatttattatacactaggatgcaggtcattgtagtagttcagatcattaactttggtatgaagcattcattcaacaaatatttatttaaatgaatgtcaggcatgtgccaggcctgtatctcagcatctaggaatatatccgtgaacaaaatagatttaaattctgtgtttttttaaaaagacactatattgcccaggctggtctcaaactcccgggctcaaggg

SEQ ID NO: 35667 - DNA, 360 bp, Homo sapiens
  misc_feature (41)..(41): n is a, c, g, or t
cggtgattgtggatattctaggacctgtggctctggcacanagtacccagggccaccccagcctcacaagtcactgtgcccaaggccctgagggaagaacagcttgctcactagtgcctgaaggaggctcccaaggcagccaccttgtacactggagacactcccagcagtgggaggcagatcaaggccaggacaccgttaatgaagctttgactagggtgaggcatctcagggccagctggccttgctgcttctcaccccactctaagccttgatctgtccacatacttgaccctgttagaatctggtgtctgcccctcccccatcctgatgtaacacatctctgtagcctgaagccgg

SEQ ID NO: 35668 - DNA, 355 bp, Homo sapiens
aggacttatttatttaaagtgcttaagctttggttttagagtttctaagagatctagtggaatttgctattatgaaaagcattacccatgctattatgaaaagcatgaaaagattaagaaatctggctaaaggtcaggtgcccagcttcgaggaaaagttgggcttttagggatcaggaagcattaaaggcacacaaactttacattttgggagtcattttgttgagtaggtgaagtgagggatttggtcttgatatttggctgccccatctctatgtgggagctcaaagttaaaaacccactgtaggtaaatgagaaggacagctcttgaacctgggccagtctatattccttc

SEQ ID NO: 35669 - DNA, 365 bp, Homo sapiens
tttaatttaatttaatttaatttaatttaatttaaaacagtcgcttgttttaatttaatttaatttaaatagttccaagaccccctggatcacaagaccaaaccagacctgcaggaactttcctcctcccctcctttccctcaccccctgtacagaaacaaatatatcttcacacccatgcagtataaagttgaaaaataagatttcattttatttgctgcctcagtacttgtaccctaaagggtctcaaaggcttctattgccagatatgtcccccctacaatgggaaaggcccccacctggctatttcctttatcagttggggcagccgccctccacaggtcctcaccgtaatgggtttgtat

SEQ ID NO: 35670 - DNA, 398 bp, Homo sapiens
gcgtatgcaagcatattcaaggagacctgaatgcaaagtaaaactatgaaatttctcaggaaaattgggctagggaaagagctctcagaacttcaaaagtataatctggcggggcacagtggctcacgcctgtaatcccaacactttgggaggccaaggcaggcggatcttctgagttaggcgttcgagaccagcctgaccaacatggagaaaccccgtctctactaaaaatacaaaaattagctgggcatagtggcaggtgcctgtaatcccagctactcaggaggctgagacaggaggactgcttgagcctgggaggcggaggttgcagcaagccaaaaatgcgctactgaactctagcctgggcaacagagagagactctgtcaaaaaaaaaaaa

SEQ ID NO: 35671 - DNA, 583 bp, Homo sapiens
ctttccttcacagtcagcctgcatggtggtctgaggccttcccccctacagcctctcccctttatctttcacggtaatcacccctcattactcgtacttctaactccatcttgaaagctgcttcctggaagatccaaacggacacaaggagggactgaaggattagaatgagggaagtaacccatgcactgcttatttgagatggggaaccgaaggactttggcagttcctacacagagacagatggcagagatgacaaggtttctcagagaatgcgtgagtaactggaatggcttttcctgatgacccagacagcctgctcaagagcacactgttgcagctgccctccttggatggaactatggaatgatttttattcttctacttcccaggtgaatgggaaaccaaggacacagtcagcatttaacaaaaaggaatctgcatctcagtcagaactgtattgcatttgcttctctctggattaccttgaagttactccccttccctcaataataatggcattatgaaaaaaattggaattgatcaaatgaagtaaagagtaaacagaggaaagactaaaaaa

SEQ ID NO: 35672 - DNA, 600 bp, Homo sapiens
ggtcattagtattagtaatcattcctaaatgtatatgtaaacatttatttcagtgttaaatattgaagtgtttggtctttatttagaagtttgatgttgtgttttatgaccagaaatatgctgtgaacttaattctttcttatagcagttagcctatgggaaaattggttttgttctacattattttttttaaagtcataatttccaagatcctatcaactccattaagtgaggatttggcagttcctacacagagacagatggcagagatgacaaggtttctcagagaatgcgtgagtaactggaatggcttttcctgatgacccagacagcctgctcaagagcacactgttgcagctgccctccttggatggaactatggaatgatttttattcttctacttcccaggtgaatgggaaaccaaggacacagtcagcatttaacaaaaaggaatctgcatctcagtcagaactgtattgcatttgcttctctctggattaccttgaagttactccccttccctcaataataatggcattatgaaaaaaattggaattgatcaaatgaagtaaagagtaaacagaggaaagactaaaaaa

SEQ ID NO: 35673 - DNA, 387 bp, Homo sapiens
gtgcagtggcaggatgatagctcactgcagctatgaactgggttcgagtggttcttccacctcagcctgctgcgtagctgaggctacaggtatgtgccgcaactcccagctaattttatttttttttattttttgtagagatggggtcttgctatgttgcgcagcctgatctccaactcatagcctgaagagatcctcccactttggccctgcaacaggcataagccactatgcccagcccttttatttttagaacttttgtacaacatatatattcttttgtatatgtgccatactgtatacacacttttaaaaaaatgttttacacaatgaccaggtgtagtggctcacacctgtaatccacacctgtaatcccagcactttggg

SEQ ID NO: 35674 - DNA, 470 bp, Homo sapiens
ctaggacttagaaggcttaagatattatggtaatttctcaatttttttttagtacttgttgcatgcaagaggcagaaaaaaatttaaactaattcagacaaaaagagaatgcattcttttatgcaattgaaatgattctgacttcaaacacaggtggatccaggagattaagtaatatgccatcaggattgagtctcagtccatctcttggttctgtgttggacattctcatataggctgtcctgatacagaaacatgatgattatcggtggctctagacatacatcttattagtttctagtagaaagaggatgaactttttctccaaagagtttcacaaaaatcctgcagttagcattactggttctgatgtcctggttgcttcatcttgtcatccctgagttaactccaatagctatttaaaatggataaaagttgaaagcaggattccccaaggaacatctattaac

SEQ ID NO: 35675 - DNA, 339 bp, Homo sapiens
ttttttttgagatggagtcttgctctgtcaccaggctggagtgcagtggcgcatctcagctcactacaacctctgcctcccaggttcaagcaattctcctgccccagccttccgaatagctgggactacaggtgtgcaccaccatgcccagctaatttttgtatatttggtagagacggggtttcaccatgttggccaggatggtcttgatctcttgacctcgtgatctgcctgccttggcctcctaaagtgttgggattacaggcgtgagccaccacgcctggccaacatcatttattaagtaggaaatcctttccccattgcttttgtcaggtttgt

SEQ ID NO: 35676 - DNA, 419 bp, Homo sapiens
ttctctcagtaattttctgtcaataatatttctctcaataatttctctcttttctatgtaaagttcttgtatgtctttggttagatacattcctagctatttgctactgttgtaaatgttactatttttgagttttattttctaattattgctgatatataggaatataatttattactgtccttatattcagtaactgtactaaactaacttattcttaaagattctttaaggcatgctgcataattaattctaccatttgtgaataatgacagtttcacttttctctggttcttaacctattttatcatgaaggaaatggagtaaaactttttttagtggattggcaacttccagagaattagattgttttgaatgtgtctaggtagaaactaatacttgtctaaaacaaaaaaaaa

SEQ ID NO: 35677 - DNA, 417 bp, Homo sapiens
acctgatcagttttttgatagttcaggaactgtcatgctgcaaataccaattgttagggaagggagacctcaggtgtatgaatctttgaactaaattaaattgtatttcctactctccataactttaaacgtgatgcaaaaacatcgtatgatgtttaagtgtttctttgtctagcctctttcttcaagcaaatgttgagtcttttaattgaacttatttttagtgttctcatgtggataaatttccctaacagtagtttgccaaagataggatagcttctcttgtgatgtatactaatgttgagtttttaaaggcttggttgtcccctttatgctttcaaccttggtcaggcttggaaaggtagattcaggattgatttcagctgtttttttcctgcggtatatgagtctaaaggc

SEQ ID NO: 35678 - DNA, 394 bp, Homo sapiens
ttcactcatcacatcacactgtttctcccctcctagctgttaccacaacctgcaactaacttatcagttgtctactttattgtttatctgtacctgcatagggaccttaggctgtcttgcttcctgctacgttccaaaaagcctataatcatgtccaatgtcatagagggccccatacatatttattaaataaattaatccaggaaggcaaagctggatcaaactacatcagcacatctggagaattatagcagtcagaggaggaaaactgtgagttaggatggaatccagcagaatggttcactacctaagccaatagacctgaaaagtcttctatcattccttgactggacacttccctgcatgaaaccacgccatagtacaggtccacttt

SEQ ID NO: 35679 - DNA, 290 bp, Homo sapiens
taaatagactgcaggacaaattattatatctttaaggtattttcagtactaaatgcttaactttagagatgtttataaatgataacaataaatacttctgtatagcaaaaagaacctttaaatgatggcctatttagggtaatcaatgctgattataactaaattcccatataaagtattttgagttctttttttgttttaattattaaagtaaatatctttaatttctgtgtatgtatataactctctccacatatatatggagagagagagagtgcgagcaagcacac

SEQ ID NO: 35680 - DNA, 911 bp, Homo sapiens
tccctgtcacaagatagaagagtttcagtctaggcttaatggcaaccattggacaaagatgctttcttccacctaacaggccattaacatcttaaaggtatttttgtatctctaattttgtttataataggtgctcaacagaatgagctgaatggctgttacaaagggggtttgtaccttgggtaagagattaaaatataactcaaaatttccttctaacgctgcacctatggaaccatgtgatagaggtgtattaaaattgttatcgaagaatatatagcatatggtaaacaacagtttgcatatggaaaatgtctttgataatttaaccagaactgcattatattcaataacggattttctttataacaaacaacaggagaaaatggagttggcacacagtggatcactttgatatttttaatagtccaagtctggattttatttattcctgagccaacaattttgaacagcatattttccatgtttctgactgtaacaaaacattttcctcattgttccattgtaaatattcctcttgttggaactctttttaatcctgagatttaaacctgtacctttcaattgtctgtgacctttcaatttcactttcaatagttgaagaacttggctttgtaaatctctcagaagcttgaaaatatcttgtctctaccccctcagcccatttcatttgccaataattattttgtaagtagggttgaaatgaactcagctggccttgtgaaatgtttaaacttgcacaaacaactacatttttgttcaacaaatagcagtttactcagccaaaatcactttggatattgccattacaaatactgttaaacttcagaaatcatgtctgtaaattagatgagccaaaataaaggacaattgggttgatgctgcattag

SEQ ID NO: 35681 - DNA, 455 bp, Homo sapiens
  misc_feature (380)..(380): n is a, c, g, or t
  misc_feature (399)..(399): n is a, c, g, or t
  misc_feature (450)..(450): n is a, c, g, or t
cttctcagtttttggtgaatgtgtaatttaccatttgagaataattaaagggggaaggaagaaaatatctcaaaatatagtgaaatttttccttttttggtgcctgtttattcttggaaacaaattaatctttaaacagcatttttgcctcctgacctcaggtgatcctcctgcctcggccccgcaaagtgctgggattacaggcatgcaccacggcgcccggcctaatttttctattttctgtaagaggtgaggtcttgccatgttgcccagggccagtctcaaactcctagcctaaggcaaactgcctcaagccatctgcttcacctttacctgccaatgttgctgggggttacaggcatgagccactggttttcagnctaagggaaaaatattttnaagttgacaatgtagggaatgaggttaggttttttcaaaggggttcattanggatt

SEQ ID NO: 35682 - DNA, 297 bp, Homo sapiens
gtgggtgaaagacctttggtctctccctgctgggtagggtggttcacagttttgttccttttgtgcatttgtgcaggagactgagaagggtttcttctgagcagaaagcttagcctggggcttactggccagagctgcctgcagcctgggaagcaggtggagtctgcagtgctggcagcgccgccgtgcagcggtgtagccgtgtgtgcgcgtgtgtgtgtgtggtgagaaaccccacttttgctggggactgactcgtgaagaccacaaggtctgggcaacacagccttggcccgt

SEQ ID NO: 35683 - DNA, 495 bp, Homo sapiens
  misc_feature (33)..(33): n is a, c, g, or t
aatgcaaggattgccaggggaccccctgaaaanaatgtgaagtgactgaacagtgttaaccttagaagactagaacctaatgagttatggcaaacagatgttatgcacgtccctgaatttggaaaactaaggtcctctttggattcccagcacgaggcatcaaaccataccatggcatggctaggacccaacccggtaccaaaatgaagaaaatgaccctacaggacccacaatcccggatgatgtggcttccttggatgacacaggccctggacattacctgggggatgctgaagaagacaactcaggaggccaagcaaatcctgctccaggcacagacaccattcactccaggaactccagaagagaagggcctttttccactgtgtccattgatgaatcttcatcactgagaatggaatatgccacatagcagatgctcaataaatatgttgaattatgaaacaaattaaaaagcacttttagtcatattca

SEQ ID NO: 35684 - DNA, 725 bp, Homo sapiens
  misc_feature (33)..(33): n is a, c, g, or t
aatgcaaggattgccaggggaccccctgaaaanaatgtgaagtgactgaacagtgttaaccttagaagactagaacctaatgagttatggcaaacagatgttatgcacgtccctgaatttggaaaactaaggtcctctttggattcccagcacgaggcatcaaaccataccatggcatggctaggacccaacccggtaccaaaatgaagaaaatgaccctacaggacccacaatcccggatgatgtggcttccttggatgacacaggccctggacattacctgggggatgctgaagaagacaactcaggaggccaagcaaatcctgctccaggcacagacaccattcactccaggaagctgccattcattcgacataagtaggtgcttcatctgataagcgctgcttgtgtaatttatcaatgacagagaaggcagatagcagcatgcatacttggggctgcatttgaaggagagcaacatccctttgttttcacagaggagaacaagcatgagttgagattgtggtgcttcttgaagtctcatccagatcagaaacctgctgctctgtccacattccatccaccaaagcaacccatatggccatgtccagcatcagatggggaaaggcagttctcctctagcacgaggagctgcaaagccacatggcaaaggatgagtgtgtaaaaaataaatgcaggagggcaggaggcattgggaacaatga

SEQ ID NO: 35685 - DNA, 630 bp, Homo sapiens
gggactgcagctggaaagtcaagacaaagatgtgtgctggagaatagtaaaaaatgcatacaaattctccaagcaccaggagagtgcctctttctttagcagcctggaatcatctatgcctggaaacatcaatgtcttctggccagacaaaggccaaggagtgaaaggcgctatgcccagcaagaaaaacttacaagtggtgaaagtgcctgtgcagggatggggtcaggggctgggtcagaatgtccaaacctcagcatcgttacaggaggttcaaagtgccttttcctctgactcagaagcacctggtattaaagaattccatgctgcagaggctatgctccacgcaagagctagaacagcattttagggtggaaactaaatggaatggaggcgcaaatgctgttgaggagacagttgccctgggccaggtcctagcctcaccttccagctgcaagaagttgcttgagctttctacgcttctgcaccctcatctataaagtgaacagaatgacagtgccccataatgacagctttgataaggattaaatgaaattaagtatgtaaaatgtttaatacagtgcctagtaaattcttaataaataaatggatgacagtgaaaaaaaaaaa

SEQ ID NO: 35686 - DNA, 502 bp, Homo sapiens
tcagaatggcctgggctgaaactcctgaaaaagttagagttgacatttctcccctggggaagtccaggggcagaaggtgagtgtagaggaggagtggggactagactggctgcagccaaaaagggcatttgaagacaggcagagtgacctttggaggcaggaaagggcacagttttcctgctctccaaggcctcctaatggggcttttatttccatctgtccttggccttccccaagctgggttcaaggtttgaatgcccagggctgcttcaaacaggtgtacaggttgggcactgcacaaaggcaacaagagaacgggttagtgggacatccggcccaccctctaccagtggagccatgtgcccaggtgctggctgggtctccccaggaggagtgctgctccgtcattccacagcgtcatccctcacagccctggaaccgcctcttccaagactaaaactttccccatcctgtcttatggctggaagcccagcttaggagg

SEQ ID NO: 35687 - DNA, 333 bp, Homo sapiens
tttttttgaggcagggtctcactgtgtcacccaggctggagtgcactggtgggatcatggctcactgcagcttcaacctcccaagctcaagcaatcctcccgcctcagccttccaagtagctgggaatacaggcactccccacaatgcccagctaatttttgtattttttgtagacggaggctcgtcatgttgcccaggctagtctcaaactcctggactcacgccatccacccaccttggcctcccaaagtgctgggattataggcataagccactgcacctggaggaatactgtcttaatacgacaaattagtactaaagctagtatcttc

SEQ ID NO: 35688 - DNA, 316 bp, Homo sapiens
gctcgacatttaatctctcagtggctacattacatttatcatgaaattgatggacacttgaaattaaatgtgtccttaggttgtaatgacagaaatatagagtacaggaccacagagatattattcttgatcttgaccttgatcttgactggtcaggcttcatctagaatatttaccaattctgggtacatcaccagatagagatattcagaggagagggagcagaatgaagtagcttgtgaaaaccatgtcataagacaaattgaaatacttaaggtatatatctgggaaaacaaaacccagaagttaaaattct

SEQ ID NO: 35689 - DNA, 834 bp, Homo sapiens
ctgaaagttcagagtctgaggtggctgtctgggcctcttgggaagagctagcagaagagagcacttgggttgaccacaaacatggaagggcttacagggctcatcttctgttttctggaaatattttctcaaactattagagatgagtgaaggagcaagagtgaccaagtccttgatggttttcctcctccagaattactgaagcccatggaattatgagatgtcaagagaacctcccttcttttttttaaattttctactccaataaaatactttttcaatgcttgttttatgccaagcactttgttatgtgttgaggataagccgcttggttctttgctaggtattaagtactaacttgtcctcagaatttggaccaatgccttgagtttgggaatacttttattaaggttattagttagggtgagattttattgagggatgtattagaaatgacacagggtctagagttaggccaaagttcaaatctcagtcctgcctcttagtatctatgtgtaaatccctcttgaaatgccaattttggccgggcacggtggctcatgcctgtaatcccagcactttgggaggccaaggaggacagatcgtctgaggtcgggagttcaagaccagcctgaccaacatggagaaaccccatctctacttaaaaaacaaaacaaaacaaaaaacaaattagccaggcatgctggcgcatgcctgtaatctcagctactcgggaggctgaggtaggagaatcacttgaacacgggaggcagaggttgcggtgagctgagatcatgccattgcactccagcctgggcaacaagagcaaaactc

SEQ ID NO: 35690 - DNA, 523 bp, Homo sapiens
aaaggaaattttatgctacccctctggcttttgtgggattctttcacatcccaggtgcctcttggagacagatctcagaagggctgtggtgtcagaagggacatggaggaggtcaggagggctcatggttccttttctttagaactgatacgaggcttggctagtcactgtgagctccagcagctccagcagcctggaataagacacctagaaggctcatccctccatgtccatgtccttttttgttttttagattgaacaaccatgctttgtttaaaaaataatctcagcaaactagggatacaagagaatttcctcaacctgtcgaagggcatctttaaaatatctactgctaacatcctatgtaatgatgaaaggctgaatgttttcccctaagattgagaataagacagagatgtcaactcttaccacttctattcaacgttgtactgaaaattctagccactgcaatcatgttttaattgggagtagggggaaagagggagggaaggagaaaaaaaaa

SEQ ID NO: 35691 - DNA, 171 bp, Homo sapiens
ggacacatggctaaaaggagttaagaatggcaaaagctaggttctcagaacacattcaaaaccagctttattcttttgggctcagtatcaccccgcagatatacaacacgaagtcactgctaattcttgtttgtctgtgggccttagtttcgcttgatagaaaaaaaaaaa

SEQ ID NO: 35692 - DNA, 438 bp, Homo sapiens
ttttttttttgtatttttagtagagacaaggtttcaccatgttggccaggctggtctctaactcctgagctcaagtgatccgcccacctcggcctcccaaagtgctaggattacaggtatgagccaccaggcccagcctaaaatgtacttttcaatgctttgttagtaatacgggaatccagataatataggatttaaggaattaagatcaaacagaccaggttccagtttctgctccatctctcttagcagttttatgaccttgaacgcaccctgtaagtgtccctaagcaccagttctctcatctgtgaaatgagaattatcacaactcccactttagagtttttgtgaagattaaattagacaatacatgccaaatgtttaacataaagtacatgttcaataaatgttaggtgatgacaatgataaatacaaaaa

SEQ ID NO: 35693 - DNA, 858 bp, Homo sapiens
tgggacaataagcctggaggtttctctccctgtgctttttctcgcttgttgtgatatccctgcctaccaaaactcccaagaagtgtcagctccaatgatgtttctttgaatcaccccatctggcaagatgcaaacactcttgcttttgaattgctttgtcactttctgtcttagctgttgagcacagttcaaaacccatttgctgagcctgtcctgtggacagccatggtggcaggagccagggatgtagaagtgaccctggagtcaccagggttcagtgtgtgtcttgcctgcctggattgtacaagcacccacggctcagagacggagacttcctcctctctgtaactgcacttggcacctggtagtgagtctggtcaaacagatgctcctgcactcaccagtgaatagacccataagatgtgccgcctttgagatctttgctttggtggatttgaaatatgggaggaagagctgagctgcactgtgtgtgggccagagtggtgcgtcgcaggcatgaagaggccaggagtagggagagttccatgggggtcaggatcagagaggtccatagtaggttcaggtgtggtggctcatgcctgtaatcccagcactttgggaggctgaggtgggaggatcacttgaggtcaggagttcgagaccagcctggccaacatggtgaaactgtctcaactaaaaatacaaatattagccgggcgtggtgacacgtgcctgtaatcccagctactctggaggctgaggcaggagaatcacttgaacctgggaggcggaggttacagtgagctgagatcgcgccactgcactctagcctgggggactgagcgagactctgtctca

SEQ ID NO: 35694 - DNA, 470 bp, Homo sapiens
gcaaagatatgggagtggacgcgtgtgtgtctgtgcccaaggaaaaatgaaagtaaacccatgttctctcactgacattcttttcagacagagctcagccccagctctgcgccccgccgcacgtccctcataagtcgatacgggatgcagcaggtcgggagagagactctgcgggtttcaacttccctggcctcactttaatttggctgccgttcccacgctgcctacctccacccacctccaccctgagacctgacacccagtggcccagggtacctggtggctcccccaaccgatgatggggataggttccgtgtctttcacttcctcttagtaactcattattattgcctgattctcatgtgttctttatcgcattcccagacttactgaccacaaaacatttaaaacattttaccaacaagaacttgtggggtttattgtctgctgaaaggcaactgccaaaaaag

SEQ ID NO: 35695 - DNA, 645 bp, Homo sapiens
gacaccagcctgaccaacatggagaaacctcgtctttactaaaaatacaaaaaaaaaaaaaaacattagctgggcgttgtggcgcatgcctgtaatcccagctgctcgggaggctgaggcaggagaatcgcctgaacccgagaggcggaggttgcggtgagccaagatcgtgcaattgcattccagcctgggcaacaagagcgaaactatgcctcaaataaaaaacaaaacaaaacaaaaaaagagccagagtaaaaagttacagcctattagaaatgtatttggaatctggaatcagtatttacagcttggctgtgttcccatttcatgcatgatagtcaatgagcagttagttgcattcaaagcacattgctcattttggttatatttaccttcaaaatcaggaaaatacggaataaatatttgcgtttatgtggttaatactcactaaacttttgaatagatttgtttttcactatccctttcttttgtaaaattattcataaaatcatttaaaaatacaaaaataaacagagttcactgaacccagatggtaaatggtggtgatgactattttttcttgtataccgaaagttattaatagaatattccagctgccctcctccagaatcttttaaaaaaaaa

SEQ ID NO: 35696 - DNA, 803 bp, Homo sapiens
aagattttagctatttcacatcctcccaagatagtaggaagttgtctgcgcatattttttttttctcaaggcttctctgtactcagccattatttaattaaacaccagccatatgctgggatctgctggttctctgcttgacgcattgccagcctggtggcctcaactgcaatttgaagttgacaggcgtacaatacaaagctcaggagacactaggaagaaaaggacttggcttggaggaatcaggaagacccagggagagaaaagtgtgccgctccaagggagggtttgcccaagagtggctcagcggaaacgtggcagtggaatttggaatctggattgtttgtcagaattgataaagacattcttataaggaaatgtatctgtgaaaagttgtttgccactcggggagggagaaaaatgattatagaattttggagacaaaaatgtatacgcagcagtcattatacacatgatcagaaggaaaaccagaagatccaggggccaaaggggaataattgatttcttaaatggcagcaagactggatttgacaactctcacgatcaagaatatttctctgtatttaatctacatctcttctgctcttagactttatattcattttctcttttttacccattattggtctttttcaaaaacaaaaatttgagacagggtcttgctcttacagcccaggctggaaagcagtggtacaatcataattcacagcagccttgaacttctggggtcaagtgaccctcccaagtagctgggactacttgggtgcttgccactaccccct

SEQ ID NO: 35697 - DNA, 418 bp, Homo sapiens
taatgcaaattcccgttgtactgtatttaattatgcacaaaatggtgcccttgactcagatttcagtgaagaacttcatttttttacttttaagtctccaagtaggaaattcaattagcgttatgaaagaaacactaaaatgtggcatttaattgcaaaatatattttaagcttttcatttatccagtgactttgccagcagtcactgaccccttcattcagagatccttttctgtttcaaaaatgcaatgcttcctttttagtatattcaagcatttgtgaaaattattgccctcatgtactcagaatgctgaataataagtgtaataaatgttatttctggttctcctttggttctcattctaacatttttatgagagatttaaaggagcaaataaactataattagaaaaaaaaa

SEQ ID NO: 35698 - DNA, 1323 bp, Homo sapiens
agcctcacgcctgcctccctatccttccaggaagtagagggaggcctgaagacccgggaatcctccaatggctctgccctgtcgccctgtttcaatcctctgcctggtgtttacatcccttgtttctgtttttgtttcctgtatctcctctctacacctctgtgtctaatacagtagccattattacaatgaaagaaaataacacattcagtccctcagtgccactagctatatttccagtgctcggaagccacatgtggctgatggctgtcaaattggacagcatggtagggaacatgtccatcatcaaagaaagttctagagtgtctgctccttaagacaggactctatgtacatggtcccagctgtgcccccagcacctagtgtggggtctgccatgcagtgggcatctgggaggtaaatggattggtgatgggatggcacactgtgttaggcaatgctgggtgtaccccgagtcggtaacctgccttttggggtgagagagccacaccatttctctctgtgcctgcactgcagaggaagcacatacacccacatgtatggagttgaagtgtcatgcccaaggagggagaggtgatggaagcactgggcagtggtgagcagcagacctcaactccaccccaccctgcactcaccaggtgggggacctctttgagccttaacatccgtgcctggaaaatggggccggcatttgtgtcttgcatacgtcttggctgttgcaaggcttgtgtcagatgagagcaggtatacgagtgctttggaaactccaaagctgtgttttttcaaatgtgatccatggaccagaagcagcagaaagtgggaaccttctggaatgcagcctaagcctctcccagagggcagcaggatcagggcaagaaggagacagccctttagaaaggcagctgcccagtgaagcctaaggaagtgtggcagcgccgtccaccctgtgtgtgacatggtggagggtctgtccctgagccggcagcctgtaccccacgcctctcagccccctcagaaagcctcctgccccctgcactcccagcctctcccttgtgcccattcccattgctagaattgttggcaacagtgcagcagcagcgatgacagcaggtagcgcccattttgccatgtgcaggcacggggttgttttacgttcattcatttaacccaatggagagtatctgtgttccaaacatcaaaaagggacagtaaaaatacggtcctataggactgccattgtatacatggtctgttgttgactgaaaggtcattatgtgacatgtgactgtattatccttggcc

SEQ ID NO: 35699 - DNA, 595 bp, Homo sapiens
caaagccaagacgtatgcaagacacaaatgagagcaggtatacgagtgctttggaaactccaaagctgtgttttttcaaatgtgatccatggaccagaagcagcagaaagtgggaaccttctggaatgcagcctaagcctctcccagagggcagcaggatcagggcaagaaggagacagccctttagaaaggcagctgcccagtgaagcctaaggaagtgtggcagcgccgtccaccctgtgtgtgacatggtggagggtctgtccctgagccggcagcctgtaccccacgcctctcagccccctcagaaagcctcctgccccctgcactcccagcctctcccttgtgcccattcccattgctagaattgttggcaacagtgcagcagcagcgatgacagcaggtagcgcccattttgccatgtgcaggcacggggttgttttacgttcattcatttaacccaatggagagtatctgtgttccaaacatcaaaaagggacagtaaaaatacggtcctataggactgccattgtatacatggtctgttgttgactgaaaggtcattatgtgacatgtgactgtattatccttggcc

SEQ ID NO: 35700 - DNA, 198 bp, Homo sapiens
tcaccatctataggacaatatgtgctttgcaataataacattagatttctagaaacacacacacatgcataacaccaggaacaaattttcctataacttattttattgatttcttttacatatatgaaatagaaaaatgatattccaaagaattatacctctcaattttttttaggaaaaatgtttaaaaaataaaaa

SEQ ID NO: 35701 - DNA, 431 bp, Homo sapiens
ctaccaacctctgaagggggaggaagggagaaagggagagggcagaaagaaaagaactcacagaaaaataattaacaaattagtatatgatttttgttaaacttgaaccatttagacatttctcaattggaaaacaatcctaaaatcaaaatatgtgaggccaagcacaatggctcatgcctgtaatgggaggccaaagtgggaggataacttgagtccaggagttcaagaccatcttaggcaacacagtgagacctcatctccacaaaaaaattaatttaaaaaaaattagctgggcatggtggcactgcaagtcccagctactcagggagctaaaggaggaggatcacttgagcccaggaggtcaaggtggcagtgacctgtgatgacaccactgcactccatcctgggcaacagtgaaactctgcctt

SEQ ID NO: 35702 - DNA, 182 bp, Homo sapiens
catgacactactggttaatacataactgagagttaataaattttgctgtgttacagtctaatttgctctctaccaacagagaccttctttctttttctgtttagtttttcaaaacaagagttatttaatgtgcttgaaaactagacatttttcctagttgtgttcactgaattagcatttat

SEQ ID NO: 35703 - DNA, 401 bp, Homo sapiens
attttagtgaaagtctcctaaaactagtcctggatgtgttttcatcacacttgaagtttaattaactgataactcaggcacaatggaaatacttagatagatgctcttaaattacatttaaacaaaactatttacaagcgatctagtaaaaatctgtgtctttaatgggctatttttaatgtttcctaaacaaattattgtaggtgggccaattttccctctttacttgttacttagaagcccatttggacatgttctaccccgatctggttctctcaccccactggctacagaatagtgtgtttttgtttgaaagggtcaaaacattaagaatgtgacatccaaaatatgtgctatttttttttcctggagtcaaaacccctaaagtataaatcgttttt

SEQ ID NO: 35704 - DNA, 840 bp, Homo sapiens
tcctgcccggatgttgcatttcccaagaccaccctggcctgccatgccctcatcctgtgcctttaaaaacccccgagaccctggcaggcagacgcacaagcagctggacattgagaggagcatataggcagagaatacaggggctgctggatgtcgaaaggaacgcaccagcataggagcacaccggcatgctggcaggccattgaccagcggaagaatgcagagtttgtcgcgggaggtcagagaagagtcaggccgccatacctgactccaggagaaaaccgtctcccttctggttcccccgtctgccgagagctacttccactcaataaaactttccactcattcttcaagcccacgtgtgatccaattcttcccgtacaccaagctattgcgaaaggggttgagttcttgatttgattcactgcttggtcgctgttggtgtatagaagaactaccgatttgtgtacattaatcttggacctggaaactttgctgaattcttttatcagttctaggagctttctggaggagtccttagggttttcaagtgctggtaatgatgtatacctggcagctgaccgtcaaatcttatgaaggattaaaacataaagtttgcattaaaggtcaaaacagtcacaagcctgctcaaattcggaaagaggggacggaaatggaacctcttcatgggaggaagaaacagggtcttgctctgttgccctggctggagtgcaatggtatgatcatagctcacagtagccttgaactcctgggcccaagccatcctcctacctcagcaaccagagtagctgggattacaggcgaatgccaccacacctg

SEQ ID NO: 35705 - DNA, 753 bp, Homo sapiens
caggcgcccaccatcacaaaaatacaaataatttttgtatttttagtacagacagggtttcaccacgttggccaggctggtctcacacttctggcctcaagtgatccacctgcctcagcctcccaaagtgctgggattacaggagtgagccaccgtacccagcctcctcccaccctttttgaagggttgatgtttcaagtctgtgaactgtggatgggccttgcctttagccctccagtcagtgctgctcttaggattccaatgaacacaacacccaggacttgcctttcatatctggagctcaaaatgctcaccttcaggtctgagaagccccagaatttgccatggggctactggacggtcatgtccttggagccaagcttagtagagagagagccacccagaaaggtggacagggcggcaggctgctcaccagagcatggccgtgtgctcacaaggggtcctgtttgatgaaagtgtcaaaccaagcaagtaccatcttggaggaaatgggcctgaagagtgcttgggacaaggaacaagcgtgtcttcgcctctcttgtgagatgaggtgtagcttgcttcagcacattggatgtccggcctggttttgaacctcagccttacttcctactaattatatgaccctttagcaaagttacttggcttctccaagccttagttccccctactagcgcctgtgtaggaatggaaggtgcttatacagtgcctgccctgtggtggaaaagccag

SEQ ID NO: 35706 - DNA, 339 bp, Homo sapiens
gaagcgggggtgcgtgcgcgtgtgagtgcgtgtgtgagtgtctgtgtgtgtgtctgtgtgtgtgtgtgagtgagttttgccatgttggccaggttggtctcaaactcatgacctcaggtgatccgcccgccttggcctcccaaagtgctgggattgcaggcttgagccactgtgcccagcccctttctgttctttctagggtaggcgccacactttcctgagtgttttttgatctagcttgagaaggttttcagtactgctttgctataagtttgtctttccttgtatcctgtcatacttacttaaggtagtattccccacataaaaattctgtgctat

SEQ ID NO: 35707 - DNA, 533 bp, Homo sapiens
ccaaagatttttgactaaaaacagatatagtaaaaatgatgtattaggagggtagactggaagttgggttcaaattgaagacagaaagataagctctacagtagtgtgcatggataagtatggtgatgagtccccaggttacaaacggactctgaattgatgagaagtttccaaatctgaaagagattgctaaagaagagcctacagaatataatgactgatgggaaagcagtccaatttcagatccctcatgtgttgcgaaatgggcataaatatagtgcacacaaggtttctaaatattttaagtctcttcctggattcaccaatgtatatttcaccaacatatatatgaaattgtaacttgttaaacttctctgttacttcaagtttcactcttgtctttttagaggatacgcaaacctcatttcatcatttctactctagagactgcttatttggtagaatgaaaaagtacaacttggatagtaaactactgtattcagattttgcacaaaaacaacaaaatacaatct

SEQ ID NO: 35708 - DNA, 281 bp, Homo sapiens
acagtcccagggtaggagagtatgtcaggatgagtgctttagtgtacaccttaaaccagagtagtgtatgggtcagggagtccctgatgccttcctgaaatgaagatctagttacctttgaaaagacattgtcttgcctttactttgtggagtcattctgttcagggttaagaagcagggatggagagttcgggccacccgcactgaagtctcattctacctcctcctggctgtgagtcctggagccagccccttgtgttttgagtactcagttcacacct

SEQ ID NO: 35709 - DNA, 445 bp, Homo sapiens
catgtccttaagccttaaccagttgtacaaatcacccacttgactctctttcactttatcagggccagaaaagttaccctaaccgacgaaaagaaggagaaggtccccactgacccctgctccagcccagttctgtgctggatcagtatagttttgcctttcctgatgactcaccgtcccgtctccctgacttctatccaataggccctactgccagccaattgttcaccttttaagttcaactggaaagaaatttgattttaagacaatcagggtctggtctgtattcacaggttatcatttgggttagttaggtctcttacagccctttcttttcctgtctttttttgattcgaggtgagagtctatacaatcagttgcctgcctgctctaacttgagtgcctgttctacttaggcagattctgttctaaccatcgagaacct

SEQ ID NO: 35710 - DNA, 343 bp, Homo sapiens
gggcctctaaaatcacgaagctgaagggaaaattcaagctgggaatgcttagacaaacctgctgttagaaatagataatcggtgccatgaagaaaagtcagcatggagacaaaggatttctccacaaggccctttttattttctgccgaaagggtgctccccgcagatggaacaattttgacaattttggtgtcaatccgtatggggacccgttctcctctggcagtggtctctagtcctctctcatgaggaggtgtcccgtcaccttgtttcggtggcctcaggggtgaggaatcaagacccacccagtgtgacaaataaacccagactctcagcaatgtgg

SEQ ID NO: 35711 - DNA, 347 bp, Homo sapiens
gtttggcctttagcacagtgccaaacacagagagatagcttatgataaatgttcattacattgaattatagtaaaggaagaagttcaatttcacaattctccaagttgcaggtgaaagttaataggaagagaaaccgtattccaaacaaggaaaggctatctgaagttataaggtgtgcatgtgtgtgtaaggatataggcaacgagttatttccagtgtaaggtgaaaacctataattcttatgggtgaaaacattatgtttcatgtttcggggcaatgacctaaatctgaatgttggcaatgcttgcctaatctagtcagttggctcaatgccttcagaaattta

SEQ ID NO: 35712 - DNA, 437 bp, Homo sapiens
gttggagacaagcctaggcaacatagtgagatcccatctctacaaaaattttaaaaaattagatgggtgtagtggcgcatgctgtagtcccaagtagttaggactacagatgcatgccaccatggctggctaatttcgaaaaattttttttgtagaggcaggttctcactatgtttcctaggctggtcttgaactcctgggctcaagcgattttcccaccacagcctcccaaagtgctgggatacaggtgtgagccaccatgcctggccctgtgtgtatttatttttacataacataataaaaatctgtggagtcagcaatctgacacaagaactggaacattgataacctgttttccccaatgaattcctttaccatcccatctcctgccttccttcacctgaggtaatgtctatcctgattcttccagaacatta

SEQ ID NO: 35713 - DNA, 213 bp, Homo sapiens
ggacttcagcttaacacagggagtgagggagagggcaagagcatgggcaagagggagggtttagttttgagcagatagatccagctcctagtttgccttagaccctggaacactggcttctttcattcggccctttagaggagtggcccagagtagcctagcagggactgaactctttcggatggcttccagagcattgttcccaagaccctc

SEQ ID NO: 35714 - DNA, 545 bp, Homo sapiens
tttttttggagacagagtctccctctgtcgcctaggctggagtgcaatggcacgatctcgactcactgcaacttccgcctcccagattcaagccattctcctgcctcggcctcccgaatagctgggactacaggcgcacgctgccacgcccggctaattttttgttttttttttaatagggacggggttttaccgtgttgcccaggctggtctcgacctcctaagctcaggcaatccgtccgccttggcctcccaaagtgctaggattacaggcgtgagtcaccgtgcccggcatgtaaaattattttttaaagtcaagaaaataagcagaaattcagaagaagagttaacctcttggggagacggaaggagtacactgagaagggggcacacagaggactagaaagatgtccttttttaaaactatgtgtcgagtacactcaatatgattattaaattatacatatatatttttgtttgcatattatctagttcataattaaaagtagaaaaaaagtaaacagatgaaggaatgaatgataagt

SEQ ID NO: 35715 - DNA, 476 bp, Homo sapiens
cgcttgagcctaggagtttgaggttgcagtgagctatgatcatgcttctgcactccagcctggggagcagagtgagaccctgtcttaaaaaaaaaaaagaagaagaagaaaaggtagcaggtgttaattatggaatctaggtgaggtaggcatatgggtgttcattgtataattgtttctacttttatggatgtttgaaattcttcctaataaaatgttgggaaaatctgcatatgaaaatcactgtggctgcagtaatatgaatagattggatggatacacaaatggatgtagagagaccaacttaaggctcatataatctgcttccagccacaacatactagtgctaccagactggacctttcaccataaacaactacaaaagactgggcaaaaaataggaagcaactattttcagaaaatggaaataggatatacaggattgcaatccctacgagaagggaaacacatgaggt

SEQ ID NO: 35716 - DNA, 469 bp, Homo sapiens
cagaagatagtgaccaggatgggtctgaaaatcatgtcatatgagaaatggttgaaagaaagaactggggataattagcttttactttaagcctcggtttagacccttcaagtcttggttaggttcccttgctatgtgctccacagtcctctgaacaagcctcatgccttccccactagaccaaggactttgttagggcagggtaggggctctgtgaggactttgttagggcagggtaggggctctgtgttcactatgatatccacaagacctagcatgggacaggatgtgtcctcagcaatggtcagagaatgagtgagtgaaatttccaattgtgagggccttacgtaaaaatgataaagaactgtagtgcctggcatctatagtcattaaattaaaaaacgaacaaggaacttagaagaggtcctaaaagtttttgaatggtgctttttgttttttggcctctctg

SEQ ID NO: 35717 - DNA, 1072 bp, Homo sapiens
ggcgacgggtgggtccggcgggtccccgggcggggcggggccggggcgaggggtgccgggtggttttccgcccggcagcccgcagcccgctgcgccccgggccgcgtctcccggcggtgggagggggcggcccccactcggttcctggcccctcgcggccccgtcagcctcccgctcggggtgcgccgcccttcgtctgggtctccgcccccaggacccgcggccgagagctccggagcgcggcttccccggccggctgcgcgatgggctgcgggaactccaccgccaccagcgcgggcgcgggccaaggccctgcaggagcagccaaagatgtaaactatggaggagtatatgttggcctaccatctgaagctgtcaatatggtgtccagtcaaacaaagacggttcggaaaaattagaagaaaataacatcatgactcaagaatcaagagcttgctcatcagtttggaaggaatttggctccgtgggacgttgtaatgtgcacagacatttccaaggaaattctaaacagtcacccttcccttttgcattcccccaaatcttaagtgtatacataaaaccctgggtacatattgttgtggtaatagaagggaattggttaaacagtacacttgtttatggaactttctgtggccacctacgaaagacaagttaacaaactgtcatggaggctgttgttgcccagccagggccgctgcattttgacaacatttccaccctggccactcagcacatttcatggaggtcatgtcttttcactgatacttttttgatagtttttatataacaaaatccttattctatttataacttaagatgataaggcactataaattaatgacctaaaataatatatttgtctgttatcttttgctatttctacttcactttaatttttagctgtaaaattggtaaatggattcttacaactatctctttccatttcttactatttggttttcaaatttcatttaaatgtcagaatttccttttttaggaacaatgtgtatttcattgcactatttaaaaataaactcaaatttgcatgcca

SEQ ID NO: 35718 - DNA, 1373 bp, Homo sapiens
ggcgacgggtgggtccggcgggtccccgggcggggcggggccggggcgaggggtgccgggtggttttccgcccggcagcccgcagcccgctgcgccccgggccgcgtctcccggcggtgggagggggcggcccccactcggttcctggcccctcgcggccccgtcagcctcccgctcggggtgcgccgcccttcgtctgggtctccgcccccaggacccgcggccgagagctccggagcgcggcttccccggccggctgcgcgatgggctgcgggaactccaccgccaccagcgcgggcgcgggccaaggccctgcaggagcagccaaagatgtaacagaagaatccgtaacagaagatgacaagaggagaaactatggaggagtatatgttggcctaccatctgaagctgtcaatatggtgtccagtcaaacaaagacggttcggaaaaattagaagaaaataacatcatgactcaagaatcaagagcttgctcatcagtttggaaggaatttggctccgtgggacgttgtaatgtgcacagacatttccaaggaaattctaaacagtcacccttcccttttgcattcccccaaatcttaagtgtatacataaaaccctgggtacatattgttgtggtaatagaagggaattggttaaacagtacacttgtttatggaactttctgtggccacctacgaaagacaagttaacaaactgtcatggaggctgttgttgcccagccagggccgctgcattttgacaacatttccaccctggccactcagcacatttcatggaggtcatgtcttttcactgatacttttttgatagtttttatataacaaaatccttattctatttataacttaagatgataaggcactataaattaatgacctaaaataatatatttgtctgttatcttttgctatttctacttcactttaatttttagctgtaaaattggtaaatggattcttacaactatctctttccatttcttactatttggttttcaaatttcatttaaatgtcagaatttccttttttaggaacaatgtgtatttcattgcactatttaaaaataaactcaaatttgcatgccatatgcacattttgattacatttttattttctttcgtgaaaggcatgtgcaactacaaatacttcatagctgtttgggttgctcattctacatcacgacaatctcatcatattatttctataacttttcaaggacttgcgatggatggttagtgggatatctggaaattaatttgataatgacttgtgtatctacttagtattgcaatgtaagttactcaattcaccaatgtatttcaacaattaaaacatttttatccctcttca

SEQ ID NO: 35719 - DNA, 1468 bp, Homo sapiens
ggcgacgggtgggtccggcgggtccccgggcggggcggggccggggcgaggggtgccgggtggttttccgcccggcagcccgcagcccgctgcgccccgggccgcgtctcccggcggtgggagggggcggcccccactcggttcctggcccctcgcggccccgtcagcctcccgctcggggtgcgccgcccttcgtctgggtctccgcccccaggacccgcggccgagagctccggagcgcggcttccccggccggctgcgcgatgggctgcgggaactccaccgccaccagcgcgggcgcgggccaaggccctgcaggagcagccaaagatgtaacagaagaatccgtaacagaagatgacaagaggagaaactatggaggagtatatgttggcctaccatctgaagctgtcaatatggtgtccagtcaaacaaagacggttcggaaaaattagaagaaaataacatcatgactcaagaatcaagagcttgctcatcagtttggaaggaatttggctccgtgggacgttgtaatgtgcacagacatttccaaggaaattctaaacagtcacccttcccttttgcattcccccaaatcttaagtgtatacataaaaccctgggtacatattgttgtggtaatagaagggaattggttaaacagtacacttgtttatggaactttctgtggccacctacgaaagacaagttaacaaactgtcatggaggctgttgttgcccagccagggccgctgcattttgacaacatttccaccctggccactcagcacatttcatggaggtcatgtcttttcactgatacttttttgatagtttttatataacaaaatccttattctatttataacttaagatgataaggcactataaattaatgacctaaaataatatatttgtctgttatcttttgctatttctacttcactttaatttttagctgtaaaattggtaaatggattcttacaactatctctttccatttcttactatttggttttcaaatttcatttaaatgtcagaatttccttttttaggaacaatgtgtatttcattgcactatttaaaaataaactcaaatttgcatgccaaaaaaaaaaaaaaaaaaagaaaaaggaaaaaaaaaaagaaaaaaaaaaagaaaaaaaaaaagaaaaaagagaagagaagagaaaatgaaaaaaaaaaaacagaaaagaaaaaacaaaggaaaggggggggggcgcaagaaataataattcagaccaccgggggggggaaaacatgagacaaggcaaacaggacgaaagtgaacaagggaagaagacggcagaacaacgcatgaggagataagatagatagagcacagcagagcgatcggcaaataaacaacaccgagcaaagagagaacaaaacgttagtgagaataaaaaaacaaaccacacggaggcagagaaaaaaagcaccaccaa

SEQ ID NO: 35720 - DNA, 1162 bp, Homo sapiens
cctgatcagttctgtttggaagaatgaaaatgacagctaagtggtgtgatctaactgacacagggaaagaagctgaaattgaccactcaggaaatgaggccctgcaggagcagccaaagatgtaacagaagaatccgtaacagaagatgacaagaggagaaactatggaggagtatatgttggcctaccatctgaagctgtcaatatggtgtccagtcaaacaaagacggttcggaaaaattagaagaaaataacatcatgactcaagaatcaagagcttgctcatcagtttggaaggaatttggctccgtgggacgttgtaatgtgcacagacatttccaaggaaattctaaacagtcacccttcccttttgcattcccccaaatcttaagtgtatacataaaaccctgggtacatattgttgtggtaatagaagggaattggttaaacagtacacttgtttatggaactttctgtggccacctacgaaagacaagttaacaaactgtcatggaggctgttgttgcccagccagggccgctgcattttgacaacatttccaccctggccactcagcacatttcatggaggtcatgtcttttcactgatacttttttgatagtttttatataacaaaatccttattctatttataacttaagatgataaggcactataaattaatgacctaaaataatatatttgtctgttatcttttgctatttctacttcactttaatttttagctgtaaaattggtaaatggattcttacaactatctctttccatttcttactatttggttttcaaatttcatttaaatgtcagaatttccttttttaggaacaatgtgtatttcattgcactatttaaaaataaactcaaatttgcatgccatatgcacattttgattacatttttattttctttcgtgaaaggcatgtgcaactacaaatacttcatagctgtttgggttgctcattctacatcacgacaatctcatcatattatttctataacttttcaaggacttgcgatggatggttagtgggatatctggaaattaatttgataatgacttgtgtatctacttagtattgcaatgtaagttactcaattcaccaatgtatttcaacaattaaaacatttttatccctcttca

SEQ ID NO: 35721 - DNA, 1110 bp, Homo sapiens
tagaggacgagaaaggatggccttggttaaataaatttaaattctagccctgcaggagcagccaaagatgtaacagaagaatccgtaacagaagatgacaagaggagaaactatggaggagtatatgttggcctaccatctgaagctgtcaatatggtgtccagtcaaacaaagacggttcggaaaaattagaagaaaataacatcatgactcaagaatcaagagcttgctcatcagtttggaaggaatttggctccgtgggacgttgtaatgtgcacagacatttccaaggaaattctaaacagtcacccttcccttttgcattcccccaaatcttaagtgtatacataaaaccctgggtacatattgttgtggtaatagaagggaattggttaaacagtacacttgtttatggaactttctgtggccacctacgaaagacaagttaacaaactgtcatggaggctgttgttgcccagccagggccgctgcattttgacaacatttccaccctggccactcagcacatttcatggaggtcatgtcttttcactgatacttttttgatagtttttatataacaaaatccttattctatttataacttaagatgataaggcactataaattaatgacctaaaataatatatttgtctgttatcttttgctatttctacttcactttaatttttagctgtaaaattggtaaatggattcttacaactatctctttccatttcttactatttggttttcaaatttcatttaaatgtcagaatttccttttttaggaacaatgtgtatttcattgcactatttaaaaataaactcaaatttgcatgccatatgcacattttgattacatttttattttctttcgtgaaaggcatgtgcaactacaaatacttcatagctgtttgggttgctcattctacatcacgacaatctcatcatattatttctataacttttcaaggacttgcgatggatggttagtgggatatctggaaattaatttgataatgacttgtgtatctacttagtattgcaatgtaagttactcaattcaccaatgtatttcaacaattaaaacatttttatccctcttca

SEQ ID NO: 35722 - DNA, 1085 bp, Homo sapiens
ccacggaaaaattgggatgccgttaccaaaaaaaaggggagaaattaacagaagaatccgtaacagaagatgacaagaggagaaactatggaggagtatatgttggcctaccatctgaagctgtcaatatggtgtccagtcaaacaaagacggttcggaaaaattagaagaaaataacatcatgactcaagaatcaagagcttgctcatcagtttggaaggaatttggctccgtgggacgttgtaatgtgcacagacatttccaaggaaattctaaacagtcacccttcccttttgcattcccccaaatcttaagtgtatacataaaaccctgggtacatattgttgtggtaatagaagggaattggttaaacagtacacttgtttatggaactttctgtggccacctacgaaagacaagttaacaaactgtcatggaggctgttgttgcccagccagggccgctgcattttgacaacatttccaccctggccactcagcacatttcatggaggtcatgtcttttcactgatacttttttgatagtttttatataacaaaatccttattctatttataacttaagatgataaggcactataaattaatgacctaaaataatatatttgtctgttatcttttgctatttctacttcactttaatttttagctgtaaaattggtaaatggattcttacaactatctctttccatttcttactatttggttttcaaatttcatttaaatgtcagaatttccttttttaggaacaatgtgtatttcattgcactatttaaaaataaactcaaatttgcatgccatatgcacattttgattacatttttattttctttcgtgaaaggcatgtgcaactacaaatacttcatagctgtttgggttgctcattctacatcacgacaatctcatcatattatttctataacttttcaaggacttgcgatggatggttagtgggatatctggaaattaatttgataatgacttgtgtatctacttagtattgcaatgtaagttactcaattcaccaatgtatttcaacaattaaaacatttttatccctcttca

SEQ ID NO: 35723 - DNA, 1337 bp, Homo sapiens
ggcgacgggtgggtccggcgggtccccgggcggggcggggccggggcgaggggtgccgggtggttttccgcccggcagcccgcagcccgctgcgccccgggccgcgtctcccggcggtgggagggggcggcccccactcggttcctggcccctcgcggccccgtcagcctcccgctcggggtgcgccgcccttcgtctgggtctccgcccccaggacccgcggccgagagctccggagcgcggcttccccggccggctgcgcgatgggctgcgggaactccaccgccaccagcgcgggcgcgggccaaggccctgcaggagcagccaaagatgtaaactatggaggagtatatgttggcctaccatctgaagctgtcaatatggtgtccagtcaaacaaagacggttcggaaaaattagaagaaaataacatcatgactcaagaatcaagagcttgctcatcagtttggaaggaatttggctccgtgggacgttgtaatgtgcacagacatttccaaggaaattctaaacagtcacccttcccttttgcattcccccaaatcttaagtgtatacataaaaccctgggtacatattgttgtggtaatagaagggaattggttaaacagtacacttgtttatggaactttctgtggccacctacgaaagacaagttaacaaactgtcatggaggctgttgttgcccagccagggccgctgcattttgacaacatttccaccctggccactcagcacatttcatggaggtcatgtcttttcactgatacttttttgatagtttttatataacaaaatccttattctatttataacttaagatgataaggcactataaattaatgacctaaaataatatatttgtctgttatcttttgctatttctacttcactttaatttttagctgtaaaattggtaaatggattcttacaactatctctttccatttcttactatttggttttcaaatttcatttaaatgtcagaatttccttttttaggaacaatgtgtatttcattgcactatttaaaaataaactcaaatttgcatgccatatgcacattttgattacatttttattttctttcgtgaaaggcatgtgcaactacaaatacttcatagctgtttgggttgctcattctacatcacgacaatctcatcatattatttctataacttttcaaggacttgcgatggatggttagtgggatatctggaaattaatttgataatgacttgtgtatctacttagtattgcaatgtaagttactcaattcaccaatgtatttcaacaattaaaacatttttatccctcttca

SEQ ID NO: 35724 - DNA, 1029 bp, Homo sapiens
ctgcccccagtttacacagctaggagaaactatggaggagtatatgttggcctaccatctgaagctgtcaatatggtgtccagtcaaacaaagacggttcggaaaaattagaagaaaataacatcatgactcaagaatcaagagcttgctcatcagtttggaaggaatttggctccgtgggacgttgtaatgtgcacagacatttccaaggaaattctaaacagtcacccttcccttttgcattcccccaaatcttaagtgtatacataaaaccctgggtacatattgttgtggtaatagaagggaattggttaaacagtacacttgtttatggaactttctgtggccacctacgaaagacaagttaacaaactgtcatggaggctgttgttgcccagccagggccgctgcattttgacaacatttccaccctggccactcagcacatttcatggaggtcatgtcttttcactgatacttttttgatagtttttatataacaaaatccttattctatttataacttaagatgataaggcactataaattaatgacctaaaataatatatttgtctgttatcttttgctatttctacttcactttaatttttagctgtaaaattggtaaatggattcttacaactatctctttccatttcttactatttggttttcaaatttcatttaaatgtcagaatttccttttttaggaacaatgtgtatttcattgcactatttaaaaataaactcaaatttgcatgccatatgcacattttgattacatttttattttctttcgtgaaaggcatgtgcaactacaaatacttcatagctgtttgggttgctcattctacatcacgacaatctcatcatattatttctataacttttcaaggacttgcgatggatggttagtgggatatctggaaattaatttgataatgacttgtgtatctacttagtattgcaatgtaagttactcaattcaccaatgtatttcaacaattaaaacatttttatccctcttca

SEQ ID NO: 35725 - DNA, 1408 bp, Homo sapiens
agtttcttctgcacatgaccctaggctgaaagttatgcccacttagactgctgcagactacttccagcacagagcggcttaagtgatggtgctcagatgacaatggatggcctggctgcatcagaatcccgtggggcgagtgccatgtaatgtggaggcctaggctctcccaggaggtttggaccaagtgcggaagggatggaattgtgaccgaacagtctctatttttaatttggatgatgttaatatacatgcagctaggtttgggcattgcttatcaagatgtattttaattgtaagtttgtaagtctcttttcctacccaactttgcctctttatataattatcatcaatgcttggctctacactggccacctaagtcttaaattaatattgggtgaatattaaataggtgttttacttaaaagaaagtaaataacttgtaggcttaaggctaatacattttttaacctaagttgtacctgtttgctcactcttttctcctcttctgttgtctccttagcttgctcatcagtttggaaggaatttggctccgtgggacgttgtaatgtgcacagacatttccaaggaaattctaaacagtcacccttcccttttgcattcccccaaatcttaagtgtatacataaaaccctgggtacatattgttgtggtaatagaagggaattggttaaacagtacacttgtttatggaactttctgtggccacctacgaaagacaagttaacaaactgtcatggaggctgttgttgcccagccagggccgctgcattttgacaacatttccaccctggccactcagcacatttcatggaggtcatgtcttttcactgatacttttttgatagtttttatataacaaaatccttattctatttataacttaagatgataaggcactataaattaatgacctaaaataatatatttgtctgttatcttttgctatttctacttcactttaatttttagctgtaaaattggtaaatggattcttacaactatctctttccatttcttactatttggttttcaaatttcatttaaatgtcagaatttccttttttaggaacaatgtgtatttcattgcactatttaaaaataaactcaaatttgcatgccatatgcacattttgattacatttttattttctttcgtgaaaggcatgtgcaactacaaatacttcatagctgtttgggttgctcattctacatcacgacaatctcatcatattatttctataacttttcaaggacttgcgatggatggttagtgggatatctggaaattaatttgataatgacttgtgtatctacttagtattgcaatgtaagttactcaattcaccaatgtatttcaacaattaaaacatttttatccctcttca

SEQ ID NO: 35726 - DNA, 560 bp, Homo sapiens
atcgagccggccccattacacagctatagaataaaatccttattctatttataacttaagatgataaggcactataaattaatgacctaaaataatatatttgtctgttatcttttgctatttctacttcactttaatttttagctgtaaaattggtaaatggattcttacaactatctctttccatttcttactatttggttttcaaatttcatttaaatgtcagaatttccttttttaggaacaatgtgtatttcattgcactatttaaaaataaactcaaatttgcatgccatatgcacattttgattacatttttattttctttcgtgaaaggcatgtgcaactacaaatacttcatagctgtttgggttgctcattctacatcacgacaatctcatcatattatttctataacttttcaaggacttgcgatggatggttagtgggatatctggaaattaatttgataatgacttgtgtatctacttagtattgcaatgtaagttactcaattcaccaatgtatttcaacaattaaaacatttttatccctcttca

SEQ ID NO: 35727 - DNA, 1108 bp, Homo sapiens
ggcgacgggtgggtccggcgggtccccgggcggggcggggccggggcgaggggtgccgggtggttttccgcccggcagcccgcagcccgctgcgccccgggccgcgtctcccggcggtgggagggggcggcccccactcggttcctggcccctcgcggccccgtcagcctcccgctcggggtgcgccgcccttcgtctgggtctccgcccccaggacccgcggccgagagctccggagcgcggcttccccggccggctgcgcgatgggctgcgggaactccaccgccaccagcgcgggcgcgggccaaggccctgcaggagcagccaaagatgtaacagaagaatccgtaacagaagatgacaagaggagaaactatggaggagtatatgttggcctaccatctgaagctgtcaatatggtgtccagtcaaacaaagacggttcggaaaaattagaagaaaataacatcatgactcaagaatcaagagcttgctcatcagtttggaaggaatttggctccgtgggacgttgtaatgtgcacagacatttccaaggaaattctaaacagtcacccttcccttttgcattcccccaaatcttaagtgtatacataaaaccctgggtacatattgttgtggtaatagaagggaattggttaaacagtacacttgtttatggaactttctgtggccacctacgaaagacaagttaacaaactgtcatggaggctgttgttgcccagccagggccgctgcattttgacaacatttccaccctggccactcagcacatttcatggaggtcatgtcttttcactgatacttttttgatagtttttatataacaaaatccttattctatttataacttaagatgataaggcactataaattaatgacctaaaataatatatttgtctgttatcttttgctatttctacttcactttaatttttagctgtaaaattggtaaatggattcttacaactatctctttccatttcttactatttggttttcaaatttcatttaaatgtcagaatttccttttttaggaacaatgtgtatttcattgcactatttaaaaataaactcaaatttgcatgcca

SEQ ID NO: 35728 - DNA, 1550 bp, Homo sapiens
ggcgacgggtgggtccggcgggtccccgggcggggcggggccggggcgaggggtgccgggtggttttccgcccggcagcccgcagcccgctgcgccccgggccgcgtctcccggcggtgggagggggcggcccccactcggttcctggcccctcgcggccccgtcagcctcccgctcggggtgcgccgcccttcgtctgggtctccgcccccaggacccgcggccgagagctccggagcgcggcttccccggccggctgcgcgatgggctgcgggaactccaccgccaccagcgcgggcgcgggccaaggccctgcaggagcagccaaagatgtaacagaagaatccgtaacagaagatgacaagaggagaaactatggaggagtatatgttggcctaccatctgaagctgtcaatatggtgtccagtcaaacaaagacggttcggaaaaattagaagaaaataacatcatgactcaagaatcaagagcttgctcatcagtttggaaggaatttggctccgtgggacgttgtaatgtgcacagacatttccaaggaaattctaaacagtcacccttcccttttgcattcccccaaatcttaagtgtatacataaaaccctgggtacatattgttgtggtaatagaagggaattggttaaacagtacacttgtttatggaactttctgtggccacctacgaaagacaagttaacaaactgtcatggaggctgttgttgcccagccagggccgctgcattttgacaacatttccaccctggccactcagcacatttcatggaggtcatgtcttttcactgatacttttttgatagtttttatataacaaaatccttattctatttataacttaagatgataaggcactataaattaatgacctaaaataatatatttgtctgttatcttttgctatttctacttcactttaatttttagctgtaaaattggtaaatggattcttacaactatctctttccatttcttactatttggttttcaaatttcatttaaatgtcagaatttccttttttaggaacaatgtgtatttcattgcactatttaaaaataaactcaaatttgcatgccatatgcacattttgattacatttttattttctttcgtgaaaggcatgtgcaactacaaatacttcatagctgtttgggttgctcattctacatcacgacaatctcatcatattatttctataacttttcaaggacttgcgatggatggttagtgggatatctggaaattaatttgataatgacttgtgtatctacttagtattgcaatgtaagttactcaattcaccaatgtatttcaacaattaaaacatttttatccctcttcaaaaaaaaaaaagaaagaacagggggtgaaccaagtactaggagggaaagacaagaggtgcaataaacacaaagaggggggcgaagcagggagggggaccactgtgttgggagggagatgttaaaaggggggacggggcaggaggtggagaagtgtggggaaccaaagcgaagggtgg

SEQ ID NO: 35729 - DNA, 1459 bp, Homo sapiens
ggcgacgggtgggtccggcgggtccccgggcggggcggggccggggcgaggggtgccgggtggttttccgcccggcagcccgcagcccgctgcgccccgggccgcgtctcccggcggtgggagggggcggcccccactcggttcctggcccctcgcggccccgtcagcctcccgctcggggtgcgccgcccttcgtctgggtctccgcccccaggacccgcggccgagagctccggagcgcggcttccccggccggctgcgcgatgggctgcgggaactccaccgccaccagcgcgggcgcgggccaaggccctgcaggagcagccaaagatgtgtgagaagtcagtatataataataaataaaatgatgtatctgtcctgaagtagttcactgtctactagggaccaaaatacagtgtgaacagaagaatccgtaacagaagatgacaagaggagaaactatggaggagtatatgttggcctaccatctgaagctgtcaatatggtgtccagtcaaacaaagacggttcggaaaaattagaagaaaataacatcatgactcaagaatcaagagcttgctcatcagtttggaaggaatttggctccgtgggacgttgtaatgtgcacagacatttccaaggaaattctaaacagtcacccttcccttttgcattcccccaaatcttaagtgtatacataaaaccctgggtacatattgttgtggtaatagaagggaattggttaaacagtacacttgtttatggaactttctgtggccacctacgaaagacaagttaacaaactgtcatggaggctgttgttgcccagccagggccgctgcattttgacaacatttccaccctggccactcagcacatttcatggaggtcatgtcttttcactgatacttttttgatagtttttatataacaaaatccttattctatttataacttaagatgataaggcactataaattaatgacctaaaataatatatttgtctgttatcttttgctatttctacttcactttaatttttagctgtaaaattggtaaatggattcttacaactatctctttccatttcttactatttggttttcaaatttcatttaaatgtcagaatttccttttttaggaacaatgtgtatttcattgcactatttaaaaataaactcaaatttgcatgccatatgcacattttgattacatttttattttctttcgtgaaaggcatgtgcaactacaaatacttcatagctgtttgggttgctcattctacatcacgacaatctcatcatattatttctataacttttcaaggacttgcgatggatggttagtgggatatctggaaattaatttgataatgacttgtgtatctacttagtattgcaatgtaagttactcaattcaccaatgtatttcaacaattaaaacatttttatccctcttca

SEQ ID NO: 35730 - DNA, 3003 bp, Homo sapiens
  misc_feature (1)..(1): n is a, c, g, or t
nacttaggctaggtcgaggctgggtgtgaatcggccgagggttggcagaagggtcccgggcccagagccagcggggccgtgctgagacggcgtacgtgccctgcgtgagtgcgtggcggcggcgcgtgcgctaggggagtgggcggtgaggcctggtccacgtgcgtcccttcccgggacccccgcagcttggcgcccagcggctacgtgagccaaggcacccggatgtccgcgcccctctccgagtgacaagtcccggcctccggtcccgcagtgcccgcagcctcggccggcgtccacgcattgccatggtgactgtgggcaactactgcgaggccgaagggcccgtgggtccggcctggatgcaggatggcctgagtccctgcttcttcttcacgctcgtgccctcgacgcggatggctctagggactctggccttggtgctggctcttccctgcagacgccgggagcggcccgctggtgctgattcgctgtcttggggggccggccctcgcatctctccctacgtgctgcagctgcttctggccacacttcaggcggcgctgcccctggccggcctggctggccgggtgggcactgcccggggggccccactgccaagctatctacttctggcctccgtgctggagagtctggccggcgcctgtggcctgtggctgcttgtcgtggagcggagccaggcacggcagcgtctggcaatgggcatctggatcaagttcaggcacagccctggtctcctgctcctctggactgtggcgtttgcagctgagaacttggccctggtgtcttggaacagcccacagtggtggtgggcaagggcagacttgggccagcaggttcagtttagcctgtgggtgctgcggtatgtggtctctggagggctgtttgtcctgggtctctgggcccctggacttcgtccccagtcctatacattgcaggttcatgaagaggaccaagatgtggaaaggagccaggttcggtcagcagcccaacagtctacctggcgagattttggcaggaagctccgcctcctgagtggctacctgtggcctcgagggagtccagctctgcagctggtggtgctcatctgcctggggctcatgggtttggaacgggcactcaatgtgttggtgcctatattctataggaacattgtgaacttgctgactgagaaggcaccttggaactctctggcctggactgttaccagttacgtcttcctcaagttcctccaggggggtggcactggcagtacaggcttcgtgagcaacctgcgcaccttcctgtggatccgggtgcagcagttcacgtctcggcgggtggagctgctcatcttctcccacctgcacgagctctcactgcgctggcacctggggcgccgcacaggggaggtgctgcggatcgcggatcggggcacatccagtgtcacagggctgctcagctacctggtgttcaatgtcatccccacgctggccgacatcatcattggcatcatctacttcagcatgttcttcaacgcctggtttggcctcattgtgttcctgtgcatgagtctttacctcaccctgaccattgtggtcactgagtggagaaccaagtttcgtcgtgctatgaacacacaggagaacgctacccgggcacgagcagtggactctctgctaaacttcgagacggtgaagtattacaacgccgagagttacgaagtggaacgctatcgagaggccatcatcaaatatcagggtttggagtggaagtcgagcgcttcactggttttactaaatcagacccagaacctggtgattgggctcgggctcctcgccggctccctgctttgcgcatactttgtcactgagcagaagctacaggttggggactatgtgctctttggcacctacattatccagctgtacatgcccctcaattggtttggcacctactacaggatgatccagaccaacttcattgacatggagaacatgtttgacttgctgaaagaggagacagaagtgaaggaccttcctggagcagggccccttcgctttcagaagggccgtattgagtttgagaacgtgcacttcagctatgccgatgggcgggagactctgcaggacgtgtctttcactgtgatgcctggacagacacttgccctggtgggcccatctggggcagggaagagcacaattttgcgcctgctgtttcgcttctacgacatcagctctggctgcatccgaatagatgggcaggacatttcacaggtgacccaggcctctctccggtctcacattggagttgtgccccaagacactgtcctctttaatgacaccatcgccgacaatatccgttacggccgtgtcacagctgggaatgatgaggtggaggctgctgctcaggctgcaggcatccatgatgccattatggctttccctgaagggtacaggacacaggtgggcgagcggggactgaagctgagcggcggggagaagcagcgcgtcgccattgcccgcaccatcctcaaggctccgggcatcattctgctggatgaggcaacgtcagcgctggatacatctaatgagagggccatccaggcttctctggccaaagtctgtgccaaccgcaccaccatcgtagtggcacacaggctctcaactgtggtcaatgctgaccagatcctcgtcatcaaggatggctgcatcgtggagaggggacgacacgaggctctgttgtcccgaggtggggtgtatgctgacatgtggcagctgcagcagggacaggaagaaacctctgaagacactaagcctcagaccatggaacggtgacaaaagtttggccacttccctctcaaagactaacccagaagggaataagatgtgtctcctttccctggcttatttcatcctggtcttggggtatggtgctagctatggtaagggaaagggacctttccgaaaaacatcttttggggaaataaaaatgtggactgtg

SEQ ID NO: 35731 - DNA, 631 bp, Homo sapiens
tcaagccgttcctcctgggcactgtccccacctagaacagataccatgaattcaaatctcacaaaacacactttccagttctcaagcccaaacaaggctcttgtgtattcttgaggcctcagccagcagcctgcctccttccattgagggttttgagtggcaggagcagttttacctggaccctctctataggcaacgtcagcgctggatacatctaatgagagggccatccaggcttctctggccaaagtctgtgccaaccgcaccaccatcgtagtggcacacaggctctcaactgtggtcaatgctgaccagatcctcgtcatcaaggatggctgcatcgtggagaggggacgacacgaggctctgttgtcccgaggtggggtgtatgctgacatgtggcagctgcagcagggacaggaagaaacctctgaagacactaagcctcagaccatggaacggtgacaaaagtttggccacttccctctcaaagactaacccagaagggaataagatgtgtctcctttccctggcttatttcatcctggtcttggggtatggtgctagctatggtaagggaaagggacctttccgaaaaacatcttttggggaaataaaaatgtggactgtg

SEQ ID NO: 35732 - DNA, 471 bp, Homo sapiens
ttcttaaggttccgggattattttggtgggggggcaagttcggggtggaaaactttaaggagaggcccattcaagctttctcggccaaagttcgggccaaccgcaccaccattgtaggtgcaacactgctctcaactgtggtcaatgctgaccagatcctcgtcatcaaggatggctgcatcgtggagaggggacgacacgaggctctgttgtcccgaggtggggtgtatgctgacatgtggcagctgcagcagggacaggaagaaacctctgaagacactaagcctcagaccatggaacggtgacaaaagtttggccacttccctctcaaagactaacccagaagggaataagatgtgtctcctttccctggcttatttcatcctggtcttggggtatggtgctagctatggtaagggaaagggacctttccgaaaaacatcttttggggaaataaaaatgtggactgtg

SEQ ID NO: 35733 - DNA, 3001 bp, Homo sapiens
ggtgcgagtccaacaccgagcattcccgtgggcctgcagttggcagaagggtcccgggcccagagccagcggggccgtgctgagacggcgtacgtgccctgcgtgagtgcgtggcggcggcgcgtgcgctaggggagtgggcggtgaggcctggtccacgtgcgtcccttcccgggacccccgcagcttggcgcccagcggctacgtgagccaaggcacccggatgtccgcgcccctctccgagtgacaagtcccggcctccggtcccgcagtgcccgcagcctcggccggcgtccacgcattgccatggtgactgtgggcaactactgcgaggccgaagggcccgtgggtccggcctggatgcaggatggcctgagtccctgcttcttcttcacgctcgtgccctcgacgcggatggctctagggactctggccttggtgctggctcttccctgcagacgccgggagcggcccgctggtgctgattcgctgtcttggggggccggccctcgcatctctccctacgtgctgcagctgcttctggccacacttcaggcggcgctgcccctggccggcctggctggccgggtgggcactgcccggggggccccactgccaagctatctacttctggcctccgtgctggagagtctggccggcgcctgtggcctgtggctgcttgtcgtggagcggagccaggcacggcagcgtctggcaatgggcatctggatcaagttcaggcacagccctggtctcctgctcctctggactgtggcgtttgcagctgagaacttggccctggtgtcttggaacagcccacagtggtggtgggcaagggcagacttgggccagcaggttcagtttagcctgtgggtgctgcggtatgtggtctctggagggctgtttgtcctgggtctctgggcccctggacttcgtccccagtcctatacattgcaggttcatgaagaggaccaagatgtggaaaggagccaggttcggtcagcagcccaacagtctacctggcgagattttggcaggaagctccgcctcctgagtggctacctgtggcctcgagggagtccagctctgcagctggtggtgctcatctgcctggggctcatgggtttggaacgggcactcaatgtgttggtgcctatattctataggaacattgtgaacttgctgactgagaaggcaccttggaactctctggcctggactgttaccagttacgtcttcctcaagttcctccaggggggtggcactggcagtacaggcttcgtgagcaacctgcgcaccttcctgtggatccgggtgcagcagttcacgtctcggcgggtggagctgctcatcttctcccacctgcacgagctctcactgcgctggcacctggggcgccgcacaggggaggtgctgcggatcgcggatcggggcacatccagtgtcacagggctgctcagctacctggtgttcaatgtcatccccacgctggccgacatcatcattggcatcatctacttcagcatgttcttcaacgcctggtttggcctcattgtgttcctgtgcatgagtctttacctcaccctgaccattgtggtcactgagtggagaaccaagtttcgtcgtgctatgaacacacaggagaacgctacccgggcacgagcagtggactctctgctaaacttcgagacggtgaagtattacaacgccgagagttacgaagtggaacgctatcgagaggccatcatcaaatatcagggtttggagtggaagtcgagcgcttcactggttttactaaatcagacccagaacctggtgattgggctcgggctcctcgccggctccctgctttgcgcatactttgtcactgagcagaagctacaggttggggactatgtgctctttggcacctacattatccagctgtacatgcccctcaattggtttggcacctactacaggatgatccagaccaacttcattgacatggagaacatgtttgacttgctgaaagaggagacagaagtgaaggaccttcctggagcagggccccttcgctttcagaagggccgtattgagtttgagaacgtgcacttcagctatgccgatgggcgggagactctgcaggacgtgtctttcactgtgatgcctggacagacacttgccctggtgggcccatctggggcagggaagagcacaattttgcgcctgctgtttcgcttctacgacatcagctctggctgcatccgaatagatgggcaggacatttcacaggtgacccaggcctctctccggtctcacattggagttgtgccccaagacactgtcctctttaatgacaccatcgccgacaatatccgttacggccgtgtcacagctgggaatgatgaggtggaggctgctgctcaggctgcaggcatccatgatgccattatggctttccctgaagggtacaggacacaggtgggcgagcggggactgaagctgagcggcggggagaagcagcgcgtcgccattgcccgcaccatcctcaaggctccgggcatcattctgctggatgaggcaacgtcagcgctggatacatctaatgagagggccatccaggcttctctggccaaagtctgtgccaaccgcaccaccatcgtagtggcacacaggctctcaactgtggtcaatgctgaccagatcctcgtcatcaaggatggctgcatcgtggagaggggacgacacgaggctctgttgtcccgaggtggggtgtatgctgacatgtggcagctgcagcagggacaggaagaaacctctgaagacactaagcctcagaccatggaacggtgacaaaagtttggccacttccctctcaaagactaacccagaagggaataagatgtgtctcctttccctggcttatttcatcctggtcttggggtatggtgctagctatggtaagggaaagggacctttccgaaaaacatcttttggggaaataaaaatgtggactgtg

SEQ ID NO: 35734 - DNA, 3424 bp, Homo sapiens
  misc_feature (1)..(1): n is a, c, g, or t
nacttaggctaggtcgaggctgggtgtgaatcggccgagggttggcagaagggtcccgggcccagagccagcggggccgtgctgagacggcgtacgtgccctgcgtgagtgcgtggcggcggcgcgtgcgctaggggagtgggcggtgaggcctggtccacgtgcgtcccttcccgggacccccgcagcttggcgcccagcggctacgtgagccaaggcacccggatgtccgcgcccctctccgagtgacaagtcccggcctccggtcccgcagtgcccgcagcctcggccggcgtccacgcattgccatggtgactgtgggcaactactgcgaggccgaagggcccgtgggtccggcctggatgcaggatggcctgagtccctgcttcttcttcacgctcgtgccctcgacgcggatggctctagggactctggccttggtgctggctcttccctgcagacgccgggagcggcccgctggtgctgattcgctgtcttggggggccggccctcgcatctctccctacgtgctgcagctgcttctggccacacttcaggcggcgctgcccctggccggcctggctggccgggtgggcactgcccggggggccccactgccaagctatctacttctggcctccgtgctggagagtctggccggcgcctgtggcctgtggctgcttgtcgtggagcggagccaggcacggcagcgtctggcaatgggcatctggatcaagttcaggcacagccctggtctcctgctcctctggactgtggcgtttgcagctgagaacttggccctggtgtcttggaacagcccacagtggtggtgggcaagggcagacttgggccagcaggttcagtttagcctgtgggtgctgcggtatgtggtctctggagggctgtttgtcctgggtctctgggcccctggacttcgtccccagtcctatacattgcaggttcatgaagaggaccaagatgtggaaaggagccaggttcggtcagcagcccaacagtctacctggcgagattttggcaggaagctccgcctcctgagtggctacctgtggcctcgagggagtccagctctgcagctggtggtgctcatctgcctggggctcatgggtttggaacgggcactcaatgtgttggtgcctatattctataggaacattgtgaacttgctgactgagaaggcaccttggaactctctggcctggactgttaccagttacgtcttcctcaagttcctccaggggggtggcactggcagtacaggcttcgtgagcaacctgcgcaccttcctgtggatccgggtgcagcagttcacgtctcggcgggtggagctgctcatcttctcccacctgcacgagctctcactgcgctggcacctggggcgccgcacaggggaggtgctgcggatcgcggatcggggcacatccagtgtcacagggctgctcagctacctggtgttcaatgtcatccccacgctggccgacatcatcattggcatcatctacttcagcatgttcttcaacgcctggtttggcctcattgtgttcctgtgcatgagtctttacctcaccctgaccattgtggtcactgagtggagaaccaagtttcgtcgtgctatgaacacacaggagaacgctacccgggcacgagcagtggactctctgctaaacttcgagacggtgaagtattacaacgccgagagttacgaagtggaacgctatcgagaggccatcatcaaatatcagggtttggagtggaagtcgagcgcttcactggttttactaaatcagacccagaacctggtgattgggctcgggctcctcgccggctccctgctttgcgcatactttgtcactgagcagaagctacaggttggggactatgtgctctttggcacctacattatccagctgtacatgcccctcaattggtttggcacctactacaggatgatccagaccaacttcattgacatggagaacatgtttgacttgctgaaagaggagacagaagtgaaggaccttcctggagcagggccccttcgctttcagaagggccgtattgagtttgagaacgtgcacttcagctatgccgatgggcgggagactctgcaggacgtgtctttcactgtgatgcctggacagacacttgccctggtgggcccatctggggcagggaagagcacaattttgcgcctgctgtttcgcttctacgacatcagctctggctgcatccgaatagatgggcaggacatttcacaggtgacccaggcctctctccggtctcacattggagttgtgccccaagacactgtcctctttaatgacaccatcgccgacaatatccgttacggccgtgtcacagctgggaatgatgaggtggaggctgctgctcaggctgcaggcatccatgatgccattatggctttccctgaagggtacaggacacaggtgggcgagcggggactgaagctgagcggcggggagaagcagcgcgtcgccattgcccgcaccatcctcaaggctccgggcatcattctgctggatgaggcaacgtcagcgctggatacatctaatgagagggccatccaggcttctctggccaaagtctgtgccaaccgcaccaccatcgtagtggcacacaggctctcaactgtggtcaatgctgaccagatcctcgtcatcaaggatggctgcatcgtggagaggggacgacacgaggctctgttgtcccgaggtggggtgtatgctgacatgtggcagctgcagcagggacaggaagaaacctctgaagacactaagcctcagaccatggaacggtgacaaaagtttggccacttccctctcaaagactaacccagaagggaataagatgtgtctcctttccctggcttatttcatcctggtcttggggtatggtgctagctatggtaagggaaagggacctttccgaaaaacatcttttggggaaataaaaatgtggactgtgaaaaaaaaaaaaaaaaacaaaaaaaaaaaaaaaaaaaaaaaaaaaacaaaaaaaaaaaaaaaaaaacggcgggggccccccacaaaaatatctctctctcctaggaggggccccaacgtcttgtcgagcgccgactccacccgatttgttatttggataaaatgggggcgcccccctattagtggaggctggctatatgttaaaatcactaacggagatcaggtggcggcgctcgatttataacagaaagacgtggagggagggaggaaaaaacggcggcgtcagggggagacaatctcttggggagaaggaggagaacctctattttctgtgtgggtggtaggtgagaaaaatgatggggtgacaaaaaaaacctccaaagcaaagaaatataaacaacgtctaccgggaagtatattat

SEQ ID NO: 35735 - DNA, 2820 bp, Homo sapiens
ggtgcgagtccaacaccgagcattcccgtgggcctgcagttggcagaagggtcccgggcccagagccagcggggccgtgctgagacggcgtacgtgccctgcgtgagtgcgtggcggcggcgcgtgcgctaggggagtgggcggtgaggcctggtccacgtgcgtcccttcccgggacccccgcagcttggcgcccagcggctacgtgagccaaggcacccggatgtccgcgcccctctccgagtgacaagtcccggcctccggtcccgcagtgcccgcagcctcggccggcgtccacgcattgccatggtgactgtgggcaactactgcgaggccgaagggcccgtgggtccggcctggatgcaggatggcctgagtccctgcttcttcttcacgctcgtgccctcgacgcggatggctctagggactctggccttggtgctggctcttccctgcagacgccgggagcggcccgctggtgctgattcgctgtcttggggggccggccctcgcatctctccctacgtgctgcagctgcttctggccacacttcaggcggcgctgcccctggccggcctggctggccgggtgggcactgcccggggggccccactgccaagctatctacttctggcctccgtgctggagagtctggccggcgcctgtggcctgtggctgcttgtcgtggagcggagccaggcacggcagcgtctggcaatgggcatctggatcaagttcaggcacagccctggtctcctgctcctctggactgtggcgtttgcagctgagaacttggccctggtgtcttggaacagcccacagtggtggtgggcaagggcagacttgggccagcaggttcagtttagcctgtgggtgctgcggtatgtggtctctggagggctgtttgtcctgggtctctgggcccctggacttcgtccccagtcctatacattgcaggttcatgaagaggaccaagatgtggaaaggagccagtgaacttgctgactgagaaggcaccttggaactctctggcctggactgttaccagttacgtcttcctcaagttcctccaggggggtggcactggcagtacaggcttcgtgagcaacctgcgcaccttcctgtggatccgggtgcagcagttcacgtctcggcgggtggagctgctcatcttctcccacctgcacgagctctcactgcgctggcacctggggcgccgcacaggggaggtgctgcggatcgcggatcggggcacatccagtgtcacagggctgctcagctacctggtgttcaatgtcatccccacgctggccgacatcatcattggcatcatctacttcagcatgttcttcaacgcctggtttggcctcattgtgttcctgtgcatgagtctttacctcaccctgaccattgtggtcactgagtggagaaccaagtttcgtcgtgctatgaacacacaggagaacgctacccgggcacgagcagtggactctctgctaaacttcgagacggtgaagtattacaacgccgagagttacgaagtggaacgctatcgagaggccatcatcaaatatcagggtttggagtggaagtcgagcgcttcactggttttactaaatcagacccagaacctggtgattgggctcgggctcctcgccggctccctgctttgcgcatactttgtcactgagcagaagctacaggttggggactatgtgctctttggcacctacattatccagctgtacatgcccctcaattggtttggcacctactacaggatgatccagaccaacttcattgacatggagaacatgtttgacttgctgaaagaggagacagaagtgaaggaccttcctggagcagggccccttcgctttcagaagggccgtattgagtttgagaacgtgcacttcagctatgccgatgggcgggagactctgcaggacgtgtctttcactgtgatgcctggacagacacttgccctggtgggcccatctggggcagggaagagcacaattttgcgcctgctgtttcgcttctacgacatcagctctggctgcatccgaatagatgggcaggacatttcacaggtgacccaggcctctctccggtctcacattggagttgtgccccaagacactgtcctctttaatgacaccatcgccgacaatatccgttacggccgtgtcacagctgggaatgatgaggtggaggctgctgctcaggctgcaggcatccatgatgccattatggctttccctgaagggtacaggacacaggtgggcgagcggggactgaagctgagcggcggggagaagcagcgcgtcgccattgcccgcaccatcctcaaggctccgggcatcattctgctggatgaggcaacgtcagcgctggatacatctaatgagagggccatccaggcttctctggccaaagtctgtgccaaccgcaccaccatcgtagtggcacacaggctctcaactgtggtcaatgctgaccagatcctcgtcatcaaggatggctgcatcgtggagaggggacgacacgaggctctgttgtcccgaggtggggtgtatgctgacatgtggcagctgcagcagggacaggaagaaacctctgaagacactaagcctcagaccatggaacggtgacaaaagtttggccacttccctctcaaagactaacccagaagggaataagatgtgtctcctttccctggcttatttcatcctggtcttggggtatggtgctagctatggtaagggaaagggacctttccgaaaaacatcttttggggaaataaaaatgtggactgtg

SEQ ID NO: 35736 - DNA, 3043 bp, Homo sapiens
  misc_feature (1)..(1): n is a, c, g, or t
nacttaggctaggtcgaggctgggtgtgaatcggccgagggttggcagaagggtcccgggcccagagccagcggggccgtgctgagacggcgtacgtgccctgcgtgagtgcgtggcggcggcgcgtgcgctaggggagtgggcggtgaggcctggtccacgtgcgtcccttcccgggacccccgcagcttggcgcccagcggctacgtgagccaaggcacccggatgtccgcgcccctctccgagtgacaagtcccggcctccggtcccgcagtgcccgcagcctcggccggcgtccacgcattgccatggtgactgtgggcaactactgcgaggccgaagggcccgtgggtccggcctggatgcaggatggcctgagtccctgcttcttcttcacgctcgtgccctcgacgcggatggctctagggactctggccttggtgctggctcttccctgcagacgccgggagcggcccgctggtgctgattcgctgtcttggggggccggccctcgcatctctccctacgtgctgcagctgcttctggccacacttcaggcggcgctgcccctggccggcctggctggccgggtgggcactgcccggggggccccactgccaagctatctacttctggcctccgtgctggagagtctggccggcgcctgtggcctgtggctgcttgtcgtggagcggagccaggcacggcagcgtctggcaatgggcatctggatcaagttcaggcacagccctggtctcctgctcctctggactgtggcgtttgcagctgagaacttggccctggtgtcttggaacagcccacagtggtggtgggcaagggcagacttgggccagcaggttcagtttagcctgtgggtgctgcggtatgtggtctctggagggctgtttgtcctgggtctctgggcccctggacttcgtccccagtcctatacattgcaggttcatgaagaggaccaagatgtggaaaggagccaggttcggtcagcagcccaacagtctacctggcgagattttggcaggaagctccgcctcctgagtggctacctgtggcctcgagggagtccagctctgcagctggtggtgctcatctgcctggggctcatgggtttggaacgggcactcaatgtgttggtgcctatattctataggaacattgtgaacttgctgactgagaaggcaccttggaactctctggcctggactgttaccagttacgtcttcctcaagttcctccaggggggtggcactggcagtacaggcttcgtgagcaacctgcgcaccttcctgtggatccgggtgcagcagttcacgtctcggcgggtggagctgctcatcttctcccacctgcacgagctctcactgcgctggcacctggggcgccgcacaggggaggtgctgcggatcgcggatcggggcacatccagtgtcacagggctgctcagctacctggtgttcaatgtcatccccacgctggccgacatcatcattggcatcatctacttcagcatgttcttcaacgcctggtttggcctcattgtgttcctgtgcatgagtctttacctcaccctgaccattgtggtcactgagtggagaaccaagtttcgtcgtgctatgaacacacaggagaacgctacccgggcacgagcagtggactctctgctaaacttcgagacggtgaagtattacaacgccgagagttacgaagtggaacgctatcgagaggccatcatcaaatatcagggtttggagtggaagtcgagcgcttcactggttttactaaatcagacccagaacctggtgattgggctcgggctcctcgccggctccctgctttgcgcatactttgtcactgagcagaagctacaggttggggactatgtgctctttggcacctacattatccagctgtacatgcccctcaattggtttggcacctactacaggatgatccagaccaacttcattgacatggagaacatgtttgacttgctgaaagaggagacagaagtgaaggaccttcctggagcagggccccttcgctttcagaagggccgtattgagtttgagaacgtgcacttcagctatgccgatgggcgggagactctgcaggacgtgtctttcactgtgatgcctggacagacacttgccctggtgggcccatctggggcagggaagagcacaattttgcgcctgctgtttcgcttctacgacatcagctctggctgcatccgaatagatgggcaggacatttcacaggtgacccaggcctctctccggtctcacattggagttgtgccccaagacactgtcctctttaatgacaccatcgccgacaatatccgttacggccgtgtcacagctgggaatgatgaggtggaggctgctgctcaggctgcaggcatccatgatgccattatggctttccctgaagggtacaggacacaggtgggcgagcggggactgaagctgagcggcggggagaagcagcgcgtcgccattgcccgcaccatcctcaaggctccgggcatcattctgctggatgaggcaacgtcagcgctggatacatctaatgagagggccatccaggcttctctggccaaagtctgtgccaaccgcaccaccatcgtagtggcacacaggctctcaactgtggtcaatgctgaccagatcctcgtcatcaaggatggctgcatcgtggagaggggacgacacgaggctctgttgtcccgaggtggggtgtatgctgacatgtggcagctgcagcagggacaggaagaaacctctgaagacactaagcctcagaccatggaacggtgacaaaagtttggccacttccctctcaaagactaacccagaagggaataagatgtgtctcctttccctggcttatttcatcctggtcttggggtatggtgctagctatggtaagggaaagggacctttccgaaaaacatcttttggggaaataaaaatgtggactgtgaaaaaaaaaagtcgacgcggccgcgaatttagtagtagta

SEQ ID NO: 35737 - DNA, 3028 bp, Homo sapiens
ggtgcgagtccaacaccgagcattcccgtgggcctgcagttggcagaagggtcccgggcccagagccagcggggccgtgctgagacggcgtacgtgccctgcgtgagtgcgtggcggcggcgcgtgcgctaggggagtgggcggtgaggcctggtccacgtgcgtcccttcccgggacccccgcagcttggcgcccagcggctacgtgagccaaggcacccggatgtccgcgcccctctccgagtgacaagtcccggcctccggtcccgcagtgcccgcagcctcggccggcgtccacgcattgccatggtgactgtgggcaactactgcgaggccgaagggcccgtgggtccggcctggatgcaggatggcctgagtccctgcttcttcttcacgctcgtgccctcgacgcggatggctctagggactctggccttggtgctggctcttccctgcagacgccgggagcggcccgctggtgctgattcgctgtcttggggggccggccctcgcatctctccctacgtgctgcagctgcttctggccacacttcaggcggcgctgcccctggccggcctggctggccgggtgggcactgcccggggggccccactgccaagctatctacttctggcctccgtgctggagagtctggccggcgcctgtggcctgtggctgcttgtcgtggagcggagccaggcacggcagcgtctggcaatgggcatctggatcaagttcaggcacagccctggtctcctgctcctctggactgtggcgtttgcagctgagaacttggccctggtgtcttggaacagcccacagtggtggtgggcaagggcagacttgggccagcaggttcagtttagcctgtgggtgctgcggtatgtggtctctggagggctgtttgtcctgggtctctgggcccctggacttcgtccccagtcctatacattgcaggttcatgaagaggaccaagatgtggaaaggagccaggttcggtcagcagcccaacagtctacctggcgagattttggcaggaagctccgcctcctgagtggctacctgtggcctcgagggagtccagctctgcagctggtggtgctcatctgcctggggctcatgggtttggaacgggcactcaatgtgttggtgcctatattctataggaacattgtgaacttgctgactgagaaggcaccttggaactctctggcctggactgttaccagttacgtcttcctcaagttcctccaggggggtggcactggcagtacaggcttcgtgagcaacctgcgcaccttcctgtggatccgggtgcagcagttcacgtctcggcgggtggagctgctcatcttctcccacctgcacgagctctcactgcgctggcacctggggcgccgcacaggggaggtgctgcggatcgcggatcggggcacatccagtgtcacagggctgctcagctacctggtgttcaatgtcatccccacgctggccgacatcatcattggcatcatctacttcagcatgttcttcaacgcctggtttggcctcattgtgttcctgtgcatgagtctttacctcaccctgaccattgtggtcactgagtggagaaccaagtttcgtcgtgctatgaacacacaggagaacgctacccgggcacgagcagtggactctctgctaaacttcgagacggtgaagtattacaacgccgagagttacgaagtggaacgctatcgagaggccatcatcaaatatcagggtttggagtggaagtcgagcgcttcactggttttactaaatcagacccagaacctggtgattgggctcgggctcctcgccggctccctgctttgcgcatactttgtcactgagcagaagctacaggttggggactatgtgctctttggcacctacattatccagctgtacatgcccctcaattggtttggcacctactacaggatgatccagaccaacttcattgacatggagaacatgtttgacttgctgaaagaggagacagaagtgaaggaccttcctggagcagggccccttcgctttcagaagggccgtattgagtttgagaacgtgcacttcagctatgccgatgggcgggagactctgcaggacgtgtctttcactgtgatgcctggacagacacttgccctggtgggcccatctggggcagggaagagcacaattttgcgcctgctgtttcgcttctacgacatcagctctggctgcatccgaatagatgggcaggacatttcacaggtgacccaggcctctctccggtctcacattggagttgtgccccaagacactgtcctctttaatgacaccatcgccgacaatatccgttacggccgtgtcacagctgggaatgatgaggtggaggctgctgctcaggctgcaggcatccatgatgccattatggctttccctgaaggaaacgtgtggtgggtaatatccacagggtacaggacacaggtgggcgagcggggactgaagctgagcggcggggagaagcagcgcgtcgccattgcccgcaccatcctcaaggctccgggcatcattctgctggatgaggcaacgtcagcgctggatacatctaatgagagggccatccaggcttctctggccaaagtctgtgccaaccgcaccaccatcgtagtggcacacaggctctcaactgtggtcaatgctgaccagatcctcgtcatcaaggatggctgcatcgtggagaggggacgacacgaggctctgttgtcccgaggtggggtgtatgctgacatgtggcagctgcagcagggacaggaagaaacctctgaagacactaagcctcagaccatggaacggtgacaaaagtttggccacttccctctcaaagactaacccagaagggaataagatgtgtctcctttccctggcttatttcatcctggtcttggggtatggtgctagctatggtaagggaaagggacctttccgaaaaacatcttttggggaaataaaaatgtggactgtg

SEQ ID NO: 35738 - DNA, 2825 bp, Homo sapiens
ggtgcgagtccaacaccgagcattcccgtgggcctgcagttggcagaagggtcccgggcccagagccagcggggccgtgctgagacggcgtacgtgccctgcgtgagtgcgtggcggcggcgcgtgcgctaggggagtgggcggtgaggcctggtccacgtgcgtcccttcccgggacccccgcagcttggcgcccagcggctacgtgagccaaggcacccggatgtccgcgcccctctccgagtgacaagtcccggcctccggtcccgcagtgcccgcagcctcggccggcgtccacgcattgccatggtgactgtgggcaactactgcgaggccgaagggcccgtgggtccggcctggatgcaggatggcctgagtccctgcttcttcttcacgctcgtgccctcgacgcggatggctctagggactctggccttggtgctggctcttccctgcagacgccgggagcggcccgctggtgctgattcgctgtcttggggggccggccctcgcatctctccctacgtgctgcagctgcttctggccacacttcaggcggcgctgcccctggccggcctggctggccgggtgggcactgcccggggggccccactgccaagctatctacttctggcctccgtgctggagagtctggccggcgcctgtggcctgtggctgcttgtcgtggagcggagccaggcacggcagcgtctggcaatgggcatctggatcaagttcaggcacagccctggtctcctgctcctctggactgtggcgtttgcagctgagaacttggccctggtgtcttggaacagcccacagtggtggtgggcaagggcagacttgggccagcaggttcagtttagcctgtgggtgctgcggtatgtggtctctggagggctgtttgtcctgggtctctgggcccctggacttcgtccccagtcctatacattgcaggttcatgaagaggaccaagatgtggaaaggagccaggttcggtcagcagcccaacagtctacctggcgagattttggcaggaagctccgcctcctgagtggctacctgtggcctcgagggagtccagctctgcagctggtggtgctcatctgcctggggctcatgggtttggaacgggcactcaatgtgttggtgcctatattctataggaacattgtgaacttgctgactgagaaggcaccttggaactctctggcctggactgttaccagttacgtcttcctcaagttcctccaggggggtggcactggcagtacaggcttcgtgagcaacctgcgcaccttcctgtggatccgggtgcagcagttcacgtctcggcgggtggagctgctcatcttctcccacctgcacgagctctcactgcgctggcacctggggcgccgcacaggggaggtgctgcggatcgcggatcggggcacatccagtgtcacagggctgctcagctacctggtgttcaatgtcatccccacgctggccgacatcatcattggcatcatctacttcagcatgttcttcaacgcctggtttggcctcattgtgttcctgtgcatgagtctttacctcaccctgaccattgtggtcactgagtggagaaccaagtttcgtcgtgctatgaacacacaggagaacgctacccgggcacgagcagtggactctctgctaaacttcgagacggtgaagtattacaacgccgagagttacgaagtggaacgctatcgagaggccatcatcaaatatcagggtttggagtggaagtcgagcgcttcactggttttactaaatcagacccagaacctggtgattgggctcgggctcctcgccggctccctgctttgcgcatactttgtcactgagcagaagctacaggttggggactatgtgctctttggcacctacattatccagctgtacatgcccctcaattggtttggcacctactacaggatgatccagaccaacttcattgacatggagaacatgtttgacttgctgaaagaggagacagaagtgaaggaccttcctggagcagggccccttcgctttcagaagggccgtattgagtttgagaacgtgcacttcagctatgccgatgggcgggagactctgcaggacgtgtctttcactgtgatgcctggacagacacttgccctggtgggcccatctggggcagggaagagcacaattttgcgcctgctgtttcgcttctacgacatcagctctggctgcatccgaatagatgggcaggacatttcacaggtacaggacacaggtgggcgagcggggactgaagctgagcggcggggagaagcagcgcgtcgccattgcccgcaccatcctcaaggctccgggcatcattctgctggatgaggcaacgtcagcgctggatacatctaatgagagggccatccaggcttctctggccaaagtctgtgccaaccgcaccaccatcgtagtggcacacaggctctcaactgtggtcaatgctgaccagatcctcgtcatcaaggatggctgcatcgtggagaggggacgacacgaggctctgttgtcccgaggtggggtgtatgctgacatgtggcagctgcagcagggacaggaagaaacctctgaagacactaagcctcagaccatggaacggtgacaaaagtttggccacttccctctcaaagactaacccagaagggaataagatgtgtctcctttccctggcttatttcatcctggtcttggggtatggtgctagctatggtaagggaaagggacctttccgaaaaacatcttttggggaaataaaaatgtggactgtg

SEQ ID NO: 35739 - DNA, 3431 bp, Homo sapiens
ggtgcgagtccaacaccgagcattcccgtgggcctgcagttggcagaagggtcccgggcccagagccagcggggccgtgctgagacggcgtacgtgccctgcgtgagtgcgtggcggcggcgcgtgcgctaggggagtgggcggtgaggcctggtccacgtgcgtcccttcccgggacccccgcagcttggcgcccagcggctacgtgagccaaggcacccggatgtccgcgcccctctccgagtgacaagtcccggcctccggtcccgcagtgcccgcagcctcggccggcgtccacgcattgccatggtgactgtgggcaactactgcgaggccgaagggcccgtgggtccggcctggatgcaggatggcctgagtccctgcttcttcttcacgctcgtgccctcgacgcggatggctctagggactctggccttggtgctggctcttccctgcagacgccgggagcggcccgctggtgctgattcgctgtcttggggggccggccctcgcatctctccctacgtgctgcagctgcttctggccacacttcaggcggcgctgcccctggccggcctggctggccgggtgggcactgcccggggggccccactgccaagctatctacttctggcctccgtgctggagagtctggccggcgcctgtggcctgtggctgcttgtcgtggagcggagccaggcacggcagcgtctggcaatgggcatctggatcaagttcaggcacagccctggtctcctgctcctctggactgtggcgtttgcagctgagaacttggccctggtgtcttggaacagcccacagtggtggtgggcaagggcagacttgggccagcaggttcagtttagcctgtgggtgctgcggtatgtggtctctggagggctgtttgtcctgggtctctgggcccctggacttcgtccccagtcctatacattgcaggttcatgaagaggaccaagatgtggaaaggagccaggttcggtcagcagcccaacagtctacctggcgagattttggcaggaagctccgcctcctgagtggctacctgtggcctcgagggagtccagctctgcagctggtggtgctcatctgcctggggctcatgggtttggaacgggcactcaatgtgttggtgcctatattctataggaacattgtgaacttgctgactgagaaggcaccttggaactctctggcctggactgttaccagttacgtcttcctcaagttcctccaggggggtggcactggcagtacaggcttcgtgagcaacctgcgcaccttcctgtggatccgggtgcagcagttcacgtctcggcgggtggagctgctcatcttctcccacctgcacgagctctcactgcgctggcacctggggcgccgcacaggggaggtgctgcggatcgcggatcggggcacatccagtgtcacagggctgctcagctacctggtgttcaatgtcatccccacgctggccgacatcatcattggcatcatctacttcagcatgttcttcaacgcctggtttggcctcattgtgttcctgtgcatgagtctttacctcaccctgaccattgtggtcactgagtggagaaccaagtttcgtcgtgctatgaacacacaggagaacgctacccgggcacgagcagtggactctctgctaaacttcgagacggtgaagtattacaacgccgagagttacgaagtggaacgctatcgagaggccatcatcaaatatcagggtttggagtggaagtcgagcgcttcactggttttactaaatcagacccagaacctggtgattgggctcgggctcctcgccggctccctgctttgcgcatactttgtcactgagcagaagctacaggttggggactatgtgctctttggcacctacattatccagctgtacatgcccctcaattggtttggcacctactacaggatgatccagaccaacttcattgacatggagaacatgtttgacttgctgaaagaggagacagaagtgaaggaccttcctggagcagggccccttcgctttcagaagggccgtattgagtttgagaacgtgcacttcagctatgccgatgggtgaggccttccttttgcttcctttgcttttccgttcatttgcacactgccttcctgcttctcagtgctctgaatccctgcttttggaaaagagcctgggcaggggaggggcagggcctactagcagctctggtgatggaaggtgcctgctgagcaaccccacctttccttgcaggcgggagactctgcaggacgtgtctttcactgtgatgcctggacagacacttgccctggtgagaggagacccagccacttggcccagatgcctcaagcttccctcattcagtgcccatggtagcttgtgacccaggctgtggagtcagagagcccagtcacgataggcaaccggattgaatggtgcagcctccatggacactggtgacctcttggagagggaacctcaaaagccagtgggcctcggccggctgcggtggcacatgcctgtaatcccagcactttgggaggcttaggtggccagatcacctaaggtgggcccatctggggcagggaagagcacaattttgcgcctgctgtttcgcttctacgacatcagctctggctgcatccgaatagatgggcaggacatttcacaggtgacccaggcctctctccggtctcacattggagttgtgccccaagacactgtcctctttaatgacaccatcgccgacaatatccgttacggccgtgtcacagctgggaatgatgaggtggaggctgctgctcaggctgcaggcatccatgatgccattatggctttccctgaagggtacaggacacaggtgggcgagcggggactgaagctgagcggcggggagaagcagcgcgtcgccattgcccgcaccatcctcaaggctccgggcatcattctgctggatgaggcaacgtcagcgctggatacatctaatgagagggccatccaggcttctctggccaaagtctgtgccaaccgcaccaccatcgtagtggcacacaggctctcaactgtggtcaatgctgaccagatcctcgtcatcaaggatggctgcatcgtggagaggggacgacacgaggctctgttgtcccgaggtggggtgtatgctgacatgtggcagctgcagcagggacaggaagaaacctctgaagacactaagcctcagaccatggaacggtgacaaaagtttggccacttccctctcaaagactaacccagaagggaataagatgtgtctcctttccctggcttatttcatcctggtcttggggtatggtgctagctatggtaagggaaagggacctttccgaaaaacatcttttggggaaataaaaatgtggactgtg

SEQ ID NO: 35740 - DNA, 1463 bp, Homo sapiens
agtgtaaccaggaccactggggctgacagagagctgggggtgtgatgtttgtgtgtgatgtttgaactcaggaaggaggattgagagttggggggaatgacccgagtgccatgtgctgtgcccatgccaaataaatttggtttgaattcatcaggtgaagtattacaacgccgagagttacgaagtggaacgctatcgagaggccatcatcaaatatcagggtttggagtggaagtcgagcgcttcactggttttactaaatcagacccagaacctggtgattgggctcgggctcctcgccggctccctgctttgcgcatactttgtcactgagcagaagctacaggttggggactatgtgctctttggcacctacattatccagctgtacatgcccctcaattggtttggcacctactacaggatgatccagaccaacttcattgacatggagaacatgtttgacttgctgaaagaggagacagaagtgaaggaccttcctggagcagggccccttcgctttcagaagggccgtattgagtttgagaacgtgcacttcagctatgccgatgggcgggagactctgcaggacgtgtctttcactgtgatgcctggacagacacttgccctggtgggcccatctggggcagggaagagcacaattttgcgcctgctgtttcgcttctacgacatcagctctggctgcatccgaatagatgggcaggacatttcacaggtgacccaggcctctctccggtctcacattggagttgtgccccaagacactgtcctctttaatgacaccatcgccgacaatatccgttacggccgtgtcacagctgggaatgatgaggtggaggctgctgctcaggctgcaggcatccatgatgccattatggctttccctgaagggtacaggacacaggtgggcgagcggggactgaagctgagcggcggggagaagcagcgcgtcgccattgcccgcaccatcctcaaggctccgggcatcattctgctggatgaggcaacgtcagcgctggatacatctaatgagagggccatccaggcttctctggccaaagtctgtgccaaccgcaccaccatcgtagtggcacacaggctctcaactgtggtcaatgctgaccagatcctcgtcatcaaggatggctgcatcgtggagaggggacgacacgaggctctgttgtcccgaggtggggtgtatgctgacatgtggcagctgcagcagggacaggaagaaacctctgaagacactaagcctcagaccatggaacggtgacaaaagtttggccacttccctctcaaagactaacccagaagggaataagatgtgtctcctttccctggcttatttcatcctggtcttggggtatggtgctagctatggtaagggaaagggacctttccgaaaaacatcttttggggaaataaaaatgtggactgtg

SEQ ID NO: 35741 - DNA, 2083 bp, Homo sapiens
ggtgcgagtccaacaccgagcattcccgtgggcctgcagttggcagaagggtcccgggcccagagccagcggggccgtgctgagacggcgtacgtgccctgcgtgagtgcgtggcggcggcgcgtgcgctaggggagtgggcggtgaggcctggtccacgtgcgtcccttcccgggacccccgcagcttggcgcccagcggctacgtgagccaaggcacccggatgtccgcgcccctctccgagtgacaagtcccggcctccggtcccgcagtgcccgcagcctcggccggcgtccacgcattgccatggtgactgtgggcaactactgcgaggccgaagggcccgtgggtccggcctggatgcaggatggcctgagtccctgcttcttcttcacgctcgtgccctcgacgcggatggctctagggactctggccttggtgctggctcttccctgcagacgccgggagcggcccgctggtgctgattcgctgtcttggggggccggccctcgcatctctccctacgtgctgcagctgcttctggccacacttcaggcggcgctgcccctggccggcctggctggccgggtgggcactgcccggggggccccactgccaagctatctacttctggcctccgtgctggagagtctggccggcgcctgtggcctgtggctgcttgtcgtggagcggagccaggcacggcagcgtctggcaatgggcatctggatcaagttcaggcacagccctggtctcctgctcctctggactgtggcgtttgcagctgagaacttggccctggtgtcttggaacagcccacagtggtggtgggcaagggcagacttgggccagcaggttcagtttagcctgtgggtgctgcggtatgtggtctctggagggctgtttgtcctgggtctctgggcccctggacttcgtccccagtcctatacattgcaggttcatgaagaggaccaagatgtggaaaggagccaggttcggtcagcagcccaacagtctacctggcgagattttggcaggaagctccgcctcctgagtggctacctgtggcctcgagggagtccagctctgcagctggtggtgctcatctgcctggggctcatgggtttggaacgggcactcaatgtgttggtgcctatattctataggaacattgtgaacttgctgactgagaaggcaccttggaactctctggcctggactgttaccagttacgtcttcctcaagttcctccaggggggtggcactggcagtacaggcttcgtgagcaacctgcgcaccttcctgtggatccgggtgcagcagttcacgtctcggcgggtggagctgctcatcttctcccacctgcacgagctctcactgcgctggcacctggggcgccgcacaggggaggtgctgcggatcgcggatcggggcacatccagtgtcacagggctgctcagctacctggtgttcaatgtcatccccacgctggccgacatcatcattggcatcatctacttcagcatgttcttcaacgcctggtttggcctcattgtgttcctgtgcatgagtctttacctcaccctgaccattgtggtcactgagtggagaaccaagtttcgtcgtgctatgaacacacaggagaacgctacccgggcacgagcagtggactctctgctaaacttcgagacggtgaagtattacaacgccgagagttacgaagtggaacgctatcgagaggccatcatcaaatatcagggtttggagtggaagtcgagcgcttcactggttttactaaatcagacccagaacctggtgattgggctcgggctcctcgccggctccctgctttgcgcatactttgtcactgagcagaagctacaggttggggactatgtgctctttggcacctacattatccagctgtacatgcccctcaattggtttggcacctactacaggatgatcagaccacttcttgacatgagactgtttgattgctgaagaagagacgaattaaggactccaaacaggccctccttcaaggctttatttaaactcctcactgccatgcggaaccccg

SEQ ID NO: 35742 - DNA, 1694 bp, Homo sapiens
ggtgcgagtccaacaccgagcattcccgtgggcctgcagttggcagaagggtcccgggcccagagccagcggggccgtgctgagacggcgtacgtgccctgcgtgagtgcgtggcggcggcgcgtgcgctaggggagtgggcggtgaggcctggtccacgtgcgtcccttcccgggacccccgcagcttggcgcccagcggctacgtgagccaaggcacccggatgtccgcgcccctctccgagtgacaagtcccggcctccggtcccgcagtgcccgcagcctcggccggcgtccacgcattgccatggtgactgtgggcaactactgcgaggccgaagggcccgtgggtccggcctggatgcaggatggcctgagtccctgcttcttcttcacgctcgtgccctcgacgcggatggctctagggactctggccttggtgctggctcttccctgcagacgccgggagcggcccgctggtgctgattcgctgtcttggggggccggccctcgcatctctccctacgtgctgcagctgcttctggccacacttcaggcggcgctgcccctggccggcctggctggccgggtgggcactgcccggggggccccactgccaagctatctacttctggcctccgtgctggagagtctggccggcgcctgtggcctgtggctgcttgtcgtggagcggagccaggcacggcagcgtctggcaatgggcatctggatcaagttcaggcacagccctggtctcctgctcctctggactgtggcgtttgcagctgagaacttggccctggtgtcttggaacagcccacagtggtggtgggcaagggcagacttgggccagcaggttcagtttagcctgtgggtgctgcggtatgtggtctctggagggctgtttgtcctgggtctctgggcccctggacttcgtccccagtcctatacattgcaggttcatgaagaggaccaagatgtggaaaggagccaggttcggtcagcagcccaacagtctacctggcgagattttggcaggaagctccgcctcctgagtggctacctgtggcctcgagggagtccagctctgcagctggtggtgctcatctgcctggggctcatgggtttggaacgggcactcaatgtgttggtgcctatattctataggaacattgtgaacttgctgactgagaaggcaccttggaactctctggcctggactgttaccagttacgtcttcctcaagttcctccaggggggtggcactggcagtacaggcttcgtgagcaacctgcgcaccttcctgtggatccgggtgcagcagttcacgtctcggcgggtggagctgctcatcttctcccacctgcacgagctctcactgcgctggcacctggggcgccgcacaggggaggtgctgcggatcgcggatcggggcacatccagtgtcacagggctgctcagctacctggtgttcaatgtcatccccacgctggccgacatcatcattggcatcatctacttcagcatgttcttcaacgcctggtttggcctcattgtgttcctgtgcatgagtctttacctcaccctgaccattgtggtcactgagtggagaaccaagtttcgtcgtgctatgaacacacaggagaacgctacccgggcacgagcagtggactctctgctaaacttcgagacggt

SEQ ID NO: 35743 - DNA, 1258 bp, Homo sapiens
cgaagggagaggagtagggtttggggagggaggagctgtgtggtgtttctcgtgcttggaaaacacaaagctgagaacctcagcacacatgggtggtgcccttccaggtgaaggaccttcctggagcagggccccttcgctttcagaagggccgtattgagtttgagaacgtgcacttcagctatgccgatgggtgaggccttccttttgcttcctttgcttttccgttcatttgcacactgccttcctgcttctcagtgctctgaatccctgcttttggaaaagagcctgggcaggggaggggcagggcctactagcagctctggtgatggaaggtgcctgctgagcaaccccacctttccttgcaggcgggagactctgcaggacgtgtctttcactgtgatgcctggacagacacttgccctggtgggcccatctggggcagggaagagcacaattttgcgcctgctgtttcgcttctacgacatcagctctggctgcatccgaatagatgggcaggacatttcacaggtgacccaggcctctctccggtctcacattggagttgtgccccaagacactgtcctctttaatgacaccatcgccgacaatatccgttacggccgtgtcacagctgggaatgatgaggtggaggctgctgctcaggctgcaggcatccatgatgccattatggctttccctgaagggtacaggacacaggtgggcgagcggggactgaagctgagcggcggggagaagcagcgcgtcgccattgcccgcaccatcctcaaggctccgggcatcattctgctggatgaggcaacgtcagcgctggatacatctaatgagagggccatccaggcttctctggccaaagtctgtgccaaccgcaccaccatcgtagtggcacacaggctctcaactgtggtcaatgctgaccagatcctcgtcatcaaggatggctgcatcgtggagaggggacgacacgaggctctgttgtcccgaggtggggtgtatgctgacatgtggcagctgcagcagggacaggaagaaacctctgaagacactaagcctcagaccatggaacggtgacaaaagtttggccacttccctctcaaagactaacccagaagggaataagatgtgtctcctttccctggcttatttcatcctggtcttggggtatggtgctagctatggtaagggaaagggacctttccgaaaaacatcttttggggaaataaaaatgtggactgtg

SEQ ID NO: 35744 - DNA, 835 bp, Homo sapiens
accttggtgttttttaaagtataggattattgtatacatgctctcctaataacttaggtaatgcgggcagagggcaaatctctttcgagctgcacttactttttcagagcttcccactctgtttagtatgttgggttctgctctttttttgagacagggtcacgctctgtcacccaggctggagtacagtggcataatctctgcggcactgcaacgctctgctcccgggttcaagcaattctcctgcctcagcctcctgagtagctgggattacagatgtgcaccagcatgcctggctaattattagattttttgtagaaacagggtttcaccatgttggccaggctggcctggaactcctagcatcatgtgatctgcccacctagcattccaaagtgctgggattacagttgtgagccattgtgcccagctgggttctgcttttttgcatttttacatacatattatatatgcagactcacagaactaatatggcattgtggaggtttttcctaaaacaaatggtattgtgacatagccatcattctcagagttgcttattaacagaacattatggagatatatttttcttccatgcctgaaggtctccctcattcattgtaattgatacagagaattctgtagtttgagcatggttgatttagccacccacctcttgagggtagaattaattaagactggttccagtctgttgcttgaaaataaaacactaccctgaaatgcctagaggcagggttgctgggtctaagcccccagacctttcttattcacttgacctgccctcctagctacctggtgttcaatgtcatcccca

SEQ ID NO: 35745 - DNA, 404 bp, Homo sapiens
ctgaccattgtggtcactgagtggagaaccaagtttcgtcgtgctatgaacacacaggagaacgctacccgggcacgagcagtggactctctgctaaacttcgagacggtaacagagggcccggtggcagtggtgtgaggcgtggagatgtggaggagtgtaaccaggaccactggggctgacagagagctgggggtgtgatgtttgtgtgtgatgtttgaactcaggaaggaggattgagagttggggggaatgacccgagtgccatgtgctgtgcccatgccaaataaatttggtttgaattcatcaggtgaagtattacaacgccgagagttacgaagtggaacgctatcgagaggccatcatcaaatatcaggtgaggatgctagtttgaggcctccgga

SEQ ID NO: 35746 - DNA, 678 bp, Homo sapiens
gaggagaagtgttggtttgaacgatccaagcaaactctcccagaatcaaattacctgggtagttgttcaacttttcactctgcttagcctgtatagacaaaccccatatatttgtagaggcttggccttggaattctggaataccattggcttttcagtaggctgatgaacacattttgaaaattctattatcttcagaattttgccccattgttaagtgcttaaccgtcactcttgaatgtgcaatgtgctgtggattccattttcatcagttctgaaagaactgcaatgtgtaaattatcagtgaaatgcatgcatataagggctctatcattatcaaattgtaaggacaattgtacccttctatatctttgggcatgctagacacccccatgccttcattgagatcccattttccccctctcaagtggaaaataatcacatccagcaagctctctcattattgagaaataccatttggaaattgccactttttattcctaagcagcacctttcactgttcatgatgctaatgttccacaaaagcatgtccattggcccactgaaggatagagggacccttttcaatctatatcagctgggctctgggactgaatctctcacctattcttgcagaaagacatactaattaaaccttgtcaaagtagtaagtcaaat

SEQ ID NO: 35747 - DNA, 943 bp, Homo sapiens
gtaggacgaaaaagaaagattttaagtaatctgctacatttcttcccccacttcctcctttttaaacagtccttatgttttactaaaatcttcaggattgaggggaacatctgttgtggaagtatgtagagaaaataacactgattttttttaaaagcctgcttttgtgaagctgtattgtattttgtggtccccacacactgcatacttaaacagttaaaagcctcaggaaagggaatcctcggaagaagtaattaatagttccaatcagagatggcagaagtaatagtttcaatcagagacggcagaagtaatagtgtcagtcagagacgtccagtggttgaggtagggcctgcataggtcgttggtgtgagatcatcctatgtgtccagttggcattctctttctctggcttgtgatctgagctcctgtatcttttatgtatttgttctctggcaagggaacatcatctttcttctgatttttctttattttactaactttgctgttgaagattttatggatgtagacgaaaactattttcacccgagaattcccctaacctagagcactttaaggactatgttaacaaggtcagaaactacactttctgttcacttgaaagatgctgccgtgatgagtgtctttccgtttagggcggtggcactcgctcttgagtctgaaggtctcagtggacggggctgtgggtgtaaccccctgcttgccaccttggcatttttagggcccaggtgttgtgagctctgtccttggagactgtgggacggtggagctgggcggcagtacgttaaattaaatatgttggcccacaggacaatgagaacgttttgtaagctgtactttgtatgctgtattactcgaatttcaaaaatgaagagggtgtaattattaaatatgtttggaaattgccaagtcattgaatacc

SEQ ID NO: 35748 - DNA, 407 bp, Homo sapiens
ttcagtccccatccttctctccttccggaaacaacctcaccactagaatgcaaatccatataatattagatccttatgaaaataacagctagaattcatcatgtgccaggcagtatgctaggtattctacctataataccttttttaatctttacagaatttattcattcattgaacaaatatttatttcctgtttcttatgtgtcatggggcagtcaagatgctgtgctggaaaagacacagcccctgcctgcagcatgctttcattctcagcaggagacgaacaccaaagcaaattagcaaaataaagtaagtaagcattggcaacaggtgagagtggctgtgaggataattaaaatggtgtaaaataattaaaatagaggagagttgggatagaaggctcagat

SEQ ID NO: 35749 - DNA, 635 bp, Homo sapiens
accatatggagctataatacatttttctgagagataatggcccatcagccatactgttttagatgggagggtaagaaagatttgtatgtgaatggcatttcataagtgctagtcaaattactgaagagaagtctctgagtctttcaaacgccagcatcttctgacacactgggcattagctgcatgcagaaaactagttaattcaggcactaggagtaaagcacatgatgaaattaaaagacctgacgcctatctgtgaggagctcccctgttagcaggggcagttgaaaacacgtatgtgcaaaatgattccaaatctgagcagcaaagaaacagtggcataaccttttttttttttttggacaattgaaactggaatttaggtggtaaaaacagcactagtggagcagggcacaatgacacacgcctgtgatcccagcactttgggagaccaaggcagtggattgttcaggagttcaccatcctgggtgacatggtgagacattgtctctacaaaaaaatataaaaattagccgggcgtggtggcgtgagcctgtggtcccaactactctctggagcctgaggtgagaagatcacttaagcctggtaggtcaaggctgctctctatcctgggt

SEQ ID NO: 35750 - DNA, 758 bp, Homo sapiens
gacggggatccggaaggcgttgtcggtgacatcacggagagggcgatttctatgtagatgaggcagcgcaggggctgctgctttgccacgaaagagttcccgtgccgtgggagcaagtctgggaccgctggtcggaccggagagtcgcagctgtgtgttagggctaggatggctccgggatgcgcgtgacgcaagtgaccttgcgtgtaaagggatacatgatcccttaattcaggctcaggctgaagaactgacccacttacgacagaagacacaggaagggagaggtgtctgctacctttttacccagcatgtgaagaacacagtcaagtcttttgagggccttctcaggaacactgacattgcctactaccagagacagagattctgtgagcaaatggtacaaggaagccagctgacagagatccttgtcagaaaacttgccacagaatcttgctctcttacccaagctggagtgcagtgacacggtcttggctgactgcaatctgtgcctcctgggctcaagcaatcttcccacctcagcctcccaagtagctgggactacaggtgtgtgccaccacacctggctaatgtttgtattttttgtagagatagggtttctccatgttgtccaggcttgtcttgaactactgagctgaagtaatccacctgctttggactcccaaagtgctgggattacagatatgagccactgtgcctggcctgagagttcttagtttcaatcagtaagagaggta

SEQ ID NO: 35751 - DNA, 763 bp, Homo sapiens
  misc_feature (762)..(762): n is a, c, g, or t
gacggggatccggaaggcgttgtcggtgacatcacggagagggcgatttctatgtagatgaggcagcgcaggggctgctgctttgccacgaaagagttcccgtgccgtgggagcaagtctgggaccgctggtcggaccggagagtcgcagctgtgtgttagggctaggatggctccgggatgcgcgtgacgcaagtgaccttgcgtgtaaagggatacatgatcccttaattcaggctcaggctgaagaactgacccacttacgacagaagacacaggaagggagaggtgtctgctacctttttacccagcatgtgaagaacacagtcaagtcttttgagggccttctcaggaacactgacattgcctactaccagagacagagattctgtgagcaaatggtacaaggaagccagctgacagagatccttgtcagaaaacttgccacagaagatgagatccagagacagcggtagcacctgaaggaaacccttttcatcaacaactgcctgtgagaaaagctggaatgtcatctcagcagctttgatgaagaaaatggtgggagaggcccaagtcagtgcttctggcaatatgtatttttctaaagcatgcacctctaaactctacaggcacatcatagattccatcgtccagctgtataatgaaaacagagttctcagagaacaccggagactcccccgacttgcctgaatcaagtttctagaggtaacaactgatgttggaactatggagaacaactaana

SEQ ID NO: 35752 - DNA, 446 bp, Homo sapiens
tttcagggttatttatttatttatttattttcaggtcccaatagactgtccaaatcttttggggttagttcaggctctgtatatagtagaagctggtgttagaaaagttgatttataccggaatatttttcatagaatcacccccaattctcaccaacaaactgagaagaaaaaaaaaagaattacccccaagaacatctgaggaagcacaacagggacagacttgaaggtacctgggcagtcctctggttttggagtagaggtaggacagggctatttgtcctctcagagactggagcaggttctgtgtgtgagtagctatgggacaaacagtcatggtctggcaaacagcctgtggcaggaaggaaggttacaactggagaagtccaaagggcagccaggcaagtattctttgagctggggaacaaaagacattttaaactttt

SEQ ID NO: 35753 - DNA, 648 bp, Homo sapiens
ccacagacagtaccttagagtctaagcttaggtacctttgtcttgtttttgtggctaaggattctcagagttgcgggatgctgatgaaatttatcccaaaagatacatgatcccttaattcaggctcaggctgaagaactgacccacttacgacagaagacacaggaagggagaggtgtctgctacctttttacccagcatgtgaagaacacagtcaagtcttttgagggccttctcaggaacactgacattgcctactaccagagacagagattctgtgagcaaatggtacaaggaagccagctgacagagatccttgtcagaaaacttgccacagaatcacccccaattctcaccaacaaactgagaagaaaaaaaaaagaattacccccaagaacatctgaggaagcacaacagggacagacttgaaggtacctgggcagtcctctggttttggagtagaggtaggacagggctatttgtcctctcagagactggagcaggttctgtgtgtgagtagctatgggacaaacagtcatggtctggcaaacagcctgtggcaggaaggaaggttacaactggagaagtccaaagggcagccaggcaagtattctttgagctggggaacaaaagacattttaaactttt

SEQ ID NO: 35754 - DNA, 232 bp, Homo sapiens
cactgggtcttacctctggcattcctatcagagcctgaaccacagacagtaccttagagtctaagcttaggtacctttgtcttgtttttgtggctaaggattctcagagttgcgggatgctgatgaaatttatcccaaaagtaagttatgaatcagatctgctttcttttgactcatttaaatcctttgtttaatgtaaagaaactttattgaggtataatttacaaactat

SEQ ID NO: 35755 - DNA, 365 bp, Homo sapiens
tagatttgccttttctggacatttcatataagtagaatcatccgggatgtcatttttgactggctgctttaacttggtgtgctgttttccacactcatccattttgtggtatgtattactacagttggttctctgcattggtgcattctacatctggtgttcaaccacagattaagaatacttaaaaaactgcatctgtactgaacatatgcacacttatttttgtcattattccctaaccaatgcagtataacaactacttatatagcatttatactttattaggtattataagtaatctagcgatgacttaatatatgagagggtgtgcatagcttatatgcaaatactatgctgttttatat

SEQ ID NO: 35756 - DNA, 3085 bp, Homo sapiens
ccgcggcggcagcagcagcagcagcagcgagaggcagaggcggcggcggcggggaggacagcacggccgaggctgcccagaggcgcctcctccacaccccccgccgcagcagcaccggcgacagattttttaaaaaatggatttggccaaccatggacttattctactgcaacagttaaacgctcagcgagagtttggtttcctgtgtgactgcacggttgcaatcggcgatgtatacttcaaggcacacaaatcagttcttgcttcattctccaattactttaagatgttgtttgtccatcagaccagtgagtgtgtccgcttgaaaccaactgacatacagcccgacatcttcagctatctcttacacttgatgtacactgggaagatggcgcctcagctcatcgacccggttcgattagaacagggcatcaagtttctgcacgcctacccgctcattcaggaagccagcctcgccagccagggagccttttctcaccctgaccaagttttcccactggcttcttcattgtatggcattcagattgcagatcatcagttgagacaagccaccaagattgcttcagcacctgaaaaactcgggcgagatccacggccacagacctccaggataagccaggagcaggtccctgaggcctcacagctctcccagctgacttcaaatctggcccaggtgaatcggacaaatatgactccctcagaccccctgcagacctcgctgtctccagaacttgtttccactcctgttcctccccctcctcccggggaggagaccaatctggaagcatcttcctccgatgagcagcctgcgtccctcacaatagcccacgtcaagccaagcatcatgaagaggaatgggagctttccaaagtactatgcctgccacctgtgtggacggcgcttcactctccggagcagcttacgtgaacacctccagatccacacaggagtacctttcacatctagccaacagggagaaagtcgcgtccccctgactctctgtagcaatgcagctgacctcgggaaagatgccatggaagtgcctgaagccgggatgataagtgacagtgagctgcagcacatctctgattctcccatcatcgatgggcagcagcagtcggaaaccccacccccctcagacattgctgacattgacaacctggagcaggccgaccaggagagggaggtgaagaggcggaagtacgagtgcacaatatgtggacgcaaatttatccagaaaagccactggagggaacacatgtacatacacaccgggaagcctttcaagtgcagcacttgtgacaaaagcttttgcagggccaaccaggctgcccgccacgtgtgcctcaaccagagcatcgacacttacaccatggtggacaaacagactctggaactctgcacatttgaggaagggagtcagatggacaacatgctggtgcaaacaaacaaaccctacaaatgcaacttgtgtgacaaaacattctccactcccaatgaggttgttaaacattcatgccaaaaccagaactcggatgtttttgccctagacgaagggcgatccattctcctgggcagtggggactcggaagtaacggagcctgaccacccagtgttagcttccatcaaaaaggaacaagaaaccgtcttactagactgaatgtcacttatctttttaaaaaactctcatttttacaaagactatcttccctcccttccctgaattcagaactgtagttctccatggcatgatacaaacaggtccttgttctcttctcctcttccccttttccacatcccagccccacctctgtaaaggctttgtgcattataaacctggaatgtatcgactttctttcaggggatattggaaagataatggtcattatacttataaactcaaattttgagaggttttagattattcagaagcatacttggaactaatgaagggtatataataaaacaactggaatccaatttggtaagctaaaattatgactttccctgggtaaaaagtcttctcagaaaaacaatgtcagaaaataacagcgtgctgcttagaaatacggctgggctctgtactatgcaaaatctagaaagtgtggggaaactttaaacccaagaaaacgttcttagtattcatcctccaggtgtcttacttcagaatgcatcctttgagattatgtccacttaagagaaatcatcagttaagaaatctactttaacaaaacaaaaaggagaaaaagtaataatgtgatggcaatcttaatttttgggtacaacatgacaagctgtgagtttgtgtgtttgtaagagaaaaatgtgtgggtacttgctaataaacaggtgaattaatgcacatccttatctcattgctggcttctttccaagttgagcaacaacaaaatgctgtatttgagtttctgacaaatttgttttaaaaatcaaatttgaatgtactattctataaattgcctttctgaatagaacatgacatgccattttctagcagctgccagtgataatttgttttacactaacttttaaatcagtgtgtgtactgcagggaaaaggatataggaatactcatcttacaggggaatttgtgaccagaagatgtagtaacttcaatgactgaaagtcaatgctgatagtttactggcaacattaattgaagcatcaaaaataaatggcaaagagaaatcaggacaaaaaatctaattgctgtttgggaaaaaacttgattttgatgtttattctccaggtttttggttgtttttttttctttcttctttcttaatgcctgaaattttctccattggcccgaaagcagtaaaaattgttcattaatcttccgttaggccaataaaagaagggcctcacaagacaaaacaggagccagaagtaaggactgaaggagaaggggagaatagctaatagctatagtatatgtatatgttaaaaactgaatatcccatcatcctatttcatgtatagttgagttctcaaatttgtaagtttttatacatcctttcattgaataaacgtttaattaaatgag

SEQ ID NO: 35757 - DNA, 3164 bp, Homo sapiens
ccgcggcggcagcagcagcagcagcagcgagaggcagaggcggcggcggcggggaggacagcacggccgaggctgcccagaggcgcctcctccacaccccccgccgcagcagcaccggcgacagattttttaaaaaatggatttggccaaccatggacttattctactgcaacagttaaacgctcagcgagagtttggtttcctgtgtgactgcacggttgcaatcggcgatgtatacttcaaggcacacaaatcagttcttgcttcattctccaattactttaagatgttgtttgtccatcagaccagtgagtgtgtccgcttgaaaccaactgacatacagcccgacatcttcagctatctcttacacttgatgtacactgggaagatggcgcctcagctcatcgacccggttcgattagaacagggcatcaagtttctgcacgcctacccgctcattcaggaagccagcctcgccagccagggagccttttctcaccctgaccaagttttcccactggcttcttcattgtatggcattcagattgcagatcatcagttgagacaagccaccaagattgcttcagcacctgaaaaactcgggcgagatccacggccacagacctccaggataagccaggagcaggtccctgaggcctcacagctctcccagctgacttcaaatctggcccaggtgaatcggacaaatatgactccctcagaccccctgcagacctcgctgtctccagaacttgtttccactcctgttcctccccctcctcccggggaggagaccaatctggaagcatcttcctccgatgagcagcctgcgtccctcacaatagcccacgtcaagccaagcatcatgaagaggaatgggagctttccaaagtactatgcctgccacctgtgtggacggcgcttcactctccggagcagcttacgtgaacacctccagatccacacaggagtacctttcacatctagccaacagggagaaagtcgcgtccccctgactctctgtagcaatgcagctgacctcgggaaagatgccatggaagtgcctgaagccgggatgataagtgacagtgagctgcagcacatctctgattctcccatcatcgatgggcagcagcagtcggaaaccccacccccctcagacattgctgacattgacaacctggagcaggccgaccaggagagggaggtgaagaggcggaagtacgagtgcacaatatgtggacgcaaatttatccagaaaagccactggagggaacacatgtacatacacaccgggaagcctttcaagtgcagcacttgtgacaaaagcttttgcagggccaaccaggctgcccgccacgtgtgcctcaaccagagcatcgacacttacaccatggtggacaaacagactctggaactctgcacatttgaggaagggagtcagatggacaacatgctggtgcaaacaaacaaaccctacaaatgcaacttgtgtgacaaaacattctccactcccaatgaggttgttaaacattcatgccaaaaccagaactcggatgtttttgccctagacgaagggcgatccattctcctgggcagtggggactcggaagtaacggagcctgaccacccagtgttagcttccatcaaaaaggaacaagaaaccgtcttactagactgaatgtcacttatctttttaaaaaactctcatttttacaaagactatcttccctcccttccctgaattcagaactgtagttctccatggcatgatacaaacaggtccttgttctcttctcctcttccccttttccacatcccagccccacctctgtaaaggctttgtgcattataaacctggaatgtatcgactttctttcaggggatattggaaagataatggtcattatacttataaactcaaattttgagaggttttagattattcagaagcatacttggaactaatgaagggtatataataaaacaactggaatccaatttggtaagctaaaattatgactttccctgggtaaaaagtcttctcagaaaaacaatgtcagaaaataacagcgtgctgcttagaaatacggctgggctctgtactatgcaaaatctagaaagtgtggggaaactttaaacccaagaaaacgttcttagtattcatcctccaggtgtcttacttcagaatgcatcctttgagattatgtccacttaagagaaatcatcagttaagaaatctactttaacaaaacaaaaaggagaaaaagtaataatgtgatggcaatcttaatttttgggtacaacatgacaagctgtgagtttgtgtgtttgtaagagaaaaatgtgtgggtacttgctaataaacaggtgaattaatgcacatccttatctcattgctggcttctttccaagttgagcaacaacaaaatgctgtatttgagtttctgacaaatttgttttaaaaatcaaatttgaatgtactattctataaattgcctttctgaatagaacatgacatgccattttctagcagctgccagtgataatttgttttacactaacttttaaatcagtgtgtgtactgcagggaaaaggatataggaatactcatcttacaggggaatttgtgaccagaagatgtagtaacttcaatgactgaaagtcaatgctgatagtttactggcaacattaattgaagcatcaaaaataaatggcaaagagaaatcaggacaaaaaatctaattgctgtttgggaaaaaacttgattttgatgtttattctccaggtttttggttgtttttttttctttcttctttcttaatgcctgaaattttctccattggcccgaaagcagtaaaaattgttcattaatcttccgttaggccaataaaagaagggcctcacaagacaaaacaggagccagaagtaaggactgaaggagaaggggagaatagctaatagctatagtatatgtatatgttaaaaactgaatatcccatcatcctatttcatgtatagttgagttctcaaatttgtaagtttttatacatcctttcattgaataaacgtttaattaaatgagtatatgatgtcatgtcatctctgcgtctttgtctacccaaagagatacaggaaggggatgtgtagtggagcagtgcttg

SEQ ID NO: 35758 - DNA, 1439 bp, Homo sapiens
ccacccatcaacctctacggctgcccctcatttgaacacacaaaatatagttgtgcggcttggtggagccatctaaattccgttaggccatttgccaatgctgctattaggggcgaaatgtcatgcgcttgatctaaatgtacttaggagaattctcaggacctgatgaattattattcggaattttatggcctcacaggttgcaggcttcataccaactgcagctaatgagctatgggccccgagaaacactgaggacacacggcgttctgcacacagagtgggctgtttctgtctgttctccccctgcacccttctcagatgcaatctcaagtcataggagaacttgtgcaaatgtttctcctggatggtttcctttagagcatgtgtcctataacttgaaatggttgtctgagcagaatgtttttagaagttagatttttttaggggggaaacaggaaccaaagcaaagccaatagagatcttgaaaaaaaaaaaaaaaagaaaaaaccaccgtggtattctaggaagaaaaaagcatttttcgaatgaaaactttttattatatttgatatattctgcttcccttccctagtatgtattaatgagatgaaatcacttcttaattttcaggttaatattaaagttgaagcccatccctctaccctgaggactctgccagcctctggcagtattcctttccaacttccacttgccccaaataggtagaagttagcctttatttttggtgtcatgtcttctttccctcctcctatcagtttttcagaaactccagaaatttaacctagtacacaggggccccccacccctgtttccagatgccttctagaaagaggactgggagtgtgaatgaggccatgtgggctttgtttgaccctgtggttgtcatgacaatttctcaaagcttagctgggacaggaagaaggaaggggaggatagcggtgtgttcagtgtgtgagctcctaaaagctcttgggtcactgttcccaggggatgatgaccctctatggcagatcagttgcatgtgcatatgagctttccctcctcccgtgggttagcatgttccacactcaccttctcaaagcaaagtctcccttaggggacccttggtatcctgttcatctggcaaatctcagcaccaatagaaacaccaagaacatggattcatcaaaggaaaaatgttgaagtttccatttttatgcttcctggtaatccttcagcccttgatggaaatttccagacctaaaccagtgaattaagagtatggggaagaggagccctcatacagttctgttaaatggtcctttaatattcttcttcagagtgacgggtaccccttgcctatacattttcaaaactacactgaaatttcaaaacatttctatcagaacacagtcttattctcagctgatctgcaa

SEQ ID NO: 35759 - DNA, 1093 bp, Homo sapiens
cctgaggaatcttgtgatctatgaccttacccccaacctgtgctccctgaaatatgtgctgtgtccactcagggttaaatggattaagggcggtgcaagatgtgctttgttaaacagatgcttgaaggcagcaggctccttaagagtcatcaccactccctaatctcaagtacccagggacactaacactctgactaggaaaaccagagatttttattatatttgatatattctgcttcccttccctagtatgtattaatgagatgaaatcacttcttaattttcaggttaatattaaagttgaagcccatccctctaccctgaggactctgccagcctctggcagtattcctttccaacttccacttgccccaaataggtagaagttagcctttatttttggtgtcatgtcttctttccctcctcctatcagtttttcagaaactccagaaatttaacctagtacacaggggccccccacccctgtttccagatgccttctagaaagaggactgggagtgtgaatgaggccatgtgggctttgtttgaccctgtggttgtcatgacaatttctcaaagcttagctgggacaggaagaaggaaggggaggatagcggtgtgttcagtgtgtgagctcctaaaagctcttgggtcactgttcccaggggatgatgaccctctatggcagatcagttgcatgtgcatatgagctttccctcctcccgtgggttagcatgttccacactcaccttctcaaagcaaagtctcccttaggggacccttggtatcctgttcatctggcaaatctcagcaccaatagaaacaccaagaacatggattcatcaaaggaaaaatgttgaagtttccatttttatgcttcctggtaatccttcagcccttgatggaaatttccagacctaaaccagtgaattaagagtatggggaagaggagccctcatacagttctgttaaatggtcctttaatattcttcttcagagtgacgggtaccccttgcctatacattttcaaaactacactgaaatttcaaaacatttctatcagaacacagtcttattctcagctgatctgcaa

SEQ ID NO: 35760 - DNA, 350 bp, Homo sapiens
acatggtaaaggatactttgccattaagaatacaaactttgagatgaggacgttatcctagaatagctgagtgggccagtctaattaaaggagctcttaaacgtgcatatcattttctggctgaggtcagaaagttgcaacatgaaaagtagtccaccccctgttgctggctttgaagatggaaaaaggaagccatgtaccaggaaccctatagtttctggaagctgtgaatgagccttgatttctacagcttgcaaaactgtaaataaggccgatagagacctcagtcctaaaatcaccagaaactaaatttggctaataaccccaataaaccagcaaccaattctccc

SEQ ID NO: 35761 - DNA, 1199 bp, Homo sapiens
gcaaatttaaatgtggtacattctccaaccatcagatagacaaaaacttaaatctaacaatgtaatgggaactctgcctctgcaagtgggattgaaaatggatataacctgctttggagaacgttaatgtctaatgaagtttgaggtgtacataaccctatgatcatgcaattccacttttaagatatatatatactttagagcaggggtctgcaaattacagtccatgggctaaatcctaccctctggctgtttgtgtaagtttttattgaaaccgtgcccacttatttatatagctgctttcacactacagtagcagagctgaatagttgcaacagggaccatagggcctgcaaagcctaaaatatatactatatactctctgactctttacagaaaaagtttgctaacctctacctttgagtaattcttacatgtacaaggagacatgtacaaggatttttttgatgcacacttgcttatcatagaaaataattggtctgtaaacctgtccatgaacagaaaattgatagatatattcaaacaacagaatgctatattgcagttaaaagtggattaagtaaaattacatatactcataaggattaatattaaaaacaataggccaagcgcggtggctcacgcctgtaatcccagcactttgggaggccagggtgggtggatcacctgcctggccaacatggtgaaaccccatctctgcaaaaaatacaaaaattagctgggcatggtggtgtgcgcctgtaatcccagctcctcgggggcctgagaatagcttgaacccaggaggcggagattatagtgagccaagattgcaccactgcactccagcctggacaacagagcaagactctgtctcaaaaaaaaagaaaaactgatgaacaaaaaacattgcagacagataaatgtacagtatgtaatatctatataaagatttaaaatatttacattttaggagtacttgaaaagttttgttctgtaatgtcttgatttttttttttttttaatctagagcaactataagggtcaggtggagtggctcacgcctgtcatcccagggctttgggtggctgaggtgggagaatcacttgagaccaggagtttgagatcagcctggacaacatagtcagaccccatctctacaaaaaaaatttttttaattagccaggtgtggccaggag

SEQ ID NO: 35762 - DNA, 1381 bp, Homo sapiens
gtatagtctgagtattaagaatatctgagatctgtattaaaaacagatgtaggccgggcacagtggctcacgcctgtaatcccagcactttgggaggccaaggcgggaggatcacctgaggtcaggagttcgagagcagcctggccaacatggtgaaaccccatttgtactaaaaataccaaaaaattagccgggtggggtggtggcgcacctataatcccagatactcggtgggctgaggctggagaattcctgaacccaggaggcagaggttgcagtgagcagagattgcgccattgtactccagcctgggcgatgagcgaaactctgtctcaaaaaaaaaaaaaaaaaaaaaaagatgtaaaaaaaaaaaaagaatatctgagatatagcaaagtttttctcatggatgaataaaaatactgaactgggcctttaaaaaagtacagaaaattgcctgtcatagaaatgcagcagtagggtcaaatgagctaaatctaaatctcatttaatgaaaaaggcactttccttttatttttgaaggatggtctaacctagtttttggaattcatttgttctgcaattaaaagagatttttaggtggttcatttaattatagctgttttggaaatgggaaggaaaataatgtgagagagagattaactgcatttgcttctgtggaaagtcagtagtcaaaaggagagtctggattatttatttatttatctaaaaatatggaacacttggtgaattttaaccttatctttgctcagaggatgtactaatctctgtgttctaattttttagtatatgtgctgctgaagcaaacacacagattatttttttctgttcttaagttttttggaggaaagctatttactataggtcttaattaaaaactatattctgtatatattgaaatgtgcagaaccctgctgctgctgtttttcgttacccagaatgtgcttacatctctctactatcatcttctctccctttgttttagcccttggggtttatgtttttttattcctttatttcatttttttctgaggttttggaagggaatggagaatggggtgtgttcattctgcctggctggttgattttatatagaaattgatgttttcatctctaagggacaaagaaaattaggaaaatatcctagttttatttttattgtggtaaaatacacattacatacagtttaccattttaaatattgttaagtcttcagttcagtgacattaagtacatttaccttgttatgtgaccattaccactatcggtctctagaactttttcatcatccagaactgaaacttgtacctattaaacaataattatccatttcacctcctccctgctctggtaactacta

SEQ ID NO: 35763 - DNA, 477 bp, Homo sapiens
  misc_feature (410)..(410): n is a, c, g, or t
taattcattgcttgctaattgggtctaaatattctgagaatgctcaagtgtagggcaaaaaacaaacacaccatgaataatggataatagttcagcaaacattattagatatgaaacagagaacataagataaaagacagaagtgccaagtttaatagaatcaaatgcccttcataattcattgagttacttctttagttttgatgctagaatgcttagaactaagtattttgcacaaatctccttaatgacatcgtgggttttaatctcttaatgggtcagttatagtatttgttttattgtaagctgcctcaatgcctttctaggatcaagtaaggaataaatatgcaagtgtaaaaaatgaatgtcaggctgggattacaggcgtgagccaccgcgcttggcctctntctttctttccgttttttttttcccctggggagaggggagcacctaggaggaaatgtgtgagactga

SEQ ID NO: 35764 - DNA, 700 bp, Homo sapiens
gtatagtctgagtattaagaatatctgagatctgtattaaaaacagatgtaggccgggcacagtggctcacgcctgtaatcccagcactttgggaggccaaggcgggaggatcacctgaggtcaggagttcgagagcagcctggccaacatggtgaaaccccatttgtactaaaaataccaaaaaattagccgggtggggtggtggcgcacctataatcccagatactcggtgggctgaggctggagaattcctgaacccaggaggcagaggttgcagtgagcagagattgcgccattgtactccagcctgggcgatgagcgaaactctgtctcaaaaaaaaaaaaaaaaaaaaaaagatgtaaaaaaaaaaaaagaatatctgagatatagcaaagtttttctcatggatgaataaaaatactgaactgggcctttaaaaaagtacagaaaattgcctgtcatagaaatgcagcagtagggtcaaatgagctaaatctaaatctcatttaatgaaaaaggcactttccttttatttttgaaggatggtctaacctagtttttggaattcatttgttctgcaattaaaagagatttttaggtggttcatttaattatagcttgtaaaaaatgaatgtcaggctgggcgtggtggctctcacctgtaatcccagcactttgggaggccgaggtgggcggat

SEQ ID NO: 35765 - DNA, 199 bp, Homo sapiens
cagtcaaaggtagaaaactgggattttagtcatgatgtctgcacagagtgggagctgcatatgtggagttggcttttagtagctggtagtggggccagccctaaagcatgaatctgggaataaaggtcccattttgctacaacttggggaagactttaaccctaatgtcttctagaaattcactgcatcagaatttatg

SEQ ID NO: 35766 - DNA, 392 bp, Homo sapiens
aaacattcctgcatttaatttgttggtggcagtgtccttatatgacaaaaccagtctcacaattcattataaacaataacctcagccgggcacagtggctcatgcctgtaatcccagcactctaggaggctgaggcaggtggattacctgaggtcaggagtttgagaccagcctggctaacatggtgaaaccccttctctactaaaaaaatacaaaaattagccgggcggcagtggcgcgtgcctgtaatcccagctacgtgggagactgaggcaggagaattgtttgaacctggggaggcagaggttgcagtgagctgagatcgcaccactgcactgcaacctgggcgacagagcgagactgtctcacaaacaaacaaacaacaacaacaa

SEQ ID NO: 35767 - DNA, 296 bp, Homo sapiens
taaaaattagccaggtgtggtggtgcacctgtagtcccaatggctcaggaggctgaggtgggaagattgcttgagcccaggaggttgaggctgtagtgaaccatgattgtgccagtgcgttctagcctggatgagagagtgagaccctgtcttaaaaataaagaatattttttcttggctgggagcagtggctcatgcctataatccaaggactttgggaggctaaggcaggaggaatacttgaggccaggagttcaagccagcctgggcaacatagcaagaacccatctctaccc

SEQ ID NO: 35768 - DNA, 445 bp, Homo sapiens
atattattcaagtattgactcagtctttctgaggtaggtacaattagtatccattagagataagaaaacagacacaagaaaattaaatcacttgctcagggtcacgtagctaataaatggtggagctagatttagaaaccaggcagtctgggctgggcgtggtgtcacgcctgttttccgagccctgtgggaggcccaggccggccgattcacgaggtcagggatctaagaccatcctggcttacacggtgaaaccccgtctctcaaaaaaaaaaaaaaaaaattagccaggcgtagtggcgggcgccctgtaatcccagctactcgggaggctgaggcaggagaatggcatgaacccgggaggcagagcttgcagtgagccgagattgcaccactgcactcctgcctgggcgacagagcaagactcagcctcaaaaaaaaaaaa

SEQ ID NO: 35769 - DNA, 336 bp, Homo sapiens
ggatagggttgcctcattgcacaatttcagggggtaccactgacattatgatctatgtgaatgatacccctggaattgtgtagttacatctataagactaattggcagctttgggattgaaccagttttaggaagtctgttacaacttgataaaataactatttaaaaaattctgagcaaaagtttactattatagctatttatgtaactatttacattttacattgtttaaattttacatttatttttatattttacatggtttacaattttagtttttctcttttaatcccaccacaatcctgtaatataggtaggttaagatgtgtagtagtt

SEQ ID NO: 35770 - DNA, 560 bp, Homo sapiens
tatgccagggatcacagcaggcatgaagatacaaagtgaaatgagaccagtccctgcccatgaacaggcagcatgacaacatgatggacagagcacggattttctgagggatacagccaggtcccacccctaattagcttcttgagctcagctaagttcttaaaacttctctgagccttgattttctcatctgcatgatggattattttataggttgaccactcgtcctggtttgcctgagactgaagggcatcctgggacacagaacttccagtgctaaaacccagaaaatcccaggcatatcaagatgagttggtcacttagaggacagatgaattgaaatgacatatagaaatggactcacactgtgccctgcatctaatagctgctctataaatgtagtcacacaaaaacgtgctcctcacatggtaaaagaaaaataaaatgaaacaaataggtgagtgcaaaataattgcagtttttgaattgttggaatttgctgtataatactggaatacattcttaaataaatgtggttatgttatacatcaaaaaaaaaa

SEQ ID NO: 35771 - DNA, 401 bp, Homo sapiens
gcgatggagttttgctcttgtcttgcaggctagagtgcagtcgtgcgatctcagctcactgcaacctccacctcccgggttcacacgattatccttcctcagcctcctgagtagcacaggcatgcaccaccacgcccggctaatttttgtatttgtagtagagatggggtttcggcatgttggctaggctggtctcgaactcctgacttcaggtgatccacccgccttggcctcccaaagtgctaggattacaggtgtgagccacagtacccagcccaaatgacttatttctaagagctactaggaaatgtcaccctaagaagttggaggagaaggctaaaatgagttttgtggagtcatgtgcaagtaagttatttatgagtgttcttatcaccaggtac

SEQ ID NO: 35772 - DNA, 342 bp, Homo sapiens
ttgagtccttcatgtctattgttccggcccaaattgccatgcaaaatcagagttagaggaattggagtggctgatgcctccagcagattgacttgaaattcaacaaaaattcctgtcccctcattaaaaaaaaatcttaattcctttcatgtaccattgtagattctttagattattttattcattataatcttataaagccagaatctatatggtccagtctctcagtgcagggtcaaatagacaggtcaatatccaaatgttcattaaaaataattttgtttgtcaggagatcgagaccatcctggtgaacacggtgaaacccagtctctactaaaaata

SEQ ID NO: 35773 - DNA, 931 bp, Homo sapiens
tggggttataaagatcataacatttatagccccagactgacttgtaagcagctgcatttaaagtacttactcagacactcaggcctgagagatagacccctttctttccagcactagctgaaataatcaagtatatagtttgttcaggattggcactaaatgtgatttaatcttttaataaaagggtccttttgtacccacttaggcttcttcgtaattaccagaaaggtgataagcctgcatgtgtctggacaccaaagattgagaagctgccagtggctgcaagagagcctactgtaaccctcatggccaccccctgatgagtgttacctggggaaagggctagcaagaggtgaagcctcctggtcatatgatgctgggggtgcctaattccttaaaggccaaggtcttctgaaataataatggtgaaggacagaaaagtctttatgagaaatcacataggatatattaagataatgataaagatacctcagcaagaacatacctaatatatacacttcttttaatctgatgacttaatgatttctgttatcaagaagtatttatgacttgagataagtcaggattaactgttatcacctctcctgtacacctccctcctttttctcctttgtacccacatgtgcagattttttcagaggtgacaatttagcatttaatgtttttttttctgcttcaagttcttaggtccctttggaggatattgatgggggtggaggtggggatagaacatctttcacactgtttggtacagagatgctcaaagcttttcccagggaaaggaactctctaaaatagtaatctgatttgatgaaagataaaattttaatatagcttcagttaaccttcaggatactttaaatgctacattgtatataaaagtaataaagtacaaatgaacacgaagact

SEQ ID NO: 35774 - DNA, 392 bp, Homo sapiens
cattattgaaagaaaataagagtataatgatgaggtaatatggcaaagggcatgctggtgttcagtgtcactcagctgcttcttgaatttccacagagcagatgattcaaatccaggtatgttttctgaaatatatacagatagaattaataatcactaatccagtataaaacatctgctaaatgccttttgagccatattccaggaagtacagattcggactttttccatatatagtccactcatttcacctctatagtaaagctggatattggtatctgtacactctggcaaaactctcagattttagttgtgagcaagagttatagagtggcattagaaagcatggttagtgctaatcatgctatgtagtaatttggcaagtagtcttc

SEQ ID NO: 35775 - DNA, 654 bp, Homo sapiens
cattctgaggtgtactgtgggttaagacctcaatatatgaattggggcgtgggtgggacataattaagtccataacagtgattctttgtgggtagtctttcttacaaatacaaaagtgtgggtattttctccgcgttgctgctttccaggagcacaggctcaaataaagttcaacgtcatgaggacagatgttatcatttctcttgtgtatattcctagaactggaattactgggttacgtttaacattttaagaagccatttgccaacatatctgcaccgttttaacttcccaccaataatattaaaggattccagtttctccactcccttacgctcatgaatgctttcttttttatttcagccattctggtaaaagtaaatggatatttcattgtggttttaatttatatttctctagtgattaatgatgttgaacacctttttcatgtacttgttaaccatttgtatatcttctttagtgaaatatctcttcaaatccattgcccatttaggagttttaaaaatatattctaggctgggtatgatggctcacacctgtaattctagcattttgggaggctgaggtgggcagatagcttgagcccaggagtttgagaccagcatgggcaacataagcaaaactccatctcta

SEQ ID NO: 35776 - DNA, 459 bp, Homo sapiens
agaagctgggcagaagctatttgtcttctgtccactcctaggttccttagcccctctcctttgtactcacagaagcatttcccctgaagatgtagcctggcccatgccaatcaaaccaggacagagagaagctgaggagtccttgccctgtccgactcttcccgccccagcctcagcaggtgaagctcggaattagtcttgcaggtctaaatgagagatgcagaaatctaggactaatctctaggctgtattgtgctgcactggccccttctgtacgactgtgtttatgccttggacttccattgaacacatcagttcctgaagtcttcctttttcttatggactgaattgcggccctccccaccaccaaattcatttgttgaagccctaacccacagtgcgactgtatttggagatagggcctttaaagaggtcggtattaaggctgggtgcagtggc

SEQ ID NO: 35777 - DNA, 373 bp, Homo sapiens
gcgtcgaccaaaaccaacaacaacaaaaatgccagggtgtgtgagggagtgaattcccaccctgagttgtgggtcccaccaatgcattgtcccaggccctttagcctcctgtctcccactttctagacactgtttgactgtacaagccactgtgtgctgctgccttggactggagagaatccgcccagcaggcggccagctggcatagtggcagccgtccctctgttactgtagctgatgtgcagctgttagtgctggccccagattctgctgagcatctgagccccctgcagaagggatgatgttgtcagaaggtggtgcctgccaaacagccaccttgctgccctcccagtcttcccgctgtcctcttcct

SEQ ID NO: 35778 - DNA, 251 bp, Homo sapiens
ttctttttaagaatatagaagtgaaaatacagagccccagatatcaagaacagacattaattcaaagaatttattatagggtagggctgataatcaactatcctataaaaatcatattattgcataaaaactaaattatttttctttctacacatcctgaattcaatttacagataatcagcatgtatttctctctcttaaaactgctctgttatctctagagaaataatttaagaatgtattcctataat

SEQ ID NO: 35779 - DNA, 243 bp, Homo sapiens
gagcttgaaaatacatgccttagtacttcattaacttcctcagagatcatcaggaaggtaaatcttaggatcaaagtgggtttcaagatcatctaatccaagactctcaattcacaagtgatgaaaccgaggcccgggagactcaaacattttacaaccaaaatgtctgccatctgtacctatcccaaggtcccttgttagcagcagataaatgaggcttgtccaacccagttctcctgactg

SEQ ID NO: 35780 - DNA, 398 bp, Homo sapiens
gtttctactgacttgtaaagagagcaaaatctgctgaaatattttgttaaacttttaatgccaaccttgaaaaggaacatattaaccagttaccctgtgataagaggatgacttgccatttttcttagaatctagtaggcagtcttgtggccctgaaacatgtgggggtggctttttgctaaattgactgtacctctttcaatgggaaggagctatggaaaggaccatgtagcttataaacgcattaggaccttaaattaagttgttgaaccacgagcatgacagtctttaacaaactaagcagtgatcttgtaaatcttctcatactgcctcataccctctcatctaggtcactagaaaaatacttttaaatgtatccttaacacaataaaaacaaa

SEQ ID NO: 35781 - DNA, 391 bp, Homo sapiens
gagcattacttgtgtacaagcctgtatgggtccagcattttccgatgaaaacaagatccacccagcgggagcttctgctgggccagaccaactccaggtagctccctgctgggcagtggctggtgccaaaacagggcacacggctggagcaggtctccctgtatggggttatctgccagagcacagagctgcagaaccggccagcagcaggccaaggcctcggtgacaagctgcccccagcagctcctgcctccagcctccaggcccggcggagtcagctgccgcacctggtacttcatttacagatggaagctggcatctctcagaggtcttcagcctctggaaacaggcccaggggactgaccgaccctcagcatttgatgttggcaac

SEQ ID NO: 35782 - DNA, 621 bp, Homo sapiens
tcatttttaaaaaaattgtttaatgaaaaaaaaattaacttacatttttcttaaaagtaacaatttaatgatatgtattttctgtgaacattcaagaaatagaaatcaccaagaaaaaaataaataaaataatttgttattctgccattcagatctaaacaatgttattttggtgcttaaatcttcagaggttttttcgtatattcacttcaaatattatttaccaacaatggaagtttatttatttatttatgtttgtttgttttttttgagacatagtctcactctgtggcccaggctggagtgcaatggcgtgatctctgctcactgcaacctctgcctcccaggttcaagcaattttcctgccttagtctctcgagtagctgggattacaggtgcctaccatcatgcccagctaatttttatatttttagtagagacagggtttcgccgtgttggccaggctggtctcgaactcctggccgcaagcaatctgcctgcctcggcctcccaaactgctgggattacagacgtgagccactgtgcccagcctgtatttgtatatatgcagttttgtaacttacttcttccacttacaaaatgataaattttccatgtcat

SEQ ID NO: 35783 - DNA, 554 bp, Homo sapiens
actcagaggttgaaagagggagcaaaggcgaatgggggccacaagtgtggagtttaagtgaccaccatcctgagcacatatcagctgtgctcctccaccatggaagtcagttcctggctacacccctcatgggaaggtgggtctccaggcctccctcaagtgcaaggtgagttgaaacatctgtagctgcttaccttttggtgccactaggatctgagtagcaaatattctttttaaaaatgtgggggaggatctacaaagtcaaagtcagctgtattaataatcctgtagccagcaggtctcaaagaaatatttctggaaaggatagggaagctgatgtcagggcggggcagtcctcagagcagtgagtctaagtggatattgcttggctgaggctataggttaaggggcagccttatcacctgggaacatctgcagatgaactaaagccaggaggatgcctaaacccaggggctaggagcagagaagagatgaggaaacaggagaggaggcaaagggaatttttcagttaaatcagtcagggaatcatagtg

SEQ ID NO: 35784 - DNA, 846 bp, Homo sapiens
tactgacttgtaatgccacttattgtcatgtattagtgatccattataaacaaatgtcctgagttttctattctgttccatcggtatatatgtttatatgtctatactatactatcttgagtattaaattgaaagtaaatttttatatccagtagggaaagatccctgttgttcttcaaaattgtttttgctattcttgatattttgctctttaatatggactttaaatcagcctaactccaaccaaaaccagacagaggtaaagagaccagagctcccttatttccaccgtgtaaggatacaaggataagatagctgttgtaaaccaggaagagaacctttaccaagaaccaatcatgctggcaccctgatcttggacttccaggcctcagaactgtgagaaataaatgtttgttgtttaagccacccagcctctgggattgttatagcagaaggttctttgatagctatgcatcacccttttatcagattgaaagttctcttttttttctcgagttttctgactttacttggtttgacaggattagataaggagttggataagagagagaaggtgaagaagaggggaattttaaatgaccaccaagtttctggactagtgagtagatgaatggagatgtcattcaccaaaattttgaatggaataagaaaaacagatttatgagggaggactggttaaatttgaggtattggtgggacattcaaataaagatatcctataaaatcgtgctgtccaatatagtaccctcctcacatgtggctattcagcatttgaaatgtggctagtccgactgggcagggtggcttatgcctgtaatcccagca

SEQ ID NO: 35785 - DNA, 430 bp, Homo sapiens
aaacaaaactgatcaaaggttaataattcattgaaaattatttggaagcatctatatgtgggtgatctttttcttactggggactgttgattggagtttcaataggtcactctcatgagtttcaatacagccactccttaccttataaattgataggctggattgagctgaaacattctagcactttgagaggctgaggtgggcagattgcttgagccgggatattgtgaccagcctgggcaacatggtgaaacctcgtctcataataatacaaatattagcagggcatggtggcatgtacctacctgtagtcccagctgcttgggaagctgaggtaggaaaatcatctgagccccataggtagaggctgaagtgagctgagatcatgccactgcactccagcggggcactggagtgagatcctatctca

SEQ ID NO: 35786 - DNA, 598 bp, Homo sapiens
atggacttggatgagccaaggaggaaatcctgcagatggcccaataagtggattatgtttgacttcagataagtaggacaagctagggagccagaaggttttattagttttgtttcactttccacaaaaccaccaaggtcccatctccaacagaacaggatgtgtgactgttccttgagtaaaaaaacaggaaactggacaaatcttgagagatcatcattaattagtacttctttagttgatttcttaatatggaggagcatgtagattattaataatgcttttgttcttgagttaagtgaaggagtcttaggtatttgttgactcattaaataaatcaccaacatgtagtagactcaaataagaaacataaaagtgatatacatttagataaatgattatagtgctttatgcttgtagtgcttcatgaatcgatagtatgattaatccaattgtgctcgtagtgttctttacaacaataactaagtttaaaatagaggaaacaatctcaactctcattaggatgattgagggataggggaaatgcctgtcacgttcatgtcaagtaggatttatcccctcacccctgttgctataa

SEQ ID NO: 35787 - DNA, 2263 bp, Homo sapiens
aagggcgcgagggcaggccgggctaacgtctgctcctgcgccgccgtcccacgggcatcccccccgtgtgtgcccagttgttcccgaagctttaggatccaagacgctgggggcaaccattttccttgcccgccgccccctcacgcttccctgcctctcctcctagcctggtcacgggctgtcccctcctccagcaatgcaaccctataataaacaagtctttccttgatcctcccctgccgcgagcgccctcggggaccttggcagctgcagccgccgcggatcctttccagaaagggggcgtggcggtgggtcggggttcgactgcgagctttctggggctcaatggaggcggggcccggccgctgtcaccgggcaggagagaacgttgcttacgtgcgcccggagtccattggccaaggcgggccacactcccgggtctggattgggtcgtggcgcagagaaggcgtggcctcgccgcgctagtccttataggctgctccgcgctggtgctagggggcagcaggccaagggggaggtgcgagcgtggacctgggacgggtctgggcggctctcggtggttggcacgggttcgcacacccattcaagcggcaggacgcacttgtcttagcagttctcgctgaccgcgctagctgcggcttctacgctccggcactctgagttcatcagcaaacgccctggcgtctgtcctcaccatgcctagcctttgggaccgcttctcgtcgtcgtccacctcctcttcgccctcgtccttgccccgaactcccaccccagatcggccgccgcgctcagcctgggggtcggcgacccgggaggaggggtttgaccgctccacgagcctggagagctcggactgcgagtccctggacagcagcaacagtggcttcgggccggaggaagacacggcttacctggatggggtgtcgttgcccgacttcgagctgctcagtgaccctgaggatgaacacttgtgtgccaacctgatgcagctgctgcaggagagcctggcccaggcgcggctgggctctcgacgccctgcgcgcctgctgatgcctagccagttggtaagccaggtgggcaaagaactactgcgcctggcctacagcgagccgtgcggcctgcggggggcgctgctggacgtctgcgtggagcagggcaagagctgccacagcgtgggccagctggcactcgaccccagcctggtgcccaccttccagctgaccctcgtgctgcgcctggactcacgactctggcccaagatccaggggctgtttagctccgccaactctcccttcctccctggcttcagccagtccctgacgctgagcactggcttccgagtcatcaagaagaagctgtacagctcggaacagctgctcattgaggagtgttgaacttcaacctgagggggccgacagtgccctccaagacagagacgactgaacttttggggtggagactagaggcaggagctgagggactgattcctgtggttggaaaactgaggcagccacctaaggtggaggtgggggaatagtgtttcccaggaagctcattgagttgtgtgcgggtggctgtgcattggggacacatacccctcagtactgtagcatgaaacaaaggcttaggggccaacaaggcttccagctggatgtgtgtgtagcatgtaccttattatttttgttactgacagttaacagtggtgtgacatccagagagcagctgggctgctcccgccccagcccggcccagggtgaaggaagaggcacgtgctcctcagagcagccggagggaggggggaggtcggaggtcgtggaggtggtttgtgtatcttactggtctgaagggaccaagtgtgtttgttgtttgttttgtatcttgtttttctgatcggagcatcactactgacctgttgtaggcagctatcttacagacgcatgaatgtaagagtaggaaggggtgggtgtcagggatcacttgggatctttgacacttgaaaaattacacctggcagctgcgtttaagccttcccccatcgtgtactgcagagttgagctggcaggggaggggctgagagggtgggggctggaacccctccccgggaggagtgccatctgggtcttccatctagaactgtttacatgaagataagatactcactgttcatgaatacacttgatgttcaagtattaagacctatgcaatattttttacttttctaataaacatgtttgttaaaaca

SEQ ID NO: 35788 - DNA, 1165 bp, Homo sapiens
  misc_feature (1141)..(1141): n is a, c, g, or t
aagggcgcgagggcaggccgggctaacgtctgctcctgcgccgccgtcccacgggcatcccccccgtgtgtgcccagttgttcccgaagctttaggatccaagacgctgggggcaaccattttccttgcccgccgccccctcacgcttccctgcctctcctcctagcctggtcacgggctgtcccctcctccagcaatgcaaccctataataaacaagtctttccttgatcctcccctgccgcgagcgccctcggggaccttggcagctgcagccgccgcggatcctttccagaaagggggcgtggcggtgggtcggggttcgactgcgagctttctggggctcaatggaggcggggcccggccgctgtcaccgggcaggagagaacgttgcttacgtgcgcccggagtccattggccaaggcgggccacactcccgggtctggattgggtcgtggcgcagagaaggcgtggcctcgccgcgctagtccttataggctgctccgcgctggtgctagggggcagcaggccaagggggaggtgcgagcgtggacctgggacgggtctgggcggctctcggtggttggcacgggttcgcacacccattcaagcggcaggacgcacttgtcttagcagttctcgctgaccgcgctagctgcggcttctacgctccggcactctgagttcatcagcaaacgccctggcgtctgtcctcaccatgcctagcctttgggaccgcttctcgtcgtcgtccacctcctcttcgccctcgtccttgccccgaactcccaccccagatcggccgccgcgctcagcctgggggtcggcgacccgggaggaggggtttgaccgctccacgagcctggagagctcggactgcgagtccctggacagcagcaacagtggcttcgggccggaggaagacacggcttacctggatggggtgtcgttgcccgacttcgagctgctcagtgaccctgaggatgaacacttgtgtgccaacctgatgcagctgctgcaggagagcctggcccaggcgcggctgggctctcgacgccctgcgcgcctgctgatgcctagccagagtggcaaaaatatggctggctaaacgagcgtcgctcgggggtgtgagttcgtgacagnaaagtcaactggcactgatcacca

SEQ ID NO: 35789 - DNA, 884 bp, Homo sapiens
aagggcgcgagggcaggccgggctaacgtctgctcctgcgccgccgtcccacgggcatcccccccgtgtgtgcccagttgttcccgaagctttaggatccaagacgctgggggcaaccattttccttgcccgccgccccctcacgcttccctgcctctcctcctagcctggtcacgggctgtcccctcctccagcaatgcaaccctataataaacaagtctttccttgatcctcccctgccgcgagcgccctcggggaccttggcagctgcagccgccgcggatcctttccagaaagggggcgtggcggtgggtcggggttcgactgcgagctttctggggctcaatggaggcggggcccggccgctgtcaccgggcaggagagaacgttgcttacgtgcgcccggagtccattggccaaggcgggccacactcccgggtctggattgggtcgtggcgcagagaaggcgtggcctcgccgcgctagtccttataggctgctccgcgctggtgctagggggcagcaggccaagggggaggtgcgagcgtggacctgggacgggtctgggcggctctcggtggttggcacgggttcgcacacccattcaagcggcaggacgcacttgtcttagcagttctcgctgaccgcgctagctgggtgagtgtcccttctgtgtgtgggtcctagagctcgcggtctggtctggtctggtccccagactgacgcctggtcggtccccctcttgtcttacacggcttctacgctccggcactctgagttcatcagcaaacgccctggcgtctgtcctcaccatgcctagcctttgggaccgcttctcgtcgtcgtccacctcctggcctgagatgggatcctctagacaccat

SEQ ID NO: 35790 - DNA, 244 bp, Homo sapiens
gcggtccgactcttcacgccggactactgacctgttgtaggcagctatcttacagacgcatgaatgtaagagtaggaaggggtgggtgtcagggatcacttgggatctttgacacttgaaaaattacacctggcagctgcgttggatgcagtcactaggcggctttggatgcagtcactaggcggctttggatgcagtcactaggcggcgtttgatgcagtcactaggcggcgttggatgcagt

SEQ ID NO: 35791 - DNA, 2355 bp, Homo sapiens
aagggcgcgagggcaggccgggctaacgtctgctcctgcgccgccgtcccacgggcatcccccccgtgtgtgcccagttgttcccgaagctttaggatccaagacgctgggggcaaccattttccttgcccgccgccccctcacgcttccctgcctctcctcctagcctggtcacgggctgtcccctcctccagcaatgcaaccctataataaacaagtctttccttgatcctcccctgccgcgagcgccctcggggaccttggcagctgcagccgccgcggatcctttccagaaagggggcgtggcggtgggtcggggttcgactgcgagctttctggggctcaatggaggcggggcccggccgctgtcaccgggcaggagagaacgttgcttacgtgcgcccggagtccattggccaaggcgggccacactcccgggtctggattgggtcgtggcgcagagaaggcgtggcctcgccgcgctagtccttataggctgctccgcgctggtgctagggggcagcaggccaagggggaggtgcgagcgtggacctgggacgggtctgggcggctctcggtggttggcacgggttcgcacacccattcaagcggcaggacgcacttgtcttagcagttctcgctgaccgcgctagctgcggcttctacgctccggcactctgagttcatcagcaaacgccctggcgtctgtcctcaccatgcctagcctttgggaccgcttctcgtcgtcgtccacctcctcttcgccctcgtccttgccccgaactcccaccccagatcggccgccgcgctcagcctgggggtcggcgacccgggaggaggggtttgaccgctccacgagcctggagagctcggactgcgagtccctggacagcagcaacagtggcttcgggccggaggaagacacggcttacctggatggggtgtcgttgcccgacttcgagctgctcagtgaccctgaggatgaacacttgtgtgccaacctgatgcagctgctgcaggagagcctggcccaggcgcggctgggctctcgacgccctgcgcgcctgctgatgcctagccagttggtaagccaggtgggcaaagaactactgcgcctggcctacagcgagccgtgcggcctgcggggggcgctgctggacgtctgcgtggagcagggcaagagctgccacagcgtgggccagctggcactcgaccccagcctggtgcccaccttccagctgaccctcgtgctgcgcctggactcacgactctggcccaagatccaggggctgtttagctccgccaactctcccttcctccctggcttcagccagtccctgacgctgagcactggcttccgagtcatcaagaagaagctgtacagctcggaacagctgctcattgaggagtgttgaacttcaacctgagggggccgacagtgccctccaagacagagacgactgaacttttggggtggagactagaggcaggagctgagggactgattcctgtggttggaaaactgaggcagccacctaaggtggaggtgggggaatagtgtttcccaggaagctcattgagttgtgtgcgggtggctgtgcattggggacacatacccctcagtactgtagcatgaaacaaaggcttaggggccaacaaggcttccagctggatgtgtgtgtagcatgtaccttattatttttgttactgacagttaacagtggtgtgacatccagagagcagctgggctgctcccgccccagcccggcccagggtgaaggaagaggcacgtgctcctcagagcagccggagggaggggggaggtcggaggtcgtggaggtggtttgtgtatcttactggtctgaagggaccaagtgtgtttgttgtttgttttgtatcttgtttttctgatcggagcatcactactgacctgttgtaggcagctatcttacagacgcatgaatgtaagagtaggaaggggtgggtgtcagggatcacttgggatctttgacacttgaaaaattacacctggcagctgcgtttaagccttcccccatcgtgtactgcagagttgagctggcaggggaggggctgagagggtgggggctggaacccctccccgggaggagtgccatctgggtcttccatctagaactgtttacatgaagataagatactcactgttcatgaatacacttgatgttcaagtattaagacctatgcaatattttttacttttctaataaacatgtttgttaaaacaaaaaaacaaaacaaacaaaacaacacaaacacacaaacacacaaaacaacaaaaaacaccaaacaacaaaaaaacacacaaacaaaaaagaa

SEQ ID NO: 35792 - DNA, 2229 bp, Homo sapiens
aagggcgcgagggcaggccgggctaacgtctgctcctgcgccgccgtcccacgggcatcccccccgtgtgtgcccagttgttcccgaagctttaggatccaagacgctgggggcaaccattttccttgcccgccgccccctcacgcttccctgcctctcctcctagcctggtcacgggctgtcccctcctccagcaatgcaaccctataataaacaagtctttccttgatcctcccctgccgcgagcgccctcggggaccttggcagctgcagccgccgcggatcctttccagaaagggggcgtggcggtgggtcggggttcgactgcgagctttctggggctcaatggaggcggggcccggccgctgtcaccgggcaggagagaacgttgcttacgtgcgcccggagtccattggccaaggcgggccacactcccgggtctggattgggtcgtggcgcagagaaggcgtggcctcgccgcgctagtccttataggctgctccgcgctggtgctagggggcagcaggccaagggggaggtgcgagcgtggacctgggacgggtctgggcggctctcggtggttggcacgggttcgcacacccattcaagcggcaggacgcacttgtcttagcagttctcgctgaccgcgctagctgcggcttctacgctccggcactctgagttcatcagcaaacgccctggcgtctgtcctcaccatgcctagcctttgggaccgcttctcgtcgtcgtccacctcctcttcgccctcgtccttgccccgaactcccaccccagatcggccgccgcgctcagcctgggggtcggcgacccgggaggaggggtttgaccgctccacgagcctggagagctcggactgcgagtccctggacagcagcaacagtggcttcgggccggaggaagacacggcttacctggatggggtgtcgttgcccgacttcgagctgctcagtgaccctgaggatgaacacttgtgtgccaacctgatgcagctgctgcaggagagcctggcccaggcgcggctgggctctcgacgccctgcgcgcctgctgatgcctagccagttggtaagccaggtgggcaaagaactactgcgcctggcctacagcgagccgtgcggcctgcggggggcgctgctggacgtctgcgtggagcagggcaagagctgccacagcgtgggccagctggcactcgaccccagcctggtgcccaccttccagctgaccctcgtgctgcgcctggactcacgactctggcccaagatccaggggctgtttagctccgccaactctcccttcctccctggcttcagccagtccctgacgctgagcactggcttccgagtcatcaagaagaagctgtacagctcggaacagctgctcattgaggagtgttgaacttcaacctgagggggccgacagtgccctccaagacagagacgactgaacttttggggtggagactagaggcaggagctgagggactgattcctgtggttggaaaactgaggcagccacctaaggtggaggtgggggaatagtgtttcccaggaagctcattgagttgtgtgcgggtggctgtgcattggggacacatacccctcagtactgtagcatgaaacaaaggcttaggggccaacaaggcttccagctggatgtgtgtgtagcatgtaccttattatttttgttactgacagttaacagtggtgtgacatccagagagcagctgggctgctcccgccccagcccggcccagggtgaaggaagaggcacgtgctcctcagagcagccggagggaggggggaggtcggaggtcgtggaggtggtttgtgtatcttactggtctgaagggaccaagtgtgtttgttgtttgttttgtatcttgtttttctgatcggagcatcactactgacctgttgtaggcagctatcttacagacgcatgaatgtaagagtaggaaggggtgggtgtcagggatcacttgggatctttgacacttgaaaaattacacctggcagctgcgtttaagccttcccccatcgtgtactgcagagttgagctggcaggggaggggctgagagggtgggggctggaacccctccccgggaggagtgccatctgggtcttccatctagaactgtttacatgaagataagatactcactgttcatgaacacgccgcgggtggatcctcaagagtcagctatgagcg

SEQ ID NO: 35793 - DNA, 2046 bp, Homo sapiens
aagggcgcgagggcaggccgggctaacgtctgctcctgcgccgccgtcccacgggcatcccccccgtgtgtgcccagttgttcccgaagctttaggatccaagacgctgggggcaaccattttccttgcccgccgccccctcacgcttccctgcctctcctcctagcctggtcacgggctgtcccctcctccagcaatgcaaccctataataaacaagtctttccttgatcctcccctgccgcgagcgccctcggggaccttggcagctgcagccgccgcggatcctttccagaaagggggcgtggcggtgggtcggggttcgactgcgagctttctggggctcaatggaggcggggcccggccgctgtcaccgggcaggagagaacgttgcttacgtgcgcccggagtccattggccaaggcgggccacactcccgggtctggattgggtcgtggcgcagagaaggcgtggcctcgccgcgctagtccttataggctgctccgcgctggtgctagggggcagcaggccaagggggaggtgcgagcgtggacctgggacgggtctgggcggctctcggtggttggcacgggttcgcacacccattcaagcggcaggacgcacttgtcttagcagttctcgctgaccgcgctagctgcggcttctacgctccggcactctgagttcatcagcaaacgccctggcgtctgtcctcaccatgcctagcctttgggaccgcttctcgtcgtcgtccacctcctcttcgccctcgtccttgccccgaactcccaccccagatcggccgccgcgctcagcctgggggtcggcgacccgggaggaggggtttgaccgctccacgagcctggagagctcggactgcgagtccctggacagcagcaacagtggcttcgggccggaggaagacacggcttacctggatggggtgtcgttgcccgacttcgagctgctcagtgaccctgaggatgaacacttgtgtgccaacctgatgcagctgctgcaggagagcctggcccaggcgcggctgggctctcgacgccctgcgcgcctgctgatgcctagccagttggtaagccaggtgggcaaagaactactgcgcctggcctacagcgagccgtgcggcctgcggggggcgctgctggacgtctgcgtggagcagggcaagagctgccacagcgtgggccagctggcactcgaccccagcctggtgcccaccttccagctgaccctcgtgctgcgcctggactcacgactctggcccaagatccaggggctgtttagctccgccaactctcccttcctccctggcttcagccagtccctgacgctgagcactggcttccgagtcatcaagaagaagctgtacagctcggaacagctgctcattgaggagtgttgaacttcaacctgagggggccgacagtgccctccaagacagagacgactgaacttttggggtggagactagaggcaggagctgagggactgattcctgtggttggaaaactgaggcagccacctaaggtggaggtgggggaatagtgtttcccaggaagctcattgagttgtgtgcgggtggctgtgcattggggacacatacccctcagtactgtagcatgaaacaaaggcttaggggccaacaaggcttccagctggatgtgtgtgtagcatgtaccttattatttttgttactgacactgttgtaggcagctatcttacagacgcatgaatgtaagagtaggaaggggtgggtgtcagggatcacttgggatctttgacacttgaaaaattacacctggcagctgcgtttaagccttcccccatcgtgtactgcagagttgagctggcaggggaggggctgagagggtgggggctggaacccctccccgggaggagtgccatctgggtcttccatctagaactgtttacatgaagataagatactcactgttcatgaatacacttgatgttcaagtattaagacctatgcaatattttttacttttctaataaacatgtttgttaaaaca

SEQ ID NO: 35794 - DNA, 2359 bp, Homo sapiens
aagggcgcgagggcaggccgggctaacgtctgctcctgcgccgccgtcccacgggcatcccccccgtgtgtgcccagttgttcccgaagctttaggatccaagacgctgggggcaaccattttccttgcccgccgccccctcacgcttccctgcctctcctcctagcctggtcacgggctgtcccctcctccagcaatgcaaccctataataaacaagtctttccttgatcctcccctgccgcgagcgccctcggggaccttggcagctgcagccgccgcggatcctttccagaaagggggcgtggcggtgggtcggggttcgactgcgagctttctggggctcaatggaggcggggcccggccgctgtcaccgggcaggagagaacgttgcttacgtgcgcccggagtccattggccaaggcgggccacactcccgggtctggattgggtcgtggcgcagagaaggcgtggcctcgccgcgctagtccttataggctgctccgcgctggtgctagggggcagcaggccaagggggaggtgcgagcgtggacctgggacgggtctgggcggctctcggtggttggcacgggttcgcacacccattcaagcggcaggacgcacttgtcttagcagttctcgctgaccgcgctagctgggtgagtgtcccttctgtgtgtgggtcctagagctcgcggtctggtctggtctggtccccagactgacgcctggtcggtccccctcttgtcttacacggcttctacgctccggcactctgagttcatcagcaaacgccctggcgtctgtcctcaccatgcctagcctttgggaccgcttctcgtcgtcgtccacctcctcttcgccctcgtccttgccccgaactcccaccccagatcggccgccgcgctcagcctgggggtcggcgacccgggaggaggggtttgaccgctccacgagcctggagagctcggactgcgagtccctggacagcagcaacagtggcttcgggccggaggaagacacggcttacctggatggggtgtcgttgcccgacttcgagctgctcagtgaccctgaggatgaacacttgtgtgccaacctgatgcagctgctgcaggagagcctggcccaggcgcggctgggctctcgacgccctgcgcgcctgctgatgcctagccagttggtaagccaggtgggcaaagaactactgcgcctggcctacagcgagccgtgcggcctgcggggggcgctgctggacgtctgcgtggagcagggcaagagctgccacagcgtgggccagctggcactcgaccccagcctggtgcccaccttccagctgaccctcgtgctgcgcctggactcacgactctggcccaagatccaggggctgtttagctccgccaactctcccttcctccctggcttcagccagtccctgacgctgagcactggcttccgagtcatcaagaagaagctgtacagctcggaacagctgctcattgaggagtgttgaacttcaacctgagggggccgacagtgccctccaagacagagacgactgaacttttggggtggagactagaggcaggagctgagggactgattcctgtggttggaaaactgaggcagccacctaaggtggaggtgggggaatagtgtttcccaggaagctcattgagttgtgtgcgggtggctgtgcattggggacacatacccctcagtactgtagcatgaaacaaaggcttaggggccaacaaggcttccagctggatgtgtgtgtagcatgtaccttattatttttgttactgacagttaacagtggtgtgacatccagagagcagctgggctgctcccgccccagcccggcccagggtgaaggaagaggcacgtgctcctcagagcagccggagggaggggggaggtcggaggtcgtggaggtggtttgtgtatcttactggtctgaagggaccaagtgtgtttgttgtttgttttgtatcttgtttttctgatcggagcatcactactgacctgttgtaggcagctatcttacagacgcatgaatgtaagagtaggaaggggtgggtgtcagggatcacttgggatctttgacacttgaaaaattacacctggcagctgcgtttaagccttcccccatcgtgtactgcagagttgagctggcaggggaggggctgagagggtgggggctggaacccctccccgggaggagtgccatctgggtcttccatctagaactgtttacatgaagataagatactcactgttcatgaatacacttgatgttcaagtattaagacctatgcaatattttttacttttctaataaacatgtttgttaaaaca

SEQ ID NO: 35795 - DNA, 1655 bp, Homo sapiens
ctccggcacccttggtttctttaagcgtttcgctgaccgcgctagctgcggcttctacgctccggcactctgagttcatcagcaaacgccctggcgtctgtcctcaccatgcctagcctttgggaccgcttctcgtcgtcgtccacctcctcttcgccctcgtccttgccccgaactcccaccccagatcggccgccgcgctcagcctgggggtcggcgacccgggaggaggggtttgaccgctccacgagcctggagagctcggactgcgagtccctggacagcagcaacagtggcttcgggccggaggaagacacggcttacctggatggggtgtcgttgcccgacttcgagctgctcagtgaccctgaggatgaacacttgtgtgccaacctgatgcagctgctgcaggagagcctggcccaggcgcggctgggctctcgacgccctgcgcgcctgctgatgcctagccagttggtaagccaggtgggcaaagaactactgcgcctggcctacagcgagccgtgcggcctgcggggggcgctgctggacgtctgcgtggagcagggcaagagctgccacagcgtgggccagctggcactcgaccccagcctggtgcccaccttccagctgaccctcgtgctgcgcctggactcacgactctggcccaagatccaggggctgtttagctccgccaactctcccttcctccctggcttcagccagtccctgacgctgagcactggcttccgagtcatcaagaagaagctgtacagctcggaacagctgctcattgaggagtgttgaacttcaacctgagggggccgacagtgccctccaagacagagacgactgaacttttggggtggagactagaggcaggagctgagggactgattcctgtggttggaaaactgaggcagccacctaaggtggaggtgggggaatagtgtttcccaggaagctcattgagttgtgtgcgggtggctgtgcattggggacacatacccctcagtactgtagcatgaaacaaaggcttaggggccaacaaggcttccagctggatgtgtgtgtagcatgtaccttattatttttgttactgacagttaacagtggtgtgacatccagagagcagctgggctgctcccgccccagcccggcccagggtgaaggaagaggcacgtgctcctcagagcagccggagggaggggggaggtcggaggtcgtggaggtggtttgtgtatcttactggtctgaagggaccaagtgtgtttgttgtttgttttgtatcttgtttttctgatcggagcatcactactgacctgttgtaggcagctatcttacagacgcatgaatgtaagagtaggaaggggtgggtgtcagggatcacttgggatctttgacacttgaaaaattacacctggcagctgcgtttaagccttcccccatcgtgtactgcagagttgagctggcaggggaggggctgagagggtgggggctggaacccctccccgggaggagtgccatctgggtcttccatctagaactgtttacatgaagataagatactcactgttcatgaatacacttgatgttcaagtattaagacctatgcaatattttttacttttctaataaacatgtttgttaaaaca

SEQ ID NO: 35796 - DNA, 1696 bp, Homo sapiens
ctcggtcctgatgcaaccgtctggatcttttacacaaagcgctaggcgagcgctgggtgctaggacccggggggcgcccgggcagggagcggcttctacgctccggcactctgagttcatcagcaaacgccctggcgtctgtcctcaccatgcctagcctttgggaccgcttctcgtcgtcgtccacctcctcttcgccctcgtccttgccccgaactcccaccccagatcggccgccgcgctcagcctgggggtcggcgacccgggaggaggggtttgaccgctccacgagcctggagagctcggactgcgagtccctggacagcagcaacagtggcttcgggccggaggaagacacggcttacctggatggggtgtcgttgcccgacttcgagctgctcagtgaccctgaggatgaacacttgtgtgccaacctgatgcagctgctgcaggagagcctggcccaggcgcggctgggctctcgacgccctgcgcgcctgctgatgcctagccagttggtaagccaggtgggcaaagaactactgcgcctggcctacagcgagccgtgcggcctgcggggggcgctgctggacgtctgcgtggagcagggcaagagctgccacagcgtgggccagctggcactcgaccccagcctggtgcccaccttccagctgaccctcgtgctgcgcctggactcacgactctggcccaagatccaggggctgtttagctccgccaactctcccttcctccctggcttcagccagtccctgacgctgagcactggcttccgagtcatcaagaagaagctgtacagctcggaacagctgctcattgaggagtgttgaacttcaacctgagggggccgacagtgccctccaagacagagacgactgaacttttggggtggagactagaggcaggagctgagggactgattcctgtggttggaaaactgaggcagccacctaaggtggaggtgggggaatagtgtttcccaggaagctcattgagttgtgtgcgggtggctgtgcattggggacacatacccctcagtactgtagcatgaaacaaaggcttaggggccaacaaggcttccagctggatgtgtgtgtagcatgtaccttattatttttgttactgacagttaacagtggtgtgacatccagagagcagctgggctgctcccgccccagcccggcccagggtgaaggaagaggcacgtgctcctcagagcagccggagggaggggggaggtcggaggtcgtggaggtggtttgtgtatcttactggtctgaagggaccaagtgtgtttgttgtttgttttgtatcttgtttttctgatcggagcatcactactgacctgttgtaggcagctatcttacagacgcatgaatgtaagagtaggaaggggtgggtgtcagggatcacttgggatctttgacacttgaaaaattacacctggcagctgcgtttaagccttcccccatcgtgtactgcagagttgagctggcaggggaggggctgagagggtgggggctggaacccctccccgggaggagtgccatctgggtcttccatctagaactgtttacatgaagataagatactcactgttcatgaatacacttgatgttcaagtattaagacctatgcaatattttttacttttctaataaacatgtttgttaaaaca

SEQ ID NO: 35797 - DNA, 1805 bp, Homo sapiens
gatctaaggatcccctgggctcagtgattcttcgccctcgtccttgccccgaactcccaccccagatcggccgccgcgctcagcctgggggtcggcgacccgggaggaggggtttgaccgctccacgagcctggagagctcggactgcgagtccctggacagcagcaacagtggcttcgggccggaggaggtgagcggtgggcgggtgccgacgcgactcgaggggccgggaaggtggggaagccccggtgctggaaggggtcagagccgccttggcttcctatcccatcgggacccagattgcttgggggcagggggaattggagtataaggtgagtgaggcggaaactgaggcacggagtgggaaggagcgttggtttcttaaggaaacagcacctcccccgcctgtgcgtttcgttttgaagccgctctaataccccttcctgtgtgctctcctttccagacacggcttacctggatggggtgtcgttgcccgacttcgagctgctcagtgaccctgaggatgaacacttgtgtgccaacctgatgcagctgctgcaggagagcctggcccaggcgcggctgggctctcgacgccctgcgcgcctgctgatgcctagccagttggtaagccaggtgggcaaagaactactgcgcctggcctacagcgagccgtgcggcctgcggggggcgctgctggacgtctgcgtggagcagggcaagagctgccacagcgtgggccagctggcactcgaccccagcctggtgcccaccttccagctgaccctcgtgctgcgcctggactcacgactctggcccaagatccaggggctgtttagctccgccaactctcccttcctccctggcttcagccagtccctgacgctgagcactggcttccgagtcatcaagaagaagctgtacagctcggaacagctgctcattgaggagtgttgaacttcaacctgagggggccgacagtgccctccaagacagagacgactgaacttttggggtggagactagaggcaggagctgagggactgattcctgtggttggaaaactgaggcagccacctaaggtggaggtgggggaatagtgtttcccaggaagctcattgagttgtgtgcgggtggctgtgcattggggacacatacccctcagtactgtagcatgaaacaaaggcttaggggccaacaaggcttccagctggatgtgtgtgtagcatgtaccttattatttttgttactgacagttaacagtggtgtgacatccagagagcagctgggctgctcccgccccagcccggcccagggtgaaggaagaggcacgtgctcctcagagcagccggagggaggggggaggtcggaggtcgtggaggtggtttgtgtatcttactggtctgaagggaccaagtgtgtttgttgtttgttttgtatcttgtttttctgatcggagcatcactactgacctgttgtaggcagctatcttacagacgcatgaatgtaagagtaggaaggggtgggtgtcagggatcacttgggatctttgacacttgaaaaattacacctggcagctgcgtttaagccttcccccatcgtgtactgcagagttgagctggcaggggaggggctgagagggtgggggctggaacccctccccgggaggagtgccatctgggtcttccatctagaactgtttacatgaagataagatactcactgttcatgaatacacttgatgttcaagtattaagacctatgcaatattttttacttttctaataaacatgtttgttaaaaca

SEQ ID NO: 35798 - DNA, 1982 bp, Homo sapiens
aagggcgcgagggcaggccgggctaacgtctgctcctgcgccgccgtcccacgggcatcccccccgtgtgtgcccagttgttcccgaagctttaggatccaagacgctgggggcaaccattttccttgcccgccgccccctcacgcttccctgcctctcctcctagcctggtcacgggctgtcccctcctccagcaatgcaaccctataataaacaagtctttccttgatcctcccctgccgcgagcgccctcggggaccttggcagctgcagccgccgcggatcctttccagaaagggggcgtggcggtgggtcggggttcgactgcgagctttctggggctcaatggaggcggggcccggccgctgtcaccgggcaggagagaacgttgcttacgtgcgcccggagtccattggccaaggcgggccacactcccgggtctggattgggtcgtggcgcagagaaggcgtggcctcgccgcgctagtccttataggctgctccgcgctggtgctagggggcagcaggccaagggggaggtgcgagcgtggacctgggacgggtctgggcggctctcggtggttggcacgggttcgcacacccattcaagcggcaggacgcacttgtcttagcagttctcgctgaccgcgctagctgcggcttctacgctccggcactctgagttcatcagcaaacgccctggcgtctgtcctcaccatgcctagcctttgggaccgcttctcgtcgtcgtccacctcctcttcgccctcgtccttgccccgaactcccaccccagatcggccgccgcgctcagcctgggggtcggcgacccgggaggaggggtttgaccgctccacgagcctggagagctcggactgcgagtccctggacagcagcaacagtggcttcgggccggaggaagacacggcttacctggatggggtgtcgttgcccgacttcgagctgctcagtgaccctgaggtcacgactctggcccaagatccaggggctgtttagctccgccaactctcccttcctccctggcttcagccagtccctgacgctgagcactggcttccgagtcatcaagaagaagctgtacagctcggaacagctgctcattgaggagtgttgaacttcaacctgagggggccgacagtgccctccaagacagagacgactgaacttttggggtggagactagaggcaggagctgagggactgattcctgtggttggaaaactgaggcagccacctaaggtggaggtgggggaatagtgtttcccaggaagctcattgagttgtgtgcgggtggctgtgcattggggacacatacccctcagtactgtagcatgaaacaaaggcttaggggccaacaaggcttccagctggatgtgtgtgtagcatgtaccttattatttttgttactgacagttaacagtggtgtgacatccagagagcagctgggctgctcccgccccagcccggcccagggtgaaggaagaggcacgtgctcctcagagcagccggagggaggggggaggtcggaggtcgtggaggtggtttgtgtatcttactggtctgaagggaccaagtgtgtttgttgtttgttttgtatcttgtttttctgatcggagcatcactactgacctgttgtaggcagctatcttacagacgcatgaatgtaagagtaggaaggggtgggtgtcagggatcacttgggatctttgacacttgaaaaattacacctggcagctgcgtttaagccttcccccatcgtgtactgcagagttgagctggcaggggaggggctgagagggtgggggctggaacccctccccgggaggagtgccatctgggtcttccatctagaactgtttacatgaagataagatactcactgttcatgaatacacttgatgttcaagtattaagacctatgcaatattttttacttttctaataaacatgtttgttaaaaca

SEQ ID NO: 35799 - DNA, 1924 bp, Homo sapiens
aagggcgcgagggcaggccgggctaacgtctgctcctgcgccgccgtcccacgggcatcccccccgtgtgtgcccagttgttcccgaagctttaggatccaagacgctgggggcaaccattttccttgcccgccgccccctcacgcttccctgcctctcctcctagcctggtcacgggctgtcccctcctccagcaatgcaaccctataataaacaagtctttccttgatcctcccctgccgcgagcgccctcggggaccttggcagctgcagccgccgcggatcctttccagaaagggggcgtggcggtgggtcggggttcgactgcgagctttctggggctcaatggaggcggggcccggccgctgtcaccgggcaggagagaacgttgcttacgtgcgcccggagtccattggccaaggcgggccacactcccgggtctggattgggtcgtggcgcagagaaggcgtggcctcgccgcgctagtccttataggctgctccgcgctggtgctagggggcagcaggccaagggggaggtgcgagcgtggacctgggacgggtctgggcggctctcggtggttggcacgggttcgcacacccattcaagcggcaggacgcacttgtcttagcagttctcgctgaccgcgctagctgcggcttctacgctccggcactctgagttcatcagcaaacgccctggcgtctgtcctcaccatgcctagcctttgggaccgcttctcgtcgtcgtccacctcctcttcgccctcgtccttgccccgaactcccaccccagatcggccgccgcgctcagcctgggggtcggcgacccgggaggaggggtttgaccgctccacgagcctggagagctcggactgcgagtccctggacagcagcaacagtggcttcgggccggaggaagacacggcttacctggatggggtgtcgttgcccgacttcgagctgctcagtgaccctgaggctggcttcagccagtccctgacgctgagcactggcttccgagtcatcaagaagaagctgtacagctcggaacagctgctcattgaggagtgttgaacttcaacctgagggggccgacagtgccctccaagacagagacgactgaacttttggggtggagactagaggcaggagctgagggactgattcctgtggttggaaaactgaggcagccacctaaggtggaggtgggggaatagtgtttcccaggaagctcattgagttgtgtgcgggtggctgtgcattggggacacatacccctcagtactgtagcatgaaacaaaggcttaggggccaacaaggcttccagctggatgtgtgtgtagcatgtaccttattatttttgttactgacagttaacagtggtgtgacatccagagagcagctgggctgctcccgccccagcccggcccagggtgaaggaagaggcacgtgctcctcagagcagccggagggaggggggaggtcggaggtcgtggaggtggtttgtgtatcttactggtctgaagggaccaagtgtgtttgttgtttgttttgtatcttgtttttctgatcggagcatcactactgacctgttgtaggcagctatcttacagacgcatgaatgtaagagtaggaaggggtgggtgtcagggatcacttgggatctttgacacttgaaaaattacacctggcagctgcgtttaagccttcccccatcgtgtactgcagagttgagctggcaggggaggggctgagagggtgggggctggaacccctccccgggaggagtgccatctgggtcttccatctagaactgtttacatgaagataagatactcactgttcatgaatacacttgatgttcaagtattaagacctatgcaatattttttacttttctaataaacatgtttgttaaaaca

SEQ ID NO: 35800 - DNA, 1663 bp, Homo sapiens
aagggcgcgagggcaggccgggctaacgtctgctcctgcgccgccgtcccacgggcatcccccccgtgtgtgcccagttgttcccgaagctttaggatccaagacgctgggggcaaccattttccttgcccgccgccccctcacgcttccctgcctctcctcctagcctggtcacgggctgtcccctcctccagcaatgcaaccctataataaacaagtctttccttgatcctcccctgccgcgagcgccctcggggaccttggcagctgcagccgccgcggatcctttccagaaagggggcgtggcggtgggtcggggttcgactgcgagctttctggggctcaatggaggcggggcccggccgctgtcaccgggcaggagagaacgttgcttacgtgcgcccggagtccattggccaaggcgggccacactcccgggtctggattgggtcgtggcgcagagaaggcgtggcctcgccgcgctagtccttataggctgctccgcgctggtgctagggggcagcaggccaagggggaggtgcgagcgtggacctgggacgggtctgggcggctctcggtggttggcacgggttcgcacacccattcaagcggcaggacgcacttgtcttagcagttctcgctgaccgcgctagctgcggcttctacgctccggcactctgagttcatcgctgtttagctccgccaactctcccttcctccctggcttcagccagtccctgacgctgagcactggcttccgagtcatcaagaagaagctgtacagctcggaacagctgctcattgaggagtgttgaacttcaacctgagggggccgacagtgccctccaagacagagacgactgaacttttggggtggagactagaggcaggagctgagggactgattcctgtggttggaaaactgaggcagccacctaaggtggaggtgggggaatagtgtttcccaggaagctcattgagttgtgtgcgggtggctgtgcattggggacacatacccctcagtactgtagcatgaaacaaaggcttaggggccaacaaggcttccagctggatgtgtgtgtagcatgtaccttattatttttgttactgacagttaacagtggtgtgacatccagagagcagctgggctgctcccgccccagcccggcccagggtgaaggaagaggcacgtgctcctcagagcagccggagggaggggggaggtcggaggtcgtggaggtggtttgtgtatcttactggtctgaagggaccaagtgtgtttgttgtttgttttgtatcttgtttttctgatcggagcatcactactgacctgttgtaggcagctatcttacagacgcatgaatgtaagagtaggaaggggtgggtgtcagggatcacttgggatctttgacacttgaaaaattacacctggcagctgcgtttaagccttcccccatcgtgtactgcagagttgagctggcaggggaggggctgagagggtgggggctggaacccctccccgggaggagtgccatctgggtcttccatctagaactgtttacatgaagataagatactcactgttcatgaatacacttgatgttcaagtattaagacctatgcaatattttttacttttctaataaacatgtttgttaaaaca

SEQ ID NO: 35801 - DNA, 531 bp, Homo sapiens
tcgtcgagccggtaccgtctatatggaagaccagatggcactcctcccggggaggggtccagcccccaccctctcagcccctccccgggaggtcggaggtcgtggaggtggtttgtgtatcttactggtctgaagggaccaagtgtgtttgttgtttgttttgtatcttgtttttctgatcggagcatcactactgacctgttgtaggcagctatcttacagacgcatgaatgtaagagtaggaaggggtgggtgtcagggatcacttgggatctttgacacttgaaaaattacacctggcagctgcgtttaagccttcccccatcgtgtactgcagagttgagctggcaggggaggggctgagagggtgggggctggaacccctccccgggaggagtgccatctgggtcttccatctagaactgtttacatgaagataagatactcactgttcatgaatacacttgatgttcaagtattaagacctatgcaatattttttacttttctaataaacatgtttgttaaaaca

SEQ ID NO: 35802 - DNA, 332 bp, Homo sapiens
tgggctgacatagaggatcctatgccgaagaatgtaagagtaggaaggggtgggtgtcagggatcacttgggatctttgacacttgaaaaattacacctggcagctgcgtttaagccttcccccatcgtgtactgcagagttgagctggcaggggaggggctgagagggtgggggctggaacccctccccgggaggagtgccatctgggtcttccatctagaactgtttacatgaagataagatactcactgttcatgaatacacttgatgttcaagtattaagacctatgcaatattttttacttttctaataaacatgtttgttaaaaca

SEQ ID NO: 35803 - DNA, 703 bp, Homo sapiens
agagagagagagagagagagagagagagagagagagagagagagagagagagagagccctcagtactgtagcatgaaacaaaggcttaggggccaacaaggcttccagctggatgtgtgtgtagcatgtaccttattatttttgttactgacagttaacagtggtgtgacatccagagagcagctgggctgctcccgccccagcccggcccagggtgaaggaagaggcacgtgctcctcagagcagccggagggaggggggaggtcggaggtcgtggaggtggtttgtgtatcttactggtctgaagggaccaagtgtgtttgttgtttgttttgtatcttgtttttctgatcggagcatcactactgacctgttgtaggcagctatcttacagacgcatgaatgtaagagtaggaaggggtgggtgtcagggatcacttgggatctttgacacttgaaaaattacacctggcagctgcgtttaagccttcccccatcgtgtactgcagagttgagctggcaggggaggggctgagagggtgggggctggaacccctccccgggaggagtgccatctgggtcttccatctagaactgtttacatgaagataagatactcactgttcatgaatacacttgatgttcaagtattaagacctatgcaatattttttacttttctaataaacatgtttgttaaaaca

SEQ ID NO: 35804 - DNA, 1317 bp, Homo sapiens
  misc_feature (1143)..(1143): n is a, c, g, or t
  misc_feature (1146)..(1146): n is a, c, g, or t
  misc_feature (1159)..(1159): n is a, c, g, or t
  misc_feature (1162)..(1162): n is a, c, g, or t
  misc_feature (1165)..(1166): n is a, c, g, or t
  misc_feature (1168)..(1168): n is a, c, g, or t
  misc_feature (1171)..(1171): n is a, c, g, or t
  misc_feature (1178)..(1178): n is a, c, g, or t
  misc_feature (1195)..(1195): n is a, c, g, or t
  misc_feature (1234)..(1234): n is a, c, g, or t
  misc_feature (1291)..(1291): n is a, c, g, or t
aagggcgcgagggcaggccgggctaacgtctgctcctgcgccgccgtcccacgggcatcccccccgtgtgtgcccagttgttcccgaagctttaggatccaagacgctgggggcaaccattttccttgcccgccgccccctcacgcttccctgcctctcctcctagcctggtcacgggctgtcccctcctccagcaatgcaaccctataataaacaagtctttccttgatcctcccctgccgcgagcgccctcggggaccttggcagctgcagccgccgcggatcctttccagaaagggggcgtggcggtgggtcggggttcgactgcgagctttctggggctcaatggaggcggggcccggccgctgtcaccgggcaggagagaacgttgcttacgtgcgcccggagtccattggccaaggcgggccacactcccgggtctggattgggtcgtggcgcagagaaggcgtggcctcgccgcgctagtccttataggctgctccgcgctggtgctagggggcagcaggccaagggggaggtgcgagcgtggacctgggacgggtctgggcggctctcggtggttggcacgggttcgcacacccattcaagcggcaggacgcacttgtcttagcagttctcgctgaccgcgctagctgcggcttctacgctccggcactctgagttcatcagcaaacgccctggcgtctgtcctcaccatgcctagcctttgggaccgcttctcgtcgtcgtccacctcctcttcgccctcgtccttgccccgaactcccaccccagatcggccgccgcgctcagcctgggggtcggcgacccgggaggaggggtttgaccgctccacgagcctggagagctcggactgcgagtccctggacagcagcaacagtggcttcgggccggaggaagacacggcttacctggatggggtgtcgttgcccgacttcgagctgctcagtgaccctgaggatgaacacttgtgtgccaacctgatgcagctgctgcaggagagcctggcccaggcgcggctgggctctcgacgccctgcgcgcctgctgatgcctagccagttggtaagccaggtgggcaaagaactactgcgcctggcctacagcgagccgtgcggccctnctnttttctcttcttnacntcnncnttnatcattncaatatcttccacatcnttttccatctttcactctaccccatcctttttcccaccncccatcttaccctctttcttctcctttactcactactctttcccaatatccattttntttttatctcctccaaccgcccgtcc

SEQ ID NO: 35805 - DNA, 2284 bp, Homo sapiens
aagggcgcgagggcaggccgggctaacgtctgctcctgcgccgccgtcccacgggcatcccccccgtgtgtgcccagttgttcccgaagctttaggatccaagacgctgggggcaaccattttccttgcccgccgccccctcacgcttccctgcctctcctcctagcctggtcacgggctgtcccctcctccagcaatgcaaccctataataaacaagtctttccttgatcctcccctgccgcgagcgccctcggggaccttggcagctgcagccgccgcggatcctttccagaaagggggcgtggcggtgggtcggggttcgactgcgagctttctggggctcaatggaggcggggcccggccgctgtcaccgggcaggagagaacgttgcttacgtgcgcccggagtccattggccaaggcgggccacactcccgggtctggattgggtcgtggcgcagagaaggcgtggcctcgccgcgctagtccttataggctgctccgcgctggtgctagggggcagcaggccaagggggaggtgcgagcgtggacctgggacgggtctgggcggctctcggtggttggcacgggttcgcacacccattcaagcggcaggacgcacttgtcttagcagttctcgctgaccgcgctagctgcggcttctacgctccggcactctgagttcatcagcaaacgccctggcgtctgtcctcaccatgcctagcctttgggaccgcttctcgtcgtcgtccacctcctcttcgccctcgtccttgccccgaactcccaccccagatcggccgccgcgctcagcctgggggtcggcgacccgggaggaggggtttgaccgctccacgagcctggagagctcggactgcgagtccctggacagcagcaacagtggcttcgggccggaggaagacacggcttacctggatggggtgtcgttgcccgacttcgagctgctcagtgaccctgaggatgaacacttgtgtgccaacctgatgcagctgctgcaggagagcctggcccaggcgcggctgggctctcgacgccctgcgcgcctgctgatgcctagccagttggtaagccaggtgggcaaagaactactgcgcctggcctacagcgagccgtgcggcctgcggggggcgctgctggacgtctgcgtggagcagggcaagagctgccacagcgtgggccagctggcactcgaccccagcctggtgcccaccttccagctgaccctcgtgctgcgcctggactcacgactctggcccaagatccaggggctgtttagctccgccaactctcccttcctccctggcttcagccagtccctgacgctgagcactggcttccgagtcatcaagaagaagctgtacagctcggaacagctgctcattgaggagtgttgaacttcaacctgagggggccgacagtgccctccaagacagagacgactgaacttttggggtggagactagaggcaggagctgagggactgattcctgtggttggaaaactgaggcagccacctaaggtggaggtgggggaatagtgtttcccaggaagctcattgagttgtgtgcgggtggctgtgcattggggacacatacccctcagtactgtagcatgaaacaaaggcttaggggccaacaaggcttccagctggatgtgtgtgtagcatgtaccttattatttttgttactgacagttaacagtggtgtgacatccagagagcagctgggctgctcccgccccagcccggcccagggtgaaggaagaggcacgtgctcctcagagcagccggagggaggggggaggtcggaggtcgtggaggtggtttgtgtatcttactggtctgaagggaccaagtgtgtttgttgtttgttttgtatcttgtttttctgatcggagcatcactactgacctgttgtaggcagctatcttacagacgcatgaatgtaagagtaggaaggggtgggtgtcagggatcacttgggatctttgacacttgaaaaattacacctggcagctgcgtttaagccttcccccatcgtgtactgcagagttgagctggcaggggaggggctgagagggtgggggctggaacccctccccgggaggagtgccatctgggtcttccatctagaactgtttacatgaagataagatactcactgttcatgaatacacttgatgttcaagtattaagacctatgcaatattttttacttttctaataaacatgtttgttaaaacaaaaaaaacaataaaacggagg

SEQ ID NO: 35806 - DNA, 2020 bp, Homo sapiens
aagggcgcgagggcaggccgggctaacgtctgctcctgcgccgccgtcccacgggcatcccccccgtgtgtgcccagttgttcccgaagctttaggatccaagacgctgggggcaaccattttccttgcccgccgccccctcacgcttccctgcctctcctcctagcctggtcacgggctgtcccctcctccagcaatgcaaccctataataaacaagtctttccttgatcctcccctgccgcgagcgccctcggggaccttggcagctgcagccgccgcggatcctttccagaaagggggcgtggcggtgggtcggggttcgactgcgagctttctggggctcaatggaggcggggcccggccgctgtcaccgggcaggagagaacgttgcttacgtgcgcccggagtccattggccaaggcgggccacactcccgggtctggattgggtcgtggcgcagagaaggcgtggcctcgccgcgctagtccttataggctgctccgcgctggtgctagggggcagcaggccaagggggaggtgcgagcgtggacctgggacgggtctgggcggctctcggtggttggcacgggttcgcacacccattcaagcggcaggacgcacttgtcttagcagttctcgctgaccgcgctagctgcggcttctacgctccggcactctgagttcatcagcaaacgccctggcgtctgtcctcaccatgcctagcctttgggaccgcttctcgtcgtcgtccacctcctcttcgccctcgtccttgccccgaactcccaccccagatcggccgccgcgctcagcctgggggtcggcgacccgggaggaggggtttgaccgctccacgagcctggagagctcggactgcgagtccctggacagcagcaacagtggcttcgggccggaggaagacacggcttacctggatggggtgtcgttgcccgacttcgagctgctcagtgaccctgaggatgaacacttgtgtgccaacctgatgcagctgctgcaggagagcctggcccaggcgcggctgggctctcgacgccctgcgcgcctgctgatgcctagccagttggtaagccaggtgggcaaagaactactgcgcctggcctacagcgagccgtgcggcctgcggggggcgctgctggacgtctgcgtggagcagggcaagagctgccacagcgtgggccagctggcactcgaccccagcctggtgcccaccttccagctgaccctcgtgctgcgcctggactcacgactctggcccaagatccaggggctgtttagctccgccaactctcccttcctccctggcttcagccagtccctgacgctgagcactggcttccgagtcatcaagaagaagctgtacagctcggaacagctgctcattgaggagtgttgaacttcaacctgagggggccgacagtgccctccaagacagagacgactgaacttttggggtggagactagaggcaggagctgagggactgattcctgtggttggaaaactgaggcagccacctaaggtggaggtgggggaatagtgtttcccaggaagctcattgagttgtgtgcgggtggctgtgcattggggacacatacccctcagtactgtagcatgaaacaaaggcttaggggccaacaaggcttccagctggatgtgtgtgtagcatgtaccttattatttttgttactgacagttaacagtggtgtgacatccagagagcagctgggctgctcccgccccagcccggcccagggtgaaggaagaggcacgtgctcctcagagcagccggagggaggggggaggtcggaggtcgtggaggtggtttgtgtatcttactggtctgaagggaccaagtgtgtttgttgtttgttttgtatcttgtttttctgatcggagcatcactactgacctgttgtaggcagctatcttacagacgcatgtgtacgaggtcagggaggccatgtatggacccaatggtgcaacgggatggggtaccgga

SEQ ID NO: 35807 - DNA, 1960 bp, Homo sapiens
aagggcgcgagggcaggccgggctaacgtctgctcctgcgccgccgtcccacgggcatcccccccgtgtgtgcccagttgttcccgaagctttaggatccaagacgctgggggcaaccattttccttgcccgccgccccctcacgcttccctgcctctcctcctagcctggtcacgggctgtcccctcctccagcaatgcaaccctataataaacaagtctttccttgatcctcccctgccgcgagcgccctcggggaccttggcagctgcagccgccgcggatcctttccagaaagggggcgtggcggtgggtcggggttcgactgcgagctttctggggctcaatggaggcggggcccggccgctgtcaccgggcaggagagaacgttgcttacgtgcgcccggagtccattggccaaggcgggccacactcccgggtctggattgggtcgtggcgcagagaaggcgtggcctcgccgcgctagtccttataggctgctccgcgctggtgctagggggcagcaggccaagggggaggtgcgagcgtggacctgggacgggtctgggcggctctcggtggttggcacgggttcgcacacccattcaagcggcaggacgcacttgtcttagcagttctcgctgaccgcgctagctgcggcttctacgctccggcactctgagttcatcagcaaacgccctggcgtctgtcctcaccatgcctagcctttgggaccgcttctcgtcgtcgtccacctcctcttcgccctcgtccttgccccgaactcccaccccagatcggccgccgcgctcagcctgggggtcggcgacccgggaggaggggtttgaccgctccacgagcctggagagctcggactgcgagtccctggacagcagcaacagtggcttcgggccggaggaagacacggcttacctggatggggtgtcgttgcccgacttcgagctgctcagtgaccctgaggatgaacacttgtgtgccaacctgatgcagctgctgcaggagagcctggcccaggcgcggctgggctctcgacgccctgcgcgcctgctgatgcctagccagttggtaagccaggtgggcaaagaactactgcgcctggcctacagcgagccgtgcggcctgcggggggcgctgctggacgtctgcgtggagcagggcaagagctgccacagcgtgggccagctggcactcgaccccagcctggtgcccaccttccagctgaccctcgtgctgcgcctggactcacgactctggcccaagatccaggggctgtttagctccgccaactctcccttcctccctggcttcagccagtccctgacgctgagcactggcttccgagtcatcaagaagaagctgtacagctcggaacagctgctcattgaggagtgttgaacttcaacctgagggggccgacagtgccctccaagacagagacgactgaacttttggggtggagactagaggcaggagctgagggactgattcctgtggttggaaaactgaggcagccacctaaggtggaggtgggggaatagtgtttcccaggaagctcattgagttgtgtgcgggtggctgtgcattggggacacatacccctcagtactgtagcatgaaacaaaggcttaggggccaacaaggcttccagctggatgtgtgtgtagcatgtaccttattatttttgttactgacagttaacagtggtgtgacatccagagagcagctgggctgctcccgccccagcccggcccagggtgaaggaagaggcacgtgctcctcagagcagccggagggaggggggaggagtgccatctgggtcttccatctagaactgtttacatgaagataagatactcactgttcatgaatacacttgatgttcaagtattaagacctatgcaatattttttacttttctaataaacatgtttgttaaaaca

SEQ ID NO: 35808 - DNA, 1674 bp, Homo sapiens
ggctagtagaggcgggcggtgaatcggccgaggctgtcttagcagttctcgctgaccgcgctagctgcggcttctacgctccggcactctgagttcatcagcaaacgccctggcgtctgtcctcaccatgcctagcctttgggaccgcttctcgtcgtcgtccacctcctcttcgccctcgtccttgccccgaactcccaccccagatcggccgccgcgctcagcctgggggtcggcgacccgggaggaggggtttgaccgctccacgagcctggagagctcggactgcgagtccctggacagcagcaacagtggcttcgggccggaggaagacacggcttacctggatggggtgtcgttgcccgacttcgagctgctcagtgaccctgaggatgaacacttgtgtgccaacctgatgcagctgctgcaggagagcctggcccaggcgcggctgggctctcgacgccctgcgcgcctgctgatgcctagccagttggtaagccaggtgggcaaagaactactgcgcctggcctacagcgagccgtgcggcctgcggggggcgctgctggacgtctgcgtggagcagggcaagagctgccacagcgtgggccagctggcactcgaccccagcctggtgcccaccttccagctgaccctcgtgctgcgcctggactcacgactctggcccaagatccaggggctgtttagctccgccaactctcccttcctccctggcttcagccagtccctgacgctgagcactggcttccgagtcatcaagaagaagctgtacagctcggaacagctgctcattgaggagtgttgaacttcaacctgagggggccgacagtgccctccaagacagagacgactgaacttttggggtggagactagaggcaggagctgagggactgattcctgtggttggaaaactgaggcagccacctaaggtggaggtgggggaatagtgtttcccaggaagctcattgagttgtgtgcgggtggctgtgcattggggacacatacccctcagtactgtagcatgaaacaaaggcttaggggccaacaaggcttccagctggatgtgtgtgtagcatgtaccttattatttttgttactgacagttaacagtggtgtgacatccagagagcagctgggctgctcccgccccagcccggcccagggtgaaggaagaggcacgtgctcctcagagcagccggagggaggggggaggtcggaggtcgtggaggtggtttgtgtatcttactggtctgaagggaccaagtgtgtttgttgtttgttttgtatcttgtttttctgatcggagcatcactactgacctgttgtaggcagctatcttacagacgcatgaatgtaagagtaggaaggggtgggtgtcagggatcacttgggatctttgacacttgaaaaattacacctggcagctgcgtttaagccttcccccatcgtgtactgcagagttgagctggcaggggaggggctgagagggtgggggctggaacccctccccgggaggagtgccatctgggtcttccatctagaactgtttacatgaagataagatactcactgttcatgaatacacttgatgttcaagtattaagacctatgcaatattttttacttttctaataaacatgtttgttaaaaca

SEQ ID NO: 35809 - DNA, 2535 bp, Homo sapiens
aagggcgcgagggcaggccgggctaacgtctgctcctgcgccgccgtcccacgggcatcccccccgtgtgtgcccagttgttcccgaagctttaggatccaagacgctgggggcaaccattttccttgcccgccgccccctcacgcttccctgcctctcctcctagcctggtcacgggctgtcccctcctccagcaatgcaaccctataataaacaagtctttccttgatcctcccctgccgcgagcgccctcggggaccttggcagctgcagccgccgcggatcctttccagaaagggggcgtggcggtgggtcggggttcgactgcgagctttctggggctcaatggaggcggggcccggccgctgtcaccgggcaggagagaacgttgcttacgtgcgcccggagtccattggccaaggcgggccacactcccgggtctggattgggtcgtggcgcagagaaggcgtggcctcgccgcgctagtccttataggctgctccgcgctggtgctagggggcagcaggccaagggggaggtgcgagcgtggacctgggacgggtctgggcggctctcggtggttggcacgggttcgcacacccattcaagcggcaggacgcacttgtcttagcagttctcgctgaccgcgctagctgcggcttctacgctccggcactctgagttcatcagcaaacgccctggcgtctgtcctcaccatgcctagcctttgggaccgcttctcgtcgtcgtccacctcctcttcgccctcgtccttgccccgaactcccaccccagatcggccgccgcgctcagcctgggggtcggcgacccgggaggaggggtttgaccgctccacgagcctggagagctcggactgcgagtccctggacagcagcaacagtggcttcgggccggaggaggtgagcggtgggcgggtgccgacgcgactcgaggggccgggaaggtggggaagccccggtgctggaaggggtcagagccgccttggcttcctatcccatcgggacccagattgcttgggggcagggggaattggagtataaggtgagtgaggcggaaactgaggcacggagtgggaaggagcgttggtttcttaaggaaacagcacctcccccgcctgtgcgtttcgttttgaagccgctctaataccccttcctgtgtgctctcctttccagacacggcttacctggatggggtgtcgttgcccgacttcgagctgctcagtgaccctgaggatgaacacttgtgtgccaacctgatgcagctgctgcaggagagcctggcccaggcgcggctgggctctcgacgccctgcgcgcctgctgatgcctagccagttggtaagccaggtgggcaaagaactactgcgcctggcctacagcgagccgtgcggcctgcggggggcgctgctggacgtctgcgtggagcagggcaagagctgccacagcgtgggccagctggcactcgaccccagcctggtgcccaccttccagctgaccctcgtgctgcgcctggactcacgactctggcccaagatccaggggctgtttagctccgccaactctcccttcctccctggcttcagccagtccctgacgctgagcactggcttccgagtcatcaagaagaagctgtacagctcggaacagctgctcattgaggagtgttgaacttcaacctgagggggccgacagtgccctccaagacagagacgactgaacttttggggtggagactagaggcaggagctgagggactgattcctgtggttggaaaactgaggcagccacctaaggtggaggtgggggaatagtgtttcccaggaagctcattgagttgtgtgcgggtggctgtgcattggggacacatacccctcagtactgtagcatgaaacaaaggcttaggggccaacaaggcttccagctggatgtgtgtgtagcatgtaccttattatttttgttactgacagttaacagtggtgtgacatccagagagcagctgggctgctcccgccccagcccggcccagggtgaaggaagaggcacgtgctcctcagagcagccggagggaggggggaggtcggaggtcgtggaggtggtttgtgtatcttactggtctgaagggaccaagtgtgtttgttgtttgttttgtatcttgtttttctgatcggagcatcactactgacctgttgtaggcagctatcttacagacgcatgaatgtaagagtaggaaggggtgggtgtcagggatcacttgggatctttgacacttgaaaaattacacctggcagctgcgtttaagccttcccccatcgtgtactgcagagttgagctggcaggggaggggctgagagggtgggggctggaacccctccccgggaggagtgccatctgggtcttccatctagaactgtttacatgaagataagatactcactgttcatgaatacacttgatgttcaagtattaagacctatgcaatattttttacttttctaataaacatgtttgttaaaaca

SEQ ID NO: 35810 - DNA, 1815 bp, Homo sapiens
ggaggtgcgacatgtgtgagcatgggaccgcggtgctactgcggccgtgcctctgcggctggctgtgggacggcgttcggccagagcgattcatccggcgaggacggcactcggtgtaatagatcgcgagagatcgctgcaagtctgcgggtttctatgcaaccggccatgtcttagtatctccaggagtggcccaggaggtttgtacgcacaggacaagccagtgcgcggaaacgtctattcctccgctacagggcaggtctccaaccgtcacgtacatgtaccagcgcacatctggtcgtgtgcgcacgcggaaatccctggcccgagatcgggcctgcgagcgtcaaacgtgtgaggtggtagggaagatcggggaaggaggggtttggaccaggaccgacagagcctggaagagcacgaacggggagatccctggagaggaggaacagtgggttgcgggccggaggaagacacggcttacctggatggggtgtcgttgcccgacttcgagctgctcagtgaccctgaggatgaacacttgtgtgccaacctgatgcagctgctgcaggagagcctggcccaggcgcggctgggctctcgacgccctgcgcgcctgctgatgcctagccagttggtaagccaggtgggcaaagaactactgcgcctggcctacagcgagccgtgcggcctgcggggggcgctgctggacgtctgcgtggagcagggcaagagctgccacagcgtgggccagctggcactcgaccccagcctggtgcccaccttccagctgaccctcgtgctgcgcctggactcacgactctggcccaagatccaggggctgtttagctccgccaactctcccttcctccctggcttcagccagtccctgacgctgagcactggcttccgagtcatcaagaagaagctgtacagctcggaacagctgctcattgaggagtgttgaacttcaacctgagggggccgacagtgccctccaagacagagacgactgaacttttggggtggagactagaggcaggagctgagggactgattcctgtggttggaaaactgaggcagccacctaaggtggaggtgggggaatagtgtttcccaggaagctcattgagttgtgtgcgggtggctgtgcattggggacacatacccctcagtactgtagcatgaaacaaaggcttaggggccaacaaggcttccagctggatgtgtgtgtagcatgtaccttattatttttgttactgacagttaacagtggtgtgacatccagagagcagctgggctgctcccgccccagcccggcccagggtgaaggaagaggcacgtgctcctcagagcagccggagggaggggggaggtcggaggtcgtggaggtggtttgtgtatcttactggtctgaagggaccaagtgtgtttgttgtttgttttgtatcttgtttttctgatcggagcatcactactgacctgttgtaggcagctatcttacagacgcatgaatgtaagagtaggaaggggtgggtgtcagggatcacttgggatctttgacacttgaaaaattacacctggcagctgcgtttaagccttcccccatcgtgtactgcagagttgagctggcaggggaggggctgagagggtgggggctggaacccctccccgggaggagtgccatctgggtcttccatctagaactgtttacatgaagataagatactcactgttcatgaatacacttgatgttcaagtattaagacctatgcaatattttttacttttctaataaacatgtttgttaaaaca

SEQ ID NO: 35811 - DNA, 1901 bp, Homo sapiens
aagggcgcgagggcaggccgggctaacgtctgctcctgcgccgccgtcccacgggcatcccccccgtgtgtgcccagttgttcccgaagctttaggatccaagacgctgggggcaaccattttccttgcccgccgccccctcacgcttccctgcctctcctcctagcctggtcacgggctgtcccctcctccagcaatgcaaccctataataaacaagtctttccttgatcctcccctgccgcgagcgccctcggggaccttggcagctgcagccgccgcggatcctttccagaaagggggcgtggcggtgggtcggggttcgactgcgagctttctggggctcaatggaggcggggcccggccgctgtcaccgggcaggagagaacgttgcttacgtgcgcccggagtccattggccaaggcgggccacactcccgggtctggattgggtcgtggcgcagagaaggcgtggcctcgccgcgctagtccttataggctgctccgcgctggtgctagggggcagcaggccaagggggaggtgcgagcgtggacctgggacgggtctgggcggctctcggtggttggcacgggttcgcacacccattcaagcggcaggacgcacttgtcttagcagttctcgctgaccgcgctagctgcggcttctacgctccggcactctgagttcatcagcaaacgccctggcgtctgtcctcaccatgcttggtaagccaggtgggcaaagaactactgcgcctggcctacagcgagccgtgcggcctgcggggggcgctgctggacgtctgcgtggagcagggcaagagctgccacagcgtgggccagctggcactcgaccccagcctggtgcccaccttccagctgaccctcgtgctgcgcctggactcacgactctggcccaagatccaggggctgtttagctccgccaactctcccttcctccctggcttcagccagtccctgacgctgagcactggcttccgagtcatcaagaagaagctgtacagctcggaacagctgctcattgaggagtgttgaacttcaacctgagggggccgacagtgccctccaagacagagacgactgaacttttggggtggagactagaggcaggagctgagggactgattcctgtggttggaaaactgaggcagccacctaaggtggaggtgggggaatagtgtttcccaggaagctcattgagttgtgtgcgggtggctgtgcattggggacacatacccctcagtactgtagcatgaaacaaaggcttaggggccaacaaggcttccagctggatgtgtgtgtagcatgtaccttattatttttgttactgacagttaacagtggtgtgacatccagagagcagctgggctgctcccgccccagcccggcccagggtgaaggaagaggcacgtgctcctcagagcagccggagggaggggggaggtcggaggtcgtggaggtggtttgtgtatcttactggtctgaagggaccaagtgtgtttgttgtttgttttgtatcttgtttttctgatcggagcatcactactgacctgttgtaggcagctatcttacagacgcatgaatgtaagagtaggaaggggtgggtgtcagggatcacttgggatctttgacacttgaaaaattacacctggcagctgcgtttaagccttcccccatcgtgtactgcagagttgagctggcaggggaggggctgagagggtgggggctggaacccctccccgggaggagtgccatctgggtcttccatctagaactgtttacatgaagataagatactcactgttcatgaatacacttgatgttcaagtattaagacctatgcaatattttttacttttctaataaacatgtttgttaaaaca

SEQ ID NO: 35812 - DNA, 1495 bp, Homo sapiens
tagggcagagaaggacccctcccgttattttgaggaccgggctggtgcgactatactactgccggatggcaaatccgggatctcggctccgagaggctcatctggcaaaagggcgcggaaaccacgggggccctgagactgagtggtccctatcccacttctctctggggcggcgctgtagccagcggctgacaggcgcagcgaaaggcagccctctgctaagggtcccagcaccatggaggacccgaaccctgaagagaacatgaagcagcaggattcacccaaggagagaagtccccagagcccaggaggcaacatctgccacctgggggccccgaagtgcacccgctgcctcatcaccttcgcagattccaagttccaggagcgtcacatgaagcgggagcacccagcggacttcgtggcccagaagctgcagggggtcctcttcatctgcttcacctgcgcccgctccttcccctcctccaaagccctaatcacccaccagcgcagccacggtccagccgccaagcccaccctgccggttgcaaccactactgcccagcccaccttcccttgtcctgactgtggcaagacctttgggcaggctgtttctctgaggcggcaccgccagatgcatgaggtccgtgcccctcctggcaccttcgcctgcacagagtgcggtcaggactttgctcaggaagcagggctgcatcaacactacattcggcatgcccggggggagctctgagtgcagcttaagcctctccacggtgacgggtggctctgtggctggtaggactcacccatgatatggggtgcaggaactctgggggccctgaaggatttgcttccctcccctgggaaggcagagggctcttaataaagaggacccagaagattcttatttagagcttcagtctttggagcacacagggccttcgtgagacagtgaaatcagataataatgagatcttttgttaaaaaaaaaaaaaatgggaagggagtgcgggagagaaatggtttgtgtctcccttattcccagttaaatacctagctgcagattgtgccatcacccttcattcttcccagatggatgccatgggctatgggagcaaattgccctggacctttgcctgaatgggggcaggaaaggtgaggtgttgctggcctgtaatgccaccaggtgagttccagatgtggagcaacttgggcttttggggatggggcagcaaagttgggagctggaccccaattgagtgggggtagcaattggagtccttgtgtctcttttccaccccctgccatcctcacttagaggggccatggcactagatggcactagtcccccgataatttatgtctcgttgaaataattttgtatatcattctagtcctgaaatatttttttcatatgtgtaggtgaaatggtatgaataagctaacaggaatagtatctaaaaacagaaaacatccatattaaaatgtctaaacaggg

SEQ ID NO: 35813 - DNA, 897 bp, Homo sapiens
tagggcagagaaggacccctcccgttattttgaggaccgggctggtgcgactatactactgccggatggcaaatccgggatctcggctccgagaggctcatctggcaaaagggcgcggaaaccacgggggccctgagactgagtggtccctatcccacttctctctggggcggcgctgtagccagcggctgacaggcgcagcgaaaggcagccctctgctaagggtcccagcaccatggaggacccgaaccctgaagagaacatgaagcagcaggattcacccaaggagagaagtccccagagcccaggaggcaacatctgccacctgggggccccgaagtgcacccgctgcctcatcaccttcgcagattccaagttccaggagcgtcacatgaagcgggagcacccagcggacttcgtggcccagaagctgcagggggtcctcttcatctgcttcacctgcgcccgctccttcccctcctccaaagccctaatcacccaccagcgcagccacggtccagccgccaagcccaccctgccggttgcaaccactactgcccagcccaccttcccttgtcctgactgtggcaagacctttgggcaggctgtttctctgaggcggcaccgccagatgcatgaggtccgtgcccctcctggcaccttcgcctgcacagagtgcggtcaggactttgctcaggaagcagggctgcatcaacactacattcggcatgcccggggggagctctgagtgcagcttaagcctctccacggtgacgggtggctctgtggctggtaggactcacccatgatatggggtgcaggaactctgggggccctgaaggatttgcttccctcccctgggaaggcagagggctcttaataaagaggacccagaag

SEQ ID NO: 35814 - DNA, 2628 bp, Homo sapiens
actgaggcctgggagcaggaacctgtaggcagcgcttgagggtagcgggatagcagctgcaagcgcgcgtgggaggcgggggctctgggcggaacaaaaatcacaggatgtcagaggatgtttcccgggaagaactgggataaaggaagggtcccagcaccatggaggacccgaaccctgaagagaacatgaagcagcaggattcacccaaggagagaagtccccagagcccaggaggcaacatctgccacctgggggccccgaagtgcacccgctgcctcatcaccttcgcagattccaagttccaggagcgtcacatgaagcgggagcacccagcggacttcgtggcccagaagctgcagggggtcctcttcatctgcttcacctgcgcccgctccttcccctcctccaaagccctaatcacccaccagcgcagccacggtccagccgccaagcccaccctgccggttgcaaccactactgcccagcccaccttcccttgtcctgactgtggcaagacctttgggcaggctgtttctctgaggcggcaccgccagatgcatgaggtccgtgcccctcctggcaccttcgcctgcacagagtgcggtcaggactttgctcaggaagcagggctgcatcaacactacattcggcatgcccggggggagctctgagtgcagcttaagcctctccacggtgacgggtggctctgtggctggtaggactcacccatgatatggggtgcaggaactctgggggccctgaaggatttgcttccctcccctgggaaggcagagggctcttaataaagaggacccagaagattcttatttagagcttcagtctttggagcacacagggccttcgtgagacagtgaaatcagataataatgagatcttttgttaaaaaaaaaaaaaatgggaagggagtgcgggagagaaatggtttgtgtctcccttattcccagttaaatacctagctgcagattgtgccatcacccttcattcttcccagatggatgccatgggctatgggagcaaattgccctggacctttgcctgaatgggggcaggaaaggtgaggtgttgctggcctgtaatgccaccaggtgagttccagatgtggagcaacttgggcttttggggatggggcagcaaagttgggagctggaccccaattgagtgggggtagcaattggagtccttgtgtctcttttccaccccctgccatcctcacttagaggggccatggcactagatggcactagtcccccgataatttatgtctcgttgaaataattttgtatatcattctagtcctgaaatatttttttcatatgtgtaggtgaaatggtatgaataagctaacaggaatagtatctaaaaacagaaaacatccatattaaaatgtctaaacagggagctctggcttttgagtgggaatttccagagaacataagggtgtgggcaggtgggggaactcaggccagagttggcctcgctttgtggggaaactggtttggaatcaaacagagataccttctgtttcgggttttatttggccaacactgggagatttcccattaagatcctattttcagctctcttgaaaggcccaacctaggctgacattgtcagcaggggcaggacagaagttacaacaggctggagggagcagtgggtgtcaccctcaactggagatgagtcccaccaggccagttttacccccttagttacctgccctgcacctgcagacaatggtcgatgccttgcatataatacttatagactctgtttatgttgagggatgtttttaaagcccacaggtgaggtggatgtggtagactgatcactgtctctgtttttagctaggcacacagtagctgaaaagactgcatttcccagattcctttgcagctagatgtggccttgtgactgatttctggctaaattcctgggtagaacagtcaagcttaagaaagggacggctgggcacagtggctcacgcctgtaatcccagcactttgtgaggctgaggccggtggatcacctgaggtcaggagtttgagaccagcctggccaacatggtgaaaccctgtctctaccaaaaatacaaaaattagccgggtgtggtggcatatgcctgtaatcccagctacttgggaggctgaggcaggagaattgcttgaacctgggagacaggttgcagtgagccaagatcgtgccattgcacttcagcctgggtgacagagtgagactgtttaaaaaaaaagaaaagaaagggacataccttttttccaccttcctaactgtaatacggaaatggtatccagccatctcagaccataaggataagagcaacacgtgggaagacagagcaacaagataggagcctgggtctctcgtcaatttcaaggagcacagccaccataccagcccacttccatattgctatctaagaaagaaacttctatcttatttaagccaccattattttgggtctctgtcacatgcaacagaatttacagcctaagacaggggtctgcaaactatggccaactctagcctgctgcctggttttgcaaataaaattttatttgaacagttttatactcattcacttatgta

SEQ ID NO: 35815 - DNA, 823 bp, Homo sapiens
actgaggcctgggagcaggaacctgtaggcagcgcttgagggtagcgggatagcagctgcaagcgcgcgtgggaggcgggggctctgggcggaacaaaaatcacaggatgtcagaggatgtttcccgggaagaactgggataaaggaagggtcccagcaccatggaggacccgaaccctgaagagaacatgaagcagcaggattcacccaaggagagaagtccccagagcccaggaggcaacatctgccacctgggggccccgaagtgcacccgctgcctcatcaccttcgcagattccaagttccaggagcgtcacatgaagcgggagcacccagcggacttcgtggcccagaagctgcagggggtcctcttcatctgcttcacctgcgcccgctccttcccctcctccaaagccctaatcacccaccagcgcagccacggtccagccgccaagcccaccctgccggttgcaaccactactgcccagcccaccttcccttgtcctgactgtggcaagacctttgggcaggctgtttctctgaggcggcaccgccagatgcatgaggtccgtgcccctcctggcaccttcgcctgcacagagtgcggtcaggactttgctcaggaagcagggctgcatcaacactacattcggcatgcccggggggagctctgagtgcagcttaagcctctccacggtgacgggtggctctgtggctggtaggactcacccatgatatggggtgcaggaactctgggggccctgaaggatttgcttccctcccctgggaaggcagagggctcttaataaagaggacccagaag

SEQ ID NO: 35816 - DNA, 1186 bp, Homo sapiens
actgaggcctgggagcaggaacctgtaggcagcgcttgagggtagcgggatagcagctgcaagcgcgcgtgggaggcgggggctctgggcggaacaaaaatcacaggatgtcagaggatgtttcccgggaagaactgggataaaggaagggtcccagcaccatggaggacccgaaccctgaagagaacatgaagcagcaggattcacccaaggagagaagtccccagagcccaggaggcaacatctgccacctgggggccccgaagtgcacccgctgcctcatcaccttcgcagattccaagttccaggagcgtcacatgaagcgggagcacccagcggacttcgtggcccagaagctgcagggggtcctcttcatctgcttcacctgcgcccgctccttcccctcctccaaagccctaatcacccaccagcgcagccacggtccagccgccaagcccaccctgccggttgcaaccactactgcccagcccaccttcccttgtcctgactgtggcaagacctttgggcaggctgtttctctgaggcggcaccgccagatgcatgaggtccgtgcccctcctggcaccttcgcctgcacagagtgcggtcaggactttgctcaggaagcagggctgcatcaacactacattcggcatgcccggggggagctctgagtgcagcttaagcctctccacggtgacgggtggctctgtggctggtaggactcacccatgatatggggtgcaggaactctgggggccctgaaggatttgcttccctcccctgggaaggcagagggctcttaataaagaggacccagaagcaaaaaaaaaaaaaaaaaaaaaaaaaaaaattttggggcggccgggccctgaaaaaatttttaaaaccaactggttgggggcgcgcggcccccagtaggctaacagctgaacagtggcgcattaaggtgggtcccaaaggaaactccggcgcacgaccaacggaggctgggctgtcccccaatataaaaaaccccgggggggaccccgggggttctggacaaactctcaaaggagaggccggggagactaggggatccacaaagggcgtccaagcgggtcgagaataaattcagccaacagggagccacagcagaaatcacacccacccgcagaccagacatatgaaagaaacacgacacgcg

SEQ ID NO: 35817 - DNA, 1457 bp, Homo sapiens
agcttcagtttctcgcatgcgcagtgagtaaacatgagcctctggtagataagagaaaccgcgatcggagtacggcgcgtgcgcagatcagggatcgcgattgcgaatcctccgctgaggtgatttggatatccctagaacgttgagggcacgagtcgggtcctgagaccaggtcctcagccagcagagccacgttccttatgagcaccgtgggtttatttcattttcctacaccactgacccgaatatgcccggcgccatggggactccggctttgggagaagctgacgttgttatccccaggaatagctgtcactccggtccagatggcaggcaagaaggactaccctgcactgctttccttggatgagaatgaactcgaagagcagtttgtgaaaggacacggtccagggggccaggcaaccaacaaaaccagcaactgcgtggtgctgaagcacatcccctcaggcatcgttgtaaagtgccatcagacaagatcagttgatcagaacagaaagctagctcggaaaatcctacaagagaaagtagatgttttctacaatggtgaaaacagtcctgttcacaaagaaaaacgagaagcggcgaagaaaaaacaagaaaggaaaaaaagagcaaaggaaaccctggaaaaaaagaagctacttaaagaactgtgggagtcaagtaaaaaggtccactgagaaaagaattagagattccaactgacagaatctgccagaagctcccagggaataatggtggcgagttccatcaccagcattattatagtgcttcaaaagaaatatttttgatgaacttaaaagacaacaaatttatttaaatggtgcactaaactgtagtgaacagagacatgcacgattcaagaataaaactcggccgggcacggtggacggtgcctcacatctgtaatcccagcactttgggaggccgaggcgggcggatcacttgaggtcaggagtttgagaccagcctggccaacatggtgaaaccccgtctctactaaaaatacaaaaaataaaactaggtcaagtgcaatgacacacgcctataatcccagcaccttgggaggctaagacaggaagatcacctgagcccaggagctcaagattgcagtgagctatgaacaccactgcactccacctgtccacttgttcttgtgtgacagaacaagaccctgtctctaaaaaataagataaaaccataaagaaacacagtcagtactatacaagaataatggctacttctagagggaaggagttgtcattgtgatgaggcacttggaggggttctggggtgcctgacaaagttctgtttcttcacctgggtggtagttagaagggtgtccccgtatttcaaattgtacctttgtgagattgtatgttttgtaataataaaattttttttgtaattaaaaaagtcaatttttatggagaact

SEQ ID NO: 35818 - DNA, 560 bp, Homo sapiens
attttactgttttttgttgttgttgttttttgagacagagtctcgctccttcagtcttcgcccagctgagatcgcgccactgcactcaagcctgggcaacacctgggtgacagagcaagaccccatctcaaaaaaaaaataaaactaggtcaagtgcaatgacacacgcctataatcccagcaccttgggaggctaagacaggaagatcacctgagcccaggagctcaagattgcagtgagctatgaacaccactgcactccacctgtccacttgttcttgtgtgacagaacaagaccctgtctctaaaaaataagataaaaccataaagaaacacagtcagtactatacaagaataatggctacttctagagggaaggagttgtcattgtgatgaggcacttggaggggttctggggtgcctgacaaagttctgtttcttcacctgggtggtagttagaagggtgtccccgtatttcaaattgtacctttgtgagattgtatgttttgtaataataaaattttttttgtaattaaaaaagtcaatttttatggagaact

SEQ ID NO: 35819 - DNA, 649 bp, Homo sapiens
agcttcagtttctcgcatgcgcagtgagtaaacatgagcctctggtagataagagaaaccgcgatcggagtacggcgcgtgcgcagatcagggatcgcgattgcgaatcctccgctgaggtgatttggatatccctagaacgttgagggcacgagtcgggtcctgagaccaggtaagcatctgcggagaagccaggtaaccctacggctgccgacgactgtcaaaggctccggagagaggactgcgagccgggacgcctgggtttttcccgacttgcgaccccgagtggcgcagccagtttacctgaggccgcgctggcggtggggtggggccggccgtgacacccgagctcagttttctcgggacctggtttacgctaggtgctgtgggtcggtcctggggctgttcaggcactcagggcaggggagaggagagactaccgtcctggagataacggttccacggaggcccaaggcgaaacggaaggatcctcatgtacaaaactgagcggaatggagctgtgagcacgcatcaggtgctgtttcaggcctggcacgtagtagaggtcagcactgcccttgctaggcttttgcggagatactcgttttttttttaatagacgtggggtgggggggtctcactgtgttgc

SEQ ID NO: 35820 - DNA, 1627 bp, Homo sapiens
agcttcagtttctcgcatgcgcagtgagtaaacatgagcctctggtagataagagaaaccgcgatcggagtacggcgcgtgcgcagatcagggatcgcgattgcgaatcctccgctgaggtgatttggatatccctagaacgttgagggcacgagtcgggtcctgagaccaggtcctcagccagcagagccacgttccttatgagcaccgtgggtttatttcattttcctacaccactgacccgaatatgcccggcgccatggggactccggctttgggagaagctgacgttgttatccccaggaatagctgtcactccggtccagatggcaggcaagaaggactaccctgcactgctttccttggatgagaatgaactcgaagagcagtttgtgaaaggacacggtccagggggccaggcaaccaacaaaaccagcaactgcgtggtgctgaagcacatcccctcaggcatcgttgtaaagtgccatcagacaagatcagttgatcagaacagaaagctagctcggaaaatcctacaagagaaagtagatgttttctacaatggtgaaaacagtcctgttcacaaagaaaaacgagaagcggcgaagaaaaaacaagaaaggaaaaaaagagcaaaggaaaccctggaaaaaaagaagctacttaaagaactgtgggagtcaagtaaaaaggtccactgagaaaagaattagagattccaactgacagaatctgccagaagctcccagggaataatggtggcgagttccatcaccagcattattatagtgcttcaaaagaaatatttttgatgaacttaaaagacaacaaatttatttaaatggtgcactaaactgtagtgaacagagacatgcacgattcaagaataaaactcggccgggcacggtggacggtgcctcacatctgtaatcccagcactttgggaggccgaggcgggcggatcacttgaggtcaggagtttgagaccagcctggccaacatggtgaaaccccgtctctactaaaaatacaaaaaattagccaggcatggtggcgggcacctgtaatcccagctactcgggaggccgaggcaggagaattgcgtgaacctgggaggcggaggttgcagtgagctgagatcgcgccactgcactcaagcctgggcaacacctgggtgacagagcaagaccccatctcaaaaaaaaaataaaactaggtcaagtgcaatgacacacgcctataatcccagcaccttgggaggctaagacaggaagatcacctgagcccaggagctcaagattgcagtgagctatgaacaccactgcactccacctgtccacttgttcttgtgtgacagaacaagaccctgtctctaaaaaataagataaaaccataaagaaacacagtcagtactatacaagaataatggctacttctagagggaaggagttgtcattgtgatgaggcacttggaggggttctggggtgcctgacaaagttctgtttcttcacctgggtggtagttagaagggtgtccccgtatttcaaattgtacctttgtgagattgtatgttttgtaataataaaattttttttgtaattaaaaaagtcaatttttatggagaact

SEQ ID NO: 35821 - DNA, 2704 bp, Homo sapiens
  misc_feature (855)..(855): n is a, c, g, or t
agcttcagtttctcgcatgcgcagtgagtaaacatgagcctctggtagataagagaaaccgcgatcggagtacggcgcgtgcgcagatcagggatcgcgattgcgaatcctccgctgaggtgatttggatatccctagaacgttgagggcacgagtcgggtcctgagaccaggtcctcagccagcagagccacgttccttatgagcaccgtgggtttatttcattttcctacaccactgacccgaatatgcccggcgccatggggactccggctttgggagaagctgacgttgttatccccaggaatagctgtcactccggtccagatggcaggcaagaaggactaccctgcactgctttccttggatgagaatgaactcgaagagcagtttgtgaaaggacacggtccagggggccaggcaaccaacaaaaccagcaactgcgtggtgctgaagcacatcccctcaggcatcgttgtaaaggtagatcacagaaggccgctgaggggagaggccccgcccaagggttccacagcctccagagatttctcccaagtgtgaatgggatcagccgaagtgcattatttttctggcttgggccaccctctaccagccaggcagtagagagcaccgcagatctcgtcccatccctgagccgttcctccctaaggcagaacctcctacaacagcctgggaagcctgtttccaggatcttttggagccagggtatggctgccatccttgaatttggcagacagcactggtgcttggctgctgccccggaagcaacgtcttgacaaagctaagcagtggctgataaaggcaggcgcccgggcagcatggttctttcaaatcngttcccactgcaggaaggctgccgagatccccagcattgctatgggatccaagtccctgaggaggcggcaagcaggcatgggttgtctgctggcagtcccagcccttaactgtcatggctggttaacattagggtggccacatcctccacgcctctctgtcccctttggtaaatgtcggtgatacctcctcttctggacagagaggactgagggcgagatcatggaggatcatggaggccaggcattttccaacctcagaagaaaaaatgctgtgcacagctgcctataggagtcttcctttttacataaaaaaacaagtctcgggccaggcacagtggctcatgcctgtaatcccagcactttgggaggccgaggtgggtggatcacctgaggtcaggagttcgagaccagtctggtcaacatggcaaaaccccatctctactgaaaatacaaaaattagccgggtgtggtggcgcgtgcctgtaatcccagttactcggaggctaaggcaggagaatcgcttgaaccctggaggcagacattgcagtgagccgagatcatgctactgcataccagcctgggcaacagacaagattccctcttaaaaaaaaaaaaaagaaggttggtcagaggggctcccagtccatctgcctcagggatcacgagagagtcctggaagcagcacagaagagagatagccaagtgccatcagacaagatcagttgatcagaacagaaagctagctcggaaaatcctacaagagaaagtagatgttttctacaatggtgaaaacagtcctgttcacaaagaaaaacgagaagcggcgaagaaaaaacaagaaaggaaaaaaagagcaaaggaaaccctggaaaaaaagaagctacttaaagaactgtgggagtcaagtaaaaaggtccactgagaaaagaattagagattccaactgacagaatctgccagaagctcccagggaataatggtggcgagttccatcaccagcattattatagtgcttcaaaagaaatatttttgatgaacttaaaagacaacaaatttatttaaatggtgcactaaactgtagtgaacagagacatgcacgattcaagaataaaactcggccgggcacggtggacggtgcctcacatctgtaatcccagcactttgggaggccgaggcgggcggatcacttgaggtcaggagtttgagaccagcctggccaacatggtgaaaccccgtctctactaaaaatacaaaaaattagccaggcatggtggcgggcacctgtaatcccagctactcgggaggccgaggcaggagaattgcgtgaacctgggaggcggaggttgcagtgagctgagatcgcgccactgcactcaagcctgggcaacacctgggtgacagagcaagaccccatctcaaaaaaaaaataaaactaggtcaagtgcaatgacacacgcctataatcccagcaccttgggaggctaagacaggaagatcacctgagcccaggagctcaagattgcagtgagctatgaacaccactgcactccacctgtccacttgttcttgtgtgacagaacaagaccctgtctctaaaaaataagataaaaccataaagaaacacagtcagtactatacaagaataatggctacttctagagggaaggagttgtcattgtgatgaggcacttggaggggttctggggtgcctgacaaagttctgtttcttcacctgggtggtagttagaagggtgtccccgtatttcaaattgtacctttgtgagattgtatgttttgtaataataaaattttttttgtaattaaaaaagtcaatttttatggagaact

SEQ ID NO: 35822 - DNA, 1990 bp, Homo sapiens
agcttcagtttctcgcatgcgcagtgagtaaacatgagcctctggtagataagagaaaccgcgatcggagtacggcgcgtgcgcagatcagggatcgcgattgcgaatcctccgctgaggtgatttggatatccctagaacgttgagggcacgagtcgggtcctgagaccaggtaagcatctgcggagaagccaggtaaccctacggctgccgacgactgtcaaaggctccggagagaggactgcgagccgggacgcctgggtttttcccgacttgcgaccccgagtggcgcagccagtttacctgaggccgcgctggcggtggggtggggccggccgtgacacccgagctcagttttctcgggacctggtttacgctaggtgctgtgggtcggtcctggggctgttcaggcactcagggcaggggagaggagagactaccgtcctggagataacggttccacggaggcccaaggcgaaacggaaggatcctcatgtacaaaactgagcggaatggagctgtgagcacgcatcaggtcctcagccagcagagccacgttccttatgagcaccgtgggtttatttcattttcctacaccactgacccgaatatgcccggcgccatggggactccggctttgggagaagctgacgttgttatccccaggaatagctgtcactccggtccagatggcaggcaagaaggactaccctgcactgctttccttggatgagaatgaactcgaagagcagtttgtgaaaggacacggtccagggggccaggcaaccaacaaaaccagcaactgcgtggtgctgaagcacatcccctcaggcatcgttgtaaagtgccatcagacaagatcagttgatcagaacagaaagctagctcggaaaatcctacaagagaaagtagatgttttctacaatggtgaaaacagtcctgttcacaaagaaaaacgagaagcggcgaagaaaaaacaagaaaggaaaaaaagagcaaaggaaaccctggaaaaaaagaagctacttaaagaactgtgggagtcaagtaaaaaggtccactgagaaaagaattagagattccaactgacagaatctgccagaagctcccagggaataatggtggcgagttccatcaccagcattattatagtgcttcaaaagaaatatttttgatgaacttaaaagacaacaaatttatttaaatggtgcactaaactgtagtgaacagagacatgcacgattcaagaataaaactcggccgggcacggtggacggtgcctcacatctgtaatcccagcactttgggaggccgaggcgggcggatcacttgaggtcaggagtttgagaccagcctggccaacatggtgaaaccccgtctctactaaaaatacaaaaaattagccaggcatggtggcgggcacctgtaatcccagctactcgggaggccgaggcaggagaattgcgtgaacctgggaggcggaggttgcagtgagctgagatcgcgccactgcactcaagcctgggcaacacctgggtgacagagcaagaccccatctcaaaaaaaaaataaaactaggtcaagtgcaatgacacacgcctataatcccagcaccttgggaggctaagacaggaagatcacctgagcccaggagctcaagattgcagtgagctatgaacaccactgcactccacctgtccacttgttcttgtgtgacagaacaagaccctgtctctaaaaaataagataaaaccataaagaaacacagtcagtactatacaagaataatggctacttctagagggaaggagttgtcattgtgatgaggcacttggaggggttctggggtgcctgacaaagttctgtttcttcacctgggtggtagttagaagggtgtccccgtatttcaaattgtacctttgtgagattgtatgttttgtaataataaaattttttttgtaattaaaaaagtcaatttttatggagaact

SEQ ID NO: 35823 - DNA, 1870 bp, Homo sapiens
agcttcagtttctcgcatgcgcagtgagtaaacatgagcctctggtagataagagaaaccgcgatcggagtacggcgcgtgcgcagatcagggatcgcgattgcgaatcctccgctgaggtgatttggatatccctagaacgttgagggcacgagtcgggtcctgagaccaggtcctcagccagcagagccacgttccttatgagcaccgtgggtttatttcattttcctacaccactgacccgaatatgcccggcgccatggggactccggctttgggagaagctgacgttgttatccccaggaatagctgtcactccggtccagatggcaggcaagaaggactaccctgcactgctttccttggatgagaatgaactcgaagagcagtttgtgaaaggacacggtccagggggccaggcaaccaacaaaaccagcaactgcgtggtgctgaagcacatcccctcaggcatcgttgtaaaggtagatcacagaaggccgctgaggggagaggccccgcccaagggttccacagcctccagagatttctcccaagtgtgaatgggatcagccgaagtgcattatttttctggcttgggccaccctctaccagccaggcagtagagagcaccgcagatctcgtcccatccctgagccgttcctccctaaggcagaacctcctacaacagcctgggaagcctgtttccaggatcttttggagccaggtgccatcagacaagatcagttgatcagaacagaaagctagctcggaaaatcctacaagagaaagtagatgttttctacaatggtgaaaacagtcctgttcacaaagaaaaacgagaagcggcgaagaaaaaacaagaaaggaaaaaaagagcaaaggaaaccctggaaaaaaagaagctacttaaagaactgtgggagtcaagtaaaaaggtccactgagaaaagaattagagattccaactgacagaatctgccagaagctcccagggaataatggtggcgagttccatcaccagcattattatagtgcttcaaaagaaatatttttgatgaacttaaaagacaacaaatttatttaaatggtgcactaaactgtagtgaacagagacatgcacgattcaagaataaaactcggccgggcacggtggacggtgcctcacatctgtaatcccagcactttgggaggccgaggcgggcggatcacttgaggtcaggagtttgagaccagcctggccaacatggtgaaaccccgtctctactaaaaatacaaaaaattagccaggcatggtggcgggcacctgtaatcccagctactcgggaggccgaggcaggagaattgcgtgaacctgggaggcggaggttgcagtgagctgagatcgcgccactgcactcaagcctgggcaacacctgggtgacagagcaagaccccatctcaaaaaaaaaataaaactaggtcaagtgcaatgacacacgcctataatcccagcaccttgggaggctaagacaggaagatcacctgagcccaggagctcaagattgcagtgagctatgaacaccactgcactccacctgtccacttgttcttgtgtgacagaacaagaccctgtctctaaaaaataagataaaaccataaagaaacacagtcagtactatacaagaataatggctacttctagagggaaggagttgtcattgtgatgaggcacttggaggggttctggggtgcctgacaaagttctgtttcttcacctgggtggtagttagaagggtgtccccgtatttcaaattgtacctttgtgagattgtatgttttgtaataataaaattttttttgtaattaaaaaagtcaatttttatggagaact

SEQ ID NO: 35824 - DNA, 191 bp, Homo sapiens
cttggaagatatttttggtctattgcaagaaaatatgtattagctggcagggcatgtcctggtaacatggcagacagtgcaaggctgaggagaggggcgtcttgctgaataatgtgtctctactcatttcctaaattccctcggtaacagatgggtcatcatttgaattgctttataaaaagctgtctttg

SEQ ID NO: 35825 - DNA, 5692 bp, Homo sapiens
  misc_feature (3448)..(3448): n is a, c, g, or t
tttttttttcttaataggaaaattttttaaactatccaaattagtctgttgaaagggtaccttttttgctgatctctgatgagttgtcttttcatccctatctgtagcttgagtgcagattgacaattcatttcagtgaattactaccgaataaaagtggttccggatccctcctagataaatgtgcacttacagcaactacctaggctctccaaatcactccactcggtatgaaaaccccatcaagatactaatcgtaagagttaatgtggctgcaaaaaataattatcctaagctttcagggataaaaagaaaattacccaggttctctgcactgtgaattttgctgacacagcggaggagcagatgactggttcctacaactgtacagccttccttgaaatcatagcttttggggttaaacacttgtgaatttcttttgcacatggcatttgcttttgaaatgcctttagtcaaatacaccagagcaactcccagctgagaccatttgagcacagttcctagtggggccacattcagagcaagcctctcgccggctcactcagttgagctgttgcttagacaccacaagtttctacaagggacttatggggaacggccctcaggggtcctggttcacatctcagctttattcatgtgctggaagcacaaacagcgagtccagggagggattctgctaatcagatgagtctgctcttgtgtctctttcttaggagacaaatacctgtatgtaattgcttcaagaactccatttggttctgatcattaccaatgaatataactgaaggagcaccaaagatcaggcataacctcgggccagttcattctgaaaatgatgtcgtaaaaagagtatgtgtgagagaaatctccttcccaagtttttaaccagatctcgtcacaatgaggagaatgctataatctatctcatggtacatttttggagcttaattctagcatactcctccaagtacactcacaattgtagctgagtcaagactgctaaatgaacagataggagaacttatattagactaatatccttgacacgaagcagggttcattgtaataaaaacggcaaacagataaatcttctaccaaaaccaaagatggaaagtcactgcaccagtctcctggaacttcataaaatcaatttcactggagcaaccagaagggtcatggagatgtataccactcgcttgggctcgtaggtttttgactggggatgcctctacactttgtaagtcatttctcccttcaaaaattgtattatatctttaatatatgtgtatttttcaatgcgagggaggaattactatgaaccaaagatatcttttggctccttctgaaagtgactcagtttgaattccattcagatttgtacagataaatagatggtcaccatttctgcatcaggttggaagagaccaatgataaaggaacccaacgtaaggaatagcagttctgaaaatagacaaagcctagaggaggtatccatttcactgagagattacacgaggggacttattttttatgttcccaattttttcttctgataatattaatcaatgtacacatgattgatgcatgatattacacttaaaatgcaggagagtacaaaacaaccttgatccaatagtttcctattctggggggtgggggcagaggcggaaaagaaaacacatctttcacttacttattgaacaaacaataagcactcagaactaatttatttatgcaggttgcaaatatgtatgaagcaataggttctggccactgccacaatttgaaatcaataaaataagaaatatatatttatatatgagggaagatgctgtttgatagagcatgtgaaatcaatggaaacatatttattaaaagtaaacctcacctttttcaccaaatagtaactagagaactagtcctagtatcttgcgtaattcttctctgtcttcattgggaaattatgtttgaaaatctttcatcacctataaaatggtgagcctcttgtactttctattcagtgtagaaagagtggactgataaataactttacattgttggtagtagtttctacagatccagtttattgcatgtcgtatctttattgtagatattaaaaacacatgataaaaattgatgtgtgcccctccttgtttggccagtatcacagaaaactttgtaaaaaagcatggggaccctactccctagattatttgagccatttactaaaattggccattagtgatacagtgaaaacaagctaaggaaatgatattctcctaaaaagttatattccagttttgattattataacacagcacaataaatgggcagtatacgtctaatggaactgagatttaaggctttaacaattcgtgttttaaaatattatattgaagactgcacaaagagaaaattatacgtttctccaatcctgtgatcatgtctgtaaataccttgcaatttcaaattacttcatccgtcattaactatatgatctcccaaacacagccttctcaaaatcgataaaaatttgccactgaatatgcattaatagctataacaatgggtgacatgccacacaaatttagcttatgcaatttatggggtgtgtgtttgcagactatgaaatgtatgaagtgcagtctcccatggagagaatagagaggcaggatggcaactagtcatgaacgcaacaatttaggttaaatgataaagaatacaatgaaatgtccagagtaacacttggtctctacctttctaacattctaacccaaggccagtgtcatgggcttggctttcttccctgtcgcctcatactgagtatgcaatttacagaggacatctgttgctttatgtcttaaggccactagaggaagtcactacattcccaacaaagatgtgtctttcggcttagtgaaaaacatttaacaagaaacaatgtgtaaccaagtccccacagtaaaatgtgtcttcagaaacatgagaatcacttttatatagccaacctcatttgaattttatcatgaacataaattatcggtgagactggtgtgcggggctggatctgtgagacaagctcacactctcatgtgtgcattctctattaacatatttggaagattgcccacattttctctgcagacctgccacaaatccttaccttcttactgaagaatgtgactattgtagcattcgtgcaattatgccagcagaggaggcactagacagtttatagactcttatggaagttgggcacatttcccaggcaggtggaatgctagctagatctagaagcacccttaaaggtcatgtagaatcaaggtcccactttatgtttcccttgggagaaaactgaaacccatggatgctgtaatttgtttaacggcaaagaaagagccaagaattgtttctcgtagttccaggntcctgatctaggaatgtttccttggctccatggcatctcccagtttgacatagtgggagctgagaaatgccatatggcctcaaaataaataaacccttgtacatttaagtgttttcccagattttcagatgcctctactcttgctgaactcatcaccagctgtatcagtagagaggtgttatggggcaattcattagatttctggtaggtcatgaatggttggtataagctttatttactcatatattgtcatccagttctttgaaattcaatcttatcctaaagtggtagtcaaagtaaaacacattaagtaggtgtttgtgtttagcagtcctactaattcatcacaatcacatagtaattgtgattataatttttggaatctttatcactttctagcactttacggtgtcattatttatggcatttttaacaactttgttgcataattgataacatcagggctacatttttttcatgtgagcctcaagaagcttccattatcaacaagaattggggaaatgacttttttacattataataccttatatattaggtttttcctgataatcttcagtagacaatgatttaaattaactgaagtttaaataagaaatatgttaaaattactaaataatatgaaaaccacattatacttgtaattttcagacacttttctcctaccttaagattttaacatcttgtaaatattaatatttgaaggggagaggaaaaatacatttgtagtagaaatattccctctaacaattctgtttaactagtaagttttttttaagttatcttccatgcctgcttccctagtctgaactccacattccagttgtcagaagaatgaatggatttaaattttctaatcattattttgggcccatgttagcagttgaaacaattaagttcctcactctttcctgcttttaggatgattttagactgtgagcataaaatcaaccctttctgtcagcacagaattgaacatcgaatggagcaaggtctacactctcagcctgtagctgtgctaatgttaggattgaattgttctattaattccctcaagagacccacagcctcaaaagagttgcttattatcagatgtccgaaattcagaaacccaaagtcaggcaaagaaggaaactgagataatgatttaatttttttaagtcactgcaggatttctctcaaagaaaacatctgaaaatggttgagaaagtagttccagatcattaactattttacagagggactgaaagccagggaaaataaagaacagaatgatagtagtatcttgatattaaatttgcatcagaaatgagcaaaatatgtcaatatgaaataatttgaaatcaaattcagattcacatgtatagtgcatagttcaagaaataatgcttactcttgtaaaaaaaaaaatatatatatatatgtatcagcaggtagagtgtgggagctccaactttgttgtgaaagctgataacagagtatgattctttccagttacaaaatactgtattactttagttatagcaagcagtacataaatgacatcaacaactcaggctgctccctgacataaaagccagttccatctttactgcagatgacaggagactttccaagacctgcagaggccccctccaccccaaccttagtgcatgctcacacacacacacacacacacacacacacacacacatttttggcttttgacccactctgtgtgttccactgaagttatcttttccttaatagattcacacagaattaccccatcctgcaaaatccttatccctatgaatctctaaaatatattaaataatgtgttatatatttgctttttgtaaatctttatttaattaatttatatatactttgtgaagtcttatactgtacatcataaagcgatgtcatctgtagttggttcaatataatgtttatgatcattttgataagaaataactttggacattaggcccttgttaagaaataaaacacccattataaatttgcttctgttggaaaatacatgatttggcatacttcatttttagtaacaatctattctagataaatgataatttggggacatctgtacttaaaaactagctgaactacgttttgggatgagatgcaaagcaacagctgtccctggaactgaaatgtgaatttctagcagaacagaaaatattataataatgaggcaataataaaattaggaaattaaattat

SEQ ID NO: 35826 - DNA, 6175 bp, Homo sapiens
  misc_feature (3448)..(3448): n is a, c, g, or t
tttttttttcttaataggaaaattttttaaactatccaaattagtctgttgaaagggtaccttttttgctgatctctgatgagttgtcttttcatccctatctgtagcttgagtgcagattgacaattcatttcagtgaattactaccgaataaaagtggttccggatccctcctagataaatgtgcacttacagcaactacctaggctctccaaatcactccactcggtatgaaaaccccatcaagatactaatcgtaagagttaatgtggctgcaaaaaataattatcctaagctttcagggataaaaagaaaattacccaggttctctgcactgtgaattttgctgacacagcggaggagcagatgactggttcctacaactgtacagccttccttgaaatcatagcttttggggttaaacacttgtgaatttcttttgcacatggcatttgcttttgaaatgcctttagtcaaatacaccagagcaactcccagctgagaccatttgagcacagttcctagtggggccacattcagagcaagcctctcgccggctcactcagttgagctgttgcttagacaccacaagtttctacaagggacttatggggaacggccctcaggggtcctggttcacatctcagctttattcatgtgctggaagcacaaacagcgagtccagggagggattctgctaatcagatgagtctgctcttgtgtctctttcttaggagacaaatacctgtatgtaattgcttcaagaactccatttggttctgatcattaccaatgaatataactgaaggagcaccaaagatcaggcataacctcgggccagttcattctgaaaatgatgtcgtaaaaagagtatgtgtgagagaaatctccttcccaagtttttaaccagatctcgtcacaatgaggagaatgctataatctatctcatggtacatttttggagcttaattctagcatactcctccaagtacactcacaattgtagctgagtcaagactgctaaatgaacagataggagaacttatattagactaatatccttgacacgaagcagggttcattgtaataaaaacggcaaacagataaatcttctaccaaaaccaaagatggaaagtcactgcaccagtctcctggaacttcataaaatcaatttcactggagcaaccagaagggtcatggagatgtataccactcgcttgggctcgtaggtttttgactggggatgcctctacactttgtaagtcatttctcccttcaaaaattgtattatatctttaatatatgtgtatttttcaatgcgagggaggaattactatgaaccaaagatatcttttggctccttctgaaagtgactcagtttgaattccattcagatttgtacagataaatagatggtcaccatttctgcatcaggttggaagagaccaatgataaaggaacccaacgtaaggaatagcagttctgaaaatagacaaagcctagaggaggtatccatttcactgagagattacacgaggggacttattttttatgttcccaattttttcttctgataatattaatcaatgtacacatgattgatgcatgatattacacttaaaatgcaggagagtacaaaacaaccttgatccaatagtttcctattctggggggtgggggcagaggcggaaaagaaaacacatctttcacttacttattgaacaaacaataagcactcagaactaatttatttatgcaggttgcaaatatgtatgaagcaataggttctggccactgccacaatttgaaatcaataaaataagaaatatatatttatatatgagggaagatgctgtttgatagagcatgtgaaatcaatggaaacatatttattaaaagtaaacctcacctttttcaccaaatagtaactagagaactagtcctagtatcttgcgtaattcttctctgtcttcattgggaaattatgtttgaaaatctttcatcacctataaaatggtgagcctcttgtactttctattcagtgtagaaagagtggactgataaataactttacattgttggtagtagtttctacagatccagtttattgcatgtcgtatctttattgtagatattaaaaacacatgataaaaattgatgtgtgcccctccttgtttggccagtatcacagaaaactttgtaaaaaagcatggggaccctactccctagattatttgagccatttactaaaattggccattagtgatacagtgaaaacaagctaaggaaatgatattctcctaaaaagttatattccagttttgattattataacacagcacaataaatgggcagtatacgtctaatggaactgagatttaaggctttaacaattcgtgttttaaaatattatattgaagactgcacaaagagaaaattatacgtttctccaatcctgtgatcatgtctgtaaataccttgcaatttcaaattacttcatccgtcattaactatatgatctcccaaacacagccttctcaaaatcgataaaaatttgccactgaatatgcattaatagctataacaatgggtgacatgccacacaaatttagcttatgcaatttatggggtgtgtgtttgcagactatgaaatgtatgaagtgcagtctcccatggagagaatagagaggcaggatggcaactagtcatgaacgcaacaatttaggttaaatgataaagaatacaatgaaatgtccagagtaacacttggtctctacctttctaacattctaacccaaggccagtgtcatgggcttggctttcttccctgtcgcctcatactgagtatgcaatttacagaggacatctgttgctttatgtcttaaggccactagaggaagtcactacattcccaacaaagatgtgtctttcggcttagtgaaaaacatttaacaagaaacaatgtgtaaccaagtccccacagtaaaatgtgtcttcagaaacatgagaatcacttttatatagccaacctcatttgaattttatcatgaacataaattatcggtgagactggtgtgcggggctggatctgtgagacaagctcacactctcatgtgtgcattctctattaacatatttggaagattgcccacattttctctgcagacctgccacaaatccttaccttcttactgaagaatgtgactattgtagcattcgtgcaattatgccagcagaggaggcactagacagtttatagactcttatggaagttgggcacatttcccaggcaggtggaatgctagctagatctagaagcacccttaaaggtcatgtagaatcaaggtcccactttatgtttcccttgggagaaaactgaaacccatggatgctgtaatttgtttaacggcaaagaaagagccaagaattgtttctcgtagttccaggntcctgatctaggaatgtttccttggctccatggcatctcccagtttgacatagtgggagctgagaaatgccatatggcctcaaaataaataaacccttgtacatttaagtgttttcccagattttcagatgcctctactcttgctgaactcatcaccagctgtatcagtagagaggtgttatggggcaattcattagatttctggtaggtcatgaatggttggtataagctttatttactcatatattgtcatccagttctttgaaattcaatcttatcctaaagtggtagtcaaagtaaaacacattaagtaggtgtttgtgtttagcagtcctactaattcatcacaatcacatagtaattgtgattataatttttggaatctttatcactttctagcactttacggtgtcattatttatggcatttttaacaactttgttgcataattgataacatcagggctacatttttttcatgtgagcctcaagaagcttccattatcaacaagaattggggaaatgacttttttacattataataccttatatattaggtttttcctgataatcttcagtagacaatgatttaaattaactgaagtttaaataagaaatatgttaaaattactaaataatatgaaaaccacattatacttgtaattttcagacacttttctcctaccttaagattttaacatcttgtaaatattaatatttgaaggggagaggaaaaatacatttgtagtagaaatattccctctaacaattctgtttaactagtaagttttttttaagttatcttccatgcctgcttccctagtctgaactccacattccagttgtcagaagaatgaatggatttaaattttctaatcattattttgggcccatgttagcagttgaaacaattaagttcctcactctttcctgcttttaggatgattttagactgtgagcataaaatcaaccctttctgtcagcacagaattgaacatcgaatggagcaaggtctacactctcagcctgtagctgtgctaatgttaggattgaattgttctattaattccctcaagagacccacagcctcaaaagagttgcttattatcagatgtccgaaattcagaaacccaaagtcaggcaaagaaggaaactgagataatgatttaatttttttaagtcactgcaggatttctctcaaagaaaacatctgaaaatggttgagaaagtagttccagatcattaactattttacagagggactgaaagccagggaaaataaagaacagaatgatagtagtatcttgatattaaatttgcatcagaaatgagcaaaatatgtcaatatgaaataatttgaaatcaaattcagattcacatgtatagtgcatagttcaagaaataatgcttactcttgtaaaaaaaaaaatatatatatatatgtatcagcaggtagagtgtgggagctccaactttgttgtgaaagctgataacagagtatgattctttccagttacaaaatactgtattactttagttatagcaagcagtacataaatgacatcaacaactcaggctgctccctgacataaaagccagttccatctttactgcagatgacaggagactttccaagacctgcagaggccccctccaccccaaccttagtgcatgctcacacacacacacacacacacacacacacacacacatttttggcttttgacccactctgtgtgttccactgaagttatcttttccttaatagattcacacagaattaccccatcctgcaaaatccttatccctatgaatctctaaaatatattaaataatgtgttatatatttgctttttgtaaatctttatttaattaatttatatatactttgtgaagtcttatactgtacatcataaagcgatgtcatctgtagttggttcaatataatgtttatgatcattttgataagaaataactttggacattaggcccttgttaagaaataaaacacccattataaatttgcttctgttggaaaatacatgatttggcatacttcatttttagtaacaatctattctagataaatgataatttggggacatctgtacttaaaaactagctgaactacgttttgggatgagatgcaaagcaacagctgtccctggaactgaaatgtgaatttctagcagaacagaaaatattataataatgaggcaataataaaattaggaaattaaattatttttaaatctgtctgtgtgatttttccccttggtaaaaatacatgaaatacataattgaaaaattaccttcttctgaagtcgtagtttttaatcttaaccatcaataaataaacctattgttaacaatgtcttattcataattctaaaaaatttacaaatgatattgctatgaggttgtgcactattaaagtttgctccatcacttaaaggtaaagcagttcaaaaatactactttacatcacaactttgcatggctgagattttgaacaactaaattgatggttttacccacaagttatttcataaagctaacactgtaatattacttggttttcttatacttttgttatcatgtgatgaaatgtaactatgtaattaaacaaaattctgacaatcatattctgctaatgtttaaaatgttacttattccttcacttattagcttgctattttgaaaataaagtgaaagaaggccctttatt

SEQ ID NO: 35827 - DNA, 425 bp, Homo sapiens
tgagaatcaagaacaaagccagcgaaagaggagggagtgaataacctttcatttcaagctgctttccccactagagacagtcatgatctgtacagcactatttgatgcaaatgcctctcagaaaagagccagtggataatagataaaaagattatctgtgacattatgaaaaatgaaagtttaaaaacggctacaagtcccataaaaaaaaaatcctaaactttattcagtcttgttgaaaggcaacagcgggaactgtgttttgttcagcccctggggtccctgcctcttccgccattgttcttaataccttccaccagctcatctgtttttcaaaaatctttcctgctgcttttctctttgctgggggaacatagggtcccaggaggctattcacagctctgttttcttttccctaacggggc

SEQ ID NO: 35828 - DNA, 208 bp, Homo sapiens
aatttggggagtaaaactgaccttggaactcaagctcacttatggaaccatgtgcactctactgctgtaaacaagacaataagggtttttaaagatgttttttatctataaaataatgattcacaacatgagtgtgcagtgcaataaggttctttcctgaaagactagaacagaagaaccctttggaatgatatgagcagaatctata

SEQ ID NO: 35829 - DNA, 326 bp, Homo sapiens
agacagggttttgccacgttatccaggctggtctcgaactcctgacctcaagtgatcctcctgccttggcccaaagtgctgggattacagggctgagccactgcacccggcctgcttcttacactttaatctgcccatgattcacccagggatcctgataaaattcagactctgatccgggagaagcaatctccaggaagaacaaccttgtgatccagtggcccctgccttcctcaccctccctctccagccacagctgattggacctggggtgggcacctgagtcagggacccatgggctcacccacagtcagtgacaggatgcc

SEQ ID NO: 35830 - DNA, 561 bp, Homo sapiens
agctcactgcaacctctgcctcccaggttcaagcaatcctcctgcctcagcctcccaagtagctgggattacaggcatccaccacgacacccagctaatttgtgtgtgtgtgtgtgtgtgtgtgtgtgtgtgtgtgtgtgtgttttggtagagaaggggtttcaccatgttgcccaggctcttctcgaactcctgacctcagtgatcacacctcagcctcccaaagtgccgggattacaggcgtgagccactgcgcccagcctttccctctctttcgggggttctgaaagtgggggccagacagaatgaggaggtggggtgggcactgagcagccacagggttccccagccagagcctcctcgggctctagagcccgggagcaacttgcactctcggcctgcagggggtgccaacactcgggtgagaacttgatggcagtggctttggccaagatgggcccaggccttcccgcatttggagggaggtgtctgtgtgtgtttgcctgtctgtccatctgtctatccaaccctagctgccttcccctttaagtcacaccaccc

SEQ ID NO: 35831 - DNA, 983 bp, Homo sapiens
gtgtctgtaaggcacattttagtcttattttaaagaataataaaataatgaggatttattctgttatttggataaatccagaagaaacattttctacagaggtatgtattgggttgcttttctgaaaggagtaaatgatatatagagaatatatttttcttacccacttaaaatgaaagggcatcatttcaactttttgccaactgaacttcataagtgctttaaaatgaaccaaatgtcagacattctgtatgttgatgttttttcctcagacttcaatttttacttttacttacctgtgtaaaatgggaacacttccacattagaaggtagttgaagttaaatcacaagttgtggttgattgataggtctggaatgtttatggagtggtagctttcataataatagttgaagaaatatatgaaggtcggacatcaaagctgtccaatattggttccaagacactgaatgtatgggcagctagatggaagtagaattaagagaaaacagtgggattggatagaccaacagtaataaaaacaaacagaggcctcaaaggaaatggtatgaaacaaagaggaaaagtatttttcctatccagaacatgtaggttttctgatagctttagatctcactaaacaaccaaaatatgtaacagagataaagcactaaagaaaattacgcaggaagaagaaattagattttttttgaaaaaaaaaaggaaaagaaaaaatttggttacgtttacaaaagtgctataatagaagttttggcaaatttattactgcaaatgtttttgcactgatttcttggattgagtataatttaaggaaatagttttagataataggatttgaaggtaagtcaaataggcaaataaaaaagcagaagtataaagcgttgaggcccgtgcctgtaatcccagccactcaggaggctgaggcaagagaatcgcctgaacccgggaggcagaggctgcagtg

SEQ ID NO: 35832 - DNA, 668 bp, Homo sapiens
tgtaatcctgtattttacaattgttttcatggaaagagaaaataactaattcttcattctttaattgttgctctttggcaatacattgttttgagatttctcaacgctttatacttccatcaaagctgtccaatattggttccaagacactgaatgtatgggcagctagatggaagtagaattaagagaaaacagtgggattggatagaccaacagtaataaaaacaaacagaggcctcaaaggaaatggtatgaaacaaagaggaaaagtatttttcctatccagaacatgtaggttttctgatagctttagatctcactaaacaaccaaaatatgtaacagagataaagcactaaagaaaattacgcaggaagaagaaattagattttttttgaaaaaaaaaaggaaaagaaaaaatttggttacgtttacaaaagtgctataatagaagttttggcaaatttattactgcaaatgtttttgcactgatttcttggattgagtataatttaaggaaatagttttagataataggatttgaaggtaagtcaaataggcaaataaaaaagcagaagtataaagcgttgaggcccgtgcctgtaatcccagccactcaggaggctgaggcaagagaatcgcctgaacccgggaggcagaggctgcagtg

SEQ ID NO: 35833 - DNA, 417 bp, Homo sapiens
ggtcgtactctagaggtatcccctctcctatccagaacatgtaggttttctgatagctttagatctcactaaacaaccaaaatatgtaacagagataaagcactaaagaaaattacgcaggaagaagaaattagattttttttgaaaaaaaaaaggaaaagaaaaaatttggttacgtttacaaaagtgctataatagaagttttggcaaatttattactgcaaatgtttttgcactgatttcttggattgagtataatttaaggaaatagttttagataataggatttgaaggtaagtcaaataggcaaataaaaaagcagaagtataaagcgttgaggcccgtgcctgtaatcccagccactcaggaggctgaggcaagagaatcgcctgaacccgggaggcagaggctgcagtg

SEQ ID NO: 35834 - DNA, 335 bp, Homo sapiens
aaaaaaaaaaagaagcattcaaagaataatgagacatgtcaatagacaacaggagccagcttaaaggggtttccaatagcgaaatctgggacaatttgatcattagaataaccagggcagtctgcctaccaaactgcggcgggtgccgtgacagcctctgagcaggtccagaagggacccctttagctgaaaggcattgcagagctcagtgtgatcaagcagaagaagaaaaagaaggacaaaggcaaggcaaatttcctgaaagccatggcaatgagcaaaaagaacaagggggagaagcgacacagcctggacaagtggaccccagcccagat

SEQ ID NO: 35835 - DNA, 408 bp, Homo sapiens
tctagaacagttcacccaattgtgtttgtatgtctgcatgtgcgtgtgtgtgtgagagtgactgaggaccttttgcagatccagatcttaatttttttaaaagcatgtcctacaatctggatttgtctaattatttccattgtattagattcagtttaaacatttttagcaaggttactacataggcaatgatgtgcctttcctcttgcatcatgtcagaaggctcttaatatcaaatttccctgtaattgttgatgctgagtttgcttttaaaatggtgtctaggctggacacactggctcatgtttgtaatcccagcactttgggaggttgaggtgggaagatcgcttgagcccaggagtttgagaggagcctgggcaacatagtgagactctgtccctaccaaaa

SEQ ID NO: 35836 - DNA, 349 bp, Homo sapiens
gtgagcagaaaagttgggattttagcagctccggccagaggccatgccctgaatgacagcccctactgcctctcacttagcaaattcacagatctggcaacactgaacttgcagaactgtgtgaggaccaaagagggccacagggcaccttgcactgaattgggctctcaaaaaaaagtgttccctttcctaggccatggggcttcccagagccaagctgggacagaaggacagagatgagtagctgagcaggagttcctggggaataggtgcccagctccaggatggccagcatcggcccttccccatggctgcctctcaagctggagcgcactccaggacctgagca

SEQ ID NO: 35837 - DNA, 315 bp, Homo sapiens
aacagttcattccttttaacgctgagtagtgaagtatttcattgtctggaatgtatcacaatttgttgaactcttcatctgttgaagaatgttttggttgttgggatggttatgaattaagctgctatgagcatttgcctacatgtaattttttgggaacttacattttcaattcacttgagttagatacgtaggagtgggtcagataagtatgtgtgtaatttttatgtaaagatttgtaaatattttgtgaatctgtaacagaatgagtagcactttttccaggtgagcgtgtggattgccaagttgcataga

SEQ ID NO: 35838 - DNA, 248 bp, Homo sapiens
gctataatacctggcaatagaataattaagtgttgcccagggtcagaaaaacaagaatgatttgtattttaatcaataaaagcctgtagacgggagggggagtaacaaggaaacaatgtgatttattttctaagccggtgcctgtccacatatgcacagggtggcaagcagcatccagttatttccaagacttgaactctaaagtcagacagagtagggttcagatcctgggtctgccgtttagatat

SEQ ID NO: 35839 - DNA, 2158 bp, Homo sapiens
gccggacagagcagaagaaccctcttggactggacgatttgggaattcaaaacttgggacaaactgtcagccttgcccctgctgtggaggcagcctcaatgctgaaaatggagcctctgaacagcacgcaccccggcaccgccgcctccagcagccccctggagtcccgtgcggccggtggcggcagcggcaatggcaacgagtacttctacattctggttgtcatgtccttctacggcattttcttgatcggaatcatgctgggctacatgaaatccaagaggcgggagaagaagtccagcctcctgctgctgtacaaagacgaggagcggctctggggggaggccatgaagccgctgcccgtggtgtcgggcctgaggtcggtgcaggtgcccctgatgctgaacatgctgcaggagagcgtggcgcccgcgctgtcctgcaccctctgttccatggaaggggacagcgtgagctccgagtcctcctccccggacgtgcacctcaccattcaggaggagggggcagacgaggagctggaggagacctcggagacgcccctcaacgagagcagcgaagggtcctcggagaacatccatcagaattcctagcacccccgggacccctgcgggtggctccatcagccagcaaccttagagagaggaaagacagttttcaagtgtctggtttcactttcacagtgcggctgccactttgaagagacccttggtaaacccctgattcggggtggggtgggggactaggctcagccggaaccagcacctccaaggagtccgggaggtgcctgtggtttgcacccaccactgaaaaagccgcggagatgcgcagcgcgtacactgactttggggcctgggtgttggggttctgatcagaatttggcgggatgatatgcttgccattttctcactggatgccctgggtagctcctgcagggtctgcctgttcccagggctgccgaatgcttaggacacgctgagagactagttgtgatttgctattttgcctagagctttgtccttctagatctgattggctgtaagtatctctactgtgtacctgtggcattccttcacagtgggttacaagcttcttttggattagagggggatttttgatgggagaaagctggagatctgaacccagcccatttgcacactataagaaaaaaaagtaacttttaaacctgttaacattggccggggttataagagatgatcttctattttgaccttttgtctaacttatgaccttgaactctgacctgtgaccatgcagcatcacatgatggcatgacgttctttggatcagaagagcttccccagaatctaacctgcactcccgatggtggttcaggagactcttcctgatctttctagaaggggtaaagtggggttgaacaaggccaagccgttagctctgctgctgctcagtttcccagcctagttttctgagctgggagaggacataatgtggtatttcgtcacgtagctgagacctagaagggcatactcaggcggagattgcacaaagctgggctccaagttctgtgcttcctgatcccgagccctgacactcatttgctgtgtggtcccgggcatgtcatcaagaagctcgctgtctgcatgaggctcccgacgatctccatccccagggggttgggaggatgtctttagattttaggactctgtgataaatattccacagcctggtgtgaggaagcttggaccaaatgcttcccctttggccggttagtctgaacaaggatctgctgatttaaaggagcagttggagattcagaacacatataactggggaattcagggcaagctaccaacccagccctgctgtagttttcccaggactgaaggaaagaggcagacaccacattctcctctgcaaagttctctggagaatgtgtgatgttaacactcccagctaagggaaagcaaagtctaaaggaaaacacacaggaatgcttccaatgtctccaagtattcctgtggtcaacagtttcgcagatccgttaggcccttaaagacaaggaggaagtaaaaggtcaaatttaaatctatttaaaaaaacttttaaaaaaattatttatttattattattttttatttttaagacagaatctcgc

SEQ ID NO: 35840 - DNA, 909 bp, Homo sapiens
gccggacagagcagaagaaccctcttggactggacgatttgggaattcaaaacttgggacaaactgtcagccttgctccagcgccagagtggttcacattcaaccctcctcccccagtgcagagagctcccacgactgatgactcctgaaggaaaaccctggaggttcagctttagcttgaggtttcagggcttccgaggcaatcgggcagcatcagtcttcagccactaagctgagaagatctgggaaggagtcggtcggagagccttgggccagagttccaggggctctgggagtggctgccaggtaggaggtgggctgatagcacaagcattggagaccagaatcaagagctaccatacagttgggaaaactggctagccatatgcagaaaactgaaactggacctcttccttacatcttatacaaaaattaactcaagatggattaaagacttaaacataagacctaaaaccataaaaaccctagaagaaaacctaggcaacaccattaaggaagtaggcatgggcaaagacttcatgactaaaacaccaaaagcaatggcaacaaaaaccaaaattgacaaatgagatctaattaaactaaagagcttctgcacagcaaaagaaacatcatcagagtgagcaggcaacctacagaatgggagaaaatgtttgcaatctatccatgtgacaaagggctaatatccagaatctacaaagaacttaaacaaatttgcaagaaaaaaaaaaaacccataaaaagcgggcaaagcatatgaacagacacttctcaaaagaagacatttatgtgaccaacaaacatatgaaaaaaagctcatcatcactggtcattagagaaatgcaaataaaaaccacaatgagataccatctcatgccagttagaatg

SEQ ID NO: 35841 - DNA, 2596 bp, Homo sapiens
atggtccgaggggggcggggctgacgtcgcgctgggaatgccctggccgagacactgaggcagggtagagagcgcttgcgggcgccgggcggagctgctgcggatcaggacccgagccgattcccgatcccgacccagatcctaacccgcgcccccgccccgccgccgccgccatgtacgacgcagagcgcggctggagcttgtccttcgcgggctgcggcttcctgggcttctaccacgtcggggcgacccgctgcctgagcgagcacgccccgcacctcctccgcgacgcgcgcatgttgttcggcgcttcggccggggcgttgcactgcgtcggcgtcctctccggtatcccgctggagcagactctgcaggtcctctcagatcttgtgcggaaggccaggagtcggaacattggcatcttccatccatccttcaacttaagcaagttcctccgacagggtctctgcaaatgcctcccggccaatgtccaccagctcatctccggcaaaataggcatctctcttaccagagtgtctgatggggaaaacgttctggtgtctgactttcggtccaaagacgaagtcgtggatgccttggtatgttcctgcttcatgcctttctacagtggccttatccctccttccttcagaggcgtgcgatatgtggatggaggagtgagtgacaacgtacccttcattgatgccaaaacaaccatcaccgtgtcccccttctatggggagtacgacatctgccctaaagtcaagtccacgaactttcttcatgtggacatcaccaagctcagtctacgcctctgcacagggaacctctaccttctctcgagagcttttgtccccccggatctcaaggtgctgggagagatatgccttcgaggatatttggatgcattcaggttcttggaagagaagggcatctgcaacaggccccagccaggcctgaagtcatcctcagaagggatggatcctgaggtcgccatgcccagctgggcaaacatgagtctggattcttccccggagtcggctgccttggctgtgaggctggagggagatgagctgctagaccacctgcgtctcagcatcctgccctgggatgagagcatcctggacaccctctcgcccaggctcgctacagcactgagtgaagaaatgaaagacaaaggtggatacatgagcaagatttgcaacttgctacccattaggataatgtcttatgtaatgctgccctgtaccctgcctgtggaatctgccattgcgattgtccagagactggtgacatggcttccagatatgcccgacgatgtcctgtggttgcagtgggtgacctcacaggtgttcactcgagtgctgatgtgtctgctccccgcctccaggtcccaaatgccagtgagcagccaacaggcctccccatgcacacctgagcaggactggccctgctggactccctgctcccccgagggctgtccagcagagaccaaagcagaggccaccccgcggtccatcctcaggtccagcctgaacttcttcttgggcaataaagtacctgctggtgctgaggggctctccacctttcccagtttttcactagagaagagtctgtgagtcacttgaggaggcgagtctagcagattctttcagaggtgctaaagtttcccatctttgtgcagctacctccgcattgctgtgtagtgacccctgcctgtgacgtggaggatcccagcctctgagctgagttggttttatgaaaagctaggaagcaacctttcgcctgtgcagcggtccagcacttaactctaatacatcagcatgcgttaattcagctggttgggaaatgacaccaggaagcccagtgcagagggtcccttactgactgtttcgtggccctattaatggtcagactgttccagcatgaggttcttagaatgacaggtgtttggatgggtgggggccttgtgatggggggtaggctggcccatgtgtgatcttgtggggtggagggaagagaatagcatgatcccacttccccatgctgtgggaaggggtgcagttcgtccccaagaacgacactgcctgtcaggtggtctgcaaagatgataaccttgactactaaaaacgtctccatggcgggggtaacaagatgataatctacttaattttagaacacctttttcacctaactaaaataatgtttaaagagttttgtataaaaatgtaaggaagcgttgttacctgttgaattttgtattatgtgaatcagtgagatgttagtagaataagccttaaaaaaaaaaaaatcggttgggtgcagtggcacacggctgtaatcccagcactttgggaggccaaggttggcagatcacctgaggtcaggagttcaagaccagtctggccaacatagcaaaaccctgtctctactaaaaatacaaaaattatctgggcatggtggtgcatgcctgtaatcccagctattcggaaggctgaggcaggagaatcacttgaacccaggaggcggaggttgcggtgagctgagattgcaccatttcattccagcctgggcaacatgagtgaaagtctgactc

SEQ ID NO: 35842 - DNA, 1698 bp, Homo sapiens
cctctccatggtgcctctgctgggctcacatgtgaccaagcacagcaaaccatgaggcaggggatggtcttgaccatgagagcccttgcagcagctgccatgggcctcagctcctctccaagctgggaagagccctgaaaagccaaggtgtttttttttccctctttatttcagtgtaagtcccttgagctttcttgaaccagaagtgggctcattttgctttagagatttcaggtgggcttgtccttgtcctagcatcccagatccaccttctgggaagtcatcagattggaggtgatgttggcagcttttgtaaacaaagggtagtgttgtaagctgttgtgtctgcctatgtgtgtgtttgtgtacttggtctcatctctgcagactggtgacatggcttccagatatgcccgacgatgtcctgtggttgcagtgggtgacctcacaggtgttcactcgagtgctgatgtgtctgctccccgcctccaggtcccaaatgccagtgagcagccaacaggcctccccatgcacacctgagcaggactggccctgctggactccctgctcccccgagggctgtccagcagagaccaaagcagaggccaccccgcggtccatcctcaggtccagcctgaacttcttcttgggcaataaagtacctgctggtgctgaggggctctccacctttcccagtttttcactagagaagagtctgtgagtcacttgaggaggcgagtctagcagattctttcagaggtgctaaagtttcccatctttgtgcagctacctccgcattgctgtgtagtgacccctgcctgtgacgtggaggatcccagcctctgagctgagttggttttatgaaaagctaggaagcaacctttcgcctgtgcagcggtccagcacttaactctaatacatcagcatgcgttaattcagctggttgggaaatgacaccaggaagcccagtgcagagggtcccttactgactgtttcgtggccctattaatggtcagactgttccagcatgaggttcttagaatgacaggtgtttggatgggtgggggccttgtgatggggggtaggctggcccatgtgtgatcttgtggggtggagggaagagaatagcatgatcccacttccccatgctgtgggaaggggtgcagttcgtccccaagaacgacactgcctgtcaggtggtctgcaaagatgataaccttgactactaaaaacgtctccatggcgggggtaacaagatgataatctacttaattttagaacacctttttcacctaactaaaataatgtttaaagagttttgtataaaaatgtaaggaagcgttgttacctgttgaattttgtattatgtgaatcagtgagatgttagtagaataagccttaaaaaaaaaaaaatcggttgggtgcagtggcacacggctgtaatcccagcactttgggaggccaaggttggcagatcacctgaggtcaggagttcaagaccagtctggccaacatagcaaaaccctgtctctactaaaaatacaaaaattatctgggcatggtggtgcatgcctgtaatcccagctattcggaaggctgaggcaggagaatcacttgaacccaggaggcggaggttgcggtgagctgagattgcaccatttcattccagcctgggcaacatgagtgaaagtctgactc

SEQ ID NO: 35843 - DNA, 846 bp, Homo sapiens
atgctgaggctccccaaccccacgatcaccgaggatatttggatgcattcaggttcttggaagagaagggtatgtatgggctgggaggatcagccatgcccttttgacaagcatttactagcggtcttggtaaagacttgagatttgccttagttctaacacttagtgcccaacgccttccttgtgttcctcaacctactcatgagcccaggagataggaaatctccgtcccattgtacagatggggaaacagaattttggaaaggagagccaagcagcacacacccctccctgaggggcagagccgagatttgaactgggatgtcatgactccagggccctctccctccccagggtccccttatctgaaggcggtttttctttccagctcgacctcttgtgacccttagtttaacaagggccgaagttaaagagtttctgcgcctggaccccaaatgaagcaatcagatttctcatctccagtcaggtgtgggtccaagcccactagacaagtttgctcttcccagagcacatttctgccttcaagtcatcctggcttgtcagggctgggggagttctgctgtagaaatattagagtggaaggaaaaagatgtgttgggagctatttttctttaatactaaaagttggttgatgaatttgtcgttggccaagaccaaggagactgcatttttaaggacatatgtgtatttatctgctcagaaaatgttcattgctgtgtgctagggatactgcagtgaacacagaggtgtgacccttgccagccttgtgagagaagtgagcagataagtaagcagaagggtgatgctgtgatcgtggggttgtaa

SEQ ID NO: 35844 - DNA, 611 bp, Homo sapiens
gtgcagtggcgtgatctcaactcactgcaagctccacctcccaggttcacgccattctcctgcctcagcctcccgagtagctgggactacaggcgccagccaccaagcccggctaatttggtccccttatctgaaggcggtttttctttccagctcgacctcttgtgacccttagtttaacaagggccgaagttaaagagtttctgcgcctggaccccaaatgaagcaatcagatttctcatctccagtcaggtgtgggtccaagcccactagacaagtttgctcttcccagagcacatttctgccttcaagtcatcctggcttgtcagggctgggggagttctgctgtagaaatattagagtggaaggaaaaagatgtgttgggagctatttttctttaatactaaaagttggttgatgaatttgtcgttggccaagaccaaggagactgcatttttaaggacatatgtgtatttatctgctcagaaaatgttcattgctgtgtgctagggatactgcagtgaacacagaggtgtgacccttgccagccttgtgagagaagtgagcagataagtaagcagaagggtgatgctgtgatcgtggggttgtaa

SEQ ID NO: 35845 - DNA, 1216 bp, Homo sapiens
atggtccgaggggggcggggctgacgtcgcgctgggaatgccctggccgagacactgaggcagggtagagagcgcttgcgggcgccgggcggagctgctgcggatcaggacccgagccgattcccgatcccgacccagatcctaacccgcgcccccgccccgccgccgccgccatgtacgacgcagagcgcggctggagcttgtccttcgcgggctgcggcttcctgggcttctaccacgtcggggcgacccgctgcctgagcgagcacgccccgcacctcctccgcgacgcgcgcatgttgttcggcgcttcggccggggcgttgcactgcgtcggcgtcctctccggtatcccgctggagcagactctgcaggtcctctcagatcttgtgcggaaggccaggagtcggaacattggcatcttccatccatccttcaacttaagcaagttcctccgacagggtctctgcaaatgcctcccggccaatgtccaccagctcatctccggcaaaataggcatctctcttaccagagtgtctgatggggaaaacgttctggtgtctgactttcggtccaaagacgaagtcgtggatgccttggtatgttcctgcttcatgcctttctacagtggccttatccctccttccttcagaggcgtgcgatatgtggatggaggagtgagtgacaacgtacccttcattgatgccaaaacaaccatcaccgtgtcccccttctatggggagtacgacatctgccctaaagtcaagtccacgaactttcttcatgtggacatcaccaagctcagtctacgcctctgcacagggaacctctaccttctctcgagagcttttgtccccccggatctcaaggtgctgggagagatatgccttcgaggatatttggatgcattcaggttcttggaagagaagggcatctgcaacaggccccagccaggcctgaagtcatcctcagaagggatggatcctgaggtcgccatgcccagctgggcaaacatgagtctggattcttccccggagtcggctgccttggctgtgaggctggagggagatgagctgctagaccacctgcgtctcagcatcctgccctgggatgagagcatcctggacaccctctcgcccaggctcgctacagctatgatattggaaatggacatgtcttttcaaggaaaataaaagcaggctttctggaatggcga

SEQ ID NO: 35846 - DNA, 465 bp, Homo sapiens
acactctgtccccgtgcactgagcaccctttagttcatatgacccccttaggcatgttacatgggcactcctataggtgcccatctggccctaggacttggccaacacaacatggactccagtttccatctgcctctttgccaggcacttttgtgcagtgcacacactgtacaacagtagacggcaaccctgagagccagagtagagcctgtcctagcaccggaatgctcggtaaggatttgtcgcaggagtgattccaaagccaatgtcctccctccatatcagcctgtttgtggctctgagaagctctgcccacatgtgaaagcttgttaagcacttaagcactaacccagagcttcagacagtgccagtcctttttccccttctttaaaagcgatatgtggatggaggagtgagtgacaacgtacccttcattgatgccaaaacaaccatcaccgtgtcccc

SEQ ID NO: 35847 - DNA, 505 bp, Homo sapiens
gtcctgctttaaagccccatacccctttctccgggtgacaaacacctgtgctcgttctcttcccttcccctcttccccttgcatttggctaataacaggccagctgcctgcctccctgcagtttggtagatgggtgggtaacgaccaccactcccacgttcgcctgatgggcttgttttccgtgcccttcacaggcatctgcaacaggccccagccaggcctgaagtcatcctcagaagggatggatcctgaggtcgccatgcccagctgggcaaacatgagtctggattcttccccggagtcggctgccttggctgtgaggctggagggagatgagctgctagaccacctgcgtctcagcatcctgccctgggatgagagcatcctggacaccctctcgcccaggctcgctacaggtacccactcctcggggtgagcacgggcagcaccttgttttctttcttgtgcattatggaggaagatggtactgccacatgggagcgat

SEQ ID NO: 35848 - DNA, 304 bp, Homo sapiens
  misc_feature (277)..(277): n is a, c, g, or t
caaaagttttagtaaatagcaagttttctaaatgtagataaatgaagcatgtgtgcccagaaatgatagttgtgctgtcttcaggtctttcttgtatgtttgacaatgtaaaatgtgttgaggccaggcgtggtgctcatgcctgtaatcccatcattttatgaggctgaggcaggagaatcagttgaacccggcaggtcgaggctgcagtgagcagtgactgtgccattgccttccagcttgggtgacacagcaagactttgtctcaaaagtaaangtgatgagaaaaagaaatgtgataaga

SEQ ID NO: 35849 - DNA, 342 bp, Homo sapiens
ctcctattctttcctcaaccgatttcaacgagtcttggacatagactctcttcctggggcttcaattaccatctgtatgctgatgatggccaaatacacatttctagccaatgaataacctctgaattccagatctatacacagtatattcaactatcaatgctaaatatccactctgatgcttcaaaagcttcttaaaggcacatgtccacagactcatgagtcaatccctattaagcacacatataaatcttcctcctcttccattctattctgtctcagcaaatgaggccaccagctgtagaagccagaaacttgagtgtaatcctcaaaaccttcttc

SEQ ID NO: 35850 - DNA, 425 bp, Homo sapiens
tttttttttttggtggggttgaggggacataacagttttttcactcttgttaaattaattttctgttgattccatctatccttaatcttcattatgagcaacataccaggttttcttctgaagatcatatgtggtagtgaggcaataatgcaaagacataggatggcagggggattccggcttctttctttcttcccctcctgtggaaagagggtctataacactccgtagtagataggacaattctaattatgaagggtaattagctaggctctgctacaaccgagagccctgagagattcctcgacgctggctgcttttctcttcctctccaccagaggcgacagcctctttccaaacagaaactgggttggaataggccggtccgggggaacggccagaagaaagatcaaaggttaaaaacc

SEQ ID NO: 35851 - DNA, 473 bp, Homo sapiens
aatactaagctgaaacttctgacaactaattattatgggggacacaataaagattgaaagcctaggttaccaagttggttttagctttctagaatctttgtaaatactcacgttcaaataagatcacacgtgcatatatagaaagcaatatgttctgaaatttcactttagtgccactgtttgtccataatggatttattgccaattttgaatcctcatcttactttgatctggcttttttttcccccccttgccagaatgtttaggagaaagtaaaattattccgttttactttggctttttgccagagatacaaactaagaatagtctgaatatgtgtttttcagatctggttacaagacggattatagattgtgttttagagcaatgttgtgattgaaatataaataatggtataactttttttgtgttagcaaaaacaacattaaaaaggttatgttacataatatgta

SEQ ID NO: 35852 - DNA, 382 bp, Homo sapiens
aacttaacaagaattcatatgcagaaacccataattctcagcagttctttagggtaaatgaaactaaagtttagggagagagaacaaggagaatttgcaaagatatgtatgacagtatttaaaaatgttcttccagcacaaagacattaatcttcctttgtcaaaataattctttctgcatgaaaagttggcatggggctcccaggcttcaggtaagatgggagaaagggagcgtttctttttttttgtaccaaagtactcaatcttctgatcttccttgactttcacgacataggcatatgtctactctgaccagtttgtttcatttattgtggtaagatgtgcttgtcttgtgctttcctggtgcagaaaaggagctgcc

SEQ ID NO: 35853 - DNA, 347 bp, Homo sapiens
ggcagaggctgcagtgagctgagttcacaccactgcacttcagcctaggtgacagagcaagactctgtctccaaaaaataattttaaaaaaagtacaggacaaactatggcaaaatgggaatctgaccagccgaccggacaaaggcttttgttgatagagttgataaaggagacctcatcaccagacatcagcatttcccaaaaacccataagtgaataaatatgaaagtaagagaagttatcacataatgcaaaataaaattcagagcaaatgaaatatacataaacataaatggaagaaaaggtggaaaagaaagacaaatagatactataatatagagaaaaag

SEQ ID NO: 35854 - DNA, 572 bp, Homo sapiens
acatatcttgccagaatctctcttatgatacttagaaagttttcatgtacttggagctaaattagtccccaaaccaaattcattattttcttcttaaaaatgtcttttacttccttgaatctgcttctgtatttcccatgtaaatttacaatgtattttgtccagttactgagataaatacctctacttttgcacctagacatttaggagccattgtttactaaattcatttgatgctgtcttctaaaagaactaaaatctagcatctcctcttcatacctcctgccactgtctttcattttccatacctggagttctgatagtagatttttaacgagcttttcccgtctctgtcttctacctagatccagtatatttctgcagtctggtatgtttttccccctaagaacctcagctgagaaataaagcaggttaacaaagctgtatgaaatgtcactggcagttaaggaaattctagttgaaacaatgggtttgctaatttcactgacgattagaaaaggtaatagaaattagaaaccaacattctcagatacttcaggtgggaatctggt

SEQ ID NO: 35855 - DNA, 374 bp, Homo sapiens
gatgatgcctgtcttgctaggatcacattttgagtagtaaggattaaaatagggagaaaaagagataggctgatcagttatgaagttatttcagtaatatacattactaaaacatatgtatatactactgaaaagtttttctacttatactgtgttactagccatttttaaagtgcattataaaccttaactcatttaatcttcctaatagctatatgaagtaggtgctattactacccccattttgcagatgagaaaactgagagcaactttccaatgatagagttagtaagtggtatatccacattccaaaccaggcaatgtagttggagttctaatttagttctagttctttgctcttaatgactactctg

SEQ ID NO: 35856 - DNA, 387 bp, Homo sapiens
ctaaggatgtccaacttttccagcactgtctgtttaaaaggctattcttcctccattgacgatcagttgactgtacttttgtggatttaattctggcttttctattcaatttcattgatctatctgttccttcactaatatacatcgtctctattgtctgttgctatgaagtaaatcttaatcagatagagtgattcctcccatttaattctttcaggaaattgtttcaattattctaatccattgcctttccacgtaacttttataataatcttgtctaagtcttcaaaaaaaccttgctggagttttgataagaattgtgttaaagtaataagtcaatttcaggagaattgtgttaaactaatggagaattggcatcttcactat

SEQ ID NO: 35857 - DNA, 313 bp, Homo sapiens
aactggatgtctttgggcatgagagccaactctcttaccgtagatggcacacaaattagcatcttcaaaccaacccaccaggtacacttcactagcctccaggtacacttcactagcctcctgcagcaccccaatgactgtgctctgaaacctaaagttggttttgaaatcctgggtgatctctctcaccaacctctagaaaggcagcttccagatgagaagctaggtcaatttctggtaacgagaatctctagaagtgccacagtcccaggcccgtagcgatgaggtttcttcaccagaccggtagagggga

SEQ ID NO: 35858 - DNA, 932 bp, Homo sapiens
ttcttttttttcaagctgtagaatttctctgccatgcaaaacttgttgataataatataacaaacatttccatctctattgccctgcttaggaaataaatcttacggggacactggaagactcttgggtgtcccttcctgatcctgttccccacctctgtcaccaggggtaacccaaacctgaactgcgtgtttatccataaatgataagtggtattgctttgcatggttttaaactttcagtagcggtttctgtcttttattcattcataaactcacaaacatatacatattgagaacctactgtatgtgaggcaccaacctaagccctgggaacatccgtaaacaacagagaggattactgctctcatgggacacacattctggtggggtgagccaaaccataaacaaaagaattgaagaacacaagtatctggcatgaagaaaatatcctacaagtttgcagagaaaaagtggatttcatacaaaggatcatggatccgaatggcactggattctttaacagcgtcagtgggaaccggaacatgatggaggaatatgttcaaaattctgaaagaaagagtttgtagttaaattagtgacgaaaattagtaaaccaagccaatggtaaaaacgagacaattgggccgggtagagtggctcgcacctgtaattccagcactctgggaggctgaggctgtggatcatctgaggtcaggagtttgagaccagtgtggccaacatggcaaaaccccatctctactgaaagtacaaaaattagctgggcttggtggcgcgtgcctgtagtcccagctactcaggaggctgagataggagaatcacttgaacttgggaggtggaggcttcagtgagccaagactgtgccattaaactcccgtctgggggacagagagagattctgtctcaaaaaaa

SEQ ID NO: 35859 - DNA, 355 bp, Homo sapiens
taaacctagaggaaattatgctaaatgaattaagccagtcacagaataaccaatactgaataattcaacttatatgaggtatataaaatagtcaaacttataaaaaacagagttaaatggtggttgccattggctaggggaaggagggaatggagggtaaaacggataaaaagtttcagttatgtaatatgaataaattccagagaactgctgtatgacattgtgcctgtggtctataatactgtcttgtgcacttaaaaatttattaagggggtagatgtcactctgtgttctcatcactaataaatacttattaataatcaattgataattaaatataaattaataaaacatt

SEQ ID NO: 35860 - DNA, 382 bp, Homo sapiens
agaagtctgaaatcaaggggtcagcagggttggtttcttcagcagagtctacggaagaatccctcccacatctccctcctcgctttgggtggcttctggccatccctgctatgccttgacttgtagatgtcactcccgtttctgcttgcatctttgcttggccttcttccctacgtctgtgtgtctcctcttcggtctcttctaaggacatgtgtcgttagatttatggcccaccctagtccagggacaatctcatcttgagatccttaatctaattacatttgcaaagtcccttttcggcaataaggtcacgttcacaggtccagagattagggacttaaacatatcttttctgggggctgggggggacactattcaaccc

SEQ ID NO: 35861 - DNA, 334 bp, Homo sapiens
cttaggaaaatcattgggaatatctctaacttgtgatttagtaggcttggaaaatgtcatataaaaagttgaacttttaagctgggtgtggtggctggtacctggaggcccagttacttgggaggtggaggcaggcagaattgcttgaggccaggagtttgagaccagcctgggtgaacagaacagatctcctcttggctctaaaaagtaaaaattgagaagtaaaggaaattaaaacaaaataaaagttgagcatcatagcatgtgcctgcagtctcaactacttgggaaactgagatgggaggatcactcgagcccacaagttagaggctgc

SEQ ID NO: 35862 - DNA, 426 bp, Homo sapiens
ttttgttaagcccctgttataagcaacgcactgttgggggtggggaaggcagaaggacaaaaagaaaagatctaatttgagctcaggagccagacataaaagcaggaagtgttaacaatgcaaaagataccaaacaaaacaaaaacccaaaaaaaagtacagggaggggggtgagttggcaaataattaatccatctgtagaggaaaccaattattttgtctgctaaatacgcttcccttcttctaagaataaaagaggtttcctctacttctgggtgttgttccttccagcccccgacctcgaatcctgtaatacccacgggaactgcactttctttcatggtcccactcccctgaccataattgattggtaaggaatgagtcctagcagcatgtaagtcctccggtgccagtttcttcctgtaa

SEQ ID NO: 35863 - DNA, 435 bp, Homo sapiens
cgtagccccctgagggctaccagcatcagtctcacttgccagctatgttcagggtcttcctatcagggaatctcatccatagccattggtagtctctgtctgtcttgctgacacttagaacagttctcactggcattacgtgcctgtgagggtgcaaaaggaacatgtctttattcatcctatgtctgcactgctgcagtacccctatgtgtgctcatagacacatagcacacctgcttgctgattccagtgaccttcccaatctggaagggagttcttctgatgggcactgacttgttctactttaatgcacccctcaaatttccataggttgtgtggccaggccattgattactgcctgtgagtcagtaaaaaaacctcaaacacaggggcttccaccactgttcagttctgccattactgtaaaaacaaaac

SEQ ID NO: 35864 - DNA, 265 bp, Homo sapiens
aaattgcgtttccaatagaattgtttttaaattactgcaatatatcttttgagatggagtcttgctctgttgcctagggtggagtgcagtcttatgatctcgtctcactgtaacctctgccttctgggttgaagagagtctcctctctcaccctgaggttacaggcgcacactaccacacttggctaatttttgtatttttggcttctttttgagatggagtcttgctccgtcgctgaggctcaagggcagtggtgcgatcttgg

SEQ ID NO: 35865 - DNA, 372 bp, Homo sapiens
actgagacacaacctgttcttatttaacactttctagggaaagaggccctaggatttgccatagcaaaccattactgcatctaatatcaagcaccctggaagtaagaaaataattatgatcaagctggctattttatttcccagaccacagagtctggaagaaactatttgcatacatattaatggatcagaagtaaattttacttttggaaaaagaactctgttctttatctctctcccattaagcttgggcctgggctatggtgtatgaaatccaatctccaataccaggaaatgattatttatttgaacgctcccctaaaacccattaagtgctctggagtgttagtttgggatgacagatttcgtagc

SEQ ID NO: 35866 - DNA, 348 bp, Homo sapiens
agcaaggagcgtcgacggaggagatagccacgagaaccagaaagtgcagaatgagcctcctccccatcaccaccacccccgccactgctggcagggaacacaccaagatcttaaaaatcatcagtttttagggccgggcacggtggctcacacctgtaatcccagcactttgggaggccgaggcgggtggatcacgaggtcaggagatcgagaccatcctggctaacacggtgaagccccgtctctactaaaaatacaaaaatattagccaggcatggtggcaggtgcctgtggtcccagctactcgggaggtggaggcagtagaatggcacgaacccgggaggcgga

SEQ ID NO: 35867 - DNA, 391 bp, Homo sapiens
gagagattctacaaaacaattgacttgtaatctccaacagtattaaggtcacaaagtcaaggaaacaccgagaaactgctgtgactcaaagatctaaaaagacgtgacaactaaatgcaacaaatgactttgaaatggatccttttgctgtaaagaacattactggtgactcttcatagggatccgagcattagatggtagtaatgtattaatgttacttttgatggttttgtagttatataggaaaatatctgtaggaaatacacactgaagtattcagggatgatgagacatcaagaaggcaaattgctgtcaaatggttcaggaaaaacagtttgtgattgctctagtctttaaaaaaaattagtaagaagaaacaaaagatttgaaa

SEQ ID NO: 35868 - DNA, 417 bp, Homo sapiens
aaaaaaccacacacacatttcaatctactgaatttgctcttgtcaggattaatccctccatttgctaagcccagtgctcatctgaattttgacagcattgaccctgaacctttgctttcgtcacattttatgagggacagtgacccagagaagagaaagatagtcataggtctgaaaagagaagaatgtgttctgttgtgttcttcaaatcagaaactgggccaatgggctaaaactacagggagacaaatgcattcttaatccaaaagtgcatagtcctaaccatgccccagacaacttttttttttctttctttttttttttttttttgagacaggatctcactctgtcacccaggctggaatgcagtagcgtaatcacagctcacttcagccttggcctcccaggctcagggaa

SEQ ID NO: 35869 - DNA, 402 bp, Homo sapiens
tttttttgaaacagagtctcgttctgtcccccaagctggagtgcagtggtgcaacctctgctcactgcaagctccgcctcctgggttcacgccattctgcctcagcctcccaagtagctgggacacttttggtttgtatttgtcacaagcaacgtgcttaatcaagactggaagaagctgactcaaaatgaaaggaagaacattgaatttctctcatctatctctactattttaagttttaaaagatcacctagaactgggatggattattacaaaaggccacaaatggctcttattactgaatcctttaatattctgatcatgacaaaaagcaacgaacacttgttatgggcttaactttcaaacaaactaaaggagaaaagaaaaatgttatttaaatag

SEQ ID NO: 35870 - DNA, 359 bp, Homo sapiens
gtgtgaccccattcgaccttttaacaaatccctaagtaaataaatagcccctaaggtaaactaagtttttctctgctgtttttttgcttgagagagctataactgtaatagacttatatttctgaacattttagtgcttgccaatatttggtaatatttatgtttcctatatttgtaatgaacattcttcttcaggtacattttttgttaaattattgtttcatgcataaaagttcaccttttattgtataaaattgactcagattaatttatacacattgacaatgggtaaatagagtttttcagattattaaaagctgaaggatgcccatgtaagcaaaaaaaaaagagaaaaaacc

SEQ ID NO: 35871 - DNA, 952 bp, Homo sapiens
tttgagccgaggagtgacaggacctaacttatattttgatgggctctctctctgtttcttgcatgtttgccatttgcccccttcccccttattctatctcagaacccctgcttactcatgttctgtgttctctaacatcagtctacatgtggcgttgggtttggtgttgtaacaactggtgacatttcagttcatgtgactactatgacctaatcactcagtctctcagtgtcccaattccagattcttgggtgacataatattagactcacatattattagactaactaatattagcccaccatggtacagcatgctgaggctggagtcagaagtgagcagaatcctgtaatatttccaagagggaatatgggcagacaggcaatggttagcacatcaacttcatcaagtacttcaaatattttggtttctcaataaatatatacatgagttaataaatctagcatatttagtaaacaacttataatcctacctactgttgtaatgctcagtaaccacttcagagtaacagtaataataggtgactttatactaaatgatggctttacactaaaacaggtttctaaaactatctgtggtaagaaccagttttcttatttgtatttccaaatagtctccataggagaatgatgtttttgtaaaatatgcctaaaaatgaattccttgacaaattaaattttaaaaagatatgcaaaattgaaaaaattttttttgttattagattcaacagacagaagattgctacgtcaaattgctctaggtttctaaatgcttagtctcaatttctgtactgatcacacaccagtaacagttccatactttaaatagcactgtactaaaactcacttatctaaatagtaaattttataataatgatggtcaattaatggcatttaatattctgaatgaacattaaagaatgtgaagttgt

SEQ ID NO: 35872 - DNA, 421 bp, Homo sapiens
gcctttactcctatagatggtggctcctctggttacgatttcagaattcaacatgttttacaatcaaaactagcatttgataagaaataaaaatcaataacccagccaaacacaccatccacatactcccaacgtgagagcaggaagaatcttgtgccttaactcccttcctgccatcagctccctccctccctccctccctcctccgtctctagcccagcaatccctctactccagttttgcccagctattgggaatcttggacagcttccttaggcccctgtgcatccaggtagggttggggcagcagaaagcgaagacccactcaagacagaccttgtcagtgcgtgcttgactcctggtcttttctgatgctttgtttgactcaacatacctcctccaacaacctgatttgcattga

SEQ ID NO: 35873 - DNA, 506 bp, Homo sapiens
  misc_feature (146)..(146): n is a, c, g, or t
  misc_feature (180)..(180): n is a, c, g, or t
  misc_feature (217)..(217): n is a, c, g, or t
  misc_feature (229)..(229): n is a, c, g, or t
  misc_feature (272)..(272): n is a, c, g, or t
ttttttttttgagacagtcttgctgtgtcacccaagctggagtgtagtggctcgatcttggctcactgcaagctcctcctcccaggttcaagagattctcctgcctcagcctcccgagtagaagggactacaggttcccgccaccnacgcccggctaattttttgtatttttggtagagnatggggttttgtcatgtaggccaggctggtctcgaanctcctgacctcngggcaatctgcctgcctcagcctcctaaagtgcggggattacnaggcgtgacacaccgcgcccagccgtccttggtttctaacagataatctgtccagtctttggcaagctctggcaacctcatcagctttagtgcctcaggcctaagaaagaagagcaaactagagcagagagctaacctggagcacttggggcggcctctgtgattcacgaactcactgccatccccattcaggcgagtatttctaggtccaggcagggggacacacagagaaac

SEQ ID NO: 35874 - DNA, 573 bp, Homo sapiens
cagtcatgatcaaagtcaactatcaagtctccctgagaaggatttggtcctagctccttaaaaacctgaggaagttttattaaaattctgggcttttgttccccctccaactaaatccctggagaacagctccccaaaccctgttctgagcaaatgagcgtgtatctgctcactgtatagactcagatgacgaaggcgggaagttcttcttgggcacctcagggagccagagatgcagagacgggagtagatcgtgtcaccagggaaatgaggaggcctatgtgcccactccctgctaatctgggactggcatggagaggctcaggactcacctgcttgactgtacagctgcatttctagtgaggaaaagttccacattcaaggattccaggatgaattgcctgtttggaaaatctgaatttttaaataaaggctttgcttaagcaaagacatacctgtctctctggccagggagagcctgtattctccctcattcctcacccccaccctgtgctgggccctcattcccgtctctactccaggtaggaaaaataaataaatttcaaagtcttc

SEQ ID NO: 35875 - DNA, 334 bp, Homo sapiens
tgattataccctgaaaactacaaaccattgctgaaagaaattaaagacgatatcaatatatggaaagacatttcattttcatggattggaagaatcaatattgttagaaagacaacattacccaaaatgagttgcagattcaatgcatcccctaccagaatcacagtaacattttttgcagaattagaaaacactgtcctaaatctcacatgacaggctcttattaatgactgacacaacacaaacactgagaaaaagaggtaaccatgaaaaggtggaaagttctgatgacatagaaaatagcaatcagcctttctcacatcccaaggccttc

SEQ ID NO: 35876 - DNA, 429 bp, Homo sapiens
atttagattgtgtttattcatctaccacttaaagttgaacttactctgataaagtttgtctcaggagaaattaatgagataaaaactttgctttttcttttctgaacgatttcttttgtgacaggtgaagaaggtcattgtatatttaggtagagataaaacaatgcagttgctagaagagctggtgagtgagcttcagctgaccgatcctgtcagttcaggggtcactcacatggataatcccccgtattatcgcatcacttccagctataaaatcccttctgtcacctcaggtgagaaatttgttaaaaccgattgctgtgtgagatgatagacatcttcatctgcttcactatggtaaccattttagggtctctatgtcccataacatgttatgaatctcagatatatacaataaaatttattaaa

SEQ ID NO: 35877 - DNA, 879 bp, Homo sapiens
gcctcagctgcttaaaaaccattgaaaatggcccatggccttgtccatctaacagagtccagtaaaatcctgacaatggaatggggagagagaaagtgagaaccaccaaactcagcacaaaacgactgagtttaaacctctgtgctaagagatgatcagagtctatcatggcttctagtagcatgagaccatgtctcacgaatgaccctaggctcccatgacaatgcctacctaagaaagctcaaggctgccaggggaacttactttagtctagccaatacttgatgatggcagtttcaggatctttctttcttatagcacttactaagaagggaatccttcctccatccctttgatatatgtgtgtatctcctagggacttcaatgtatctttgcccaggatctgaaaggcaatacttttgaggtgtagtcctcaggaaggactgagcctctgtcttccagtctctgtgggaggttagaatcctaacttctaatattgccagctggcagacacagctgtcctgatgaggcagacatttaaaatgaccaatcttttgtaatgtttcacttgtgccctgccccctgccctctcccctgcctctctctcccattagaatgccatcacctctgcacaaatgcgaacagaaccagccccttcctctacggtcagtagttactgaataaaattggttttcatcgatttgactaatgtctgatatatctttgacaaaataagtgtgaatgattgtttttagagacacggcagctgcaaagagaggcacagacatggcaggagagggaggggtcacctgacccttctcatttcataggcatctattcctgcctggtgtttatgagcctgagacttggcagggctgt

SEQ ID NO: 35878 - DNA, 531 bp, Homo sapiens
attaactgttccgggtgtctcctgactttcagtgcacggccacatcatggtacctaacttgtggcaaattgttgctttataagtaaggatccagtccaagttcatgtactacaattggttactttggtctctttgcttctgaaacagtccccaacatttattgtggcattgacttttttgtagagtccagggcattctaattttatagaatgccctgctcttgatctatcagacgaaatgcttcctcttgcatttaacctgcttctccactctctgggtttcctgtacactggactgctggtagaagcctgattagaagcaggtttaatgtggcaaaaatttctcctagcagtgcaaggcccccttccccagaaggcaggcagtgtccatctgctccaggattggtgtgtttttatcaagaatggatgttggattttggcagttcccttttcggcagctcttgagatgatcacgtggtgaatcattttctattactacagtgaattacagtcacttgaattccatcctact

SEQ ID NO: 35879 - DNA, 342 bp, Homo sapiens
atcaaaaggaagaaatgagaaaaagaacttttatctgaagaatgcaagtcctttccaattatcagatccagagaggtattaaaatgagacggcaatcctgtcctacacacacccccttttgaggcatgtactcatctttttatactgcttactattgccacaagtagctgaaaattagcctactggtgctgcaccagacattataacccatatcctatagcttaataatggatagccaatcaacagcttatgttatgttaatgtaaattattggtaaataactcaggaactgcctcttctttccttttaaaaacccacttgtgggccgggcgtggtggctca

SEQ ID NO: 35880 - DNA, 119 bp, Homo sapiens
gtttggtcccataagtcgtccagagcatacctcttctatttgtgtccctgttgtctgtcttggaaaccagtgcccgaataatgaaagattaatgagatcatcttcagccctgctttcgg

SEQ ID NO: 35881 - DNA, 428 bp, Homo sapiens
ttagtttgggaagatgagagggtgtggttgagaatgatttctgaaaactaagtgaacaaacactcaagaagactaagaactattaattggatttggcaacgtgggggtcattggtgaccttggttaaatgtatttttgtggtggtgtggcgataatggcctgattgaaatagattccagaaagcataggaagacagaaattggagatgtgctcttatacagataattcagagttgggctttatacttgtgtgaagaaacttgttattagctggaagaagatatatatcgaaagaattgatttaatgatggcagaagtcatggcatacttgtatattaataagcataattaaatggaagtctggaaattgaggaggcaggacagaaagaagaagactaaatgtagagacgtatttgagagggaatgggt

SEQ ID NO: 35882 - DNA, 1636 bp, Homo sapiens
aagggtcttcctcccccgggattcagagcggcccctcctccaggccaggctcgccgcggggcgctgagcaggcccggacaccgcggccgaggttatcgttaggcatctcccaggcgaccggctccgcagcaagatggcggacgagaaggacagggaagagagattggaacaattatcaggtcattaggatgctgtcctacggaaggagagctgcatgatctgattgcagaggtagaggaagaagaacccactggatacattcgattcgaaaaatttcttccggtgatgacagaaatactactagaaagaaaatacagaccaattccagaagatgtccttcttcgagcttttgaggttttagattcagctaaacgtgggtttcttactaaggacgagctgatcaagtatatgactgaagaaggataacctgagattttcccaaggtaaaatccaaatagagacctgatgtgccactggctcggccgtgcatgctagaatcaccagccagagatgaggatgaaccgcgtgccttcaggacagggcggagacggaggaggaaaggagtgtggtgatcctcggaacatcagcagacaggctgttgatgataggaacacattgcagcggggaaggaggatggctgagatatgaaatacccttcaaggtggacgcatacccaggggcatgtcattcggtggcaggggccagcacggacatgcagcactgaggcgtgtgctagcgcccaatgcgtcgacccaggcacggacttgtttggagcatacaggacagctctgcgttaagacctgtaagccattaaagaagtacagtctggtgaatgaaccctaatctcttgatgatcaagtgatgacatcatattctgtctccgaggagacaccctcttgcacagaaggcagtagaggaagcttgcgtcgagattgcctacctccccagccccaccttcgagggttctttcaaaagttcggactgatgttcaacttcacatcttgtctcaaggcaatcctctctgtttagtctcatagagttggctttgtggaatgtaattcatttttatctttagcacaaatttgtctgtttcttttaaggccaccagaaagcacaacatagactccccacagaaatctcattttatctcctaagttgcagaataaacgtaccttgtttgcaaagggaacattttcctttacactcaaatcacttcaatgtgtattttgcctcttcagctcactgacctcgcccgcagcatctgatgtaagtcaccatatgccatttcccgactaggagagtgcttggcctcttgtgcaggaagtttgcttaccctcatgactcctggcttccgcagagcctgccataccccacagcttggccgggccctgtggaaagccatctctattctcacactgctggggaaggtgcatgactcaggacccgacacacaggcctgagagtctggcgatcttgtgctctgatcccagcttcatgtgtgactcactctggatcaggcgcttcacttcctgtgcacctctgtctgtaaaatagagagcccagctctagtccttctccctcctgagaagcaatgcagagatttagtcccctttgcagtcacccagtgtctaagtac

SEQ ID NO: 35883 - DNA, 1538 bp, Homo sapiens
tggggtcatcctggactctggcctacgtgtctttgtcctactcatggcctagagaggtaggatgaccgtctgtcctgctttgcccgtggtagttccagactatacctgtcccagtgtaattattaataggtctcctttgtactcttagaaatgttccagtttagatgattaatatgtggtcatcccattcaaaaaatagtgagtaaaaacggtggtgaggaatcgtcacttctggaaggcttcctgacagataattccagcagtggtaagaatggaaggcatttcttccttctctagtttcccaagatcatttttttccccaggataacctgagattttcccaaggtaaaatccaaatagagacctgatgtgccactggctcggccgtgcatgctagaatcaccagccagagatgaggatgaaccgcgtgccttcaggacagggcggagacggaggaggaaaggagtgtggtgatcctcggaacatcagcagacaggctgttgatgataggaacacattgcagcggggaaggaggatggctgagatatgaaatacccttcaaggtggacgcatacccaggggcatgtcattcggtggcaggggccagcacggacatgcagcactgaggcgtgtgctagcgcccaatgcgtcgacccaggcacggacttgtttggagcatacaggacagctctgcgttaagacctgtaagccattaaagaagtacagtctggtgaatgaaccctaatctcttgatgatcaagtgatgacatcatattctgtctccgaggagacaccctcttgcacagaaggcagtagaggaagcttgcgtcgagattgcctacctccccagccccaccttcgagggttctttcaaaagttcggactgatgttcaacttcacatcttgtctcaaggcaatcctctctgtttagtctcatagagttggctttgtggaatgtaattcatttttatctttagcacaaatttgtctgtttcttttaaggccaccagaaagcacaacatagactccccacagaaatctcattttatctcctaagttgcagaataaacgtaccttgtttgcaaagggaacattttcctttacactcaaatcacttcaatgtgtattttgcctcttcagctcactgacctcgcccgcagcatctgatgtaagtcaccatatgccatttcccgactaggagagtgcttggcctcttgtgcaggaagtttgcttaccctcatgactcctggcttccgcagagcctgccataccccacagcttggccgggccctgtggaaagccatctctattctcacactgctggggaaggtgcatgactcaggacccgacacacaggcctgagagtctggcgatcttgtgctctgatcccagcttcatgtgtgactcactctggatcaggcgcttcacttcctgtgcacctctgtctgtaaaatagagagcccagctctagtccttctccctcctgagaagcaatgcagagatttagtcccctttgcagtcacccagtgtctaagtac

SEQ ID NO: 35884 - DNA, 1476 bp, Homo sapiens
gagagcagcgaggcaggagtgaggtcgagtgggcaggcgtgagagccgagcacaggggcagaaaggaagactctgcacccagaaagcggaaaggagatggagtttcgctccgtcgcccaggctgaagtgcagtggcgtgatcttggctcgttgcaacctccacctcccgggttcaagagattctcctgcctcagcctcctgagcagctgggatgacaggcacacaccaccacgcctggctaatttctgtatttttagtagagacggggtttcaccatggtctggtgacctcctggtctcgaactcctgacctcaagtgatcctcccgcctcagcctcccaaagttctgggattacaggcatgagccaccgcacccggctgcttccttaactcttgatctcctctctgtatcttgctttgtctagctgttctcttctctccatattcatccaaacatttgcttagaagtacccagaagcatggcgttgaatgtggtacaccttgaacgaagggtgaagaaacgaggcagagtgacttagtagcaagtgacagcacacagtttaaattttaatattagcccatttacaaacaacagcttatataatagtcattcacatacctcaacactcaccatcccctccccactttttttctggagacagggtttcactgtcaccccagctggaatgcaggtggcatgatcacagctcactgtagcatcgacctcctggactcaaggggtcctcgcgcctcagcctcctgagtagctgggaccacaggtgcatgccaccacgcccagctaatgtttttttttattttttgtagagacagggtctggctatgttgcttaggctggtctcaaactcctgggttcaagcgatcctgccacctcagcctcccaaagtgttaggattacagatgtgagccactgtgcccagccaacattcaccccattcaagtgtgcaattcaatggattctagtatcttcacagtgctgtgcaactatcactcctatctacttacaaagcatttccatcatcttaaaaagaatccccatgtccaatagcagttccccttcccccaccgtcatcctcgggcaaccgctaatcttcctgtgtgtctgtggatttgcctcttcagggcatttcacataaacacaatcatacaatatgtggccttctgtgtctggcttctttcatttagtgtaaggcttttgaggttcatccatgttgtaatgtatatccttagttcattcttttttgttaagctcacaaataaaaagcctcactttttatttgaggcaaggagactggctacagggattacagttccagcagtcaaaacgcaactccaagtggcactatttggaccgtaggttttgcttcattttggctggaaaagggtattcaggatgtacttctcccagccggacaagaaaaagggcaaagaaaactggaagagacgtctcgtctacaca

SEQ ID NO: 35885 - DNA, 451 bp, Homo sapiens
tttttgttgctatgagaaccttctattttgtattagacattgcagccttgacgacgcaatgtttgtgctattttgcgcatgttttcctgcagctattcctctcctctagcaatagtcgaatggctctggtttcctcttgcgcccggcccagtttttccgttttagcttcggttgtcataggctgtgctgtcgctttctctgggaaaggacggtgaagactggacgggagaaaccgggagggcaggcgcggccgttctgcagcagccgggccgcttcccagcggggaggcgggctgcgaatgggaagcgggaggaggaggccgggccgcgggctggttctatcacccccttgggagcccagctcttcacctagctctccggcgcttttcaaaatatcctgcgcgggctgcgccggaggcgccggcagggggtgctgataatggcgtcgttgt

SEQ ID NO: 35886 - DNA, 1512 bp, Homo sapiens
tttttgttgctatgagaaccttctattttgtattagacattgcagccttgacgacgcaatgtttgtgctattttgcgcatgttttcctgcagctattcctctcctctagcaatagtcgaatggctctggtttcctcttgcgcccggcccagtttttccgttttagcttcggttgtcataggctgtgctgtcgctttctctgggaaaggacggtgaagactggacgggagaaaccgggagggcaggcgcggccgttctgcagcagccgggccgcttcccagcggggaggcgggctgcgaatgggaagcgggaggaggaggccgggccgcgggctggttctatcacccccttgggagcccagctcttcacctagctctccggcgcttttcaaaatctgcagttaacaacaaaaatcgagcaacgccacgtcgcacaaacaggacaggagggggcgaggggccaggctcgccgcggggcgctgagcaggcccggacaccgcggccgaggttatcgttaggcatctcccaggcgaccggctccgcagcaagatggcggacgagaaggacagggaagagataatagtagcagaatttcacaaaaaaatcaaagaggcatttgaagtctttgaccatgagtcgaataatacagtggatgtgagagagattggaacaattatcaggtcattaggatgctgtcctacggaaggagagctgcatgatctgattgcagaggtagaggaagaagaacccactggatacattcgattcgaaaaatttcttccggtgatgacagaaatactactagaaagaaaatacagaccaattccagaagatgtccttcttcgagcttttgaggttttagattcagctaaacgtgggtttcttactaaggacgagctgatcaagtatatgactgaagaaggtgagcctttttctcaagaggaaatggaagaaatgttgtctgctgcaattgatccagaatcaaattcaattaattacaaggactatataacaatgatggtgatagatgaaaattaaatgttctaaagataatttctgattgaaagaacaattttagaaattgcttgttcttgttaatttcacatcttatcttaggattcctatatgtgatatttaataccttgtgacataactattttaagacactttgtttttaaagatgatcgtaacactttaaaccaaatttagtatgtctagccttacagaatgataaattactatttatttaaaaactattcttaaaacattttaacattagaatggattgttgtttattttctacaataaaactcaggtcaccttcgaattaattaagctgacaaaatgaaaatgacttaattacccaaggtttggcatgtaaagatcttaagagggggcagaacgaaccactcgaaaacgagtagcagtgtaatgaaggcttcttttttaaacaataacaaatgcttcatcaatctgagtgtggaaggtgatttatcaaaataaatattactaat

SEQ ID NO: 35887 - DNA, 2426 bp, Homo sapiens
tttttgttgctatgagaaccttctattttgtattagacattgcagccttgacgacgcaatgtttgtgctattttgcgcatgttttcctgcagctattcctctcctctagcaatagtcgaatggctctggtttcctcttgcgcccggcccagtttttccgttttagcttcggttgtcataggctgtgctgtcgctttctctgggaaaggacggtgaagactggacgggagaaaccgggagggcaggcgcggccgttctgcagcagccgggccgcttcccagcggggaggcgggctgcgaatgggaagcgggaggaggaggccgggccgcgggctggttctatcacccccttgggagcccagctcttcacctagctctccggcgcttttcaaaatctgcagttaacaacaaaaatcgagcaacgccacgtcgcacaaacaggacaggagggggcgaggggccaggctcgccgcggggcgctgagcaggcccggacaccgcggccgaggttatcgttaggcatctcccaggcgaccggctccgcagcaagatggcggacgagaaggacagggaagagataatagtagcagaatttcacaaaaaaatcaaagaggcatttgaagtctttgaccatgagtcgaataatacagtggatgtgagagagattggaacaattatcaggtcattaggatgctgtcctacggaaggagagctgcatgatctgattgcagaggtagaggaagaagaacccactggatacattcgattcgaaaaatttcttccggtgatgacagaaatactactagaaagaaaatacagaccaattccagaagatgtccttcttcgagcttttgaggttttagattcagctaaacgtgggtttcttactaaggacgagctgatcaagtatatgactgaagaaggtgagcctttttctcaagaggaaatggaagaaatgttgtctgctgcaattgatccagaatcaaattcaattaattacaaggactatataacaatgatggtgatagatgaaaattaaatgttctaaagataatttctgattgaaagaacaattttagaaattgcttgttcttgttaatttcacatcttatcttaggattcctatatgtgatatttaataccttgtgacataactattttaagacactttgtttttaaagatgatcgtaacactttaaaccaaatttagtatgtctagccttacagaatgataaattactatttatttaaaaactattcttaaaacattttaacattagaatggattgttgtttattttctacaataaaactcaggtcaccttcgaattaattaagctgacaaaatgaaaatgacttaattacccaaggtttggcatgtaaagatcttaagagggggcagaacgaaccactcgaaaacgagtagcagtgtaatgaaggcttcttttttaaacaataacaaatgcttcatcaatctgagtgtggaaggtgatttatcaaaataaatattactaatttatttttttatgagtgccaattacaaatatcatttgggataataataacttagtgtaaacatttatatttgctgatccagcatgtcaccatttatggagtagctaaaggagttgagatcattggaactagagaaaagaaggttgagtggaagttgatagtgtaaggtagtggcaattctccctttgtctttagaattctcacccactccgcatatctgtcatgggagcattgtcctgaatactgagtaagaatactgagaaatgttatggtgtgcaaatgtacagctcctgaaagagcagaatgaagcacaagcagtcacaatggaaaaatatatggcatggccactgcctcctccttgcaattctctccgatcttggcatcttatatggcaactatatggcaacttacaagcaaaggggaagataaagtaaagggaagtgaacaattttccaaacttagatattctgttataacaagacacacacacacacacacacacacacacacacacgggtctctatttgaagatggcttcaccactatatgtgtgtatctacatagatgtaaacatttagagttgctgtgagccttcctcaggcatgtagtcttgcccccaaaagaggcggctgctacccaagagactgtcgctgttcattcattcatgaaacactgaaggagtaccatgagatgatgtgctgggaaccggagtccctaacgaatccaggtcacagtttagtgagggaagcctgcaaggcagtcagcagccacatttcagataggggcatgttcagggtcccgtgcaagtgccgaagagaggcagctactcagccttgcagggagagagctttctggaagatgaaaggtgctagtgagcggagaaggcttcccaggacaggaagctcctgactttaa

SEQ ID NO: 35888 - DNA, 2538 bp, Homo sapiens
tttttgttgctatgagaaccttctattttgtattagacattgcagccttgacgacgcaatgtttgtgctattttgcgcatgttttcctgcagctattcctctcctctagcaatagtcgaatggctctggtttcctcttgcgcccggcccagtttttccgttttagcttcggttgtcataggctgtgctgtcgctttctctgggaaaggacggtgaagactggacgggagaaaccgggagggcaggcgcggccgttctgcagcagccgggccgcttcccagcggggaggcgggctgcgaatgggaagcgggaggaggaggccgggccgcgggctggttctatcacccccttgggagcccagctcttcacctagctctccggcgcttttcaaaatctgcagttaacaacaaaaatcgagcaacgccacgtcgcacaaacaggacaggagggggcgaggggccaggctcgccgcggggcgctgagcaggcccggacaccgcggccgaggttatcgttaggcatctcccaggcgaccggctccgcagcaagatggcggacgagaaggacagggaagggcctgggatacaacagtgatgagataaggcctcggactttactgatcgaacatctaatggaaggtggaagaagagaccatcacacaatgacggtgttatggggaacacaggagataatagtagcagaatttcacaaaaaaatcaaagaggcatttgaagtctttgaccatgagtcgaataatacagtggatgtgagagagattggaacaattatcaggtcattaggatgctgtcctacggaaggagagctgcatgatctgattgcagaggtagaggaagaagaacccactggatacattcgattcgaaaaatttcttccggtgatgacagaaatactactagaaagaaaatacagaccaattccagaagatgtccttcttcgagcttttgaggttttagattcagctaaacgtgggtttcttactaaggacgagctgatcaagtatatgactgaagaaggtgagcctttttctcaagaggaaatggaagaaatgttgtctgctgcaattgatccagaatcaaattcaattaattacaaggactatataacaatgatggtgatagatgaaaattaaatgttctaaagataatttctgattgaaagaacaattttagaaattgcttgttcttgttaatttcacatcttatcttaggattcctatatgtgatatttaataccttgtgacataactattttaagacactttgtttttaaagatgatcgtaacactttaaaccaaatttagtatgtctagccttacagaatgataaattactatttatttaaaaactattcttaaaacattttaacattagaatggattgttgtttattttctacaataaaactcaggtcaccttcgaattaattaagctgacaaaatgaaaatgacttaattacccaaggtttggcatgtaaagatcttaagagggggcagaacgaaccactcgaaaacgagtagcagtgtaatgaaggcttcttttttaaacaataacaaatgcttcatcaatctgagtgtggaaggtgatttatcaaaataaatattactaatttatttttttatgagtgccaattacaaatatcatttgggataataataacttagtgtaaacatttatatttgctgatccagcatgtcaccatttatggagtagctaaaggagttgagatcattggaactagagaaaagaaggttgagtggaagttgatagtgtaaggtagtggcaattctccctttgtctttagaattctcacccactccgcatatctgtcatgggagcattgtcctgaatactgagtaagaatactgagaaatgttatggtgtgcaaatgtacagctcctgaaagagcagaatgaagcacaagcagtcacaatggaaaaatatatggcatggccactgcctcctccttgcaattctctccgatcttggcatcttatatggcaactatatggcaacttacaagcaaaggggaagataaagtaaagggaagtgaacaattttccaaacttagatattctgttataacaagacacacacacacacacacacacacacacacacacgggtctctatttgaagatggcttcaccactatatgtgtgtatctacatagatgtaaacatttagagttgctgtgagccttcctcaggcatgtagtcttgcccccaaaagaggcggctgctacccaagagactgtcgctgttcattcattcatgaaacactgaaggagtaccatgagatgatgtgctgggaaccggagtccctaacgaatccaggtcacagtttagtgagggaagcctgcaaggcagtcagcagccacatttcagataggggcatgttcagggtcccgtgcaagtgccgaagagaggcagctactcagccttgcagggagagagctttctggaagatgaaaggtgctagtgagcggagaaggcttcccaggacaggaagctcctgactttaa

SEQ ID NO: 35889 - DNA, 2215 bp, Homo sapiens
tttttgttgctatgagaaccttctattttgtattagacattgcagccttgacgacgcaatgtttgtgctattttgcgcatgttttcctgcagctattcctctcctctagcaatagtcgaatggctctggtttcctcttgcgcccggcccagtttttccgttttagcttcggttgtcataggctgtgctgtcgctttctctgggaaaggacggtgaagactggacgggagaaaccgggagggcaggcgcggccgttctgcagcagccgggccgcttcccagcggggaggcgggctgcgaatgggaagcgggaggaggaggccgggccgcgggctggttctatcacccccttgggagcccagctcttcacctagctctccggcgcttttcaaaatctgcagttaacaacaaaaatcgagcaacgccacgtcgcacaaacaggacaggagggggcgaggggccaggctcgccgcggggcgctgagcaggcccggacaccgcggccgaggttatcgttaggcatctcccaggcgaccggctccgcagcaagatggcggacgagaaggacagggaagagagattggaacaattatcaggtcattaggatgctgtcctacggaaggagagctgcatgatctgattgcagaggtagaggaagaagaacccactggatacattcgattcgaaaaatttcttccggtgatgacagaaatactactagaaagaaaatacagaccaattccagaagatgtccttcttcgagcttttgaggttttagattcagctaaacgtgggtttcttactaaggacgagctgatcaagtatatgactgaagaagatggagtttcgctccgtcgcccaggctgaagtgcagtggcgtgatcttggctcgttgcaacctccacctcccgggttcaagagattctcctgcctcagcctcctgagcagctgggatgacaggcacacaccaccacgcctggctaatttctgtatttttagtagagacggggtttcaccatggtctggtgacctcctggtctcgaactcctgacctcaagtgatcctcccgcctcagcctcccaaagttctgggattacaggcatgagccaccgcacccggctgcttccttaactcttgatctcctctctgtatcttgctttgtctagctgttctcttctctccatattcatccaaacatttgcttagaagtacccagaagcatggcgttgaatgtggtacaccttgaacgaagggtgaagaaacgaggcagagtgacttagtagcaagtgacagcacacagtttaaattttaatattagcccatttacaaacaacagcttatataatagtcattcacatacctcaacactcaccatcccctccccactttttttctggagacagggtttcactgtcaccccagctggaatgcaggtggcatgatcacagctcactgtagcatcgacctcctggactcaaggggtcctcgcgcctcagcctcctgagtagctgggaccacaggtgcatgccaccacgcccagctaatgtttttttttattttttgtagagacagggtctggctatgttgcttaggctggtctcaaactcctgggttcaagcgatcctgccacctcagcctcccaaagtgttaggattacagatgtgagccactgtgcccagccaacattcaccccattcaagtgtgcaattcaatggattctagtatcttcacagtgctgtgcaactatcactcctatctacttacaaagcatttccatcatcttaaaaagaatccccatgtccaatagcagttccccttcccccaccgtcatcctcgggcaaccgctaatcttcctgtgtgtctgtggatttgcctcttcagggcatttcacataaacacaatcatacaatatgtggccttctgtgtctggcttctttcatttagtgtaaggcttttgaggttcatccatgttgtaatgtatatccttagttcattcttttttgttaagctcacaaataaaaagcctcactttttatttgaggcaaggagactggctacagggattacagttccagcagtcaaaacgcaactccaagtggcactatttggaccgtaggttttgcttcattttggctggaaaagggtattcaggatgtacttctcccagccggacaagaaaaagggcaaagaaaactggaagagacgtctcgtctacaca

SEQ ID NO: 35890 - DNA, 2464 bp, Homo sapiens
tttttgttgctatgagaaccttctattttgtattagacattgcagccttgacgacgcaatgtttgtgctattttgcgcatgttttcctgcagctattcctctcctctagcaatagtcgaatggctctggtttcctcttgcgcccggcccagtttttccgttttagcttcggttgtcataggctgtgctgtcgctttctctgggaaaggacggtgaagactggacgggagaaaccgggagggcaggcgcggccgttctgcagcagccgggccgcttcccagcggggaggcgggctgcgaatgggaagcgggaggaggaggccgggccgcgggctggttctatcacccccttgggagcccagctcttcacctagctctccggcgcttttcaaaatctgcagttaacaacaaaaatcgagcaacgccacgtcgcacaaacaggacaggagggggcgaggggccaggctcgccgcggggcgctgagcaggcccggacaccgcggccgaggttatcgttaggcatctcccaggcgaccggctccgcagcaagatggcggacgagaaggacagggaagagataatagtagcagaatttcacaaaaaaatcaaagaggcatttgaagtctttgaccatgagtcgaataatacagtggatgtgagagagattggaacaattatcaggtcattaggatgctgtcctacggaaggagagctgcatgatctgattgcagaggaggagaagccaggcgtatcagggccttggttttccaggtagaggaagaagaacccactggatacattcgattcgaaaaatttcttccggtgatgacagaaatactactagaaagaaaatacagaccaattccagaagatgtccttcttcgagcttttgaggttttagattcagctaaacgtgggtttcttactaaggacgagctgatcaagtatatgactgaagaaggtgagcctttttctcaagaggaaatggaagaaatgttgtctgctgcaattgatccagaatcaaattcaattaattacaaggactatataacaatgatggtgatagatgaaaattaaatgttctaaagataatttctgattgaaagaacaattttagaaattgcttgttcttgttaatttcacatcttatcttaggattcctatatgtgatatttaataccttgtgacataactattttaagacactttgtttttaaagatgatcgtaacactttaaaccaaatttagtatgtctagccttacagaatgataaattactatttatttaaaaactattcttaaaacattttaacattagaatggattgttgtttattttctacaataaaactcaggtcaccttcgaattaattaagctgacaaaatgaaaatgacttaattacccaaggtttggcatgtaaagatcttaagagggggcagaacgaaccactcgaaaacgagtagcagtgtaatgaaggcttcttttttaaacaataacaaatgcttcatcaatctgagtgtggaaggtgatttatcaaaataaatattactaatttatttttttatgagtgccaattacaaatatcatttgggataataataacttagtgtaaacatttatatttgctgatccagcatgtcaccatttatggagtagctaaaggagttgagatcattggaactagagaaaagaaggttgagtggaagttgatagtgtaaggtagtggcaattctccctttgtctttagaattctcacccactccgcatatctgtcatgggagcattgtcctgaatactgagtaagaatactgagaaatgttatggtgtgcaaatgtacagctcctgaaagagcagaatgaagcacaagcagtcacaatggaaaaatatatggcatggccactgcctcctccttgcaattctctccgatcttggcatcttatatggcaactatatggcaacttacaagcaaaggggaagataaagtaaagggaagtgaacaattttccaaacttagatattctgttataacaagacacacacacacacacacacacacacacacacacgggtctctatttgaagatggcttcaccactatatgtgtgtatctacatagatgtaaacatttagagttgctgtgagccttcctcaggcatgtagtcttgcccccaaaagaggcggctgctacccaagagactgtcgctgttcattcattcatgaaacactgaaggagtaccatgagatgatgtgctgggaaccggagtccctaacgaatccaggtcacagtttagtgagggaagcctgcaaggcagtcagcagccacatttcagataggggcatgttcagggtcccgtgcaagtgccgaagagaggcagctactcagccttgcagggagagagctttctggaagatgaaaggtgctagtgagcggagaaggcttcccaggacaggaagctcctgactttaa

SEQ ID NO: 35891 - DNA, 2298 bp, Homo sapiens
tttttgttgctatgagaaccttctattttgtattagacattgcagccttgacgacgcaatgtttgtgctattttgcgcatgttttcctgcagctattcctctcctctagcaatagtcgaatggctctggtttcctcttgcgcccggcccagtttttccgttttagcttcggttgtcataggctgtgctgtcgctttctctgggaaaggacggtgaagactggacgggagaaaccgggagggcaggcgcggccgttctgcagcagccgggccgcttcccagcggggaggcgggctgcgaatgggaagcgggaggaggaggccgggccgcgggctggttctatcacccccttgggagcccagctcttcacctagctctccggcgcttttcaaaatctgcagttaacaacaaaaatcgagcaacgccacgtcgcacaaacaggacaggagggggcgaggggccaggctcgccgcggggcgctgagcaggcccggacaccgcggccgaggttatcgttaggcatctcccaggcgaccggctccgcagcaagatggcggacgagaaggacagggaagagagattggaacaattatcaggtcattaggatgctgtcctacggaaggagagctgcatgatctgattgcagaggtagaggaagaagaacccactggatacattcgattcgaaaaatttcttccggtgatgacagaaatactactagaaagaaagttttagattcagctaaacgtgggtttcttactaaggacgagctgatcaagtatatgactgaagaaggtgagcctttttctcaagaggaaatggaagaaatgttgtctgctgcaattgatccagaatcaaattcaattaattacaaggactatataacaatgatggtgatagatgaaaattaaatgttctaaagataatttctgattgaaagaacaattttagaaattgcttgttcttgttaatttcacatcttatcttaggattcctatatgtgatatttaataccttgtgacataactattttaagacactttgtttttaaagatgatcgtaacactttaaaccaaatttagtatgtctagccttacagaatgataaattactatttatttaaaaactattcttaaaacattttaacattagaatggattgttgtttattttctacaataaaactcaggtcaccttcgaattaattaagctgacaaaatgaaaatgacttaattacccaaggtttggcatgtaaagatcttaagagggggcagaacgaaccactcgaaaacgagtagcagtgtaatgaaggcttcttttttaaacaataacaaatgcttcatcaatctgagtgtggaaggtgatttatcaaaataaatattactaatttatttttttatgagtgccaattacaaatatcatttgggataataataacttagtgtaaacatttatatttgctgatccagcatgtcaccatttatggagtagctaaaggagttgagatcattggaactagagaaaagaaggttgagtggaagttgatagtgtaaggtagtggcaattctccctttgtctttagaattctcacccactccgcatatctgtcatgggagcattgtcctgaatactgagtaagaatactgagaaatgttatggtgtgcaaatgtacagctcctgaaagagcagaatgaagcacaagcagtcacaatggaaaaatatatggcatggccactgcctcctccttgcaattctctccgatcttggcatcttatatggcaactatatggcaacttacaagcaaaggggaagataaagtaaagggaagtgaacaattttccaaacttagatattctgttataacaagacacacacacacacacacacacacacacacacacgggtctctatttgaagatggcttcaccactatatgtgtgtatctacatagatgtaaacatttagagttgctgtgagccttcctcaggcatgtagtcttgcccccaaaagaggcggctgctacccaagagactgtcgctgttcattcattcatgaaacactgaaggagtaccatgagatgatgtgctgggaaccggagtccctaacgaatccaggtcacagtttagtgagggaagcctgcaaggcagtcagcagccacatttcagataggggcatgttcagggtcccgtgcaagtgccgaagagaggcagctactcagccttgcagggagagagctttctggaagatgaaaggtgctagtgagcggagaaggcttcccaggacaggaagctcctgactttaa

SEQ ID NO: 35892 - DNA, 1360 bp, Homo sapiens
tttttgttgctatgagaaccttctattttgtattagacattgcagccttgacgacgcaatgtttgtgctattttgcgcatgttttcctgcagctattcctctcctctagcaatagtcgaatggctctggtttcctcttgcgcccggcccagtttttccgttttagcttcggttgtcataggctgtgctgtcgctttctctgggaaaggacggtgaagactggacgggagaaaccgggagggcaggcgcggccgttctgcagcagccgggccgcttcccagcggggaggcgggctgcgaatgggaagcgggaggaggaggccgggccgcgggctggttctatcacccccttgggagcccagctcttcacctagctctccggcgcttttcaaaatctgcagttaacaacaaaaatcgagcaacgccacgtcgcacaaacaggacaggagggggcgaggggccaggctcgccgcggggcgctgagcaggcccggacaccgcggccgaggttatcgttaggcatctcccaggcgaccggctccgcagcaagatggcggacgagaaggacagggaagagataatagtagcagaatttcacaaaaaaatcaaagaggcatttgaagtctttgaccatgagtcgaataatacagtggatgtgagagagattggaacaattatcaggtcattaggatgctgtcctacggaaggagagctgcatgatctgattgcagaggtagaggaagaagaacccactggatacattcgattcgaaaaatttcttccggtgatgacagaaatactactagaaagaaaatacagaccaattccagaagatgtccttcttcgagcttttgaggttttagattcagctaaacgtgggtttcttactaaggacgagctgatcaagtatatgactgaagaagagacaggtaagctaaggtggggagctgtgaagtgacttgctcaagatctcagagctcgtgagaggcagccagcatgtggatccaaacttgtgctttaaccactcagttatcttccttccatctttcatcaaatactggggcttcaagttaatcctctggtaatttcaaaagttttaatctaaataaataaccttgttcatgatgtctgtatgtcttcctactgttttgcctgaaatgacgtgttctagaggttgcttgatctatgacatctgcaggctaaaagaagtccagaatctaccagggtgtacaatagccttgtctttgaacctctggactgtcgtgatgtcctggctctacagctccagggagcgtaactagtggcactgtgggagcttgtggggctccatggctattaagctggctagtggaaagagaaaaaa

SEQ ID NO: 35893 - DNA, 1387 bp, Homo sapiens
tttttgttgctatgagaaccttctattttgtattagacattgcagccttgacgacgcaatgtttgtgctattttgcgcatgttttcctgcagctattcctctcctctagcaatagtcgaatggctctggtttcctcttgcgcccggcccagtttttccgttttagcttcggttgtcataggctgtgctgtcgctttctctgggaaaggacggtgaagactggacgggagaaaccgggagggcaggcgcggccgttctgcagcagccgggccgcttcccagcggggaggcgggctgcgaatgggaagcgggaggaggaggccgggccgcgggctggttctatcacccccttgggagcccagctcttcacctagctctccggcgcttttcaaaatctgcagttaacaacaaaaatcgagcaacgccacgtcgcacaaacaggacaggagggggcgaggggccaggctcgccgcggggcgctgagcaggcccggacaccgcggccgaggttatcgttaggcatctcccaggcgaccggctccgcagcaagatggcggacgagaaggacagggaagagataatagtagcagaatttcacaaaaaaatcaaagaggcatttgaagtctttgaccatgagtcgaataatacagtggatgtgagagagattggaacaattatcaggtcattaggatgctgtcctacggaaggagagctgcatgatctgattgcagaggtagaggaagaagaacccactggatacattcgattcgaaaaatttcttccggtgatgacagaaatactactagaaagaaaatacagaccaattccagaagatgtccttcttcgagcttttgaggttttagattcagctaaacgtgggtttcttactaaggacgagctgatcaagtatatgactgaagaaggtggtgtcgttatcacccccattctagagacaggtaagctaaggtggggagctgtgaagtgacttgctcaagatctcagagctcgtgagaggcagccagcatgtggatccaaacttgtgctttaaccactcagttatcttccttccatctttcatcaaatactggggcttcaagttaatcctctggtaatttcaaaagttttaatctaaataaataaccttgttcatgatgtctgtatgtcttcctactgttttgcctgaaatgacgtgttctagaggttgcttgatctatgacatctgcaggctaaaagaagtccagaatctaccagggtgtacaatagccttgtctttgaacctctggactgtcgtgatgtcctggctctacagctccagggagcgtaactagtggcactgtgggagcttgtggggctccatggctattaagctggctagtggaaagagaaaaaa

SEQ ID NO: 35894 - DNA, 946 bp, Homo sapiens
tttttgttgctatgagaaccttctattttgtattagacattgcagccttgacgacgcaatgtttgtgctattttgcgcatgttttcctgcagctattcctctcctctagcaatagtcgaatggctctggtttcctcttgcgcccggcccagtttttccgttttagcttcggttgtcataggctgtgctgtcgctttctctgggaaaggacggtgaagactggacgggagaaaccgggagggcaggcgcggccgttctgcagcagccgggccgcttcccagcggggaggcgggctgcgaatgggaagcgggaggaggaggccgggccgcgggctggttctatcacccccttgggagcccagctcttcacctagctctccggcgcttttcaaaatctgcagttaacaacaaaaatcgagcaacgccacgtcgcacaaacaggacaggagggggcgaggggccaggctcgccgcggggcgctgagcaggcccggacaccgcggccgaggttatcgttaggcatctcccaggcgaccggctccgcagcaagatggcggacgagaaggacagggaagggcctgggatacaacagtgatgagataaggcctcggactttactgatcgaacatctaatggaaggtggaagaagagaccatcacacaatgacggtgttatggggaacacaggagataatagtagcagaatttcacaaaaaaatcaaagaggcatttgaagtctttgaccatgagtcgaataatacagtggatgtgagattcttcctattttgctcccgactgatttgatcctgctgtgtgtctcctactcctttgcgtctacctcctcatgggttcagatgctttgtgattctgcacctgccttctctctctgtgccgttcctcttccatctctcttccatctgtatgtcttgctttaaaactcccaaggaaaa

SEQ ID NO: 35895 - DNA, 227 bp, Homo sapiens
gcattcctacagccctggatgtcatatgataaaataaatcacactgaatcaagttcctacaagatagaagtccctaagtgtccaggaatgtgtattgcatcagacagtgtttagcagccgggaagatctcagaacaattttttaaacaaacacttgcatgttgctgcttctatgccaggtactgttctaagtcccattcaaatcataacacgtttcattctcatgac

SEQ ID NO: 35896 - DNA, 249 bp, Homo sapiens
ctttgagagccacagactctcttgtctttgttgcagctactcggttctcccattatggtggaaaagcagccactgacaacgtgtaaacaaatgggtgccactgtgttccaataaaattttatttacagggttggatgtggtggctcacacctgtaatcccagcactttgggaggacaaggcgggtggatcatgaggtcagatgttcgacaccagcctgaccaacatggtgaaaccccgtatttactaaa

SEQ ID NO: 35897 - DNA, 111 bp, Homo sapiens
agcctgtaagtgtccacatatcatgcacatgcagtgcgtatttgttgcatgagctcctggtatgcaggtgccaaatgtcatgctaagtgtgtcgactggatgacagaagaa

SEQ ID NO: 35898 - DNA, 402 bp, Homo sapiens
gcgtcgacccagaatcctaaatagacctgtgttgagaaaattaaattagtagctaacatatatgcatacatgtgtacatgcatacatacatgcgtaaacatgcccacacacaccagacgtaagcaggtttacacttctaccaaacattcaagaaacgtgaaaataagccgggtgcggtggctcatgcctgtaatcccagcactttgggaggctgaggcgggtggatcacgaggtcaggagatcgagaccatcctggctgacacggcgagaccccgtgtctactaaaaatacaaaacatttgccgggcgtggtggcaggtgcctgtggtcccagctactcaggaggcagagtcttgttctgtcgcccaggctggagttcagtggtgcaatctcgcctcaatgc

SEQ ID NO: 35899 - DNA, 466 bp, Homo sapiens
ttatgtgatcttgctgtttttctctgattatttgtaagaatttctgttttctccagtgttttgaaatttcacaatgatacagctaattgtagatctcattttcctttgtgctcggtactcagtggattctttaaacttggaaacaaatttcttttatttctaagaaggcttctagagtcatttcattaatgacttcatcctttaattttttcctctcctttctttctaagactcctgtttggaagttttgcctcctatactagtcctctgtttttcatgttttttttcattttttattttttgacattttactttctgggagatttcattttccaactgatattattttcttctatcatgttaattattaagaattctttttcttcttgcagcatcctattcttatttaatagatgaagcattttttaatatctgataattttaatgatagattttttgaagtttt

SEQ ID NO: 35900 - DNA, 488 bp, Homo sapiens
tgaaataataccaaatatccaacgtttgcattagagcccaaaatgagaaaagagggaaaaaaagagttgggctgaaagagtatttgcagaaataatgtcggaaaacttcccaaatttggtgaaagacagaaataactaagaaattgagagaatactaattgagataaacccaaagatattcatgccatgaaaaatactgtgttgaaagctgaacaaattgcatcgtatttaatggtgaaagactgaatttttccaaagtaaggaatatccactcatcactgttactcaacaataattgaagttctagatgttgctattatacaagaaaagtaagaaaggcatgcagattgaaaaggaagacataaaactgtctatttgcagatgatacgactacacagaaaatttcaaggaatgtgaaaaccaaaaaaggatacaagatcaaacacaaaaatcaatctcatttctgtgcactaacatgaacacagaaa

SEQ ID NO: 35901 - DNA, 696 bp, Homo sapiens
agtagatttgaaggcttatttggctttagagttaacatataggtttttaaaaatgtacttgtatatttaagaaaatgacggttttaatgtgacctcttgtgctagaacaatcactacaaaaacataaagccacaagtacgagtctgctttttaatgatttgtgttttgtttctctttatagtttatatggtatagcgtaaggaacagagcttactctatcagcgaggcaggctaatttcatcaatgtttgaaagtttcatagtggtgtgcctttatctcctctttgctgtgtgttagagcgatcagagtttcccagaagtattcattttttacaaattataaatggatgtattttgaaaccgcatgtctgagcttcctaacttaattatcttttctaattttaagtgctgatttatttgggatgatttttctgcacctcagcattcccttagccgttcaattttaatagcagatagttgtcctcacacacatgaatgccttggtacaaacgtctgtctttaggacatatggattagatctatttagagtcaagaaaaagaaacattgcaaattttgcctggctatttcagagtaactgtattagaatttgcatcaaggctatgatgtttgctccatcatttattgattcaaataaaccacaacccacagcagttgcatttcatataagcagtccta

SEQ ID NO: 35902 - DNA, 340 bp, Homo sapiens
attgacatttccaacccagcacatacccacatacgtaaccaaagcaaaagcttcacgaaatagtgacctactttaccttcctccccatgatcgactctgatatttccactctgattggatatttccaatcatattttctggtaggtccttttattttctacctcatttttaaaaaatgttggtcacagttcactaaattgacttcgtgatgcgctaatgggggtgagacccttagtttgaaattttgaaggagactgaattctaaaggcaatccgtagatttaggcatattttagccccacttcatggatgggaaaatcaaggctttgttgtgaatcagt

SEQ ID NO: 35903 - DNA, 375 bp, Homo sapiens
taggaactgttaacccaaggacaaaataactgctgggatagagcaaagcacagaagtgtgtacccatagagagtgggtgacaaaactgaggcaaatattggcagatcgcatccccaagcaaggagggcacccacacatgggagcactcaggtctaaggttaactctaatgtaaaatgggtacaaggctgaaatcctacaacattctaacacttcctccttataagcatccatatatctttactgcaataaggtgtggtatatgcatacaaataaaattccctaacttagaatctgcctttaagagaaaaaaaaaaattcccagctctaatttcattcctatcaagttattttagattcttcatgcagtccccttc

SEQ ID NO: 35904 - DNA, 5312 bp, Homo sapiens
  misc_feature (758)..(758): n is a, c, g, or t
  misc_feature (2040)..(2040): n is a, c, g, or t
  misc_feature (3496)..(3496): n is a, c, g, or t
  misc_feature (3630)..(3630): n is a, c, g, or t
tgtggtgactctaaccataacagcctgagacagaggtcccaggagatccctccttgtggaaaagcagtagttctcttccccagaaaggactggggtcaaaggatgcacaacagtaacgactttgtggtgaggttggcagagaatatacgatggggagcttgatgtgtgagaagtggaaagaaggtcatcttggatgattggaggacaacatcccgcaaacgacaacagggaaagcacagtacttttacaaaaggctccgcaaatatctcatccttaccatctgttccttgtgccttataagatttttggatttcatcctaagagtaacacgcatttatggggagactgagggataggactgggtaaatttgagatatatctccaaaaaccatcttcattttaccaaagagaaaaatgaagcccagagaggttaagtgacttgcccaggatcatacagctaatgagtagtcaggaaaatattctctttagagttctttgtatttctttcttcatagtgttgccaaatataaataatagtgtagggttggcctgccatgtgttggagtgggcaggatctttggtgtgacaaaggtagataatttgtctagccaagttttgagatatcacaaagctaccagtgccttagccaggcagaagttatattcagaatgattacaagttgctctatgatagaaggtgctcaaataaatgttagtataggccagcactgtattctatgctacagggattccagaaangaaaattagtaaggtgtagactcctttctactgggtcataagctatttaggagtctgtttctgtctatggttcctttgtgtgctcttgttaactatactgcaaagtaaacatattgtattgttgcagagggggagagattgcatctggcctgggagatcaggaaagctgaagcaggaggtggcatttgaaatgaaatacttagaagctggtgattaaattctgttcatcttttataagaaatgacatttatggaacacttattgcatgctttgagctttgcaacaatctttcatttaatccttctaacaactcagtgggaaaggtacacttatttcacagaggaggaaccgaaggctcagttaacttattggagcaatgccattggtgccacacctggatggccttgctgggccagcttctcttggtgttggctgccaactagttcacaccagccttctcctgaggaatgctcttggctgatgagagcactcatacctggagaagtaatctggaagggaaagtcaaggaaaccttgctgactaagtagacagtatgaaaaacactggtgagagactttggacttcctggatctgtcttccatctaatagatattccagaaagagagactttaaggttttcttttttgttttaatggagaatagaaaataatccctttttttttttttttttttttttgagacgggatcttcccctgtctccgaggctggaatacggtggtgcgatcaaagctcactgcagccttgaactcctaggctcatcatgcagtcttccctcagcctcctgagtagctaggaccataggcacatgtcaccacatctggctaatttttcttactttttggagaaatgaagtcttgctattttacccaggctggtcttgaactcttgggctcaatgattctcctgtctcagcctcccaaaatgttgagattgcaggcatgagccactgcgcctggcctaatccatttgtttgtttttttgtttgtttgtttgttttttgagacggagtctcgatctgttgcccaggctggagtgcagtggagcaatcttgggtcactgcaacctctgcctcctgggttcaagcaattctcctgccttagcctcctgagtagctgcgactacaggtgcatgccaacacgcctggctaattttttgtatttttaatagagacagggtttcaccatgttagccacggtggtctcgatctcctgacctcgtgatccacctgcctcggcctcccaaagtgctgggattacaggcntgagccactgcgcccggccctaatccattttttttaaagtgaatttccttgtggccccaggtggtgagcaacaatagtgggagaaagttcacacacagatatcacctagtataatttcaacctcctaagaattccaaggatcgttcgctaaagctaaggtgaaaattctacgtattgccagaggagacatagaaagtttcaacagactggcactcaatggtttatcttccaaatgggaactatctccaaagtgctaaatttttatgaaggaagatgattttgaatttagaattctatattctgtttactatctttaagagtgagaacaaaataacagtgttcttgaacatgcaaacactcagacaacactgcatacataattttgggggcccaatgcataataaaagcgtggggctgcttgttgaaagatttaagagtttgggccgggtgcggtggctcacacctgtaatcccagcagtttgggaggccaaggcaggcggatcacctgaggtcgggagttcacaaccagcctgaccaacatggagaaaccccgtctctactaaaaatacaaaaattagccgggtgtggtggcgcatgcctgtaatcccaactactcaggaggctgaggcaggagaatcgcttgaacccgggagacgggaggttgtggtgagctgagatcgtgccattgcactccagtctgggtaagaagagtgaaactccgtctcaataaataaataaataaataaaaattaaaattaaaaattaagaatttcaggatggcaactgcagagcattaaaataagtgtgggacccctctgaatgcagcgccccatgcagttgcacagctcatgtgcccaggaagctgagaaaactcaccacccatgaagtcttctggaaaaaagaaagcatttaattcaaaaaagtggtgagtgcgagacaaaacaaaaaatgatcccagtaaaacataaaaaaaattattgtctttaatattctttatgaagcttaatgatttttagaataccattaagaatagaggggagggcttggcacggtggctcatgcttgtaattccagcactgtggaaggccgaggtgggtggataacttgagatcaagagttcaagaccagcctggccaacatgatgaaaccttgtctctactaaaaatacaaaaattagccggcagggtggcacgtgcctgtaattccagctacttgggaggctgaggcaggagactcgcttgaacctgggagttggaggttgcagtgaaacgagattgcaccactgcactccagcctgagtgaggaagcaaaatctgtgtctcaaaaacaaaacaaaacaaacagaatagaggggagatgtgtacttaaaaatcatacacattaaaatttgataatttcaacaacaggaaagagatggtcaagaagtaagagaaaagtaaaatgcaagcttaaagtnttgttagacttgggcaggggatgtttaaatactgattaattagaactaattgtatttttaaaaattaattttaaatatgtaaaggtaagcacaatatttaaaggtaactgcaaaattagtgacttacccaacanacatttataatctcatggtttctgcggatgaagaattcagacatggctgagctaggtcctctgcttcaagatctttgcatggccgcagtcaagatggtagccagggctggggtctcaaggctggagtcaaggtgatggccagggctgggcttcctctttgagtgaggaaggacatgctttccaagctcatgtggttgttgggatttggttccctccagctgatggattgagggccttagttggtagctgtccatctgctgaaggccaccttcagtttgtttccacgtgaacctcctcaacatggccacttccttcatcaaagcatgtaaaccaagaaggcagtggagagtctaacaagacagcagttacaaccttgtgcagtgtaatcatggaagtgacatcccgcggtctttgctggattctgatggttagaaggaagtcacaggtttcatccacactcaggagcagaggaactctcaagggtgtgagcaccaggagactgggatccctgggggctgtcttagagcttactcactaccacactcattcataataaggcctgtcagacaagggagacttggtcatacacctgagttatataaatcctcatccagtctccctatggttgacaaggtgtcttgctcataagcgtcagtacctggtgtcaggtgctctcatataatcaatcactgtttgttgaatgaacatgaattgctacaaataaaagcagttttgaaaaaacagtttggcgccattaacaggttgtttttaatttgcattgtaaaatgggtttggcagttttgcatattaaaaggtcaaaatgttatgccatgaaagataaaacaagagcttaaacattccagaacaaaattttccacaggatgcccttgtgtttgcctttcacatctggattgttgtcatagtcctgccattcgcagtaatttacatttgagtcacatttctctcttgaggagtaaatatagtacagtacttccctttaaatgtcctttactcaaggagaaaaacgtatttggggtacatattttcacaaccatcctggcataaattttaaaatctgtgtgcaaatgggtggtgattgcatcatgttaggttgctcagagaatgtctttaagatgacatgattgagaattgattcattaacactgttactattttttcagagctcattccgcaaaaccatgtctgagagccaggaagtctggattcttgtcccagtgccccaaccaatgagctgagtggccttggcaagtcacccagtctgcaccagttttcttgtctgtggaatgctgggcttggatgaatagtaattcaaggatctctccctctgcagtgtgctttctggtgaccatgaatggatgctgtcagtagatgccttggtgctctttacggtgctggtgcaactacccccaactgtcaggaagatgtcccctagtggcttatagctgtctcctctgcagaattgcccttggccaaacagctgcttcctcacctgggagatcacacccctgcagccgatgattgactgacacgtgggtgcagaaagcctgccctcttgcctccaggtgggacccagtctgtggtgcaatttgtgttcctgggcacctgtgggactggctgaagttaaacttcagattaaactacatccttaattaaaaaattcc

SEQ ID NO: 35905 - DNA, 4083 bp, Homo sapiens
  misc_feature (758)..(758): n is a, c, g, or t
  misc_feature (2267)..(2267): n is a, c, g, or t
  misc_feature (2401)..(2401): n is a, c, g, or t
tgtggtgactctaaccataacagcctgagacagaggtcccaggagatccctccttgtggaaaagcagtagttctcttccccagaaaggactggggtcaaaggatgcacaacagtaacgactttgtggtgaggttggcagagaatatacgatggggagcttgatgtgtgagaagtggaaagaaggtcatcttggatgattggaggacaacatcccgcaaacgacaacagggaaagcacagtacttttacaaaaggctccgcaaatatctcatccttaccatctgttccttgtgccttataagatttttggatttcatcctaagagtaacacgcatttatggggagactgagggataggactgggtaaatttgagatatatctccaaaaaccatcttcattttaccaaagagaaaaatgaagcccagagaggttaagtgacttgcccaggatcatacagctaatgagtagtcaggaaaatattctctttagagttctttgtatttctttcttcatagtgttgccaaatataaataatagtgtagggttggcctgccatgtgttggagtgggcaggatctttggtgtgacaaaggtagataatttgtctagccaagttttgagatatcacaaagctaccagtgccttagccaggcagaagttatattcagaatgattacaagttgctctatgatagaaggtgctcaaataaatgttagtataggccagcactgtattctatgctacagggattccagaaangaaaattagtaaggtgtagactcctttctactgggtcataagctatttaggagtctgtttctgtctatggttcctttgtgtgctcttgttaactatactgcaaagtaaacatattgtattgttgcagagggggagagattgcatctggcctgggagatcaggaaagctgaagcaggaggtggcatttgaaatgaaatacttagaagctggtgattaaattctgttcatcttttataagaaatgacatttatggaacacttattgcatgctttgagctttgcaacaatctttcatttaatccttctaacaactcagtgggaaaggtacacttatttcacagaggaggaaccgaaggctcagttaacttattggagcaatgccattggtgccacacctggatggccttgctgggccagcttctcttggtgttggctgccaactagttcacaccagccttctcctgaggaatgctcttggctgatgagagcactcatacctggagaagtaatctggaagggaaagtcaaggaaaccttgctgactaagtagacagtatgaaaaacactggtgagagactttggacttcctggatctgtcttccatctaatagatattccagaaagagagactttaaggttttcttttttgttttaatggagaatagaaaataatccctttttttttttttttttttttttgagacgggatcttcccctgtctccgagctgagatcgtgccattgcactccagtctgggtaagaagagtgaaactccgtctcaataaataaataaataaataaaaattaaaattaaaaattaagaatttcaggatggcaactgcagagcattaaaataagtgtgggacccctctgaatgcagcgccccatgcagttgcacagctcatgtgcccaggaagctgagaaaactcaccacccatgaagtcttctggaaaaaagaaagcatttaattcaaaaaagtggtgagtgcgagacaaaacaaaaaatgatcccagtaaaacataaaaaaaattattgtctttaatattctttatgaagcttaatgatttttagaataccattaagaatagaggggagggcttggcacggtggctcatgcttgtaattccagcactgtggaaggccgaggtgggtggataacttgagatcaagagttcaagaccagcctggccaacatgatgaaaccttgtctctactaaaaatacaaaaattagccggcagggtggcacgtgcctgtaattccagctacttgggaggctgaggcaggagactcgcttgaacctgggagttggaggttgcagtgaaacgagattgcaccactgcactccagcctgagtgaggaagcaaaatctgtgtctcaaaaacaaaacaaaacaaacagaatagaggggagatgtgtacttaaaaatcatacacattaaaatttgataatttcaacaacaggaaagagatggtcaagaagtaagagaaaagtaaaatgcaagcttaaagtnttgttagacttgggcaggggatgtttaaatactgattaattagaactaattgtatttttaaaaattaattttaaatatgtaaaggtaagcacaatatttaaaggtaactgcaaaattagtgacttacccaacanacatttataatctcatggtttctgcggatgaagaattcagacatggctgagctaggtcctctgcttcaagatctttgcatggccgcagtcaagatggtagccagggctggggtctcaaggctggagtcaaggtgatggccagggctgggcttcctctttgagtgaggaaggacatgctttccaagctcatgtggttgttgggatttggttccctccagctgatggattgagggccttagttggtagctgtccatctgctgaaggccaccttcagtttgtttccacgtgaacctcctcaacatggccacttccttcatcaaagcatgtaaaccaagaaggcagtggagagtctaacaagacagcagttacaaccttgtgcagtgtaatcatggaagtgacatcccgcggtctttgctggattctgatggttagaaggaagtcacaggtttcatccacactcaggagcagaggaactctcaagggtgtgagcaccaggagactgggatccctgggggctgtcttagagcttactcactaccacactcattcataataaggcctgtcagacaagggagacttggtcatacacctgagttatataaatcctcatccagtctccctatggttgacaaggtgtcttgctcataagcgtcagtacctggtgtcaggtgctctcatataatcaatcactgtttgttgaatgaacatgaattgctacaaataaaagcagttttgaaaaaacagtttggcgccattaacaggttgtttttaatttgcattgtaaaatgggtttggcagttttgcatattaaaaggtcaaaatgttatgccatgaaagataaaacaagagcttaaacattccagaacaaaattttccacaggatgcccttgtgtttgcctttcacatctggattgttgtcatagtcctgccattcgcagtaatttacatttgagtcacatttctctcttgaggagtaaatatagtacagtacttccctttaaatgtcctttactcaaggagaaaaacgtatttggggtacatattttcacaaccatcctggcataaattttaaaatctgtgtgcaaatgggtggtgattgcatcatgttaggttgctcagagaatgtctttaagatgacatgattgagaattgattcattaacactgttactattttttcagagctcattccgcaaaaccatgtctgagagccaggaagtctggattcttgtcccagtgccccaaccaatgagctgagtggccttggcaagtcacccagtctgcaccagttttcttgtctgtggaatgctgggcttggatgaatagtaattcaaggatctctccctctgcagtgtgctttctggtgaccatgaatggatgctgtcagtagatgccttggtgctctttacggtgctggtgcaactacccccaactgtcaggaagatgtcccctagtggcttatagctgtctcctctgcagaattgcccttggccaaacagctgcttcctcacctgggagatcacacccctgcagccgatgattgactgacacgtgggtgcagaaagcctgccctcttgcctccaggtgggacccagtctgtggtgcaatttgtgttcctgggcacctgtgggactggctgaagttaaacttcagattaaactacatccttaattaaaaaattcc

SEQ ID NO: 35906 - DNA, 502 bp, Homo sapiens
cttccctgacatttgttgctcctcacattcttgattcatttagctgtcattctctgctgctgagctacaggcaacttgagggcagggactaggtagctttagactttttctccaatgacattccaaaggctgtgtgggttatgagggggagtcatcccagcaggaagtagtctgcgttgctgacatcatttaggattgccttcatacagtgatcataaaaagcatactgacacttagtgtcatcctggtgtttacattttctacaatgtgccctcttgttgctttgcacccaaggctgaccactctcaccgtccttgcttggtacctatttagtgccagaccttgcacatagtagctactttataaataagccagggtggctacgttcagcaggggccaggcaaaggctgggaagggggtcttgttctaggggaagaagcagccaaaactgaggaacacttagaccatgcaagagagagaaagactcagggccttggtaggg

SEQ ID NO: 35907 - DNA, 748 bp, Homo sapiens
acagagctaaaaggagaagtacacaaagtcacaattacagctggggacttctgtaacccactatgaacagttgatagaactactagacagaatgttagtaaagatgtaacagtgccatcaaacaacaaaatctcataaacattgatagaaattccactcagtgacagaatgtacattcttctcaggtgtccattaaacactcaccaagatggatcttgggtcataaaaccaacttgaatcaatttaaaagattgaaattatgatggggcatggtggtttgtgcctataatcccagcgctttgggaagctgatgtgggaggactgcttgagaccggtcagtttgggccacatggcaagacctccatctcttcaaaaaaattttttttgtaaattattcaggtatggtggcacgtaccagtagtcccagctacttggaaggctgaggcattagggtctcttgagcccaggagttccaggtggcagtgagctgtgatcatgccactgtactgcagcctaggcaacagacttcatctcttaaaaaaaaaaaaaaaaaaaaaaaactgaaattggaattatttcaggtatacaaggttagtgcaataatcaaaagtaattgtcagccaggtgtggtggctcacacctgtaatcccaacattttgggaggccgaggcaggtggatcacgaggtcaggagatggagaccatcctggctaacatggtgaaaccccatctctactaaaaatgcaaaa

SEQ ID NO: 35908 - DNA, 509 bp, Homo sapiens
tgctgctgctgtattttacttctcagtcctctatttgagttggcaagtaggagttgagttgacagcagggtctctctttcagtagacattgtgaccttcacttatttaaggaaataataaattggaatttcctattaaagggcaatgactttgcttttaaaatgaaaagctcatgccaatcaaataaaaaggaaatagatactttggagagtgaaggaccccaattattactatgcctgcaccttttgtacacaacatatgctcttaagttttttaaaaaaatccttcaccattattcagaaatctaaatcaacattattaaagtcaatttctctttctctcccttttttctccttcctttcctctcatttcaacagtggtatgagagttcagatattctctgccgtgagtaaaaagctctggaaatcagctattgtgccaacaccgggaacatatccaggcccatggtgcgaaaatgaaatatgtgctgttgaattattatttttgtc

SEQ ID NO: 35909 - DNA, 303 bp, Homo sapiens
gctaagctaggaaaataaaactagcacacctgcaataattagccaccaattaagtgctaaatcatgtgctcctgacagtgttggaatgcagtgtgggtgaggggaaatttgaggtggacactggctctcttggagctttggcaagattcagctgtgccttgctgaacaattgagcaatgttgtaaaaaatacatttttaataaatatgtgtgacagcttttcccacttctttttaaaaatattagatcagaattttaagacattttattataaaacactactataacataaataacattttaa

SEQ ID NO: 35910 - DNA, 760 bp, Homo sapiens
aaatgactcagttcaggaggagaatcctcacctcatcttcttccataggcttaggtgtggagaggagatagaaggaagtttttttaaaaagtaattagaggtatagaattgtaggcttcttatactcttgagtctctgtcattgtgtcaaggaaaccatgaaacgcgtgacaaatgtgtcatatcttatgggaagttaattttacttgaagtggttgaggtaggtggtaccttgtttttatgaaaaacgcaggtccatttcaaaatagaaatataaaacataaattgtttaggggaaaaaagagactttaaagaaatatttcaaccttgccttctagacttctctataaatatttttctctgccataagaggtactttgctgggaaagcttacatcattcctgtgtaatagaaagactataaatgttagggtcagataggagttatgatttcagctccctgacctgctggctctgcaacctttacaaatttacttaactacactgaacttctcttcatctataaaataccttttttttctagtcgtgatccctgtggcccttgtggacccatgcacatctgctcaggaaacgtggaattgttgtgaggatatgatggggttccagggtttcctcctgggagctggcactttgaagccggtgggacttagcctgcttttctgtctttaaaaggctgtatgtcaagtcatcactatccatctttttctagctgttgctttttcatctctttcttgtttgggc

SEQ ID NO: 35911 - DNA, 390 bp, Homo sapiens
ttgaccagttttctactcagggtgccatattttgtttttctaagtggagtaaagttcttggatctaaaaagaagctcagcccttctgtgagtaacagatggggaaagatgagcaagttcagggggataatcagtgccagtgtggtcctggtgaatggatgatgatagcactggagagataggcccagggagaaggagtccactggcccagccaggcacttggggaaggagccagtgacgtcactgcagtctggggacactagggcacaatgggcagcagagttatcctccaggtccgctgacaccaggcaacctagtttgtggcaggaagaaaggatcaaagtttgacatggaggagagtgttcctgaaattagattcatggtttgtttc

SEQ ID NO: 35912 - DNA, 325 bp, Homo sapiens
gttatccagtacaaaatcataatagcaaatgttgggaaatgatagaggattgattaaataaattgtagtatgtctttccatcagtgaaaaataaataacatccgctgtcagaaagaatgagctaattctctttctgctgctaagatctccaaaatacattgttgactgaaggaaaaagaaaagataagaacagtgaattaaatatgctatctttgtaaaagaatgagggaaaagtagaaaagattatgtattcatttttacttatgttgtgtcaagaaacctggccaggtgcatgcctgtaatcccagctactcagaaggtggga

SEQ ID NO: 35913 - DNA, 261 bp, Homo sapiens
gttatccagtacaaaatcataatagcaaatgttgggaaatgatagaggattgattaaataaattgtagtatgtctttccatcagtgaaaaataaataacatccgctgtcagaaagaatgagctaattctctttctgctgctaagatctccaaaatacatcgtggcctgggcctagttttagaagtttcaatagcaacaacaacaacaacaacaacaaacaacgttattgggtaagagcagttttaagttcacagcaaaaag

SEQ ID NO: 35914 - DNA, 1859 bp, Homo sapiens
tactttaaaaatcaataaataaaacaaatgaaaaatagcagcattgcatttctttgcacagagaaaggtgagaggaggagagtggcattatccctcctaggcagagtgcctgtgcgtgagggcgcccataaagccctgtgctgcctctttaaacgaaggattttcgatcatgacaacgatagcaattgatataccttcaaaatacgtgtccagtgagtgttgattgtgtgtggtttctctaggagaccgtgttcatgcaacacagcattatttcaccgcctttaccccagcttcttcatacacatgcacttgtcaagggctctttggctgaagagaagttagaagtttccagatatggaggggtattttcagcagatatgcccaccgccatggttttgtcagctctgtagggtggtcttgcaccctgctcactgctggcatcacctgagcctatggcagatacccagtgctgcccgccaccatgtgaattcatcagctctgcaggcacagaccttgcactaggaatgggctgggacgccaccctctgcctcttaccattcactgggtttggcaagtgtgctgggatctggaatcacatggatgaggaacccgataatggtgacgaccgaggtagcaggcgaaccacctggccagggcaggaagtgggcagctcacgggactatggctgcaccgcgggttcataccgactaccatcctggaggtgggagcgcatgctcatctgtaaaagtccggtcccacgttggacacaccggggtcttcttctttgttgaccaggatcctctggcagtgtctttaacaagccagagtctgatcccaccgctcataaagccagggttgttgaaagcttggggcttcctcctcctctgtgcgcagccctcagcaaacggtcacagcctgtgctgtctgctgtacaccgacttggtatcatcccatgaactgtccccctttcgtgctctgtgcttagggccctctgatgccccatctgcctgtgcttcctgcaactgtttagcaagcacctattatctatagggtgctggggtgctgggcgaggccaatcgctcctattactttctgccctggggacgtcctgttttcccacctacccctgtaacgcctctgctctgccttcccatctgcggggctaacgccatcccacaagggctgggctgtccgttcagaagagaaactgggaaggggccttgaggacctgtgtccaggcagggtggacaagggctttgtgcagggagctcctctcccatctttgtgtcctgacagccgtgaccgtgacccctcaaagcagagccagtagtgatcagtatcctgctgcttcaagcctgcacggtcctcttctcctctccgcacatctgcatgcctgtcaaacccagaatagtttggggcctggtaaacagagggaagttggctggaggaggccagtcaggagtgcaagaaccccgcgtactctgtcccacgtggataaagtctctaattccagtctgaggtgaattcttagagagtgctttcatttaatgtttgctttatgcatttcccctgcagctgtgactaattgtggaacagcatacattttgttttgagactctcttgagatttttctggcagtgtaaggtctacaccattttcctctcagcatcagagaaggcagaaagcaagagaaaggaatgcaatgtgagcaaggccaggcacacttgtgctactgcagttggcaagaatggagtctaatcccagcactttgggaggccgaggcgggtggatcacctgaggtcaggaatttgagaccaacctggccaacatgttgaaacctcgtctgtactaaaaataca

SEQ ID NO: 35915 - DNA, 375 bp, Homo sapiens
aataatggcatatatcggagccaaatggtcaaatgatacacagagccaggagcctagcagccttgtccagtttgatgctctataccaagcttgtccaaccagtggcctgcatatcacatgtggcccaggacggctttgaatatggcccaacacaaattcataaactttcttaaaacaatatgagcattatgaaatttttttcatgatattttttcttttttcttttttttttttttttaactcatcagctatcattagtgttaatgtattttatgtgtggcccaagacagttcttccaatgtggcccaggaaagccaaaagattggacacccctgctttataccctttacactgtccttggtagagaaaaaaaaa

SEQ ID NO: 35916 - DNA, 1023 bp, Homo sapiens
gctaggtaaggcctggtgtaaaatcggacgaggaagaagagccacgggcgggcacgcactgcccattggttggaaggcccttcgctctagctgggaggctgacggcccgcgggcgtaagcggactgcagccgcgagctcctggaggcggcgggatggaggcggcggccgagcctggaaacctggccggcgtcaggcacatcatcctggtcctctcaggaaaggggggcgttgggaaaagcaccatctccacggagctggccctggcactgcgccatgcaggcaagaaggtgggaatcctggatgtggacctgtgtggccccagtatcccccgcatgctcggggcgcagggcagggctgtgcaccagtgcgaccgcggctgggcacccgtcttcctggaccgggagcagagcatctcgctcatgtctgtgggcttcctgctggagaagccggacgaggccgtggtgtggagaggccccaagaaaaacgcgctgataaagcagtttgtgtccgacgtggcctggggggagctggactacctggtggtggacacgcccccggggacctccgatgagcacatggccaccatagaagccctgcgtccctaccagcccctgggggccctcgtggtcaccacgccccaggcggtgtccgtgggggacgtgaggcgcgagctgaccttctgtaggaagacgggcttgcgggtgatgggaatcgtggagaatatgagcggcttcacctgcccacactgcacggagtgcaccagcgtcttctccaggggcggcggagaggagctggcccagctcgccggggtgcccttcttaggctccgtgcccctggaccctgcgctcatgaggaccctggaggagggccacgacttcatccaggagttccccgggagccggctatgttggatacctcatagacagaagtttggagcaacacggtggctccctgatatggactctgagacgttccggcacaggttggcacccaagaaaaacgcggcggacggcccaagggca

SEQ ID NO: 35917 - DNA, 201 bp, Homo sapiens
gactttgacaccccgtagctaacaccgatgacatagaccaggtgctggaggcccggggtcacctgaggactgcagaagtcctgcgctccgctaactgtgtggacacgcggcgtgccccctaagggggcgaactgacctcaggcatgtcttgtaactgtagaggcgcctgccattaaacgtgtccgctgctgtggcgacaga

SEQ ID NO: 35918 - DNA, 1441 bp, Homo sapiens
gctaggtaaggcctggtgtaaaatcggacgaggaagaagagccacgggcgggcacgcactgcccattggttggaaggcccttcgctctagctgggaggctgacggcccgcgggcgtaagcggactgcagccgcgagctcctggaggcggcgggatggaggcggcggccgagcctggaaacctggccggcgtcaggcacatcatcctggtcctctcaggaaaggggggcgttgggaaaagcaccatctccacggagctggccctggcactgcgccatgcaggcaagaaggtgggaatcctggatgtggacctgtgtggccccagtatcccccgcatgctcggggcgcagggcagggctgtgcaccagtgcgaccgcggctgggcacccgtcttcctggaccgggagcagagcatctcgctcatgtctgtgggcttcctgctggagaagccggacgaggccgtggtgtggagaggccccaagaaaaacgcgctgataaagcagtttgtgtccgacgtggcctggggggagctggactacctggtggtggacacgcccccggggacctccgatgagcacatggccaccatagaagccctgcgtccctaccagcccctgggggccctcgtggtcaccacgccccaggcggtgtccgtgggggacgtgaggcgcgagctgaccttctgtaggaagacgggcttgcgggtgatgggaatcgtggagaatatgagcggcttcacctgcccacactgcacggagtgcaccagcgtcttctccaggggcggcggagaggagctggcccagctcgccggggtgcccttcttaggctccgtgcccctggaccctgcgctcatgaggaccctggaggagggccacgacttcatccaggagttccccgggagccccgccttcgctgcactcacctccatagcccagaagattctggacgcgacgcccgcgtgcctcccctgactaaggccaccttgcagccgctttccagggccaccaagggctctgctccagcctctcagagaaacagaggcctgggctcggttcccgggccctgcaggggcaggcccaggcagcgtcagcgggagagcttctccccgaccagcccagccccaggatgtgtcgcaccagcagctctgcctggttggcctgcagtgccgtggtctgcgtgctctgcagctgtgagacgggggcggcctgggctctcttcccatccatgttgcctacctgtgcccctggcagccgcgtgtccacacagttagcggagcgcaggacttctgcagtcctcaggtgaccccgggcctccagcaccctgggtcgctgtcatctgtgtttagctcggggagtgccccctaagggggcgaactgacctcaggcatgtcttgtaactgtagaggcgcctgccattaaacgtgtccgctgctgtggcgacaga

SEQ ID NO: 35919 - DNA, 1495 bp, Homo sapiens
gctaggtaaggcctggtgtaaaatcggacgaggaagaagagccacgggcgggcacgcactgcccattggttggaaggcccttcgctctagctgggaggctgacggcccgcgggcgtaagcggactgcagccgcgagctcctggaggcggcgggatggaggcggcggccgagcctggaaacctggccggcgtcaggcacatcatcctggtcctctcaggaaaggggggcgttgggaaaagcaccatctccacggagctggccctggcactgcgccatgcaggcaagaaggtgggaatcctggatgtggacctgtgtggccccagtatcccccgcatgctcggggcgcagggcagggctgtgcaccagtgcgaccgcggctgggcacccgtcttcctggaccgggagcagagcatctcgctcatgtctgtgggcttcctgctggagaagccggacgaggccgtggtgtggagaggccccaagaaaaacgcgctgataaagcagtttgtgtccgacgtggcctggggggagctggactacctggtggtggacacgcccccggggacctccgatgagcacatggccaccatagaagccctgcgtccctaccagcccctgggggccctcgtggtcaccacgccccaggcggtgtccgtgggggacgtgaggcgcgagctgaccttctgtaggaagacgggcttgcgggtgatgggaatcgtggagaatatgagcggcttcacctgcccacactgcacggagtgcaccagcgtcttctccaggggcggcggagaggagctggcccagctcgccggggtgcccttcttaggctccgtgcccctggaccctgcgctcatgaggaccctggaggagggccacgacttcatccaggagttccccgggagccccgccttcgctgcactcacctccatagcccagaagattctggacgcgacgcccgcgtgcctcccctgactaaggccaccttgcagccgctttccagggccaccaagggctctgctccagcctctcagagaaacagaggcctgggctcggttcccgggccctgcaggggcaggcccaggcagcgtcagcgggagagcttctccccgaccagcccagccccaggatgtgtcgcaccagcagctctgcctggttggcctgcagtgccgtggtctgcgtgctctgcagctgtgagacgggggcggcctgggctctcttcccatccatgttgcctacctgtgcccctggcagccgcgtgtccacacagttagcggagcgcaggacttctgcagtcctcaggtgaccccgggcctccagcaccctgggtcgctgtcatctgtgtttagctcggggagtgccccctaagggggcgaactgacctcaggcatgtcttgtaactgtagaggcgcctgccattaaacgtgtccgctgctgtggcgacagaaaaaactaacaaaaaaaaaatccggccttttttggggaaagggtaagggcgtca

SEQ ID NO: 35920 - DNA, 1521 bp, Homo sapiens
gctaggtaaggcctggtgtaaaatcggacgaggaagaagagccacgggcgggcacgcactgcccattggttggaaggcccttcgctctagctgggaggctgacggcccgcgggcgtaagcggactgcagccgcgagctcctggaggcggcgggatggaggcggcggccgagcctggaaacctggccggcgtcaggcacatcatcctggtcctctcaggaaaggggggcgttgggaaaagcaccatctccacggagctggccctggcactgcgccatgcaggcaagaaggtgggaatcctggatgtggacctgtgtggccccagtatcccccgcatgctcggggcgcagggcagggctgtgcaccagtgcgaccgcggctgggcacccgtcttcctggaccgggagcagagcatctcgctcatgtctgtgggcttcctgctggagaagccggacgaggccgtggtgtggagaggccccaagaaaaacgcgctgataaagcagtttgtgtccgacgtggcctggggggagctggactacctggtggtggacacgcccccggggacctccgatgagcacatggccaccatagaagccctgcgtccctaccagcccctgggggccctcgtggtcaccacgccccaggcggtgtccgtgggggacgtgaggcgcgagctgaccttctgtaggaagacgggcttgcgggtgatgggaatcgtggagaatatgagcggcttcacctgcccacactgcacggagtgcaccagcgtcttctccaggggcggcggagaggagctggcccagctcgccggggtgcccttcttaggctccgtgcccctggaccctgcgctcatgaggaccctggaggagggccacgacttcatccaggagttccccgggagccccgccttcgctgcactcacctccatagcccagaagattctggacgcgacgcccgcgtgcctcccctgactaaggccaccttgcagccgctttccagggccaccaagggctctgctccagcctctcagagaaacagaggcctgggctcggttcccgggccctgcaggggcaggcccaggcagcgtcagcgggagagcttctccccgaccagcccagccccaggatgtgtcgcaccagcagctctgcctggttggcctgcagtgccgtggtctgcgtgctctgcagctgtgagacgggggcggcctgggctctcttcccatccatgttgcctacctgtgcccctggcagccgcgtgtccacacagttagcggagcgcaggacttctgcagtcctcaggtgaccccgggcctccagcaccctgggtcgctgtcatctgtgtttagctcggggagtgccccctaagggggcgaactgacctcaggcatgtcttgtaactgtagaggcgcctgccattaaacgtgtccgctgctgtggcgacagaaaaaaaacaaaccacaacacaacacaaaacacacgaccacaaacatcaaccacaaaacaggcggccacaccaagaggtca

SEQ ID NO: 35921 - DNA, 1366 bp, Homo sapiens
gctaggtaaggcctggtgtaaaatcggacgaggaagaagagccacgggcgggcacgcactgcccattggttggaaggcccttcgctctagctgggaggctgacggcccgcgggcgtaagcggactgcagccgcgagctcctggaggcggcgggatggaggcggcggccgagcctggaaacctggccggcgtcaggcacatcatcctggtcctctcaggaaaggggggcgttgggaaaagcaccatctccacggagctggccctggcactgcgccatgcaggcaagaaggtgggaatcctggatgtggacctgtgtggccccagtatcccccgcatgctcggggcgcagggcagggctgtgcaccagtgcgaccgcggctgggcacccgtcttcctggaccgggagcagagcatctcgctcatgtctgtgggcttcctgctggagaagccggacgaggccgtggtgtggagaggccccaagaaaaacgcgctgataaagcagtttgtgtccgacgtggcctggggggagctggactacctggtggtggacacgcccccggggacctccgatgagcacatggccaccatagaagccctgcgtccctaccagcccctgggggccctcgtggtcaccacgccccaggcggtgtccgtgggggacgtgaggcgcgagctgaccttctgtaggaagacgggcttgcgggtgatgggaatcgtggagaatatgagcggcttcacctgcccacactgcacggagtgcaccagcgtcttctccaggggcggcggagaggagctggcccagctcgccggggtgcccttcttaggctccgtgcccctggaccctgcgctcatgaggaccctggaggagggccacgacttcatccaggagttccccgggagccccgccttcgctgcactcacctccatagcccagaagattctggacgcgacgcccgcgtgcctcccctgactaaggccaccttgcagccgctttccagggccaccaagggctctgctccagcctctcagagaaacagaggcctgggctcggttcccgggccctgcaggggcaggcccaggcagcgtcagcgggagagcttctccccgaccagcccagccccaggatgtgtcgcaccagcagctctgcctggttggcctgcagtgcccctggcagccgcgtgtccacacagttagcggagcgcaggacttctgcagtcctcaggtgaccccgggcctccagcaccctgggtcgctgtcatctgtgtttagctcggggagtgccccctaagggggcgaactgacctcaggcatgtcttgtaactgtagaggcgcctgccattaaacgtgtccgctgctgtggcgacaga

SEQ ID NO: 35922 - DNA, 1334 bp, Homo sapiens
gctaggtaaggcctggtgtaaaatcggacgaggaagaagagccacgggcgggcacgcactgcccattggttggaaggcccttcgctctagctgggaggctgacggcccgcgggcgtaagcggactgcagccgcgagctcctggaggcggcgggatggaggcggcggccgagcctggaaacctggccggcgtcaggcacatcatcctggtcctctcaggaaaggggggcgttgggaaaagcaccatctccacggagctggccctggcactgcgccatgcaggcaagaaggtgggaatcctggatgtggacctgtgtggccccagtatcccccgcatgctcggggcgcagggcagggctgtgcaccagtgcgaccgcggctgggcacccgtcttcctggaccgggagcagagcatctcgctcatgtctgtgggcttcctgctggagaagccggacgaggccgtggtgtggagaggccccaagaaaaacgcgctgataaagcagtttgtgtccgacgtggcctggggggagctggactacctggtggtggacacgcccccggggacctccgatgagcacatggccaccatagaagccctgcgtccctaccagcccctgggggccctcgtggtcaccacgccccaggcggtgtccgtgggggacgtgaggcgcgagctgaccttctgtaggaagacgggcttgcgggtgatgggaatcgtggagaatatgagcggcttcacctgcccacactgcacggagtgcaccagcgtcttctccaggggcggcggagaggagctggcccagctcgccggggtgcccttcttaggctccgtgcccctggaccctgcgctcatgaggaccctggaggagggccacgacttcatccaggagttccccgggagccccgccttcgctgcactcacctccatagcccagaagattctggacgcgacgcccgcgtgcctcccctgactaaggccaccttgcagccgctttccagggccaccaagggctctgctccagcctctcagagaaacagaggcctgggctcggttcccgggccctgcaggggcaggcccagctgtgagacgggggcggcctgggctctcttcccatccatgttgcctacctgtgcccctggcagccgcgtgtccacacagttagcggagcgcaggacttctgcagtcctcaggtgaccccgggcctccagcaccctgggtcgctgtcatctgtgtttagctcggggagtgccccctaagggggcgaactgacctcaggcatgtcttgtaactgtagaggcgcctgccattaaacgtgtccgctgctgtggcgacaga

SEQ ID NO: 35923 - DNA, 1705 bp, Homo sapiens
gctaggtaaggcctggtgtaaaatcggacgaggaagaagagccacgggcgggcacgcactgcccattggttggaaggcccttcgctctagctgggaggctgacggcccgcgggcgtaagcggactgcagccgcgagctcctggaggcggcgggatggaggcggcggccggagtgtggggctggggctgccttttccgcgtcccctggaggagacctcaggcagcctctgtaggtctgaggacccgcctgcatgccaggttctccgggaggctttggacttgggagcctttgaacgtgcccttgagaggcggatcagaagggggcaggttttacgcatcatgtgttgagcccctcacatgcaccctccaaggacctgtcggggatggagcagcttgctggagacaaggggcatggcctcagcggtggcgccgggagcctggaaacctggccggcgtcaggcacatcatcctggtcctctcaggaaaggggggcgttgggaaaagcaccatctccacggagctggccctggcactgcgccatgcaggcaagaaggtgggaatcctggatgtggacctgtgtggccccagtatcccccgcatgctcggggcgcagggcagggctgtgcaccagtgcgaccgcggctgggcacccgtcttcctggaccgggagcagagcatctcgctcatgtctgtgggcttcctgctggagaagccggacgaggccgtggtgtggagaggccccaagaaaaacgcgctgataaagcagtttgtgtccgacgtggcctggggggagctggactacctggtggtggacacgcccccggggacctccgatgagcacatggccaccatagaagccctgcgtccctaccagcccctgggggccctcgtggtcaccacgccccaggcggtgtccgtgggggacgtgaggcgcgagctgaccttctgtaggaagacgggcttgcgggtgatgggaatcgtggagaatatgagcggcttcacctgcccacactgcacggagtgcaccagcgtcttctccaggggcggcggagaggagctggcccagctcgccggggtgcccttcttaggctccgtgcccctggaccctgcgctcatgaggaccctggaggagggccacgacttcatccaggagttccccgggagccccgccttcgctgcactcacctccatagcccagaagattctggacgcgacgcccgcgtgcctcccctgactaaggccaccttgcagccgctttccagggccaccaagggctctgctccagcctctcagagaaacagaggcctgggctcggttcccgggccctgcaggggcaggcccaggcagcgtcagcgggagagcttctccccgaccagcccagccccaggatgtgtcgcaccagcagctctgcctggttggcctgcagtgccgtggtctgcgtgctctgcagctgtgagacgggggcggcctgggctctcttcccatccatgttgcctacctgtgcccctggcagccgcgtgtccacacagttagcggagcgcaggacttctgcagtcctcaggtgaccccgggcctccagcaccctgggtcgctgtcatctgtgtttagctcggggagtgccccctaagggggcgaactgacctcaggcatgtcttgtaactgtagaggcgcctgccattaaacgtgtccgctgctgtggcgacaga

SEQ ID NO: 35924 - DNA, 1911 bp, Homo sapiens
gctaggtaaggcctggtgtaaaatcggacgaggaagaagagccacgggcgggcacgcactgcccattggttggaaggcccttcgctctagctgggaggctgacggcccgcgggcgtaagcggactgcagccgcgagctcctggaggcggcgggatggaggcggcggccggtgagtggcgggccagggtgcggagccgctccagggcctcgcttggggccccgccgcgtcccttcccggggcggcctcgctgcgtcgcgcgcctccggtgcgaccatcaccggccggcgtggctgggccgggccagaggccgcggcgcgggcattttctaaacagggtcgtttcccgcgtgctcctgcttcgatgtggaagctccgtgatctcggagggcctgagtcgtggagttgggggagcttttaaagttaactttgttgagcaccgcgttgtaggcgggcgcggtggcgcctgtgggccccgctatcctggaggtcgcggttgcaactgcaccgcagcccgggcaagagcgagaccctgtctctaaataaatcacacgcgcgcagtcatgaaagtaagacggacgccagaatctcacatgcttttaagttctttgtggaagtggcgctctcagtgttcagaaaagtagcctggaaacctggccggcgtcaggcacatcatcctggtcctctcaggaaaggggggcgttgggaaaagcaccatctccacggagctggccctggcactgcgccatgcaggcaagaaggtgggaatcctggatgtggacctgtgtggccccagtatcccccgcatgctcggggcgcagggcagggctgtgcaccagtgcgaccgcggctgggcacccgtcttcctggaccgggagcagagcatctcgctcatgtctgtgggcttcctgctggagaagccggacgaggccgtggtgtggagaggccccaagaaaaacgcgctgataaagcagtttgtgtccgacgtggcctggggggagctggactacctggtggtggacacgcccccggggacctccgatgagcacatggccaccatagaagccctgcgtccctaccagcccctgggggccctcgtggtcaccacgccccaggcggtgtccgtgggggacgtgaggcgcgagctgaccttctgtaggaagacgggcttgcgggtgatgggaatcgtggagaatatgagcggcttcacctgcccacactgcacggagtgcaccagcgtcttctccaggggcggcggagaggagctggcccagctcgccggggtgcccttcttaggctccgtgcccctggaccctgcgctcatgaggaccctggaggagggccacgacttcatccaggagttccccgggagccccgccttcgctgcactcacctccatagcccagaagattctggacgcgacgcccgcgtgcctcccctgactaaggccaccttgcagccgctttccagggccaccaagggctctgctccagcctctcagagaaacagaggcctgggctcggttcccgggccctgcaggggcaggcccaggcagcgtcagcgggagagcttctccccgaccagcccagccccaggatgtgtcgcaccagcagctctgcctggttggcctgcagtgccgtggtctgcgtgctctgcagctgtgagacgggggcggcctgggctctcttcccatccatgttgcctacctgtgcccctggcagccgcgtgtccacacagttagcggagcgcaggacttctgcagtcctcaggtgaccccgggcctccagcaccctgggtcgctgtcatctgtgtttagctcggggagtgccccctaagggggcgaactgacctcaggcatgtcttgtaactgtagaggcgcctgccattaaacgtgtccgctgctgtggcgacaga

SEQ ID NO: 35925 - DNA, 1460 bp, Homo sapiens
gctaggtaaggcctggtgtaaaatcggacgaggaagaagagccacgggcgggcacgcactgcccattggttggaaggcccttcgctctagctgggaggctgacggcccgcgggcgtaagcggactgcagccgcgagctcctggaggcggcgggatggaggcggcggccgagcctggaaacctggccggcgtcaggcacatcatcctggtcctctcaggaaaggggggcgttgggaaaagcaccatctccacggagctggccctggcactgcgccatgcaggcaagaaggctgtgccgctccttgcaggtgggaatcctggatgtggacctgtgtggccccagtatcccccgcatgctcggggcgcagggcagggctgtgcaccagtgcgaccgcggctgggcacccgtcttcctggaccgggagcagagcatctcgctcatgtctgtgggcttcctgctggagaagccggacgaggccgtggtgtggagaggccccaagaaaaacgcgctgataaagcagtttgtgtccgacgtggcctggggggagctggactacctggtggtggacacgcccccggggacctccgatgagcacatggccaccatagaagccctgcgtccctaccagcccctgggggccctcgtggtcaccacgccccaggcggtgtccgtgggggacgtgaggcgcgagctgaccttctgtaggaagacgggcttgcgggtgatgggaatcgtggagaatatgagcggcttcacctgcccacactgcacggagtgcaccagcgtcttctccaggggcggcggagaggagctggcccagctcgccggggtgcccttcttaggctccgtgcccctggaccctgcgctcatgaggaccctggaggagggccacgacttcatccaggagttccccgggagccccgccttcgctgcactcacctccatagcccagaagattctggacgcgacgcccgcgtgcctcccctgactaaggccaccttgcagccgctttccagggccaccaagggctctgctccagcctctcagagaaacagaggcctgggctcggttcccgggccctgcaggggcaggcccaggcagcgtcagcgggagagcttctccccgaccagcccagccccaggatgtgtcgcaccagcagctctgcctggttggcctgcagtgccgtggtctgcgtgctctgcagctgtgagacgggggcggcctgggctctcttcccatccatgttgcctacctgtgcccctggcagccgcgtgtccacacagttagcggagcgcaggacttctgcagtcctcaggtgaccccgggcctccagcaccctgggtcgctgtcatctgtgtttagctcggggagtgccccctaagggggcgaactgacctcaggcatgtcttgtaactgtagaggcgcctgccattaaacgtgtccgctgctgtggcgacaga

SEQ ID NO: 35926 - DNA, 1242 bp, Homo sapiens
gctaggtaaggcctggtgtaaaatcggacgaggaagaagagccacgggcgggcacgcactgcccattggttggaaggcccttcgctctagctgggaggctgacggcccgcgggcgtaagcggactgcagccgcgagctcctggaggcggcgggatggaggcggcggccgagcctggaaacctggccggcgtcaggcacatcatcctggtcctctcaggaaaggggggcgttgggaaaagcaccatctccacggagctggccctggcactgcgccatgcaggcaagaagcgctgataaagcagtttgtgtccgacgtggcctggggggagctggactacctggtggtggacacgcccccggggacctccgatgagcacatggccaccatagaagccctgcgtccctaccagcccctgggggccctcgtggtcaccacgccccaggcggtgtccgtgggggacgtgaggcgcgagctgaccttctgtaggaagacgggcttgcgggtgatgggaatcgtggagaatatgagcggcttcacctgcccacactgcacggagtgcaccagcgtcttctccaggggcggcggagaggagctggcccagctcgccggggtgcccttcttaggctccgtgcccctggaccctgcgctcatgaggaccctggaggagggccacgacttcatccaggagttccccgggagccccgccttcgctgcactcacctccatagcccagaagattctggacgcgacgcccgcgtgcctcccctgactaaggccaccttgcagccgctttccagggccaccaagggctctgctccagcctctcagagaaacagaggcctgggctcggttcccgggccctgcaggggcaggcccaggcagcgtcagcgggagagcttctccccgaccagcccagccccaggatgtgtcgcaccagcagctctgcctggttggcctgcagtgccgtggtctgcgtgctctgcagctgtgagacgggggcggcctgggctctcttcccatccatgttgcctacctgtgcccctggcagccgcgtgtccacacagttagcggagcgcaggacttctgcagtcctcaggtgaccccgggcctccagcaccctgggtcgctgtcatctgtgtttagctcggggagtgccccctaagggggcgaactgacctcaggcatgtcttgtaactgtagaggcgcctgccattaaacgtgtccgctgctgtggcgacaga

SEQ ID NO: 35927 - DNA, 1077 bp, Homo sapiens
gctaggtaaggcctggtgtaaaatcggacgaggaagaagagccacgggcgggcacgcactgcccattggttggaaggcccttcgctctagctgggaggctgacggcccgcgggcgtaagcggactgcagccgcgagctcctggaggcggcgggatggaggcggcggccgagcctggaaacctggccggcgtcaggcacatcatcctggtcctctcaggaaaggggggcgttgggaaaagcaccatctccacggagctggccctggcactgcgccatgcaggcaagaaggtgggaatcctggatgtggacctgtgtggccccagtatcccccgcatgctcggggcgcagggcagggctgtgcaccagtgcgaccgcggctgggcacccgtcttcctggaccgggagcagagcatctcgctcatgtctgtgggcttcctgctggagaagccggacgaggccgtggtgtggagaggccccaagaaaaacgcgctgataaagcagtttgtgtccgacgtggcctggggggagctggactacctggtggtggacacgcccccggggacctccgatgagcacatggccaccatagaagccctgcgtccctaccagcccctgggggccctcgtggtcaccacgccccaggcggtgtccgtgggggacgtgaggcgcgagctgaccttctgtaggaagacgggcttgcgggtgatgggaatcgtggagaatatgagcggcttcacctgcccacactgcacggagtgcaccagcgtcttctccaggggcggcggagaggagctggcccagctcgccggggtgcccttcttaggctccgtgcccctggaccctgcgctcatgaggaccctggaggagggccacgacttcatccaggagttccccgggagccccgccttcgctgcactcacctccatagcccagaagattctggacgagggccggtgctcctgatagggcacttgagcgttcaggcacaggttgtcagttaaaaaaaggtggctgtcggcctgggggcaggaggaggaattccgcacagccgtttacctcctgggcagacggcaggca

SEQ ID NO: 35928 - DNA, 1339 bp, Homo sapiens
ttttttgagacagggtcttaactgtcgccaaggctgaagtgcagtggcacgatcataactcactgcagccttgacctcctgggctcaagcgaccctcccacctcagcctcctgagcacctgggaccacaggatgcaccaccccgcttggctacatttttaatgtgtagacatggggtctgaatacgttattgagagtggtgcggaactcctcctggaccgaaatgatccttccactttggcctctcagagtgctgggattactggcagcctggaaacctggccggcgtcaggcacatcatcctggtcctctcaggaaaggggggcgttgggaaaagcaccatctccacggagctggccctggcactgcgccatgcaggcaagaagcgctgataaagcagtttgtgtccgacgtggcctggggggagctggactacctggtggtggacacgcccccggggacctccgatgagcacatggccaccatagaagccctgcgtccctaccagcccctgggggccctcgtggtcaccacgccccaggcggtgtccgtgggggacgtgaggcgcgagctgaccttctgtaggaagacgggcttgcgggtgatgggaatcgtggagaatatgagcggcttcacctgcccacactgcacggagtgcaccagcgtcttctccaggggcggcggagaggagctggcccagctcgccggggtgcccttcttaggctccgtgcccctggaccctgcgctcatgaggaccctggaggagggccacgacttcatccaggagttccccgggagccccgccttcgctgcactcacctccatagcccagaagattctggacgcgacgcccgcgtgcctcccctgactaaggccaccttgcagccgctttccagggccaccaagggctctgctccagcctctcagagaaacagaggcctgggctcggttcccgggccctgcaggggcaggcccaggcagcgtcagcgggagagcttctccccgaccagcccagccccaggatgtgtcgcaccagcagctctgcctggttggcctgcagtgccgtggtctgcgtgctctgcagctgtgagacgggggcggcctgggctctcttcccatccatgttgcctacctgtgcccctggcagccgcgtgtccacacagttagcggagcgcaggacttctgcagtcctcaggtgaccccgggcctccagcaccctgggtcgctgtcatctgtgtttagctcggggagtgccccctaagggggcgaactgacctcaggcatgtcttgtaactgtagaggcgcctgccattaaacgtgtccgctgctgtggcgacaga

SEQ ID NO: 35929 - DNA, 1130 bp, Homo sapiens
tccagaggagaagcctggaaaagcctgtccttattatcaggacggatttactacaaaagcctggaaacctggccggcgtcaggcacatcatcctggtcctctcaggaaaggggggcgttgggaaaagcaccatctccacggagctggccctggcactgcgccatgcaggcaagaagcgctgataaagcagtttgtgtccgacgtggcctggggggagctggactacctggtggtggacacgcccccggggacctccgatgagcacatggccaccatagaagccctgcgtccctaccagcccctgggggccctcgtggtcaccacgccccaggcggtgtccgtgggggacgtgaggcgcgagctgaccttctgtaggaagacgggcttgcgggtgatgggaatcgtggagaatatgagcggcttcacctgcccacactgcacggagtgcaccagcgtcttctccaggggcggcggagaggagctggcccagctcgccggggtgcccttcttaggctccgtgcccctggaccctgcgctcatgaggaccctggaggagggccacgacttcatccaggagttccccgggagccccgccttcgctgcactcacctccatagcccagaagattctggacgcgacgcccgcgtgcctcccctgactaaggccaccttgcagccgctttccagggccaccaagggctctgctccagcctctcagagaaacagaggcctgggctcggttcccgggccctgcaggggcaggcccaggcagcgtcagcgggagagcttctccccgaccagcccagccccaggatgtgtcgcaccagcagctctgcctggttggcctgcagtgccgtggtctgcgtgctctgcagctgtgagacgggggcggcctgggctctcttcccatccatgttgcctacctgtgcccctggcagccgcgtgtccacacagttagcggagcgcaggacttctgcagtcctcaggtgaccccgggcctccagcaccctgggtcgctgtcatctgtgtttagctcggggagtgccccctaagggggcgaactgacctcaggcatgtcttgtaactgtagaggcgcctgccattaaacgtgtccgctgctgtggcgacaga

SEQ ID NO: 35930 - DNA, 1219 bp, Homo sapiens
gctaggtaaggcctggtgtaaaatcggacgaggaagaagagccacgggcgggcacgcactgcccattggttggaaggcccttcgctctagctgggaggctgacggcccgcgggcgtaagcggactgcagccgcgagctcctggaggcggcgggatggaggcggcggccgagcctggaaacctggccggcgtcaggcacatcatcctggtcctctcaggaaaggggggcgttgggaaaagcaccatctccacggagctggccctggcactgcgccatgcaggcaagaagcgctgataaagcagtttgtgtccgacgtggcctggggggagctggactacctggtggtggacacgcccccggggacctccgatgagcacatggccaccatagaagccctgcgtccctaccagcccctgggggccctcgtggtcaccacgccccaggcggtgtccgtgggggacgtgaggcgcgagctgaccttctgtaggaagacgggcttgcgggtgatgggaatcgtggagaatatgagcggcttcacctgcccacactgcacggggcggcggagaggagctggcccagctcgccggggtgcccttcttaggctccgtgcccctggaccctgcgctcatgaggaccctggaggagggccacgacttcatccaggagttccccgggagccccgccttcgctgcactcacctccatagcccagaagattctggacgcgacgcccgcgtgcctcccctgactaaggccaccttgcagccgctttccagggccaccaagggctctgctccagcctctcagagaaacagaggcctgggctcggttcccgggccctgcaggggcaggcccaggcagcgtcagcgggagagcttctccccgaccagcccagccccaggatgtgtcgcaccagcagctctgcctggttggcctgcagtgccgtggtctgcgtgctctgcagctgtgagacgggggcggcctgggctctcttcccatccatgttgcctacctgtgcccctggcagccgcgtgtccacacagttagcggagcgcaggacttctgcagtcctcaggtgaccccgggcctccagcaccctgggtcgctgtcatctgtgtttagctcggggagtgccccctaagggggcgaactgacctcaggcatgtcttgtaactgtagaggcgcctgccattaaacgtgtccgctgctgtggcgacaga

SEQ ID NO: 35931 - DNA, 1045 bp, Homo sapiens
cctgtgttgaatcggcacagtggaggcgggggatggaggcggcggcgagcctggaaacctggccggcgtcaggcacatcatcctggtcctctcaggaaaggggggcgttgggaaaagcaccatctccacggagctggccctggcactgcgccatgcaggcaagaagcgctgataaagcagtttgtgtccgacgtggcctggggggagctggactacctggtggtggacacgcccccggggacctccgatgagcacatggccaccatagaagccctgcgtccctaccagcccctgggggccctcgtggtcaccacgccccaggcggtgtccgtgggggacgtgaggcgcgagctgaccttctgtaggaagacgggcttgcgggtgatgggaatcgtggagaatatgagcggcttcacctgcccacactgcacggagtgcaccagcgtcttctccaggggcggcggagaggagctggcccagctcgccggggtgcccttcttaggctccgtgcccctggaccctgcgctcatgaggaccctggaggagggccacgacttcatccaggagttccccgggagccccgccttcgctgcactcacctccatagcccagaagattctggacgcgacgcccgcgtgcctcccctgactaaggccaccttgcagccgctttccagggccaccaagggctctgctccagcctctcagagaaacagaggcctgggctcggttcccgggccctgcaggggcaggcccaggcagcgtcagcgggagagcttctccccgaccagcccagccccaggatgtgtcgcaccagcagctctgcctggttggcctgcagtgcccctggcagccgcgtgtccacacagttagcggagcgcaggacttctgcagtcctcaggtgaccccgggcctccagcaccctgggtcgctgtcatctgtgtttagctcggggagtgccccctaagggggcgaactgacctcaggcatgtcttgtaactgtagaggcgcctgccattaaacgtgtccgctgctgtggcgacaga

SEQ ID NO: 35932 - DNA, 792 bp, Homo sapiens
gctaggtaaggcctggtgtaaaatcggacgaggaagaagagccacgggcgggcacgcactgcccattggttggaaggcccttcgctctagctgggaggctgacggcccgcgggcgtaagcggactgcagccgcgagctcctggaggcggcgggatggaggcggcggccgagcctggaaacctggccggcgtcaggcacatcatcctggtcctctcaggaaaggggggcgttgggaaaagcaccatctccacggagctggccctggcactgcgccatgcaggcaagaaggctgtgccgctccttgcaggtgggaatcctggatgtggacctgtgtggccccagtatcccccgcatgctcggggcgcagggcagggctgtgcaccagtgcgaccgcggctgggcacccgtcttcctggaccgggagcagagcatctcgctcatgtctgtgggcttcctgctggagaagccggacgaggccgtggtgtggagaggccccaagaaaaacgcgctgataaagcagtttgtgtccgacgtggcctggggggagctggactacctggtggtggacacgcccccggggacctccgatgagcacatggccaccatagaagccctgcgtccctaccagcccctgggggccctcgtggtcaccacgccccaggcggtgtccgtgggggacgtgaggcgcgagctgaccttctgtaggaagacgggcttgcgggtgatgggaatcgtggagaatatgagcggcttcacctgcccacactgcacggtgagtcccgggggttgcag

SEQ ID NO: 35933 - DNA, 1461 bp, Homo sapiens
gctaggtaaggcctggtgtaaaatcggacgaggaagaagagccacgggcgggcacgcactgcccattggttggaaggcccttcgctctagctgggaggctgacggcccgcgggcgtaagcggactgcagccgcgagctcctggaggcggcgggatggaggcggcggccggagtgtggggctggggctgccttttccgcgtcccctggaggagacctcaggcagcctctgtaggtctgaggacccgcctgcatgccaggttctccgggaggctttggacttgggagcctttgaacgtgcccttgagaggcggatcagaagggggcaggttttacgcatcatgtgttgagcccctcacatgcaccctccaaggacctgtcggggatggagcagcttgctggagacaaggggcatggcctcagcggtggcgccgggagcctggaaacctggccggcgtcaggcacatcatcctggtcctctcaggaaaggggggcgttgggaaaagcaccatctccacggagctggccctggcactgcgccatgcaggcaagaaggtgggaatcctggatgtggacctgtgtggccccagtatcccccgcatgctcggggcgcagggcagggctgtgcaccagtgcgaccgcggctgggcacccgtcttcctggaccgggagcagagcatctcgctcatgtctgtgggcttcctgctggagaagccggacgaggccgtggtgtggagaggccccaagaaaaacggtaacggccgggcggcgcgtccgccgtcctggtgaagggggttagcgtccgtgccggcctctcctgtggaaatgttcctcttcagcagccaggcctgttcctggggacctgcacatgacacccacgaccaggcacagggctcaggctggcggtgtgtctccagttgggtccgtgctgccacacagctgtccccaactcccggtcagagggagtggggtctgctgagaccctggccatggcatgcagggacctgaggccccagtgtggcaggtcataggggcagagctgagggggttctggtgcctctggagcaggtggcattagacgcccccaaaggcagggagaggctggtgggagtgaggcgcaggctgtgggtgcaccagtggggcatccaccacggagaatgtgggtgctcccatgtgtgggtacagacgcctggagggtcctggctccgtgttctgatttggggcctcggggagtcagcgggggctctgtgggcaggggccagacactgcagaaagggacgctgtaatggccccggccccatctttgcactcctgcagcgggccagggcctcccgagagcctgtgatggaggctggtggcaagtgacacctgatggactgcagcccctcggcctgacctggctggttcttagtggcgcagggccacgtgtgcagacctgccctgccctgaccgccccgtctgccc

SEQ ID NO: 35934 - DNA, 1298 bp, Homo sapiens
gctaggtaaggcctggtgtaaaatcggacgaggaagaagagccacgggcgggcacgcactgcccattggttggaaggcccttcgctctagctgggaggctgacggcccgcgggcgtaagcggactgcagccgcgagctcctggaggcggcgggatggaggcggcggccgagcctggaaacctggccggcgtcaggcacatcatcctggtcctctcaggaaaggggggcgttgggaaaagcaccatctccacggagctggccctggcactgcgccatgcaggcaagaaggtgagcgccctacccctcactgggcggagccccgggcagctgcccgcatccccgtggaggcctggcggtgcccccggcctaggctgtgccgctccttgcaggtgggaatcctggatgtggacctgtgtggccccagtatcccccgcatgctcggggcgcagggcagggctgtgcaccagtgcgaccgcggctgggcacccgtcttcctggaccgggagcagagcatctcgctcatgtctgtgggcttcctgctggagaagccggacgaggccgtggtgtggagaggccccaagaaaaacggtaacggccgggcggcgcgtccgccgtcctggtgaagggggttagcgtccgtgccggcctctcctgtggaaatgttcctcttcagcagccaggcctgttcctggggacctgcacatgacacccacgaccaggcacagggctcaggctggcggtgtgtctccagttgggtccgtgctgccacacagctgtccccaactcccggtcagagggagtggggtctgctgagaccctggccatggcatgcagggacctgaggccccagtgtggcaggtcataggggcagagctgagggggttctggtgcctctggagcaggtggcattagacgcccccaaaggcagggagaggctggtgggagtgaggcgcaggctgtgggtgcaccagtggggcatccaccacggagaatgtgggtgctcccatgtgtgggtacagacgcctggagggtcctggctccgtgttctgatttggggcctcggggagtcagcgggggctctgtgggcaggggccagacactgcagaaagggacgctgtaatggccccggccccatctttgcactcctgcagcgggccagggcctcccgagagcctgtgatggaggctggtggcaagtgacacctgatggactgcagcccctcggcctgacctggctggttcttagtggcgcagggccacgtgtgcagacctgccctgccctgaccgccccgtctgccc

SEQ ID NO: 35935 - DNA, 783 bp, Homo sapiens
gctaggtaaggcctggtgtaaaatcggacgaggaagaagagccacgggcgggcacgcactgcccattggttggaaggcccttcgctctagctgggaggctgacggcccgcgggcgtaagcggactgcagccgcgagctcctggaggcggcgggatggaggcggcggccgagcctggaaacctggccggcgtcaggcacatcatcctggtcctctcaggaaaggggggcgttgggaaaagcaccatctccacggagctggccctggcactgcgccatgcaggcaagaaggtgagcgccctacccctcactgggcggagccccgggcagctgcccgcatccccgtggaggcctggcggtgcccccggcctaggctgtgccgctccttgcaggtgggaatcctggatgtggacctgtgtggccccagtatcccccgcatgctcggggcgcagggcagggctgtgcatccaccacggagaatgtgggtgctcccatgtgtgggtacagacgcctggagggtcctggctccgtgttctgatttggggcctcggggagtcagcgggggctctgtgggcaggggccagacactgcagaaagggacgctgtaatggccccggccccatctttgcactcctgcagcgggccagggcctcccgagagcctgtgatggaggctggtggcaagtgacacctgatggactgcagcccctcggcctgacctggctggttcttagtggcgcagggccacgtgtgcagacctgccctgccctgaccgccccgtctgccc

SEQ ID NO: 35936 - DNA, 635 bp, Homo sapiens
gacatggcgccaccgcctccactgtgccctgcaggctccgtgcccctggaccctgcgctcatgaggaccctggaggagggccacgacttcatccaggagttccccgggagccccgccttcgctgcactcacctccatagcccagaagattctggacgcgacgcccgcgtgcctcccctgactaaggccaccttgcagccgctttccagggccaccaagggctctgctccagcctctcagagaaacagaggcctgggctcggttcccgggccctgcaggggcaggcccaggcagcgtcagcgggagagcttctccccgaccagcccagccccaggatgtgtcgcaccagcagctctgcctggttggcctgcagtgccgtggtctgcgtgctctgcagctgtgagacgggggcggcctgggctctcttcccatccatgttgcctacctgtgcccctggcagccgcgtgtccacacagttagcggagcgcaggacttctgcagtcctcaggtgaccccgggcctccagcaccctgggtcgctgtcatctgtgtttagctcggggagtgccccctaagggggcgaactgacctcaggcatgtcttgtaactgtagaggcgcctgccattaaacgtgtcc

SEQ ID NO: 35937 - DNA, 289 bp, Homo sapiens
gagtgtggggctggggctgccttttccgcgtcccctggaggagacctcaggcagcctctgtaggtctgaggacccgcctgcatgccaggttctccgggaggctttggacttgggagcctttgaacgtgcccttgagaggcggatcagaagggggcaggttttacgcatcatgtgttgagcccctcacatgcaccctccaaggacctgtcggggatggagcagcttgctggagacaaggggcatggcctcagcggtggcgccggggtgagaatgcaggggttttgccaag

SEQ ID NO: 35938 - DNA, 1367 bp, Homo sapiens
catgttggacaggttggtcttggtgatctgcccaccttggcctccaaagtgctgggattacacgtgtgagccaccatgcctggccctctctactactaccattctaatccaagccaccaataactcttgcctagacttctgcaatgacttcctaactagtcttcttgcttccactccgcctatctatgtaaaacaaatctttagaattccaatttcaaatatcattaaaatcagaaacaccactgtcaagcatgaattagggaagagcaggaaaatcaaagataataactgggaattaactttcactgtcattaagatttagtttaagttaaacttgtactgttttcaaaaggggagctagtggcattttggctgaagcaattcttccccctacagctcatcagtactgcaaaacttttagcttgcctggccaatagtctgttacaatccaaaaggtaattccaaacatcctgactccaccccaatctcctttgagaagcactaagttaaaattatgtcaatataagcctgtggtaaaatcagggtgaggttaaataacaagtgagaatcatcctaacaacattaggactaaataaacacacgtttatagcaaacaaagatccatctctatgattcccttcccttcacccactaagctcccaggatatggcagccaagagtttggaacaatctcctctagggaatttgatcacctcaagaggaaagacctaaaaatactgacatttggggttccccagtgaaatattccaataagattaccctacagtgaggctcaatgttgataagccacagccacttgcttggctacaaatcaacattttaatctctcactcttaaaacaagaacagacagttgaaggggatgagaaaagcagatgtgtgaagggctctatgttatccccacttccagcttgaaacaaggcataaactccccatgcaaaagttaccctcctgatactaggaagaaaagaatattcttatcaccaggaatggggagtcaatgcagggatgagtctgcacaacaaaccgtactaaaataatcctttccttccattagtttcccccatgtagttcctagtcactttcctacaatttgccacccttagaaactcaaaaccctttccttcatccagtcatttctcttcaatttattaccctttgttaaaatggtatataaagccaggcttggtgactcacacctgtaatcccagcactaaggccgaggtgggaggactgcttgagcctaggagttcaagatcagcatgggcgacaaagcaagacctcatctctacaaaaaaaatttttaaaagaacttaactgggcatgcttatagtcctagctatttgg

SEQ ID NO: 35939 - DNA, 1313 bp, Homo sapiens
catgttggacaggttggtcttggtgatctgcccaccttggcctccaaagtgctgggattacacgtgtgagccaccatgcctggccctctctactactaccattctaatccaagccaccaataactcttgcctagacttctgcaatgacttcctaactagtcttcttgcttccactccgcctatctatgtaaaacaaatctttagaattccaatttcaaatatcattaaaatcagaaacaccactgtcaagcatgaattagggaagagcaggaaaatcaaagataataactgggaattaactttcactgtcattaagatttagtttaagttaaacttgtactgttttcaaaaggggagctagtggcattttggctgaagcaattcttccccctacagctcatcagtactgcaaaacttttagcttgcctggccaatagtctgttacaatccaaaaggtaattccaaacatcctgactccaccccaatctcctttgagaagcactaagttaaaattatgtcaatataagcctgtggtaaaatcagggtgaggttaaataacaagtgagaatcatcctaacaacattaggactaaataaacacacgtttatagcaaacaaagatccatctctatgattcccttcccttcacccactaagctcccaggatatggcagccaagagtttggaacaatctcctctagggaatttgatcacctcaagaggaaagacctaaaaatactgacatttggggttccccagtgaaatattccaataagattaccctacattaatctctcactcttaaaacaagaacagacagttgaaggggatgagaaaagcagatgtgtgaagggctctatgttatccccacttccagcttgaaacaaggcataaactccccatgcaaaagttaccctcctgatactaggaagaaaagaatattcttatcaccaggaatggggagtcaatgcagggatgagtctgcacaacaaaccgtactaaaataatcctttccttccattagtttcccccatgtagttcctagtcactttcctacaatttgccacccttagaaactcaaaaccctttccttcatccagtcatttctcttcaatttattaccctttgttaaaatggtatataaagccaggcttggtgactcacacctgtaatcccagcactaaggccgaggtgggaggactgcttgagcctaggagttcaagatcagcatgggcgacaaagcaagacctcatctctacaaaaaaaatttttaaaagaacttaactgggcatgcttatagtcctagctatttgg

SEQ ID NO: 35940 - DNA, 848 bp, Homo sapiens
cacctgccagtagtgggatagataagccacgtggctcaataaattattgaacccatagtgtcaccctccaagtatttttcttttttaatcacaataccataatgcctttaggtgtgaaactgggtatagcctaagaataggaactggatgagatatttcatgaggacacttgatccttgcttgctgtgatattgctaagggtgtggcatcatgatttggacaaaatgagaatggcaggaattggggagataaaatatcaggctcataggccttcatggagttaaagcagtattgtgtgtgcttagctccagaattctcagaatttttacaataattcaacaggacgttggattgaataagcactttaatactgaaacactggatttgaaaactggatgttatgtgttctactcataagcctattactcattggctgtgacctgggatacatcactgcttttgcttttagagaatgagggtcattgggctaggtatttacagctcttaatattttagggttgcagtctagcaccgtatttttaaaacaagaattctaagcttctaatatccacctgttctttgcaaggttaacttttttttaacaaactctgagaatcagaagtcttagacatttacttgataattttagcatttgaggaattggctgatgttcctagaatcaaattctgacagaaactttaatgccccctctatctcactgttttatttaacaagagttctgattgctttcattggttggtaaaacagatatttcaagtaatagccacactgattaatttcattatggtgacatttcattaatgtcattatggtgacatttcagtttt

SEQ ID NO: 35941 - DNA, 1005 bp, Homo sapiens
ctgtaaatattcatgaagtaagcacaccatgtaacacctatatttaaaaaacaatattaccactaccttataagccttcccttcctctacccttacagtcactatgtcccaccaagcaaacaggatgacttctacagcatatattagttttgcctgcttttgagtatgaaatcatatggcggctttttcaaattttatttgtgagatttattgatgttgttgtttgtactaacagttcattcaggcccattgctgtattatattccactgcatgactagaccctagtttatctgttctatttttggatttgttttgtttttacattttggctgtatgtctttgggtgtgcatacatacacatttctgttggctatgtacctagaagtggggctgctggatcatagaacgtgcatatgttcaacttttgtagatgctgctagatgctttccttaagtgtttattctttatattccagcagcagtttgtaagtttcatttgttctatatcttcaccaacacttggtgatattgttggtagagatgggcctcttcctatggttgctgaggctggtcttaaactcctgggtgtaagcaatccttccaaagtgctgggattacaggcatgacaggtgtagcatcaaccttggccagtaatgtggttttaatttgtattcccctgataactaatgaagtagaactctttttcatatatttactattcatttggagtactaaaaaaattttatgacacttgcattttaaaatattaaactttcctatgttaagaagggctgttgtaaattagttattttctaaaacatttggcataatcattcagtctatctctgtatttgataagttgtgaaattctttgaaaatatttttttccttaataaaactatgtatttcaaaccatggaattgatttcaaatgctaccttctgagtgttattaagactatttattcatagtatttttgaaaacaagactagaaaaaatgaagtgt

SEQ ID NO: 35942 - DNA, 715 bp, Homo sapiens
atggaaatgatgttagacaaaaagtgaattcagcagttttcttatttgaattcaaaatgggtcataaagcagtgaagacaacttgcaacatcaacaatacatttggcccaggaactactaatgaacctacagtatagtggtggttcaagaagtttcataaaggagacagccttgaagataaggagcacagtggtcggccattgaagttgacaacaaccagttgagagcaatcatcgaagcagatcctctgacaactacacgagaagttgccgaagaactcatcgttgaccattttatgattgttcggcatttgaagcaaattggaaaggtgaaaaagcttaataagtgggtgttaggatcacctaagcagaccattcccttcccctcccacaggccttacaatacagtctcttgcgctctccacacagtcaccccagggcaaaagacaaaccccccacttcactgacccctccactaactgtttgtccaggcagttacaggatgccattaacgtctgttcacctcacataacaaagctggcaaaaaacatctccaggatgcggacaagacacttgcatccccgaatcagctccccgaccctgacccagttcctcatcctataaagccctgctgtagtctgtaagtgtggctgcctcctctgcttttgtcaggaggtagcccggcaggactgacaataaattagcttgcctgaact

SEQ ID NO: 35943 - DNA, 553 bp, Homo sapiens
atggaaatgatgttagacaaaaagtgaattcagcagttttcttatttgaattcaaaatgggtcataaagcagtgaagacaacttgcaacatcaacaatacatttggcccaggaactactaatgaacctacagtatagtggtggttcaagaagtttcataaaggagacagccttgaagataaggagcacagtggtcggccattgaagttgacaacaaccagttgagagcaatcatcgaagcagatcctctgacaactacacgagaagttgccgaagaactcatcgttgaccattttatgattgttcggcatttgaagcaaattggaaaggcagttacaggatgccattaacgtctgttcacctcacataacaaagctggcaaaaaacatctccaggatgcggacaagacacttgcatccccgaatcagctccccgaccctgacccagttcctcatcctataaagccctgctgtagtctgtaagtgtggctgcctcctctgcttttgtcaggaggtagcccggcaggactgacaataaattagcttgcctgaact

SEQ ID NO: 35944 - DNA, 383 bp, Homo sapiens
tgttgatcattaaactttgaactgcatttgagtgtaatattgcagtttcttttgctcgtgaatcctcaaacccaaaatgatgaaagtaaaactttcagcaaaacagtcacataggcaaccaagtagggcaaggtgaccacagtctgactactatttaactgctcacttcccaggggaggggcattggccactttgctcattacccaaaaagtcctgagccccttgatcctaggttcctcagctgtgattcaactgcctgtatgcgtagcgtccatctgagcctgttgcattgtcccgtggcacttgggggcaggggaactggaaaaaccatactgatgctcatgttgcttgctgtgttgtaataaactgtcttgtttgaaccc

SEQ ID NO: 35945 - DNA, 340 bp, Homo sapiens
cagacaaaaaatcaaaagacaaaaatcagtttcaaatacatacaccagcaccgtcaggaaaagcattttttttcatttaccgtagtgagaaaaagcataatgtacttaggagaaatctaacaagagacatacaagcctgtacatttcattctttgctatttctctttaacatgtaatggtttatgcactgtaagtcatagtaaaaatgttgagcaaaggaataaagtcatagaagagtacgtagcatgattctattatcatacttaagtcaaggtaaaagtaaatgacatattgtttagaaattcaaatgcagtggaaaaattataaccaaaaatgtcag

SEQ ID NO: 35946 - DNA, 312 bp, Homo sapiens
gcatccataccaccaactaataaaaaatctgtcctttgaagcaataatacattcaagtatcttcctcaggcactacttttgttatgttttatactacatttattcatacacttggccttattttctctgttgctaagttaaaaacttgaagtcagaaactttttctttttcatacatatatcccttggagtactggcactatattcagaacacagtaggtcaataaatatttatttgattggtattcaaaagctgggcaaactagcctttaaatatgaagatcacaagttctgataagtttttctcacaaat

SEQ ID NO: 35947 - DNA, 2830 bp, Homo sapiens
  misc_feature (23)..(23): n is a, c, g, or t
  misc_feature (599)..(599): n is a, c, g, or t
ttgctacatcaaagagagagatncttttgtttgtttgttcgtttgttttttgagactgagtttcactctttcgcccaggctggagtgcattggcatgatctcagctcactacaacctctgccttctggtttcaagcaactcttctgcctcagcatcccaagtagctgggataacaggtgccagccaccatgcccagctaatttgtgtatttctagtagagatggggtttcaccatattggccaagctggtcttgaactcctgacctcatgtgatccgcccgcctcagcctcccaaagtgctgggattacaggcttgagccaccacgcccagcctgtagcatattttaataggagaatacaatatataatagtagcagggttaagtaaggcatccatcatctgtagcatttctcctttgttttacaaacaatccaattctacactttaaaaaaaaatttttaaatgtacaattaaatttttatttaccacagtgttatttttatcgtcataataaaaattatatacgagtataaatgaaattcatttctaaattcttaataaatattttctcatgccaggtgtggtggctcacgtctgtnatcccagcactttgacaggctgagcgagggagtggatcttgaggtcagcagttcgagaccagcatggccaatatggagaaatcccgtctctactaaaaatacaaaaattagccaggcgtggtggcatgtgcctgtaatcccagctactcaggaggctgaggcaggagaatcgcttgaacctgggaggtggaggttgcaatgagccaagatcaccccactgcactccagcctgggcaacagagcgagactccatctcaaaaagtaaaatatattttcaaattttctatatatttttctttgaacatgtggcctgtctgcctgcaaacatatacagacttttagttttgattcatatagagttaaatacatgttagtctaaagacaaatcttaggtgtaagaaaattatggagttaagtatgtgtgtgtgagtatgagtttgtacatattttcagaaggaaagaatgatacgggaacaaaaatcattttaatatggtgactactataaaactaaaaacctaaaaaatgctgaaagcaaatgtatactttttggtttgtattgaatttattactgtacagtctatgacttagagttctgaatcttcccaagcaaattctctgtatatacttgcctggtactcatgctagacccatactttttttgtttcttacattttttttgttttatattttatgaagtattcattatgtgagctggtctgcgattataagaatttttatgaaatttagtgcacacaaaataatctttagatgtaattccaaaagtagtgtattaagttacattttatttagttagagcactccattttgttcttttaagaggagaacaatatataggttttctttagtgatttgttcctttcactttttataattgacataagcatatttattgagtcaatttgttcagctaagtactagggaggcttcattagtcatgaggatgtttttatatataaatgtagcaaacatatattacagttttcactgtgtaatagattatccataataattcataaatattcctgctgaagttagtttgtaacttcaagtcaaagatgaaaaatatcaatggtgaagattgattgttcatatagagaggacattttttttccagactgtaaaactgaatcttgttgaatttaaagagaaattctggcagaggcagatgaatcacctgaggtcaggagtttgagaccagcctgatgaatatggtgaaacccagtctctactaaaactacaaaaatagccaggcatggtggtgggtgcctgtaatcccactcgggaggctgagtcaggagaattgcttgaacccggaggtgaagattggagtaagccaagattgtgccgttgcactacagcctgggcgacagagcgagactccatataaaaaaaaaaaaaaaaaaaaagctgggcgtggtggctcacacctgtaatcccagcactttgggaggccaaggtgggcgaatcacttgaggtcgggagtttgagaccaggtgaccaacatggagaaactccatctctactaaaaaatacaaaattagcccggtgtggtggcgcatgcctgtaatcccagctactcgggagactgaggcaggagaatcgcttgaacacgacaggtggaggttgcagtgtggcgagattgcaccattgcactccagtctgggcgacaagagggaaactccatctgaaaaaaaagagaaattcttttattttctacttctcttcagatttgtcttatgcattttccaactatgtatgcatcacagctattctttttctgagttatagctacagttttcttactgttgtcttcatgccatttcatttcacatggtactttgtagattttgatgaggaagttggtatttttagtgcacacaaaaattggttttaactgtagagtttgcttatcagaacagttaaaaggcagccaggtgtggctcacgcctgtaatcccagcactgagataggtcaaggagggtggatcacttgaggtcaggagtttgagaccagcctgaccaacatggtgaaaccctgtgtctactaaaaatacaaatttagccacgcgtggtgacgcacgcctgtaatcccagctactcggaaggccgagggagcagaatcgcttgaacctgggaggtagaggttgcggtgagccgagactgggccactgcacttcagcctgggcaacaagagcgaaattctgtctaaa

SEQ ID NO: 35948 - DNA, 2689 bp, Homo sapiens
  misc_feature (23)..(23): n is a, c, g, or t
  misc_feature (599)..(599): n is a, c, g, or t
ttgctacatcaaagagagagatncttttgtttgtttgttcgtttgttttttgagactgagtttcactctttcgcccaggctggagtgcattggcatgatctcagctcactacaacctctgccttctggtttcaagcaactcttctgcctcagcatcccaagtagctgggataacaggtgccagccaccatgcccagctaatttgtgtatttctagtagagatggggtttcaccatattggccaagctggtcttgaactcctgacctcatgtgatccgcccgcctcagcctcccaaagtgctgggattacaggcttgagccaccacgcccagcctgtagcatattttaataggagaatacaatatataatagtagcagggttaagtaaggcatccatcatctgtagcatttctcctttgttttacaaacaatccaattctacactttaaaaaaaaatttttaaatgtacaattaaatttttatttaccacagtgttatttttatcgtcataataaaaattatatacgagtataaatgaaattcatttctaaattcttaataaatattttctcatgccaggtgtggtggctcacgtctgtnatcccagcactttgacaggctgagcgagggagtggatcttgaggtcagcagttcgagaccagcatggccaatatggagaaatcccgtctctactaaaaatacaaaaattagccaggcgtggtggcatgtgcctgtaatcccagctactcaggaggctgaggcaggagaatcgcttgaacctgggaggtggaggttgcaatgagccaagatcaccccactgcactccagcctgggcaacagagcgagactccatctcaaaaagtaaaatatattttcaaattttctatatatttttctttgaacatgtggcctgtctgcctgcaaacatatacagacttttagttttgattcatatagagttaaatacatgttagtctaaagacaaatcttaggtgtaagaaaattatggagttaagtatgtgtgtgtgagtatgagtttgtacatattttcagaaggaaagaatgatacgggaacaaaaatcattttaatatggtgactactataaaactaaaaacctaaaaaatgctgaaagcaaatgtatactttttggtttgtattgaatttattactgtacagtctatgacttagagttctgaatcttcccaagcaaattctctgtatatacttgcctggtactcatgctagacccatactttttttgtttcttacattttttttgttttatattttatgaagtattcattatgtgagctggtctgcgattataagaatttttatgaaatttagtgcacacaaaataatctttagatgtaattccaaaagtagtgtattaagttacattttatttagttagagcactccattttgttcttttaagaggagaacaatatataggttttctttagtgatttgttcctttcactttttataattgacataagcatatttattgagtcaatttgttcagctaagtactagggaggcttcattagtcatgaggatgtttttatatataaatgtagcaaacatatattacagttttcactgtgtaatagattatccataataattcataaatattcctgctgaagttagtttgtaacttcaagtcaaagatgaaaaatatcaatggtgaagattgattgttcatatagagaggacattttttttccagactgtaaaactgaatcttgttgaatttaaagagaaattctggcagaggcagatgaatcacctgaggtcaggagtttgagaccagcctgatgaatatggtgaaacccagtctctactaaaactacaaaaatagccaggcatggtggtgggtgcctgtaatcccactcgggaggctgagtcaggagaattgcttgaacccggaggtgaagattggagtaagccaagattgtgccgttgcactacagcctgggcgacagagcgagactccatataaaaaaaaaaaaaaaaaaaaagctgggcgtggtggctcacacctgtaatcccagcactttgggaggccaaggtgggcgaatcacttgaggtcgggagtttgagaccaggtgaccaacatggagaaactccatctctactaaaaaatacaaaattagcccggtgtggtggcgcatgcctgtaatcccagctactcgggagactgaggcaggagaatcgcttgaacacgacaggtggaggttgcagtgtggcgagattgcaccattgcactccagtctgggcgacaagagggaaactccatctgaaaaaaaagagaaattcttttattttctacttctcttcagatttgtcttatgcattttccaactatgtatgcatcacagctattctttttctgagttatagctacagttttcttactgttgtcttcatgccatttcatttcacatggtactttgtagattttgatgaggaagttggtatttttagtgcacacaaaaattggttttaactgtagagtttgcttatcagaacagttaaaaggcagccaccaggcctggctcctaatccactttcatggaccctcgtgattgcattggatctccccgggtaatctgggatgttctacttggcctaaggtcagctgattagcaaccttagttcatctgcagtctccataacttct

SEQ ID NO: 35949 - DNA, 379 bp, Homo sapiens
caaaagacacctacacagataaaacaaggttttcctttctctatcctctctcatcaccaaatgtccagcttagagtcgccctctttcaaaaataccaaacacatctcagggtaggtcatttcctgtggtccccagtgtgggtaaaatccttggctctacagatacatttcaaatgggtttgttttggaggcatcttcctctctaaatcctaaatactctgttgacactcttaatctggaatttttgaggggtagaaaagggaagtgcgatctgaagtgttatcccagtttcatgtttgaacttgttaagaaaatacctctgtcctcagtgacgtactcttttgggtttggatgtggtatcctagaagttccaaatgatg

SEQ ID NO: 35950 - DNA, 414 bp, Homo sapiens
acaagcaatgtcagatgcccctcttctagagaggacagtacaggtggcttaccaaaagaggctgcagttcacaagaacaggttagatgtctatctgtccatacaaggtcatgaggtggactccacaaccaggctgaagcctaatgcctaataactaactgagcagaggctccagaccagggtcagactgcacaagagagtgagtggtgctctatctagagtgttgagttagactatgatcctctgtataaggcatatttgttgggaactgtacaagactgagccttctgaaatgacttaagtagtcccggattaaaaggggcaggtcataggtacagtaggaagcccaggaatcgggtagaagatttgagcaggatgctttgtctgatatctcacagtgccatttgttcttccc

SEQ ID NO: 35951 - DNA, 294 bp, Homo sapiens
taatagagacagggtctcactatgttgcccaactggtcttaaaatcctgggctcaaatgttcctcccacctcaacctcccaaagtgctgggattacaggtgtgagacatcacacctaccctgaacatgttaagttttaaatgcctaagagacatccaatcagagatgtcaagcaactagttggatttgtaagtctggagctcagagaagacataaattcaggaggtatcagcccatagaatatttttaaagccatgaatgaatgagtttctttaggaatgtataaagagggccc

SEQ ID NO: 35952 - DNA, 354 bp, Homo sapiens
tttctctcctgaaggcaattctctagtaatgtgtggtatttaataattgaaccaagtcagaaatcccaagaacaaccagcctcaacaagaagacaattaaagtagaatccaattaaggggtatacatttcttcctcaacctgatgaacagatttttttaaaggtgagagaaatttcagttgaatatttgtatttcaagattaaacccaataacaaattatacatatagaaaatgggccgggcgcggtggctcacgcctgtaatcccagcactttgggaggtcgaggcgggcggatcacgaggtcaggagatcaagaccatcccggctaaaacggtgaaaccccgtctctactaa

SEQ ID NO: 35953 - DNA, 607 bp, Homo sapiens
cttgtagtgagccgagatactgcactccagcctgggagacagagcgagacgccgtctcaaaaaacaaaaacaaaaacaaaaacaaaacaaaaaaaaaaaccacacacatgtaccaaacgcttaagatttaatacaaggaatactttttactatctcatcaagaatattttttcagccaggtgtggtggctcacatctgtaatctcagcactttggaaggccaaagtgggaggatcacttgaagccaggagttcaagactagcctgggcaacatagtaagaccctgtctctacaaaaaattaaaaatcagccaagtgtggtggtgcatgcctgtagtcctggctactcaggaggctgaggcagcaggatcacttgagctcaggggtccaaggctgcagcaagctgtgatgccactgttggactccagcctggacaacagagcaaggccctatctcaaaaataaattaattaattaagaaatgagtggacacagtggctcccacctataatcccagcactttgggaggcgaacacaggaggattacttatggccaggcgttcaagaccagcctgggcaacgtagtgagaccctgtctctacaaaacagt

SEQ ID NO: 35954 - DNA, 239 bp, Homo sapiens
gatgctactagtttggacaccacactttgggaaccagtgccttaaatatttactttatgtagacaagccatgaattttgtctcctgtgtggtaccactgagaacagcattagtggtaaagaaagggatctggcatttactgagcacctatgacatttgccatctgccaggtacctcatggggcactttatacacattattctatttaagactcacagccaccctgtcaatcaatttatg

SEQ ID NO: 35955 - DNA, 467 bp, Homo sapiens
ggacattaaaaaaaaaagatatttaccatgggaccatgggacttgagagaaatggattctggaagctgtggctgagcatctgaatttattcaggttctgaagggcagcattatgagtggaccccaagatcaacaaaggcctcacagagccaggcatttggtgacagtttgtgagaatgtaacaatgcaaaatttagcctgtattggctgtcattatcctagaagtctctttcagacaatttaaaggactcatgacaactcttaagaaaacaaaatacatatatcaaaatgtgtacctgagggaagtaaaatgttctgtttggcttctgtaccagggctcgttagtgaagaatgaataaagcaagtgttattattattattattattgttattacaatgataattcatgtggttgcttgtgtggagcaaagaaattcttgtgtaaatggcctttaatagtagttgatg

SEQ ID NO: 35956 - DNA, 351 bp, Homo sapiens
ataggtactaccttaaatacttattgatgagttaagattgaacaactaatgatttttcacatttgcataaatatccttataaatcaaccatgcttttgagaaatctgctaacatctgtaaaatgtgataaatactaaaagggaagctatgagtgctgtgtgagctaccaagtcctatgaagaagccattctccaacctcttttctaccccagtcccttctcaagagaggcagctggggctgggcgtggtggctcatgcctgtaatcccagaactctgggaggccaaggcgggtggatcacctgaggtcaggggttggtgatcagcctggccaacatggtgaaaccctgtct

SEQ ID NO: 35957 - DNA, 605 bp, Homo sapiens
cacagatccactctccactcatttccatcctgtcttatgccacttggggcttgtccttctagaatgcatccctggctcccctgtgtgcacacttgtagttaggtttagcattgggggcacccgatggagcctggaagtgagaggaaggtgaggtccgtatttcttccctctccctccctgctctggcactgagtatctggcaatagctgcatctgtctattacttcagtggccactcttccacagccccaattctcagtgggtcccatagcattatttacctttgttcctttagctcccatcaaggaagacccagaggcattctcctcaccaaggcattaagaaatgcatgggtgaggggaacagcggcgtgcgtgtaaaggtcctgtggcacctctcctctgcaggctggaggtcatggcgggagatgctgcatggatttgccctccctgctgtcagaacaacagggttctggaagagtagaggacaggccgtgggacttggctgtctagagacatggcgggagggatttccttgagaggcagggacatgtggtggttactaatcattgtgaggtgtctgggatgtaatggatgggaaatctac

SEQ ID NO: 35958 - DNA, 381 bp, Homo sapiens
gaattgcattatacttatagatcaatctggggagaattggcatctttactgtgttgaatcttccaatctgtgaacatggcctctctgttccttgagacacaacaatattgaaattgggccaatgaataaccctacagtagcctatcattcactttggggaacggaagctgttgtgagcaaccctatgtgagcctcctgtcctcagctacatcgatgagcttggcagtgaattatctagtcccatccaagcttccagaagactgcagccccagctgacagcttgactgcaacctcatgaatgtttctgagctaggaccacccagttgcttctgaattcctcaccctcagaaactatgatacaataaataccgattattttaa

SEQ ID NO: 35959 - DNA, 284 bp, Homo sapiens
gaattgcattatacttatagatcaatctggggagaattggcatctttactgtgttgaatcttccaatctgtgaacatggtatgtctctaattatttagatcttttattttattcatcagcattttacagtttttagcctatgaatcctgtatggtttactagatttattcccaaacattttatttttgaaggtatttaaatggtattttttttaaaatttctattttcaattcttctctgctagtatatagaaatgtgattaatttttatgcatgatcttgtat

SEQ ID NO: 35960 - DNA, 396 bp, Homo sapiens
atttactgtagctttatctgtaatagctaaaaactcaaaagaacccagctgttcttccatgagtaaatgattaaatgaactgtggtacatccacaccatggactagtactcatcaataaaaagaaatgaactattgatacatgccacaatctccagagaatcatgctgagtggaaaaagccaatcctaaaggttaatatataatatgctacatacttccatttataaaaattcttgaagtgagaaaattacaggaagaaatgaggctgggagcagtggctcacgcctgtaatcccagcactttgggtaaaataatagcctcccattaagaagaaatttggaaaaaatttgaaaaatctaaaagtagtataaagtatctactaaatgtaaaaaaaaa

SEQ ID NO: 35961 - DNA, 1101 bp, Homo sapiens
  misc_feature (2)..(2): n is a, c, g, or t
  misc_feature (12)..(12): n is a, c, g, or t
  misc_feature (16)..(16): n is a, c, g, or t
  misc_feature (21)..(21): n is a, c, g, or t
  misc_feature (28)..(28): n is a, c, g, or t
  misc_feature (36)..(36): n is a, c, g, or t
tnacaccggaangggngtggnctgaatncgggcccnttttatgaattttttcagccacaacaactggattctcttttctgatttttgctgcagcttctgctttgtaatcatacggacagttgtgcttgtcagagttaacggtgaagtccacaaaacaaatttccacatcggcagtcaaacctgtaagaccaactttctttctgcacatgaaacatctgtttttctttggtttgggcaattcaggagctttttctttactctgagaagtactgggctgaaaaactgatgggctgggctgagtgacaactggctctcacacctctgttttcggggtagttattttgtcctctgttgaaatgctcatttctgtcatttgctgagttacaggcaaggcagccgcaggcacatttcttgatttttcagatgtgctgccagcagcaccttcacagttgtttaagctagtgtctgctctctgtacagatgcagaatctgaggtaggactgttggaaccactagctgtccccattgggctcattctgccactattctgctgcctctgaagatgttctttgtagcaaactgaacacattccatttgtcctaggatttccataaaagccacatcctgtgctacacagcatgggccccggggtctggttagtctcctgagccatatttttttgcttgggaatgaacacttgagttcaagtctctagtctgccactaagtcagtgaccttgggcaagtccttactttccagatttcagttccctctttgccaaatggagtagaattgacttttaaaggctccttttcagggccctgcagggtcccaaatgcgaaagccgggttcgcgcgcgaagccggcacgatgaggccgggccgaggcctccgggaaggctgagccgggcgccctggtgccgccgccgcgggccgggagcgggtcggagcagcaggcggaggtggcgccgccgccgccgcggggtcttcctttgttcctgcagcagcgtcgagcgtggccgggacacgccggagctcgggaagtgggaggagggaagcgagggggggccgaggaggaggtggagggagcaccggcggccgc

SEQ ID NO: 35962 - DNA, 426 bp, Homo sapiens
ttgagatggagtctcactctgtcgcccaggctggagtgcagtggcgcctcctggcttcatgccattctcctgcctcagcctccccagtagctgggactacaggcgcccgccaccacgcccggctaattttttgtatttttagtagagatggggtttcatcatgttcgccaggctggtcttgatctcctgaccttgtgatccgcccgcctcggccttctaactcttctcagagttatgagatacttaccactaaggaggatacttacccttctgagtaactgatgtgaatttaatcacaacttctaatgggcgtaagacatatagagcattgcatgcattcaggacaattctttctgccaattaaggatactattatattatcccatgtatgatgtggggttgctttctcagcacacttggggttgc

SEQ ID NO: 35963 - DNA, 397 bp, Homo sapiens
cctcaccgtcatgacctcctctaaccctaatcacctcccaaaggccccgcctcctaatactatcccacggaggggttagggcatcaacataagaatttggagggggccacagttcagtccacagcaggatgtgtgtgtgtggagtgaagcagactgaccgggcctcaacatcacctgggaatcctggaaggaaacaggttcctgggccttgctccaacctaaggaacccgaatctgcatagctcacatggcgccgtatttccaacgttcagagcacattggaaagttgggaggaaggatgaggcttgtgttttcactcacaaactccctccagaagatgataatgaaagtgtctgacgcataaggaaataaataagatggttatgtgcccagctcaa

SEQ ID NO: 35964 - DNA, 797 bp, Homo sapiens
cctcaccgtcatgacctcctctaaccctaatcacctcccaaaggccccgcctcctaatactatcccacggaggggttagggcatcaacataagaatttggagggggccacagttcagtccacagcaggatgtgtgtgtgtggagtgaagcagactgaccgggcctcaacatcacctgggaatcctggaaggaaacaggttcctgggccttgctccaacctaaggaacccgaatctgcataggtgaggcctcagaatcagccttcccagcagcgcggtggggagtacaggggagccgcgggagggttttgggaggggggaagcagctacatggtagaccctgcacgcgccctcgctcctctgctggaggaagtgatgagggcaggcctggggctggcaatgggatcctcagcagttgctgctcagatcagttgcctccttggaccatgttcccatgagcaagacaggagccaccaggaaatgcaggtttccatttggacaagctcctttaggctggacagtcgagggatggtagaagtgtgcccccaccccatttctgccccactttgctctaatggtgtgagttggaaggaccatctccctcacttttcccttcatcctgagtgaaacctggtttccacagctcacatggcgccgtatttccaacgttcagagcacattggaaagttgggaggaaggatgaggcttgtgttttcactcacaaactccctccagaagatgataatgaaagtgtctgacgcataaggaaataaataagatggttatgtgcccagctcaa

SEQ ID NO: 35965 - DNA, 628 bp, Homo sapiens
aggtcagttaccttcctctctaaactggctgttgtggctatcagctcctgtattgtttgatcatgattcttagcttctttgcattgggttacaacatgctcctttagctcaccaaagtttgttgttatccaccttctgaagccgacttctgtcaattcagccatctccacctcagcctggttctgtgcccttgctggaggggtgttgcagtcatttagagaagaggaactctgactttttgagttttcagtgcttttgtattgattctttctcatctttgggggctatctatcttcagtctttgaggttgctgacctctgaatgaggtttttgtggggtctttttttttcatgttgttgttgttgttttctggttttcttttttttttctttgaaatttaaagaaaaaatttattgaagatctgaaaaacaattcctaaaagattgacttttccagaaaactagctacacagtgcattgcatctatcatgttaaaacgtgcattagacacaaatacaaaaaccatgaaacaagccaccattcttcaacaatttgagccaagataaaatgcctaagtaacaacatggatgccttgcaaaggatgggctctttactttaagcaccataaa

SEQ ID NO: 35966 - DNA, 380 bp, Homo sapiens
tcattgaaaaggggctcagaaggctaaattagatgtaattgttaatgggttaaaaaaaatctaagtctaaactaatagcttcagcaacggcttccccatcatctctcctgctgcttgccacactgttctccatacaacagcctgaaagagtttttaaaagtaaaatcaaatcctatgtctcacctatttaaaacctttctataccttcccattccactctaaactgatctctaggctctctcggggcactgcatgatctgcttatccttccaacggcatttcctcatcactctccctttttacttcattaatggccacagccagattggcctcccttctattccataaacaatcaaaactttcttgcctctggatcttca

SEQ ID NO: 35967 - DNA, 386 bp, Homo sapiens
ccccatctcaaacaacaacaacaaaacaaaaaaaaaaatagaagaagaaggttagagaaaaaaaatctaagtctaaactaatagcttcagcaacggcttccccatcatctctcctgctgcttgccacactgttctccatacaacagcctgaaagagtttttaaaagtaaaatcaaatcctatgtctcacctatttaaaacctttctataccttcccattccactctaaactgatctctaggctctctcggggcactgcatgatctgcttatccttccaacggcatttcctcatcactctccctttttacttcattaatggccacagccagattggcctcccttctattccataaacaatcaaaactttcttgcctctggatcttca

SEQ ID NO: 35968 - DNA, 385 bp, Homo sapiens
caaaagcctcctcctccaagcagccttccctgcctccctcaggcagaacagctccttctgggcacccacctgcatgaaagcacctcttccccacccacacctccctcctgcctgaggcgggcacagggcatgtgctcgatgaagcctgtagcctgggggctccaggtccaggcctctgaaaaacccacctcccttgtccagccaagccctcaggtggcttatcacagggccactttctctttgttgctcttcctgagtccttcttggttctgggctggagggggcttggaccgaactccctcctgcaggtgaccaagcccctggcctctgcccatctctgagtctaggttctccgctgcttccctagggaggagcatctcagaat

SEQ ID NO: 35969 - DNA, 345 bp, Homo sapiens
actggaaagagaaaggatacaattctgcatgagcatttattatagatcctaggctgaggggtgtgttgtttttgcataggctgagtcacacggaggactggcagaaatgttaataaagagctgagaactgaatagaaatagcagagtttatgtaggcctccagacatagaaattctggtccagtcaaggttaagagaccttattgaatatcttaggcatttcactgaaactcatgaaagaccaagcaggtaagaatcgcatactacttggtcgggcacggtggctcacgcctgtaatcccagcactttgagaggccgaggcgggcggatcacgaggtcaggaaat

SEQ ID NO: 35970 - DNA, 214 bp, Homo sapiens
tttttttgaaatatttaaagaggtttattctgagccaaatatgagtgaccaaggcctgtgacaaagcccaaggagttcctgagaaactgtgcccaaggcggttggtttacagcttggttttatacatttgaggaggacagaagttacaggcagacatcaatccagaaaggcgggacaacttgaagtggatggggaaggcacagggtctggaggg

SEQ ID NO: 35971 - DNA, 381 bp, Homo sapiens
ctggaattacagttgtgagccaccacacctggcctgtctccaaattaacaaaaaaattattaacataatttatttgagtcatacaatacatagagtatttcaagtgaattaaaatactataacaatgtaagagaatgtttataaaaatggaagaaagaaatagaaaaaccacccatactactaccatcgcaatgtaaatttctttttcatattccttcacagtaatttttccaattatgtaatttgtataacactctggacataacgtatccataagtggttatgttgttgtttttgagactcattttttttcttgttgcaatatattcttgtcatttagaattactaatgacctcaaaatattcctttgaacaaaggcac

SEQ ID NO: 35972 - DNA, 277 bp, Homo sapiens
cctatatttcagggacatttaaatgaataacaccaacaacttgatagaaacttctttcacttgagaggaaacacaagaaaaatataaatcagcagaatactgatatgcatgttaaaattttggagtcaaaaagaaaaataattgtaggctgggtttatatttttgaaatatttaggttcaagatttaccatgtcagcaggtgtggtgccaatctaaactaccttttgaagtgagcttaaataccaactaattaattgcaaaactaatattcttgaga

SEQ ID NO: 35973 - DNA, 699 bp, Homo sapiens
ttctagataggtggtagactccaggtcttaattgcatgcctgttgttatttctggatctcatatacctaatgtcttggccgactttccatgcaatgaaaactcatttccttgtggcattgaattgatggatgaattaatgaatgaaaagaaaatttaaaaaatctcttgtagcaagcaattctggcactatagccaagtataattttcactgcaagaataattgcaccatttattttcaccttggtctttactctatttacattgctataaaaatgtttcatattttcttaggttagccctcaccatcatctttgtgaaaaaggaattaaaaataattttaacacctatgtatacttggctccttatcatacacaatgagaagttagtttggataggaaaatgacttaaacacagctgggtgcggtcagtggctcacacttgtaatcccaggactttgggaggccgaggtgggtggatcacctgaggtcaagagttcaaaaccagcctgaccaacatggtgaaaccccatctctactaagaatacaaaaattagctgggcatcgtggcatccacctgtaatcccagctactagggagactggggcaggagaatcgcttgaacccaggaggtggaggtgcagtgagtcgagatctcgccattgtactccagcctgggcaacaagagtgaaactctgtttc

SEQ ID NO: 35974 - DNA, 352 bp, Homo sapiens
tgcttcagcctcccaaagtgctgggattacaggtgtgagccactgcgcccagcccatggccaattttctattctgttctgaacattagcttttagtttcagggtatgtatgtgtaaatacacaaatactttcaaaccgtatacatacagtttttaaatgacctaggtcaagatttaatagcagagatttaaatttatagtaatatgcctccatcatctcttggcaaaattctcttctgttgttttatagcagtttcctgttaacacgtgttatttactagcttgtgaggacagagatgggttttattcatctttgcatcctctgtggtaagtatagtacgaagcacagagta

SEQ ID NO: 35975 - DNA, 514 bp, Homo sapiens
acgtgaaaagctgagagacaccatgttcttcatagtagggtactgagcctcctgaaatttagttgatattggaaatgctgacagacccttaactagagtgctgtgcaaagtagtgctataattcagtttaaagtggacttacatttgaaaaacatccttctgaatgtcacacattaataataagttctgaggaggcatttggtgcagctagtaatcataattcttattaaaactggtgacgtctggcccccagggtgtagccaagctcaaattgatgctttttgccgcctgatcaccagcatggcctaagtgctcattatattgtagagagggcctttggagctctcattagatttgacaggaattctctctagggggaaactgggcattagcgagactcctgacaggctgaaattattcctgctttatggcttataaccaaatgctagcaaggcatcatcaggggacacaaaaaattgtcatttttgacaacatctttgttactaaaaaaaaa

SEQ ID NO: 35976 - DNA, 264 bp, Homo sapiens
ttttctttttgttttttgggactgagtctcactctgtggctcaggctggagtacaatggcgcgatctaggctgactgcaacctctgggaaacttctaaaaatcccatcgctcaggtcatatcccagaccaataaatcagaatctttcagagcagaagccagacacttcttaggtgattctaatgttcaagcaaatttgagttgtcaatgaatagtttctctcaagtcaggcagagattgtacgtaaggtagtaatacaaggcat

SEQ ID NO: 35977 - DNA, 427 bp, Homo sapiens
tgagaacaactgccacaggggaaattattcactgccagaactgcagcaagatgaaggatttggggaattaatacccctctctccttccaccactgatcagttgctgcttcccatgggccagccccaaacagaagccagaaagcaggtgaccctaagtaatgctatctgcagaggtcagccttccagggagcagagcagggccgtgaagagtggagaatggataggctggggcaaacagaataaccagaaccatcatggacagaagaatggatagatcaatggaaagaggggtggatggatgaattaatgaacagatacctgaataaaaggatagaaggccaggcacggtggctcacgcctgtaatcccaacactttgggaagcggaggcaagcagatcatttgaagtcaggagttcgaaaccaggag

SEQ ID NO: 35978 - DNA, 533 bp, Homo sapiens
ctcagggcctacccactggggcatggcagcaacatggcttcctccctcccctctctgctagaaagagcctccagtagggatctggcccctctttcgggtatagctcagctccagagtagaggatattagaaagatactgcatcccttattttacaggtgaggccaacagcaggcaagtgagctgcccaaaacacacagcaaggaactgacagaggaggggcttgtttctaagaaagaagggacaaaaaaagaaatagagttggagacgtctagaagagagagacctagagaagagtggggagtagggaagagagagtatggaaagggggtggctacggcttactgcacggacagggtggtgggccctcacaggcccagggacccagggagaaggctctaagctgcctcctgctgtgggggaatgtgaagtcttggagaagaggtgagaggcacaggaagaggtgtctgggggatggagaagccgtggcctgagaggaccccagtggcctggctggggcgtctgaccgctcccc

SEQ ID NO: 35979 - DNA, 412 bp, Homo sapiens
acaccatggaatactatgcagccataataaagaacaaaatgatgtctcttgcagcagcatggatgcagctggagaccattatcctaagcaaaccaacacagaatcagaaaaccacatgttcttgcttttaagtgagagctaaaccttgggtacacatggacataaagatgggaacagtagacagtggaggctatgataaaaagaagggaagtggggcaagggttgaaaaactaactgttgggtactaggcttaactacctgggtgttgggaccatttgtatcccaaaccttagtatcatacaacatacccgtgtaacaaacctgcatctttactctctgaatctaaaataaaagttgaaatttttaaaaaacccaaagtgaagtaaacaataaaaataaaaaagtggttcaa

SEQ ID NO: 35980 - DNA, 367 bp, Homo sapiens
gggtcatgttcagtgctatgtcctttttaaaaattaacttttaagctctccaaaaatctacaagataggtttcattatctccatttttgcataagggtaaaatgtaagcccagatgaaagtgacttgttcaaacttcccccactccccataatatgcttcagacctggaaagatttagaggagcagattattacctgtaacaaaaattactgccaaaaaaaaagaatataagggaacttatccttctccttttaagaagctacaattccaaaacgggatgaagactgtaaaagaaagaaaattatcagcacacttgatttttgcttataaatgcaaaaagtataaataaaatattaactgaatctaa

SEQ ID NO: 35981 - DNA, 714 bp, Homo sapiens
gattgagggatggtgatgcagattgtgggggattaacaccccccccccacaagatatccctggtgcggtcactatttttcagtaccaattatgtgccagggccatacaacatgctttaaatgtattatttcatttaattcttaaagaggcttgtaaaatagaatattatgttatgatacccatttacaacaaagaaaactaagtcacagaaagtttaagtaaattgcctaaggttatacctggcagggtgcagggccaaggtctgaactctgatgtaaagttaaaaacatggaatggactgtctgcatttgaatcctggctcagctaggaaccttccttgggcaaatttcttaatctgtcagtgcctgtcttttcatatttagagtgggggaaaataatagcacccacctcacaggaatgttgcaagtattaaatgagttaagatgtgtagtacatggcacacataaacctctcaattattattgtaatagttattgtttatttttatgattaccgtcttcttctactgtaggcattctggaagtgaagatcattgttcccaaactctggcttattcactgtaacaaatggacccctagatccgcagatgtcagagccagcagctcacccagtgctccaggagagcacagaatcattaaggaataagaaccagcctgacctgattttacagctgagaagatgaagtcaggggag

SEQ ID NO: 35982 - DNA, 281 bp, Homo sapiens
ccttctgcatcagcctcaaacattttaacatgtcagatcaggattcatcttttaatcaatcaatggtaccttaagataatttgcagccagttttccttcttaatggtatgtaaaacagcatcttctcatcgatactatcttaatttactgaaacagcacctagcagaactggtggtggtctgcagtttatacaatataaacctgatctggtaactaccccaactcctcaggtgtggtgtattagcccagtaaaagggaaaatcctctttctgagtcactaa

SEQ ID NO: 35983 - DNA, 927 bp, Homo sapiens
tacaatagaaaagagataggagcatgggtgatagaaaagacaggaaaaagggacatgggattattgtttcctgggatatcgccataaactattaaagaaatgtttgctctgaaacaacctgatatgacttcaagagaaatgaacgactgggaagaaattaaaatttaatagacactccagacaaataagatcttagtctacaataccataactacaagcacaggctggcaaactcgagtctgaatgagagactaaattacaaatgatggatagctgctttcgcagaccaaacagataatggttggaaaaaagtatgcttgtgaataggaaactaatgaccatgcagtacagtatgaaagttagataagagaaaaatactataatgaagaaagctgcatggctgagggaaatgctgagcaaactatttgtacacctaaagaaaaggggaaaagcactaaaagcttccaaatataacagaatctacccttgtatgggagttactagatattaaagactgagataaactaagacaatataatcagtacgatatgagcttttaagaaacatcttctttcatgtcataatacaactaagtatgaaacaaataatcaaagtctaacacagtcttatcagaaaaacaggaaacaactccaaatcaaatacacatgaggaactaagcgaaatttagggaaaattctgtatgctttcatacagtcattgtaataaagacaatatgagacactgattcaacagaaaggcagcaaccagcctgaacttggttaacagttaatcacattatatggagagaactacaaacaggcccctgtaaaatctaactgtaggagatacacagccatagtcaattcaatgcaataaaaatatactcagtctctactatgagccagaagctgccagagaccagaaata

SEQ ID NO: 35984 - DNA, 393 bp, Homo sapiens
gatatttcccaaatttagctccttttcttgtagtagcaggctattgcttccagatttgttctgttctctttgttattggtagagtgagctatctgaattatatctcactgtgtttttttctcgtctgcctgcagtttttatctgagttgtatctgactgtgtcccttccttatgacaggacagagtctctgtgacttggtcttgctgcctctctaggtttatcgtttgctactccgtgctttgctgtagtaagatacttttatgatacatttttatacttcattgtactttgaagcaaactgtaatttctgaccagcatatccttgttcattttgcttggtttagcctttaaaatttaatgtaattatcttcatctggaagaattctctgttt

SEQ ID NO: 35985 - DNA, 552 bp, Homo sapiens
gagaattggatgcatgtcttccccctttagttgtataagcataaactggttttatgacggcaagcataaaattaagatcagcagtgcacaaatctctgtgtaaccttcaagaccttttatttccccaaattagaagtgaccttaagaactgatggtgtcttcaccctgggcagctatggtggtggagcagaaaatagtagactgggattgggacaggctaagtcccacccttcaccctggctgggtgaccttgggcatactcacccttgcttttctgggactgagggtcttcatctgagaaatgaatcatttttcttgataatttacagttttctttcaaatccctccacacccccacccccaccaaggtttttatttttatggcaactcagatcttgaaccttaaaaaaaaaaataaagtagagaggacagcaatccttaccagtgtcactctatcaccctatacagctcctcaaacacaagcccagaaggggcttcattttggtggaagtcctgggcctacatttgtatatttaagtggaacccgaatac

SEQ ID NO: 35986 - DNA, 493 bp, Homo sapiens
  misc_feature (79)..(79): n is a, c, g, or t
caccaaccctatacgtatggtttaacaatggctactggcagcaatgcccctcatctctggggcaactgcagatcagggnagggattcaaggagggccatcagaagaaggaggcaacatcagtggatctttgggtctcaaggccccataccattgcaagagacccacccctctgcagtgccccactcccatcccacagacccggcctttcctcggtgagtcagtgcccactcaagcccaactcaaggctaaaagtgtgtgatgatccttcccaccttcctgttcatccactgtccctggaattcctcttctaaaatgaggataccaagtccagaacagtttttggttattaacctataaaacctcaatgcataaatctttgttataaaattggtgataatatgatcataaatgtcacctcaagtgatactttaacaaagggtcattcatttctttatgtagtcttgagaaaataaactgttgaataaaaaaaaa

SEQ ID NO: 35987 - DNA, 349 bp, Homo sapiens
  misc_feature (306)..(306): n is a, c, g, or t
  misc_feature (315)..(315): n is a, c, g, or t
aatcagaaagacaataaccttcatcatcaaagaggaagtacaggtccatggctgagataaacgtttggcagagctgctggtgaaagctgcccatcttctgggtttgtggaagaagataatgacttaaagtcctcagctgcccagtgagtaccctttccatggtcagataaagtaatctcaacagaacagttgttaaaaatccatacttgttgctccctaagagtaatacattcacccactttggatgaaaggattcaggccaaagtcaagaagagctaagaaactctacagtatcattctctctgnaccgattcnagagccaagtgagtgtttacttagaactgagtca

SEQ ID NO: 35988 - DNA, 513 bp, Homo sapiens
atctccaacaaggccacatcattgcatttagggactgctcagataatctgggatgatatccgtagttaattacatctgcaaggaccctttttccaaacaaggtcacacgaacaggtgtcagggatgtgatgtggatgtatcttttgggagcccaccattcaacccagtgtaaaccctaatgcagaaattggtgcagaaaaaaatggggagaatctgggattggctatctggccaggctgtggcaaaaagcaatgaagatactgcttgtcttagggaacgggacaaagggttgtcccctgggcgtccctgggaggaggagcccagtgaaagtctctggggtttcggggtggtgcccccaaaagaattcaatggctatgtctatggtgtgggatacgtttaaaatagctcttcaagaatgagaataaggccaggtgccgtggctcatgcctgtaatcccagcattttgggaagctacggtgagcatatggcttgagcccagaacttcaagaccag

SEQ ID NO: 35989 - DNA, 1642 bp, Homo sapiens
acaggctcccgggccacgagaaaccggccgagcagtccgggccaagctccccggaaccctcggccgtcgcaacccccgacgccagggctgaagcgccgggcactgccgcctccctcggtcgcccgcccgcacgcccggagcggggaagcacgccgcctccctacgcaccagcatggcacctcgcacaagtagcgccgccaaagtttccccacgagggggctgagggacaaaagcccctcccgaaactcgcccgaacttcgagggcctccgacctgcacggccctacgcccaggcggcggccccgagcgccgggggcccgcacgggcacatgcagccctttgttttctgtccagccgggcgctgcctacgtgcagcatcagggatgtcggagcgtttcgcaggggccggacactggacgatcaccctgggtaggggtccggaccccgcgccccgaagagtccggagcctggccccccgaccctcccctcgggagcaggcccatttaatcaaagttttgcagtgtccttgatgagaaacgcccggagtatccgccccgcacgggcggagagttggcgactttcactctgctttttaaactggcaagacgccatcatcagcaaaccacattgtcctgccggccggacctgcccgacggcggccgcatcccacggcccacgcggggctggacattcggacaaggaccagggtcgcagcccgaagcacgtggtctgtcacgtagagcacaaaaagcagtgccctgcggagttcactgactcccgcggcgtacacaacgccgccgcctccatctccagccaagttggcttccctggccatcttacagcgcggacggccgcccataaacgggaagccctcgcggtgtcgcccacacctacgctacaggtgaacgcaccgggagcaaaacttcgggctccgaaagcaccccggacaccagaggctcttgggcgcggtccgaagagggcaggcgagtggaagacgggctgtttttaagcgaccgcgtgttgctctcattgtcgcatccgcatccctccggagttgagcaaacaacgccacgccgcgtgcgctccggcagagcccagcactgacccccaaaggccgatttaaagaccctcggccgccagctcggaagcggatggcaacttagtttccgagcgaatggcgtttattgtccaccctagtccgagggctgcagtcaactaaaccacgaggtttcacaacggcgcccgaccctgcccgcgcctcgcgcccacgcggacgcaccgaccccggccgctgcgcggtggccaacgagtcgctttcctctcgggcctttcggccgccgggctcctttccgcgagagaacactgcggcggagaaaagtcattgtcaccttcaacgtggatccctcaactccggcgactcctcaattatgcccaggctccactcacttccccgccccgagactttcggtttgcctcaaataccctccccaattaataaatacacactaaacacgagcgtaccaaagaacctggggtctgaagatcacgaaaacagcgctcccaacaatgccacctccaagacaaaacttcctgtgtgtatgtggaaggacggggggaggtgggtggaggtgaaaagagaaaaa

SEQ ID NO: 35990 - DNA, 449 bp, Homo sapiens
atgggaatttgaatcccggtctggcttactgctgcatttatactcctctttctccaggagccagggttggggctgtagcctaaagaaaatggtgacatgagggcatctcagcaggtcccgacctgagaaaatacttccgtttactctatttaattttattttgaggctgggcatggtggctcacacctgtaatcccagcactttgggaggctgcagtgggtggatcacctgaggtcaggagttcaaaaccagcctgaccaacatggcgaaaccctgtctctactaaaaatgcaacaattggctaggggtggtggcacatgcctgtaatcccagctacttgggaggctgagggaggagaatcacttgaacccaggatgcagaggttgcagtgagccaagattgctccactgcactacagcctgggctacgagagcgaaactccctctcaa

SEQ ID NO: 35991 - DNA, 771 bp, Homo sapiens
gaaggggtgggaagacctcgcagcacagccgggcgcccgtcgggctctgggagagagcgagagagaaatccggttaaaatcagagtcggagggaggtttaaccacagatcggttccgatcggattattccttaaaggggacgcgccattgtcaagagaacggagccaggggcccgagggcggggaccggcggcgctggaggagcgaggcagctgtactaggactgggaacggttcccatcatatgatccccggtcctcctgtccccaaaaagtgggtatcccttcatccagctattggtaacaccttcaggtcaaaacgaggaacttccccacattgacagtgacctattgcacgtgaagcctcagaattgaacagagaaaggagcaggagccaaaaagacctcaacattaggaagcctctgaatgcttttatgttatccttgaacgaacttgagagcgaatgtccgtagctagaggtggtaccctctaaacaaagaaagttgccgttatacaaccaagattcttggcagaaaggggtggcatgcccttctccccgggaaggagcaggcgctacactattatgattttacgccggaacagaaacgacacggtaacattattgcaggttttaatcccaggactggtctgcacgagcacacttttggttacgacacacgaacgggcaagaacaggcaaacttccggactctgctcaggtaacgggccaagaatgaacgtgctaactctgaacctggggaaaagaggtcttcca

SEQ ID NO: 35992 - DNA, 730 bp, Homo sapiens
gaaggggtgggaagacctcgcagcacagccgggcgcccgtcgggctctgggagagagcgagagagaaatccggttaaaatcagagtcggagggaggtttaaccacagatcggttccgatcggattattccttaaaggggacgcgccattgtcaagagaacggagccaggggcccgagggcggggaccggcggcgctggaggagcgaggcagctgtactaggactgggaacggagctgaagccatttattggtatcttggatggttaacatctaaatgcttaattcctgaaaccactcaagagtcataggattagatgatccaagtcaccaagaaattactgtctcaagtgatacgatccttgaggaattgccatactgtcttccacaatggttgaactaatttacactcccaccaacagcgtaaaagcattcctgtttctccacatcctctccagcatctgttgtttcctgactttttaatgattgccattctaactggcgtgagatggtatctcattgtaaagtcacagatatttttttacttttgttcatgttccaaagcctttaccttctactttttcttttgtaggtaatcatcaaaatttttattattagccaatatggtgtataaataataattattgtaatactaagcaattgtatgttatgtaaaaatttctgttatataaatctatgcataaatatatgcatataatatttgtgtacatat

SEQ ID NO: 35993 - DNA, 477 bp, Homo sapiens
gaaggggtgggaagacctcgcagcacagccgggcgcccgtcgggctctgggagagagcgagagagaaatccggttaaaatcagagtcggagggaggtttaaccacagatcggttccgatcggattattccttaaaggggacgcgccattgtcaagagaacggagccaggggcccgagggcggggaccggcggcgctggaggagcgaggcagctgtactaggactgggaacggcctagaacattccatattctgcttcacacacggtgactcactcactactgctttgtaccagtgtgcccactcgagtgcctgtaaagtacaagctccagatcaaaaaagcttctagatggatcctttccaaacttggtgtcttttctacaaactctgtgcctcaacaaccatttctaagtgcttcagcgccagtcagcaaagtaaataaatactgtgcttcttccaactttcattccacttgggga

SEQ ID NO: 35994 - DNA, 189 bp, Homo sapiens
ggtagaggagattgggagaactggttgagggttagaggcagcttacaaattaaatagggtagttatggtagacctcttgagttgatttattaaagtagagttcttttgtttcttttacttttagcttcagcgccagtcagcaaagtaaataaatactgtgcttcttccaactttcattccacttgggga

SEQ ID NO: 35995 - DNA, 280 bp, Homo sapiens
ctcattggaccctggaacagaaagaagacactgacagaaaaactagaaaaattctaatgaagtctggaatttaattaataatattttaccaacgttggtttcgttgtgtctccgttttgaccataaactgtgttaatatacgatgttatgaataagaaaactgagtgaagcattgatggcaactctttgtactgtctgcttgacttttctgtaaatgtaattgccaaatcagaaagttttagatgtttaaaataaagtgaataagctaaaaacaaaggga

SEQ ID NO: 35996 - DNA, 478 bp, Homo sapiens
  misc_feature (31)..(31): n is a, c, g, or t
tgtgtgtgtgtgcacgtgcatgcgcgtcatnttgtggtcatccaggaagcagtgtggggtagcaggaagtgcgcagggttagaatcagacaggcctggctttgattcttgccaatgtttactgtctgtccttgggcaagtcactaaatctctcttagcctcagtttcttcttctgtcaagtggggtgataatagtagctacttattgcagaaattaaatgtagctgcgtctgatcccctggcacagtgcagtatgcagtgctgatagggaaagctaaaatttgcagagcgctcacagcctgcctggagcattttacatgcagtaattctccaagccttacaacacctcctcacaaaataggttattcttagccccattttacagttgagaaacctgaggctcagggattgcacagccagttggcggcaggcagggattcaaatgcacacatctgtttctaaagtctgggctcctaaca

SEQ ID NO: 35997 - DNA, 366 bp, Homo sapiens
cctgggaggagaaggttgcagtgagccaagatcgcgccactacactccagcctaggcgacagagcgagactccatctcaaaaaaaaaaaaaaaaaaaacaaaaaaagaaaggctacgaataaccatttttatggggctacttatgaggattaaataggttattgcaccacataccttgctgacagcctgccacataataagtgatcaataaatggcagcgttgttattatttagaggggcacagattaaacatgtgcattctaggaacagataacttgctttaaaagtgtttcattacttaccctctttgggatcttgggcaaacttaacctttgtaagccttggtgtccttatctgtgaaataaa

SEQ ID NO: 35998 - DNA, 163 bp, Homo sapiens
ttttttttagaggcggttcagtgttttgttatattgcagtgctgctctgtgctcaggaccataggtgtttaggactctcctgcatatactgttgtttatagactgcttctttgcacagtctttaccttgttaaaagtagttagatattttactgctccttgcg

SEQ ID NO: 35999 - DNA, 498 bp, Homo sapiens
tgaagaagatttaacaggtagtagtgcttttcttcctgagctttaataccagtgagagaagcaactagttcagagaaattttgtaagcagaatccaggaaaacttatgagtcaggattcagaacctttaaggaaagcaggtttgacctaagccaaggcactgactgaaaagaggctttaagaaagacctttcgtaagtggaaggaaggatacactggagatttagactggaaatggttttaacagtatatattaggacaagtaagacaatatatcagattcctatgtatgtattaattatacccaaagagtatttcagactagtccaaagtagctttttactttcaatagttgccagtattatattgtgcaggacaccacagggaaggggaacagaaaagacaaggaaggccctggggacactattagaaaagtaatctggatcctctgatggtagaagaaaataggcaaccaactctaaagtaatgtaaaacagtct

SEQ ID NO: 36000 - DNA, 689 bp, Homo sapiens
aatgcaggcagcctctagtaggaaaggccagtcccagctgacaaccagcaaggaagtgggaactcagtcctacagctgcaaggaactaaattcagccaatagcttgaatgaatgtggaagcaaattttccccagagtttccagcagggaacccacccactggataccctcatttagcccttgtgagacccagtcaagcccactgacttctgtaagataatccatttgtgttgttttgtttgtgataatttgttatgacacaatggaaaacaaatacaggggttttgctggttttattttagagtctttgggatatcattttctagagaacaaagatagcaaagattctataaaacaatttagtcctggaagactccacggaataatggtgttgagtggaacctgtgcctgtttcttgatgtttgaatattattattgtccttagatgcagtttgaaggggcttgatggtcagcttagtgagatgtagtttctgaaggtctaggacattggtaggatttctgtaaataggtggttcttccatatcttggataaatgacataattccgtggagtcttccaggactaaattgttttatagaatctttgctatctttgttctctagaaaatgatatcccaaagactctaaaataaaaccagcaaaacccctgtatttgttttccattgtgtca

SEQ ID NO: 36001 - DNA, 485 bp, Homo sapiens
acttctcactggatttagggcctatttaaatataccaggatggtctcatctcaagttccttaacttcatctgcaaagagcttttttccaaataaggtcacatttacaggatccaggggtttggatatggacctatcttctgtgggggccaacataacccactgcatggtgtagatgaagaaaggcttttgtcaatcggtgaatccaggtcatgggtactttcaacttagttatattattctgtctacttttgtatttgctagaattcttccatgtaaatttaaaaactatcttattttaggagctcctacaatgaccaggttttgtgccagacaatgaggactggaatcaaacaagaagaaggctttcccctcaggaactcagggtctagtggggaagctgatattgaatacatcatgtcaaaacagtgtagggaaagaagacatagtagagaaaataccatggtaggtgaaagtagtgcattcc

SEQ ID NO: 36002 - DNA, 751 bp, Homo sapiens
ttatgcttaatagttctaccattcacatttagttttataatttatctcagagtattttttgtatatgatatgaggtatgggttaagggttcattggtttttatatagacatctaatcaatcaagaactacttattgaaaaggcatttcacaccattagactttttgaatctatgttcattgagtaatattcgtctctaggtttttgttcttataatgtacttacgagattttgctatcaaagttatgctgggtgtaataaaaatgagttgggaagagtttcttcatttactagtctctggaagaagttttatgatattagtattatatttttctcaagtgtttagaaaaattcaccataaaaatccttttgggactaaacttttttgcagaatgtttttgattttggactgcattttttttatgtataggattatttatattttctgcttcttcttgctgttttggataaattatgttgtttaaacaatttgcaaattcatctgagtttgttaaatttattggcatatgattacttgtaatatcactttgttatatttttaatgtcttttgggactgcaataatgtcccctgataattataatggattctctctctgtgtctctttattgatcattcttagtttggttcattaaaaccaacttttggttttactgaatttctaaattttttaaaatttgattcttgcttttatgtttattatattctctgatttactttaaatttgttatt

SEQ ID NO: 36003 - DNA, 1512 bp, Homo sapiens
gtaagaggtggggaggaggaggcacagttaatggatctgtaaacttgcaccctctttcagagtggtacatggaagacagcacaaagtggatccatactctgaaatgcagtaactctgatgcttgaatttgtctcccttcttgccagaaaggattctaataactcggtgtcaaagccaagacataaactcaaccccttctcttccaaaagcttcacgttacagcatggaagctgttgccaagtttgatttcactgcttcaggtgaggatgaactgagctttcacactggagatgttttgaagattttaagtaaccaagaggagtggtttaaggcggagcttgggagccaggaaggatatgtgcccaagaatttcatagacatccagtttcccaaatggtttcacgaaggcctctctcgacaccaggcagagaacttactcatgggcaaggaggttggcttcttcatcatccgggccagccagagctccccaggggacttctccatctctgtcaggcatgaggatgacgttcaacacttcaaggtcatgcgagacaacaagggtaattactttctgtggactgagaagtttccatccctaaataagctggtagactactacaggacaaattccatctccagacagaagcagatcttccttagagacagaacccgagaagaccagggtcaccggggcaacagcctggaccggaggtcccagggaggcccacacctcagtggggctgtgggagaagaaatccgaccttcgatgaaccggaagctgtcggatcaccccccgacccttcccctgcagcagcaccagcaccagccacagcctccgcaatatgccccagcgccccagcagctgcagcagcccccacagcagcgatatctgcagcaccaccatttccaccaggaacgccgaggaggcagccttgacataaatgatgggcattgtggcaccggcttgggcagtgaaatgaatgcggccctcatgcatcggagacacacagacccagtgcagctccaggcggcagggcgagtgcggtgggcccgggcgctgtatgactttgaggccctggaggatgacgagctggggttccacagcggggaggtggtggaggtcctggatagctccaacccatcctggtggaccggccgcctgcacaacaagctgggcctcttccctgccaactacgtggcacccatgacccgataaactcttcaggggacagaagctttttgtctggagctgcccacaagaaagagggcaaggaaaaaaggctggactccatgactatatatacatacatctatctacatctgcctgtgtacacacacaactttttatactagtaatttattggcaattgggctggtaattagttgatgcaaaagggaactcaggtggagaataatattgacacttgcttttctgcccccctcaggggtgtgtggaaggcagtgggggagttgggaggggggcagggaaatgaaatggagttttgtcctggc

SEQ ID NO: 36004 - DNA, 888 bp, Homo sapiens
  misc_feature (51)..(51): n is a, c, g, or t
cgcgccacccgcgcagtggagagacaacgaaaccacgcagccccccgcggngcggccttagtattttaagtaaccaagaggagtggtttaaggcggagcttgggagccaggaaggatatgtgcccaagaatttcatagacatccagtttcccaatccagcctgggcgacagagcgagactctgactcaaaaagaaacctccacttactctcagaggtatctttactctccgagaccctttaaaattcttgacctttcttttacatcaggcaattggcatcactagtgccagtttatttttagatataaatgtatgtctgtttgaaaaataaactttacatccaaaagagaatgacttggcaatgaagtaaaactggatctaatggtaaaggctcagcccacccttcctagatggataaaatccattttctctagccctggttcgaatgtgtcccatcacttgtgagtccagactggcaacaaaaggtgctgatctaaaagaagttatcgtccagtggcagggtctggggaaggggcggcaggcgccatgtccagccacgaaggtggcaagaagaaggcactgaaacagcccaagaagcaggccaaggagatggacgaggaagagaaggctttcaagcagaaacaaaaagaggagcagaagaaactcgaggtgctaaaagcgaaggtcgtggggaagggctctggccacaggtggaattaagaaatctggcaaaaaaataagctgttccttgtgcctaaggagacggtgaccctttatttcatccgtatttaaacctctctattccctcctataatatcttttgccacctatagttggaattaagtgtcgtcttggagctgttgtacatttaagaataaacttttgtaa

SEQ ID NO: 36005 - DNA, 2004 bp, Homo sapiens
gtaagaggtggggaggaggaggcacagttaatggatctgtaaacttgcaccctctttcagagtggtacatggaagacagcacaaagtggatccatactctgaaatgcagtaactctgatgcttgaatttgtctcccttcttgccagaaaggattctaataactcggtgtcaaagccaagacataaactcaaccccttctcttccaaaagcttcacgttacagcatggaagctgttgccaagtttgatttcactgcttcaggtgaggatgaactgagctttcacactggagatgttttgaagattttaagtaaccaagaggagtggtttaaggcggagcttgggagccaggaaggatatgtgcccaagaatttcatagacatccagtttcccaaatggtttcacgaaggcctctctcgacaccaggcagagaacttactcatgggcaaggaggttggcttcttcatcatccgggccagccagagctccccaggggacttctccatctctgtcaggcatgaggatgacgttcaacacttcaaggtcatgcgagacaacaagggtaattactttctgtggactgagaagtttccatccctaaataagctggtagactactacaggacaaattccatctccagacagaagcagatcttccttagagacagaacccgagaagaccagggtcaccggggcaacagcctggaccggaggtcccagggaggcccacacctcagtggggctgtgggagaagaaatccgaccttcgatgaaccggaagctgtcggatcaccccccgacccttcccctgcagcagcaccagcaccagccacagcctccgcaatatgccccagcgccccagcagctgcagcagcccccacagcagcgatatctgcagcaccaccatttccaccaggaacgccgaggaggcagccttgacataaatgatgggcattgtggcaccggcttgggcagtgaaatgaatgcggccctcatgcatcggagacacacagacccagtgcagctccaggcggcagggcgagtgcggtgggcccgggcgctgtatgactttgaggccctggaggatgacgagctggggttccacagcggggaggtggtggaggtcctggatagctccaacccatcctggtggaccggccgcctgcacaacaagctgggcctcttccctgccaactacgtggcacccatgacccgataaactcttcaggggacagaagctttttgtctggagctgcccacaagaaagagggcaaggaaaaaaggctggactccatgactatatatacatacatctatctacatctgcctgtgtacacacacaactttttatactagtaatttattggcaattgggctggtaattagttgatgcaaaagggaactcaggtggagaataatattgacacttgcttttctgcccccctcaggggtgtgtggaaggcagtgggggagttgggaggggggcagggaaatgaaatggagttttgtcctggccttcagctgtcactgcttcctccttgtcttgggaattttcacggagaacagctaagcagagaccacacctcggcactggacacagaacaacagggtggggttgaacttggtggggcacgttctagctgacctgcaagccccgctcacctggagggcttgcagagcagctctcctcctgttctccaaggggtgggcactgttgcattaggaattaaggtgcagcccagtgctgcgggcagccaagcgagtctgagcggggatgtgaaggcaggacggggttggagagaccctgcctgtgcaaggctggcctcctagtcaacacctagctgagacattcatctctgttcaaattaatattccttgggtctttcaaatgaatgtttcaatgtgaggagcgaagtactgggaaatcgagggattttccacaatccccaagcagcttactcagtggaacctctgtttccccagctatgaaggaaatagcatcctaca

SEQ ID NO: 36006 - DNA, 1578 bp, Homo sapiens
  misc_feature (13)..(13): n is a, c, g, or t
gatgatgaaaggngaagggaaaggctgcggatggccttcatttcctgctcctggcatctggggattccgagaatgatcccaggacctagatcctatagattccggcagctcttcctgcaaacacaagcccttgttgtgtgcctgagccttgctctccggcctggagacatccatctgcccactctcctaggaactgctgattaccaggaagcaccatcggcttgctgccctccccctggcagagaggcacaatgaccacattatttctcttccagcttcacgttacagcatggaagctgttgccaagtttgatttcactgcttcaggtgaggatgaactgagctttcacactggagatgttttgaagattttaagtaaccaagaggagtggtttaaggcggagcttgggagccaggaaggatatgtgcccaagaatttcatagacatccagtttcccaaatggtttcacgaaggcctctctcgacaccaggcagagaacttactcatgggcaaggaggttggcttcttcatcatccgggccagccagagctccccaggggacttctccatctctgtcaggcatgaggatgacgttcaacacttcaaggtcatgcgagacaacaagggtaattactttctgtggactgagaagtttccatccctaaataagctggtagactactacaggacaaattccatctccagacagaagcagatcttccttagagacagaacccgagaagaccagggtcaccggggcaacagcctggaccggaggtcccagggaggcccacacctcagtggggctgtgggagaagaaatccgaccttcgatgaaccggaagctgtcggatcaccccccgacccttcccctgcagcagcaccagcaccagccacagcctccgcaatatgccccagcgccccagcagctgcagcagcccccacagcagcgatatctgcagcaccaccatttccaccaggaacgccgaggaggcagccttgacataaatgatgggcattgtggcaccggcttgggcagtgaaatgaatgcggccctcatgcatcggagacacacagacccagtgcagctccaggcggcagggcgagtgcggtgggcccgggcgctgtatgactttgaggccctggaggatgacgagctggggttccacagcggggaggtggtggaggtcctggatagctccaacccatcctggtggaccggccgcctgcacaacaagctgggcctcttccctgccaactacgtggcacccatgacccgataaactcttcaggggacagaagctttttgtctggagctgcccacaagaaagagggcaaggaaaaaaggctggactccatgactatatatacatacatctatctacatctgcctgtgtacacacacaactttttatactagtaatttattggcaattgggctggtaattagttgatgcaaaagggaactcaggtggagaataatattgacacttgcttttctgcccccctcaggggtgtgtggaaggcagtgggggagttgggaggggggcagggaaatgaaatggagttttgtcctggc

SEQ ID NO: 36007 - DNA, 781 bp, Homo sapiens
ggcctgtgcataggtatctgatttaaattgcagcagggtagccgggcatggtggctcacacctgtagttccagctacttgggaggccaaggcaggaggacttcttgaggccaagggttcaaaaccagcctgagcaacatagcaagaccccatctctacaaaaaaagtttttttaagctgcagaggggtcagccttcagggaatgttgctctcaaagacttggatgtggtgggaggagccagcagaccctcccctgcctgcccagcccacagctcagcagagcctcttctgtgcttcccccaacagcgagtgcggtgggcccgggcgctgtatgactttgaggccctggaggatgacgagctggggttccacagcggggaggtggtggaggtcctggatagctccaacccatcctggtggaccggccgcctgcacaacaagctgggcctcttccctgccaactacgtggcacccatgacccgataaactcttcaggggacagaagctttttgtctggagctgcccacaagaaagagggcaaggaaaaaaggctggactccatgactatatatacatacatctatctacatctgcctgtgtacacacacaactttttatactagtaatttattggcaattgggctggtaattagttgatgcaaaagggaactcaggtggagaataatattgacacttgcttttctgcccccctcaggggtgtgtggaaggcagtgggggagttgggaggggggcagggaaatgaaatggagttttgtcctggc

SEQ ID NO: 36008 - DNA, 164 bp, Homo sapiens
agaatggagtctccattatgttctacctgagagtcagtatgaaatgtcaaatataaaagtacataattcagaggtctatttcaaagtaataatcatttgagcataatttctccactgacagagacgactgttattttattttcaatcaaaagtttttatgcata

SEQ ID NO: 36009 - DNA, 223 bp, Homo sapiens
gcaatccaaagcagagtccaaagtagttaaaatgctaaaaagaaaacaatattaggcagcctgtgctaagtgtatcaagttgcccaggcacagttaactgtcctggttagacaacttcagttgcacaaggcctcagggtgaaactgcagctgtgaagaggtcataatggttgtgaaaaagacaggcagtggaaacgatctttgaggaaacaggttgtgtagtt

SEQ ID NO: 36010 - DNA, 358 bp, Homo sapiens
gaggacccagcccggtcccaattctgcattcccctcatccccaaggctggaaactccctatggccactcctgtgggctcagccatcttacactacaagctcctctgataagtcccatccctccgcccagcctgcccactcaccaggaacagccatacaactcatttccctgctgccccatggaaacttcatctctctgtgcctcagagggtctgccaagcccctgtggcccaccactccatcccctgccagtggatgctctggcatggccagcgtcctcacttaggcacctgtcccccagctggcacaccccaggatcagcccacacgagtgacctgcccccacatccaccaatcccc

SEQ ID NO: 36011 - DNA, 674 bp, Homo sapiens
tgagtagctgggactacaggcatgcgccatcacaccgaggtaatttttgtattttttggcagagacagggtttcaccatgttgaccaggctggtcttgaactcctgacctcaagccatctgcccaccttggcctcccaaagttctgggattattttttaagcagttttgataggtgtgtacctagtagtgctctgtggtttaatttgcatttcccagggagtgggggcactgcctgtcttctcacgcctcagttgcttgttgctgtgacggtcgcccactcctcctgccagtgtctgtgctgctcacggtagctgcatcagcttcacgctgtccgcccttcgccacccaccgcgcctgctgctcaggaatgttccaagcaacttggtggtaacagaagctgagaacagcccagatgtccttcggtgcaagagtggatggatcagttgtggtctattcacagaatagaatgtgaccacactggagatgaatgaattgtagctacaatctgcagtgtagacgaatcttaggaacgtaggcgtttcagaagcagatcaagccaggcacgatgctgtgtgcctatagtcccagctactcagagcctgaaggtgggagatcacttcagcctgggagtttgaggccagcctgggcaacatagcaagaccctgtctcaaag

SEQ ID NO: 36012 - DNA, 339 bp, Homo sapiens
tgagtagctgggactacaggcatgcgccatcacaccgaggtaatttttgtattttttggcagagacagggtttcaccatgttgaccaggctggtcttgaactcctgacctcaagccatctgcccaccttggcctcccaaagttctgggattattttttaagcagttttgataggtgtgtacctagtagtgctctgtggtaagaagtgggctagggcatttttaatcttagagcggaagcctataatcactgcgcccgctcataaggggatggccatggctaggtttatagatagttgggtggttgtgtaaatgagttgaggcaggacccgagaactgtg

SEQ ID NO: 36013 - DNA, 1407 bp, Homo sapiens
cgcccggcggccgcaccacgtgggccaggcgccccacgcctggagctcccctctctggagccccgggaaaggaagcggggcagggaggccgggtgggagcaggggggtctccggcgcttcctctcctctgcgggcgccgcgcggctcctgagagtccgccccccgtcctgacgctcagctaggaagcgggtcctcgggcccctcccccgacacacacacacacacacacacacacacacacacacacacactctctctctctctctctctctctctctctctctctctcatcacacacacacacacacagcccgtctcgcgcctgaggtctcgcccgcaggccggtggcgcggggtcagctgctgcctgcggtccaggacagggtcggttccgccgcgcagcgcccaggcccagctcgtccagagtctgcggacagcgcacgtccaggtaacgcgcttcaaggggccgcggctcggagctgggggaccccgggccgccctgcccatacgagtgcgagcgtggagagcgcgggcgggggcgcggtcccgggggccggccagctggagggggcgggagcgctgggcggggcctgcgctgaccccggcgctgagtccctggggccgccgggcggatggcgtggccggacgcgggggccccgggccttccgggcgtgacctagggctcgggggcggggaggcccctccggcggggcggccctgggtggtccggcagaggcggaggccgctccgagcctgtgagccctgggcgcctgcggaggcggggagagggcggggtgtgccgccctggtggggaccgcggggtcggagaggggacattgccccccccgaggcgaacgtccaaccgcgggtccgggtccccgcccaaggccgccccgcgaggtggcctcggcccggccgtccccgagggtggctcggatcctttcaaccagcgcgctggaggcgaaggggctgcgccattccgggtcaggcagccaacgcgggacacgcgcgtctccgagcttgcggcccgcgaaacccgggtgacctaccgcgccggtgccctcaaagcccccacgcccgggccggtggccgctgcagccactgagccacgcggtctccccggcccggtcggcagaaggagctggtccgttactagaaaagtccagatgcaaagtcgggggtcgtgctgccgcttcctgccagcgcaccgcacccacctggggccgccaccgaccgcacaggacgcgcctcctaccccctgttctggcccggccgagagctggtgcccccagcggccgcccgcccccgtccgcagaccccggggcccttgctgctttgcattgggaacaaccggagccaggcccggagctgagggggccagggcctttggaggaagcattggcctcca

SEQ ID NO: 36014 - DNA, 2024 bp, Homo sapiens
cgcccggcggccgcaccacgtgggccaggcgccccacgcctggagctcccctctctggagccccgggaaaggaagcggggcagggaggccgggtgggagcaggggggtctccggcgcttcctctcctctgcgggcgccgcgcggctcctgagagtccgccccccgtcctgacgctcagctaggaagcgggtcctcgggcccctcccccgacacacacacacacacacacacacacacacacacacacacactctctctctctctctctctctctctctctctctctctcatcacacacacacacacacagcccgtctcgcgcctgaggtctcgcccgcaggccggtggcgcggggtcagctgctgcctgcggtccaggacagggtcggttccgccgcgcagcgcccaggcccagctcgtccagagtctgcggacagcgcacgtccagacatcgcccactcgggctcacagtgccatccgggtgaggacctccgtggagagctctctttgccaaagaaaagcagttgcattaggtctgcgagcaggcagggtggcctcttcctggctccccatccaccaaggaagcttcaagtccctgggacacaggcactttcccacacaggatggagccgggccaccctcacagctcctgccctgcagacgctggccttgtggagggaggcaggcagcaggagcagtgctttctgggcctctgtagccagagctggccctgctgcagcttacgtctgcctgcagcccagacgtcctcctggtcctcctgatgcccccgacctccacggaggacgagcatttccagcccagccctccccatcttcacctcgcactcccctgacacactgggagcctcctgatccgtgaacccgcgctggcgggagtagctactgaccgctggggacccctgcccaggctgttcgcatgtggaaaggattcagggagcaggcgatgcccaaagcgtggagaccagcactgctctctccccagtgacaggtgcacgcccagatcacggatgtgtcgggaacagctgtgctcctgctgctcagcgtccgtcactccaggctgggagcgggtccccaagcttctggctgggcctatccgtctccactctcagtgtgggggtggggggcgccaacagcacgcatttgctctctgcacttctcgtctgataatgggcagagggtccttctgcagccccaaaacatccctaggcaggagccctggggccccaagcagccagggaggtgagcaccaaggacctcccagagagcgtcaccttccgtcgagggaggcccagcctgggggcggtgtctgagacttggaatcaacgcttccgttggtggcagtaaatcctgtccctaaccctgcagtacagctgtgccgtgtacaggagggtgctgtctgacgccagacacctggactacagatcgcagcctgattcctggtcattgctccactgaaccccagaccccagcctcgttctgggccctcatcccctagatccagggaccccagccccatttcagcccttgggcccttgtaggatgcgaggccctgggccccagcccccagcccatccgtggcccaggcactggggggctgaggtcctctgagaagggacacagggcctggggggctctctcagcccatcagcaggagaggactgactccagaaaaatcagcgtttgtacccactcaggctgccaagacctgtgtccgtccttccaagctcaaccttcagagttcatgaggccccttgcccagaatgtccacagagttcatgaggccccttgcccggaatgtccacatttgaaacctcccaacaccgagccccatttcaagtataaccaggagggaaaatggtgcttgaaataagcatgccacaaaggaaaacctgctttctcgaaatgggccctggccgcccaggccctgacctccccggccaggatggaacgttccagagacccattagtgccaaaggcaaatgaaaacacaccctgtgaaaatgtc

SEQ ID NO: 36015 - DNA, 2053 bp, Homo sapiens
cgcccggcggccgcaccacgtgggccaggcgccccacgcctggagctcccctctctggagccccgggaaaggaagcggggcagggaggccgggtgggagcaggggggtctccggcgcttcctctcctctgcgggcgccgcgcggctcctgagagtccgccccccgtcctgacgctcagctaggaagcgggtcctcgggcccctcccccgacacacacacacacacacacacacacacacacacacacacactctctctctctctctctctctctctctctctctctctcatcacacacacacacacacagcccgtctcgcgcctgaggtctcgcccgcaggccggtggcgcggggtcagctgctgcctgcggtccaggacagggtcggttccgccgcgcagcgcccaggcccagctcgtccagagtctgcggacagcgcacgtccagacatcgcccactcgggctcacagtgccatccgggtgaggacctccgtggagagctctctttgccaaagaaaagcagttgcattaggtctgcgagcaggcagggtggcctcttcctggctccccatccaccaaggaagcttcaagtccctgggacacaggcactttcccacacaggatggagccgggccaccctcacagctcctgccctgcagacgctggccttgtggagggaggcaggcagcaggagcagtgctttctgggcctctgtagccagagctggccctgctgcagcttacgtctgcctgcagcccagacgtcctcctggtcctcctgatgcccccgacctccacggaggacgagcatttccagcccagccctccccatcttcacctcgcactcccctgacacactgggagcctcctgatccgtgaacccgcgctggcgggagtagctactgaccgctggggacccctgcccaggctgttcgcatgtggaaaggattcagggagcaggcgatgcccaaagcgtggagaccagcactgctctctccccagtgacaggtgcacgcccagatcacggatgtgtcgggaacagctgtgctcctgctgctcagcgtccgtcactccaggctgggagcgggtccccaagcttctggctgggcctatccgtctccactctcagtgtgggggtggggggcgccaacagcacgcatttgctctctgcacttctcgtctgataatgggcagagggtccttctgcagccccaaaacatccctaggcaggagccctggggccccaagcagccagggaggtgagcaccaaggacctcccagagagcgtcaccttccgtcgagggaggcccagcctgggggcggtgtctgagacttggaatcaacgcttccgttggtggcagtaaatcctgtccctaaccctgcagtacagctgtgccgtgtacaggagggtgctgtctgacgccagacacctggactacagatcgcagcctgattcctggtcattgctccactgaaccccagaccccagcctcgttctgggccctcatcccctagatccagggaccccagccccatttcagcccttgggcccttgtaggatgcgaggccctgggccccagcccccagcccatccgtggcccaggcactggggggctgaggtcctctgagaagggacacagggcctggggggctctctcagcccatcagcaggagaggactgactccagaaaaatcagcgtttgtacccactcaggctgccaagacctgtgtccgtccttccaagctcaaccttcagagttcatgaggccccttgcccagaatgtccacagagttcatgaggccccttccttgaatgtccacagagttcatgaggctgcccggaatgtccacatttgaaacctcccaacaccgagccccatttcaagtataaccaggagggaaaatggtgcttgaaataagcatgccacaaaggaaaacctgctttctcgaaatgggccctggccgcccaggccctgacctccccggccaggatggaacgttccagagacccattagtgccaaaggcaaatgaaaacacaccctgtgaaaatgtc

SEQ ID NO: 36016 - DNA, 1999 bp, Homo sapiens
cgcccggcggccgcaccacgtgggccaggcgccccacgcctggagctcccctctctggagccccgggaaaggaagcggggcagggaggccgggtgggagcaggggggtctccggcgcttcctctcctctgcgggcgccgcgcggctcctgagagtccgccccccgtcctgacgctcagctaggaagcgggtcctcgggcccctcccccgacacacacacacacacacacacacacacacacacacacacactctctctctctctctctctctctctctctctctctctcatcacacacacacacacacagcccgtctcgcgcctgaggtctcgcccgcaggccggtggcgcggggtcagctgctgcctgcggtccaggacagggtcggttccgccgcgcagcgcccaggcccagctcgtccagagtctgcggacagcgcacgtccagacatcgcccactcgggctcacagtgccatccgggtgaggacctccgtggagagctctctttgccaaagaaaagcagttgcattaggtctgcgagcaggcagggtggcctcttcctggctccccatccaccaaggaagcttcaagtccctgggacacaggcactttcccacacaggatggagccgggccaccctcacagctcctgccctgcagacgctggccttgtggagggaggcaggcagcaggagcagtgctttctgggcctctgtagccagagctggccctgctgcagcttacgtctgcctgcagcccagacgtcctcctggtcctcctgatgcccccgacctccacggaggacgagcatttccagcccagccctccccatcttcacctcgcactcccctgacacactgggagcctcctgatccgtgaacccgcgctggcgggagtagctactgaccgctggggacccctgcccaggctgttcgcatgtggaaaggattcagggagcaggcgatgcccaaagcgtggagaccagcactgctctctccccagtgacaggtgcacgcccagatcacggatgtgtcgggaacagctgtgctcctgctgctcagcgtccgtcactccaggctgggagcgggtccccaagcttctggctgggcctatccgtctccactctcagtgtgggggtggggggcgccaacagcacgcatttgctctctgcacttctcgtctgataatgggcagagggtccttctgcagccccaaaacatccctaggcaggagccctggggccccaagcagccagggaggtgagcaccaaggacctcccagagagcgtcaccttccgtcgagggaggcccagcctgggggcggtgtctgagacttggaatcaacgcttccgttggtggcagtaaatcctgtccctaaccctgcagtacagctgtgccgtgtacaggagggtgctgtctgacgccagacacctggactacagatcgcagcctgattcctggtcattgctccactgaaccccagaccccagcctcgttctgggccctcatcccctagatccagggaccccagccccatttcagcccttgggcccttgtaggatgcgaggccctgggccccagcccccagcccatccgtggcccaggcactggggggctgaggtcctctgagaagggacacagggcctggggggctctctcagcccatcagcaggagaggactgactccagaaaaatcagcgtttgtacccactcaggctgccaagacctgtgtccgtccttccaagctcaaccttcagagttcatgaggccccttgcccagaatgcccggaatgtccacatttgaaacctcccaacaccgagccccatttcaagtataaccaggagggaaaatggtgcttgaaataagcatgccacaaaggaaaacctgctttctcgaaatgggccctggccgcccaggccctgacctccccggccaggatggaacgttccagagacccattagtgccaaaggcaaatgaaaacacaccctgtgaaaatgtc

SEQ ID NO: 36017 - DNA, 1866 bp, Homo sapiens
cgcccggcggccgcaccacgtgggccaggcgccccacgcctggagctcccctctctggagccccgggaaaggaagcggggcagggaggccgggtgggagcaggggggtctccggcgcttcctctcctctgcgggcgccgcgcggctcctgagagtccgccccccgtcctgacgctcagctaggaagcgggtcctcgggcccctcccccgacacacacacacacacacacacacacacacacacacacacactctctctctctctctctctctctctctctctctctctcatcacacacacacacacacagcccgtctcgcgcctgaggtctcgcccgcaggccggtggcgcggggtcagctgctgcctgcggtccaggacagggtcggttccgccgcgcagcgcccaggcccagctcgtccagagtctgcggacagcgcacgtccaggcactttcccacacaggatggagccgggccaccctcacagctcctgccctgcagacgctggccttgtggagggaggcaggcagcaggagcagtgctttctgggcctctgtagccagagctggccctgctgcagcttacgtctgcctgcagcccagacgtcctcctggtcctcctgatgcccccgacctccacggaggacgagcatttccagcccagccctccccatcttcacctcgcactcccctgacacactgggagcctcctgatccgtgaacccgcgctggcgggagtagctactgaccgctggggacccctgcccaggctgttcgcatgtggaaaggattcagggagcaggcgatgcccaaagcgtggagaccagcactgctctctccccagtgacaggtgcacgcccagatcacggatgtgtcgggaacagctgtgctcctgctgctcagcgtccgtcactccaggctgggagcgggtccccaagcttctggctgggcctatccgtctccactctcagtgtgggggtggggggcgccaacagcacgcatttgctctctgcacttctcgtctgataatgggcagagggtccttctgcagccccaaaacatccctaggcaggagccctggggccccaagcagccagggaggtgagcaccaaggacctcccagagagcgtcaccttccgtcgagggaggcccagcctgggggcggtgtctgagacttggaatcaacgcttccgttggtggcagtaaatcctgtccctaaccctgcagtacagctgtgccgtgtacaggagggtgctgtctgacgccagacacctggactacagatcgcagcctgattcctggtcattgctccactgaaccccagaccccagcctcgttctgggccctcatcccctagatccagggaccccagccccatttcagcccttgggcccttgtaggatgcgaggccctgggccccagcccccagcccatccgtggcccaggcactggggggctgaggtcctctgagaagggacacagggcctggggggctctctcagcccatcagcaggagaggactgactccagaaaaatcagcgtttgtacccactcaggctgccaagacctgtgtccgtccttccaagctcaaccttcagagttcatgaggccccttgcccagaatgtccacagagttcatgaggccccttgcccggaatgtccacatttgaaacctcccaacaccgagccccatttcaagtataaccaggagggaaaatggtgcttgaaataagcatgccacaaaggaaaacctgctttctcgaaatgggccctggccgcccaggccctgacctccccggccaggatggaacgttccagagacccattagtgccaaaggcaaatgaaaacacaccctgtgaaaatgtc

SEQ ID NO: 36018 - DNA, 1686 bp, Homo sapiens
ggggcctaggccagtcagctgaggacgtgttggtgcactcccgggagggcggtatgtgggtgaggatccccatgcagagtggtgcccacaaaccccccttccagagtcatctctggtccaccttgaagtccccaggaaaatgacctcgtcctccgcgggtgtgagccactaggcctgagaggacgccgggacggagctttcagagagggaggtgtcgggatggcttgagggtcaccaggtattaattaagcacttgctgtgtgccaggcactttcccacacaggatggagccgggccaccctcacagctcctgccctgcagacgctggccttgtggagggaggcaggcagcaggagcagtgctttctgggcctctgtagccagagctggccctgctgcagcttacgtctgcctgcagcccagacgtcctcctggtcctcctgatgcccccgacctccacggaggacgagcatttccagcccagccctccccatcttcacctcgcactcccctgacacactgggagcctcctgatccgtgaacccgcgctggcgggagtagctactgaccgctggggacccctgcccaggctgttcgcatgtggaaaggattcagggagcaggcgatgcccaaagcgtggagaccagcactgctctctccccagtgacaggtgcacgcccagatcacggatgtgtcgggaacagctgtgctcctgctgctcagcgtccgtcactccaggctgggagcgggtccccaagcttctggctgggcctatccgtctccactctcagtgtgggggtggggggcgccaacagcacgcatttgctctctgcacttctcgtctgataatgggcagagggtccttctgcagccccaaaacatccctaggcaggagccctggggccccaagcagccagggaggtgagcaccaaggacctcccagagagcgtcaccttccgtcgagggaggcccagcctgggggcggtgtctgagacttggaatcaacgcttccgttggtggcagtaaatcctgtccctaaccctgcagtacagctgtgccgtgtacaggagggtgctgtctgacgccagacacctggactacagatcgcagcctgattcctggtcattgctccactgaaccccagaccccagcctcgttctgggccctcatcccctagatccagggaccccagccccatttcagcccttgggcccttgtaggatgcgaggccctgggccccagcccccagcccatccgtggcccaggcactggggggctgaggtcctctgagaagggacacagggcctggggggctctctcagcccatcagcaggagaggactgactccagaaaaatcagcgtttgtacccactcaggctgccaagacctgtgtccgtccttccaagctcaaccttcagagttcatgaggccccttgcccagaatgtccacagagttcatgaggccccttgcccggaatgtccacatttgaaacctcccaacaccgagccccatttcaagtataaccaggagggaaaatggtgcttgaaataagcatgccacaaaggaaaacctgctttctcgaaatgggccctggccgcccaggccctgacctccccggccaggatggaacgttccagagacccattagtgccaaaggcaaatgaaaacacaccctgtgaaaatgtc

SEQ ID NO: 36019 - DNA, 1647 bp, Homo sapiens
cgcccggcggccgcaccacgtgggccaggcgccccacgcctggagctcccctctctggagccccgggaaaggaagcggggcagggaggccgggtgggagcaggggggtctccggcgcttcctctcctctgcgggcgccgcgcggctcctgagagtccgccccccgtcctgacgctcagctaggaagcgggtcctcgggcccctcccccgacacacacacacacacacacacacacacacacacacacacactctctctctctctctctctctctctctctctctctctcatcacacacacacacacacagcccgtctcgcgcctgaggtctcgcccgcaggccggtggcgcggggtcagctgctgcctgcggtccaggacagggtcggttccgccgcgcagcgcccaggcccagctcgtccagagtctgcggacagcgcacgtccagacatcgcccactcgggctcacagtgccatccgggtgaggacctccgtggagagctctctttgccaaagaaaagcagttgcattaggtctgcgagcaggcagggtggcctcttcctggctccccatccaccaaggaagcttcaagtccctgggacacaggcactttcccacacaggatggagccgggccaccctcacagctcctgccctgcagacgctggccttgtggagggaggcaggcagcaggagcagtgctttctgggcctctgtagccagagctggccctgctgcagcttacgtctgcctgcagcccagacgtcctcctggtcctcctgatgcccccgacctccacggaggacgagcatttccagcccagccctccccatcttcacctcgcactcccctgacacactgggagcctcctgatccgtgaacccgcgctggcgggagtagctactgaccgctggggacccctgcccaggctgttcgcatgtggaaaggattcagggagcaggcgatgcccaaagcgtggagaccagcactgctctctccccagtgacagtacagctgtgccgtgtacaggagggtgctgtctgacgccagacacctggactacagatcgcagcctgattcctggtcattgctccactgaaccccagaccccagcctcgttctgggccctcatcccctagatccagggaccccagccccatttcagcccttgggcccttgtaggatgcgaggccctgggccccagcccccagcccatccgtggcccaggcactggggggctgaggtcctctgagaagggacacagggcctggggggctctctcagcccatcagcaggagaggactgactccagaaaaatcagcgtttgtacccactcaggctgccaagacctgtgtccgtccttccaagctcaaccttcagagttcatgaggccccttgcccagaatgtccacagagttcatgaggccccttgcccggaatgtccacatttgaaacctcccaacaccgagccccatttcaagtataaccaggagggaaaatggtgcttgaaataagcatgccacaaaggaaaacctgctttctcgaaatgggccctggccgcccaggccctgacctccccggccaggatggaacgttccagagacccattagtgccaaaggcaaatgaaaacacaccctgtgaaaatgtc

SEQ ID NO: 36020 - DNA, 779 bp, Homo sapiens
ggggttcgcaggacccctctcaagacccccttcgggagtcagcttcttggccacgcacacttggagctctgggctgggttgcagctccctgtacttcactgtctcgggtgctggcagtgccagctggggcacgagttccggtttgggtcaaggctggcctgttggctggggtggcgtctgcctgagaactggccttgtctgtgccttaagcttcctggcgctcacagggcagtggaaaaccactcagtgagtctttcttggcaccttgcaggagcagtgctttctgggcctctgtagccagagctggccctgctgcagcttacgtctgcctgcagcccagacgtcctcctggtcctcctgatgcccccgacctccacggaggacgagcatttccagcccagccctccccatcttcacctcgcactcccctgacacactgggagcctcctgatccgtgaacccgcgctggcgggagtagctactgaccgctggggacccctgcccaggctgttcgcatgtggaaaggattcagggagcaggcgatgcccaaagcgtggagaccagcactgctctctccccagtgacaggtgcacgcccagatcacggatgtgtcgggaacagctgtgctcctgctgctcagcgtccgtcactccaggctgggagcgggtccccaagcttctggctgggcctatccgtctccactctcagtgtgggggtggggggcgccaacagcacgcatttgctctctgcacttctcgtctgataatgggcagagggtc

SEQ ID NO: 36021 - DNA, 372 bp, Homo sapiens
ttttttttgtaaattcagtaatctcaccagcaacaagctttgctttcaaataagcatatctgccaacttaaacagcatctcctaaggcagcggagtaatgaaagacacatgtaggtacttgcctgtcatcagatgcaagctcacgtctgcctgaaattgggcctgtaattctgctgatcctcgggttcaggacagcatggccgagagtggtctacaatgcggcccttagtctaaacagcagatgaaggatgcaaggggccaacctttttcatccctgctgggctcttgaccagttgttgctctttagttcaagggggagatgtgagggattgctcaaacacttggcagacagaaaggtcttaagacagcaag

SEQ ID NO: 36022 - DNA, 407 bp, Homo sapiens
tctcatttattgattcaacaaatattgattgagttcttactttatacaagacttacatcggagaatctgacttggagcttgcagtccaggagggaagataattaaacagtgacagtgaggaacaaagtgtgctggctcgtgcattgcaccatttcaggggcaccattcacacataatacaatgcaaatttcaccccttggagttgtgcaacttggtgaccaggcactgatgggagcaagcaaattgtggatcaggaaaggcctccctagaagaaaggacatttaagctgagacctgaactatgactgtcagttaattatgtaaagcaagggaggaacagtgtgctgggctgaaagaacagcatgtgaaaaatgtgggggagaaagcaaggggcaggggaagtgacag

SEQ ID NO: 36023 - DNA, 595 bp, Homo sapiens
  misc_feature (69)..(69): n is a, c, g, or t
aagtgaggctttctggggagagagggcttgtactcgagcttgagccaaaggagggtgggctccagcttnttagccctcaaaaacactcgttttcatggtgggagtggagggagggccagccagggcatccaggaggactccctctcccaggggctggaatttatgtgatgagaactccccactcatgacaaaggagggagctgggagcccctgagatgtcttatcagcttgtttgggtgtgggacaaaagggacaagggtataatagggcttgaaagctgtcagtgggcaaacatcaaaaatggagtcagagctgggcacagtggttcacacttgtgatcccagcacttttgggaggccaaggcggcagtatttgcttgagaccgtgagctttaagacctgcctggagaacataggaagaccctatctctacaaaaatttaataattacccaggcatgatggcacgtacttgtagtcgtagctacttgggaggctgaagtgggaggatcgtttaagcccaggagtttgaggctgtagtgagctatggttgccccactgccctccagcctgggtgacagagtaagacctcgtccct

SEQ ID NO: 36024 - DNA, 770 bp, Homo sapiens
tgagatgacatcttgctctgtcacccaggatacatgacattgcttcacaagatatcttcaaaccccttgtctcctaacttagcactaatttggtaatcattcagacgttatcattacaaaaactacaaagcctattctttctttcaggcagtctgccctgagggtataaacaatagtatttattacatattctttaggacccccatgttataccctattaaaccttgataaatattcttctgtgtttctagaacaaacaaactgctttcctgctcattgttccttggctccgctaaaaaaaaaaaaaaaaaaaaaaagtcaagcatatttcaactagaaaaaggaaaccataggcagccagacacagagactatactgtttctcatttcatcagccttgggacttgaacagcaggtcactccatttgaaaactagcagacgtaataaatagaaagaggcatagaaagcaagctgaccacagattgggctgtagcacccagccatttctgtctgtcttggaaaggccaaagagaatgcactgtatactgccattgtatcaaatgttttgggcacctttttcagggcatttatgaaagaaaaaaagaaaagggagggattaaggactggataagccttttcctgcctgagtacctgtttcatgatgtttctttatagtcatcatgactggcaaaataatctttaaggttgcttggcagtgtccaaaaagtagacaaatagaccttgtacctgtggaagaaattttaaaaacc

SEQ ID NO: 36025 - DNA, 243 bp, Homo sapiens
tatgttccttttaggaaaattggaaaatacaagagaagtaaaaaagtaaataaaaatcatcaaggagtgattcctaaaaacatgttggggtacttctttccatcttttctcaatgaatatatctgtatgtgtgtgtgtatgtgtatgtattttttccaatgtatgtgtatacatgtgcacacacatgcgtgcaattacagtcttttagctaacatagggaaaggagtagatagaaaaggatta

SEQ ID NO: 36026 - DNA, 469 bp, Homo sapiens
gttctgtggtgttgactacattcacattgttgtacgaccatcactactgtccatcttgaactttttcatcttcccgactgaagctctgtacccagtgaataataactccccattccctgcccccagcccctggcactgccatttctccatctgtgtctctgaattcagctattatagatacctcatgtaagtccagtcctgtggcattcgtctttttgtgattggcttatttcactgagtgtaatgttaccaatgttcatccatgtgatgggcagaaattgtgtgggattttttttttttaatgggagtttcactctaggctggagtgcagtggcgtgatctctgcttactgcagcctctgcctccccagttcaagcttcaagagtctcctactcaggaggctgaggctaaagaatcacttgaacctgggaggcagaggttgcagtaagccaagatcacaccattgcac

SEQ ID NO: 36027 - DNA, 372 bp, Homo sapiens
accattgggggagcaggtttggggtaaacagacttgaattgggtgttctctgtgcattttgtttatttagttcatgttggcaaattactattttaagtaaagttgtttccctaagcattaaaaagttgttttttttttgtagcctgaatgggttccagggtgctctgccttgaccagctgtgctgtgtggtcctaagtcaattcccttcccttgcctggatctgagtttgcctcatcctccttgtgagccagccatgtgagagtcagtgagtcagtgcctgaactaggatggctgttggggcaggtggatagacacagtttctttgtgaaaaatgaccccttaactgtcacttgcttacactgatgattaga

SEQ ID NO: 36028 - DNA, 439 bp, Homo sapiens
gggaatcttcaaggctctcattgactctgagcataagcttggcccctcttttccttgtgataacacaatccttcctcttatttccacctactgttaattttaatctatagtaccagagagatacttgcatcatttagtcctttactggggtagagttgataattgtgctttctttaaaagaaatagcaatgctcagtgcccgtgtttcccccttcctcttcaatccgatattaacacgtattacagaaactaaatgagttccctgtttaaattacattgatattcagttactatgtggcatcccctcaatagaggtcagccagcttctccctcatcactgctcccgtctgctgtgtcacaaacttccctctagttaaaagaagtaggactcaaatccccacaccccttacacaccctcactgtggtagctttcttcttg

SEQ ID NO: 36029 - DNA, 413 bp, Homo sapiens
atctacttggtggtgagagtgacacatgggccatttgcaggtgtcacaccctgtggacgaatggtcatgctacacggtggtttgtgccaaggcctcatggacacagttcacattcttagtgtcctaggagctcctgccatgattccttagcagtggttatgcttgtttttatgatggcaaggctccccaaactttgtggacaatgcacagataacaactgctgatggaaatcaatggcctggcctgcttccttcataagagcaaaggtaaaggcagcctcttaacatctaatgctccctttgcctttttcagagttggagaatcacagcatttttctgaaatgtggagtgggaaatctaaatgtggagtggggaagctataattacatagcttggaaaaagaaaagtttaaga

SEQ ID NO: 36030 - DNA, 1579 bp, Homo sapiens
  misc_feature (1394)..(1395): n is a, c, g, or t
tgcgtacacgtcacttccgaggcgggaggatgaagttgattgactatggtctctccggctaccaggaagagtctgccgaaggtgaaggccatggacttcatcacctccacagccatcctgcccctgctgttcggctgcctgggcgtcttcggcctcttccggctgctgcagtgggtgcgcgggaaggcctacctgcggaatgctgtggtggtgatcacaggcgccacctcagggctgggcaaagaatgtgcaaaagtcttctatgctgcgggtgctaaactggtgctctgtggccggaatggtggggccctagaagagctcatcagagaactcaccgcttctcatgccaccaaggtgcagacacacaagccttacttggtgaccttcgacctcacagactctggggccatagttgcagcagcagctgagatcctgcagtgctttggctatgtcgacatacttgtcaacaatgctgggatcagctaccgtggtaccatcatggacaccacagtggatgtggacaagagggtcatggagacaaactactttggcccagttgctctaacgaaagcactcctgccctccatgatcaagaggaggcaaggccacattgtcgccatcagcagcatccagggcaagatgagcattccttttcgatcagcatatgcagcctccaagcacgcaacccaggctttctttgactgtctgcgtgccgagatggaacagtatgaaattgaggtgaccgtcatcagccccggctacatccacaccaacctctctgtaaatgccatcaccgcggatggatctaggtatggagttatggacaccaccacagcccagggccgaagccctgtggaggtggcccaggatgttcttgctgctgtggggaagaagaagaaagatgtgatcctggctgacttactgccttccttggctgtttatcttcgaactctggctcctgggctcttcttcagcctcatggcctccagggccagaaaagagcggaaatccaagaactcctagtactctgaccagccagggccagggcagagaagcagcactcttaggcttgcttactctacaagggacagttgcatttgttgagactttaatggagatttgtctcacaagtgggaaagactgaagaaacacatctcgtgcagatctgctggcagaggacaatcaaaaacgacaacaagcttcttcccagggtgaggggaaacacttaaggaataaatatggagctggggtttaacactaaaaactagaaataaacatctcaaacagtaagagttgtagtcttccaggactagaaccttgtgtcctttgaattctcgccctgccagctcctagaaatagtttcaatcttggaatcagatgttatgtcacctganncagttgtttctgtatttgacttaaacctcattgttgtggcagaaagaccacctccagtactgaggggagaaagttgtagtttcaagaagtcagcagtcacgcccatttccaggtccctatgatatctcatccaacttaaaacgtgggccagtatgtaatggcttatttggtgtatcccaaggga

SEQ ID NO: 36031 - DNA, 1050 bp, Homo sapiens
aagctaggtagaggccgggtgtgaatcggcagaggctctccggctacaggaagagtctgccgaaggtgaaggccatggacttcatcacctccacagccatcctgcccctgctgttcggctgcctgggcgtcttcggcctcttccggctgctgcagtgggtgcgcgggaaggcctacctgcggaatgctgtggtggtgatcacaggcgccacctcagggctgggcaaagaatgtgcaaaagtcttctatgctgcgggtgctaaactggtgctctgtggccggaatggtggggccctagaagagctcatcagagaactcaccgcttctcatgccaccaaggtgcagacacacaagccttacttggtgaccttcgacctcacagactctggggccatagttgcagcagcagctgagatcctgcagtgctttggctatgtcgacatacttgtcaacaatgctgggatcagctaccgtggtaccatcatggacaccacagtggatgtggacaagagggtcatggagacaaactactttggcccagttgctctaacgaaagcactcctgccctccatgatcaagaggaggcaaggccacattgtcgccatcagcagcatccagggcaagatgagcattccttttcgatcagcatatgcagcctccaagcacgcaacccaggctttctttgactgtctgcgtgccgagatggaacagtatgaaattgaggtgaccgtcatcagccccggctacatccacaccaacctctctgtaaatgccatcaccgcggatggatctaggtatggagttatggacacaacacagccaggcgaagcctgtggaggtggccgatgtctgctgtgggcggagagcaagaagatgtgtctggtgaattaggctcctggtggtatttcaacctggtcgggtctttacctcaggctcggcgaaaaaggaatcaaacctgtctgccacgcggcggggaaaggccctggggtctccaggcggtttggaggggggccggagaaaactggctggggcaaacccgggggggatgggc

SEQ ID NO: 36032 - DNA, 1723 bp, Homo sapiens
tgcgtacacgtcacttccgaggcgggaggatgaagttgattgactatggtctctccggctaccaggaagagtctgccgaaggtgaaggccatggacttcatcacctccacagccatcctgcccctgctgttcggctgcctgggcgtcttcggcctcttccggctgctgcagtgggtgcgcgggaaggcctacctgcggaatgctgtggtggtgatcacaggcgccacctcagggctgggcaaagaatgtgcaaaagtcttctatgctgcgggtgctaaactggtgctctgtggccggaatggtggggccctagaagagctcatcagagaactcaccgcttctcatgccaccaaggtgcagacacacaagccttacttggtgaccttcgacctcacagactctggggccatagttgcagcagcagctgagatcctgcagtgctttggctatgtcgacatacttgtcaacaatgctgggatcagctaccgtggtaccatcatggacaccacagtggatgtggacaagagggtcatggagacaaactactttggcccagttgctctaacgaaagcactcctgccctccatgatcaagaggaggcaaggccacattgtcgccatcagcagcatccagggcaagatgagcattccttttcgatcagcatatgcagcctccaagcacgcaacccaggctttctttgactgtctgcgtgccgagatggaacagtatgaaattgaggtgaccgtcatcagccccggctacatccacaccaacctctctgtaaatgccatcaccgcggatggatctaggtatggagttatggacaccaccacagcccagggccgaagccctgtggaggtggcccaggatgttcttgctgctgtggggaagaagaagaaagatgtgatcctggctgacttactgccttccttggctgtttatcttcgaactctggctcctgggctcttcttcagcctcatggcctccagggccagaaaagagcggaaatccaagaactcctagtactctgaccagccagggccagggcagagaagcagcactcttaggcttgcttactctacaagggacagttgcatttgttgagactttaatggagatttgtctcacaagtgggaaagactgaagaaacacatctcgtgcagatctgctggcagaggacaatcaaaaacgacaacaagcttcttcccagggtgaggggaaacacttaaggaataaatatggagctggggtttaacactaaaaactaggcacaataaagcatcgcccaaaaaaaaaaaaaaaaaaaaaaaaaaaaaaccgtgtgtgtggggcgcgcgccctgcgcggcccccggagagaagagtttttaagagagaccacacttggggtggggcgcggcggggagcccacgggggcaacacgagggaaacagtgggccaaagagggggttccaccaagggagaacaccggggtcacagcgaacaaagggccggggaacttctcccacacaaataaaaaggccccggggaggaaaacggaagcggtttgggagaaaaataatccaaagaggggaggcatcgcgggggggccacaagggggggagactttacacacagcgggggagtctaaaggggaaagccgcggaatttctccaaattaacgcccccagcgggggaaagcagaaagcagcggaagcaacaagacgagaaaaaaacacacgcgt

SEQ ID NO: 36033 - DNA, 1469 bp, Homo sapiens
  misc_feature (1284)..(1285): n is a, c, g, or t
tgcgtacacgtcacttccgaggcgggaggatgaagttgattgactatggtctctccggctaccaggaagagtctgccgaaggtgaaggccatggacttcatcacctccacagccatcctgcccctgctgttcggctgcctgggcgtcttcggcctcttccggctgctgcagtgggtgcgcgggaaggcctacctgcggaatgctgtggtggtgatcacaggcgccacctcagggctgggcaaaggtgcagacacacaagccttacttggtgaccttcgacctcacagactctggggccatagttgcagcagcagctgagatcctgcagtgctttggctatgtcgacatacttgtcaacaatgctgggatcagctaccgtggtaccatcatggacaccacagtggatgtggacaagagggtcatggagacaaactactttggcccagttgctctaacgaaagcactcctgccctccatgatcaagaggaggcaaggccacattgtcgccatcagcagcatccagggcaagatgagcattccttttcgatcagcatatgcagcctccaagcacgcaacccaggctttctttgactgtctgcgtgccgagatggaacagtatgaaattgaggtgaccgtcatcagccccggctacatccacaccaacctctctgtaaatgccatcaccgcggatggatctaggtatggagttatggacaccaccacagcccagggccgaagccctgtggaggtggcccaggatgttcttgctgctgtggggaagaagaagaaagatgtgatcctggctgacttactgccttccttggctgtttatcttcgaactctggctcctgggctcttcttcagcctcatggcctccagggccagaaaagagcggaaatccaagaactcctagtactctgaccagccagggccagggcagagaagcagcactcttaggcttgcttactctacaagggacagttgcatttgttgagactttaatggagatttgtctcacaagtgggaaagactgaagaaacacatctcgtgcagatctgctggcagaggacaatcaaaaacgacaacaagcttcttcccagggtgaggggaaacacttaaggaataaatatggagctggggtttaacactaaaaactagaaataaacatctcaaacagtaagagttgtagtcttccaggactagaaccttgtgtcctttgaattctcgccctgccagctcctagaaatagtttcaatcttggaatcagatgttatgtcacctganncagttgtttctgtatttgacttaaacctcattgttgtggcagaaagaccacctccagtactgaggggagaaagttgtagtttcaagaagtcagcagtcacgcccatttccaggtccctatgatatctcatccaacttaaaacgtgggccagtatgtaatggcttatttggtgtatcccaaggga

SEQ ID NO: 36034 - DNA, 1495 bp, Homo sapiens
  misc_feature (1310)..(1311): n is a, c, g, or t
tgcgtacacgtcacttccgaggcgggaggatgaagttgattgactatggtctctccggctaccaggaagagtctgccgaaggtgaaggccatggacttcatcacctccacagccatcctgcccctgctgttcggctgcctgggcgtcttcggcctcttccggctgctgcagtgggtgcgcgggaaggcctacctgcggaatgctgtggtggtgatcacaggcgccacctcagggctgggcaaagaatgtgcaaaagtcttctatgctgcgggtgctaaactggtgctctgtggccggaatggtggggccctagaagagctcatcagagaactcaccgcttctcatgccaccaaggtgcagacacacaagccttacttggtgaccttcgacctcacagactctggggccatagttgcagcagcagctgagatcctgcagtgctttggctatgtcgacatacttgtcaacaatgctgggatcagctaccgtggtaccatcatggacaccacagtggatgtggacaagagggtcatggagacaaactactttggcccagttgctctaacgaaagcactcctgccctccatgatcaagaggaggcaaggccacattgtcgccatcagcagcatccagggcaagatgagcattccttttcgatcagcatatgcagcctccaagcacgcaacccaggctttctttgactgtctgcgtgccgagatggaacagtatgaaattgaggtgaccgtcatcacccagggccgaagccctgtggaggtggcccaggatgttcttgctgctgtggggaagaagaagaaagatgtgatcctggctgacttactgccttccttggctgtttatcttcgaactctggctcctgggctcttcttcagcctcatggcctccagggccagaaaagagcggaaatccaagaactcctagtactctgaccagccagggccagggcagagaagcagcactcttaggcttgcttactctacaagggacagttgcatttgttgagactttaatggagatttgtctcacaagtgggaaagactgaagaaacacatctcgtgcagatctgctggcagaggacaatcaaaaacgacaacaagcttcttcccagggtgaggggaaacacttaaggaataaatatggagctggggtttaacactaaaaactagaaataaacatctcaaacagtaagagttgtagtcttccaggactagaaccttgtgtcctttgaattctcgccctgccagctcctagaaatagtttcaatcttggaatcagatgttatgtcacctganncagttgtttctgtatttgacttaaacctcattgttgtggcagaaagaccacctccagtactgaggggagaaagttgtagtttcaagaagtcagcagtcacgcccatttccaggtccctatgatatctcatccaacttaaaacgtgggccagtatgtaatggcttatttggtgtatcccaaggga

SEQ ID NO: 36035 - DNA, 449 bp, Homo sapiens
tgctagggcttagagctggagtccacagagggagatctgggattcatatcagatgagaggaagagcctaggaaagtcccctgaactctgctactttgtcactggtgtgtttggttttggttcttccaggaagagtctgccgaaggtgaaggccatggacttcatcacctccacagccatcctgcccctgctgttcggctgcctgggcgtcttcggcctcttccggctgctgcagtgggtgcgcgggaaggcctacctgcggaatgctgtggtggtgatcacaggcgccacctcagggctgggcaaaggtgggtcctggaggcagtgctgccagggggcgggggtaagtcagccagggatgaggagcggcccagctgcacagggaccaccagcgcaaatgcccgaagcggcagcagaaggccagataagggaagtgggccggatggcact

SEQ ID NO: 36036 - DNA, 852 bp, Homo sapiens
gtgtgaagaaataagaagaatcagtgatactcctagacattggagctcagtgacaggaaacagtaatcatgttgtcgtctactgagaagggcaaggatgaaggaatgagcaggtttgggcaaagaactaagaattgagtttttgaatgtttgtttttagactctaagcagaatccaaatggagatgctcagtaaggagatggatatctaggtcgagagctcaggcaagaggctgagagtaagaacataaatccaggagtcaccagaatacgctaggtatttaaagctaagaaattagatgaggttctttttaaaatcttacttaataaaaagtacagaaatttttctaagtgctttacaaatattaactcaaccctcttaacaactctctgaggtaagaactattattactcttatattccatattaaagataaggaaactgagacacagattatctaagcaactaggcccaaaatcacactaccggtaagcagcaaacctgggactgaatccaagcagtgtggccccagtctgaattcttaacactaagctaaattgcttcctaatactctaagggaaaaaaaaaagtggaaggagagaagaggctccggaactgagccgcagggcactcaacttttagaagttgcaaaaaggggaagcaaaaaaatttaaaaggagctaagtagaaaatgagaaaaagtttggtgtcctgaaatcccatgaataaaatactgtatatcaaagaggaatgcttaagagatcaaaaaagaaatggactagaaagtgaccattggatttggcaaggtggaagtcactagagactttgaatacatacttgatgaaataagttat

SEQ ID NO: 36037 - DNA, 875 bp, Homo sapiens
  misc_feature (812)..(812): n is a, c, g, or t
  misc_feature (815)..(815): n is a, c, g, or t
gtgtgaagaaataagaagaatcagtgatactcctagacattggagctcagtgacaggaaacagtaatcatgttgtcgtctactgagaagggcaaggatgaaggaatgagcaggtttgggcaaagaactaagaattgagtttttgaatgtttgtttttagactctaagcagaatccaaatggagatgctcagtaaggagatggatatctaggtcgagagctcaggcaagaggctgagagtaagaacataaatccaggagtcaccagaatacgctaggtatttaaagctaagaaattagatgaggttctttttaaaatcttacttaataaaaagtacagaaatttttctaagtgctttacaaatattaactcaaccctcttaacaactctctgaggtaagaactattattactcttatattccatattaaagataaggaaactgagacacagattatctaagcaactaggcccaaaatcacactaccggtaagcagcaaacctgggactgaatccaagcagtgtggccccagtctgaattcttaacactaagctaaattgcttcctaatactctaagggaaaaaaaaaagtggaaggagagaagaggctccggaactgagccgcagggcactcaacttttagaagttgcaaaaaggggaagcaaaaaaatttaaaaggagctaagtagaaaatgagaaaaagtttggtgtcctgaaatcccatgaataaaatactgtatatcaaagaggaatgcttaagagatcaaaaaagaaatggactagaaagtgaccattggattgttttgttccaagtnacnagagtagcttatagcaataccaacgttgactgagaatagaatgatctgcacgtttacttc

SEQ ID NO: 36038 - DNA, 861 bp, Homo sapiens
gtgtgaagaaataagaagaatcagtgatactcctagacattggagctcagtgacaggaaacagtaatcatgttgtcgtctactgagaagggcaaggatgaaggaatgagcaggtttgggcaaagaactaagaattgagtttttgaatgtttgtttttagactctaagcagaatccaaatggagatgctcagtaaggagatggatatctaggtcgagagctcaggcaagaggctgagagtaagaacataaatccaggagtcaccagaatacgctaggtatttaaagctaagaaattagatgaggttctttttaaaatcttacttaataaaaagtacagaaatttttctaagtgctttacaaatattaactcaaccctcttaacaactctctgaggtaagaactattattactcttatattccatattaaagataaggaaactgagacacagattatctaagcaactaggcccaaaatcacactaccggtaagcagcaaacctgggactgaatccaagcagtgtggccccagtctgaattcttaacactaagctaaattgcttcctaatactctaagggaaaaaaaaaagtggaaggagagaagaggctccggaactgagccgcagggcactcaacttttagaagttgcaaaaaggggaagcaaaaaaatttaaaaggagctaagtagaaaatgagaaaaagtttggtgtcctgaaatcccatgaataaaatactgtatatcaaagaggaatgcttaagagatcaaaaaagatgtggtatcagtcacgaccgacagaacctttttttccaagtcacaagctgtgcttgatgaaactacgcaacgttcgatgagcatagatatg

SEQ ID NO: 36039 - DNA, 552 bp, Homo sapiens
actgcttattaaattaaatgcaattttccaattcattaagtataatcggtgatctccaaggttctgtccactgctaagattcaggacactcatttaaggtggaacaaaaaaggtagcatctagtaagtgccaaccacataaaggtactgtagcaggccctctagacatattatttaactgcagaatggaatgatgtgttttcccctctttaaagacaagaacactggaactcaaagaatttaacttgcctatgatttcaccgtgagctgagaagtggcagaggtaaggagtgaacttttttctactcttatataaacttccaagtttcagtgacatgctctaaggaagagtttaaaaagaaaaattcaacatccacctttcataattaaaatacacaaagacaagtaaattcataaggttgtccttattcacagtaatgattacattctgccataagggatttggaaatggtatttggcttgctttcattccacacttgtgtgccaaggtagttcctacgtgcgttcaaattaaaccaaaattctctccccg

SEQ ID NO: 36040 - DNA, 613 bp, Homo sapiens
gtgtgaagaaataagaagaatcagtgatactcctagacattggagctcagtgacaggaaacagtaatcatgttgtcgtctactgagaagggcaaggatgaaggaatgagcaggtttgggcaaagaactaagaattgagtttttgaatgtttgtttttagactctaagcagaatccaaatggagatgctcagtaaggagatggatatctaggtcgagagctcaggcaagaggctgagagtaagaacataaatccaggagtcaccagaatacgctagacaagaacactggaactcaaagaatttaacttgcctatgatttcaccgtgagctgagaagtggcagaggtaaggagtgaacttttttctactcttatataaacttccaagtttcagtgacatgctctaaggaagagtttaaaaagaaaaattcaacatccacctttcataattaaaatacacaaagacaagtaaattcataaggttgtccttattcacagtaatgattacattctgccataagggatttggaaatggtatttggcttgctttcattccacacttgtgtgccaaggtagttcctacgtgcgttcaaattaaaccaaaattctctccccg

SEQ ID NO: 36041 - DNA, 802 bp, Homo sapiens
gacaccgggagagccaggagcgtggacacagccagaactcatcacagaggctggcgtccagtcccgggtcacgtgcagcaggaacaagcagccactctgggggcaccaggtggagaggcaagacgacaaagagggtgcccgtgttcttgcgaaagcggggctgctggccacgagtgctggacagaggcccccacgctctgctgcccccatcacgccgttccgtgactgtcacgcagaatccacagacaggaagggaggctcgagcgggactgcggccagcgcctgcctcggccgtcagggaggactcctgggctcactcgaaggaggtgtcaccatttcagctttggcttttcttcttcttttaaattttctaaagctcattaattgtctttgatgtttcttttgtgatgacaataaaatatcctttttaagtcttgtacttcgtgatgggagccgccttcctgtgtccacgcgcctcctgcccccggtgggaagcacggtcaggaggaggctggtccagctgcacctcgggggctccctgcactcgccccccgcctcctgcagccacacgcattgcccgagcggccctccctggcccctgtcgctacatggacccctggggcttctcctcttttctacatggatgcagtttctcctcctgctgggcacggtgctgcctgccctggtcactctgcgggggacagggcctccagggaaagctgggtcgaggctgggagctggctcaggctggccaggcagagccacagggagggccttccagaaccaaccatggtgtgaagcg

SEQ ID NO: 36042 - DNA, 815 bp, Homo sapiens
catttctctagtgacagccaggcttcttgaaaacactgtctgtgtctaacctcccattttttccttactcctctagacctggaatctggcttctcaccctacacccatcacaatcactgaacaataactgctttttacaggactacttctttggtactacatttggtcctcacttctctatttccctccttcatagcttctttggccccacattcaattgtctagttacttatcgtgggcctcctctgtggatcactcttcctccactgcttcttacatgctgatgttccccagcattccatcccctggcttctgatcgctgggcaaatctctcaacatgaccacatgtcctcccctagtttcagcctcactcacatgcagatgactcctagatctgtctcctgaaggcagctctgtgtatccagcaccctactggacacctcacaagtcttaggttaaatgtacaaaactggatccatttttacctattgtttttctacctactcttcttattttctcagaggcagtgaatagcagcaccaacaccaattcttattttctttgtgatccctttgtctcctcccatatccagtttctaaattttatcaagttcactatagccttcatatcctcaaactaaccacttttctctccatcttcattgctgaaatctctcatctgctcttgccttctcccatttggcttgatcttatcattcatacttttacatgctcttattgtcattctagtgaaattttgaagagagaagagataacttgtgatgaattcattgtgtgacacggaagtatgtagtc

SEQ ID NO: 36043 - DNA, 1189 bp, Homo sapiens
ttccaccaccatctctgcccatcactagggctggaggcagagaaaaacttcccctactcaagaaaaagaagctatttttgtcaagttaaatgagcctgaacctgcagagctgaattggcagatgaatattgctaattggtgcagtttcttcggtgcaggaaagagtttccaatcagaccggcaattcattggccacatgaagaacagccagttgtaaggggtaaaataaattggagaagagaacatccacatggattaagtcccaagctcaccctttgttagtgagaatgtagtcacgtggccatacctactacaaggtctatttctggcatctctttccacagcacaggcagccttgcagaatgaaaagtatttctcccacctgccctggcctctgccctggctctgaaagaggcaggctgtgaatgatggttgtcagtgtctggagttttcactgaaaaacagtcccctgaaatggaaagacacacagaggggagtgatctcatcgccactgatttttcccaactttcagttttgtatctccatggtggaactcgatacagcagcatccctcagtggttccagcccagaagtgcaaggggaagccggctgcctgttcatgaattctgtagctcaaaaagcagaggccgagaaagcaaaatttcaaacctttgtcagaaagggtgagaccttgctcagcacgatagctgagaacagcttcctccttcaatgctggtctctctatactgacagttgacagctgatgatcccacattctcagtcatgcgaatgacctcacctgagcaccagtttgtaacggatgtttaagaggaaagcaagggaattaaatgctgcacaggaatttggcacttctgtatagaaatagaaaaactaaatgaaacttatagtaccttccactcaactaagattcttgtgaagcaaagtatatctgggaaaatatagtaatatggttattttgtgttcatagtgtgtgactctacttataagcactttttaatcattataatcaatcactttaaagatcttagagggaacttattaatcaaaatttaagccttctttaaaaaaaaaaaacttcccatatactaattttgcacagaagcaaaagattagattgggattctgcctgttgtggagagacaaagacaagagtgctccagaaaaaaaa

SEQ ID NO: 36044 - DNA, 379 bp, Homo sapiens
aacagccagttgtaaggggtaaaataaattggagaagagaacatccacatggattaagtcccaagctcaccctttgttagtgagaatgtagtcacgtggccatacctactacaaggtaggctagaacatataatctcattggatagccatgatattgctacattaacatataagaaggggagatgaattttggtggacagctagcattctcctcatttaattctcccttctcagtactcaactttgtgttcagatctagcacagcagtcagctctgctaatcagacaagtaagaggggatgctcaaagtgggaggatccatttaatacatttttgtccaaatagacacattatttaaataaaaataaataagttattgt

SEQ ID NO: 36045 - DNA, 327 bp, Homo sapiens
gagggtagcttgcatgtaatgaaataaaatccaggaaaattttcaaatcctcaaaagggctaagaatcttggacccgtttcttttcctttttgtgtgtgtgggttctgttttctgaaagaaggtctccctctgtggcagtgcagcagaggcattatcatagctcactgcagcctcgacctcctggtctcaaacaatcctcccatctcggcctcccaagtaactgggactacaggcatgcaccaccacacctggcttttttttttaaattattttttgtagagatggggtctcaccatgttctcgaggctaatctcgaattagcctca

SEQ ID NO: 36046 - DNA, 447 bp, Homo sapiens
gttctagtttgcctaccacttatttagagcaaaggaatcttgataatatactgtttccaacgaagagtactattttttctctgattttattggcttaagcaagtactatttcaatggtatgactttctttaaatataattaggtagagggaacagcaagtacacaagctccaaggcaggaacaaatttagattgtcctaaagaacagggaaaaaatatcaaacatgggagtaatagaccaagggaagaatattaagaagagatgagaggagtagggcctaggggccataagaagttaagattttaagtgaaataagtgctggccaggcgtggtggctcacacctgtattcctagcactttgggaggctgaggctggccagttgcttgagcccaagaattcaagactggccttggcaacatgatgaaaccccatctgtacaaaaaaaa

SEQ ID NO: 36047 - DNA, 488 bp, Homo sapiens
gccaacatggtgaaaccccgtctctactaaaaatacaaatattaatcgggcgtggtggtgggtgcctgtaatcccagctactcgggaggctgaggcaggagaaccgcttgaagctgggaggtggagattgcggtgagctgagatcacgctactgcactccagcctgggtgacagggcgagactctgtctcaaaaaatagaaaaagaaaaaaatgaaacatactaaaaaacaattcactgtttacctgaaattcaaatgtaactgggcctcttgaatttacatttgctaatcctggtgattccacctctctgttgttcccattttacagaaggggaaacgggcccaggggcagggagtgtggagagcaggcagacgggtggagagaagcaggcaggcagtttgcccagcatggcacagctgctgcctcctattcctgtgcaggaagctgaaagccgagctactccacacccgggtccgggtccctccag

SEQ ID NO: 36048 - DNA, 411 bp, Homo sapiens
tgccaggaattggctaattgaactcgtggcagatttaccatgagacacagagaaatgttttgagacagacattttcatatatattggttagaaatactgtttttcagaaggatatgttttaggttacagaatcaaaatacggtcacgtgcctcataacgacgtttaggtcaaggacagaccgcatttgcaacggtggctccataaggttgtaatggagctgaaaaattcctgccgcctagcgacgtcttgatcttgaccctgtgtaggcctagggtaatgcgtttgtatcttagtttttaacaaaagttaaaaaaaaaatagaaaaaagcttatagaataagaatataaaatttcttttctatagctttaaaatgtgtttgtgttttaagttaaacgttattacaaaagag

SEQ ID NO: 36049 - DNA, 689 bp, Homo sapiens
atgaagtaaaggaaattcttcattgggagcttaaggaataaaatgggtgaaaaggtatggagcaatattgtaaaatccaccttttacatcaccattattaaagatattactaattttaattacaaattataacttttaaaaaatgtaattatgaatgagatgcaactgaatgctgaagaatatctcttgacctcttctgtgttgtccttccacattataaaaattgatttatttttgagaaggaatgactcaaggctgtagagggcagtataagccaactcaagtggactttcctgggttagtgaagtggtacaactgttgttactgtccaagtgtccagttaggtttgataccccaagtatctgaccactggccattagaattgtttcagacttaaaaataaaggaagataaaatggaaagtgttttagaaccaaagaatcacataaacccacaaaaaggtggcaattatgcaacagctgtttccacccttagaaattcttgtggcaaaaccaaagccattacctgggataatcccagcctaaaaacaattcgtctcagtgaactttatggataaagtttcttgttaaagaatttactttcttttacttgtctagttgtataatttcaatttaaaaataggtaaaatcctccaccgtcctccccttttcctctctctaccttcaccaa

SEQ ID NO: 36050 - DNA, 409 bp, Homo sapiens
tttttaaaaattttattttaattgacaaaaattgtatacatttgtggtgtacaacgtgatgttctgaaatatgtattaattgtggaaggaccaatcaacctaattagtcaacacatgcattactgtcagaggcatttgaaccagaacaactccatcttgagtaggggctgggaaaaagacctgataaactgcattcccaggaggttaggcattcttagttacaggatgagataggatgttggcacgagatacaggtcaaaaaccttgctgacaaaacagggtgcagtaaagaagccagacaaaacccaccaaaaccaagatggcggtaagagtgacctctggtcgtctcactgctacactcccaccagtgccatgacagtttacaaatgccatggcaacataagcaagt

SEQ ID NO: 36051 - DNA, 935 bp, Homo sapiens
cgctcagtcagtcaggcccgcgccgccgcctgtcagcgcgtctgaggaggcagcgccgggcgccccagccgcccagcccgcgcacgccccagcggccggccggagcccagacccccgcgaagaccccgcgcgcagccgcgtcccctcccccgccgctgaggagctgccgccgccggcatgagcagagggaggcgggtcccggagagccccctgcctcgcgcgcggcttggagtttgaagggccccgcgccgagccccgccagcgccgccgccgcctgccttcgcccgcctccttccctccctctcgccgctgccggggacgggagccgcgcgccaggccgggcggcgggtggcgggctgcgcgccggggttcatgagcctccgggcggcccgcggccccgggagcctgctgccgtgactcaccccccgcccccgcttgtgtctcgtccctcccggcaggatgccggaccagatctctgtctcggagttcatcgccgagaccaccgaggactacaactcgcccaccacgtccagcttcaccacgcggctgcacaactgcaggaacaccgtcacgctgctggaggaggctctagaccaagatagaacagcccttcagaaagtgaagaagtctgtaaaagcaatatataattctggtcaagatcatgtacaaaatgaagaaaactatgcacaagttcttgataagtttgggagtaattttttaagtcgagacaaccccgaccttggcaccgcgtttgtcaagttttctactcttacaaaggaactgtccacactgctgaaaaatctgctccagggtttgagccacaatgtgatcttcaccttggattctttgttaaaaggagacctaaagggagtcaaaggagatctcaagaagccatttgacaaagcctggaaagattatgagacaaagtttacagt

SEQ ID NO: 36052 - DNA, 232 bp, Homo sapiens
tccgatcttggtctgagacaatgtcttctgcccagtttcaccggatgactcttgtcccctttttgtcctgccccctatccaggtcgttttctgatgtggcggctgagacatgagatcttcagcctccaggctctccagtttttcgtcgagagattcactatggaatcggtgagtgatctctagcccatcctgtccagaaaactcggcgtgggagatacagcgggattcttct

SEQ ID NO: 36053 - DNA, 1552 bp, Homo sapiens
cgctcagtcagtcaggcccgcgccgccgcctgtcagcgcgtctgaggaggcagcgccgggcgccccagccgcccagcccgcgcacgccccagcggccggccggagcccagacccccgcgaagaccccgcgcgcagccgcgtcccctcccccgccgctgaggagctgccgccgccggcatgagcagagggaggcgggtcccggagagccccctgcctcgcgcgcggcttggagtttgaagggccccgcgccgagccccgccagcgccgccgccgcctgccttcgcccgcctccttccctccctctcgccgctgccggggacgggagccgcgcgccaggccgggcggcgggtggcgggctgcgcgccggggttcatgagcctccgggcggcccgcggccccgggagcctgctgccgtgactcaccccccgcccccgcttgtgtctcgtccctcccggcaggatgccggaccagatctctgtctcggagttcatcgccgagaccaccgaggactacaactcgcccaccacgtccagcttcaccacgcggctgcacaactgcaggaacaccgtcacgctgctggaggaggctctagaccaagatagaacagcccttcagaaagtgaagaagtctgtaaaagcaatatataattctggtcaagatcatgtacaaaatgaagaaaactatgcacaagttcttgataagtttgggagtaattttttaagtcgagacaaccccgaccttggcaccgcgtttgtcaagttttctactcttacaaaggaactgtccacactgctgaaaaatctgctccagggtttgagccacaatgtgatcttcaccttggattctttgttaaaaggagacctaaagggagtcaaaggagtaagtgttcagaaatttgattttcactttaacttgaaaggattaattttttttttcctctttcaagatcatagtagtacttgtatttgaaagactctttgaacattttcagcgttaaaaatgctcttggaaaatgatcattggaaaaaatgtgcctcttcacataatggtattgacagaggaatgagattaggcactttcaagaagattgggaaggtcctccatgggtgggagagagaagctaagcccgagtcttggctcccacagtgtgaccactggggacccagcccttctgaacctcgggctcctgcttcatcagcatgaccagggcgcttacccttctttcctctctcaggcttcttgtgtatataacacatggtttgatgttggccaggcacagtggtcatgcctataatctgagcactttgggagaccatggcggcgggtaaattgcttgagcccaggagttcaagaccagcctgggcaacataataagacccccatgtctacagaagaagtacaagaattagccaggggtggtggtgagtgcctgtagttctagctactcaggaagctgaggtgggaagatcaattgagcctgggagttcaaggctacagtgagctgtgattgtggcactgcactccattctaggcaacagagtgagaccctgtc

SEQ ID NO: 36054 - DNA, 352 bp, Homo sapiens
tcttagctcctcactcacatgctttatggttctgcacaaatgactccacctctgttccctcagctgcaaagtagtgataattgtgtcgcctaacctacagaggtgtcatgtaggttcaatgaaataatgcatggaaagcccttcaacagagcctggtgtgtggaaaatgctcagtcaatagtagctggttttattgttcatgtggactttattttttaaccatctcccatcttccctttgctttttcagctccagggtttgagccacaatgtgatcttcaccttggattctttgttaaaaggagacctaaagggagtcaaaggagtaagtgttcagaaatttgattttcact

SEQ ID NO: 36055 - DNA, 395 bp, Homo sapiens
tctttttaagtaccacccaccaagtgagaacccctgagttagtgttatttcccttttgtgtgatatcattcctgttcatattcaattttatggaatttttcacaagatgatgcctttaatttggcaatttaggtttaaaatttatttttatcttccaaaataatcagaaaccctctgacagtaattgcatcaaatcattaagactgagccctataggatacaacatgatcgaagctcctctcattttattaaggtttcttgcagggaaagttactgacttattttgaacctgcttaatagtaataaagttggctggacatggtggctcaggcctgtaatcgcgccactgcagtccagcctgggcgacagagcaagaatccgtctaaaaaaaaaaa

SEQ ID NO: 36056 - DNA, 515 bp, Homo sapiens
ggtgggaggattgcctgaggccaggagttggaggctgcagagagctatgatggtgccactgcactctagcatgggcgacaaaacaatagtcttgtctcaaaaaaactaaaaaagactaaagtgaaattgaaattcagagagtaagtgacttcaaggtagaggcagaaacagaggctggatttgaattcgatcctctggctccagagctcctgggagttatcttgggaatgactgcaaggtctgaggtagatcgttccaggagcaggtgcttatatacagtggaatggcacccactggcacaccactaggaattctgttttcttaccaccaccggagccaggtctctgtcacggtgatgagaagttcccaaagtcatttctcctctctagggtgtcccctctctgtctgctgccactaaatccctaacgacattagagcgaataaatggcatttttaacttcagctttaagcaacaaagaaatactattaagtcaagatgtgtccatctttaccat

SEQ ID NO: 36057 - DNA, 311 bp, Homo sapiens
tccaagtcctggagatacatttcaattaaaatagcagtcatcaagatacccttggaatctctgaattatagctcatctatctagacaaccttacttcaaaatgtggaccacacctgttgctgctttaaagaatgtatgtatattaatacaaaatacttagtaactagatcttttattctaaagctacggtttttaaactttattttagtcttgggaccctgtctttaagcaaaaattaacccagagtcaaacatgcaaaacagataaaagagataaaagaagccccactttggttcagactgtgtatgtgt

SEQ ID NO: 36058 - DNA, 254 bp, Homo sapiens
gagtataattctcaggttgtaatttcccttgtcagttacaaatgatcctcagaagtcagtcctgcaacagcagtgacaaactgattcctggttatttgccaattacctttttaaaacttaggctcagttttataattagatcagccctgaagggaaactccttactagatgtgctgcattagacttaatttgcatggaatattaacagtatctggaggcttactttcccttgtatgcatgtgaccacataactg

SEQ ID NO: 36059 - DNA, 312 bp, Homo sapiens
gacacacaaccaaactctcacacgtgatatgtttaagtaaacaataaatcaccaatcttgttgaaactccaagaatgtgatttgaacccatttgatttctagtgagctgccttgaaacattaaggacatggaaagctgaaaagaggttgacccagtgtttcagcaatttgagttgtggttctttgtagcagtgtgtatgttggggagatgttcacaggctcatatagaaaaaagaccattaggaagaagcatactttccagattgtaggtggtttatggaaaggaaatctaatttctagaattaaaaaaaaa

SEQ ID NO: 36060 - DNA, 346 bp, Homo sapiens
catgaagctggaactgtagccagctctaagttcacttcatgccagatgcataagcaaaggagaaaggatctccaattacacctcgcaaaccgacattcattctgtgcaaatgagaaatatctcaggggaggactcaggcccgacttgggccacacacacacccattggccagtcactgtgaaacaattttgtagactggttgtgagggcagaagtagaatttaacaaccttttctggaaccacataattgaaggaagggggaaaagttccccctaaatgattttggacgcacagttaccagaagaagagataaagataaggagaagaaaaaggaaaaaataaaaac

SEQ ID NO: 36061 - DNA, 505 bp, Homo sapiens
ctaagggacagacctggtgccactggccaactattggccttgttccctaagctctgcaaaccccagtctccaagcatcaaatgggaatgataatgatatctgacctcagagttggtgtgtggaacataaacagagtcacacagctcaggtccttgagcacacaagcaggtgctcagtgagtgtcaggctttatttttgggtaatccaaagctgtctgcaaggggaactccactttgctctgtctgagctacagagaccttgttttcacagatcagggcatcatgaccccaggttctccatttggctgtgcccctgacttctcctctctattacctttgctcagtgctagggatactcatgcaagcgtgcaggtggaagcctaccaggggcgagaagtacacagagaaatctccaccctgctgaagaaagcagcagcattaccacgcaagagctccagagaaacctcttttctcagaactgctggctcagcggagcaaaggtgact

SEQ ID NO: 36062 - DNA, 534 bp, Homo sapiens
ttaaacatagtgatagtgaaactcaatgtcaaatattctacctcattgtttccattagatgaattcatatttgatttggctatgtgccaagatttgggttgtagaaaaaaatgttgaacacaggagagattgtcctgaaaaaagcattgtgactgggtgggttggcccttccaggaagccagggagtgttgactagactgcagcacttcccaaacgttaatgtgtaggaacttcccggagatcttgctaaaatgcagattctgacgcatttctaacaagctccctgtgatgcagaagcagctgatctgtgggtacattatgagtagcaagggactagaggataatagtgtcttaatgctggtggcatttgtcactaataaatgttaacaatagctaccatgtactgcgtgccaactatgagacatgaagtcacagagctagtaaggaaggttgctagaaactgtctctgaaatgtatgctcttgccaccactccaagccggctcactgcagggtactggggtgagtgggaatgc

SEQ ID NO: 36063 - DNA, 375 bp, Homo sapiens
tcgaccaccatgcttaaccacaaaagaggtccttttatgccagagtctcgctctgttggccaggctggagtacagtggcatgatcttggctcactgcaacttccatctcctgggctcaagcaattctcctgcctcagcctcctgagtagctgacattacagattttaaaaaggaagaaaaatcatatcaagttatcagttggcttgcacctgaagatcatcaaagagaatttaaaaagagttttgatttctttctggaagaaactttaggtggcagaggaaaatttgaaaacttattaaatgttctagaatacttggcgttgcagtgcagtcattttttgtggttaagcatggtgacattagtcgacgcggccgc

SEQ ID NO: 36064 - DNA, 620 bp, Homo sapiens
cagctcttttggtagaacattcagctgttaggacaagaagctggtgtcttacctgtcacccacacccagaacagcacctgataattcagttatctccccctaccttttattgttttatcgctctgaaatgggggatctcaataaaataaagcaagggcacccttaaaccattttaaccctatttccatcacaagaatttctctaagacaagtctctgaatattcccatatatggagctcactgtctattgggatagaaaaataaacataagtatgtcccaaatgttacatgggacatacttacactaagaaattgtcatttgtctgaaattcaaatttaactgtatcctatatttttatttgctaaatctgacaaccctacttcaaggacaaggcaagttacacaggagtgacatggggctaagagcagagagtggtgcaagctgtgaaaatgagcacattccccaatagaagggcatttaaatacttttttttttttttaaatcactacacaccaacaaaatacatctgcatctgaatgtggcttgtggaccaccagtttccaatcttggctgtaggacagctctgaatatcagaaattgttttttagattgagccaaa

SEQ ID NO: 36065 - DNA, 463 bp, Homo sapiens
ttcatgaaaaagcctcgattttgctaattttcattgtgtaaatacttcaccatggctgagttccagctatctacatgacacctctaaacagagttgggaatgttgtacacaatcagctctcaggagctggtgtaataaagacattgtatcatttaaccattggaaaacagcactggttactcggaacaagaatgaaaaagacaaatgactttttaaatatttttaaatttgtaattgatacataattgtatggacttttctgtttcttttgattttttgtggagatgggatttccctatgttgcccaggctggtctcaaactcctgggctcaagcaatcctcccacttcagcctcacgcctgtaatcccagcactttgggaggtggaggcgggcggatcacctgaggtcaggagttcgagattagcctggccaacatggtgaaacccgtctctactgaaatac

SEQ ID NO: 36066 - DNA, 676 bp, Homo sapiens
taaacatagtttgtaggttctcatgcatagatactcttaacaaatgaatacttagcattgcttttttcaagcaacaaatatattactttagctttctcagagtaagattacaaaattgtggaacttactgggttttgtaggaaaagctagtttctaattaaactcttaatctatttttagtgctgagtacatattgagaaggtagaatatttccagtggcctggttagaaatacttttcattgcacaaccaacatgaaaggatgacttatttccatgccagctgtcctcagttttcctgaccttaatggaacatattagatccagctgctggaatatttactctaatggaataaagcagttggattctttccttgcctattttccaaagaggacagtgttgaccaaaatatgtacttgttggtagcactagaagatcttcatgatagatacagttgacaacttttaaaataattgtctgtcccaatggggaaaaatgtatataatacacagaacactaggttaatatccagaatgcagacatattttcatatattcttacatctttcttatccccaaatactggacttcaccttcttgtcagtgtaaacctccattacaggaaacactgaggaaaaggaagtacccaccagaaatcatcttacattgcatatattc

SEQ ID NO: 36067 - DNA, 1083 bp, Homo sapiens
aataattaggaagactaagcagccccagagataagacctcatgggatcattgttacttcttatggagtgataaagtgaccttcctcgaattgtatcaatccataaccaatcaagttgctgcaacctatgcactgggcttgaatgaaagctgtcatgattctgctaaagattctctgtctttccctgtgtgtgaaaccttaacgtctctactttggaacgccgatctcatttatttggagttggtgtttccaggtggctttcttcaagctttgtgttcacataaactcagtacttaatcttacattctaaattttattatttactgctgacgtcagtttctgtcggattgtaggcgcctgaccagagagggcacgcgtcgctatgttgtaaaactcacactcgtcaaaaagacatgggttagggttttccccctccctctggatgaagctaattagctgacacagatggtcacctccattaccaaatagagccaggatgaactatgtgtgaccaagagtgttgtcaagtcctcttccctgaggactgattagtgtttatcttgaaaacatgtactcaatgggttgtatagaacagtgaagtttccttgtctcttttcaacctcttagctgtttgcctcaatttcccatcacattctggtttaaggcttacttattaataatgtggtttttatttctttcactattatcatcgtgaagatgatttctcattggggggaagattttttttgttttccattatattttctcaaaatttaaagagtaaagaaatgaatattttttgggccaggaagtgtggcttatgactataatcccagcactttcagaggctgaggcagtcagatcacttgaagtcagaagttcgagaccagcctagccaatatggtgaaacctcgtttgtatcgaaaatacagaaattagccgggcatggttgtgcgcgtctgtaatgtcaactactccggaggctgagacaggaaaatcggttcaacccaggaggcagaggctgcagtgagcccagatctcgccaccgcattccagcctggccaaaaaagaaaactctgcctca

SEQ ID NO: 36068 - DNA, 229 bp, Homo sapiens
gggtttcaccatgttggccaggctggtcttgcactcctgacctcaagtaatctgcccatctcagccttccagagtgctagtattataggcatggttgtgcgcgtctgtaatgtcaactactccggaggctgagacaggaaaatcggttcaacccaggaggcagaggctgcagtgagcccagatctcgccaccgcattccagcctggccaaaaaagaaaactctgcctca

SEQ ID NO: 36069 - DNA, 937 bp, Homo sapiens
ttaggtgtctattactgcaaaacaagttacctcaaactgtgtggtttaaaacaagcttttatcaactcacgtattttcgaagggttaggaattcaggagtatcttagctgggtggcactactacctcagaatctctcaggacatggcagccaaggtgtcaaccagagctaaagtcatttgaagacttgagctaggcctggaagatttgctcctaagatggttcattcaacatggttgttgccaagaggcccctgttccgtcccccatgggcctctctatatggatgcttgagtgtcctcatgacacggtggctaatctccctgcagtattaaacaataagagagaataaagaggaagccacaaagcctgtttgcctcagtctcagaagtcaaacactgtcactttgaccttattctattaggagccactaaatccagtcaagtctcaagggaagtgggaaggggtattgactgaaccccaccttttgaagagactgtcaaaaaatttgtgacatatatttcacctccacagacctttaccatctaaaagtcgatgacacaatttggattattctcatcatatctaactaaatcaggcatcgagggaaccaggggaaaaaagcacttggggcacatagcacccaattcaagaattatcctcaaacccagctactgaaaggggctgctgtaaccttaacaccagttttacctcacggctgttgaagtgacccactatgactctaagagtaattttacctaaagccatcactcactaatcagagcttgccagctcccagaaacttgctaatattaatgagcattttttttcaacacaatacagaacgtttctctttttaataaaactcccaaccttctctttgttctttggacacaacagagaccaccatggtctatgtgtatgccccaaattgcaattc

SEQ ID NO: 36070 - DNA, 773 bp, Homo sapiens
cagcatttaggaaaggggatggcaggagcggctccacagccatctttcaggacacctgcttgctggggtgcagttagaatacagccaccaagttgtgactccctcccttccagcctgccaggtgattggacagtgtggacacgtgtccctgtccagccaggctctcagagcctgtggcactcatttattcctcagaagtgtgtctgtcctttcactcaggaacatttgccaagtgtgtcaaatgggccatgtctgctaggtgctagaaaaccaaacacaattgaggcaccgccctggaggacctcaccaaggacaggggtaagctgggcacgaaggcagacatcttcacaggtcaacccggtgctggtcaggagccatgactataggagctggagggagcgaggaggccaccatgcgcagcccagtggccctccttttccagcctgagccagcactgtcaggcgtagagcgtctcggattctgcaggtgcctgggtgggaacaccttggtatttctctcaccctggggtcttgtaccacttgtcagcttggagcgggagcttggtaacagttgggcaacttcagcactctgggggaaagaagtgcattttcagaagcgtagggacagtcaggagaaatttgctcaaatgttgcttgggcacagtggctcatgcctgtaatcccaatgacttgggaggctaaggcaggaggattgccttttaggccaagaactggagaccagcctggacaacatagtgagatccacctccaaaa

SEQ ID NO: 36071 - DNA, 432 bp, Homo sapiens
tttaggtcctccatataactgcggcacacagcagatgctaacaaacatcacttcctcttataatgagatagattttacatattaaggcttgctttgtgcctaccagaatgtcagctccatgaaagcagaaatttttgcctgtttagttcaccactgtctctccattacttatgtaacagaatctgccacctagatgtttgaaaaacactttttgaataaaccaggtgccatatgagcaattacatttatcatgactgcatcctcatagccacctggtgagtcaggtacacgaattatacccattttacagatgagaaaaacctggcccgggaatttaacttccgtctcagggtctcgcaaccagcaaggggccaagccaagatttaaatccatttaaagtcagtcttaaacctgactctgaatcccatgctc

SEQ ID NO: 36072 - DNA, 296 bp, Homo sapiens
ggaaggctaagagttttacctgtagcccctgaagtgctatgtcttagaggagtaaggatgagatgggattaggcaagtcttttcaaagacaagtccagcttcaaatcagagaatctgctgatcagcttctattctatttgcccaggcagagcaaaatatattcaattttaatatattaaatttttataaatttttaaaaatttaaattgtaaactttcaccaaaggaaagttacactatccaaactctaaaattacttcttcaggttttcatagaagctataaaaacttacatata

SEQ ID NO: 36073 - DNA, 379 bp, Homo sapiens
ttactcaattctttactgattttccgatttttaagctatttctattaacatacacaagtcaggtctgaattgcataaacatcttttttattagaaataaggtagccattctcatctatcttcaagtgctctgaatctgtatttttgctttaaacatgaaaccacaggccaagtttcgtttctcatttaccacttctccacctgagttgtcagttttgcttttgctctaactcaaggccaaatgaaagggcatctcattaaatcactgtgctgggcaaggttcatgtaaagttatctactttgctttgcatacttttttttagtttgtcatttggaaataaatttaaacctaatactgttcaagatgtgttcttgtgttt

SEQ ID NO: 36074 - DNA, 2285 bp, Homo sapiens
attattttgcaggagtctacacccaggcggtggctatacttattaaagttggcgggagctgagcgatcagtcggtcctgggctggctgtggtgtagggcgttgcaggcagcgctcacctcctcaggccggcagaatgcgggtggctgtggctggctgctgccacggcgagctggataagatctatgagacgctggcgctggcagagcggcgcggcccggggcctgtcgacctcttgctgtgctgcggcgacttccaggcggtgcgcaacgaggcggatctacgctgcatggccgtgccgcccaagtatcgtcacatgcaaaccttctacaggtattactctggagagaaaaaggctccagttctcacgctcttcattgggggaaaccatgaagcctcaaatcatttgcaagagttaccctatggtggctgggtggcaccaaacatttattatttaggtttggctggtgtggtaaaataccgaggtgtaaggatcggtggaatctctggtatctttaaatctcatgactatcgaaaaggtcattttgagtgccccccttataattcatctacaatcaggagtatatatcatgtgagaaatattgaagtctataaattaaaacagctgaagcagcctatagatatattcttgtctcatgattggccaagaagtatatatcattatggaaataagaagcaacttcttaagactaaatcttttttccgacaagaagtggaaaataacacattaggaagtccagctgcctcagagcttttagagcatctcaaacctacttattggttttctgcccaccttcatgtgaagtttgccgccttgatgcagcatcaggcaaaggataaaggacagacagccagagcaaccaaatttttagccttggacaaatgcttaccacatagagattttcttcagatattagagatagaacatgaccccagtgctcctgattacttggaatatgatattgaatggctcactattctcagggctacggatgatcttattaatgtgactgggcgcctgtggaatatgccagaaaataatggcctgcatgcaaggtgggattatagtgcaacagaagaaggtatgaaagaagtattggaaaaattgaatcatgatctcaaggttccatgtaactttagtgtaacagctgcttgttatgatcctagcaagccacagacacaaatgcagctgattcataggatcaatcctcagactactgaattttgtgcccaacttggcatcatagacatcaatgttaggcttcagaagtccaaggaagaacatcatgtgtgtggtgaatatgaagaacaggatgatgtggagagtaatgactctggagaagaccagagtgaatataatacagacacatctgctctgtcttctattaatccagatgaaataatgttagatgaagaagaagatgaagatagtattgtaagtgcacatagtggcatgaatacaccatcggtagaaccttctgatcaagcttctgagttttctgcaagtttctctgatgtcaggatcttgccaggctctatgattgtatcttctgatgatacggtggattccacaattgatagagaggggaaacctggtgggactgtggagtcagggaatggagaggacttaaccaaggtgccattgaagaggctgagtgatgaacatgaacctgaacaaagaaagaaaattaagaggaggaatcaagccatttacgctgcagtggatgatgatgatgatgatgcagcttaagatgatttacttgttttgtttttgtgtttgttttgcttttttgagatggagtttcactcttgtcacctagactggagtgcaatggcgtgatctcggctcaccgcaacctccgcctcccaggttcaagcaattctcctgcctcagcctcccaagtaggtgggactacaggtgcccgccaccacacccggctaatttttgcatttttagtaatgacagggtttcaccatgttggccaggctggtctccaactcctgacctcaggcgatccacctgtcttggccttctaaagtgctgggattacaggcgtgagccactgtgcctggccgacaatttacttgtcttagtattatatgtagatatgtgattttttgagactgtatttttagagctgaatttttgactaaagacttaactttataataatgaagatacattagagaattttagttagatattgactttatctttaggcttttgtatgtttcagatgcaaacatattaaagtttcatatattt

SEQ ID NO: 36075 - DNA, 2142 bp, Homo sapiens
tttaagttctgccagtttacttttaagctcttttgtttatctttaatccttgggttatatgctttgatttatgtgtgttcaatgctttgagttaacgtcatcatcatcattagtttttgccttgaattttgtatggaaattgaaggtctgagaagttaaatgccttctcttttatcacacaagtgggtatagaattaacttaattttggaaaagtaacagtcattcctttgacacacaacttaggggtatgtgtgataaagattattttcatcctattccgtgtatgaagaatcacctgtggttgttttaacattctttcttaaatcatgattcatattgtccaggcaaaggataaaggacagacagccagagcaaccaaatttttagccttggacaaatgcttaccacatagagattttcttcagatattagagatagaacatgaccccagtgctcctgattacttggaatatgatattgaatggctcactattctcagggctacggatgatcttattaatgtgactgggcgcctgtggaatatgccagaaaataatggcctgcatgcaaggtgggattatagtgcaacagaagaaggtatgaaagaagtattggaaaaattgaatcatgatctcaaggttccatgtaactttagtgtaacagctgcttgttatgatcctagcaagccacagacacaaatgcagctgattcataggatcaatcctcagactactgaattttgtgcccaacttggcatcatagacatcaatgttaggcttcagaagtccaaggaagaacatcatgtgtgtggtgaatatgaagaacaggatgatgtggagagtaatgactctggagaagaccagagtgaatataatacagacacatctgctctgtcttctattaatccagatgaaataatgttagatgaagaagaagatgaagatagtattgtaagtgcacatagtggcatgaatacaccatcggtagaaccttctgatcaagcttctgagttttctgcaagtttctctgatgtcaggatcttgccaggctctatgattgtatcttctgatgatacggtggattccacaattgatagagaggggaaacctggtgggactgtggagtcagggaatggagaggacttaaccaaggtgccattgaagaggctgagtgatgaacatgaacctgaacaaagaaagaaaattaagaggaggaatcaagccatttacgctgcagtggatgatgatgatgatgatgcagcttaagatgatttacttgttttgtttttgtgtttgttttgcttttttgagatggagtttcactcttgtcacctagactggagtgcaatggcgtgatctcggctcaccgcaacctccgcctcccaggttcaagcaattctcctgcctcagcctcccaagtaggtgggactacaggtgcccgccaccacacccggctaatttttgcatttttagtaatgacagggtttcaccatgttggccaggctggtctccaactcctgacctcaggcgatccacctgtcttggccttctaaagtgctgggattacaggcgtgagccactgtgcctggccgacaatttacttgtcttagtattatatgtagatatgtgattttttgagactgtatttttagagctgaatttttgactaaagacttaactttataataatgaagatacattagagaattttagttagatattgactttatctttaggcttttgtatgtttcagatgcaaacatattaaagtttcatatatttacttgactgggtatcttttttttgaagacatacattattcacttccatttttacaataaacacttacttaacatctactctgtgccaagcactctgctataatatgggaccataaagatgagtaagacaaggatttttgcctccaaggacttgttatcactgtaaacattttgatgtatacaatatggctatattatattttgttttataaaatcaagtctttgtatatattatgatgtatgctttcttttcatttattataaatatttttcctgatcagcttttaatatctgtcaaataaaaattgaaattgaagatggtatataagatttcaggaaataaactactctgaatactaaa

SEQ ID NO: 36076 - DNA, 395 bp, Homo sapiens
gacccaatagcaggcgcacagggtcttacttaacatctactctgtgccaagcactctgctataatatgggaccataaagatgagtaagacaaggatttttgcctccaaggacttgttatcactgtaaacattttgatgtatacaatatggctatattatattttgttttataaaatcaagtctttgtatatattatgatgtatgctttcttttcatttattataaatatttttcctgatcagcttttaatatctgtcaaataaaaattgaaattgaagatggtatataagatttcaggaaataaactactctgaatactaaacattggtaaacgtacaatcttaatttgctgagattagtataaccctgctgacttttgcatattgagttttttt

SEQ ID NO: 36077 - DNA, 2718 bp, Homo sapiens
attattttgcaggagtctacacccaggcggtggctatacttattaaagttggcgggagctgagcgatcagtcggtcctgggctggctgtggtgtagggcgttgcaggcagcgctcacctcctcaggccggcagaatgcgggtggctgtggctggctgctgccacggcgagctggataagatctatgagacgctggcgctggcagagcggcgcggcccggggcctgtcgacctcttgctgtgctgcggcgacttccaggcggtgcgcaacgaggcggatctacgctgcatggccgtgccgcccaagtatcgtcacatgcaaaccttctacaggtattactctggagagaaaaaggctccagttctcacgctcttcattgggggaaaccatgaagcctcaaatcatttgcaagagttaccctatggtggctgggtggcaccaaacatttattatttaggtttggctggtgtggtaaaataccgaggtgtaaggatcggtggaatctctggtatctttaaatctcatgactatcgaaaaggtcattttgagtgccccccttataattcatctacaatcaggagtatatatcatgtgagaaatattgaagtctataaattaaaacagctgaagcagcctatagatatattcttgtctcatgattggccaagaagtatatatcattatggaaataagaagcaacttcttaagactaaatcttttttccgacaagaagtggaaaataacacattaggaagtccagctgcctcagagcttttagagcatctcaaacctacttattggttttctgcccaccttcatgtgaagtttgccgccttgatgcagcatcaggcaaaggataaaggacagacagccagagcaaccaaatttttagccttggacaaatgcttaccacatagagattttcttcagatattagagatagaacatgaccccagtgctcctgattacttggaatatgatattgaatggctcactattctcagggctacggatgatcttattaatgtgactgggcgcctgtggaatatgccagaaaataatggcctgcatgcaaggtgggattatagtgcaacagaagaaggtatgaaagaagtattggaaaaattgaatcatgatctcaaggttccatgtaactttagtgtaacagctgcttgttatgatcctagcaagccacagacacaaatgcagctgattcataggatcaatcctcagactactgaattttgtgcccaacttggcatcatagacatcaatgttaggcttcagaagtccaaggaagaacatcatgtgtgtggtgaatatgaagaacaggatgatgtggagagtaatgactctggagaagaccagagtgaatataatacagacacatctgctctgtcttctattaatccagatgaaataatgttagatgaagaagaagatgaagatagtattgtaagtgcacatagtggcatgaatacaccatcggtagaaccttctgatcaagcttctgagttttctgcaagtttctctgatgtcaggatcttgccaggctctatgattgtatcttctgatgatacggtggattccacaattgatagagaggggaaacctggtgggactgtggagtcagggaatggagaggacttaaccaaggtgccattgaagaggctgagtgatgaacatgaacctgaacaaagaaagaaaattaagaggaggaatcaagccatttacgctgcagtggatgatgatgatgatgatgcagcttaagatgatttacttgttttgtttttgtgtttgttttgcttttttgagatggagtttcactcttgtcacctagactggagtgcaatggcgtgatctcggctcaccgcaacctccgcctcccaggttcaagcaattctcctgcctcagcctcccaagtaggtgggactacaggtgcccgccaccacacccggctaatttttgcatttttagtaatgacagggtttcaccatgttggccaggctggtctccaactcctgacctcaggcgatccacctgtcttggccttctaaagtgctgggattacaggcgtgagccactgtgcctggccgacaatttacttgtcttagtattatatgtagatatgtgattttttgagactgtatttttagagctgaatttttgactaaagacttaactttataataatgaagatacattagagaattttagttagatattgactttatctttaggcttttgtatgtttcagatgcaaacatattaaagtttcatatatttacttgactgggtatcttttttttgaagacatacattattcacttccatttttacaataaacacttacttaacatctactctgtgccaagcactctgctataatatgggaccataaagatgagtaagacaaggatttttgcctccaaggacttgttatcactgtaaacattttgatgtatacaatatggctatattatattttgttttataaaatcaagtctttgtatatattatgatgtatgctttcttttcatttattataaatatttttcctgatcagcttttaatatctgtcaaataaaaattgaaattgaagatggtatataagatttcaggaaataaactactctgaatactaaacattggtaaacgtacaatcttaatttgctgagattagtataaccctgctgacttttgcatattgagttttttt

SEQ ID NO: 36078 - DNA, 2583 bp, Homo sapiens
attattttgcaggagtctacacccaggcggtggctatacttattaaagttggcgggagctgagcgatcagtcggtcctgggctggctgtggtgtagggcgttgcaggcagcgctcacctcctcaggccggcagaatgcgggtggctgtggctggctgctgccacggcgagctggataagatctatgagacgctggcgctggcagagcggcgcggcccggggcctgtcgacctcttgctgtgctgcggcgacttccaggcggtgcgcaacgaggcggatctacgctgcatggccgtgccgcccaagtatcgtcacatgcaaaccttctacagcctcaaatcatttgcaagagttaccctatggtggctgggtggcaccaaacatttattatttaggtttggctggtgtggtaaaataccgaggtgtaaggatcggtggaatctctggtatctttaaatctcatgactatcgaaaaggtcattttgagtgccccccttataattcatctacaatcaggagtatatatcatgtgagaaatattgaagtctataaattaaaacagctgaagcagcctatagatatattcttgtctcatgattggccaagaagtatatatcattatggaaataagaagcaacttcttaagactaaatcttttttccgacaagaagtggaaaataacacattaggaagtccagctgcctcagagcttttagagcatctcaaacctacttattggttttctgcccaccttcatgtgaagtttgccgccttgatgcagcatcaggcaaaggataaaggacagacagccagagcaaccaaatttttagccttggacaaatgcttaccacatagagattttcttcagatattagagatagaacatgaccccagtgctcctgattacttggaatatgatattgaatggctcactattctcagggctacggatgatcttattaatgtgactgggcgcctgtggaatatgccagaaaataatggcctgcatgcaaggtgggattatagtgcaacagaagaaggtatgaaagaagtattggaaaaattgaatcatgatctcaaggttccatgtaactttagtgtaacagctgcttgttatgatcctagcaagccacagacacaaatgcagctgattcataggatcaatcctcagactactgaattttgtgcccaacttggcatcatagacatcaatgttaggcttcagaagtccaaggaagaacatcatgtgtgtggtgaatatgaagaacaggatgatgtggagagtaatgactctggagaagaccagagtgaatataatacagacacatctgctctgtcttctattaatccagatgaaataatgttagatgaagaagaagatgaagatagtattgtaagtgcacatagtggcatgaatacaccatcggtagaaccttctgatcaagcttctgagttttctgcaagtttctctgatgtcaggatcttgccaggctctatgattgtatcttctgatgatacggtggattccacaattgatagagaggggaaacctggtgggactgtggagtcagggaatggagaggacttaaccaaggtgccattgaagaggctgagtgatgaacatgaacctgaacaaagaaagaaaattaagaggaggaatcaagccatttacgctgcagtggatgatgatgatgatgatgcagcttaagatgatttacttgttttgtttttgtgtttgttttgcttttttgagatggagtttcactcttgtcacctagactggagtgcaatggcgtgatctcggctcaccgcaacctccgcctcccaggttcaagcaattctcctgcctcagcctcccaagtaggtgggactacaggtgcccgccaccacacccggctaatttttgcatttttagtaatgacagggtttcaccatgttggccaggctggtctccaactcctgacctcaggcgatccacctgtcttggccttctaaagtgctgggattacaggcgtgagccactgtgcctggccgacaatttacttgtcttagtattatatgtagatatgtgattttttgagactgtatttttagagctgaatttttgactaaagacttaactttataataatgaagatacattagagaattttagttagatattgactttatctttaggcttttgtatgtttcagatgcaaacatattaaagtttcatatatttacttgactgggtatcttttttttgaagacatacattattcacttccatttttacaataaacacttacttaacatctactctgtgccaagcactctgctataatatgggaccataaagatgagtaagacaaggatttttgcctccaaggacttgttatcactgtaaacattttgatgtatacaatatggctatattatattttgttttataaaatcaagtctttgtatatattatgatgtatgctttcttttcatttattataaatatttttcctgatcagcttttaatatctgtcaaataaaaattgaaattgaagatggtatataagatttcaggaaataaactactctgaatactaaa

SEQ ID NO: 36079 - DNA, 2630 bp, Homo sapiens
attattttgcaggagtctacacccaggcggtggctatacttattaaagttggcgggagctgagcgatcagtcggtcctgggctggctgtggtgtagggcgttgcaggcagcgctcacctcctcaggccggcagaatgcgggtggctgtggctggctgctgccacggcgagctggataagatctatgagacgctggcgctggcagagcggcgcggcccggggcctgtcgacctcttgctgtgctgcggcgacttccaggcggtgcgcaacgaggcggatctacgctgcatggccgtgccgcccaagtatcgtcacatgcaaaccttctacaggtattactctggagagaaaaaggctccagttctcacgctcttcattgggggaaaccatgaagcctcaaatcatttgcaagagttaccctatggtggctgggtggcaccaaacatttattatttaggtttggctggtgtggtaaaataccgaggtgtaaggatcggtggaatctctggtatctttaaatctcatgactatcgaaaaggtcattttgagtgccccccttataattcatctacaatcaggagtatatatcatgtgagaaatattgaagtctataaattaaaacagctgaagcagcctatagatatattcttgtctcatgattggccaagaagtatatatcattatggaaataagaagcaacttcttaagactaaatcttttttccgacaagaagtggaaaataacacattaggaagtccagctgcctcagagcttttagagcatctcaaacctacttattggttttctgcccaccttcatgtgaagtttgccgccttgatgcagcatcaggcaaaggataaaggacagacagccagagcaaccaaatttttagccttggacaaatgcttaccacatagagattttcttcagatattagagatagaacatgaccccagtgctcctgattacttggaatatgatattgaatggctcactattctcagggctacggatgatcttattaatgtgactgggcgcctgtggaatatgccagaaaataatggcctgcatgcaaggtgggattatagtgcaacagaagaaggtatgaaagaagtattggaaaaattgaatcatgatctcaaggttccatgtaactttagtgtaacagctgcttgttatgatcctagcaagccacagacacaaatgcagctgattcataggatcaatcctcagactactgaattttgtgcccaacttggcatcatagacatcaatgttaggcttcagaagtccaaggaagaacatcatgtgtgtggtgaatatgaagaacaggatgatgtggagagtaatgactctggagaagaccagagtgaatataatacagacacatctgctctgtcttctattaatccagatgaaataatgttagatgaagaagaagatgaagatagtattgtaagtgcacatagtggcatgaatacaccatcggtagaaccttctgatcaagcttctgagttttctgcaagtttctctgatgtcaggatcttgccaggctctatgattgtatcttctgatgatacggtggattccacaattgatagagaggggaaacctggtgggactgtggagtcagggaatggagaggacttaaccaaggtgccattgaagaggctgagtgatgaacatgaacctgaacaaagaaagaaaattaagaggaggaatcaagccatttacgctgcagtggatgatgatgatgatgatgcagcttaagatgatttacttgttttgtttttgtgtttgttttgcttttttgagatggagtttcactcttgtcacctagactggagtgcaatggcgtgatctcggctcaccgcaacctccgcctcccaggagaatcgtcgaacccgggaggcggaggctgcagtgagccgagatcatgccactgcactcacagcctgggcgaaagagactccatctccaaaaaacaaaaaaaaaaaaagtgaagcgacgggaaaaacagccacaatctcgggaagcctgagacgcacggagaatgggatatgaccccgcgggaaggcagcgacgctagcataggtgcagcacaaaaaactgcactaacgggaaactagggccgtggccaccaagatggagcaaaacctccctcacaaacaacaaacaacacatacaacgagaggcgtgagcgagagcactgatgtaaccacaacaaccagagcagacgtagcaggcaaaaactgcgtgaacccacaagaaggcccaccgtgtgtgaccgagaagactagatgtcacagccgcggagacgtcatgccacgggtgacgcagacacaagaaccgcggcgctccaaacaaaaacagcacacaaaacgagaccgacacaaccaaactgggcggggcagcgaacgataacccgagaggggccagacgacagcgacatcagcgcagcagtctcacaaggaccacaaggcaggcgactacaacacgcggactggcgagacccaggtcaacgcgggcaaaggcgagcgcacttgaaaagcacaaattggcgagaaagggacgccaacaaatgcccggaaagaagatacgaatggacacgagttgagagacgacgcgcat

SEQ ID NO: 36080 - DNA, 702 bp, Homo sapiens
gacgtagctggaaccacagacacaatgctactgacctggcttttgttttttcttatagatttgctggtctccaactcctgacctcaggcgatccacctgtcttggccttctaaagtgctgggattacaggcgtgagccactgtgcctggccgacaatttacttgtcttagtattatatgtagatatgtgattttttgagactgtatttttagagctgaatttttgactaaagacttaactttataataatgaagatacattagagaattttagttagatattgactttatctttaggcttttgtatgtttcagatgcaaacatattaaagtttcatatatttacttgactgggtatcttttttttgaagacatacattattcacttccatttttacaataaacacttacttaacatctactctgtgccaagcactctgctataatatgggaccataaagatgagtaagacaaggatttttgcctccaaggacttgttatcactgtaaacattttgatgtatacaatatggctatattatattttgttttataaaatcaagtctttgtatatattatgatgtatgctttcttttcatttattataaatatttttcctgatcagcttttaatatctgtcaaataaaaattgaaattgaagatggtatataagatttcaggaaataaactactctgaatactaaa

SEQ ID NO: 36081 - DNA, 299 bp, Homo sapiens
tcaacaccaaatttgatcttgggccaactcaaagatgcatgacgctttcattctttttacaaagcccttttctagtcattgtgcctttgggttctgacattaagtcactgctgaggaaggggagagagggtgacagaggctcagttcctgaggcacagtatctccatcctcacctaccattcattcattcatgctcaactaacaagcttctgcaggtcccattccacctttccccaccaacattaatgccaattctacaaataacgacatgtgtagtgtttacaaggtatgagacattc

SEQ ID NO: 36082 - DNA, 330 bp, Homo sapiens
ttttgaaaagtgttttctggtacacaaaaataatattctgaaatatctctctgatatttgattgccggatttaacctacatacctctgaaccttggtttttcagacatgcaaactgcttaacaagttccaatgcattaatcaatgcaccattgcataacttacagtaagaaaagttggtagatatttcagcaatgccataaaatatgcttccatttaacactttgagacaaccaatacactatttatattattgagacaaaacaaacctaagatcacagaaaaatatttattttaatagaatggtatttaagtagatagtttttttgttg

SEQ ID NO: 36083 - DNA, 458 bp, Homo sapiens
cttaactactttcttacgtaaaatggaactcatcaaagcactgacctcatatcacgaggatgaaaataagattaaaaaatacttagttcaatgcctggctcatagtaagtggtaagtgctcaccatattttaatttttacatagaacatgtcttactttttcattagaaaaaaagaaaatagagttatttcagtgggaagtagtggttgaggttaagaggcttaatgacatacaccgggactcaaatgacaccgccaaagggggcacatttgtttaaagggaagagtgtgaacttgtaaagtttaggaaataagaatgtagctgggctcggtggctcacgtgtgaaatcccagcacactgggaggccaaggcagggtggatcccttgagctcaggagttcgagactaccctgagcaatatggtgaaaccctgtccctgcaaaaaatacaaaaaaaaaa

SEQ ID NO: 36084 - DNA, 444 bp, Homo sapiens
ggcctcctgtcagtggcaccaatggacctgctacccacagaatcttgttccgttgtagacaatgaagctgcttagcaatcttgggcaagccatctcttaatattaaagcagacaccacagaatagctttcttcacttacaaatgttgattgggcatttatgatatggcaggaactccttctcacatggagacctgatgttaaaggacacagccatgctcttgaggagcttacaatccaagctggaggcaggggagggtatagtctttaaatatgcttaagtgttgtagggaaggacagagttaccaataaacatgtaactagaaagccaggctcagttcttacctctgggaatcagaactctttatgcaacttgattgatagaatctactatctggaagataattgaagaactttaataaaattgtcaatagaataaaaaaaaa

SEQ ID NO: 36085 - DNA, 351 bp, Homo sapiens
taggtcttcctcgaagatccaagagaaacaaaactaacaataacaattggaactagcaaggtttagaaaggccattgtatacaagataaatatttttagaatctgcagttcccctaatcagtagcagcagtaacctgttagaagatgtaatgaaagtaaagatctgggccaggcacgatgtctcacgcctgtaatccaagcactttgggaggccaaggtgggcagatcatgaggtcaagagattgagaccatcctggccaacatgatgaaaccccatctctactaaaaatacaaaaattagctgggtgtggtggtacgcgcctgtagtcccagctactcgggaagctgggg

SEQ ID NO: 36086 - DNA, 653 bp, Homo sapiens
gctcgaccgaagatggcggaggtgcaggtcctggtgcttgatggtcgaggccatctcctgggccgcctggcggccatcgtggctaaacaggtactgctgggccggaaggtggtggtcgtacgctgtgaaggcatcaacatttctggcaatttctacagaaacaagttgaagtacctggctttcctccgcaagcggatgaacaccaacccttcccgaggcccctaccacttccgggcccccagccgcatcttctggcggaccgtgcgaggtatgctgccccacaaaaccaagcgaggccaggccgctctggaccgtctcaaggtgtttgacggcatcccaccgccctacgacaagaaaaagcggatggtggttcctgctgccctcaaggtcgtgcgtctgaagcctacaagaaagtttgcctatctggggcgcctggctcacgaggttggctggaagtaccaggcagtgacagccaccctggaggagaagaggaaagagaaagccaagatccactaccggaagaagaaacagctcatgaggctacggaaacaggccgagaagaacgtggagaagaaaattgacaaatacacagaggtcctcaagacccacggactcctggtctgagcccaataaagactgttaattccttaaaa

SEQ ID NO: 36087 - DNA, 659 bp, Homo sapiens
taaattcgcggccggtcgacggcggaggtgcaggtcctggtgcttgatggtcgaggccatctcctgggccgcctggcggccatcgtggctaaacaggtactgctgggccggaaggtggtggtcgtacgctgtgaaggcatcaacatttctggcaatttctacagaaacaagttgaagtacctggctttcctccgcaagcggatgaacaccaacccttcccgaggcccctaccacttccgggcccccagccgcatcttctggcggaccgtgcgaggtatgctgccccacaaaaccaagcgaggccaggccgctctggaccgtctcaaggtgtttgacggcatcccaccgccctacgacaagaaaaagcggatggtggttcctgctgccctcaaggtcgtgcgtctgaagcctacaagaaagtttgcctatctggggcgcctggctcacgaggttggctggaagtaccaggcagtgacagccaccctggaggagaagaggaaagagaaagccaagatccactaccggaagaagaaacagctcatgaggctacggaaacaggccgagaagaacgtggagaagaaaattgacaaatacacagaggtcctcaagacccacggactcctggtctgagcccaataaagactgttaattccttaaaa

SEQ ID NO: 36088 - DNA, 699 bp, Homo sapiens
gctcgaccgaagatggcggaggtgcaggtcctggtgcttgatggtcgaggccatctcctgggccgcctggcggccatcgtggctaaacaggtactgctgggccggaaggtggtggtcgtacgctgtgaaggcatcaacatttctggcaatttctacagaaacaagttgaagtacctggctttcctccgcaagcggatgaacaccaacccttcccgaggcccctaccacttccgggcccccagccgcatcttctggcggaccgtgcgaggtatgctgccccacaaaaccaagcgaggccaggccgctctggaccgtctcaaggtgtttgacggcatcccaccgccctacgacaagaaaaagcggatggtggttcctgctgccctcaaggtcgtgcgtctgaagcctacaagaaagtttgcctatctggggcgcctggctcacgaggttggctggaagtaccaggcagtgtctggggcgcctggctcacgaggttggctggaagtaccaggcagtgacagccaccctggaggagaagaggaaagagaaagccaagatccactaccggaagaagaaacagctcatgaggctacggaaacaggccgagaagaacgtggagaagaaaattgacaaatacacagaggtcctcaagacccacggactcctggtctgagcccaataaagactgttaattccttaaaa

SEQ ID NO: 36089 - DNA, 616 bp, Homo sapiens
gctcgaccgaagatggcggaggtgcaggtcctggtgcttgatggtcgaggccatctcctgggccgcctggcggccatcgtggctaaacaggtactgctgggccggaaggtggtggtcgtacgctgtgaaggcatcaacatttctggcaatttctacagaaacaagttgaagtacctggctttcctccgcaagcggatgaacaccaacccttcccgaggcccctaccacttccgggcccccagccgcatcttctggcggaccgtgcgaggtatgctgccccacaaaaccaagcgaggccaggccgctctggaccgtctcaaggtgtttgacggcatcccaccgccctacgacaagaaaaagcggatggtggttcctgctgccctcatctggggcgcctggctcacgaggttggctggaagtaccaggcagtgacagccaccctggaggagaagaggaaagagaaagccaagatccactaccggaagaagaaacagctcatgaggctacggaaacaggccgagaagaacgtggagaagaaaattgacaaatacacagaggtcctcaagacccacggactcctggtctgagcccaataaagactgttaattccttaaaa

SEQ ID NO: 36090 - DNA, 586 bp, Homo sapiens
gctcgaccgaagatggcggaggtgcaggtcctggtgcttgatggtcgaggccatctcctgggccgcctggcggccatcgtggctaaacaggtactgctgggccggaaggtggtggtcgtacgctgtgaaggcatcaacatttctggcaatttctacagaaacaagttgaagtacctggctttcctccgcaagcggatgaacaccaacccttcccgaggcccctaccacttccgggcccccagccgcatcttctggcggaccgtgcgaggtatgctgccccacaaaaccaagcgaggccaggccgctctggaccgtctcaggtcgtgcgtctgaagcctacaagaaagtttgcctatctggggcgcctggctcacgaggttggctggaagtaccaggcagtgacagccaccctggaggagaagaggaaagagaaagccaagatccactaccggaagaagaaacagctcatgaggctacggaaacaggccgagaagaacgtggagaagaaaattgacaaatacacagaggtcctcaagacccacggactcctggtctgagcccaataaagactgttaattccttaaaa

SEQ ID NO: 36091 - DNA, 333 bp, Homo sapiens
aggtcctggtgcttgatggtcgaggccatctcctgggccgcctggcggccatcgtggctaaacaggtactgctgggtaagtcgctgctcgtggcccctctgtcatgggcccccgctggaggtcagtgatgagcaacattcaccatctttcgtttgagtctcacggccatgagatcaaccccatgcaccgctctgagacctgccagccactcttccccagggttggggactccaggctcaagaagtaattatgtattaggctagtttttcatttaaacaggaacttagctctggcaagtactgcgctgtgtctggagggtgactgcataggcag

SEQ ID NO: 36092 - DNA, 468 bp, Homo sapiens
gctagctttgaaacccaactttgccacagaccagcatgttgatggagaggctctcacccacaagcatggagtgggagggtgatttcctgggagaaagaaagccactttctttttggaagccaacgaatgccaagtagatgccaccaaagccagtgatggcttgtgaaagcccagtgtcctgggacaggaaagacaaggggatcccagccaagtctgactgcaatgaggccaaacgttgccccagagcaagacttcatctcccttttcctgacaaaccattgatggctgcgtttcacattaacctagattaaaagtctccttgaaatgtataattgtaattaattattggttcatttgtttgtctcacccccacccccagaatgttacttaatggtatggagggattacctttatctttgtatcatcagagatcaataaatgcatgctgaataaataagtgtgaaataa

SEQ ID NO: 36093 - DNA, 376 bp, Homo sapiens
agagacaagaaggaaagttgggtaaaagcaccctggactatcctgaagtctaatggaagtgcggccaggccactggtgtctttaagccaaagttggcctaaagttgaacaagttctcaggctctcagtgacaggctgccttaggaagcctgcggcacttgataattgtctacaagcggctgttgggaggcttggctctctgccccaattttatgagtgcaaatgaaacaatgcatttcagagtgtggcagctggggccaatagtcaagtagttgaaagtctgcaaggtgcattctcaaggtacacaggagccagtgcgtatgtaatttggcttttcaaaactccatcctagttttgcttagaaaatatttcagaaa

SEQ ID NO: 36094 - DNA, 376 bp, Homo sapiens
ggaggattatgttcagttctttcatcttttttctctgatctatgctgttcttaactaagctcagctctccctgtggcccagccctgatatggatgactggctacctttccctaagagccaactctccagtcaaagggctaaagagttctcttcctctttgggtagttagacagaaatggattcaaattctgccacttccatatgttagctctaagtcacataatctaacatgtatatcctcaattttctgtgaaactaacataacacctaatctgtgggcattaaaatgagataatatgtgaaaaatatgtagcatatacagttaattctcattattttctgtaattatactccataaaaatacctcaaacactga

SEQ ID NO: 36095 - DNA, 404 bp, Homo sapiens
cctcagttgattttctcacttacactcccccacattgaaatgctctcaaagtccagcagcaaattctatcaattacatgtaagtttcattccatacatgtgtccggtgcctggtgggaggttcctatattaaagtcatctaccttccatccattgtctgccttacagccacagtttactcatctgtacaacgaaataacaccactttccttttcctatgcccaaatgagctaaggatgtgaaggtattttgcagaatatagagtgataaagaaaaataaggtgctattacactgtgtgagcatgccgcagaccacaactgcacttgttagactggaggcttatgagaaaaacatctcaccttgtagaaaacatgcatcttactatctctgataacttgtttttc

SEQ ID NO: 36096 - DNA, 372 bp, Homo sapiens
agctccactcgcgtcgacggctgcagaagacagggagtgagaagggtctctgtcccccagggctgcacagaggatggtgtggccaagacagagcaggctacagtggacaggcaagcggcagggctggtgctgagtcactccacagtgtcgaatctactatctgcaggatgccagggacaccagataaagatgtggtccaggccgggcatggtggctcacacctgtaatcccagcactttgggaggttgaggcaggaggatcactcgaggccaggagttcaagaccagcctgggcaatatagcaagccccatctctaattaaaaaaaaaaagtcgacgcggccgcgaatttagtagtagtagtagtagtagta

SEQ ID NO: 36097 - DNA, 301 bp, Homo sapiens
gcaatcatgaaggaagggttggctctgcttagactgaccctgggctacctagtgccaggtgagccttcgcagtcacctagtcgtcttccactggcttactgatgggaaatcaaggccttgatcaggcaagaccctggatacaagagagttccttcccgacccccagctctgagaaacagctgaggcctctaagcatcattaccaagaatgtcttccataagtggggcctcacggaagctgtgaggaggaacaactggatatattctgagcattgattctggaagcatttgtgctggcaaag

SEQ ID NO: 36098 - DNA, 782 bp, Homo sapiens
  misc_feature (712)..(712): n is a, c, g, or t
  misc_feature (771)..(771): n is a, c, g, or t
aagttcggtgggctccaggcgtcgcgatggaggagagcgggtacgagtcggtgctctgtgtcaagcctgacgtccacgtctaccgcatccctccgcgggctaccaaccgtggctacagggctgcggagtggcagctggaccagccatcatggagtggccggctgaggatcactgcaaagggacagatggcctacatcaagctggaggacaggacgtcaggggagctctttgctcaggccccggtggatcagtttcctggcacagctgtggagagtgtgacggattccagcaggtacttcgtgatccgcatcgaagatggaaatgggcgacgggcgtttattggaattggcttcggggaccgaggtgatgcctttgacttcaatgttgcattgcaggaccatttcaagtgggtgaaacagcagtgtgaatttgcaaaacaagcccagaacccagaccaaggccctaaactggacctgggcttcaaggagggccagaccatcaagctcaacatcgcaaacatgaagaagaaggaaggagcagctgggaatccccgagtccggcctgccagcacaggagggctgagcctgcttccccctcccccaggggggaaaacctccaccctgatccctccccctggggagcagttggctgtggggggatccctcgtccagccagcagttgctcccagttcaagattaaacttccaagccanggacccaagccaaggcaacaagggcttggggtcccaagttcctgaaccttgaagcaaangggttttttcc

SEQ ID NO: 36099 - DNA, 260 bp, Homo sapiens
tgtcgaccagggggccagcagttaaccacaaatgagttaagcaggaacgactgggagctacagtgacctggagagatcatgcccaatatacgggcacagccaataatactgagcttaaccaactgctgctcaggaaggtggtctctgaagctgtcagatcttcccactgtcacaaaagccagaaatctggatttttatatgaaacatcttgattttgaactattaacaactaatttaaaagctgataaaacacgtcgacg

SEQ ID NO: 36100 - DNA, 850 bp, Homo sapiens
gtaagataggaagaaaaagtgtggactttggagccagccatactagcttcaaaatctacctcttccacttatcagttgcatgtatttgattttagcgaattattcatagtttcacttttgtttataataggtagataatatagggttgcaatgaggattaaatttgataatacatataaagcttccagctcagttttttatatggagcaactgctcaataaatgttctcatatattgatctgttaatgttaagtcattttgagggttctaatatgtatttaatattctactctataggcatttgcaaatgacagttccctcttcctttatttccttggattgctaaaatagtacaagttttaaatagggttttttgctctagggaggcagcggaatagagttaagaggtgatttgccaagtaaatgaaagatgccttttagtgaaagaagcagaaagcatgactcatggctccagtaataagaacactcactgcttcacgtgagaacccttaagacagggcagttccaggtatggcattatcagggctctggctctctggtgttctcttggctctgccctgctttgtatgctgccccattcctcgggctaattcttcttgtgaccacaagatggcgatagcagttacagatttcactagctcctctcccctgcagaaagctccagaaacaaaaaggggccatctcgcctggtgtgtctttatgagagcaaagaaacctttcccaagagtcccacaactgactttccctcatatcttattggctggaatggttacttgaccatgcctaaagcaatcacagcaaagtgattggcttagaccagttgggaccc

SEQ ID NO: 36101 - DNA, 394 bp, Homo sapiens
gtaatcattccacagcgtaaaaatatatcaaaacttcacattttctcccataaatatatataattattacttgtcaattaaacatttttaaaatgattgtgtttaatcaccaaagatagtgtcttttattcttagtaacaacctccattttggattagaatatttgaattttatagtgaaaataatctacaaaatcagttatgcatttatcagatagtttataacaaaaatggatgcatcacagtcatagctttcttagcacagttttctgaaatgacttaatcccaaagtaatttacaggcagactaaatggatttattatgtataaacatcctcatctcacattatctaagaaaaaaattgatgtttggtaaaaaaaaaaattaattcacaa

SEQ ID NO: 36102 - DNA, 542 bp, Homo sapiens
gatcttggaaaaattggtcacaggtgaatagagtgcaatttatagcatcagaaagaacatagtactccataatatctactccagaacttgttcaggggtatggtagagtatgtttaactaaattcctctgatccctgcttttagccagctttgcctggattggccacatcttagggctgtgtggacctggttcattcccacttagtttataaaagcccatcttattttttggcgtggtgtacatgcttaccaatgaaagttagcttctggattagttctcaagtgaaaaaaattaagatgattcatttgacatgatacttaattttgatgtgactttatttggaactcagatcccaagctaatcaaaaagtaccattaaaagcgacattcttttcccctatcttctagaaagaattaaaaagcagtttcttcttttcctctttagagaagataaagcgaaaaaccaataactgagaaattaacagccacaaaagtttgcaaatggagtctgtgagtttcaaaggctccaaattaaaaaaaaa

SEQ ID NO: 36103 - DNA, 1455 bp, Homo sapiens
actctcatctctgatgtatcatcgtatacgtccgaaatgagctgcactaagtgtactgatggcctgttttgtcagggtgccatcttctgatttctcgtaattccatgatcgggttccgagacagctacttctgcagatcatggagcaattgtcatacccctgtgtgaagttgttctcccacaaaggtaactaaatagtccttgtcagatttgaaatgaagtagccatcgcctttctcatactacattttactctcgtatcgtttctgaccacttgtgttgcactgctggtcagcccagaggaagattgctgaaaatatgccagttgcagggacatctctacacacagaaaacaagaacataatactcaatatataaatacatatgtgtgcacacacatgcaccttatgctttgtggacagctttcataaagaccttgcagtgaagaaatgttttctgtatatttttcatcctactctttgaactcaagatacatgaatttgcctaccatatactattcagtgtaattttaatgagtataatgtaaataatatttgacattttaaccccaatgcatcattaagatgcattaaaatgatgctgtatataattgtcataataggtggttatcctattatttagagaataaatttttatgagagaaaaaaataaagctattgaaactataatatgacttactaatggcaggtcctgtgaaatgaaaagttttgcaatatagaaaaatattgtgttttctcctcatgtttctttgccgaaaggtacactttatcaattgtagtttattactaaagacttggaattccaactccaggaccctttccttctctacagaaatgccagtttgaattgtttatagtttgaattgttttgtgtgcttatagttatgtcagggttttttttgagattattagattttatgtcaaattaatatataatttaagtcctaataaaataactacaaagttacctgtaatcatcacttttggttgcttttattttggataaatacatggtctgatcagttataggtaatattttattttaaattcttattatagatcacatattaactactataccaaaaatataaaaacacaaactctctttaatgcatcaatttaaaaaataaccttcttaagtcccacagggtttatctgatagaaaatactatttagatctaataaacatacaccttggttctaagcgtgtgctgtccactatgatagtcactaactactgtggccgtttagtacctgaagtgtggctagtctaaacggagctgcactgtgagtgtccaacaggcaccaactgtcagacagtgcaaaaaaaaaaggaaaaaacctcaattattaattattttatattaacatgttgaaatgacaatattttggataaattgggcaaaataaaatatattattaatttcacttgcttct

SEQ ID NO: 36104 - DNA, 729 bp, Homo sapiens
ttagtgaggagactgcagagacacacacataggtggctccctgaacgaagaattaacgagtctgctatggcactttttctttatgtatcacttttggccgagtgagctgacaaagtgtttgagggcctgtattgtaggagtgccatcttctgaatacaagtaaataaaaaatcaaagtccaaaaagtttctttcagtcattaagaatttaataaccctttgtaatgtggaagtcgtagtaggtaactaaatagtccttgtcagatttgaaatgaagtagccatcgcctttctcatactacattttactctcgtatcgtttctgaccacttgtgttgcactgctggtcagcccagaggaagattgctgaaaatatgccagttgcagggacatctctacacacagaaaacaagaacataatactcaatatataaatacatatgtgtgcacacacatgcaccttatgctttgtggacagctttcataaagaccttgcagtgaagaaatgttttctgtatatttttcatcctactctttgaactcaagatacatgaatttgcctaccatatactattcagtgtaattttaatgagtataatgtaaataatatttgacattttaaccccaatgcatcattaagatgcattaaaatgatgctgtatataattgtcataataggtggttatcctattatttagagaataaatttttatgagagaaaaaaataaagc

SEQ ID NO: 36105 - DNA, 266 bp, Homo sapiens
tttcttggaatttctgaaggcaggcaagcctgtatagccgggctaactttcacctcatcctcctgcctcgtctcacctctcccttcccttttccttgcctgtggatgctgacctctgcatgggtgcctgcttctctaaagctacgatgtaatctgtagctgtccttcctcgtttgagacccacatgtgaacaccccatatgtgtgcactttttctgcgaatggtgatcatctgattttcaaggggttctttagcttgttttttaaa

SEQ ID NO: 36106 - DNA, 434 bp, Homo sapiens
attttccaggttactcatgaaggcagcagttcctacagcatgattatggtaggattataaagttttgcaactgaaagggatcatgaaaagtatagcctagcccccattttcaggtgtggatagtggagctcagagaggtttgatggcctacagagtcatacagctggattcagtgtgacttagagacagacagctctgtcatctagatccttctggatccttctagatccttcctgtggctgatggtacacacagatcaccggaggtcttgtcagaacgcacgttctgatccaggaagtttggggcaaggcctgagactctgcatttctacagtgatgctgatgctatagcacactttggttttggagtacatttcccaaaattggtttgactttgatatacttatgtaaaagacccttcagtaaaaaaaaaaa

SEQ ID NO: 36107 - DNA, 223 bp, Homo sapiens
agggaagaaatcattcaaagattggaaagacttatgtgtagtattctgtatactaaagggtatcaaatttagttgtcagttgatagcaatttaatttcttgatacatggcatacactggaatcttatgatgaattatttaggggacctgtgccacaaagtctactagaataaacctatcctaaacttaatcctgttagaatttccttcttttgaactctgttt

SEQ ID NO: 36108 - DNA, 851 bp, Homo sapiens
aaaaggccggcggaacagccagaggagcagagaggcaaagaaacattgtgaaatctccaactcttaaccttcaacatgaaagtctctgcagtgcttctgtgcctgctgctcatgacagcagctttcaacccccagggacttgctcagccagatgcactcaacgtcccatctacttgctgcttcacatttagcagtaagaagatctccttgcagaggctgaagagctatgtgatcaccaccagcaggtgtccccagaaggctgtcatcttcagaaccaaactgggcaaggagatctgtgctgacccaaaggagaagtgggtccagaattatatgaaacacctgggccggaaagctcacaccctgaagacttgaactctgctacccctactgaaatcaagctggagtacgtgaaatgacttttccattctcctctggcctcctcttctatgctttggaatacttctaccataattttcaaataggatgcattcggttttgtgattcaaaatgtactatgtgttaagtaatattggctattatttgacttgttgctggtttggagtttatttgagtattgctgatcttttctaaagcaaggccttgagcaagtaggttgctgtctctaagcccccttcccttccactatgagctgctggcagtgggtttgtattcggttcccaggggttgagagcatgcctgtgggagtcatggacatgaagggatgctgcaatgtaggaaggagagctctttgtgaatgtgaggtgttgctaaatatgttattgtggaaagatgaatgcaatagtaggactgctgacattttgcagaaaatacattttatttaaaatctccta

SEQ ID NO: 36109 - DNA, 830 bp, Homo sapiens
aaaaggccggcggaacagccagaggagcagagaggcaaagaaacattgtgaaatctccaactcttaaccttcaacatgaaagtctctgcagtgcttctgtgcctgctgctcatgacagcagctttcaacccccagggacttgctcagccagatgcactcaacgtcccatctacttgctgcttcacatttagcagtaagaagatctccttgcagaggctgaagagctatgtgatcaccaccagcagcttcagaaccaaactgggcaaggagatctgtgctgacccaaaggagaagtgggtccagaattatatgaaacacctgggccggaaagctcacaccctgaagacttgaactctgctacccctactgaaatcaagctggagtacgtgaaatgacttttccattctcctctggcctcctcttctatgctttggaatacttctaccataattttcaaataggatgcattcggttttgtgattcaaaatgtactatgtgttaagtaatattggctattatttgacttgttgctggtttggagtttatttgagtattgctgatcttttctaaagcaaggccttgagcaagtaggttgctgtctctaagcccccttcccttccactatgagctgctggcagtgggtttgtattcggttcccaggggttgagagcatgcctgtgggagtcatggacatgaagggatgctgcaatgtaggaaggagagctctttgtgaatgtgaggtgttgctaaatatgttattgtggaaagatgaatgcaatagtaggactgctgacattttgcagaaaatacattttatttaaaatctccta

SEQ ID NO: 36110 - DNA, 1249 bp, Homo sapiens
aaaaggccggcggaacagccagaggagcagagaggcaaagaaacattgtgaaatctccaactcttaaccttcaacatgaaagtctctgcagtgcttctgtgcctgctgctcatgacagcagctttcaacccccagggacttgctcagccagatgcactcaacgtcccatctacttgctgcttcacatttagcagtaagaagatctccttgcagaggctgaagagctatgtgatcaccaccagcaggtgtccccagaaggctgtcatcttcagaaccaaactgggcaaggagatctgtgctgacccaaaggagaagtgggtccagaattatatgaaacacctgggccggaaagctcacaccctgaagacttgaactctgctacccctactgaaatcaagctggagtacgtgaaatgacttttccattctcctctggcctcctcttctatgctttggaatacttctaccataattttcaaataggatgcattcggttttgtgattcaaaatgtactatgtgttaagtaatattggctattatttgacttgttgctggtttggagtttatttgagtattgctgatcttttctaaagcaaggccttgagcaagtaggttgctgtctctaagcccccttcccttccactatgagctgctggcagtgggtttgtattcggttcccaggggttgagagcatgcctgtgggagtcatggacatgaagggatgctgcaatgtaggaaggagagctctttgtgaatgtgaggtgttgctaaatatgttattgtggaaagatgaatgcaatagtaggactgctgacattttgcagaaaatacattttatttaaaatctcctaaaaaaaaaagttttcttcaggagtaactgccaaccagtaggggctctcagaggtgtgggtggatggcatgccagtggaaggcagatgtacagaggccctggccatggggctagcctggctcatctgagtttcaaggagggcctgcctcaccagcccaggctgttctggaacaatggctccagtccccagcatgggcgctcctggctcgcaactcatccgtttcatattcagttcatttctttctttaaaaccacactcctgccaaaagtaaacccatccctccccctctagtctcccaccccaatctatgcctccccactccaagcagcaagtgattcagacttcatgtgcacctgacactcagagggaaaccagatgaccaagtcctagtgagcctc

SEQ ID NO: 36111 - DNA, 402 bp, Homo sapiens
gaaagctactataaaataacagattagatactttttaaggatcacttatagtaaatctagaaatggaaaaaaaaaatcacagagacagaatttgtttagcgctaagtgcaaatgctgctgagatgttagtggactgaggctcagaatttaagcactgcagctgttctccagcggcctagggctgctgtcttctgcagcgctcccatcctcggccttcctgccctgacctgtcttcagaagtgcctggcgaaggcagcgatggcgaccacctgcaagatggcctccaggccgtggagctccaggagtgtggcgctgagggcccagtccgcccacgacaccagggtctgccaaagcaggaagtgggcagagaggaggacggtgccggccgtgatggccaagctg

SEQ ID NO: 36112 - DNA, 357 bp, Homo sapiens
gagagactaaagaagtttgcatttccccagtattatttttatattatttaaattaattattctgagcttatttaggaaagactagaagctttcactaatagaacgtataagtatctccaaaatgtaagggcttcattaatctgttaaaggaaaacaattataacaatttataacactttgttgttagataaaagaaaacaggatttcacagataacatgactatgttttttgtccgcaactgaaatttgaggcactaaggtattcaataaatcagtaaattagagttttggataatagttgatatagattgaaaattttgagtcaggaaatcaattcaaataggtgtgaataaatta

SEQ ID NO: 36113 - DNA, 375 bp, Homo sapiens
ccttctgtcacccaggctggagtgcagtggcacaatcttggttcaccgcaagctctgcctcctgggttacaccattctcctgcctcagcctcccaagtagctgggactacaggcgcccgccaccacacctggctcattttttttttgcatttttagtagagacggggtttcaccgtgttagccaggatggtcttgatctcctgacctcgtgatccgcccgccttggcctcccaacgtgctgggattacaggcgtgagctagcgtgcccagctgacaagcttgagagtttttaaacaagggccccaagcaaatttactgtcaggcaagtttgtgaaattctattatcacattagataattgatactcagttttaca

SEQ ID NO: 36114 - DNA, 475 bp, Homo sapiens
ttctaaaactgaccagtgctcattagacagatggccactcatgtgaaaattgatttgtgcataaatgtaaggaatatgtgctctcattgggtaatctcatctgcttttgtggttggggaatggcatgccttttaaaaaaactaaaaccaatatagttactttatttggctgattttgaatgattattctgttttgataaaaatatatttaaaacattcagaactgaaaagcacagacaacaaattatgtaaacattaaaaacctgaaaatacacatacttacagttaatatttgaacattaaaaagaaaacttttagcttcaggggtatatgtgcaagtttgttatataggtaaattgcgagtcatagggttttggtgtatggattattttgttacccagataataagcattgtacttgataggtagtttcccggtcctcaccctttttccacgttgtgccctcaggtaggttct

SEQ ID NO: 36115 - DNA, 445 bp, Homo sapiens
actagagtgggaggagagttgctgaagccaaggtttcttctgtgtggccagacatgcagccagagacagctttgggacctggaactggtctgtgagtgtcattgctcagtgttctagtctgctcccttggtcagttgggggacagtgcccaccaggtctgagaggcagaagggaagcacagtccacttacctggagatctactcctcagttcaaaccacaccaaaggaggggatagcacagtctgccaaaggccctcttgggtcaaagaaaacgtgaaactgcaccagctactgaaggtggcaccaccaaaactcaagaatagatgtagagagggggttatctcttgccaaccccctcagtgcattgtcacagacttggtagtgcctcttcccatcagggcctggggagcctgggctaagatggttgagtttgcttttccagctt

SEQ ID NO: 36116 - DNA, 342 bp, Homo sapiens
ctcaagcaagtcacctcacctctctgggcttttcacataaaataacccagagacatgtcgcacatgcttttcagcctgatttacctgtcccatagcaccagtttacagcagagttgagcctaagcccgcggttttgcctggcatagggttggtccgctgaggaactcgggagcattttacatggattacagcgccacctattgggaaaaagtagactatgaaaaatgacaagataaagggatcggtgtgggatttttgctgaaaaaacgagagtaacaacagtatggatctagaaaaatttctgaagttcacgtcatatttatatttattgagaagtgtcca

SEQ ID NO: 36117 - DNA, 405 bp, Homo sapiens
gaaaatgtgagaaatcagaaaggttgcaatttcatggtacaagctccttgagcacaatgacatgattttgcaaactatttctagggtaagaaataatatcttttaaatttgtggcaaaatctgctgtaatgggagattactgcagtgatggacggctttatagaaacacagttatatgtactttattaaaccatgtagcaggaaaaaaacatgatggcactcaagaagttgaattccagccgctttcaatttctgggtacatataacctttttgttagcacctctaagacactgagtttattatcaaaatgacaagagcatttgacaaaacgacctttggttccaagacttctaggatctgtcaaacatcttgtgggtagccagtctccaagatgaccccagtgg

SEQ ID NO: 36118 - DNA, 439 bp, Homo sapiens
taaagcaatttggattctcctattaattttacatagagaaattacgttggtatatcttgagataggaaggtacaaaatcaggacaggcttattctgccaggcccaatgtggcacatctgttttataagtaaacagaagttgaaattttatcttagataaagttcatcaaattttacttttgctaatacatgtaatcacctcagctatatagtttaagtattcaatgacagtaaactagtaagtattcttaataaactataaactgttaagtatttaactataactatctaagaaactcttaagtatttttaagcatggagattgatccccttcagggactatgaataataacttacacatttcatcttcagtccatctccccattatccacctaacactgccttgaacatggaggggaaaaaaaagtgttaatttaaga

SEQ ID NO: 36119 - DNA, 375 bp, Homo sapiens
atttgtttatttcccatttgccttgtattttatgcaggcaggactgttaatgaagtgaattaccaagccagcaatgctttgaattacgatggcgttgcagtattgaattgtgaaactgtgaccagtaggcaccaataggattgtgtctcctatgcctcttcttaaatcagagagggtatctttttaaataaaaactcagaataggtttagttgcgcaaactaaaatcacagaagatacgtggaaacaaatgagaggatctgggatagaagtgaaggtgacggaatgaagtcttggggaccaaacagggtcttcagagtcagcaaggccagtctctgaatctgggctccactctctgactttagctcttgagcttt

SEQ ID NO: 36120 - DNA, 266 bp, Homo sapiens
ggagagagtaagttatcaaggaaataattcaagaaaatttcagaaaactgcaaggacatgcattttatattgaaaaggtccattgaacgctcagcataatagatgcagaaggatctacccatcctgaagcttcctggtgtgacattgcaaaatatttgggataaagagaagattgttaaagctttcagaaaaaaaggggcaaatcaggttacatacccaaagttaagaatcaaaagcatcaaacttcttgccaacactgttgaaac

SEQ ID NO: 36121 - DNA, 494 bp, Homo sapiens
atcaatttcttggtactcacgagaagaaaaaaaagttcatgtttttcccccagtcttgtattttaacataagttctgaattgtctcaaaattcacactagctttttgagtttgattgcccagagtagcagcactccctcatttgctgccttatttaattttttttttccttttctccatccctatttcagaggacagaatagaaagaaaaggagcatgaatatttaacatccctatagatttcatagtgagtgggggaggaagtaacactgcagaatccagagttcccaggccatgctgactgatgctgtggcttcaaacagaattgggaggcttctgttttggatgcctagaaattgcataagggtcaaaaggctgggcgcagtggctcacgcctgtaatcccagcactttgggaggccaaggcaggtggaacacgaggtcaagagaccatcctggccaatgtggtgaaaccccatctctactaaaaatacaa

SEQ ID NO: 36122 - DNA, 319 bp, Homo sapiens
gagctggtgggcatggaatgttaagaaggccaggggtcataatctcacccagccaccgcagcacaacaatgactggcttaaacaacgaaaaactgcatctatgatcttagcaacaacattcagtaacattaggtatcaccagggaggaggacgccacctccctggtgatagctgattggaccagagggaagccccagtcccagggcagccaatcagcagcctgcaagcagccaatgagatggcctggagggggagttctgcccaatcacaataccaataaataagaggtccaggctggatctctgtcttggagatttga

SEQ ID NO: 36123 - DNA, 100 bp, Homo sapiens
ttcatcatccccaaaagaaaccattagcatcagtactcattagcagtcactctcccatctgctctgccttccctctaatccccagccctaggccaccatt

SEQ ID NO: 36124 - DNA, 474 bp, Homo sapiens
ttttaaagtgctgttcaaggcatatgcctctagtaggttcaccttgattgcttagacacaagagctcctgagacattaaacactggagtagatcttgggagagctcagaaccacatataagtgagtataagtttccccttcctcattctccagtgaacattcatggcagtgttcattggctcaaaccggcatgtgtgtgatgacttaggattcagtgacgtttgatgatgtggctgtggagttcaccccagaggagtgggctttactggacacaactgagaaatgcctctacagagatgtgatgttggagaactatgtgaacctggcctctgtgggtaagagtaacatcattttgcttggcatggtgccctgcacctgtagtcccagatacttgggaggctgaggtgggagaagtgcttgagtgtgggagtttgatattagcatggacagtattgtgagaccgcatctctaaaa

SEQ ID NO: 36125 - DNA, 544 bp, Homo sapiens
taaaaatgatctgaaatttattctcttggggataaaatttattgtatatattatatatataatataattcttgttatgtatgtgtatatatataattatttgtgtatatatgtgtatatatataattatttttattgcgtgctactattccaagccagatgctaagtgctggggacacatgtaagcaagttaaactggcccctcgccagatgaaacttagtttgcagttggtgaaacagacattacagagataattgtgcagttgcttatttagttacaaccatgaagaatactctgaagggcaaagacaatgtgtaacagagtcctgtcctaatcctggcggttagagatagtgtagttaaggagatgatatttaagcttaaaaacagaacttagggaagctggtcagcccagggcttgggcttgaggaagagaagggcatttcacatagaaggagctgtgtgggcaaaggctctggaaccattttgtactatgagaaatccaaaaagaaaaagatttaaaaaggaaggggtggtcagtagca

SEQ ID NO: 36126 - DNA, 566 bp, Homo sapiens
gcaccctctccaaaggctgccacctccaggaaggacacctggacaattcaccagctcactgctctgcccctccccgctctgcccctcccccaaatgcctggccctccccatgcaggacccgcacagactgggtccccttcccggggctctgagtggtgggggtgacgagagtggaggagctgctggggccctgtgtgtgtgggctggggacaggggagggcatcctggggatggggatccttgggccaggctgctagtcagtggccccaaggcagcccctccccactgcttccccataggcagaggcagccgggaacctggcagtggtggcctttctacagagcctggagggtgcggttggtgcccaggccccatgcccagaagtgctgcctggtgtctaacctgaaggcgtcctgctgcagtataagccattccttcctcccatgacctgctggaggggtctcaggcatgaccccactgctggggctgcttcccagcctgctctcatgtaaagcctgaaggcctttgttgggcaggacggcaataaagtctctgacatcccctca

SEQ ID NO: 36127 - DNA, 1154 bp, Homo sapiens
cccaccccaccgccccacaggttcgggccttcttgcagcctcccctgaagggcgtggtcatggagaccttcggttcagggaacggacccaccaagcccgacctgctgcaggagctgcgggtggccaccgagcgcggcctggtcatcgtcaactgtacccactgcctccagggggctgtgaccacagactatgcagctggcatggccatggcgggagccggcgtcatctcaggcttcgacatgacatcggaggccgccctggccaagctatcgtatgtgctgggccagccagggctgagcctggatgtcaggaaggagctgctgaccaaggaccttcggggggagatgacgccaccctcggtggaagagcgccggccctcactgcagggcaacacgctgggcggtggggtctcctggctcctcagtctgagcggcagccaggaggcagatgccctgcggaatgccctggtgcccagcctggcctgtgctgctgcccacgccggtgacgtggaggcgctgcaggcgcttgtggagctgggcagtgacctgggcctggtggactttaacggccaaaccccactgcacgcggccgcccggggaggccacacagaggcagtcaccatgctgctgcagagaggtgtggacgtgaacacccgggacacggatggcttcagcccgctgctgctggccgtgcggggcaggcatccgggtgtcattgggttgctgcgggaagccggggcctccctgtccacccaggagctggaggaagcagggacggagctgtgcaggctggcatacagggccgacctcgaaggcctgcaggtgtggtggcaggcaggggctgacctggggcagccgggctatgacgggcacagcgccctgcacgtcgcagaggcagccgggaacctggcagtggtggcctttctacagagcctggagggtgcggttggtgcccaggccccatgcccagaagtgctgcctggtgtctaacctgaaggcgtcctgctgcagtataagccattccttcctcccatgacctgctggaggggtctcaggcatgaccccactgctggggctgcttcccagcctgctctcatgtaaagcctgaaggcctttgttgggcaggacggcaataaagtctctgacatcccctca

SEQ ID NO: 36128 - DNA, 920 bp, Homo sapiens
tgccttctcagactgcatggagacctgaggctcccctaactgtcgccaggaaatcctctcctgctctccactcttcctcgaggctgctgaccaaggaccttcggggggagatgacgccaccctcggtggaagagcgccggccctcactgcagggcaacacgctgggcggtggggtctcctggctcctcagtctgagcggcagccaggaggcagatgccctgcggaatgccctggtgcccagcctggcctgtgctgctgcccacgccggtgacgtggaggcgctgcaggcgcttgtggagctgggcagtgacctgggcctggtggactttaacggccaaaccccactgcacgcggccgcccggggaggccacacagaggcagtcaccatgctgctgcagagaggtgtggacgtgaacacccgggacacggatggcttcagcccgctgctgctggccgtgcggggcaggcatccgggtgtcattgggttgctgcgggaagccggggcctccctgtccacccaggagctggaggaagcagggacggagctgtgcaggctggcatacagggccgacctcgaaggcctgcaggtgtggtggcaggcaggggctgacctggggcagccgggctatgacgggcacagcgccctgcacgtcgcagaggcagccgggaacctggcagtggtggcctttctacagagcctggagggtgcggttggtgcccaggccccatgcccagaagtgctgcctggtgtctaacctgaaggcgtcctgctgcagtataagccattccttcctcccatgacctgctggaggggtctcaggcatgaccccactgctggggctgcttcccagcctgctctcatgtaaagcctgaaggcctttgttgggcaggacggcaataaagtctctgacatcccctca

SEQ ID NO: 36129 - DNA, 824 bp, Homo sapiens
tgccttctcagactgcatggagacctgaggctcccctaactgtcgccaggaaatcctctcctgctctccactcttcctcgaggctgctgaccaaggaccttcggggggagatgacgccaccctcggtggaagagcgccggccctcactgcagggcaacacgctgggcggtggggtctcctggctcctcagtctgagcggcagccagggcagtgacctgggcctggtggactttaacggccaaaccccactgcacgcggccgcccggggaggccacacagaggcagtcaccatgctgctgcagagaggtgtggacgtgaacacccgggacacggatggcttcagcccgctgctgctggccgtgcggggcaggcatccgggtgtcattgggttgctgcgggaagccggggcctccctgtccacccaggagctggaggaagcagggacggagctgtgcaggctggcatacagggccgacctcgaaggcctgcaggtgtggtggcaggcaggggctgacctggggcagccgggctatgacgggcacagcgccctgcacgtcgcagaggcagccgggaacctggcagtggtggcctttctacagagcctggagggtgcggttggtgcccaggccccatgcccagaagtgctgcctggtgtctaacctgaaggcgtcctgctgcagtataagccattccttcctcccatgacctgctggaggggtctcaggcatgaccccactgctggggctgcttcccagcctgctctcatgtaaagcctgaaggcctttgttgggcaggacggcaataaagtctctgacatcccctca

SEQ ID NO: 36130 - DNA, 1172 bp, Homo sapiens
cccaccccaccgccccacaggttcgggccttcttgcagcctcccctgaagggcgtggtcatggagaccttcggttcagggaacggacccaccaagcccgacctgctgcaggagctgcgggtggccaccgagcgcggcctggtcatcgtcaactgtacccactgcctccagggggctgtgaccacagactatgcagctggcatggccatggcgggagccggcgtcatctcaggcttcgacatgacatcggaggccgccctggccaagctatcgtatgtgctgggccagccagggctgagcctggatgtcaggaaggagctgctgaccaaggaccttcggggggagatgacgccaccctcggtggaagagcgccggccctcactgcagggcaacacgctgggcggtggggtctcctggctcctcagtctgagcggcagccaggaggcagatgccctgcggaatgccctggtgcccagcctggcctgtgctgctgcccacgccggtgacgtggaggcgctgcaggcgcttgtggagctgggcagtgacctgggcctggtggactttaacggccaaaccccactgcacgcggccgcccggggaggccacacagaggcagtcaccatgctgctgcagagaggtgtggacgtgaacacccgggacacggatggcttcagcccgctgctgctggccgtgcggggcaggcatccgggtgtcattgggttgctgcgggaagccggggcctccctgtccacccaggagctggaggaagcagggacggagctgtgcaggctggcatacagggccgacctcgaaggcctgcaggtgtggtggcaggcaggggctgacctggggcagccgggctatgacgggcacagcgccctgcacgtcgcagaggcagccgggaacctggcagtggtggcctttctacagagcctggagggtgcggttggtgcccaggccccatgcccagagccctcatgttttcaggaagtgctgcctggtgtctaacctgaaggcgtcctgctgcagtataagccattccttcctcccatgacctgctggaggggtctcaggcatgaccccactgctggggctgcttcccagcctgctctcatgtaaagcctgaaggcctttgttgggcaggacggcaataaagtctctgacatcccctca

SEQ ID NO: 36131 - DNA, 1054 bp, Homo sapiens
cccaccccaccgccccacaggttcgggccttcttgcagcctcccctgaagggcgtggtcatggagaccttcggttcagggaacggacccaccaagcccgacctgctgcaggagctgcgggtggccaccgagcgcggcctggtcatcgtcaactgtacccactgcctccagggggctgtgaccacagactatgcagctggcatggccatggcgggagccggcgtcatctcaggcttcgacatgacatcggaggccgccctggccaagctatcgtatgtgctgggccagccagggctgagcctggatgtcaggaaggagctgctgaccaaggaccttcggggggagatgacgccaccctcggtggaagagcgccggccctcactgcagggcaacacgctgggcggtggggtctcctggctcctcagtctgagcggcagccaggaggcagatgccctgcggaatgccctggtgcccagcctggcctgtgctgctgcccacgccggtgacgtggaggcgctgcaggcgcttgtggagctgggcagtgacctgggcctggtggactttaacggccaaaccccactgcacgcggccgcccggggaggccacacagaggcagtcaccatgctgctgcagagaggtgtggacgtgaacacccgggacacggatggcttcagcccgctgctgctggccgtgcggggcaggcatccgggtgtcattgggttgctgcgggaagccggggcctccctgtccacccaggagctggaggaagcagggacggagctgtgcaggcagaggcagccgggaacctggcagtggtggcctttctacagagcctggagggtgcggttggtgcccaggccccatgcccagaagtgctgcctggtgtctaacctgaaggcgtcctgctgcagtataagccattccttcctcccatgacctgctggaggggtctcaggcatgaccccactgctggggctgcttcccagcctgctctcatgtaaagcctgaaggcctttgttgggcaggacggcaataaagtctctgacatcccctca

SEQ ID NO: 36132 - DNA, 170 bp, Homo sapiens
agacctgaggctcccctaactgtcgccaggaaatcctctcctgctctccactcttcctcgagggtggggttcagacacagctggccccagacccttgggttgccagcctctggggctggacggaggcttttggggcccctggagaccctgagctggtagggccagggagt

SEQ ID NO: 36133 - DNA, 673 bp, Homo sapiens
actgcgctcggcctcattttatttctcttctctggacattttccatcttaatactttcatcttgagatttgacacttaggactgcacagggcattttaggtgtggacagctttgattttgtactaaaaatgattacacttggcttgatttccatttctcttccttctgttgcttgcctttctacatggtttagactgaagcaacagtgtactaatatcactagtaaaccatctacagtgcctgctattctagggtgtaactgagagctcagaactcattctcacatcaggatttgtgctcctagcatttgtaggtgacgtgttgatctaggtctgccttttttgtgttcatgttagtcactaacaaggggggtttctagtgcttatggaccacatggcaattaaatgcccatatattgccctgaaaccatctggtttaacttgtccctcaatcctagaagaaacctgacaatgggattttcacatttctctaaggaatatgttagtaagttattccttaagcacatagattccatccagattattagtgcctttttccccccagctcaattttagagataaaaagagctttagacatggtattgtacactcaccaaacctctgttttatccctaaatagaccaagagagattaccaagtctcccaaggttaca

SEQ ID NO: 36134 - DNA, 4485 bp, Homo sapiens
cccggccggactgagttcgctgctgtcccggttcctctcgagtcggctccaactgccagcccgggttggcgccatgtacgccgtgtacaaacaggcgcatccgcccaccggtctggagttctccatgtactgcaacttcttcaacaacagcgagcgcaacctggtagtggccgggacctcgcagctctacgtgtaccgcctcaaccgcgacgccgaggctctgaccaagaatgacaggagcacagaggggaaggcccaccgggagaagctcgagcttgctgcctccttctccttctttggcaacgtcatgtccatggccagcgtgcagctggcaggagccaagcgggatgccctgctcctaagcttcaaggatgccaagctgtctgtggtggagtacgacccgggcacccatgacctgaagaccctgtcactgcactactttgaggagcctgagcttcgggacgggtttgtgcagaatgtacacacgccgcgagtgcgggtggaccccgacgggcgctgtgcagccatgcttgtctacggcacgcggctggtggtcctgcccttccgcagggagagcctggctgaggagcacgaggggctcgtgggtgaggggcagaggtccagcttcctgcccagctacatcatcgacgtgcgggccctagacgagaagctgctcaacatcatcgacctgcagttcctgcatggctactacgagcctaccctcctcatcctgtttgagcccaaccagacctggcctgggcgcgtggccgtgcggcaggacacgtgctccattgtggccatctcactgaacatcacgcagaaggtgcaccccgtcatctggtccctcaccagcctgccctttgactgcacccaggctctggctgtgcccaagcccataggtggggtggtggtgtttgccgtcaactcgctgttgtacctgaaccagagcgtccccccgtatggcgtggctctcaacagcctcaccacaggaaccacggctttcccgcttcgcacccaggagggtgtgcggatcaccctggactgcgcccaggccaccttcatctcctacgacaagatggtcatctccctcaagggcggcgagatctacgtgctgaccctcatcaccgacggcatgcgcagtgtccgagcgttccactttgacaaggcggccgccagcgtcctcaccaccagcatggtcaccatggagcccgggtacctgttcctgggttctcgcctgggcaattccctcctcctcaagtacacggagaagctgcaggagcccccggccagtgctgtccgtgaggctgccgacaaggaagagcctccctcaaagaagaagcgagtggatgcgacggccggctggtcagctgcgggtaagtcggtgccgcaggatgaggtggacgagattgaagtgtacggcagcgaggcccagtcgggaacacagctggccacctactcctttgaggtgtgtgacagcatcctgaacattggaccctgtgccaatgccgccgtgggcgagcctgccttcctctctgaagagtttcagaacagccccgagccggacctggagattgtggtttgctccggccacgggaagaacggggctttgtcggtgctgcagaagagcatccggccccaggtggtgacaacctttgagcttcccggctgctatgacatgtggacagtcatcgccccggtgcgtaaggaggaggaggacaatcccaagggggagggcacagagcaggaacccagcaccacccctgaagcagacgacgacggccgcagacacggattcctgattctgagccgggaagactccaccatgatcctgcagacggggcaggagatcatggagctggacaccagtggcttcgccactcagggccccacggtctttgctgggaacatcggggacaaccgctacattgtccaagtgtcaccactgggcatccgcctgctggaaggagtgaatcagctgcacttcatccccgtggacctgggcgcccccatcgtgcagtgcgccgtggccgacccctatgtggtcatcatgagtgccgagggccacgtcaccatgttcctgctgaagagtgactcctacggtggccgccaccaccgcctggcgctgcacaagcccccgctgcaccatcagtccaaggtgattacgctgtgcctgtaccgagacctcagcggcatgttcaccactgagagccgcctgggtggggcccgtgacgagctcgggggccgcagtggcccggaggccgagggcctgggctcagagactagccccacagtggatgacgaggaggagatgctgtatggggattcgggctccctcttcagccccagcaaggaggaggcccgaagaagcagccagccccctgctgaccgggaccctgcacccttccgggcagagcctacccactggtgcctgctggtgcgggagaatggcaccatggagatctaccagcttcccgactggcggctggtgttcctggtgaagaacttccctgtggggcagcgggtccttgtggacagctcctttggacagcccactacacagggcgaggcccgcagggaggaggccacgcgccagggggagctgcccctcgtcaaggaggtgctgctggtggcgctgggcagccgccagagcaggccctacctgctggtgcatgtggaccaagagctgcttatctacgaggccttcccccacgactctcagctcggccagggcaatctcaaagtccgctttaagaaggtccctcacaacatcaacttccgtgagaagaagccaaagccatccaagaagaaagcagaaggtggcggcgcagaggagggggctggggcccggggccgcgtggcgcgtttccgctacttcgaggatatttatggctactcaggggtcttcatctgcggcccctcccctcactggctcttggtgaccggccgaggggctctgcggctacaccccatggccatcgacggcccggtcgactctttcgctccattccacaatgtcaactgtccccgcggcttcctgtacttcaacagacagggcgagctgaggatcagtgtcctgcctgcctacctgtcctatgatgccccatggcctgtcaggaagatcccgctgcgctgcacggcccactatgtggcttaccacgtggagtctaaggtgtatgctgtggccaccagcaccaacacgccgtgtgcccgcatcccacgcatgactggcgaggagaaggagtttgagaccatcgagagagatgagcggtacatccacccccagcaggaggccttctccatccagctcatctccccggtcagctgggaggctattcccaatgccaggatcgagctgcaggagtgggagcatgtgacctgcatgaagacagtgtctctgcgcagtgaggagaccgtgtcgggcctcaaaggctacgtggccgccgggacctgcctcatgcagggggaggaggtcacgtgccgagggcggatcttgatcatggatgtgattgaggtggtgcccgagcctggccagcccttgaccaagaacaagttcaaagtcctttacgagaaggagcagaaggggcccgtgaccgccctgtgccactgcaatggccacctggtgtcggccatcggccagaagattttcctgtggagcctgcgggccagcgagctgacgggcatggccttcatcgacacgcagctctacatacaccagatgatcagcgtcaagaacttcatcctggcagccgacgtcatgaagagcatttcgctgctgcgctaccaggaggaaagcaagacgctgagcctggtgtcgcgggatgccaagcccctggaggtgtacagcgtggacttcatggtggacaatgcccagctgggttttctggtgtctgaccgcgaccgcaacctcatggtgtacatgtacctgcccgaagccaaggagagtttcgggggcatgcgcctgctgcgtcgggcagacttccacgtgggtgcccacgtgaacacgttctggaggaccccgtgccgggccactgaagggctcagcaaaaagtcggtcgtgtgggagaataagcacatcacgtggtttgccaccctggacggcggcatcgggctgctgctgcccatgcaggagaagacctaccggcggctgctgatgctgcagaacgcgctgaccaccatgctgccacaccacgccggcctcaacccccgcgccttccggatgctgcacgtggaccgccgcaccctccagaatgccgtgcgcaacgtgctggatggggagctgctcaaccgctacctgtacctgagcaccatggagcgcagcgagctagccaagaagatcggcaccacaccagacataatcctggacgacttgctggagacggaccgcgtcaccgcccacttctagccccgtggatgccgtcaccaccagcacacggaactacctcccaccccctttttgtacaaaacacaaggaaaaacattttttgc

SEQ ID NO: 36135 - DNA, 4555 bp, Homo sapiens
cccggccggactgagttcgctgctgtcccggttcctctcgagtcggctccaactgccagcccgggttggcgccatgtacgccgtgtacaaacaggcgcatccgcccaccggtctggagttctccatgtactgcaacttcttcaacaacagcgagcgcaacctggtagtggccgggacctcgcagctctacgtgtaccgcctcaaccgcgacgccgaggctctgaccaagaatgacaggagcacagaggggaaggcccaccgggagaagctcgagcttgctgcctccttctccttctttggcaacgtcatgtccatggccagcgtgcagctggcaggagccaagcgggatgccctgctcctaagcttcaaggatgccaagctgtctgtggtggagtacgacccgggcacccatgacctgaagaccctgtcactgcactactttgaggagcctgagcttcgggacgggtttgtgcagaatgtacacacgccgcgagtgcgggtggaccccgacgggcgctgtgcagccatgcttgtctacggcacgcggctggtggtcctgcccttccgcagggagagcctggctgaggagcacgaggggctcgtgggtgaggggcagaggtccagcttcctgcccagctacatcatcgacgtgcgggccctagacgagaagctgctcaacatcatcgacctgcagttcctgcatggctactacgagcctaccctcctcatcctgtttgagcccaaccagacctggcctgggcgcgtggccgtgcggcaggacacgtgctccattgtggccatctcactgaacatcacgcagaaggtgcaccccgtcatctggtccctcaccagcctgccctttgactgcacccaggctctggctgtgcccaagcccataggtggggtggtggtgtttgccgtcaactcgctgttgtacctgaaccagagcgtccccccgtatggcgtggctctcaacagcctcaccacaggaaccacggctttcccgcttcgcacccaggagggtgtgcggatcaccctggactgcgcccaggccaccttcatctcctacgacaagatggtcatctccctcaagggcggcgagatctacgtgctgaccctcatcaccgacggcatgcgcagtgtccgagcgttccactttgacaaggcggccgccagcgtcctcaccaccagcgtgagttgggactaggggttgggtctgggtccagacccggcccagccatcacacacctgccctccctcagatggtcaccatggagcccgggtacctgttcctgggttctcgcctgggcaattccctcctcctcaagtacacggagaagctgcaggagcccccggccagtgctgtccgtgaggctgccgacaaggaagagcctccctcaaagaagaagcgagtggatgcgacggccggctggtcagctgcgggtaagtcggtgccgcaggatgaggtggacgagattgaagtgtacggcagcgaggcccagtcgggaacacagctggccacctactcctttgaggtgtgtgacagcatcctgaacattggaccctgtgccaatgccgccgtgggcgagcctgccttcctctctgaagagtttcagaacagccccgagccggacctggagattgtggtttgctccggccacgggaagaacggggctttgtcggtgctgcagaagagcatccggccccaggtggtgacaacctttgagcttcccggctgctatgacatgtggacagtcatcgccccggtgcgtaaggaggaggaggacaatcccaagggggagggcacagagcaggaacccagcaccacccctgaagcagacgacgacggccgcagacacggattcctgattctgagccgggaagactccaccatgatcctgcagacggggcaggagatcatggagctggacaccagtggcttcgccactcagggccccacggtctttgctgggaacatcggggacaaccgctacattgtccaagtgtcaccactgggcatccgcctgctggaaggagtgaatcagctgcacttcatccccgtggacctgggcgcccccatcgtgcagtgcgccgtggccgacccctatgtggtcatcatgagtgccgagggccacgtcaccatgttcctgctgaagagtgactcctacggtggccgccaccaccgcctggcgctgcacaagcccccgctgcaccatcagtccaaggtgattacgctgtgcctgtaccgagacctcagcggcatgttcaccactgagagccgcctgggtggggcccgtgacgagctcgggggccgcagtggcccggaggccgagggcctgggctcagagactagccccacagtggatgacgaggaggagatgctgtatggggattcgggctccctcttcagccccagcaaggaggaggcccgaagaagcagccagccccctgctgaccgggaccctgcacccttccgggcagagcctacccactggtgcctgctggtgcgggagaatggcaccatggagatctaccagcttcccgactggcggctggtgttcctggtgaagaacttccctgtggggcagcgggtccttgtggacagctcctttggacagcccactacacagggcgaggcccgcagggaggaggccacgcgccagggggagctgcccctcgtcaaggaggtgctgctggtggcgctgggcagccgccagagcaggccctacctgctggtgcatgtggaccaagagctgcttatctacgaggccttcccccacgactctcagctcggccagggcaatctcaaagtccgctttaagaaggtccctcacaacatcaacttccgtgagaagaagccaaagccatccaagaagaaagcagaaggtggcggcgcagaggagggggctggggcccggggccgcgtggcgcgtttccgctacttcgaggatatttatggctactcaggggtcttcatctgcggcccctcccctcactggctcttggtgaccggccgaggggctctgcggctacaccccatggccatcgacggcccggtcgactctttcgctccattccacaatgtcaactgtccccgcggcttcctgtacttcaacagacagggcgagctgaggatcagtgtcctgcctgcctacctgtcctatgatgccccatggcctgtcaggaagatcccgctgcgctgcacggcccactatgtggcttaccacgtggagtctaaggtgtatgctgtggccaccagcaccaacacgccgtgtgcccgcatcccacgcatgactggcgaggagaaggagtttgagaccatcgagagagatgagcggtacatccacccccagcaggaggccttctccatccagctcatctccccggtcagctgggaggctattcccaatgccaggatcgagctgcaggagtgggagcatgtgacctgcatgaagacagtgtctctgcgcagtgaggagaccgtgtcgggcctcaaaggctacgtggccgccgggacctgcctcatgcagggggaggaggtcacgtgccgagggcggatcttgatcatggatgtgattgaggtggtgcccgagcctggccagcccttgaccaagaacaagttcaaagtcctttacgagaaggagcagaaggggcccgtgaccgccctgtgccactgcaatggccacctggtgtcggccatcggccagaagattttcctgtggagcctgcgggccagcgagctgacgggcatggccttcatcgacacgcagctctacatacaccagatgatcagcgtcaagaacttcatcctggcagccgacgtcatgaagagcatttcgctgctgcgctaccaggaggaaagcaagacgctgagcctggtgtcgcgggatgccaagcccctggaggtgtacagcgtggacttcatggtggacaatgcccagctgggttttctggtgtctgaccgcgaccgcaacctcatggtgtacatgtacctgcccgaagccaaggagagtttcgggggcatgcgcctgctgcgtcgggcagacttccacgtgggtgcccacgtgaacacgttctggaggaccccgtgccgggccactgaagggctcagcaaaaagtcggtcgtgtgggagaataagcacatcacgtggtttgccaccctggacggcggcatcgggctgctgctgcccatgcaggagaagacctaccggcggctgctgatgctgcagaacgcgctgaccaccatgctgccacaccacgccggcctcaacccccgcgccttccggatgctgcacgtggaccgccgcaccctccagaatgccgtgcgcaacgtgctggatggggagctgctcaaccgctacctgtacctgagcaccatggagcgcagcgagctagccaagaagatcggcaccacaccagacataatcctggacgacttgctggagacggaccgcgtcaccgcccacttctagccccgtggatgccgtcaccaccagcacacggaactacctcccaccccctttttgtacaaaacacaaggaaaaacattttttgc

SEQ ID NO: 36136 - DNA, 1288 bp, Homo sapiens
cccggccggactgagttcgctgctgtcccggttcctctcgagtcggctccaactgccagcccgggttggcgccatgtacgccgtgtacaaacaggcgcatccgcccaccggtctggagttctccatgtactgcaacttcttcaacaacagcgagcgcaacctggtagtggccgggacctcgcagctctacgtgtaccgcctcaaccgcgacgccgaggctctgaccaagaatgacaggagcacagaggggaaggcccaccgggagaagctcgagcttgctgcctccttctccttctttggcaacgtcatgtccatggccagcgtgcagctggcaggagccaagcgggatgccctgctcctaagcttcaaggatgccaagctgtctgtggtggagtacgacccgggcacccatgacctgaagaccctgtcactgcactactttgaggagcctgagcttcgggacgggtttgtgcagaatgtacacacgccgcgagtgcgggtggaccccgacgggcgctgtgcagccatgcttgtctacggcacgcggctggtggtcctgcccttccgcagggagagcctggctgaggagcacgaggggctcgtgggtgaggggcagaggtccagcttcctgcccagctacatcatcgacgtgcgggccctagacgagaagctgctcaacatcatcgacctgcagttcctgcatggctactacgagcctaccctcctcatcctgtttgagcccaaccagacctggcctgggcgcgtggccgtgcggcaggacacgtgctccattgtggccatctcactgaacatcacgcagaaggtgcaccccgtcatctggtccctcaccagcctgccctttgactgcacccaggctctggctgtgcccaagcccataggtggggtggtggtgtttgccgtcaactcgctgttgtacctgaaccagagcgtccccccgtatggcgtggctctcaacagcctcaccacaggaaccacggctttcccgcttcgcacccaggagggtgtgcggatcaccctggactgcgcccaggccaccttcatctcctacgacaagatggtcatctccctcaagggcggcgagatctacgtgctgaccctcatcaccgacggcatgcgcagtgtccgagcgttccactttgacaaggcggccgccagcgtcctcaccaccagcatggtcaccatggagcccgggtacctgttcctgggttctcgcctgggcaattccctcctcctcaagtacaacctgccgtggtgagatcctctagaa

SEQ ID NO: 36137 - DNA, 4601 bp, Homo sapiens
cccggccggactgagttcgctgctgtcccggttcctctcgagtcggctccaactgccaggtgggcggccgggcgggcggccgaggcggcagcgcgaggccggggaggggcgcggtgcggggccgggctcctgcgtgggcgaccccgctcacccttcctctcccggccttgcgcagcccgggttggcgccatgtacgccgtgtacaaacaggcgcatccgcccaccggtctggagttctccatgtactgcaacttcttcaacaacagcgagcgcaacctggtagtggccgggacctcgcagctctacgtgtaccgcctcaaccgcgacgccgaggctctgaccaagaatgacaggagcacagaggggaaggcccaccgggagaagctcgagcttgctgcctccttctccttctttggcaacgtcatgtccatggccagcgtgcagctggcaggagccaagcgggatgccctgctcctaagcttcaaggatgccaagctgtctgtggtggagtacgacccgggcacccatgacctgaagaccctgtcactgcactactttgaggagcctgagcttcgggacgggtttgtgcagaatgtacacacgccgcgagtgcgggtggaccccgacgggcgctgtgcagccatgcttgtctacggcacgcggctggtggtcctgcccttccgcagggagagcctggctgaggagcacgaggggctcgtgggtgaggggcagaggtccagcttcctgcccagctacatcatcgacgtgcgggccctagacgagaagctgctcaacatcatcgacctgcagttcctgcatggctactacgagcctaccctcctcatcctgtttgagcccaaccagacctggcctgggcgcgtggccgtgcggcaggacacgtgctccattgtggccatctcactgaacatcacgcagaaggtgcaccccgtcatctggtccctcaccagcctgccctttgactgcacccaggctctggctgtgcccaagcccataggtggggtggtggtgtttgccgtcaactcgctgttgtacctgaaccagagcgtccccccgtatggcgtggctctcaacagcctcaccacaggaaccacggctttcccgcttcgcacccaggagggtgtgcggatcaccctggactgcgcccaggccaccttcatctcctacgacaagatggtcatctccctcaagggcggcgagatctacgtgctgaccctcatcaccgacggcatgcgcagtgtccgagcgttccactttgacaaggcggccgccagcgtcctcaccaccagcatggtcaccatggagcccgggtacctgttcctgggttctcgcctgggcaattccctcctcctcaagtacacggagaagctgcaggagcccccggccagtgctgtccgtgaggctgccgacaaggaagagcctccctcaaagaagaagcgagtggatgcgacggccggctggtcagctgcgggtaagtcggtgccgcaggatgaggtggacgagattgaagtgtacggcagcgaggcccagtcgggaacacagctggccacctactcctttgaggtgtgtgacagcatcctgaacattggaccctgtgccaatgccgccgtgggcgagcctgccttcctctctgaagagtttcagaacagccccgagccggacctggagattgtggtttgctccggccacgggaagaacggggctttgtcggtgctgcagaagagcatccggccccaggtggtgacaacctttgagcttcccggctgctatgacatgtggacagtcatcgccccggtgcgtaaggaggaggaggacaatcccaagggggagggcacagagcaggaacccagcaccacccctgaagcagacgacgacggccgcagacacggattcctgattctgagccgggaagactccaccatgatcctgcagacggggcaggagatcatggagctggacaccagtggcttcgccactcagggccccacggtctttgctgggaacatcggggacaaccgctacattgtccaagtgtcaccactgggcatccgcctgctggaaggagtgaatcagctgcacttcatccccgtggacctgggcgcccccatcgtgcagtgcgccgtggccgacccctatgtggtcatcatgagtgccgagggccacgtcaccatgttcctgctgaagagtgactcctacggtggccgccaccaccgcctggcgctgcacaagcccccgctgcaccatcagtccaaggtgattacgctgtgcctgtaccgagacctcagcggcatgttcaccactgagagccgcctgggtggggcccgtgacgagctcgggggccgcagtggcccggaggccgagggcctgggctcagagactagccccacagtggatgacgaggaggagatgctgtatggggattcgggctccctcttcagccccagcaaggaggaggcccgaagaagcagccagccccctgctgaccgggaccctgcacccttccgggcagagcctacccactggtgcctgctggtgcgggagaatggcaccatggagatctaccagcttcccgactggcggctggtgttcctggtgaagaacttccctgtggggcagcgggtccttgtggacagctcctttggacagcccactacacagggcgaggcccgcagggaggaggccacgcgccagggggagctgcccctcgtcaaggaggtgctgctggtggcgctgggcagccgccagagcaggccctacctgctggtgcatgtggaccaagagctgcttatctacgaggccttcccccacgactctcagctcggccagggcaatctcaaagtccgctttaagaaggtccctcacaacatcaacttccgtgagaagaagccaaagccatccaagaagaaagcagaaggtggcggcgcagaggagggggctggggcccggggccgcgtggcgcgtttccgctacttcgaggatatttatggctactcaggggtcttcatctgcggcccctcccctcactggctcttggtgaccggccgaggggctctgcggctacaccccatggccatcgacggcccggtcgactctttcgctccattccacaatgtcaactgtccccgcggcttcctgtacttcaacagacagggcgagctgaggatcagtgtcctgcctgcctacctgtcctatgatgccccatggcctgtcaggaagatcccgctgcgctgcacggcccactatgtggcttaccacgtggagtctaaggtgtatgctgtggccaccagcaccaacacgccgtgtgcccgcatcccacgcatgactggcgaggagaaggagtttgagaccatcgagagagatgagcggtacatccacccccagcaggaggccttctccatccagctcatctccccggtcagctgggaggctattcccaatgccaggatcgagctgcaggagtgggagcatgtgacctgcatgaagacagtgtctctgcgcagtgaggagaccgtgtcgggcctcaaaggctacgtggccgccgggacctgcctcatgcagggggaggaggtcacgtgccgagggcggatcttgatcatggatgtgattgaggtggtgcccgagcctggccagcccttgaccaagaacaagttcaaagtcctttacgagaaggagcagaaggggcccgtgaccgccctgtgccactgcaatggccacctggtgtcggccatcggccagaagattttcctgtggagcctgcgggccagcgagctgacgggcatggccttcatcgacacgcagctctacatacaccagatgatcagcgtcaagaacttcatcctggcagccgacgtcatgaagagcatttcgctgctgcgctaccaggaggaaagcaagacgctgagcctggtgtcgcgggatgccaagcccctggaggtgtacagcgtggacttcatggtggacaatgcccagctgggttttctggtgtctgaccgcgaccgcaacctcatggtgtacatgtacctgcccgaagccaaggagagtttcgggggcatgcgcctgctgcgtcgggcagacttccacgtgggtgcccacgtgaacacgttctggaggaccccgtgccgggccactgaagggctcagcaaaaagtcggtcgtgtgggagaataagcacatcacgtggtttgccaccctggacggcggcatcgggctgctgctgcccatgcaggagaagacctaccggcggctgctgatgctgcagaacgcgctgaccaccatgctgccacaccacgccggcctcaacccccgcgccttccggatgctgcacgtggaccgccgcaccctccagaatgccgtgcgcaacgtgctggatggggagctgctcaaccgctacctgtacctgagcaccatggagcgcagcgagctagccaagaagatcggcaccacaccagacataatcctggacgacttgctggagacggaccgcgtcaccgcccacttctagccccgtggatgccgtcaccaccagcacacggaactacctcccaccccctttttgtacaaaacacaaggaaaaacattttttgc

SEQ ID NO: 36138 - DNA, 4740 bp, Homo sapiens
cccggccggactgagttcgctgctgtcccggttcctctcgagtcggctccaactgccagcccgggttggcgccatgtacgccgtgtacaaacaggcgcatccgcccaccggtctggagttctccatgtactgcaacttcttcaacaacagcgagcgcaacctggtagtggccgggacctcgcagctctacgtgtaccgcctcaaccgcgacgccgaggaacaccacagaagaggcaaacagcagccccatcagctttcaggaggcggcggaggcctttgcctcatgactggatgctgatgctttgatgcttggttgggtagtgttggcctggattcccccactgtaagcatggtaagtttagcgatggctgttcttgcggaaatctagttttgcgttcctggaataactcaacccagttgtgttacaatacccctgcttgtcactgggctcatctgcaggcgttttgaggaggctctgaccaagaatgacaggagcacagaggggaaggcccaccgggagaagctcgagcttgctgcctccttctccttctttggcaacgtcatgtccatggccagcgtgcagctggcaggagccaagcgggatgccctgctcctaagcttcaaggatgccaagctgtctgtggtggagtacgacccgggcacccatgacctgaagaccctgtcactgcactactttgaggagcctgagcttcgggacgggtttgtgcagaatgtacacacgccgcgagtgcgggtggaccccgacgggcgctgtgcagccatgcttgtctacggcacgcggctggtggtcctgcccttccgcagggagagcctggctgaggagcacgaggggctcgtgggtgaggggcagaggtccagcttcctgcccagctacatcatcgacgtgcgggccctagacgagaagctgctcaacatcatcgacctgcagttcctgcatggctactacgagcctaccctcctcatcctgtttgagcccaaccagacctggcctgggcgcgtggccgtgcggcaggacacgtgctccattgtggccatctcactgaacatcacgcagaaggtgcaccccgtcatctggtccctcaccagcctgccctttgactgcacccaggctctggctgtgcccaagcccataggtggggtggtggtgtttgccgtcaactcgctgttgtacctgaaccagagcgtccccccgtatggcgtggctctcaacagcctcaccacaggaaccacggctttcccgcttcgcacccaggagggtgtgcggatcaccctggactgcgcccaggccaccttcatctcctacgacaagatggtcatctccctcaagggcggcgagatctacgtgctgaccctcatcaccgacggcatgcgcagtgtccgagcgttccactttgacaaggcggccgccagcgtcctcaccaccagcatggtcaccatggagcccgggtacctgttcctgggttctcgcctgggcaattccctcctcctcaagtacacggagaagctgcaggagcccccggccagtgctgtccgtgaggctgccgacaaggaagagcctccctcaaagaagaagcgagtggatgcgacggccggctggtcagctgcgggtaagtcggtgccgcaggatgaggtggacgagattgaagtgtacggcagcgaggcccagtcgggaacacagctggccacctactcctttgaggtgtgtgacagcatcctgaacattggaccctgtgccaatgccgccgtgggcgagcctgccttcctctctgaagagtttcagaacagccccgagccggacctggagattgtggtttgctccggccacgggaagaacggggctttgtcggtgctgcagaagagcatccggccccaggtggtgacaacctttgagcttcccggctgctatgacatgtggacagtcatcgccccggtgcgtaaggaggaggaggacaatcccaagggggagggcacagagcaggaacccagcaccacccctgaagcagacgacgacggccgcagacacggattcctgattctgagccgggaagactccaccatgatcctgcagacggggcaggagatcatggagctggacaccagtggcttcgccactcagggccccacggtctttgctgggaacatcggggacaaccgctacattgtccaagtgtcaccactgggcatccgcctgctggaaggagtgaatcagctgcacttcatccccgtggacctgggcgcccccatcgtgcagtgcgccgtggccgacccctatgtggtcatcatgagtgccgagggccacgtcaccatgttcctgctgaagagtgactcctacggtggccgccaccaccgcctggcgctgcacaagcccccgctgcaccatcagtccaaggtgattacgctgtgcctgtaccgagacctcagcggcatgttcaccactgagagccgcctgggtggggcccgtgacgagctcgggggccgcagtggcccggaggccgagggcctgggctcagagactagccccacagtggatgacgaggaggagatgctgtatggggattcgggctccctcttcagccccagcaaggaggaggcccgaagaagcagccagccccctgctgaccgggaccctgcacccttccgggcagagcctacccactggtgcctgctggtgcgggagaatggcaccatggagatctaccagcttcccgactggcggctggtgttcctggtgaagaacttccctgtggggcagcgggtccttgtggacagctcctttggacagcccactacacagggcgaggcccgcagggaggaggccacgcgccagggggagctgcccctcgtcaaggaggtgctgctggtggcgctgggcagccgccagagcaggccctacctgctggtgcatgtggaccaagagctgcttatctacgaggccttcccccacgactctcagctcggccagggcaatctcaaagtccgctttaagaaggtccctcacaacatcaacttccgtgagaagaagccaaagccatccaagaagaaagcagaaggtggcggcgcagaggagggggctggggcccggggccgcgtggcgcgtttccgctacttcgaggatatttatggctactcaggggtcttcatctgcggcccctcccctcactggctcttggtgaccggccgaggggctctgcggctacaccccatggccatcgacggcccggtcgactctttcgctccattccacaatgtcaactgtccccgcggcttcctgtacttcaacagacagggcgagctgaggatcagtgtcctgcctgcctacctgtcctatgatgccccatggcctgtcaggaagatcccgctgcgctgcacggcccactatgtggcttaccacgtggagtctaaggtgtatgctgtggccaccagcaccaacacgccgtgtgcccgcatcccacgcatgactggcgaggagaaggagtttgagaccatcgagagagatgagcggtacatccacccccagcaggaggccttctccatccagctcatctccccggtcagctgggaggctattcccaatgccaggatcgagctgcaggagtgggagcatgtgacctgcatgaagacagtgtctctgcgcagtgaggagaccgtgtcgggcctcaaaggctacgtggccgccgggacctgcctcatgcagggggaggaggtcacgtgccgagggcggatcttgatcatggatgtgattgaggtggtgcccgagcctggccagcccttgaccaagaacaagttcaaagtcctttacgagaaggagcagaaggggcccgtgaccgccctgtgccactgcaatggccacctggtgtcggccatcggccagaagattttcctgtggagcctgcgggccagcgagctgacgggcatggccttcatcgacacgcagctctacatacaccagatgatcagcgtcaagaacttcatcctggcagccgacgtcatgaagagcatttcgctgctgcgctaccaggaggaaagcaagacgctgagcctggtgtcgcgggatgccaagcccctggaggtgtacagcgtggacttcatggtggacaatgcccagctgggttttctggtgtctgaccgcgaccgcaacctcatggtgtacatgtacctgcccgaagccaaggagagtttcgggggcatgcgcctgctgcgtcgggcagacttccacgtgggtgcccacgtgaacacgttctggaggaccccgtgccgggccactgaagggctcagcaaaaagtcggtcgtgtgggagaataagcacatcacgtggtttgccaccctggacggcggcatcgggctgctgctgcccatgcaggagaagacctaccggcggctgctgatgctgcagaacgcgctgaccaccatgctgccacaccacgccggcctcaacccccgcgccttccggatgctgcacgtggaccgccgcaccctccagaatgccgtgcgcaacgtgctggatggggagctgctcaaccgctacctgtacctgagcaccatggagcgcagcgagctagccaagaagatcggcaccacaccagacataatcctggacgacttgctggagacggaccgcgtcaccgcccacttctagccccgtggatgccgtcaccaccagcacacggaactacctcccaccccctttttgtacaaaacacaaggaaaaacattttttgc

SEQ ID NO: 36139 - DNA, 5314 bp, Homo sapiens
cccggccggactgagttcgctgctgtcccggttcctctcgagtcggctccaactgccaggtgggcggccgggcgggcggccgaggcggcagcgcgaggccggggaggggcgcggtgcggggccgggctcctgcgtgggcgaccccgctcacccttcctctcccggccttgcgcagcccgggttggcgccatgtacgccgtgtacaaacaggcgcatccgcccaccggtctggagttctccatgtactgcaacttcttcaacaacagcgagcgcaacctggtagtggccgggacctcgcagctctacgtgtaccgcctcaaccgcgacgccgaggaacaccacagaagaggcaaacagcagccccatcagctttcaggaggcggcggaggcctttgcctcatgactggatgctgatgctttgatgcttggttgggtagtgttggcctggattcccccactgtaaggttatttcttccttttgtaactaaaagtatcttgtagggacttattttgaaaccctgtaaacgtcctcttattcagattttcaaggtttttttttctttctttctttctctttttttttttagacggagtctcgctctatcacccaggctggagtgcagtggcacaatctcggctcactgcaagctccacctcctgggttcaagcgattcccctgcctcagctactgaggaggctgagacaggagaatcgcttgaacctggaaggcagaggttgcagtgagccaaaatcacaccattgcactccagcctgggcaacaaagtgagactccatctcaaaaaaaaaaaaaaaattttcctcctatttttgctttactaggagtttttatcacgaatgcctttatcagatgctttttttgtatccactaaaatgacatgatttttctccttaattttgacagcatggtaagtttagcgatggctgttcttgcggaaatctagttttgcgttcctggaataactcaacccagttgtgttacaatacccctgcttgtcactgggctcatctgcaggcgttttgaggaggctctgaccaagaatgacaggagcacagaggggaaggcccaccgggagaagctcgagcttgctgcctccttctccttctttggcaacgtcatgtccatggccagcgtgcagctggcaggagccaagcgggatgccctgctcctaagcttcaaggatgccaagctgtctgtggtggagtacgacccgggcacccatgacctgaagaccctgtcactgcactactttgaggagcctgagcttcgggacgggtttgtgcagaatgtacacacgccgcgagtgcgggtggaccccgacgggcgctgtgcagccatgcttgtctacggcacgcggctggtggtcctgcccttccgcagggagagcctggctgaggagcacgaggggctcgtgggtgaggggcagaggtccagcttcctgcccagctacatcatcgacgtgcgggccctagacgagaagctgctcaacatcatcgacctgcagttcctgcatggctactacgagcctaccctcctcatcctgtttgagcccaaccagacctggcctgggcgcgtggccgtgcggcaggacacgtgctccattgtggccatctcactgaacatcacgcagaaggtgcaccccgtcatctggtccctcaccagcctgccctttgactgcacccaggctctggctgtgcccaagcccataggtggggtggtggtgtttgccgtcaactcgctgttgtacctgaaccagagcgtccccccgtatggcgtggctctcaacagcctcaccacaggaaccacggctttcccgcttcgcacccaggagggtgtgcggatcaccctggactgcgcccaggccaccttcatctcctacgacaagatggtcatctccctcaagggcggcgagatctacgtgctgaccctcatcaccgacggcatgcgcagtgtccgagcgttccactttgacaaggcggccgccagcgtcctcaccaccagcatggtcaccatggagcccgggtacctgttcctgggttctcgcctgggcaattccctcctcctcaagtacacggagaagctgcaggagcccccggccagtgctgtccgtgaggctgccgacaaggaagagcctccctcaaagaagaagcgagtggatgcgacggccggctggtcagctgcgggtaagtcggtgccgcaggatgaggtggacgagattgaagtgtacggcagcgaggcccagtcgggaacacagctggccacctactcctttgaggtgtgtgacagcatcctgaacattggaccctgtgccaatgccgccgtgggcgagcctgccttcctctctgaagagtttcagaacagccccgagccggacctggagattgtggtttgctccggccacgggaagaacggggctttgtcggtgctgcagaagagcatccggccccaggtggtgacaacctttgagcttcccggctgctatgacatgtggacagtcatcgccccggtgcgtaaggaggaggaggacaatcccaagggggagggcacagagcaggaacccagcaccacccctgaagcagacgacgacggccgcagacacggattcctgattctgagccgggaagactccaccatgatcctgcagacggggcaggagatcatggagctggacaccagtggcttcgccactcagggccccacggtctttgctgggaacatcggggacaaccgctacattgtccaagtgtcaccactgggcatccgcctgctggaaggagtgaatcagctgcacttcatccccgtggacctgggcgcccccatcgtgcagtgcgccgtggccgacccctatgtggtcatcatgagtgccgagggccacgtcaccatgttcctgctgaagagtgactcctacggtggccgccaccaccgcctggcgctgcacaagcccccgctgcaccatcagtccaaggtgattacgctgtgcctgtaccgagacctcagcggcatgttcaccactgagagccgcctgggtggggcccgtgacgagctcgggggccgcagtggcccggaggccgagggcctgggctcagagactagccccacagtggatgacgaggaggagatgctgtatggggattcgggctccctcttcagccccagcaaggaggaggcccgaagaagcagccagccccctgctgaccgggaccctgcacccttccgggcagagcctacccactggtgcctgctggtgcgggagaatggcaccatggagatctaccagcttcccgactggcggctggtgttcctggtgaagaacttccctgtggggcagcgggtccttgtggacagctcctttggacagcccactacacagggcgaggcccgcagggaggaggccacgcgccagggggagctgcccctcgtcaaggaggtgctgctggtggcgctgggcagccgccagagcaggccctacctgctggtgcatgtggaccaagagctgcttatctacgaggccttcccccacgactctcagctcggccagggcaatctcaaagtccgctttaagaaggtccctcacaacatcaacttccgtgagaagaagccaaagccatccaagaagaaagcagaaggtggcggcgcagaggagggggctggggcccggggccgcgtggcgcgtttccgctacttcgaggatatttatggctactcaggggtcttcatctgcggcccctcccctcactggctcttggtgaccggccgaggggctctgcggctacaccccatggccatcgacggcccggtcgactctttcgctccattccacaatgtcaactgtccccgcggcttcctgtacttcaacagacagggcgagctgaggatcagtgtcctgcctgcctacctgtcctatgatgccccatggcctgtcaggaagatcccgctgcgctgcacggcccactatgtggcttaccacgtggagtctaaggtgtatgctgtggccaccagcaccaacacgccgtgtgcccgcatcccacgcatgactggcgaggagaaggagtttgagaccatcgagagagatgagcggtacatccacccccagcaggaggccttctccatccagctcatctccccggtcagctgggaggctattcccaatgccaggatcgagctgcaggagtgggagcatgtgacctgcatgaagacagtgtctctgcgcagtgaggagaccgtgtcgggcctcaaaggctacgtggccgccgggacctgcctcatgcagggggaggaggtcacgtgccgagggcggatcttgatcatggatgtgattgaggtggtgcccgagcctggccagcccttgaccaagaacaagttcaaagtcctttacgagaaggagcagaaggggcccgtgaccgccctgtgccactgcaatggccacctggtgtcggccatcggccagaagattttcctgtggagcctgcgggccagcgagctgacgggcatggccttcatcgacacgcagctctacatacaccagatgatcagcgtcaagaacttcatcctggcagccgacgtcatgaagagcatttcgctgctgcgctaccaggaggaaagcaagacgctgagcctggtgtcgcgggatgccaagcccctggaggtgtacagcgtggacttcatggtggacaatgcccagctgggttttctggtgtctgaccgcgaccgcaacctcatggtgtacatgtacctgcccgaagccaaggagagtttcgggggcatgcgcctgctgcgtcgggcagacttccacgtgggtgcccacgtgaacacgttctggaggaccccgtgccgggccactgaagggctcagcaaaaagtcggtcgtgtgggagaataagcacatcacgtggtttgccaccctggacggcggcatcgggctgctgctgcccatgcaggagaagacctaccggcggctgctgatgctgcagaacgcgctgaccaccatgctgccacaccacgccggcctcaacccccgcgccttccggatgctgcacgtggaccgccgcaccctccagaatgccgtgcgcaacgtgctggatggggagctgctcaaccgctacctgtacctgagcaccatggagcgcagcgagctagccaagaagatcggcaccacaccagacataatcctggacgacttgctggagacggaccgcgtcaccgcccacttctagccccgtggatgccgtcaccaccagcacacggaactacctcccaccccctttttgtacaaaacacaaggaaaaacattttttgc

SEQ ID NO: 36140 - DNA, 4725 bp, Homo sapiens
cccggccggactgagttcgctgctgtcccggttcctctcgagtcggctccaactgccaggtgggcggccgggcgggcggccgaggcggcagcgcgaggccggggaggggcgcggtgcggggccgggctcctgcgtgggcgaccccgctcacccttcctctcccggccttgcgcagcccgggttggcgccatgtacgccgtgtacaaacaggcgcatccgcccaccggtctggagttctccatgtactgcaacttcttcaacaacagcgagcgcaacctggtagtggccgggacctcgcagctctacgtgtaccgcctcaaccgcgacgccgagcatggtaagtttagcgatggctgttcttgcggaaatctagttttgcgttcctggaataactcaacccagttgtgttacaatacccctgcttgtcactgggctcatctgcaggcgttttgaggaggctctgaccaagaatgacaggagcacagaggggaaggcccaccgggagaagctcgagcttgctgcctccttctccttctttggcaacgtcatgtccatggccagcgtgcagctggcaggagccaagcgggatgccctgctcctaagcttcaaggatgccaagctgtctgtggtggagtacgacccgggcacccatgacctgaagaccctgtcactgcactactttgaggagcctgagcttcgggacgggtttgtgcagaatgtacacacgccgcgagtgcgggtggaccccgacgggcgctgtgcagccatgcttgtctacggcacgcggctggtggtcctgcccttccgcagggagagcctggctgaggagcacgaggggctcgtgggtgaggggcagaggtccagcttcctgcccagctacatcatcgacgtgcgggccctagacgagaagctgctcaacatcatcgacctgcagttcctgcatggctactacgagcctaccctcctcatcctgtttgagcccaaccagacctggcctgggcgcgtggccgtgcggcaggacacgtgctccattgtggccatctcactgaacatcacgcagaaggtgcaccccgtcatctggtccctcaccagcctgccctttgactgcacccaggctctggctgtgcccaagcccataggtggggtggtggtgtttgccgtcaactcgctgttgtacctgaaccagagcgtccccccgtatggcgtggctctcaacagcctcaccacaggaaccacggctttcccgcttcgcacccaggagggtgtgcggatcaccctggactgcgcccaggccaccttcatctcctacgacaagatggtcatctccctcaagggcggcgagatctacgtgctgaccctcatcaccgacggcatgcgcagtgtccgagcgttccactttgacaaggcggccgccagcgtcctcaccaccagcatggtcaccatggagcccgggtacctgttcctgggttctcgcctgggcaattccctcctcctcaagtacacggagaagctgcaggagcccccggccagtgctgtccgtgaggctgccgacaaggaagagcctccctcaaagaagaagcgagtggatgcgacggccggctggtcagctgcgggtaagtcggtgccgcaggatgaggtggacgagattgaagtgtacggcagcgaggcccagtcgggaacacagctggccacctactcctttgaggtgtgtgacagcatcctgaacattggaccctgtgccaatgccgccgtgggcgagcctgccttcctctctgaagagtttcagaacagccccgagccggacctggagattgtggtttgctccggccacgggaagaacggggctttgtcggtgctgcagaagagcatccggccccaggtggtgacaacctttgagcttcccggctgctatgacatgtggacagtcatcgccccggtgcgtaaggaggaggaggacaatcccaagggggagggcacagagcaggaacccagcaccacccctgaagcagacgacgacggccgcagacacggattcctgattctgagccgggaagactccaccatgatcctgcagacggggcaggagatcatggagctggacaccagtggcttcgccactcagggccccacggtctttgctgggaacatcggggacaaccgctacattgtccaagtgtcaccactgggcatccgcctgctggaaggagtgaatcagctgcacttcatccccgtggacctgggcgcccccatcgtgcagtgcgccgtggccgacccctatgtggtcatcatgagtgccgagggccacgtcaccatgttcctgctgaagagtgactcctacggtggccgccaccaccgcctggcgctgcacaagcccccgctgcaccatcagtccaaggtgattacgctgtgcctgtaccgagacctcagcggcatgttcaccactgagagccgcctgggtggggcccgtgacgagctcgggggccgcagtggcccggaggccgagggcctgggctcagagactagccccacagtggatgacgaggaggagatgctgtatggggattcgggctccctcttcagccccagcaaggaggaggcccgaagaagcagccagccccctgctgaccgggaccctgcacccttccgggcagagcctacccactggtgcctgctggtgcgggagaatggcaccatggagatctaccagcttcccgactggcggctggtgttcctggtgaagaacttccctgtggggcagcgggtccttgtggacagctcctttggacagcccactacacagggcgaggcccgcagggaggaggccacgcgccagggggagctgcccctcgtcaaggaggtgctgctggtggcgctgggcagccgccagagcaggccctacctgctggtgcatgtggaccaagagctgcttatctacgaggccttcccccacgactctcagctcggccagggcaatctcaaagtccgctttaagaaggtccctcacaacatcaacttccgtgagaagaagccaaagccatccaagaagaaagcagaaggtggcggcgcagaggagggggctggggcccggggccgcgtggcgcgtttccgctacttcgaggatatttatggctactcaggggtcttcatctgcggcccctcccctcactggctcttggtgaccggccgaggggctctgcggctacaccccatggccatcgacggcccggtcgactctttcgctccattccacaatgtcaactgtccccgcggcttcctgtacttcaacagacagggcgagctgaggatcagtgtcctgcctgcctacctgtcctatgatgccccatggcctgtcaggaagatcccgctgcgctgcacggcccactatgtggcttaccacgtggagtctaaggtgtatgctgtggccaccagcaccaacacgccgtgtgcccgcatcccacgcatgactggcgaggagaaggagtttgagaccatcgagagagatgagcggtacatccacccccagcaggaggccttctccatccagctcatctccccggtcagctgggaggctattcccaatgccaggatcgagctgcaggagtgggagcatgtgacctgcatgaagacagtgtctctgcgcagtgaggagaccgtgtcgggcctcaaaggctacgtggccgccgggacctgcctcatgcagggggaggaggtcacgtgccgagggcggatcttgatcatggatgtgattgaggtggtgcccgagcctggccagcccttgaccaagaacaagttcaaagtcctttacgagaaggagcagaaggggcccgtgaccgccctgtgccactgcaatggccacctggtgtcggccatcggccagaagattttcctgtggagcctgcgggccagcgagctgacgggcatggccttcatcgacacgcagctctacatacaccagatgatcagcgtcaagaacttcatcctggcagccgacgtcatgaagagcatttcgctgctgcgctaccaggaggaaagcaagacgctgagcctggtgtcgcgggatgccaagcccctggaggtgtacagcgtggacttcatggtggacaatgcccagctgggttttctggtgtctgaccgcgaccgcaacctcatggtgtacatgtacctgcccgaagccaaggagagtttcgggggcatgcgcctgctgcgtcgggcagacttccacgtgggtgcccacgtgaacacgttctggaggaccccgtgccgggccactgaagggctcagcaaaaagtcggtcgtgtgggagaataagcacatcacgtggtttgccaccctggacggcggcatcgggctgctgctgcccatgcaggagaagacctaccggcggctgctgatgctgcagaacgcgctgaccaccatgctgccacaccacgccggcctcaacccccgcgccttccggatgctgcacgtggaccgccgcaccctccagaatgccgtgcgcaacgtgctggatggggagctgctcaaccgctacctgtacctgagcaccatggagcgcagcgagctagccaagaagatcggcaccacaccagacataatcctggacgacttgctggagacggaccgcgtcaccgcccacttctagccccgtggatgccgtcaccaccagcacacggaactacctcccaccccctttttgtacaaaacacaaggaaaaacattttttgc

SEQ ID NO: 36141 - DNA, 4478 bp, Homo sapiens
gcagggcttcctcttctctaacaggcacgcagatcagtagctacagataccccttggctctggcttcctgccctgtgacatttggacccaggggccggggctgggctgctgtaggtgtgcaaccaggcaggtttgggggtgtgcagacacagagtgcactctaaccctgagtgcttgccgcacagggcctggctgctagggagccgtgaggctctgaccaagaatgacaggagcacagaggggaaggcccaccgggagaagctcgagcttgctgcctccttctccttctttggcaacgtcatgtccatggccagcgtgcagctggcaggagccaagcgggatgccctgctcctaagcttcaaggatgccaagctgtctgtggtggagtacgacccgggcacccatgacctgaagaccctgtcactgcactactttgaggagcctgagcttcgggacgggtttgtgcagaatgtacacacgccgcgagtgcgggtggaccccgacgggcgctgtgcagccatgcttgtctacggcacgcggctggtggtcctgcccttccgcagggagagcctggctgaggagcacgaggggctcgtgggtgaggggcagaggtccagcttcctgcccagctacatcatcgacgtgcgggccctagacgagaagctgctcaacatcatcgacctgcagttcctgcatggctactacgagcctaccctcctcatcctgtttgagcccaaccagacctggcctgggcgcgtggccgtgcggcaggacacgtgctccattgtggccatctcactgaacatcacgcagaaggtgcaccccgtcatctggtccctcaccagcctgccctttgactgcacccaggctctggctgtgcccaagcccataggtggggtggtggtgtttgccgtcaactcgctgttgtacctgaaccagagcgtccccccgtatggcgtggctctcaacagcctcaccacaggaaccacggctttcccgcttcgcacccaggagggtgtgcggatcaccctggactgcgcccaggccaccttcatctcctacgacaagatggtcatctccctcaagggcggcgagatctacgtgctgaccctcatcaccgacggcatgcgcagtgtccgagcgttccactttgacaaggcggccgccagcgtcctcaccaccagcatggtcaccatggagcccgggtacctgttcctgggttctcgcctgggcaattccctcctcctcaagtacacggagaagctgcaggagcccccggccagtgctgtccgtgaggctgccgacaaggaagagcctccctcaaagaagaagcgagtggatgcgacggccggctggtcagctgcgggtaagtcggtgccgcaggatgaggtggacgagattgaagtgtacggcagcgaggcccagtcgggaacacagctggccacctactcctttgaggtgtgtgacagcatcctgaacattggaccctgtgccaatgccgccgtgggcgagcctgccttcctctctgaagagtttcagaacagccccgagccggacctggagattgtggtttgctccggccacgggaagaacggggctttgtcggtgctgcagaagagcatccggccccaggtggtgacaacctttgagcttcccggctgctatgacatgtggacagtcatcgccccggtgcgtaaggaggaggaggacaatcccaagggggagggcacagagcaggaacccagcaccacccctgaagcagacgacgacggccgcagacacggattcctgattctgagccgggaagactccaccatgatcctgcagacggggcaggagatcatggagctggacaccagtggcttcgccactcagggccccacggtctttgctgggaacatcggggacaaccgctacattgtccaagtgtcaccactgggcatccgcctgctggaaggagtgaatcagctgcacttcatccccgtggacctgggcgcccccatcgtgcagtgcgccgtggccgacccctatgtggtcatcatgagtgccgagggccacgtcaccatgttcctgctgaagagtgactcctacggtggccgccaccaccgcctggcgctgcacaagcccccgctgcaccatcagtccaaggtgattacgctgtgcctgtaccgagacctcagcggcatgttcaccactgagagccgcctgggtggggcccgtgacgagctcgggggccgcagtggcccggaggccgagggcctgggctcagagactagccccacagtggatgacgaggaggagatgctgtatggggattcgggctccctcttcagccccagcaaggaggaggcccgaagaagcagccagccccctgctgaccgggaccctgcacccttccgggcagagcctacccactggtgcctgctggtgcgggagaatggcaccatggagatctaccagcttcccgactggcggctggtgttcctggtgaagaacttccctgtggggcagcgggtccttgtggacagctcctttggacagcccactacacagggcgaggcccgcagggaggaggccacgcgccagggggagctgcccctcgtcaaggaggtgctgctggtggcgctgggcagccgccagagcaggccctacctgctggtgcatgtggaccaagagctgcttatctacgaggccttcccccacgactctcagctcggccagggcaatctcaaagtccgctttaagaaggtccctcacaacatcaacttccgtgagaagaagccaaagccatccaagaagaaagcagaaggtggcggcgcagaggagggggctggggcccggggccgcgtggcgcgtttccgctacttcgaggatatttatggctactcaggggtcttcatctgcggcccctcccctcactggctcttggtgaccggccgaggggctctgcggctacaccccatggccatcgacggcccggtcgactctttcgctccattccacaatgtcaactgtccccgcggcttcctgtacttcaacagacagggcgagctgaggatcagtgtcctgcctgcctacctgtcctatgatgccccatggcctgtcaggaagatcccgctgcgctgcacggcccactatgtggcttaccacgtggagtctaaggtgtatgctgtggccaccagcaccaacacgccgtgtgcccgcatcccacgcatgactggcgaggagaaggagtttgagaccatcgagagagatgagcggtacatccacccccagcaggaggccttctccatccagctcatctccccggtcagctgggaggctattcccaatgccaggatcgagctgcaggagtgggagcatgtgacctgcatgaagacagtgtctctgcgcagtgaggagaccgtgtcgggcctcaaaggctacgtggccgccgggacctgcctcatgcagggggaggaggtcacgtgccgagggcggatcttgatcatggatgtgattgaggtggtgcccgagcctggccagcccttgaccaagaacaagttcaaagtcctttacgagaaggagcagaaggggcccgtgaccgccctgtgccactgcaatggccacctggtgtcggccatcggccagaagattttcctgtggagcctgcgggccagcgagctgacgggcatggccttcatcgacacgcagctctacatacaccagatgatcagcgtcaagaacttcatcctggcagccgacgtcatgaagagcatttcgctgctgcgctaccaggaggaaagcaagacgctgagcctggtgtcgcgggatgccaagcccctggaggtgtacagcgtggacttcatggtggacaatgcccagctgggttttctggtgtctgaccgcgaccgcaacctcatggtgtacatgtacctgcccgaagccaaggagagtttcgggggcatgcgcctgctgcgtcgggcagacttccacgtgggtgcccacgtgaacacgttctggaggaccccgtgccgggccactgaagggctcagcaaaaagtcggtcgtgtgggagaataagcacatcacgtggtttgccaccctggacggcggcatcgggctgctgctgcccatgcaggagaagacctaccggcggctgctgatgctgcagaacgcgctgaccaccatgctgccacaccacgccggcctcaacccccgcgccttccggatgctgcacgtggaccgccgcaccctccagaatgccgtgcgcaacgtgctggatggggagctgctcaaccgctacctgtacctgagcaccatggagcgcagcgagctagccaagaagatcggcaccacaccagacataatcctggacgacttgctggagacggaccgcgtcaccgcccacttctagccccgtggatgccgtcaccaccagcacacggaactacctcccaccccctttttgtacaaaacacaaggaaaaacattttttgc

SEQ ID NO: 36142 - DNA, 4189 bp, Homo sapiens
tcagctcggtaccagttctactccacaaacagctggcaggagccaagcgggatgccctgctcctaagcttcaaggatgccaagctgtctgtggtggagtacgacccgggcacccatgacctgaagaccctgtcactgcactactttgaggagcctgagcttcgggacgggtttgtgcagaatgtacacacgccgcgagtgcgggtggaccccgacgggcgctgtgcagccatgcttgtctacggcacgcggctggtggtcctgcccttccgcagggagagcctggctgaggagcacgaggggctcgtgggtgaggggcagaggtccagcttcctgcccagctacatcatcgacgtgcgggccctagacgagaagctgctcaacatcatcgacctgcagttcctgcatggctactacgagcctaccctcctcatcctgtttgagcccaaccagacctggcctgggcgcgtggccgtgcggcaggacacgtgctccattgtggccatctcactgaacatcacgcagaaggtgcaccccgtcatctggtccctcaccagcctgccctttgactgcacccaggctctggctgtgcccaagcccataggtggggtggtggtgtttgccgtcaactcgctgttgtacctgaaccagagcgtccccccgtatggcgtggctctcaacagcctcaccacaggaaccacggctttcccgcttcgcacccaggagggtgtgcggatcaccctggactgcgcccaggccaccttcatctcctacgacaagatggtcatctccctcaagggcggcgagatctacgtgctgaccctcatcaccgacggcatgcgcagtgtccgagcgttccactttgacaaggcggccgccagcgtcctcaccaccagcatggtcaccatggagcccgggtacctgttcctgggttctcgcctgggcaattccctcctcctcaagtacacggagaagctgcaggagcccccggccagtgctgtccgtgaggctgccgacaaggaagagcctccctcaaagaagaagcgagtggatgcgacggccggctggtcagctgcgggtaagtcggtgccgcaggatgaggtggacgagattgaagtgtacggcagcgaggcccagtcgggaacacagctggccacctactcctttgaggtgtgtgacagcatcctgaacattggaccctgtgccaatgccgccgtgggcgagcctgccttcctctctgaagagtttcagaacagccccgagccggacctggagattgtggtttgctccggccacgggaagaacggggctttgtcggtgctgcagaagagcatccggccccaggtggtgacaacctttgagcttcccggctgctatgacatgtggacagtcatcgccccggtgcgtaaggaggaggaggacaatcccaagggggagggcacagagcaggaacccagcaccacccctgaagcagacgacgacggccgcagacacggattcctgattctgagccgggaagactccaccatgatcctgcagacggggcaggagatcatggagctggacaccagtggcttcgccactcagggccccacggtctttgctgggaacatcggggacaaccgctacattgtccaagtgtcaccactgggcatccgcctgctggaaggagtgaatcagctgcacttcatccccgtggacctgggcgcccccatcgtgcagtgcgccgtggccgacccctatgtggtcatcatgagtgccgagggccacgtcaccatgttcctgctgaagagtgactcctacggtggccgccaccaccgcctggcgctgcacaagcccccgctgcaccatcagtccaaggtgattacgctgtgcctgtaccgagacctcagcggcatgttcaccactgagagccgcctgggtggggcccgtgacgagctcgggggccgcagtggcccggaggccgagggcctgggctcagagactagccccacagtggatgacgaggaggagatgctgtatggggattcgggctccctcttcagccccagcaaggaggaggcccgaagaagcagccagccccctgctgaccgggaccctgcacccttccgggcagagcctacccactggtgcctgctggtgcgggagaatggcaccatggagatctaccagcttcccgactggcggctggtgttcctggtgaagaacttccctgtggggcagcgggtccttgtggacagctcctttggacagcccactacacagggcgaggcccgcagggaggaggccacgcgccagggggagctgcccctcgtcaaggaggtgctgctggtggcgctgggcagccgccagagcaggccctacctgctggtgcatgtggaccaagagctgcttatctacgaggccttcccccacgactctcagctcggccagggcaatctcaaagtccgctttaagaaggtccctcacaacatcaacttccgtgagaagaagccaaagccatccaagaagaaagcagaaggtggcggcgcagaggagggggctggggcccggggccgcgtggcgcgtttccgctacttcgaggatatttatggctactcaggggtcttcatctgcggcccctcccctcactggctcttggtgaccggccgaggggctctgcggctacaccccatggccatcgacggcccggtcgactctttcgctccattccacaatgtcaactgtccccgcggcttcctgtacttcaacagacagggcgagctgaggatcagtgtcctgcctgcctacctgtcctatgatgccccatggcctgtcaggaagatcccgctgcgctgcacggcccactatgtggcttaccacgtggagtctaaggtgtatgctgtggccaccagcaccaacacgccgtgtgcccgcatcccacgcatgactggcgaggagaaggagtttgagaccatcgagagagatgagcggtacatccacccccagcaggaggccttctccatccagctcatctccccggtcagctgggaggctattcccaatgccaggatcgagctgcaggagtgggagcatgtgacctgcatgaagacagtgtctctgcgcagtgaggagaccgtgtcgggcctcaaaggctacgtggccgccgggacctgcctcatgcagggggaggaggtcacgtgccgagggcggatcttgatcatggatgtgattgaggtggtgcccgagcctggccagcccttgaccaagaacaagttcaaagtcctttacgagaaggagcagaaggggcccgtgaccgccctgtgccactgcaatggccacctggtgtcggccatcggccagaagattttcctgtggagcctgcgggccagcgagctgacgggcatggccttcatcgacacgcagctctacatacaccagatgatcagcgtcaagaacttcatcctggcagccgacgtcatgaagagcatttcgctgctgcgctaccaggaggaaagcaagacgctgagcctggtgtcgcgggatgccaagcccctggaggtgtacagcgtggacttcatggtggacaatgcccagctgggttttctggtgtctgaccgcgaccgcaacctcatggtgtacatgtacctgcccgaagccaaggagagtttcgggggcatgcgcctgctgcgtcgggcagacttccacgtgggtgcccacgtgaacacgttctggaggaccccgtgccgggccactgaagggctcagcaaaaagtcggtcgtgtgggagaataagcacatcacgtggtttgccaccctggacggcggcatcgggctgctgctgcccatgcaggagaagacctaccggcggctgctgatgctgcagaacgcgctgaccaccatgctgccacaccacgccggcctcaacccccgcgccttccggatgctgcacgtggaccgccgcaccctccagaatgccgtgcgcaacgtgctggatggggagctgctcaaccgctacctgtacctgagcaccatggagcgcagcgagctagccaagaagatcggcaccacaccagacataatcctggacgacttgctggagacggaccgcgtcaccgcccacttctagccccgtggatgccgtcaccaccagcacacggaactacctcccaccccctttttgtacaaaacacaaggaaaaacattttttgc

SEQ ID NO: 36143 - DNA, 3561 bp, Homo sapiens
ctcattgcaaattcccggactgctaggcgaggagagggaagggggcggaggagacagggctactgcaggcgcagagctgggggcagccgggggcccgagtggctgaggctggtcccgcagcggccgcttgccggcgttctggctcctgtggcctcaccaggaagcgtcagagtcccgacactggggaagctcggagcgccgcctccgctgccgccgcctcctgcctggctctgggtccccgagccccctcccctggcccagcccgactccctcctccttcccgaaccatccggctcgggctccttccctggcgatggctggccgctgagccatggctcagtacggccaccccagtccgctcggcatggctgcgagagaggagctgtacagcaaagtcaccccccggaggaaccgccaacagcgccccggcaccatcaagcatggatcggcgctggacgtgctcctctccatggggttccccagagcccgcgcacaaaaagccttggcatccacgggaggaagaagtgttcaggcagcatgtgactggttattctcccatgtcggtgaccccttcctggatgaccccctgccccgggagtacgtcctctacctccgtcccaccggccccttagcacagaagctttccgacttttggcagcagtcgaagcagatctgcgggaagaacaaggcacacaacatcttcccccacatcacactctgccagttctttatgtgcgaggacagcaaggtggatgccctgggggaagccctgcagaccacggtcagtcgctggaaatgtaagttctcggccccgctgcccctggagctctatacgtcgtccaacttcatcggcctctttgtaaaggaagacagtgcggaggtcctcaagaagtttgctgctgactttgctgcagaggctgcatccaaaaccgaagtgcatgtggaacctcataagaagcagctacatgtgaccctggcttaccacttccaagccagccacctacccaccctagagaaactggcccagaacattgacgtcaagctagggtgtgactgggtggctaccatattttctcgggatatccgatttgctaaccatgagacattacaggtcatctacccctataccccacaaaatgacgatgagctggagctggtccccggggacttcatcttcatgtctccaatggagcagaccagcaccagcgagggttggatctatggcacgtccttaaccaccggctgctctggactcctgcctgagaattacattaccaaggctgatgaatgcagcacctggatatttcatggttcttattcaatcttaaatacatcgtcatccaactctctcacgtttggggatggagtattggagaggcggccttatgaggaccaggggctcggggagacgactcctcttactatcatctgccagcccatgcagccgctgagggtcaacagccagcccggcccccagaagcgatgcctttttgtgtgtcggcatggtgagaggatggatgttgtgtttgggaagtactggctgtcccagtgcttcgatgccaaaggccgctacatacgcaccaacctgaacatgcctcatagtttacctcagcggagtggtggtttccgagattacgagaaagatgctcccatcactgtgtttggatgcatgcaagcaagactagtgggtgaagccttattagagagcaataccattatcgatcatgtctattgctccccgtcccttcgctgcgttcagactgcacacaatatcttgaaaggtttacaacaagaaaatcacttgaagatccgtgtagagcccggcttatttgagtggacaaaatgggttgctgggagcacattacctgcatggatacctccatcagagttagctgcagccaacctgagtgttgatacaacctacagacctcacattccaatcagcaaattagttgtttcagaatcctatgatacttatatcagtagaagtttccaagtaacaaaagaaataataagtgaatgtaaaagtaaaggaaataacatcctgattgtggcccacgcatcttcccttgaagcgtgtacctgccaacttcagggcctgtcacctcagaactccaaggacttcgtacaaatggtccgaaagatcccatatctgggattttgttcctgtgaagaattaggagaaactggaatatggcagctgacagatccaccaatccttcctcttacccatggaccaactgggggcttcaactggagagagaccttgcttcaagaataaaccacaccagtgaacaagaaggaaaggccttttggagtgtgtctttctgtgtgtttaaaaacagtgggaaaatccacaccacactctaagtggacagctcagaataatttagcatatttcctttcacacttaaagttcttaagatgagactgtgtaaatgagagaaagacttgattcagaggaaaaaaatgtgttctctctggactcttgcctagctcacaaggctttggagaattgtcttcctaaatcggggcacctgctacagaagagaatgtttcgttccctctgggtatgcacagctaaggggcctcatttctcccagagggagctgctggcccgctctaaggggtgcaagaggaaggagtgtgcccagaccagctgggggagcattgaaaggacagcttggggatggaatttttttttttttatctccattttccagttaggtagagccaagctgaggaatccttttaagattattagaaaacatgccctgaagagagttgttcttaggttacacatgaaatcctaccgtcactagcccccatacaccagtgttgctggctgaagatacccgcttaaggatgctaacatttaccctggtactgccacattttctctagagcagctggcccttcttgctacagccctatcccccctccttgcttctgtgaaatggggagacaaagcacttttgctctccaaagcacttttggatactcaggaggaaagataagatacatgtttgaagtattcaatcataggagcaaagaacttgcaaaatatgaagtgacttggaattaaccatgttgtagcctaacgtgctactgcatttctaaatcatcaatatttgcttgtctttgcccctagactctagactatgttaactagttaaggatgttacattttgaaaggatgtatgttagatatattatttgcagcaagaagttcattctgtgcaatatggacatgtttgcaaaccataccaagggtcaggttgttgtacacttacagtacgtgtcaaccataatggaacatccacaaatgcatcaattataccagggatgtatagtaagtcagggaactaatataaatgatgacagtcatggctgcactgctacttgtgctgtcgttttgtttgtttttctatgataatttaaaatacataggtagggctactgaggaaatttggagagccacattctgtggtttctcattatacttacttcctgcatttagagggagtttatttaaaagaaataaatgacaatcaaaccaaa

SEQ ID NO: 36144 - DNA, 1016 bp, Homo sapiens
ctcattgcaaattcccggactgctaggcgaggagagggaagggggcggaggagacagggctactgcaggcgcagagctgggggcagccgggggcccgagtggctgaggctggtcccgcagcggccgcttgccggcgttctggctcctgtggcctcaccaggaagcgtcagagtcccgacactggggaagctcggagcgccgcctccgctgccgccgcctcctgcctggctctgggtccccgagccccctcccctggcccagcccgactccctcctccttcccgaaccatccggctcgggctccttccctggcgatggctggccgctgagccatggctcagtacggccaccccagtccgctcggcatggctgcgagagaggagctgtacagcaaagtcaccccccggaggaaccgccaacagcgccccggcaccatcaagcatggatcggcgctggacgtgctcctctccatggggttccccagagcccgcgcgtaagtggccgggctcgcagccctcggcgacccctcccgcgcgcgcggccggccctcggcttcgctccggctcgcctcccagcgcctgcgggacaggcagcgcgctccccgctgcccgagacctgttgggggcgggatgggcgcgctggcaacccgggactcggctccgggcgggggtgcgggggaagacgcggcgcgggggcgttgggccagggctcgccgtgggatgcctaaagctgggggacgagggcgcggggttcgagtcccgggtatagtgctcagcctccgccccagccgggtggagctcagcgtttctctcgcgcgctcccctaggtctccagcgccgagcgcctagggaggcggggccctgcggaggactcgggcaccctctccgtctggaatactgggctggtctgggatcctccggtgtctgggaaagggcgggagactgcggggcagggaggccggcgcccccgttgcagcggcttccagctccggatgtcgctctcgggttcggtctcccc

SEQ ID NO: 36145 - DNA, 6873 bp, Homo sapiens
ctcattgcaaattcccggactgctaggcgaggagagggaagggggcggaggagacagggctactgcaggcgcagagctgggggcagccgggggcccgagtggctgaggctggtcccgcagcggccgcttgccggcgttctggctcctgtggcctcaccaggaagcgtcagagtcccgacactggggaagctcggagcgccgcctccgctgccgccgcctcctgcctggctctgggtccccgagccccctcccctggcccagcccgactccctcctccttcccgaaccatccggctcgggctccttccctggcgatggctggccgctgagccatggctcagtacggccaccccagtccgctcggcatggctgcgagagaggagctgtacagcaaagtcaccccccggaggaaccgccaacagcgccccggcaccatcaagcatggatcggcgctggacgtgctcctctccatggggttccccagagcccgcgcacaaaaagccttggcatccacgggaggaagaagtgttcaggcagcatgtgactggttattctcccatgtcggtgaccccttcctggatgaccccctgccccgggagtacgtcctctacctccgtcccaccggccccttagcacagaagctttccgacttttggcagcagtcgaagcagatctgcgggaagaacaaggcacacaacatcttcccccacatcacactctgccagttctttatgtgcgaggacagcaaggtggatgccctgggggaagccctgcagaccacggtcagtcgctggaaatgtaagttctcggccccgctgcccctggagctctatacgtcgtccaacttcatcggcctctttgtaaaggaagacagtgcggaggtcctcaagaagtttgctgctgactttgctgcagaggctgcatccaaaaccgaagtgcatgtggaacctcataagaagcagctacatgtgaccctggcttaccacttccaagccagccacctacccaccctagagaaactggcccagaacattgacgtcaagctagggtgtgactgggtggctaccatattttctcgggatatccgatttgctaaccatgagacattacaggtcatctacccctataccccacaaaatgacgatgagctggagctggtccccggggacttcatcttcatgtctccaatggagcagaccagcaccagcgagggttggatctatggcacgtccttaaccaccggctgctctggactcctgcctgagaattacattaccaaggctgatgaatgcagcacctggatatttcatggttcttattcaatcttaaatacatcgtcatccaactctctcacgtttggggatggagtattggagaggcggccttatgaggaccaggggctcggggagacgactcctcttactatcatctgccagcccatgcagccgctgagggtcaacagccagcccggcccccagaagcgatgcctttttgtgtgtcggcatggtgagaggatggatgttgtgtttgggaagtactggctgtcccagtgcttcgatgccaaaggccgctacatacgcaccaacctgaacatgcctcatagtttacctcagcggagtggtggtttccgagattacgagaaagatgctcccatcactgtgtttggatgcatgcaagcaagactagtgggtgaagccttattagagagcaataccattatcgatcatgtctattgctccccgtcccttcgctgcgttcagactgcacacaatatcttgaaaggtttacaacaagaaaatcacttgaagatccgtgtagagcccggcttatttgagtggacaaaatgggttgctgggagcacattacctgcatggatacctccatcagagttagctgcagccaacctgagtgttgatacaacctacagacctcacattccaatcagcaaattagttgtttcagaatcctatgatacttatatcagtagaagtttccaagtaacaaaagaaataataagtgaatgtaaaagtaaaggaaataacatcctgattgtggcccacgcatcttcccttgaagcgtgtacctgccaacttcagggcctgtcacctcagaactccaaggacttcgtacaaatggtccgaaagatcccatatctgggattttgttcctgtgaagaattaggagaaactggaatatggcagctgacagatccaccaatccttcctcttacccatggaccaactgggggcttcaactggagagagaccttgcttcaagaataaaccacaccagtgaacaagaaggaaaggccttttggagtgtgtctttctgtgtgtttaaaaacagtgggaaaatccacaccacactctaagtggacagctcagaataatttagcatatttcctttcacacttaaagttcttaagatgagactgtgtaaatgagagaaagacttgattcagaggaaaaaaatgtgttctctctggactcttgcctagctcacaaggctttggagaattgtcttcctaaatcggggcacctgctacagaagagaatgtttcgttccctctgggtatgcacagctaaggggcctcatttctcccagagggagctgctggcccgctctaaggggtgcaagaggaaggagtgtgcccagaccagctgggggagcattgaaaggacagcttggggatggaatttttttttttttatctccattttccagttaggtagagccaagctgaggaatccttttaagattattagaaaacatgccctgaagagagttgttcttaggttacacatgaaatcctaccgtcactagcccccatacaccagtgttgctggctgaagatacccgcttaaggatgctaacatttaccctggtactgccacattttctctagagcagctggcccttcttgctacagccctatcccccctccttgcttctgtgaaatggggagacaaagcacttttgctctccaaagcacttttggatactcaggaggaaagataagatacatgtttgaagtattcaatcataggagcaaagaacttgcaaaatatgaagtgacttggaattaaccatgttgtagcctaacgtgctactgcatttctaaatcatcaatatttgcttgtctttgcccctagactctagactatgttaactagttaaggatgttacattttgaaaggatgtatgttagatatattatttgcagcaagaagttcattctgtgcaatatggacatgtttgcaaaccataccaagggtcaggttgttgtacacttacagtacgtgtcaaccataatggaacatccacaaatgcatcaattataccagggatgtatagtaagtcagggaactaatataaatgatgacagtcatggctgcactgctacttgtgctgtcgttttgtttgtttttctatgataatttaaaatacataggtagggctactgaggaaatttggagagccacattctgtggtttctcattatacttacttcctgcatttagagggagtttatttaaaagaaataaatgacaatcaaaccaaatcatcagttatcaatgtctgtttaattgtgtgactatctgactgttgatggccacagatgatggtctcctatggtatagttcactctgtagaagatgtatgcaaagtgaaatgccagccctttaaagagacattagttagtgtaaaatggatctttacatgttgcagtaacattgactatgtttcaaaactcagatgcataaaacgtaaggtatataaaaatacatctatgcttgcgtttgaaactacaacttgataacccctagaaagaagaggacatgagaggatgctggctatatatgttaatgagcaaaaggattatagttgttttgttttgtttttagagacagggtctcactataatgcttagactggtcttgaactcctgggctcaagcgatcctcctgcccctgtctcccaaagtgctaggattacaggtgtgagccaccacacctggcccatagttgtattttttttaggtcacttagaaaaatatgtcatgtattttacattttgagaaacaaatcaatcatggtttcttctagcgttgcgcaaacactgacccagcttctgggtatggaaataaccctgtgatgatgtgttaatataaaatgttgggagggaatattcccaataaaggtcttaagagaaaagtcacattacaagtaatgtaatggctctaccattcattcttctggtatttgtaatgaagtgaatccactgtttaatcagatccataatctttaacagattcaccacaaattttcatgggcgttgagtgctcagaataatgcttgaacacctcaccttgaaactgtagcagtgtgttctgggcagtatctgtaatgtatgaaatagagtctggaataggttatccactccatcttctaggttatcttagttgtatgacgaactgataaatctgtctgactgggctacaatccattgttcttagtccaatatggacactgccttaggcaatggtctatataagcaaaaggagatagagatctgaaataattttccgaataattcaggtggaaaacaagaaagattgtatttctctgctttcatttcaatttcattatttcaaattgcttgtcaaaatggcccaaaagatctgaattcacattaagttccccttgcacacttacctatttaaaaaactaaacttgcactgcaactgagaaattatttgtaaatcatgtggcatctatgtataataaaagaaagagacaactatattactcaatttcatatacatccaaaaagtataggctaatatatataacctgaagttgcagctggttctttttgatctgaagctgatgcttattaaaacaaatgatgtatggggagaggagaaggaagggcaaggaaggaattgacagataagaagcaaatggtttcttgtacagaggaattttgttttaatgtagaaagttatttgaaataaactaggtgaaatgaaattaactaaaggttttaatctgggattgaaagcctgatagcatttcctgcttctacaagtgtgccacatcaatccggtaatgccccagtgttattcacagacagaactttgtttcctgtgattttaaaataccgcgtctgttcctccatggaccagagtaattggcacattttaatgcataagctgggggtttcattttcccaggctctcttcaccatcactgcattggtagctaggagcttattgcttcaccccagtatggagttcagattacagtgttttccattacatttagattcatagaatctgaatggctgattaaatggccatctgatggctgaaagaggggcgtatttttcactctgtagtgaaaggcttggaggagtttctactttttattttaattatactttaaccaaagaattattttaaagtaaccttatatttaaaagatgattttgcaaaaaataaaaaataaaaaatatgccttctggagtgatgtctgtttggtaaatcattgttgataatttccttgttagtggtatttggaatgcatatagattgtcttgtcattgtgcttaacattaccataagtgtgtcttttccactcaactagctgtattcgtattaaaatgaagtctcttatttcaattacctagtgttgttgggaactaattgaacagctacagtaaaagaagttcctatctcattgcctttgtggaaaggcttccctatgtggtaaaagaaaggcattcctccgtaacctaggcactctgcaagtccagtgtttaatttcaaagcagtgatgaattgctcttttgaaattactctaagtaatccatgtgttagaatacagatgaacctccgtttgatttcacagccttcagcacaggcaactgttactgagtctgcacgaacttagataatgaggtgcagggttatttgcatttaaattgcaatccagcacacgtgtgagaaagaagaggcactagtctaaaaggctgcattgcggggagagatgagacaggcagaggagggtggggtaaagagcgatttaacatctatttaggttaatgttcactttacaaaggtgatgggggatattttgttaggtgatagcagatgcttttcatttttaaacatagaattaaaattggatttgcttctctttaatacttcaacatattgaatttccctaggaaagtgactagctataatgaaaattcaagcgaaaagggaaaaagattgtaaatgcagatgaaataacttcatttttaagtacaaataatagtaggattggtgtatgtaggtttaaaattatagtgatgactagtcgaacttaatatacaatcagttcttgcaaatactttacacttagctgccattacacaacaaattggaattttccagctgttcaactatcatggactctgtacaggatagatgtgtataatggaaaatatgtactgcttctttctttgattgccactcaagatggaaacaccatgccaaggcattttggttatacacagatcattctaaacctgttattttggagaggtgtattggtttctttctcatttataaggctattgtatttttttttgtatgtgattcaggtgtatttatttgaagactatttgtagttataggaaaaccacacctacctgtattgccaaattctttgtaaactctccgtggcacttgtgctttcctggctgagagctctcccctgttgatacagctatggcaccattgtaattacagatgcacctttcaggagcatctccattaaatggttcatagatgatttaataaaaagaaacttctcagttgatccag

SEQ ID NO: 36146 - DNA, 6260 bp, Homo sapiens
ggttaagtaattgcattatcagcctcctccagtctctggggagaggatgccaatgttaagtagcagcagacttccatctccccttgtctctgagtgaagactgcctgttttccctgccagtgcgaggacagcaaggtggatgccctgggggaagccctgcagaccacggtcagtcgctggaaatgtaagttctcggccccgctgcccctggagctctatacgtcgtccaacttcatcggcctctttgtaaaggaagacagtgcggaggtcctcaagaagtttgctgctgactttgctgcagaggctgcatccaaaaccgaagtgcatgtggaacctcataagaagcagctacatgtgaccctggcttaccacttccaagccagccacctacccaccctagagaaactggcccagaacattgacgtcaagctagggtgtgactgggtggctaccatattttctcgggatatccgatttgctaaccatgagacattacaggtcatctacccctataccccacaaaatgacgatgagctggagctggtccccggggacttcatcttcatgtctccaatggagcagaccagcaccagcgagggttggatctatggcacgtccttaaccaccggctgctctggactcctgcctgagaattacattaccaaggctgatgaatgcagcacctggatatttcatggttcttattcaatcttaaatacatcgtcatccaactctctcacgtttggggatggagtattggagaggcggccttatgaggaccaggggctcggggagacgactcctcttactatcatctgccagcccatgcagccgctgagggtcaacagccagcccggcccccagaagcgatgcctttttgtgtgtcggcatggtgagaggatggatgttgtgtttgggaagtactggctgtcccagtgcttcgatgccaaaggccgctacatacgcaccaacctgaacatgcctcatagtttacctcagcggagtggtggtttccgagattacgagaaagatgctcccatcactgtgtttggatgcatgcaagcaagactagtgggtgaagccttattagagagcaataccattatcgatcatgtctattgctccccgtcccttcgctgcgttcagactgcacacaatatcttgaaaggtttacaacaagaaaatcacttgaagatccgtgtagagcccggcttatttgagtggacaaaatgggttgctgggagcacattacctgcatggatacctccatcagagttagctgcagccaacctgagtgttgatacaacctacagacctcacattccaatcagcaaattagttgtttcagaatcctatgatacttatatcagtagaagtttccaagtaacaaaagaaataataagtgaatgtaaaagtaaaggaaataacatcctgattgtggcccacgcatcttcccttgaagcgtgtacctgccaacttcagggcctgtcacctcagaactccaaggacttcgtacaaatggtccgaaagatcccatatctgggattttgttcctgtgaagaattaggagaaactggaatatggcagctgacagatccaccaatccttcctcttacccatggaccaactgggggcttcaactggagagagaccttgcttcaagaataaaccacaccagtgaacaagaaggaaaggccttttggagtgtgtctttctgtgtgtttaaaaacagtgggaaaatccacaccacactctaagtggacagctcagaataatttagcatatttcctttcacacttaaagttcttaagatgagactgtgtaaatgagagaaagacttgattcagaggaaaaaaatgtgttctctctggactcttgcctagctcacaaggctttggagaattgtcttcctaaatcggggcacctgctacagaagagaatgtttcgttccctctgggtatgcacagctaaggggcctcatttctcccagagggagctgctggcccgctctaaggggtgcaagaggaaggagtgtgcccagaccagctgggggagcattgaaaggacagcttggggatggaatttttttttttttatctccattttccagttaggtagagccaagctgaggaatccttttaagattattagaaaacatgccctgaagagagttgttcttaggttacacatgaaatcctaccgtcactagcccccatacaccagtgttgctggctgaagatacccgcttaaggatgctaacatttaccctggtactgccacattttctctagagcagctggcccttcttgctacagccctatcccccctccttgcttctgtgaaatggggagacaaagcacttttgctctccaaagcacttttggatactcaggaggaaagataagatacatgtttgaagtattcaatcataggagcaaagaacttgcaaaatatgaagtgacttggaattaaccatgttgtagcctaacgtgctactgcatttctaaatcatcaatatttgcttgtctttgcccctagactctagactatgttaactagttaaggatgttacattttgaaaggatgtatgttagatatattatttgcagcaagaagttcattctgtgcaatatggacatgtttgcaaaccataccaagggtcaggttgttgtacacttacagtacgtgtcaaccataatggaacatccacaaatgcatcaattataccagggatgtatagtaagtcagggaactaatataaatgatgacagtcatggctgcactgctacttgtgctgtcgttttgtttgtttttctatgataatttaaaatacataggtagggctactgaggaaatttggagagccacattctgtggtttctcattatacttacttcctgcatttagagggagtttatttaaaagaaataaatgacaatcaaaccaaatcatcagttatcaatgtctgtttaattgtgtgactatctgactgttgatggccacagatgatggtctcctatggtatagttcactctgtagaagatgtatgcaaagtgaaatgccagccctttaaagagacattagttagtgtaaaatggatctttacatgttgcagtaacattgactatgtttcaaaactcagatgcataaaacgtaaggtatataaaaatacatctatgcttgcgtttgaaactacaacttgataacccctagaaagaagaggacatgagaggatgctggctatatatgttaatgagcaaaaggattatagttgttttgttttgtttttagagacagggtctcactataatgcttagactggtcttgaactcctgggctcaagcgatcctcctgcccctgtctcccaaagtgctaggattacaggtgtgagccaccacacctggcccatagttgtattttttttaggtcacttagaaaaatatgtcatgtattttacattttgagaaacaaatcaatcatggtttcttctagcgttgcgcaaacactgacccagcttctgggtatggaaataaccctgtgatgatgtgttaatataaaatgttgggagggaatattcccaataaaggtcttaagagaaaagtcacattacaagtaatgtaatggctctaccattcattcttctggtatttgtaatgaagtgaatccactgtttaatcagatccataatctttaacagattcaccacaaattttcatgggcgttgagtgctcagaataatgcttgaacacctcaccttgaaactgtagcagtgtgttctgggcagtatctgtaatgtatgaaatagagtctggaataggttatccactccatcttctaggttatcttagttgtatgacgaactgataaatctgtctgactgggctacaatccattgttcttagtccaatatggacactgccttaggcaatggtctatataagcaaaaggagatagagatctgaaataattttccgaataattcaggtggaaaacaagaaagattgtatttctctgctttcatttcaatttcattatttcaaattgcttgtcaaaatggcccaaaagatctgaattcacattaagttccccttgcacacttacctatttaaaaaactaaacttgcactgcaactgagaaattatttgtaaatcatgtggcatctatgtataataaaagaaagagacaactatattactcaatttcatatacatccaaaaagtataggctaatatatataacctgaagttgcagctggttctttttgatctgaagctgatgcttattaaaacaaatgatgtatggggagaggagaaggaagggcaaggaaggaattgacagataagaagcaaatggtttcttgtacagaggaattttgttttaatgtagaaagttatttgaaataaactaggtgaaatgaaattaactaaaggttttaatctgggattgaaagcctgatagcatttcctgcttctacaagtgtgccacatcaatccggtaatgccccagtgttattcacagacagaactttgtttcctgtgattttaaaataccgcgtctgttcctccatggaccagagtaattggcacattttaatgcataagctgggggtttcattttcccaggctctcttcaccatcactgcattggtagctaggagcttattgcttcaccccagtatggagttcagattacagtgttttccattacatttagattcatagaatctgaatggctgattaaatggccatctgatggctgaaagaggggcgtatttttcactctgtagtgaaaggcttggaggagtttctactttttattttaattatactttaaccaaagaattattttaaagtaaccttatatttaaaagatgattttgcaaaaaataaaaaataaaaaatatgccttctggagtgatgtctgtttggtaaatcattgttgataatttccttgttagtggtatttggaatgcatatagattgtcttgtcattgtgcttaacattaccataagtgtgtcttttccactcaactagctgtattcgtattaaaatgaagtctcttatttcaattacctagtgttgttgggaactaattgaacagctacagtaaaagaagttcctatctcattgcctttgtggaaaggcttccctatgtggtaaaagaaaggcattcctccgtaacctaggcactctgcaagtccagtgtttaatttcaaagcagtgatgaattgctcttttgaaattactctaagtaatccatgtgttagaatacagatgaacctccgtttgatttcacagccttcagcacaggcaactgttactgagtctgcacgaacttagataatgaggtgcagggttatttgcatttaaattgcaatccagcacacgtgtgagaaagaagaggcactagtctaaaaggctgcattgcggggagagatgagacaggcagaggagggtggggtaaagagcgatttaacatctatttaggttaatgttcactttacaaaggtgatgggggatattttgttaggtgatagcagatgcttttcatttttaaacatagaattaaaattggatttgcttctctttaatacttcaacatattgaatttccctaggaaagtgactagctataatgaaaattcaagcgaaaagggaaaaagattgtaaatgcagatgaaataacttcatttttaagtacaaataatagtaggattggtgtatgtaggtttaaaattatagtgatgactagtcgaacttaatatacaatcagttcttgcaaatactttacacttagctgccattacacaacaaattggaattttccagctgttcaactatcatggactctgtacaggatagatgtgtataatggaaaatatgtactgcttctttctttgattgccactcaagatggaaacaccatgccaaggcattttggttatacacagatcattctaaacctgttattttggagaggtgtattggtttctttctcatttataaggctattgtatttttttttgtatgtgattcaggtgtatttatttgaagactatttgtagttataggaaaaccacacctacctgtattgccaaattctttgtaaactctccgtggcacttgtgctttcctggctgagagctctcccctgttgatacagctatggcaccattgtaattacagatgcacctttcaggagcatctccattaaatggttcatagatgatttaataaaaagaaacttctcagttgatccag

SEQ ID NO: 36147 - DNA, 6975 bp, Homo sapiens
attagctaggcatggtggcgggcgcctgtagtcccagctactcgggaggctgaggcaggagaatggcgtgaacccgggaggcagagcttgcagtgagccgagatggatcactgcactccagcctgggtgacagagtaagactctctcaaaaaaatagaaaaaagaaaaaagaaaaccatcagcaccacttctaatactttctgccaaaggggctgaaaacaagaatctgctctgtcagggatctgggtcactaagaatgagtgggtgaagaggaaggaggaaaaaccaagacatgacaacctttagagaagcaaaaataaaactctaatgtggaaactgctgaaaatagactgcctgggctgtcagactgcatgcaaatctgatgctaatcacatggaaattaattacaagtcctaacttccatatgtcttgatatgacccttgggggaaaacctgctgcaggtgtctactccccaccacagaggattgagtggaacacaggctttgatgtcgcctccttcacactcagctcttgccactgcagggagaggaggctaaaaatattaacaatagaaatttgatttcttctttcagacaaaaagccttggcatccacgggaggaagaagtgttcaggcagcatgtgactggttattctcccatgtcggtgaccccttcctggatgaccccctgccccgggagtacgtcctctacctccgtcccaccggccccttagcacagaagctttccgacttttggcagcagtcgaagcagatctgcgggaagaacaaggcacacaacatcttcccccacatcacactctgccagttctttatgtgcgaggacagcaaggtggatgccctgggggaagccctgcagaccacggtcagtcgctggaaatgtaagttctcggccccgctgcccctggagctctatacgtcgtccaacttcatcggcctctttgtaaaggaagacagtgcggaggtcctcaagaagtttgctgctgactttgctgcagaggctgcatccaaaaccgaagtgcatgtggaacctcataagaagcagctacatgtgaccctggcttaccacttccaagccagccacctacccaccctagagaaactggcccagaacattgacgtcaagctagggtgtgactgggtggctaccatattttctcgggatatccgatttgctaaccatgagacattacaggtcatctacccctataccccacaaaatgacgatgagctggagctggtccccggggacttcatcttcatgtctccaatggagcagaccagcaccagcgagggttggatctatggcacgtccttaaccaccggctgctctggactcctgcctgagaattacattaccaaggctgatgaatgcagcacctggatatttcatggttcttattcaatcttaaatacatcgtcatccaactctctcacgtttggggatggagtattggagaggcggccttatgaggaccaggggctcggggagacgactcctcttactatcatctgccagcccatgcagccgctgagggtcaacagccagcccggcccccagaagcgatgcctttttgtgtgtcggcatggtgagaggatggatgttgtgtttgggaagtactggctgtcccagtgcttcgatgccaaaggccgctacatacgcaccaacctgaacatgcctcatagtttacctcagcggagtggtggtttccgagattacgagaaagatgctcccatcactgtgtttggatgcatgcaagcaagactagtgggtgaagccttattagagagcaataccattatcgatcatgtctattgctccccgtcccttcgctgcgttcagactgcacacaatatcttgaaaggtttacaacaagaaaatcacttgaagatccgtgtagagcccggcttatttgagtggacaaaatgggttgctgggagcacattacctgcatggatacctccatcagagttagctgcagccaacctgagtgttgatacaacctacagacctcacattccaatcagcaaattagttgtttcagaatcctatgatacttatatcagtagaagtttccaagtaacaaaagaaataataagtgaatgtaaaagtaaaggaaataacatcctgattgtggcccacgcatcttcccttgaagcgtgtacctgccaacttcagggcctgtcacctcagaactccaaggacttcgtacaaatggtccgaaagatcccatatctgggattttgttcctgtgaagaattaggagaaactggaatatggcagctgacagatccaccaatccttcctcttacccatggaccaactgggggcttcaactggagagagaccttgcttcaagaataaaccacaccagtgaacaagaaggaaaggccttttggagtgtgtctttctgtgtgtttaaaaacagtgggaaaatccacaccacactctaagtggacagctcagaataatttagcatatttcctttcacacttaaagttcttaagatgagactgtgtaaatgagagaaagacttgattcagaggaaaaaaatgtgttctctctggactcttgcctagctcacaaggctttggagaattgtcttcctaaatcggggcacctgctacagaagagaatgtttcgttccctctgggtatgcacagctaaggggcctcatttctcccagagggagctgctggcccgctctaaggggtgcaagaggaaggagtgtgcccagaccagctgggggagcattgaaaggacagcttggggatggaatttttttttttttatctccattttccagttaggtagagccaagctgaggaatccttttaagattattagaaaacatgccctgaagagagttgttcttaggttacacatgaaatcctaccgtcactagcccccatacaccagtgttgctggctgaagatacccgcttaaggatgctaacatttaccctggtactgccacattttctctagagcagctggcccttcttgctacagccctatcccccctccttgcttctgtgaaatggggagacaaagcacttttgctctccaaagcacttttggatactcaggaggaaagataagatacatgtttgaagtattcaatcataggagcaaagaacttgcaaaatatgaagtgacttggaattaaccatgttgtagcctaacgtgctactgcatttctaaatcatcaatatttgcttgtctttgcccctagactctagactatgttaactagttaaggatgttacattttgaaaggatgtatgttagatatattatttgcagcaagaagttcattctgtgcaatatggacatgtttgcaaaccataccaagggtcaggttgttgtacacttacagtacgtgtcaaccataatggaacatccacaaatgcatcaattataccagggatgtatagtaagtcagggaactaatataaatgatgacagtcatggctgcactgctacttgtgctgtcgttttgtttgtttttctatgataatttaaaatacataggtagggctactgaggaaatttggagagccacattctgtggtttctcattatacttacttcctgcatttagagggagtttatttaaaagaaataaatgacaatcaaaccaaatcatcagttatcaatgtctgtttaattgtgtgactatctgactgttgatggccacagatgatggtctcctatggtatagttcactctgtagaagatgtatgcaaagtgaaatgccagccctttaaagagacattagttagtgtaaaatggatctttacatgttgcagtaacattgactatgtttcaaaactcagatgcataaaacgtaaggtatataaaaatacatctatgcttgcgtttgaaactacaacttgataacccctagaaagaagaggacatgagaggatgctggctatatatgttaatgagcaaaaggattatagttgttttgttttgtttttagagacagggtctcactataatgcttagactggtcttgaactcctgggctcaagcgatcctcctgcccctgtctcccaaagtgctaggattacaggtgtgagccaccacacctggcccatagttgtattttttttaggtcacttagaaaaatatgtcatgtattttacattttgagaaacaaatcaatcatggtttcttctagcgttgcgcaaacactgacccagcttctgggtatggaaataaccctgtgatgatgtgttaatataaaatgttgggagggaatattcccaataaaggtcttaagagaaaagtcacattacaagtaatgtaatggctctaccattcattcttctggtatttgtaatgaagtgaatccactgtttaatcagatccataatctttaacagattcaccacaaattttcatgggcgttgagtgctcagaataatgcttgaacacctcaccttgaaactgtagcagtgtgttctgggcagtatctgtaatgtatgaaatagagtctggaataggttatccactccatcttctaggttatcttagttgtatgacgaactgataaatctgtctgactgggctacaatccattgttcttagtccaatatggacactgccttaggcaatggtctatataagcaaaaggagatagagatctgaaataattttccgaataattcaggtggaaaacaagaaagattgtatttctctgctttcatttcaatttcattatttcaaattgcttgtcaaaatggcccaaaagatctgaattcacattaagttccccttgcacacttacctatttaaaaaactaaacttgcactgcaactgagaaattatttgtaaatcatgtggcatctatgtataataaaagaaagagacaactatattactcaatttcatatacatccaaaaagtataggctaatatatataacctgaagttgcagctggttctttttgatctgaagctgatgcttattaaaacaaatgatgtatggggagaggagaaggaagggcaaggaaggaattgacagataagaagcaaatggtttcttgtacagaggaattttgttttaatgtagaaagttatttgaaataaactaggtgaaatgaaattaactaaaggttttaatctgggattgaaagcctgatagcatttcctgcttctacaagtgtgccacatcaatccggtaatgccccagtgttattcacagacagaactttgtttcctgtgattttaaaataccgcgtctgttcctccatggaccagagtaattggcacattttaatgcataagctgggggtttcattttcccaggctctcttcaccatcactgcattggtagctaggagcttattgcttcaccccagtatggagttcagattacagtgttttccattacatttagattcatagaatctgaatggctgattaaatggccatctgatggctgaaagaggggcgtatttttcactctgtagtgaaaggcttggaggagtttctactttttattttaattatactttaaccaaagaattattttaaagtaaccttatatttaaaagatgattttgcaaaaaataaaaaataaaaaatatgccttctggagtgatgtctgtttggtaaatcattgttgataatttccttgttagtggtatttggaatgcatatagattgtcttgtcattgtgcttaacattaccataagtgtgtcttttccactcaactagctgtattcgtattaaaatgaagtctcttatttcaattacctagtgttgttgggaactaattgaacagctacagtaaaagaagttcctatctcattgcctttgtggaaaggcttccctatgtggtaaaagaaaggcattcctccgtaacctaggcactctgcaagtccagtgtttaatttcaaagcagtgatgaattgctcttttgaaattactctaagtaatccatgtgttagaatacagatgaacctccgtttgatttcacagccttcagcacaggcaactgttactgagtctgcacgaacttagataatgaggtgcagggttatttgcatttaaattgcaatccagcacacgtgtgagaaagaagaggcactagtctaaaaggctgcattgcggggagagatgagacaggcagaggagggtggggtaaagagcgatttaacatctatttaggttaatgttcactttacaaaggtgatgggggatattttgttaggtgatagcagatgcttttcatttttaaacatagaattaaaattggatttgcttctctttaatacttcaacatattgaatttccctaggaaagtgactagctataatgaaaattcaagcgaaaagggaaaaagattgtaaatgcagatgaaataacttcatttttaagtacaaataatagtaggattggtgtatgtaggtttaaaattatagtgatgactagtcgaacttaatatacaatcagttcttgcaaatactttacacttagctgccattacacaacaaattggaattttccagctgttcaactatcatggactctgtacaggatagatgtgtataatggaaaatatgtactgcttctttctttgattgccactcaagatggaaacaccatgccaaggcattttggttatacacagatcattctaaacctgttattttggagaggtgtattggtttctttctcatttataaggctattgtatttttttttgtatgtgattcaggtgtatttatttgaagactatttgtagttataggaaaaccacacctacctgtattgccaaattctttgtaaactctccgtggcacttgtgctttcctggctgagagctctcccctgttgatacagctatggcaccattgtaattacagatgcacctttcaggagcatctccattaaatggttcatagatgatttaataaaaagaaacttctcagttgatccag

SEQ ID NO: 36148 - DNA, 4996 bp, Homo sapiens
ttatcagtaacaaagcactttcaaaatattgcttaggcaaattgtcttcttgagtgtgtttgctcccctgcagagcatttagttagcttccagtatttgcaaagtttccatgtctttatagaaacagtcttcccataccttgccattttcccccaggaaataacatcctgattgtggcccacgcatcttcccttgaagcgtgtacctgccaacttcagggcctgtcacctcagaactccaaggacttcgtacaaatggtccgaaagatcccatatctgggattttgttcctgtgaagaattaggagaaactggaatatggcagctgacagatccaccaatccttcctcttacccatggaccaactgggggcttcaactggagagagaccttgcttcaagaataaaccacaccagtgaacaagaaggaaaggccttttggagtgtgtctttctgtgtgtttaaaaacagtgggaaaatccacaccacactctaagtggacagctcagaataatttagcatatttcctttcacacttaaagttcttaagatgagactgtgtaaatgagagaaagacttgattcagaggaaaaaaatgtgttctctctggactcttgcctagctcacaaggctttggagaattgtcttcctaaatcggggcacctgctacagaagagaatgtttcgttccctctgggtatgcacagctaaggggcctcatttctcccagagggagctgctggcccgctctaaggggtgcaagaggaaggagtgtgcccagaccagctgggggagcattgaaaggacagcttggggatggaatttttttttttttatctccattttccagttaggtagagccaagctgaggaatccttttaagattattagaaaacatgccctgaagagagttgttcttaggttacacatgaaatcctaccgtcactagcccccatacaccagtgttgctggctgaagatacccgcttaaggatgctaacatttaccctggtactgccacattttctctagagcagctggcccttcttgctacagccctatcccccctccttgcttctgtgaaatggggagacaaagcacttttgctctccaaagcacttttggatactcaggaggaaagataagatacatgtttgaagtattcaatcataggagcaaagaacttgcaaaatatgaagtgacttggaattaaccatgttgtagcctaacgtgctactgcatttctaaatcatcaatatttgcttgtctttgcccctagactctagactatgttaactagttaaggatgttacattttgaaaggatgtatgttagatatattatttgcagcaagaagttcattctgtgcaatatggacatgtttgcaaaccataccaagggtcaggttgttgtacacttacagtacgtgtcaaccataatggaacatccacaaatgcatcaattataccagggatgtatagtaagtcagggaactaatataaatgatgacagtcatggctgcactgctacttgtgctgtcgttttgtttgtttttctatgataatttaaaatacataggtagggctactgaggaaatttggagagccacattctgtggtttctcattatacttacttcctgcatttagagggagtttatttaaaagaaataaatgacaatcaaaccaaatcatcagttatcaatgtctgtttaattgtgtgactatctgactgttgatggccacagatgatggtctcctatggtatagttcactctgtagaagatgtatgcaaagtgaaatgccagccctttaaagagacattagttagtgtaaaatggatctttacatgttgcagtaacattgactatgtttcaaaactcagatgcataaaacgtaaggtatataaaaatacatctatgcttgcgtttgaaactacaacttgataacccctagaaagaagaggacatgagaggatgctggctatatatgttaatgagcaaaaggattatagttgttttgttttgtttttagagacagggtctcactataatgcttagactggtcttgaactcctgggctcaagcgatcctcctgcccctgtctcccaaagtgctaggattacaggtgtgagccaccacacctggcccatagttgtattttttttaggtcacttagaaaaatatgtcatgtattttacattttgagaaacaaatcaatcatggtttcttctagcgttgcgcaaacactgacccagcttctgggtatggaaataaccctgtgatgatgtgttaatataaaatgttgggagggaatattcccaataaaggtcttaagagaaaagtcacattacaagtaatgtaatggctctaccattcattcttctggtatttgtaatgaagtgaatccactgtttaatcagatccataatctttaacagattcaccacaaattttcatgggcgttgagtgctcagaataatgcttgaacacctcaccttgaaactgtagcagtgtgttctgggcagtatctgtaatgtatgaaatagagtctggaataggttatccactccatcttctaggttatcttagttgtatgacgaactgataaatctgtctgactgggctacaatccattgttcttagtccaatatggacactgccttaggcaatggtctatataagcaaaaggagatagagatctgaaataattttccgaataattcaggtggaaaacaagaaagattgtatttctctgctttcatttcaatttcattatttcaaattgcttgtcaaaatggcccaaaagatctgaattcacattaagttccccttgcacacttacctatttaaaaaactaaacttgcactgcaactgagaaattatttgtaaatcatgtggcatctatgtataataaaagaaagagacaactatattactcaatttcatatacatccaaaaagtataggctaatatatataacctgaagttgcagctggttctttttgatctgaagctgatgcttattaaaacaaatgatgtatggggagaggagaaggaagggcaaggaaggaattgacagataagaagcaaatggtttcttgtacagaggaattttgttttaatgtagaaagttatttgaaataaactaggtgaaatgaaattaactaaaggttttaatctgggattgaaagcctgatagcatttcctgcttctacaagtgtgccacatcaatccggtaatgccccagtgttattcacagacagaactttgtttcctgtgattttaaaataccgcgtctgttcctccatggaccagagtaattggcacattttaatgcataagctgggggtttcattttcccaggctctcttcaccatcactgcattggtagctaggagcttattgcttcaccccagtatggagttcagattacagtgttttccattacatttagattcatagaatctgaatggctgattaaatggccatctgatggctgaaagaggggcgtatttttcactctgtagtgaaaggcttggaggagtttctactttttattttaattatactttaaccaaagaattattttaaagtaaccttatatttaaaagatgattttgcaaaaaataaaaaataaaaaatatgccttctggagtgatgtctgtttggtaaatcattgttgataatttccttgttagtggtatttggaatgcatatagattgtcttgtcattgtgcttaacattaccataagtgtgtcttttccactcaactagctgtattcgtattaaaatgaagtctcttatttcaattacctagtgttgttgggaactaattgaacagctacagtaaaagaagttcctatctcattgcctttgtggaaaggcttccctatgtggtaaaagaaaggcattcctccgtaacctaggcactctgcaagtccagtgtttaatttcaaagcagtgatgaattgctcttttgaaattactctaagtaatccatgtgttagaatacagatgaacctccgtttgatttcacagccttcagcacaggcaactgttactgagtctgcacgaacttagataatgaggtgcagggttatttgcatttaaattgcaatccagcacacgtgtgagaaagaagaggcactagtctaaaaggctgcattgcggggagagatgagacaggcagaggagggtggggtaaagagcgatttaacatctatttaggttaatgttcactttacaaaggtgatgggggatattttgttaggtgatagcagatgcttttcatttttaaacatagaattaaaattggatttgcttctctttaatacttcaacatattgaatttccctaggaaagtgactagctataatgaaaattcaagcgaaaagggaaaaagattgtaaatgcagatgaaataacttcatttttaagtacaaataatagtaggattggtgtatgtaggtttaaaattatagtgatgactagtcgaacttaatatacaatcagttcttgcaaatactttacacttagctgccattacacaacaaattggaattttccagctgttcaactatcatggactctgtacaggatagatgtgtataatggaaaatatgtactgcttctttctttgattgccactcaagatggaaacaccatgccaaggcattttggttatacacagatcattctaaacctgttattttggagaggtgtattggtttctttctcatttataaggctattgtatttttttttgtatgtgattcaggtgtatttatttgaagactatttgtagttataggaaaaccacacctacctgtattgccaaattctttgtaaactctccgtggcacttgtgctttcctggctgagagctctcccctgttgatacagctatggcaccattgtaattacagatgcacctttcaggagcatctccattaaatggttcatagatgatttaataaaaagaaacttctcagttgatccag

SEQ ID NO: 36149 - DNA, 3764 bp, Homo sapiens
ctcattgcaaattcccggactgctaggcgaggagagggaagggggcggaggagacagggctactgcaggcgcagagctgggggcagccgggggcccgagtggctgaggctggtcccgcagcggccgcttgccggcgttctggctcctgtggcctcaccaggaagcgtcagagtcccgacactggggaagctcggagcgccgcctccgctgccgccgcctcctgcctggctctgggtccccgagccccctcccctggcccagcccgactccctcctccttcccgaaccatccggctcgggctccttccctggcgatggctggccgctgagccatggctcagtacggccaccccagtccgctcggcatggctgcgagagaggagctgtacagcaaagtcaccccccggaggaaccgccaacagcgccccggcaccatcaagcatggatcggcgctggacgtgctcctctccatggggttccccagagcccgcgcacaaaaagccttggcatccacgggaggaagaagtgttcaggcagcatgtgactggttattctcccatgtcggtgaccccttcctggatgaccccctgccccgggagtacgtcctctacctccgtcccaccggccccttagcacagaagctttccgacttttggcagcagtcgaagcagatctgcgggaagaacaaggcacacaacatcttcccccacatcacactctgccagttctttatgtgcgaggacagcaaggtggatgccctgggggaagccctgcagaccacggtcagtcgctggaaatgtaagttctcggccccgctgcccctggagctctatacgtcgtccaacttcatcggcctctttgtaaaggaagacagtgcggaggtcctcaagaagtttgctgctgactttgctgcagaggctgcatccaaaaccgaagtgcatgtggaacctcataagaagcagctacatgtgaccctggcttaccacttccaagccagccacctacccaccctagagaaactggcccagaacattgacgtcaagctagggtgtgactgggtggctaccatattttctcgggatatccgatttgctaaccatgagacattacaggtcatctacccctataccccacaaaatgacgatgagctggagctggtccccggggacttcatcttcatgtctccaatggagcagaccagcaccagcgagggttggatctatggcacgtccttaaccaccggctgctctggactcctgcctgagaattacattaccaaggctgatgaatgcagcacctggatatttcatggttcttattcaatcttaaatacatcgtcatccaactctctcacgtttggggatggagtattggagaggcggccttatgaggaccaggggctcggggagacgactcctcttactatcatctgccagcccatgcagccgctgagggtcaacagccagcccggcccccagaagcgatgcctttttgtgtgtcggcatggtgagaggatggatgttgtgtttgggaagtactggctgtcccagtgcttcgatgccaaaggccgctacatacgcaccaacctgaacatgcctcatagtttacctcagcggagtggtggtttccgagattacgagaaagatgctcccatcactgtgtttggatgcatgcaagcaagactagtgggtgaagccttattagagagcaataccattatcgatcatgtctattgctccccgtcccttcgctgcgttcagactgcacacaatatcttgaaaggtttacaacaagaaaatcacttgaagatccgtgtagagcccggcttatttgagtggacaaaatgggttgctgggagcacattacctgcatggatacctccatcagagttagctgcagccaacctgagtgttgatacaacctacagacctcacattccaatcagcaaattagttgtttcagaatcctatgatacttatatcagtagaagtttccaagtaacaaaagaaataataagtgaatgtaaaagtaaaggaaataacatcctgattgtggcccacgcatcttcccttgaagcgtgtacctgccaacttcagggcctgtcacctcagaactccaaggacttcgtacaaatggtccgaaagatcccatatctgggattttgttcctgtgaagaattaggagaaactggaatatggcagctgacagatccaccaatccttcctcttacccatggaccaactgggggcttcaactggagagagaccttgcttcaagaataaaccacaccagtgaacaagaaggaaaggccttttggagtgtgtctttctgtgtgtttaaaaacagtgggaaaatccacaccacactctaagtggacagctcagaataatttagcatatttcctttcacacttaaagttcttaagatgagactgtgtaaatgagagaaagacttgattcagaggaaaaaaatgtgttctctctggactcttgcctagctcacaaggctttggagaattgtcttcctaaatcggggcacctgctacagaagagaatgtttcgttccctctgggtatgcacagctaaggggcctcatttctcccagagggagctgctggcccgctctaaggggtgcaagaggaaggagtgtgcccagaccagctgggggagcattgaaaggacagcttggggatggaatttttttttttttatctccattttccagttaggtagagccaagctgaggaatccttttaagattattagaaaacatgccctgaagagagttgttcttaggttacacatgaaatcctaccgtcactagcccccatacaccagtgttgctggctgaagatacccgcttaaggatgctaacatttaccctggtactgccacattttctctagagcagctggcccttcttgctacagccctatcccccctccttgcttctgtgaaatggggagacaaagcacttttgctctccaaagcacttttggatactcaggaggaaagataagatacatgtttgaagtattcaatcataggagcaaagaacttgcaaaatatgaagtgacttggaattaaccatgttgtagcctaacgtgctactgcatttctaaatcatcaatatttgcttgtctttgcccctagactctagactatgttaactagttaaggatgttacattttgaaaggatgtatgttagatatattatttgcagcaagaagttcattctgtgcaatatggacatgtttgcaaaccataccaagggtcaggttgttgtacacttacagtacgtgtcaaccataatggaacatccacaaatgcatcaattataccagggatgtatagtaagtcagggaactaatataaatgatgacagtcatggctgcactgctacttgtgctgtcgttttgtttgtttttctatgataatttaaaatacataggtagggctactgaggaaatttggagagccacattctgtggtttctcattatacttacttcctgcatttagagggagtttatttaaaagaaataaatgacaatcaaaccaaaaaaaaaaaagaaaaaaaaaatgtgcgggcacgaaagtctaacctcgtggcggcggcccagggtaggaccgtccaggtgcgcggaaccgccggagggcggtcccccaaaaggcggcacgggctcgacacccggctggctcgtctcgggccgacatcccccccccggcgcgttccgaggacaaaaagccacagcaaaagcgcaac

SEQ ID NO: 36150 - DNA, 2630 bp, Homo sapiens
  misc_feature (2579)..(2582): n is a, c, g, or t
  misc_feature (2605)..(2605): n is a, c, g, or t
ctcattgcaaattcccggactgctaggcgaggagagggaagggggcggaggagacagggctactgcaggcgcagagctgggggcagccgggggcccgagtggctgaggctggtcccgcagcggccgcttgccggcgttctggctcctgtggcctcaccaggaagcgtcagagtcccgacactggggaagctcggagcgccgcctccgctgccgccgcctcctgcctggctctgggtccccgagccccctcccctggcccagcccgactccctcctccttcccgaaccatccggctcgggctccttccctggcgatggctggccgctgagccatggctcagtacggccaccccagtccgctcggcatggctgcgagagaggagctgtacagcaaagtcaccccccggaggaaccgccaacagcgccccggcaccatcaagcatggatcggcgctggacgtgctcctctccatggggttccccagagcccgcgcacaaaaagccttggcatccacgggaggaagaagtgttcaggcagcatgtgactggttattctcccatgtcggtgaccccttcctggatgaccccctgccccgggagtacgtcctctacctccgtcccaccggccccttagcacagaagctttccgacttttggcagcagtcgaagcagatctgcgggaagaacaaggcacacaacatcttcccccacatcacactctgccagttctttatgtgcgaggacagcaaggtggatgccctgggggaagccctgcagaccacggtcagtcgctggaaatgtaagttctcggccccgctgcccctggagctctatacgtcgtccaacttcatcggcctctttgtaaaggaagacagtgcggaggtcctcaagaagtttgctgctgactttgctgcagaggctgcatccaaaaccgaagtgcatgtggaacctcataagaagcagctacatgtgaccctggcttaccacttccaagccagccacctacccaccctagagaaactggcccagaacattgacgtcaagctagggtgtgactgggtggctaccatattttctcgggatatccgatttgctaaccatgagacattacaggtcatctacccctataccccacaaaatgacgatgagctggagctggtccccggggacttcatcttcatgtctccaatggagcagaccagcaccagcgagggttggatctatggcacgtccttaaccaccggctgctctggactcctgcctgagaattacattaccaaggctgatgaatgcagcacctggatatttcatggttcttattcaatcttaaatacatcgtcatccaactctctcacgtttggggatggagtattggagaggcggccttatgaggaccaggggctcggggagacgactcctcttactatcatctgccagcccatgcagccgctgagggtcaacagccagcccggcccccagaagcgatgcctttttgtgtgtcggcatggtgagaggatggatgttgtgtttgggaagtactggctgtcccagtgcttcgatgccaaaggccgctacatacgcaccaacctgaacatgcctcatagtttacctcagcggagtggtggtttccgagattacgagaaagatgctcccatcactgtgtttggatgcatgcaagcaagactagtgggtgaagccttattagagagcaataccattatcgatcatgtctattgctccccgtcccttcgctgcgttcagactgcacacaatatcttgaaaggtttacaacaagaaaatcacttgaagatccgtgtagagcccggcttatttgagtggacaaaatgggttgctgggagcacattacctgcatggatacctccatcagagttagctgcagccaacctgagtgttgatacaacctacagacctcacattccaatcagcaaattagttgtttcagaatcctatgatacttatatcagtagaagtttccaagtaacaaaagaaataataagtgaatgtaaaagtaaaggaaataacatcctgattgtggcccacgcatcttcccttgaagcgtgtacctgccaacttcagggcctgtcacctcagaactccaaggacttcgtacaaatggtccgaaagatcccatatctgggattttgttcctgtgaagaattaggagaaactggaatatggcagctgacagatccaccaatccttcctcttacccatggaccaactgggggcttcaactggagagagaccttgcttcaagaataaaccacaccagtgaacaagaaggaaaggccttttggagtgtgtctttctgtgtgtttaaaaacagtgggaaaatccacaccacactctaagtggacagctcagaataatttagcatatttcctttcacacttaaagttcttaagatgagactgtgtaaatgagagaaagacttgattcagaggaaaaaaatgtgttctctctggactcttgcctagctcacaaggctttggagaattgtcttcctaaatcggggcacctgctacagaagagaatgtttcgttccctctggggaaccccnnnnaaggggcccttttttttcccagnggagggggggccccttttattgcgg

SEQ ID NO: 36151 - DNA, 1919 bp, Homo sapiens
ctcattgcaaattcccggactgctaggcgaggagagggaagggggcggaggagacagggctactgcaggcgcagagctgggggcagccgggggcccgagtggctgaggctggtcccgcagcggccgcttgccggcgttctggctcctgtggcctcaccaggaagcgtcagagtcccgacactggggaagctcggagcgccgcctccgctgccgccgcctcctgcctggctctgggtccccgagccccctcccctggcccagcccgactccctcctccttcccgaaccatccggctcgggctccttccctggcgatggctggccgctgagccatggctcagtacggccaccccagtccgctcggcatggctgcgagagaggagctgtacagcaaagtcaccccccggaggaaccgccaacagcgccccggcaccatcaagcatggatcggcgctggacgtgctcctctccatggggttccccagagcccgcgcacaaaaagccttggcatccacgggaggaagaagtgttcaggcagcatgtgactggttattctcccatgtcggtgaccccttcctggatgaccccctgccccgggagtacgtcctctacctccgtcccaccggccccttagcacagaagctttccgacttttggcagcagtcgaagcagatctgcgggaagaacaaggcacacaacatcttcccccacatcacactctgccagttctttatgtgcgaggacagcaaggtggatgccctgggggaagccctgcagaccacggtcagtcgctggaaatgtaagttctcggccccgctgcccctggagctctatacgtcgtccaacttcatcggcctctttgtaaaggaagacagtgcggaggtcctcaagaagtttgctgctgactttgctgcagaggctgcatccaaaaccgaagtgcatgtggaacctcataagaagcagctacatgtgaccctggcttaccacttccaagccagccacctacccaccctagagaaactggcccagaacattgacgtcaagctagggtgtgactgggtggctaccatattttctcgggatatccgatttgctaaccatgagacattacaggtcatctacccctataccccacaaaatgacgatgagctggagctggtccccggggacttcatcttcatgtctccaatggagcagaccagcaccagcgagggttggatctatggcacgtccttaaccaccggctgctctggactcctgcctgagaattacattaccaaggctgatgaatgcagcacctggatatttcatggttcttattcaatcttaaatacatcgtcatccaactctctcacgtttggggatggagtattggagaggcggccttatgaggaccaggggctcggggagacgactcctcttactatcatctgccagcccatgcagccgctgagggtcaacagccagcccggcccccagaagcgatgcctttttgtgtgtcggcatggtgagaggatggatgttgtgtttgggaagtactggctgtcccagtgcttcgatgccaaaggccgctacatacgcaccaacctgaacatgcctcatagtttacctcagcggagtggtggtttccgagattacgagaaagatgctcccatcactgtgtttggatgcatgcaagcaagactagtgggtaagtatcctggagtgactgcactccaggcatttcttgcctcctccttcaaaacactggtaccatggatatgcaagacacttcctgtgggtttctataactttcctacaagtttcctcaattcaaaaggaacttactacacaaccattaagtttaggacactgtgctcagccctgggttggttgaccaaagtgaatgaggtgtggtccttattgaggagcacgtgatcca

SEQ ID NO: 36152 - DNA, 1112 bp, Homo sapiens
ctgcttcttgaggatcccctctccctactgtatcctaggcactctgcaagtccagtgtttaatttcaaagcagtgatgaattgctcttttgaaattactctaagtaatccatgtgttagaatacagatgaacctccgtttgatttcacagccttcagcacaggcaactgttactgagtctgcacgaacttagataatgaggtgcagggttatttgcatttaaattgcaatccagcacacgtgtgagaaagaagaggcactagtctaaaaggctgcattgcggggagagatgagacaggcagaggagggtggggtaaagagcgatttaacatctatttaggttaatgttcactttacaaaggtgatgggggatattttgttaggtgatagcagatgcttttcatttttaaacatagaattaaaattggatttgcttctctttaatacttcaacatattgaatttccctaggaaagtgactagctataatgaaaattcaagcgaaaagggaaaaagattgtaaatgcagatgaaataacttcatttttaagtacaaataatagtaggattggtgtatgtaggtttaaaattatagtgatgactagtcgaacttaatatacaatcagttcttgcaaatactttacacttagctgccattacacaacaaattggaattttccagctgttcaactatcatggactctgtacaggatagatgtgtataatggaaaatatgtactgcttctttctttgattgccactcaagatggaaacaccatgccaaggcattttggttatacacagatcattctaaacctgttattttggagaggtgtattggtttctttctcatttataaggctattgtatttttttttgtatgtgattcaggtgtatttatttgaagactatttgtagttataggaaaaccacacctacctgtattgccaaattctttgtaaactctccgtggcacttgtgctttcctggctgagagctctcccctgttgatacagctatggcaccattgtaattacagatgcacctttcaggagcatctccattaaatggttcatagatgatttaataaaaagaaacttctcagttgatccag

SEQ ID NO: 36153 - DNA, 780 bp, Homo sapiens
acggtggagctaaaaacggctaattgatcttgagataagaataccctttactaaggcaaagatttaattgaaatccaaaatgatttatagaaacgaaaggcattttccatttgttgtcttctgccgaaattctgaattgcatacacacatgaaggataatgaatggtttcaacggtgctatattaggttctctgattttcatgacctatgtatgtttggaaatacaatattgtataaaatgtggatcgttttgttaccgatttaatattgccattttaatttggtgtaacaattggttacacttgtttttcaaagctatcctttgaggagaaagtcaaaatgtgttgttagcctacctccactcaggcctcttgctgtgtaatcattattccaggttatgatgtgcatagcttttaaaactgcgtgtactattattctgctctttcccatactcttgtcatgtattcagaacctaaacttatagcaaaagagccaagcagtagcagtttttgtaaatgtaaaaataattagatccagactttgtttccttcaattttaaaaataaaaaatacctcagtgctatgtttttcagttatcacctgcatttctcaaaaaataacacctgcttcatgtggcacataacttgtaagaatcacattttggattttaaagaaagactattaaatattttaagatcactatcaatgacatttccctttcttttattcaacaatggagcctactgcagtagcgatttttaccttatagcttaggtctgac

SEQ ID NO: 36154 - DNA, 522 bp, Homo sapiens
acggtggagctaaaaacggctaattgatcttgagataagaataccctttactaaggcaaagatttaattgaaatccaaaatgatttatagaaacgaaaggcattttccatttgttgtcttctgccgaaattctgaattgcatacacacatgaaggataatgaatggtttcaacggtgctatattaggttctctgattttcatgacctatgtatgtttggaaatacaatattgtataaaatgtggatcgttttgttaccgatttaatattgccattttaatttggtgtaacaattggttacacttgtttttcaaagctatcctttgaggagaaagtcaaaatgtgttgttagcctacctccactcaggcctcttgctgtgtaatcattattccaggttatgatgtgcatagcttttaaaaccgctactgcttggctcttttgctataagtttaggttctgaatacatgacaagagtatgggaaagagcagaataatagtacacgcagttttaggtcgacgcgg

SEQ ID NO: 36155 - DNA, 323 bp, Homo sapiens
gcttattaagctaagaataattatactaaatagtaaaccacagacataaactttagcagtgctatctcgtttagcagtgctatctcgacgattacaatttaataccaggaatgtatcatgtaatgaatgcatattgaagatagtccatgtaaggcttcatactatcaattacaaaacaaaagtagtctcccatttcactcctatgtgggaggagttctacatccatcacattttccacatttaccatctgtgataagttctagctcaataaacttgaagttcaataaacttgaagcacagaaagtaagcaacaaagaacaaaa

SEQ ID NO: 36156 - DNA, 751 bp, Homo sapiens
tgagacagagtctcgctctgtcgcccaggctagagtgcagtggtgcgatcttggctcactgcaacctctgcctcctgggttcaagcaattctcctgcctcagcctcctgagtagctgggattacaggcgcacgtgtgccaccacgtccagttaatagagattttcagtagagacgaggtttcaccctgttggtcaggctggtctcgaactcctgaacaagggagacttctaagaaggtaggagttgagcaagaaatggctgctatggttttcctcctcctgagcatcacaaccatctggggagctttcaaaaaatgaagttgctcagccgttgagaactgctggaaagcccagcttaacaagttgtttgcttgggtggactctgcttgggggtgcagcggggggttctttccagtcctggtgtgttgctgggatgaagcagagagccctagaactgttctctccatcccacttacggcaagggctgttcctctgtcaggccagtccttgggggcaatgacagcagcaggaacattctggtaagtgtgtggtttccctcccagtgagcaggctaaccctgagtataggaacttaggggaggttaggtggctgatgcatgttttccagaccggtttgtatctgcttgtcattgatcttagaagttcatattatggtggaattatctatttgcatgtgtaaactttgaatatgtttttaacttttaataaaaagttatttttaaatattgtttt

SEQ ID NO: 36157 - DNA, 3889 bp, Homo sapiens
gtagctgctttgcaggtacatcatgtgacagtggaattatagaagatgtgaagaaaacaacacacactccaacactaaaagcatgatgtagctgctttgcaggtaaaagaagcagctacatcatgcttttagtgttggagtgtgtgttgttttctgtggctcaggggtattttagaatggactcttctgcaacccagtttcacatagagactcatgagaacacatcaggactttggtcaatatggtaccgcaaccattttgaccgtagtgttgtattaaatgatgtgtttctttccaaggagaccaagcacatgttaaagattctgaatttcactggccctttatttctacctccaggctgttggaatatattttctttgaaacttgctgttaaagacattgccataaatctattcaccaatgtatttttgactacaaacataggtgccatttttgcaatacctctacagatttattcagcaccaaccaaggaagggagtctgggttttgaagtgatagcacattgtggcatgcattatttcatgggaaaatcaaaagcaggaaatcctaattggaatgggagcctttctctggatcaatctacctggaatgtggattctgaacttgcaaataaattgtatgaaagatggaagaaatataaaaatggtgacgtctgcaagaggaatgttttgggaacaactcgatttgctcacttgaagaaatccaaggagtcagagtcctttgttttctttttgcctcgtttgatcgcagagcctggcctcatgttaaacttcagcgcaactgcccttaggagcaggatgatcaagtactttgtggtgcagaacccgtcctcttggccggtctccttgcagctcctgcctctctccttgtaccctaaacccgaagccctagtgcacctgctccacagatggtttggcactgatatgcagatgattaatttcacaactggtgaattccagctcaccgaagcttgcccttacctgggtacgcattctgaggaatccaggtttggcatcctccacttacatctgcagcctttggaaatgaaaagggttggcgtagttttcacacctgctgactatggaaaagttacctcactcatactaatccggaataacttgactgttattgacatgattggcgtggaaggatttggagcaagagagttattaaaagtgggtggaagacttcctggtgcaggaggctcactccgatttaaggtgcccgagtccacgctgatggactgccgtagacaactgaaagacagtaagcaaattttatctattacaaagaactttaaagttgagaatattggacctcttcctataactgtttcgtctctgaaaattaatgggtataactgccaaggttatggattcgaggtgctggattgtcatcagttttccctggacccaaacacatcccgcgatatcagcattgtgttcactccagactttacctcctcctgggtaattcgggacctaagtcttgtaaccgcagcggacctagaatttcgcttcactctcaatgtgactctccctcatcacctgttgcccttgtgtgcagacgtggttccaggacccagctgggaggagtcattttggaggctcacggtcttctttgtcagtttgtccctgttgggtgtgattttaatagccttccaacaagcacagtacattctcatggaattcatgaaaacaagacagaggcaaaatgctagctcctcttcacagcaaaacaatggtcctatggatgtaatcagcccccattcttacaaaagcaattgcaagaactttctcgatacatatggcccctctgataaaggcagggggaagaactgccttccagtgaacactccccaaagcaggatccagaatgctgcaaagaggagcccagccacctatggtcattctcagaagaagcacaaatgctcagtgtattacagtaaacacaaaaccagcacagctgcggccagcagcaccagcacgactactgaggaaaaacagacttcacccctgggcagctcactgcctgctgctaaagaggacatttgcactgatgccatgcgtgagaactggatcagcctcagatatgcaagtggcataaatgtcaacctgcagaagaatttaacccttcccaaaaacttactgaataaagaagaaaacacactgaaaaacacaattgttttcagtaatccttcttcagaatgtagtatgaaggagggaatacagacatgtatgtttcctaaggaaactgacattaaaacttcagagaacacagccgagttcaaggaacgggagctctgtccactgaagacctccaagaaactacctgaaaaccatttaccaagaaactcacctcagtaccaccagccagacttgccagaaatttccaggaaaaataatgggaataaccagcaagtacctgtcaagaatgaagtagatcattgtgaaaatttgaagaaggtggacacaaagccttcttcagaaaagaagattcacaaaacatctagagaagacatgttttctgagaaacaggacatacctttcgtagagcaagaagatccttataggaagaaaaagcttcaggagaaaagagaaggaaatttacaaaatttaaattggagtaaaagtcgaacatgtagaaagaacaagaaaaggggtgttgctccagtctcaaggcctcctgaacagagtgatctaaagcttgtgtgcagtgactttgagaggtctgagctgagcagtgacatcaatgtaagaagctggtgtatacaggaaagcactagggaggtttgtaaagcagatgccgaaattgcaagcagtttacctgctgcccagagagaggcagaaggttactaccagaagcctgagaagaaatgtgtggacaagttctgctccgattccagctctgactgtgggagctcctctggcagcgtgcgtgccagccggggcagctgggggagctggagcagcaccagcagctccgacggggataagaagcccatggtggacgcccagcacttcctgccggccggagacagtgtttcacaaaatgattttccttctgaagctcccatctccttgaatctttctcataacatctgcaatcccatgaccgtgaatagtctcccacaatacgcagagccttcctgtcccagccttcctgccgggcccacaggtgttgaagaagataaaggtctttactcacctggagacctgtggcccactccgccagtgtgtgtgacaagcagcttaaactgcaccctggagaacggcgtgccttgtgtgattcaggagtcggccccggttcataatagtttcattgattggagtgcaacatgcgaaggccagttttccagcgcatactgtccattggaattgaacgattacaatgcctttccagaagaaaacatgaactatgccaatggcttcccctgtcctgcagatgttcagacagactttattgatcacaactctcagtctacctggaacaccccacccaacatgcctgctgcctggggacatgccagtttcatcagctctccgccctacctcacaagcacccgaagcttgtctccaatgtctggactttttggttccatctgggccccgcaaagcgatgtgtatgaaaattgctgccccatcaaccccaccacggaacattcgacccacatggaaaaccaagcggtcgtgtgcaaggaatactacccggggttcaacccgtttcgcgcctatatgaacctggacatatggactaccacagcgaataggaatgcaaatttcccactgtctagagactcgagttactgtgggaatgtgtgaaaataattggatttttaaacaatgtgaataaagaggcttgtgttttg

SEQ ID NO: 36158 - DNA, 648 bp, Homo sapiens
catcctatcttaaatcattgtatttggccaggcgtggtggctcacgcctgtaatcccaacactttgggaggccgaggcagtggatcagttgaggctggtctcgaactcctgaacaagggagacttctaagaaggtaggagttgagcaagaaatggctgctatggttttcctcctcctgagcatcacaaccatctggggagctttcaaaaaatgaagttgctcagccgttgagaactgctggaaagcccagcttaacaagttgtttgcttgggtggactctgcttgggggtgcagcggggggttctttccagtcctggtgtgttgctgggatgaagcagagagccctagaactgttctctccatcccacttacggcaagggctgttcctctgtcaggccagtccttgggggcaatgacagcagcaggaacattctggtaagtgtgtggtttccctcccagtgagcaggctaaccctgagtataggaacttaggggaggttaggtggctgatgcatgttttccagaccggtttgtatctgcttgtcattgatcttagaagttcatattatggtggaattatctatttgcatgtgtaaactttgaatatgtttttaacttttaataaaaagttatttttaaatattgtttt

SEQ ID NO: 36159 - DNA, 734 bp, Homo sapiens
tggcatgctacactttgtttgttgtttgtctttgctcacttgaatgtagcttgttcactgctgtatcctcagtatctttaatggggccttgcagaaagtagttcctcaaatatttgttatgtgagtctcatcttgtcatccaggtcaagagacaatcggacactgtctgaagaaacggtcaaaacaatatgctgtatttcagaattatatcctgaaattatattccgaaaggagttagtcagcatgtgtgggtgacattagggagtgttttctggagggaagggcaggtgcaggaagggtaggatgagggccaggtgaggatagggtggactcaggccttgttctcttccgtaggtctttactcacctggagacctgtggcccactccgccagtgtgtgtgacaagcagcttaaactgcaccctggagaacggcgtgccttgtgtgattcaggagtcggccccggttcataatagagacagagtcttgctctgtcgcccaggctggagcgcagtggtgcaattatagctcactgcagccttgaactcctgggttcaagcggttctcctgcctcagcctctcaagtaactgggactacagtttcattgattggagtgcaacatgcgaaggccagttttccagcgcatactgtccattggaattgaacgattacaatgcctttccagaaggtaagggctcttcagacaatcccaacgccattattttattcttaga

SEQ ID NO: 36160 - DNA, 460 bp, Homo sapiens
aaacatttgcttttttccttataggtttggcactgatatgcagatgattaatttcacaactggtgaattccagctcaccgaagcttgcccttacctggtaggatgttatcctaaaacagaaaaaagaatgccgacaaactagacacatgagcatacgggcctcattgatttatgtttaaaatgtcttttatttactatatatggctcttttattttgattctctgggcattaacgatacatagcagatttttccagttaactagtgcggtaggagctgggtttatgttagctctaaatcattttaatttgattatttagaatcatgtgagtaaagaaataacagttgaacagagctttgtagaaaaccatgaaacttgagaccccagaatttataattctcttaagattccttggccctcaaattcttttttagggcaagataaggaaaaacaaatacat

SEQ ID NO: 36161 - DNA, 467 bp, Homo sapiens
cagatccttttctttagctagggaacctttatcatgtttttttcacatatactcctaatatttagactcacaatcatggtgatttctaggcagcataaataagtttagtgttttagtccaattggccctccatatctgcaggggaattggtcgcaggaccccctcggatactaaaatctcaaggatgttcaagtcctttaaaaccattgatggaaaaattggccctccttatttgagggttctccacctgcggttggttgaacctgcaggtttggaacctgcagatgcagagggctgaatgtatattcttgtctagcattaaacaggaagagatgataattagttcatgtctgttatatcttattttcacacaatcacagttttacttagaatgtttccagcttctcgtttagtaagatcgacccttatcccagggtttctcagctttcgcagtattggtattttgg

SEQ ID NO: 36162 - DNA, 3977 bp, Homo sapiens
gtagctgctttgcaggtacatcatgtgacagtggaattatagaagatgtgaagaaaacaacacacactccaacactaaaagcatgatgtagctgctttgcaggtaaaagaagcagctacatcatgcttttagtgttggagtgtgtgttgttttctgtggctcaggggtattttagaatggactcttctgcaacccagtttcacatagagactcatgagaacacatcaggactttggtcaatatggtaccgcaaccattttgaccgtagtgttgtattaaatgatgtgtttctttccaaggagaccaagcacatgttaaagattctgaatttcactggccctttatttctacctccaggctgttggaatatattttctttgaaacttgctgttaaagacattgccataaatctattcaccaatgtatttttgactacaaacataggtgccatttttgcaatacctctacagatttattcagcaccaaccaaggaagggagtctgggttttgaagtgatagcacattgtggcatgcattatttcatgggaaaatcaaaagcaggaaatcctaattggaatgggagcctttctctggatcaatctacctggaatgtggattctgaacttgcaaataaattgtatgaaagatggaagaaatataaaaatggtgacgtctgcaagaggaatgttttgggaacaactcgatttgctcacttgaagaaatccaaggagtcagagtcctttgttttctttttgcctcgtttgatcgcagagcctggcctcatgttaaacttcagcgcaactgcccttaggagcaggatgatcaagtactttgtggtgcagaacccgtcctcttggccggtctccttgcagctcctgcctctctccttgtaccctaaacccgaagccctagtgcacctgctccacagatggtttggcactgatatgcagatgattaatttcacaactggtgaattccagctcaccgaagcttgcccttacctgggtacgcattctgaggaatccaggtttggcatcctccacttacatctgcagcctttggaaatgaaaagggttggcgtagttttcacacctgctgactatggaaaagttacctcactcatactaatccggaataacttgactgttattgacatgattggcgtggaaggatttggagcaagagagttattaaaagtgggtggaagacttcctggtgcaggaggctcactccgatttaaggtgcccgagtccacgctgatggactgccgtagacaactgaaagacagtaagcaaattttatctattacaaagaactttaaagttgagaatattggacctcttcctataactgtttcgtctctgaaaattaatgggtataactgccaaggttatggattcgaggtgctggattgtcatcagttttccctggacccaaacacatcccgcgatatcagcattgtgttcactccagactttacctcctcctgggtaattcgggacctaagtcttgtaaccgcagcggacctagaatttcgcttcactctcaatgtgactctccctcatcacctgttgcccttgtgtgcagacgtggttccaggacccagctgggaggagtcattttggaggctcacggtcttctttgtcagtttgtccctgttgggtgtgattttaatagccttccaacaagcacagtacattctcatggaattcatgaaaacaagacagaggcaaaatgctagctcctcttcacagcaaaacaatggtcctatggatgtaatcagcccccattcttacaaaagcaattgcaagaactttctcgatacatatggcccctctgataaaggcagggggaagaactgccttccagtgaacactccccaaagcaggatccagaatgctgcaaagaggagcccagccacctatggtcattctcagaagaagcacaaatgctcagtgtattacagtaaacacaaaaccagcacagctgcggccagcagcaccagcacgactactgaggaaaaacagacttcacccctgggcagctcactgcctgctgctaaagaggacatttgcactgatgccatgcgtgagaactggatcagcctcagatatgcaagtggcataaatgtcaacctgcagaagaatttaacccttcccaaaaacttactgaataaagaagaaaacacactgaaaaacacaattgttttcagtaatccttcttcagaatgtagtatgaaggagggaatacagacatgtatgtttcctaaggaaactgacattaaaacttcagagaacacagccgagttcaaggaacgggagctctgtccactgaagacctccaagaaactacctgaaaaccatttaccaagaaactcacctcagtaccaccagccagacttgccagaaatttccaggaaaaataatgggaataaccagcaagtacctgtcaagaatgaagtagatcattgtgaaaatttgaagaaggtggacacaaagccttcttcagaaaagaagattcacaaaacatctagagaagacatgttttctgagaaacaggacatacctttcgtagagcaagaagatccttataggaagaaaaagcttcaggagaaaagagaaggaaatttacaaaatttaaattggagtaaaagtcgaacatgtagaaagaacaagaaaaggggtgttgctccagtctcaaggcctcctgaacagagtgatctaaagcttgtgtgcagtgactttgagaggtctgagctgagcagtgacatcaatgtaagaagctggtgtatacaggaaagcactagggaggtttgtaaagcagatgccgaaattgcaagcagtttacctgctgcccagagagaggcagaaggttactaccagaagcctgagaagaaatgtgtggacaagttctgctccgattccagctctgactgtgggagctcctctggcagcgtgcgtgccagccggggcagctgggggagctggagcagcaccagcagctccgacggggataagaagcccatggtggacgcccagcacttcctgccggccggagacagtgtttcacaaaatgattttccttctgaagctcccatctccttgaatctttctcataacatctgcaatcccatgaccgtgaatagtctcccacaatacgcagagccttcctgtcccagccttcctgccgggcccacaggtgttgaagaagataaaggtctttactcacctggagacctgtggcccactccgccagtgtgtgtgacaagcagcttaaactgcaccctggagaacggcgtgccttgtgtgattcaggagtcggccccggttcataatagtttcattgattggagtgcaacatgcgaaggccagttttccagcgcatactgtccattggaattgaacgattacaatgcctttccagaagaaaacatgaactatgccaatggcttcccctgtcctgcagatgttcagacagactttattgatcacaactctcagtctacctggaacaccccacccaacatgcctgctgcctggggacatgccagtttcatcagctctccgccctacctcacaagcacccgaagcttgtctccaatgtctggactttttggttccatctgggccccgcaaagcgatgtgtatgaaaattgctgccccatcaaccccaccacggaacattcgacccacatggaaaaccaagcggtcgtgtgcaaggaatactacccggggttcaacccgtttcgcgcctatatgaacctggacatatggactaccacagcgaataggaatgcaaatttcccactgtctagagactcgagttactgtgggaatgtgtgaaaataattggatttttaaacaatgtgaataaagaggcttgtgttttgattactagtgtaaactggttattgagatagattatgacattggtggatattttggcacttttatatgaaaataaattttttaatgaaa

SEQ ID NO: 36163 - DNA, 3951 bp, Homo sapiens
aaagattcccacctctccttcctgataccctccttagcaagacagaacaaatctgttggtagaatgaggtgaacaatagaccagttataaacatgcatcttctctaggatcggctcctggtctgtgccccctttcaagaactactgttttccctcggcactctagatagtgacctggaagactcgttgatgattagcatgtgtgtggaaggagtttcgcattttagatttaaagctgttaaaaatgttccaagtataattttgtttcaggctgtattcatgagccatgtgtcttttacgttattacctttacataattcgatttagttttgttttatgacatgtttgtttaatttgatatcatttgccattgagttagagggacttttaataaataagcagcagagacagaggtggcatttattaactctacagtcctctcagtttaagaagtttaatattaagcccttggcattatttactaattgaattatgttttctgtaaatctaaatatggaatctgatctaacttttaggaaatcctaattggaatgggagcctttctctggatcaatctacctggaatgtggattctgaacttgcaaataaattgtatgaaagatggaagaaatataaaaatggtgacgtctgcaagaggaatgttttgggaacaactcgatttgctcacttgaagaaatccaaggagtcagagtcctttgttttctttttgcctcgtttgatcgcagagcctggcctcatgttaaacttcagcgcaactgcccttaggagcaggatgatcaagtactttgtggtgcagaacccgtcctcttggccggtctccttgcagctcctgcctctctccttgtaccctaaacccgaagccctagtgcacctgctccacagatggtttggcactgatatgcagatgattaatttcacaactggtgaattccagctcaccgaagcttgcccttacctgggtacgcattctgaggaatccaggtttggcatcctccacttacatctgcagcctttggaaatgaaaagggttggcgtagttttcacacctgctgactatggaaaagttacctcactcatactaatccggaataacttgactgttattgacatgattggcgtggaaggatttggagcaagagagttattaaaagtgggtggaagacttcctggtgcaggaggctcactccgatttaaggtgcccgagtccacgctgatggactgccgtagacaactgaaagacagtaagcaaattttatctattacaaagaactttaaagttgagaatattggacctcttcctataactgtttcgtctctgaaaattaatgggtataactgccaaggttatggattcgaggtgctggattgtcatcagttttccctggacccaaacacatcccgcgatatcagcattgtgttcactccagactttacctcctcctgggtaattcgggacctaagtcttgtaaccgcagcggacctagaatttcgcttcactctcaatgtgactctccctcatcacctgttgcccttgtgtgcagacgtggttccaggacccagctgggaggagtcattttggaggctcacggtcttctttgtcagtttgtccctgttgggtgtgattttaatagccttccaacaagcacagtacattctcatggaattcatgaaaacaagacagaggcaaaatgctagctcctcttcacagcaaaacaatggtcctatggatgtaatcagcccccattcttacaaaagcaattgcaagaactttctcgatacatatggcccctctgataaaggcagggggaagaactgccttccagtgaacactccccaaagcaggatccagaatgctgcaaagaggagcccagccacctatggtcattctcagaagaagcacaaatgctcagtgtattacagtaaacacaaaaccagcacagctgcggccagcagcaccagcacgactactgaggaaaaacagacttcacccctgggcagctcactgcctgctgctaaagaggacatttgcactgatgccatgcgtgagaactggatcagcctcagatatgcaagtggcataaatgtcaacctgcagaagaatttaacccttcccaaaaacttactgaataaagaagaaaacacactgaaaaacacaattgttttcagtaatccttcttcagaatgtagtatgaaggagggaatacagacatgtatgtttcctaaggaaactgacattaaaacttcagagaacacagccgagttcaaggaacgggagctctgtccactgaagacctccaagaaactacctgaaaaccatttaccaagaaactcacctcagtaccaccagccagacttgccagaaatttccaggaaaaataatgggaataaccagcaagtacctgtcaagaatgaagtagatcattgtgaaaatttgaagaaggtggacacaaagccttcttcagaaaagaagattcacaaaacatctagagaagacatgttttctgagaaacaggacatacctttcgtagagcaagaagatccttataggaagaaaaagcttcaggagaaaagagaaggaaatttacaaaatttaaattggagtaaaagtcgaacatgtagaaagaacaagaaaaggggtgttgctccagtctcaaggcctcctgaacagagtgatctaaagcttgtgtgcagtgactttgagaggtctgagctgagcagtgacatcaatgtaagaagctggtgtatacaggaaagcactagggaggtttgtaaagcagatgccgaaattgcaagcagtttacctgctgcccagagagaggcagaaggttactaccagaagcctgagaagaaatgtgtggacaagttctgctccgattccagctctgactgtgggagctcctctggcagcgtgcgtgccagccggggcagctgggggagctggagcagcaccagcagctccgacggggataagaagcccatggtggacgcccagcacttcctgccggccggagacagtgtttcacaaaatgattttccttctgaagctcccatctccttgaatctttctcataacatctgcaatcccatgaccgtgaatagtctcccacaatacgcagagccttcctgtcccagccttcctgccgggcccacaggtgttgaagaagataaaggtctttactcacctggagacctgtggcccactccgccagtgtgtgtgacaagcagcttaaactgcaccctggagaacggcgtgccttgtgtgattcaggagtcggccccggttcataatagtttcattgattggagtgcaacatgcgaaggccagttttccagcgcatactgtccattggaattgaacgattacaatgcctttccagaagaaaacatgaactatgccaatggcttcccctgtcctgcagatgttcagacagactttattgatcacaactctcagtctacctggaacaccccacccaacatgcctgctgcctggggacatgccagtttcatcagctctccgccctacctcacaagcacccgaagcttgtctccaatgtctggactttttggttccatctgggccccgcaaagcgatgtgtatgaaaattgctgccccatcaaccccaccacggaacattcgacccacatggaaaaccaagcggtcgtgtgcaaggaatactacccggggttcaacccgtttcgcgcctatatgaacctggacatatggactaccacagcgaataggaatgcaaatttcccactgtctagagactcgagttactgtgggaatgtgtgaaaataattggatttttaaacaatgtgaataaagaggcttgtgttttgattactagtgtaaactggttattgagatagattatgacattggtggatattttggcacttttatatgaaaataaattttttaatgaaa

SEQ ID NO: 36164 - DNA, 3725 bp, Homo sapiens
gtagctgctttgcaggtacatcatgtgacagtggaattatagaagatgtgaagaaaacaacacacactccaacactaaaagcatgatgtagctgctttgcaggtaaaagaagcagctacatcatgcttttagtgttggagtgtgtgttgttttctgtggctcaggggtattttagaatggactcttctgcaacccagtttcacatagagactcatgagaacacatcaggactttggtcaatatggtaccgcaaccattttgaccgtagtgttgtattaaatgatgtgtttctttccaaggagaccaagcacatgttaaagattctgaatttcactggccctttatttctacctccaggctgttggaatatattttctttgaaacttgctgttaaagacattgccataaatctattcaccaatgtatttttgactacaaacataggtgccatttttgcaatacctctacagatttattcagcaccaaccaaggaagggagtctgggttttgaagtgatagcacattgtggcatgcattatttcatgggaaaatcaaaagcaggaaatcctaattggaatgggagcctttctctggatcaatctacctggaatgtggattctgaacttgcaaataaattgtatgaaagatggaagaaatataaaaatggtgacgtctgcaagtttggcactgatatgcagatgattaatttcacaactggtgaattccagctcaccgaagcttgcccttacctgggtacgcattctgaggaatccaggtttggcatcctccacttacatctgcagcctttggaaatgaaaagggttggcgtagttttcacacctgctgactatggaaaagttacctcactcatactaatccggaataacttgactgttattgacatgattggcgtggaaggatttggagcaagagagttattaaaagtgggtggaagacttcctggtgcaggaggctcactccgatttaaggtgcccgagtccacgctgatggactgccgtagacaactgaaagacagtaagcaaattttatctattacaaagaactttaaagttgagaatattggacctcttcctataactgtttcgtctctgaaaattaatgggtataactgccaaggttatggattcgaggtgctggattgtcatcagttttccctggacccaaacacatcccgcgatatcagcattgtgttcactccagactttacctcctcctgggtaattcgggacctaagtcttgtaaccgcagcggacctagaatttcgcttcactctcaatgtgactctccctcatcacctgttgcccttgtgtgcagacgtggttccaggacccagctgggaggagtcattttggaggctcacggtcttctttgtcagtttgtccctgttgggtgtgattttaatagccttccaacaagcacagtacattctcatggaattcatgaaaacaagacagaggcaaaatgctagctcctcttcacagcaaaacaatggtcctatggatgtaatcagcccccattcttacaaaagcaattgcaagaactttctcgatacatatggcccctctgataaaggcagggggaagaactgccttccagtgaacactccccaaagcaggatccagaatgctgcaaagaggagcccagccacctatggtcattctcagaagaagcacaaatgctcagtgtattacagtaaacacaaaaccagcacagctgcggccagcagcaccagcacgactactgaggaaaaacagacttcacccctgggcagctcactgcctgctgctaaagaggacatttgcactgatgccatgcgtgagaactggatcagcctcagatatgcaagtggcataaatgtcaacctgcagaagaatttaacccttcccaaaaacttactgaataaagaagaaaacacactgaaaaacacaattgttttcagtaatccttcttcagaatgtagtatgaaggagggaatacagacatgtatgtttcctaaggaaactgacattaaaacttcagagaacacagccgagttcaaggaacgggagctctgtccactgaagacctccaagaaactacctgaaaaccatttaccaagaaactcacctcagtaccaccagccagacttgccagaaatttccaggaaaaataatgggaataaccagcaagtacctgtcaagaatgaagtagatcattgtgaaaatttgaagaaggtggacacaaagccttcttcagaaaagaagattcacaaaacatctagagaagacatgttttctgagaaacaggacatacctttcgtagagcaagaagatccttataggaagaaaaagcttcaggagaaaagagaaggaaatttacaaaatttaaattggagtaaaagtcgaacatgtagaaagaacaagaaaaggggtgttgctccagtctcaaggcctcctgaacagagtgatctaaagcttgtgtgcagtgactttgagaggtctgagctgagcagtgacatcaatgtaagaagctggtgtatacaggaaagcactagggaggtttgtaaagcagatgccgaaattgcaagcagtttacctgctgcccagagagaggcagaaggttactaccagaagcctgagaagaaatgtgtggacaagttctgctccgattccagctctgactgtgggagctcctctggcagcgtgcgtgccagccggggcagctgggggagctggagcagcaccagcagctccgacggggataagaagcccatggtggacgcccagcacttcctgccggccggagacagtgtttcacaaaatgattttccttctgaagctcccatctccttgaatctttctcataacatctgcaatcccatgaccgtgaatagtctcccacaatacgcagagccttcctgtcccagccttcctgccgggcccacaggtgttgaagaagataaaggtctttactcacctggagacctgtggcccactccgccagtgtgtgtgacaagcagcttaaactgcaccctggagaacggcgtgccttgtgtgattcaggagtcggccccggttcataatagtttcattgattggagtgcaacatgcgaaggccagttttccagcgcatactgtccattggaattgaacgattacaatgcctttccagaagaaaacatgaactatgccaatggcttcccctgtcctgcagatgttcagacagactttattgatcacaactctcagtctacctggaacaccccacccaacatgcctgctgcctggggacatgccagtttcatcagctctccgccctacctcacaagcacccgaagcttgtctccaatgtctggactttttggttccatctgggccccgcaaagcgatgtgtatgaaaattgctgccccatcaaccccaccacggaacattcgacccacatggaaaaccaagcggtcgtgtgcaaggaatactacccggggttcaacccgtttcgcgcctatatgaacctggacatatggactaccacagcgaataggaatgcaaatttcccactgtctagagactcgagttactgtgggaatgtgtgaaaataattggatttttaaacaatgtgaataaagaggcttgtgttttgattactagtgtaaactggttattgagatagattatgacattggtggatattttggcacttttatatgaaaataaattttttaatgaaa

SEQ ID NO: 36165 - DNA, 4434 bp, Homo sapiens
  misc_feature (4433)..(4434): n is a, c, g, or t
gtagctgctttgcaggtacatcatgtgacagtggaattatagaagatgtgaagaaaacaacacacactccaacactaaaagcatgatgtagctgctttgcaggtaaaagaagcagctacatcatgcttttagtgttggagtgtgtgttgttttctgtggctcaggggtattttagaatggactcttctgcaacccagtttcacatagagactcatgagaacacatcaggactttggtcaatatggtaccgcaaccattttgaccgtagtgttgtattaaatgatgtgtttctttccaaggagaccaagcacatgttaaagattctgaatttcactggccctttatttctacctccaggctgttggaatatattttctttgaaacttgctgttaaagacattgccataaatctattcaccaatgtatttttgactacaaacataggtgccatttttgcaatacctctacagatttattcagcaccaaccaaggaagggagtctgggttttgaagtgatagcacattgtggcatgcattatttcatgggaaaatcaaaagcaggaaatcctaattggaatgggagcctttctctggatcaatctacctggaatgtggattctgaacttgcaaataaattgtatgaaagatggaagaaatataaaaatggtgacgtctgcaagaggaatgttttgggaacaactcgatttgctcacttgaagaaatccaaggagtcagagtcctttgttttctttttgcctcgtttgatcgcagagcctggcctcatgttaaacttcagcgcaactgcccttaggagcaggatgatcaagtactttgtggtgcagaacccgtcctcttggccggtctccttgcagctcctgcctctctccttgtaccctaaacccgaagccctagtgcacctgctccacagatggtttggcactgatatgcagatgattaatttcacaactggtgaattccagctcaccgaagcttgcccttacctgggtacgcattctgaggaatccaggtttggcatcctccacttacatctgcagcctttggaaatgaaaagggttggcgtagttttcacacctgctgactatggaaaagttacctcactcatactaatccggaataacttgactgttattgacatgattggcgtggaaggatttggagcaagagagttattaaaagtgggtggaagacttcctggtgcaggaggctcactccgatttaaggtgcccgagtccacgctgatggactgccgtagacaactgaaagacagtaagcaaattttatctattacaaagaactttaaagttgagaatattggacctcttcctataactgtttcgtctctgaaaattaatgggtataactgccaaggttatggattcgaggtgctggattgtcatcagttttccctggacccaaacacatcccgcgatatcagcattgtgttcactccagactttacctcctcctgggtaattcgggacctaagtcttgtaaccgcagcggacctagaatttcgcttcactctcaatgtgactctccctcatcacctgttgcccttgtgtgcagacgtggttccaggacccagctgggaggagtcattttggaggctcacggtcttctttgtcagtttgtccctgttgggtgtgattttaatagccttccaacaagcacagtacattctcatggaattcatgaaaacaagacagaggcaaaatgctagctcctcttcacagcaaaacaatggtcctatggatgtaatcagcccccattcttacaaaagcaattgcaagaactttctcgatacatatggcccctctgataaaggcagggggaagaactgccttccagtgaacactccccaaagcaggatccagaatgctgcaaagaggagcccagccacctatggtcattctcagaagaagcacaaatgctcagtgtattacagtaaacacaaaaccagcacagctgcggccagcagcaccagcacgactactgaggaaaaacagacttcacccctgggcagctcactgcctgctgctaaagaggacatttgcactgatgccatgcgtgagaactggatcagcctcagatatgcaagtggcataaatgtcaacctgcagaagaatttaacccttcccaaaaacttactgaataaagaagaaaacacactgaaaaacacaattgttttcagtaatccttcttcagaatgtagtatgaaggagggaatacagacatgtatgtttcctaaggaaactgacattaaaacttcagagaacacagccgagttcaaggaacgggagctctgtccactgaagacctccaagaaactacctgaaaaccatttaccaagaaactcacctcagtaccaccagccagacttgccagaaatttccaggaaaaataatgggaataaccagcaagtacctgtcaagaatgaagtagatcattgtgaaaatttgaagaaggtggacacaaagccttcttcagaaaagaagattcacaaaacatctagagaagacatgttttctgagaaacaggacatacctttcgtagagcaagaagatccttataggaagaaaaagcttcaggagaaaagagaaggaaatttacaaaatttaaattggagtaaaagtcgaacatgtagaaagaacaagaaaaggggtgttgctccagtctcaaggcctcctgaacagagtgatctaaagcttgtgtgcagtgactttgagaggtctgagctgagcagtgacatcaatgtaagaagctggtgtatacaggaaagcactagggaggtttgtaaagcagatgccgaaattgcaagcagtttacctgctgcccagagagaggcagaaggttactaccagaagcctgagaagaaatgtgtggacaagttctgctccgattccagctctgactgtgggagctcctctggcagcgtgcgtgccagccggggcagctgggggagctggagcagcaccagcagctccgacggggataagaagcccatggtggacgcccagcacttcctgccggccggagacagtgtttcacaaaatgattttccttctgaagctcccatctccttgaatctttctcataacatctgcaatcccatgaccgtgaatagtctcccacaatacgcagagccttcctgtcccagccttcctgccgggcccacaggtgttgaagaagataaaggtctttactcacctggagacctgtggcccactccgccagtgtgtgtgacaagcagcttaaactgcaccctggagaacggcgtgccttgtgtgattcaggagtcggccccggttcataatagtttcattgattggagtgcaacatgcgaaggccagttttccagcgcatactgtccattggaattgaacgattacaatgcctttccagaagaaaacatgaactatgccaatggcttcccctgtcctgcagatgttcagacagactttattgatcacaactctcagtctacctggaacaccccacccaacatgcctgctgcctggggacatgccagtttcatcagctctccgccctacctcacaagcacccgaagcttgtctccaatgtctggactttttggttccatctgggccccgcaaagcgatgtgtatgaaaattgctgccccatcaaccccaccacggaacattcgacccacatggaaaaccaagcggtcgtgtgcaaggaatactacccggggttcaacccgtttcgcgcctatatgaacctggacatatggactaccacagcgaataggaatgcaaatttcccactgtctagagactcgagttactgtgggaatgtgtgaaaataattggatttttaaacaatgtgaataaagaggcttgtgttttgattactagtgtaaactggttattgagatagattatgacattggtggatattttggcacttttatatgaaaataaattttttaatgaaaaaaaaaaaaaaaaaaactcgagactagtgccctggggttgtctgtgggcctcatgggcattgtggtgggcactgtcttcatcatccaaggcctgcgttcagttggtgcttccagacaccaagggccattgtgaatcccatcctggaagggaaggtgcatcgccatctacaggagcagaagaatggacttgctaaatgacctagcactattctctggcccgatttatcatatcccttttctcctccaaatatttctcctctcaccttttctctgggacttaagctgctatatcccctcagagctcacaaatgcctttacattctttccctgacctcctgattttttttttcttttctcaaatgttacctacaaagacatgcctggggtaagccacccggctacctaattcctcagtaacctccatcttctccaaggaagcaatttccttttatgagnn

SEQ ID NO: 36166 - DNA, 1183 bp, Homo sapiens
ctagggaaggtgaactacctggaaatacagacaggtggctacctgtctgaaaatctacctgacgggtagatttaaaaccacaggttacctcatagttatgttagttaattttttttgttgttggttatgacaagactttgctagatttgggaatttaatattcctcaattcttttctggctgtgtaactttacatcctttatatctgtatgtttcttccccaagaaactcttccccaagacttccattgagtgaaaactcaatcagacgtggttatacatatcagtatttcctcgtgcagaaaaaatgagtcgttcctcctttgccctcttccccacaggaccgtgaatagtctcccacaatacgcagagccttcctgtcccagccttcctgccgggcccacaggtgttgaagaagataaaggtctttactcacctggagacctgtggcccactccgccagtgtgtgtgacaagcagcttaaactgcaccctggagaacggcgtgccttgtgtgattcaggagtcggccccggttcataatagtttcattgattggagtgcaacatgcgaaggccagttttccagcgcatactgtccattggaattgaacgattacaatgcctttccagaagaaaacatgaactatgccaatggcttcccctgtcctgcagatgttcagacagactttattgatcacaactctcagtctacctggaacaccccacccaacatgcctgctgcctggggacatgccagtttcatcagctctccgccctacctcacaagcacccgaagcttgtctccaatgtctggactttttggttccatctgggccccgcaaagcgatgtgtatgaaaattgctgccccatcaaccccaccacggaacattcgacccacatggaaaaccaagcggtcgtgtgcaaggaatactacccggggttcaacccgtttcgcgcctatatgaacctggacatatggactaccacagcgaataggaatgcaaatttcccactgtctagagactcgagttactgtgggaatgtgtgaaaataattggatttttaaacaatgtgaataaagaggcttgtgttttgattactagtgtaaactggttattgagatagattatgacattggtggatattttggcacttttatatgaaaataaattttttaatgaaa

SEQ ID NO: 36167 - DNA, 1331 bp, Homo sapiens
gtagctgctttgcaggtacatcatgtgacagtggaattatagaagatgtgaagaaaacaacacacactccaacactaaaagcatgatgtagctgctttgcaggtaaaagaagcagctacatcatgcttttagtgttggagtgtgtgttgttttctgtggctcaggggtattttagaatggactcttctgcaacccagtttcacatagagactcatgagaacacatcaggactttggtcaatatggtaccgcaaccattttgaccgtagtgttgtattaaatgatgtgtttctttccaaggagaccaagcacatgttaaagattctgaatttcactggccctttatttctacctccaggctgttggaatatattttctttgaaacttgctgttaaagacattgccataaatctattcaccaatgtatttttgactacaaacataggtgccatttttgcaatacctctacagatttattcagcaccaaccaaggaagggagtctgggttttgaagtgatagcacattgtggcatgcattatttcatgggaaaatcaaaagcaggaaatcctaattggaatgggagcctttctctggatcaatctacctggaatgtggattctgaacttgcaaataaattgtatgaaagatggaagaaatataaaaatggtgacgtctgcaagaggaatgttttgggaacaactcgatttgctcacttgaagaaatccaaggagtcagagtcctttgttttctttttgcctcgtttgatcgcagagcctggcctcatgttaaacttcagcgcaactgcccttaggagcaggatgatcaagtactttgtggtgcagaacccgtcctcttggccggtctccttgcagctcctgcctctctccttgtaccctaaacccgaagccctagtgcacctgctccacagatggtttggcactgatatgcagatgattaatttcacaactggtgaattccagctcaccgaagcttgcccttacctgggtacgcattctgaggaatccaggtttggcatcctccacttacatctgcagcctttggaaatgaaaagggttggcgtagttttcacacctgctgactatggaaaagttacctcactcatactaatccggaataacttgactgttattgacatgattggcgtggaaggatttggagcaagagagttattaaaagtgggtggaagacttcctggtgcaggaggctcactccgatttaaggtgcccgagtccacgctgatggactgccgtagacgtgagttcatatgtgtggcactctgacaggggaggttggcattaaagctgagagtg

SEQ ID NO: 36168 - DNA, 1367 bp, Homo sapiens
gtagctgctttgcaggtacatcatgtgacagtggaattatagaagatgtgaagaaaacaacacacactccaacactaaaagcatgatgtagctgctttgcaggtaaaagaagcagctacatcatgcttttagtgttggagtgtgtgttgttttctgtggctcaggggtattttagaatggactcttctgcaacccagtttcacatagagactcatgagaacacatcaggactttggtcaatatggtaccgcaaccattttgaccgtagtgttgtattaaatgatgtgtttctttccaaggagaccaagcacatgttaaagattctgaatttcactggccctttatttctacctccaggctgttggaatatattttctttgaaacttgctgttaaagacattgccataaatctattcaccaatgtatttttgactacaaacataggtgccatttttgcaatacctctacagatttattcagcaccaaccaaggaagggagtctgggttttgaagtgatagcacattgtggcatgcattatttcatgggaaaatcaaaagcaggaaatcctaattggaatgggagcctttctctggatcaatctacctggaatgtggattctgaacttgcaaataaattgtatgaaagatggaagaaatataaaaatggtgacgtctgcaagaggaatgttttgggaacaactcgatttgctcacttgaagaaatccaaggagtcagagtcctttgttttctttttgcctcgtttgatcgcagagcctggcctcatgttaaacttcagcgcaactgcccttaggagcaggatgatcaagtactttgtggtgcagaacccgtcctcttggccggtctccttgcagctcctgcctctctccttgtaccctaaacccgaagccctagtgcacctgctccacagatggtttggcactgatatgcagatgattaatttcacaactggtgaattccagctcaccgaagcttgcccttacctggtaggatgttatcctaaaacagaaaaaagaatgccgacaaactagacacatgagcatacgggcctcattgatttatgtttaaaatgtcttttatttactatatatggctcttttattttgattctctgggcattaacgatacatagcagatttttccagttaactagtgcggtaggagctgggtttatgttagctctaaatcattttaatttgattatttagaatcatgtgagtaaagaaataacagttgaacagagctttgtagaaaaccatgaaacttgagaccccagaatttataattctcttaagattccttggccctcaaattcttttttagggcaagataaggaaaaacaaatacat

SEQ ID NO: 36169 - DNA, 710 bp, Homo sapiens
gtagctgctttgcaggtacatcatgtgacagtggaattatagaagatgtgaagaaaacaacacacactccaacactaaaagcatgatgtagctgctttgcaggtaaaagaagcagctacatcatgcttttagtgttggagtgtgtgttgttttctgtggctcaggggtattttagaatggactcttctgcaacccagtttcacatagagactcatgagaacacatcaggactttggtcaatatggtaccgcaaccattttgaccgtagtgttgtattaaatgatgtgtttctttccaaggagaccaagcacatgttaaagattctgaatttcactggccctttatttctacctccaggctgttggaatatattttctttgaaacttgtgggatgaagcagagagccctagaactgttctctccatcccacttacggcaagggctgttcctctgtcaggccagtccttgggggcaatgacagcagcaggaacattctggtaagtgtgtggtttccctcccagtgagcaggctaaccctgagtataggaacttaggggaggttaggtggctgatgcatgttttccagaccggtttgtatctgcttgtcattgatcttagaagttcatattatggtggaattatctatttgcatgtgtaaactttgaatatgtttttaacttttaataaaaagttatttttaaatattgtttt

SEQ ID NO: 36170 - DNA, 737 bp, Homo sapiens
ggttcagaatccagtccaggatttctcatttcattggcaggtctttttagtctcctttaatcttccccagctgttctttgccttttatgacatagacatttttgaagcgtgctggccatttatttcctatgatgtttcttgattggagttacatgatatttcctcatgattaggttatgctttttggccagaatatctcaggagggatgctgtgtccctctcggggttttaacttttctttcctcacacctagatcaagtactttgtggtgcagaacccgtcctcttggccggtctccttgcagctcctgcctctctccttgtaccctaaacccgaagccctagtgcacctgctccacagatggtatgaagactttttttctgagaggcagtttgggaagtacttgggaagacttagaattacttaatgtcctacactttttcaaccaggacctgtgtgtggatgtggacacagtattaaccgattagctcatggaccttgggcatcctgccccttggtgcatgtgatttgatggaactacctggctctgtgtgttatgtggcatcttcagtgttactatgcgaagtccactaaccaacagatccttttctttagctagggaacctttatcatgtttttttcacatatactcctaatatttagactcacaatcatggtgatttctaggcagcataaataagtttagtgttttagtccaattggccctccatatctgc

SEQ ID NO: 36171 - DNA, 491 bp, Homo sapiens
aggacatttgcactgatgccatgcgtgagaactggatcagcctcagatatgcaagtggcataaatgtcaacctgcagaagaatttaacccttcccaaaaacttactgaataaagaagaaaacacactgaaaaacacaattgttttcagtaatccttcttcagaatgtagtatgaaggagggaatacagacatgtatgtttcctaaggaaactgacattaaaacttcagagaacacagccgagttcaaggaacgggagctctgtccactgaagacctccaagaaactacctgaaaaccatttaccaagaaactcacctcagtaccaccagccagacttgccagaaatttccaggaaaaataatggtaatcttttcatcccctttgataattctctcctgtttgtacccagtctgtttttaatggaattgttctcacctgtgaccgttagttttaattgtggatgctgagttttagcaaaggtttaaatattg

SEQ ID NO: 36172 - DNA, 312 bp, Homo sapiens
tttttgtgtgtgtgtgtcttttccaggcctcctgaacagagtgatctaaagcttgtgtgcagtgactttgagaggtctgagctgagcagtgacatcaatgtaagaagctggtgtatacaggaaagcactagggaggtttgtaaagcagatgccgaaattgcaagcagtttacctgctgcccagagagaggcaggtatgtaatgatactgagctacaaatggtgcttctgtgggaatttttgtttcctcaatgaagtatctaataagagaaatgacacctcagtgattttatctctacaggcaacttagctaa

SEQ ID NO: 36173 - DNA, 311 bp, Homo sapiens
cacgattcatgtttaatgtttaattaaaaaatgtgagaatatcagtttaaagtgaaaaatcagtcatgcattaatgatattaataacctatgcattttaataccgaatatacagttgaagtgtactttttgaaacttgtgataatgtgtttcttttaatgcaggagacagtgtttcacaaaatgattttccttctgaagctcccatctccttgaatctttctcataacatctgcaatcccatgtaagttttttattttccagcttttacagtatgttttgtgtactgctttttctaccaattattgtgttt

SEQ ID NO: 36174 - DNA, 448 bp, Homo sapiens
cttttaacttatttttccttcctcatttatacttcagccctacctcacaagcacccgaagcttgtctccaatgtctggactttttggttccatctgggccccgcaaagcgatgtgtatgaaaattgctgccccatcaaccccaccacggaacattcgacccacatggaaaaccaagcggtcgtgtgcaaggaatactacccggggttcaacccgtttcgcgcctatatgaacctggacatatggactaccacagcgaataggaatgcaaatttcccactgtctagagactcgagttactgtgggaatgtgtgaaaataattggatttttaaacaatgtgaataaagaggcttgtgttttgattactagtgtaaactggttattgagatagattatgacattggtggatattttggcacttttatatgaaaataaattttttaatgaaa

SEQ ID NO: 36175 - DNA, 2078 bp, Homo sapiens
aggcagggcggtaaatcggccgaggcgaacaggaagaggacgaaaaaaataaccgtccgcgacgccgagacaaaccggacccgcaaccaccatgaacagcaaaggtcaatatccaacacagccaacctaccctgtgcagcctcctgggaatccagtataccctcagaccttgcatcttcctcaggctccaccctataccgatgctccacctgcctactcagagctctatcgtccgagctttgtgcacccaggggctgccacagtccccaccatgtcagccgcatttcctggagcctctctgtatcttcccatggcccagtctgtggctgttgggcctttaggttccacaatccccatggcttattatccagtcggtcccatctatccacctggctccacagtgctggtggaaggagggtatgatgcaggtgccagatttggagctggggctactgctggcaacattcctcctccacctcctggatgccctcccaatgctgctcagcttgcagtcatgcagggagccaacgtcctcgtaactcagcggaaggggaacttcttcatgggtggttcagatggtggctacaccatctggtgaggaaccaaggccacctttgtgccgggaaagacatcacataccttcagcacttctcacaatgtaactgctttagtcatattaacctgaagttgcagtttagacacatgttgttggggtgtctttctggtgcccaaactttcaggcacttttcaaatttaataaggaaccatgtaatggtagcagtacctccctaaagcattttgaggtaggggaggtatccattcataaaatgaatgtgggtgaagccgccctaaggattttcctttaatttctctggagtaatactgtaccatactggtctttgcttttagtaataaaacatcaaattaggtttggagggaactttgatcttcctaagaattaaagttgccaaattattctgattggtctttaatctcctttaagtctttgatatatattacttgttataaatggaacgcattagttgtctgccttttcctttccatcccttgccccacccatcccatctccaaccctagtcttccatttcctcccgccagtctccattgaatcaatggtgcaggacagaaagccagtcagactaatttccttctttcctcgcacttctccccactcgtcatcttttaactagtgtttcacaaggatcctctgaaaccctctctgtgccccaagtacagatcccattacttctgctttcgtatctcctcaggcaaaagtggagggtgccttatgggccctcctcataggttgtctctgcatacacgaacctaacccaaatttgctttggtgccagaaaaactgagctatgtttgaacaaagatgtcgtgcaaactgtactgtgaacaacagttggtttaaaatatgaggggcaaggaggaggatgcatttcaaaagcttgattgatgtgttcagagctaaattaagaggagttttcagatcaaaaactggttaccattttttgtcagagtgtctgatgcggccactcattcggctccccagaattcctagactgggttaatagggtcatattgtgaatgtctcactacaaaatgacttgagtccagtgaaatctcattagggtttaagaatatttcagggatccttaatgttttgatttttgttttctgaaattggattttattttattttatcttataatttcagttcatctaaattgtgtgttctgtacatgtgatgtttgactgtaccattgactgttatggaagttcagcgttgtatgtctctctctacactgtggtgcacttaacttgtggaatttttatactaaaaatgtagaataaagactattttgaagatttgaataaagtgatgaagttgcattacacctcactgcaaggattctttacttagcttgtttttagatttcttctatatatattttatttatatcccatctagaattcagctaggtgctgctgctgctctgtttcctttgatgacgctttgaaataaaggcaggagtacaagcctaaaaaaa

SEQ ID NO: 36176 - DNA, 1902 bp, Homo sapiens
aggcagggcggtaaatcggccgaggcgaacaggaagaggacgaaaaaaataaccgtccgcgacgccgagacaaaccggacccgcaaccaccatgaacagcaaaggtcaatatccaacacagccaacctaccctgtgcagcctcctgggaatccagtataccctcagaccttgcatcttcctcaggctccaccctataccgatgctccacctgcctactcagagctctatcgtccgagctttgtgcacccaggggctgccacagtccccaccatgtcagccgcatttcctggagcctctctgtatcttcccatggcccagtctgtggctgttgggcctttaggttccacaatccccatggcttattatccagtcggtcccatctatccacctggctccacagtgctggtggaaggagggtatgatgcaggtgccagatttggagctggggctactgctggcaacattcctcctccacctcctggatgccctcccaatgctgctcagcttgcagtcatgcagggagccaacgtcctcgtaactcagcggaaggggaacttcttcatgggtggttcagatggtggctacaccatctggtgaggaaccaaggccacctttgtgccgggaaagacatcacataccttcagcacttctcacaatgtaactgctttagtcatattaacctgaagttgcagtttagacacatgttgttggggtgtctttctggtgcccaaactttcaggcacttttcaaatttaataaggaaccatgtaatggtagcagtacctccctaaagcattttgaggtaggggaggtatccattcataaaatgaatgtgggtgaagccgccctaaggattttcctttaatttctctggagtaatactgtaccatactggtctttgcttttagtaataaaacatcaaattaggtttggagggaactttgatcttcctaagaattaaagttgccaaattattctgattggtctttaatctcctttaagtctttgatatatattacttgttataaatggaacgcattagttgtctgccttttcctttccatcccttgccccacccatcccatctccaaccctagtcttccatttcctcccgccagtctccattgaatcaatggtgcaggacagaaagccagtcagactaatttccttctttcctcgcacttctccccactcgtcatcttttaactagtgtttcacaaggatcctctgaaaccctctctgtgccccaagtacagatcccattacttctgctttcgtatctcctcaggcaaaagtggagggtgccttatgggccctcctcataggttgtctctgcatacacgaacctaacccaaatttgctttggtgccagaaaaactgagctatgtttgaacaaagatgtcgtgcaaactgtactgtgaacaacagttggtttaaaatatgaggggcaaggaggaggatgcatttcaaaagcttgattgatgtgttcagagctaaattaagaggagttttcagatcaaaaactggttaccattttttgtcagagtgtctgatgcggccactcattcggctccccagaattcctagactgggttaatagggtcatattgtgaatgtctcactacaaaatgacttgagtccagtgaaatctcattagggtttaagaatatttcagggatccttaatgttttgatttttgttttctgaaattggattttattttattttatcttataatttcagttcatctaaattgtgtgttctgtacatgtgatgtttgactgtaccattgactgttatggaagttcagcgttgtatgtctctctctacactgtggtgcacttaacttgtggaatttttatactaaaaatgtagaataaagactattttgaagatttgaa

SEQ ID NO: 36177 - DNA, 355 bp, Homo sapiens
atatcgtcgacccacgcgtccggtgaatgtctcactacaaaatgacttgagtccagtgaaatctcattagggtttaagaatatttcagggatccttaatgttttgatttttgttttctgaaattggattttattttattttatcttataatttcagttcatctaaattgtgtgttctgtacatgtgatgtttgactgtaccattgactgttatggaagttcagcgttgtatgtctctctctacactgtggtgcacttaacttgtggaatttttatactaaaaatgtagaataaagactattttgaagatttgaataaagtgatgaagttgcattacacctcaaaaaaaaaataaa

SEQ ID NO: 36178 - DNA, 2093 bp, Homo sapiens
cgctagacggacggaccatcatgtgacacggaagtagctccgaacaggaagaggacgaaaaaaataaccgtccgcgacgccgagacaaaccggacccgcaaccaccatgaacagcaaaggtcaatatccaacacagccaacctaccctgtgcagcctcctgggaatccagtataccctcagaccttgcatcttcctcaggctccaccctataccgatgctccacctgcctactcagagctctatcgtccgagctttgtgcacccaggggctgccacagtccccaccatgtcagccgcatttcctggagcctctctgtatcttcccatggcccagtctgtggctgttgggcctttaggttccacaatccccatggcttattatccagtcggtcccatctatccacctggctccacagtgctggtggaaggagggtatgatgcaggtgccagatttggagctggggctactgctggcaacattcctcctccacctcctggatgccctcccaatgctgctcagcttgcagtcatgcagggagccaacgtcctcgtaactcagcggaaggggaacttcttcatgggtggttcagatggtggctacaccatctggtgaggaaccaaggccacctttgtgccgggaaagacatcacataccttcagcacttctcacaatgtaactgctttagtcatattaacctgaagttgcagtttagacacatgttgttggggtgtctttctggtgcccaaactttcaggcacttttcaaatttaataaggaaccatgtaatggtagcagtacctccctaaagcattttgaggtaggggaggtatccattcataaaatgaatgtgggtgaagccgccctaaggattttcctttaatttctctggagtaatactgtaccatactggtctttgcttttagtaataaaacatcaaattaggtttggagggaactttgatcttcctaagaattaaagttgccaaattattctgattggtctttaatctcctttaagtctttgatatatattacttgttataaatggaacgcattagttgtctgccttttcctttccatcccttgccccacccatcccatctccaaccctagtcttccatttcctcccgccagtctccattgaatcaatggtgcaggacagaaagccagtcagactaatttccttctttcctcgcacttctccccactcgtcatcttttaactagtgtttcacaaggatcctctgaaaccctctctgtgccccaagtacagatcccattacttctgctttcgtatctcctcaggcaaaagtggagggtgccttatgggccctcctcataggttgtctctgcatacacgaacctaacccaaatttgctttggtgccagaaaaactgagctatgtttgaacaaagatgtcgtgcaaactgtactgtgaacaacagttggtttaaaatatgaggggcaaggaggaggatgcatttcaaaagcttgattgatgtgttcagagctaaattaagaggagttttcagatcaaaaactggttaccattttttgtcagagtgtctgatgcggccactcattcggctccccagaattcctagactgggttaatagggtcatattgtgaatgtctcactacaaaatgacttgagtccagtgaaatctcattagggtttaagaatatttcagggatccttaatgttttgatttttgttttctgaaattggattttattttattttatcttataatttcagttcatctaaattgtgtgttctgtacatgtgatgtttgactgtaccattgactgttatggaagttcagcgttgtatgtctctctctacactgtggtgcacttaacttgtggaatttttatactaaaaatgtagaataaagactattttgaagatttgaataaagtgatgaagttgcattacacctcactgcaaggattctttacttagcttgtttttagatttcttctatatatattttatttatatcccatctagaattcagctaggtgctgctgctgctctgtttcctttgatgacgctttgaaataaaggcaggagtacaagcctaaaaaaa

SEQ ID NO: 36179 - DNA, 1917 bp, Homo sapiens
cgctagacggacggaccatcatgtgacacggaagtagctccgaacaggaagaggacgaaaaaaataaccgtccgcgacgccgagacaaaccggacccgcaaccaccatgaacagcaaaggtcaatatccaacacagccaacctaccctgtgcagcctcctgggaatccagtataccctcagaccttgcatcttcctcaggctccaccctataccgatgctccacctgcctactcagagctctatcgtccgagctttgtgcacccaggggctgccacagtccccaccatgtcagccgcatttcctggagcctctctgtatcttcccatggcccagtctgtggctgttgggcctttaggttccacaatccccatggcttattatccagtcggtcccatctatccacctggctccacagtgctggtggaaggagggtatgatgcaggtgccagatttggagctggggctactgctggcaacattcctcctccacctcctggatgccctcccaatgctgctcagcttgcagtcatgcagggagccaacgtcctcgtaactcagcggaaggggaacttcttcatgggtggttcagatggtggctacaccatctggtgaggaaccaaggccacctttgtgccgggaaagacatcacataccttcagcacttctcacaatgtaactgctttagtcatattaacctgaagttgcagtttagacacatgttgttggggtgtctttctggtgcccaaactttcaggcacttttcaaatttaataaggaaccatgtaatggtagcagtacctccctaaagcattttgaggtaggggaggtatccattcataaaatgaatgtgggtgaagccgccctaaggattttcctttaatttctctggagtaatactgtaccatactggtctttgcttttagtaataaaacatcaaattaggtttggagggaactttgatcttcctaagaattaaagttgccaaattattctgattggtctttaatctcctttaagtctttgatatatattacttgttataaatggaacgcattagttgtctgccttttcctttccatcccttgccccacccatcccatctccaaccctagtcttccatttcctcccgccagtctccattgaatcaatggtgcaggacagaaagccagtcagactaatttccttctttcctcgcacttctccccactcgtcatcttttaactagtgtttcacaaggatcctctgaaaccctctctgtgccccaagtacagatcccattacttctgctttcgtatctcctcaggcaaaagtggagggtgccttatgggccctcctcataggttgtctctgcatacacgaacctaacccaaatttgctttggtgccagaaaaactgagctatgtttgaacaaagatgtcgtgcaaactgtactgtgaacaacagttggtttaaaatatgaggggcaaggaggaggatgcatttcaaaagcttgattgatgtgttcagagctaaattaagaggagttttcagatcaaaaactggttaccattttttgtcagagtgtctgatgcggccactcattcggctccccagaattcctagactgggttaatagggtcatattgtgaatgtctcactacaaaatgacttgagtccagtgaaatctcattagggtttaagaatatttcagggatccttaatgttttgatttttgttttctgaaattggattttattttattttatcttataatttcagttcatctaaattgtgtgttctgtacatgtgatgtttgactgtaccattgactgttatggaagttcagcgttgtatgtctctctctacactgtggtgcacttaacttgtggaatttttatactaaaaatgtagaataaagactattttgaagatttgaa

SEQ ID NO: 36180 - DNA, 1958 bp, Homo sapiens
cgctagacggacggaccatcatgtgacacggaagtagctccgaacaggaagaggacgaaaaaaataaccgtccgcgacgccgagacaaaccggacccgcaaccaccatgaacagcaaaggtcaatatccaacacagccaacctaccctgtgcagcctcctgggaatccagtataccctcagaccttgcatcttcctcaggctccaccctataccgatgctccacctgcctactcagagctctatcgtccgagctttgtgcacccaggggctgccacagtccccaccatgtcagccgcatttcctggagcctctctgtatcttcccatggcccagtctgtggctgttgggcctttaggttccacaatccccatggcttattatccagtcggtcccatctatccacctggctccacagtgctggtggaaggagggtatgatgcaggtgccagatttggagctggggctactgctggcaacattcctcctccacctcctggatgccctcccaatgctgctcagcttgcagtcatgcagggagccaacgtcctcgtaactcagcggaaggggaacttcttcatgggtggttcagatggtggctacaccatctggtgaggaaccaaggccacctttgtgccgggaaagacatcacataccttcagcacttctcacaatgtaactgctttagtcatattaacctgaagttgcagtttagacacatgttgttggggtgtctttctggtgcccaaactttcaggcacttttcaaatttaataaggaaccatgtaatggtagcagtacctccctaaagcattttgaggtaggggaggtatccattcataaaatgaatgtgggtgaagccgccctaaggattttcctttaatttctctggagtaatactgtaccatactggtctttgcttttagtaataaaacatcaaattaggtttggagggaactttgatcttcctaagaattaaagttgccaaattattctgattggtctttaatctcctttaagtctttgatatatattacttgttataaatggaacgcattagttgtctgccttttcctttccatcccttgccccacccatcccatctccaaccctagtcttccatttcctcccgccagtctccattgaatcaatggtgcaggacagaaagccagtcagactaatttccttctttcctcgcacttctccccactcgtcatcttttaactagtgtttcacaaggatcctctgaaaccctctctgtgccccaagtacagatcccattacttctgctttcgtatctcctcaggcaaaagtggagggtgccttatgggccctcctcataggttgtctctgcatacacgaacctaacccaaatttgctttggtgccagaaaaactgagctatgtttgaacaaagatgtcgtgcaaactgtactgtgaacaacagttggtttaaaatatgaggggcaaggaggaggatgcatttcaaaagcttgattgatgtgttcagagctaaattaagaggagttttcagatcaaaaactggttaccattttttgtcagagtgtctgatgcggccactcattcggctccccagaattcctagactgggttaatagggtcatattgtgaatgtctcactacaaaatgacttgagtccagtgaaatctcattagggtttaagaatatttcagggatccttaatgttttgatttttgttttctgaaattggattttattttattttatcttataatttcagttcatctaaattgtgtgttctgtacatgtgatgtttgactgtaccattgactgttatggaagttcagcgttgtatgtctctctctacactgtggtgcacttaacttgtggaatttttatactaaaaatgtagaataaagactattttgaagatttgaataaagtgatgaagttgcattacacctcaaaaaaaaaataaa

SEQ ID NO: 36181 - DNA, 1884 bp, Homo sapiens
cgctagacggacggaccatcatgtgacacggaagtagctccgaacaggaagaggacgaaaaaaataaccgtccgcgacgccgagacaaaccggacccgcaaccaccatgaacagcaaaggtcaatatccaacacagccaacctaccctgtgcagcctcctgggaatccagtataccctcagaccttgcatcttcctcaggctccaccctataccgatgctccacctgcctactcagagctctatcgtccgagctttgtgcacccaggggctgccacagtccccaccatgtcagccgcatttcctggagcctctctgtatcttcccatggcccagtctgtggctgttgggcctttaggttccacaatccccatggcttattatccagtcggtcccatctatccacctggctccacagtgctggtggaaggagggtatgatgcaggtgccagatttggagctggggctactgctggcaacattcctcctccacctcctggatgccctcccaatgctgctcagcttgcagtcatgcagggagccaacgtcctcgtaactcagcggaaggggaacttcttcatgggtggttcagatggtggctacaccatctggtgaggaaccaaggccacctttgtgccgggaaagacatcacataccttcagcacttctcacaatgtaactgctttagtcatattaacctgaagttgcagtttagacacatgttgttggggtgtctttctggtgcccaaactttcaggcacttttcaaatttaataaggaaccatgtaatggtagcagtacctccctaaagcattttgaggtaggggaggtatccattcataaaatgaatgtgggtgaagccgccctaaggattttcctttaatttctctggagtaatactgtaccatactggtctttgcttttagtaataaaacatcaaattaggtttggagggaactttgatcttcctaagaattaaagttgccaaattattctgattggtctttaatctcctttaagtctttgatatatattacttgttataaatggaacgcattagttgtctgccttttcctttccatcccttgccccacccatcccatctccaaccctagtcttccatttcctcccgccagtctccattgaatcaatggtgcaggacagaaagccagtcagactaatttccttctttcctcgcacttctccccactcgtcatcttttaactagtgtttcacaaggatcctctgaaaccctctctgtgccccaagtacagatcccattacttctgctttcgtatctcctcaggcaaaagtggagggtgccttatgggccctcctcataggttgtctctgcatacacgaacctaacccaaatttgctttggtgccagaaaaactgagctatgtttgaacaaagatgtcgtgcaaactgtactgtgaacaacagttggtttaaaatatgaggggcaaggaggaggatgcatttcaaaagcttgattgatgtgttcagagctaaattaagaggagttttcagatcaaaaactggttaccattttttgtcagagtgtctgatgcggccactcattcggctccccagaattcctagactgggttaatagggtcatattgtgaatgtctcactacaaaatgacttgagtccagtgaaatctcattagggtttaagaatatttcagggatccttaatgttttgatttttgttttctgaaattggattttattttattttatcttataatttcagttcatctaaattgtgtgttctgtacatgtgatgtttgactgtaccattgactgttatggaagttcagcgttgtatgtctctctctacactgtgggtagacgcctgtggtaagactaatcctgggg

SEQ ID NO: 36182 - DNA, 1309 bp, Homo sapiens
  misc_feature (1254)..(1254): n is a, c, g, or t
  misc_feature (1257)..(1257): n is a, c, g, or t
cgctagacggacggaccatcatgtgacacggaagtagctccgaacaggaagaggacgaaaaaaataaccgtccgcgacgccgagacaaaccggacccgcaaccaccatgaacagcaaaggtcaatatccaacacagccaacctaccctgtgcagcctcctgggaatccagtataccctcagaccttgcatcttcctcaggctccaccctataccgatgctccacctgcctactcagagctctatcgtccgagctttgtgcacccaggggctgccacagtccccaccatgtcagccgcatttcctggagcctctctgtatcttcccatggcccagtctgtggctgttgggcctttaggttccacaatccccatggcttattatccagtcggtcccatctatccacctggctccacagtgctggtggaaggagggtatgatgcaggtgccagatttggagctggggctactgctggcaacattcctcctccacctcctggatgccctcccaatgctgctcagcttgcagtcatgcagggagccaacgtcctcgtaactcagcggaaggggaacttcttcatgggtggttcagatggtggctacaccatctggtgaggaaccaaggccacctttgtgccgggaaagacatcacataccttcagcacttctcacaatgtaactgctttagtcatattaacctgaagttgcagtttagacacatgttgttggggtgtctttctggtgcccaaactttcaggcacttttcaaatttaataaggaaccatgtaatggtagcagtacctccctaaagcattttgaggtaggggaggtatccattcataaaatgaatgtgggtgaagccgccctaaggattttcctttaatttctctggagtaatactgtaccatactggtctttgcttttagtaataaaacatcaaattaggtttggagggaactttgatcttcctaagaattaaagttgccaaattattctgattggtctttaatctcctttaagtctttgatatatattacttgttataaatggaacgcattagttgtctgccttttcctttccatcccttgccccacccatcccatctccaaccctagtcttccatttcctcccgccagtctccattgaatcaatggtgcaggacagaaagccagtcagactaatttccttctttcctcgcacttctccccactcgtcatcttttaactagtgtttcacaaggatcctctgaaaccttntgngccagaagatccatacatctggtcggttcccggccagtggggcctaggccca

SEQ ID NO: 36183 - DNA, 1276 bp, Homo sapiens
cgctagacggacggaccatcatgtgacacggaagtagctccgaacaggaagaggacgaaaaaaataaccgtccgcgacgccgagacaaaccggacccgcaaccaccatgaacagcaaaggtcaatatccaacacagccaacctaccctgtgcagcctcctgggaatccagtataccctcagaccttgcatcttcctcaggctccaccctataccgatgctccacctgcctactcagagctctatcgtccgagctttgtgcacccaggggctgccacagtccccaccatgtcagccgcatttcctggagcctctctgtatcttcccatggcccagtctgtggctgttgggcctttaggttccacaatccccatggcttattatccagtcggtcccatctatccacctggctccacagtgctggtggaaggagggtatgatgcaggtgccagatttggagctggggctactgctggcaacattcctcctccacctcctggatgccctcccaatgctgctcagcttgcagtcatgcagggagccaacgtcctcgtaactcagcggaaggggaacttcttcatgggtggttcagatggtggctacaccatctggtgaggaaccaaggccacctttgtgccgggaaagacatcacataccttcagcacttctcacaatgtaactgctttagtcatattaacctgaagttgcagtttagacacatgttgttggggtgtctttctggtgcccaaactttcaggcacttttcaaatttaataaggaaccatgtaatggtagcagtacctccctaaagcattttgaggtaggggaggtatccattcataaaatgaatgtgggtgaagccgccctaaggattttcctttaatttctctggagtaatactgtaccatactggtctttgcttttagtaataaaacatcaaattaggtttggagggaactttgatcttcctaagaattaaagttgccaaattattctgattggtctttaatctcctttaagtctttgatatatattacttgttataaatggaacgcattagttgtctgccttttcctttccatcccttgccccacccatcccatctccaaccctagtcttccatttcctcccgccagtctccattgactgttatggaagttcagcgttgtatgtctctctctacactgtggtgcacttaacttgtggaatttttatactaaaaatgtagaataaagactattttgaagatttgaaaataaaaaaaataaaaaatacaaa

SEQ ID NO: 36184 - DNA, 1896 bp, Homo sapiens
ccctaactccagcaggcttctaacttccggtccgcaggcttttgtggccaaccccaaggggggggctggccaaacccaaggtccccaccatgtcagccgcatttcctggagcctctctgtatcttcccatggcccagtctgtggctgttgggcctttaggttccacaatccccatggcttattatccagtcggtcccatctatccacctggctccacagtgctggtggaaggagggtatgatgcaggtgccagatttggagctggggctactgctggcaacattcctcctccacctcctggatgccctcccaatgctgctcagcttgcagtcatgcagggagccaacgtcctcgtaactcagcggaaggggaacttcttcatgggtggttcagatggtggctacaccatctggtgaggaaccaaggccacctttgtgccgggaaagacatcacataccttcagcacttctcacaatgtaactgctttagtcatattaacctgaagttgcagtttagacacatgttgttggggtgtctttctggtgcccaaactttcaggcacttttcaaatttaataaggaaccatgtaatggtagcagtacctccctaaagcattttgaggtaggggaggtatccattcataaaatgaatgtgggtgaagccgccctaaggattttcctttaatttctctggagtaatactgtaccatactggtctttgcttttagtaataaaacatcaaattaggtttggagggaactttgatcttcctaagaattaaagttgccaaattattctgattggtctttaatctcctttaagtctttgatatatattacttgttataaatggaacgcattagttgtctgccttttcctttccatcccttgccccacccatcccatctccaaccctagtcttccatttcctcccgccagtctccattgaatcaatggtgcaggacagaaagccagtcagactaatttccttctttcctcgcacttctccccactcgtcatcttttaactagtgtttcacaaggatcctctgaaaccctctctgtgccccaagtacagatcccattacttctgctttcgtatctcctcaggcaaaagtggagggtgccttatgggccctcctcataggttgtctctgcatacacgaacctaacccaaatttgctttggtgccagaaaaactgagctatgtttgaacaaagatgtcgtgcaaactgtactgtgaacaacagttggtttaaaatatgaggggcaaggaggaggatgcatttcaaaagcttgattgatgtgttcagagctaaattaagaggagttttcagatcaaaaactggttaccattttttgtcagagtgtctgatgcggccactcattcggctccccagaattcctagactgggttaatagggtcatattgtgaatgtctcactacaaaatgacttgagtccagtgaaatctcattagggtttaagaatatttcagggatccttaatgttttgatttttgttttctgaaattggattttattttattttatcttataatttcagttcatctaaattgtgtgttctgtacatgtgatgtttgactgtaccattgactgttatggaagttcagcgttgtatgtctctctctacactgtggtgcacttaacttgtggaatttttatactaaaaatgtagaataaagactattttgaagatttgaataaagtgatgaagttgcattacacctcactgcaaggattctttacttagcttgtttttagatttcttctatatatattttatttatatcccatctagaattcagctaggtgctgctgctgctctgtttcctttgatgacgctttgaaataaaggcaggagtacaagcctaaaaaaa

SEQ ID NO: 36185 - DNA, 1812 bp, Homo sapiens
aggcagggcggtaaatcggccgaggcgaacaggaagaggacgaaaaaaataaccgtccgcgacgccgagacaaaccggacccgcaaccaccatgaacagcaaaggtcaatatccaacacagccaacctaccctgtgcagcctcctgggaatccagtataccctcagaccttgcatcttcctcaggctccaccctataccgatgcctccacctcctggatgccctcccaatgctgctcagcttgcagtcatgcagggagccaacgtcctcgtaactcagcggaaggggaacttcttcatgggtggttcagatggtggctacaccatctggtgaggaaccaaggccacctttgtgccgggaaagacatcacataccttcagcacttctcacaatgtaactgctttagtcatattaacctgaagttgcagtttagacacatgttgttggggtgtctttctggtgcccaaactttcaggcacttttcaaatttaataaggaaccatgtaatggtagcagtacctccctaaagcattttgaggtaggggaggtatccattcataaaatgaatgtgggtgaagccgccctaaggattttcctttaatttctctggagtaatactgtaccatactggtctttgcttttagtaataaaacatcaaattaggtttggagggaactttgatcttcctaagaattaaagttgccaaattattctgattggtctttaatctcctttaagtctttgatatatattacttgttataaatggaacgcattagttgtctgccttttcctttccatcccttgccccacccatcccatctccaaccctagtcttccatttcctcccgccagtctccattgaatcaatggtgcaggacagaaagccagtcagactaatttccttctttcctcgcacttctccccactcgtcatcttttaactagtgtttcacaaggatcctctgaaaccctctctgtgccccaagtacagatcccattacttctgctttcgtatctcctcaggcaaaagtggagggtgccttatgggccctcctcataggttgtctctgcatacacgaacctaacccaaatttgctttggtgccagaaaaactgagctatgtttgaacaaagatgtcgtgcaaactgtactgtgaacaacagttggtttaaaatatgaggggcaaggaggaggatgcatttcaaaagcttgattgatgtgttcagagctaaattaagaggagttttcagatcaaaaactggttaccattttttgtcagagtgtctgatgcggccactcattcggctccccagaattcctagactgggttaatagggtcatattgtgaatgtctcactacaaaatgacttgagtccagtgaaatctcattagggtttaagaatatttcagggatccttaatgttttgatttttgttttctgaaattggattttattttattttatcttataatttcagttcatctaaattgtgtgttctgtacatgtgatgtttgactgtaccattgactgttatggaagttcagcgttgtatgtctctctctacactgtggtgcacttaacttgtggaatttttatactaaaaatgtagaataaagactattttgaagatttgaataaagtgatgaagttgcattacacctcactgcaaggattctttacttagcttgtttttagatttcttctatatatattttatttatatcccatctagaattcagctaggtgctgctgctgctctgtttcctttgatgacgctttgaaataaaggcaggagtacaagcctaaaaaaa

SEQ ID NO: 36186 - DNA, 1832 bp, Homo sapiens
aggcagggcggtaaatcggccgaggcgaacaggaagaggacgaaaaaaataaccgtccgcgacgccgagacaaaccggacccgcaaccaccatgaacagcaaaggtcaatatccaacacagccaacctaccctgtgcagcctcctgggaatccagtataccctcagaccttgcatcttcctcaggctccaccctataccgatgctccacctgcctactcagagcctccacctcctggatgccctcccaatgctgctcagcttgcagtcatgcagggagccaacgtcctcgtaactcagcggaaggggaacttcttcatgggtggttcagatggtggctacaccatctggtgaggaaccaaggccacctttgtgccgggaaagacatcacataccttcagcacttctcacaatgtaactgctttagtcatattaacctgaagttgcagtttagacacatgttgttggggtgtctttctggtgcccaaactttcaggcacttttcaaatttaataaggaaccatgtaatggtagcagtacctccctaaagcattttgaggtaggggaggtatccattcataaaatgaatgtgggtgaagccgccctaaggattttcctttaatttctctggagtaatactgtaccatactggtctttgcttttagtaataaaacatcaaattaggtttggagggaactttgatcttcctaagaattaaagttgccaaattattctgattggtctttaatctcctttaagtctttgatatatattacttgttataaatggaacgcattagttgtctgccttttcctttccatcccttgccccacccatcccatctccaaccctagtcttccatttcctcccgccagtctccattgaatcaatggtgcaggacagaaagccagtcagactaatttccttctttcctcgcacttctccccactcgtcatcttttaactagtgtttcacaaggatcctctgaaaccctctctgtgccccaagtacagatcccattacttctgctttcgtatctcctcaggcaaaagtggagggtgccttatgggccctcctcataggttgtctctgcatacacgaacctaacccaaatttgctttggtgccagaaaaactgagctatgtttgaacaaagatgtcgtgcaaactgtactgtgaacaacagttggtttaaaatatgaggggcaaggaggaggatgcatttcaaaagcttgattgatgtgttcagagctaaattaagaggagttttcagatcaaaaactggttaccattttttgtcagagtgtctgatgcggccactcattcggctccccagaattcctagactgggttaatagggtcatattgtgaatgtctcactacaaaatgacttgagtccagtgaaatctcattagggtttaagaatatttcagggatccttaatgttttgatttttgttttctgaaattggattttattttattttatcttataatttcagttcatctaaattgtgtgttctgtacatgtgatgtttgactgtaccattgactgttatggaagttcagcgttgtatgtctctctctacactgtggtgcacttaacttgtggaatttttatactaaaaatgtagaataaagactattttgaagatttgaataaagtgatgaagttgcattacacctcactgcaaggattctttacttagcttgtttttagatttcttctatatatattttatttatatcccatctagaattcagctaggtgctgctgctgctctgtttcctttgatgacgctttgaaataaaggcaggagtacaagcctaaaaaaa

SEQ ID NO: 36187 - DNA, 2067 bp, Homo sapiens
cgctagacggacggaccatcatgtgacacggaagtagctccgaacaggaagaggacgaaaaaaataaccgtccgcgacgccgagacaaaccggacccgcaaccaccatgaacagcaaaggtcaatatccaacacagccaacctaccctgtgcagcctcctgggaatccagtataccctcagaccttgcatcttcctcaggctccaccctataccgatgctccacctgcctactcagagctctatcgtccgagctttgtgcacccaggggctgccacagtccccaccatgtcagccgcatttcctggagcctctctgtatcttcccatggcccagtctgtggctgttgggcctttaggttccacaatccccatggcttattatccagtcggtcccatctatccacctggctccacagtgctggtggaaggagggtatgatgcaggtgccagatttggagctggggctactgctggcaacattcctcctccacctcctggatgccctcccaatgctgctcagcttgcagtcatgcagggagccaacgtcctcgtaactcagcggaaggggaacttcttcatgggtggttcagatggtggctacaccatctggtgaggaaccaaggccacctttgtgccgggaaagacatcacataccttcagcacttctcacctgaagttgcagtttagacacatgttgttggggtgtctttctggtgcccaaactttcaggcacttttcaaatttaataaggaaccatgtaatggtagcagtacctccctaaagcattttgaggtaggggaggtatccattcataaaatgaatgtgggtgaagccgccctaaggattttcctttaatttctctggagtaatactgtaccatactggtctttgcttttagtaataaaacatcaaattaggtttggagggaactttgatcttcctaagaattaaagttgccaaattattctgattggtctttaatctcctttaagtctttgatatatattacttgttataaatggaacgcattagttgtctgccttttcctttccatcccttgccccacccatcccatctccaaccctagtcttccatttcctcccgccagtctccattgaatcaatggtgcaggacagaaagccagtcagactaatttccttctttcctcgcacttctccccactcgtcatcttttaactagtgtttcacaaggatcctctgaaaccctctctgtgccccaagtacagatcccattacttctgctttcgtatctcctcaggcaaaagtggagggtgccttatgggccctcctcataggttgtctctgcatacacgaacctaacccaaatttgctttggtgccagaaaaactgagctatgtttgaacaaagatgtcgtgcaaactgtactgtgaacaacagttggtttaaaatatgaggggcaaggaggaggatgcatttcaaaagcttgattgatgtgttcagagctaaattaagaggagttttcagatcaaaaactggttaccattttttgtcagagtgtctgatgcggccactcattcggctccccagaattcctagactgggttaatagggtcatattgtgaatgtctcactacaaaatgacttgagtccagtgaaatctcattagggtttaagaatatttcagggatccttaatgttttgatttttgttttctgaaattggattttattttattttatcttataatttcagttcatctaaattgtgtgttctgtacatgtgatgtttgactgtaccattgactgttatggaagttcagcgttgtatgtctctctctacactgtggtgcacttaacttgtggaatttttatactaaaaatgtagaataaagactattttgaagatttgaataaagtgatgaagttgcattacacctcactgcaaggattctttacttagcttgtttttagatttcttctatatatattttatttatatcccatctagaattcagctaggtgctgctgctgctctgtttcctttgatgacgctttgaaataaaggcaggagtacaagcctaaaaaaa

SEQ ID NO: 36188 - DNA, 1481 bp, Homo sapiens
aattcgagctcgaattccgaattccgggatgggatcacataccttcagcacttctcacaatgtaactgctttagtcatattaacctgaagttgcagtttagacacatgttgttggggtgtctttctggtgcccaaactttcaggcacttttcaaatttaataaggaaccatgtaatggtagcagtacctccctaaagcattttgaggtaggggaggtatccattcataaaatgaatgtgggtgaagccgccctaaggattttcctttaatttctctggagtaatactgtaccatactggtctttgcttttagtaataaaacatcaaattaggtttggagggaactttgatcttcctaagaattaaagttgccaaattattctgattggtctttaatctcctttaagtctttgatatatattacttgttataaatggaacgcattagttgtctgccttttcctttccatcccttgccccacccatcccatctccaaccctagtcttccatttcctcccgccagtctccattgaatcaatggtgcaggacagaaagccagtcagactaatttccttctttcctcgcacttctccccactcgtcatcttttaactagtgtttcacaaggatcctctgaaaccctctctgtgccccaagtacagatcccattacttctgctttcgtatctcctcaggcaaaagtggagggtgccttatgggccctcctcataggttgtctctgcatacacgaacctaacccaaatttgctttggtgccagaaaaactgagctatgtttgaacaaagatgtcgtgcaaactgtactgtgaacaacagttggtttaaaatatgaggggcaaggaggaggatgcatttcaaaagcttgattgatgtgttcagagctaaattaagaggagttttcagatcaaaaactggttaccattttttgtcagagtgtctgatgcggccactcattcggctccccagaattcctagactgggttaatagggtcatattgtgaatgtctcactacaaaatgacttgagtccagtgaaatctcattagggtttaagaatatttcagggatccttaatgttttgatttttgttttctgaaattggattttattttattttatcttataatttcagttcatctaaattgtgtgttctgtacatgtgatgtttgactgtaccattgactgttatggaagttcagcgttgtatgtctctctctacactgtggtgcacttaacttgtggaatttttatactaaaaatgtagaataaagactattttgaagatttgaataaagtgatgaagttgcattacacctcactgcaaggattctttacttagcttgtttttagatttcttctatatatattttatttatatcccatctagaattcagctaggtgctgctgctgctctgtttcctttgatgacgctttgaaataaaggcaggagtacaagcctaaaaaaa

SEQ ID NO: 36189 - DNA, 427 bp, Homo sapiens
  misc_feature (419)..(419): n is a, c, g, or t
ctctactctcacagggccttcaatctagcaagggaaagatctgcacaaaactacacttaaaagcacttaaaccagaaatgtggttattacaaaggcgaaatggccagtctcagggatcaggaaacgcttccttgaaaacgtgacatttaggctgagacctgaagggtaagaaagaaagtgactgataaaggcagaaataccagtgagaggtaagagcggtgcgggcagagagatgaacaacagccaggagccagaaaagagcttggatccttcaaggaagaagccagtgtggctggaatacagtaacaaaggaagaaaagtatgaaaagttctcctgtgagcgactggagtcgtgcttgacatgttcctttcctctgtccccacatccagtcagtaccaccctggtattaggaggtggntactgttg

SEQ ID NO: 36190 - DNA, 233 bp, Homo sapiens
aaaatgttggcagtatttctgattaatgtgggaagaaaagctctattcattgactgatttatttgaaatcagatggggtcagttaaaaaatatttaatttgttctcttgaaacactgaacccaaaagaaatgaatctgaacttaaataataatctttgggcaaaaattgcacacaattttgattgctttcctaagtgtcatgtaaacaccaaaacattaagaaagagcttcta

SEQ ID NO: 36191 - DNA, 443 bp, Homo sapiens
ttggcccaccccgcccccaacctgtaccggtaaaaaccagaccagatggcagaagaaaaggaagaaaagagcaacacaagcagctgaccagcagggatacaagctgctgagccttggggatacatgcggctgagctttagctgtggatagatgcggctaacttcagatggtgcgacttcagggaaagatcaccttccttccgcatcaattccccatcctgctgacagccacttttatcacccattgaaatcctccgcatgcactaccttccaaatagctcatgtgacctggttcttcctggacactgaacaagaactcgggtgtcaaaaagggcaggtgcaggatgctgtcaccctgacccttcactgaactgttaatatttagccatccacgaacaacagctgagtgaaacgagccactccagttcctgcccacgaaggggg

SEQ ID NO: 36192 - DNA, 872 bp, Homo sapiens
attaaactcaggcgctttaaattttacactgaaatacgttgaaagctagcttagttgatctctgtcattaacagaaaccatctctgtttttgttattttcttggcttgatttaacgttcgttgctcgcaagaaacagaaacccactcaaggtagttgaaggaaagggaggttttcattcaagggagttggagaatcggaaggcaagaatgagcctcaggcctctcatgggactggacccggccagtggaaagctgttgtctcacaccctgccccacctcacaatacatgtctcttttctgcctctttccttgcatgcttgtcattctcactcgctatgtatgccagctttccctgcagctccatgcacgctgcgtctgtggccctttcctgccttttgccttccaggctaaaactagatagcttttgggtcttaattccaaatgcttaggagtgaatcggttagctcagaagtccaaccagttcaaacacctgtgtcaatctagcacattaattctcaaccttggctattatttgatgtcactgggagctttaatagataccaaagcctgtgtcccattaccagaaattctggttttagtggtctgggatgttactaaacctaatttgttgggatatgtttaagttcccagaggattctaacatagagctgtggtccatggttaagaagcactgatctaggagagaagagggtcatcttataggcgtggaatgctcagatagtggggtcttggcctaggtagattattctcccaaagatgtcctctagggtgtccccatttttggctttaacctaccagtcctctttcttatagggtgtgttggaataacctatggagctctactttaagga

SEQ ID NO: 36193 - DNA, 474 bp, Homo sapiens
gaacccactcaatgctgattacactgatgtggtttctcttggtaagggacccatcaaagggttttacccagagccagggaagctgcatggcctcttgccgataatcacacatgaagagtagcaggaatttctatgtggctaagataaagtacgtgaagaaatgcttaaaaactgcttggagtagaacacaatttactttaatgcaaaagcagtgcccaggaagctgagtgagatgtaaaggcagaagtctaaaagggagaaaactcagtaggcaaaaatcactaaatgatttctacaaaatcatttcctgagcacccactttggtatataatatgctttaagcttttcactactctgccgggcgtggtggctcatgcctgtaatcccagcactttgggaggctgaggtgggaggatcaccaggtcaggagttcgagaccagcctggccaacatggtgaaaccccatctctacta

SEQ ID NO: 36194 - DNA, 372 bp, Homo sapiens
ggccattgtcctggtccaagtctttattctgtgttaccagaattattgcaaaaacctctcagctagtgttcatactcctgggttttcctgtctatttctgtaagtaagtgctgcctgatcctgctaaaatgcatgctactaaacttttaatgatgtcccaatatgtatagaaaaacctacatgctttggcacaggctttttttgtgtcactattttttcttatctttctaggctagtcttctcctgcttccttattataccctatacttacagtggccatataattttccaaatgggacacttaagtgtgaaaggggccctagtagtaattatgttggggaaacaggcctaagacaatactgttctgtaata

SEQ ID NO: 36195 - DNA, 1099 bp, Homo sapiens
  misc_feature (726)..(726): n is a, c, g, or t
gagacagggtctcgctctgttacccaggctggagtgcagcggcacgatctcagttttctgcagcctccacatcccaggctcaagcgattctcctgcctcagcctcccgagtagctgtgactgcaatcacgcgccaccataccccactaatttttgtattttttgtagagatgggtagggtcagtaaccatttaaatatgccactgaccttgagaaaaagaatgtcagctataatcacaagccacaaacgtctgtcactgtgaattggctcatcacgaagaactgagggataacatggagttatgatagcagtggaggcaggcaggggaaaagggcccatgagatatggatggcagcactctcccccattccctgccatccccactgcacatgtataagctaagtaaatattacgtcgtcttttactaacaccccaaaactctcacttgatgaaggaccaggggagtaagttgctgaatgggctcattaagacttaggaattctttagaggctcaaacacagaaagccagtgatgggaaataaggatgacacagctgatagcccatggagtcccagggtgagactaagactccataagagccaggcttagacttataaaggaatgctggctgctgaagacattcagaactcaagctaagaatctctggcctgcattcagaagatacctttggtctctgtggttggccaaatgatggctccaaatatnatccacagatatgattatcctggataatctgggtggtccctcaatgcaaccacaagaatctttataaaaaggcagagggagatttggcacagaagagaaagcagtgatcctggaggtactgattggagtgatgtggccacaagccaaggaatgcctgcagcctgcagaagctggaagaggccaggaatggattatcccctagagcccccggcaagaacacggcccttccaaccccttgactttatcacagtgaaactgatgtcagacttctggcctccagaactgcaggagaataaatctggattgttttaagccactaagtttgtgataattggttacaccagccaaagaaaaccaaggcagtccttcattc

SEQ ID NO: 36196 - DNA, 1163 bp, Homo sapiens
  misc_feature (790)..(790): n is a, c, g, or t
attacaggcatgagccactgtgcctggccttgaattgtgaactttaaaagggtgaattttatggtatgtgaatcatatcacattcttttaaaaaagttaacagggactctttcctcagtgtggaagtgtaattgacagacctcctaactaccagtgagcgtggggatgagaaaatgccacacaataaagttgcttgagaaagagagagattgagcgacagatcatgtgtgagatggagtagggtcagtaaccatttaaatatgccactgaccttgagaaaaagaatgtcagctataatcacaagccacaaacgtctgtcactgtgaattggctcatcacgaagaactgagggataacatggagttatgatagcagtggaggcaggcaggggaaaagggcccatgagatatggatggcagcactctcccccattccctgccatccccactgcacatgtataagctaagtaaatattacgtcgtcttttactaacaccccaaaactctcacttgatgaaggaccaggggagtaagttgctgaatgggctcattaagacttaggaattctttagaggctcaaacacagaaagccagtgatgggaaataaggatgacacagctgatagcccatggagtcccagggtgagactaagactccataagagccaggcttagacttataaaggaatgctggctgctgaagacattcagaactcaagctaagaatctctggcctgcattcagaagatacctttggtctctgtggttggccaaatgatggctccaaatatnatccacagatatgattatcctggataatctgggtggtccctcaatgcaaccacaagaatctttataaaaaggcagagggagatttggcacagaagagaaagcagtgatcctggaggtactgattggagtgatgtggccacaagccaaggaatgcctgcagcctgcagaagctggaagaggccaggaatggattatcccctagagcccccggcaagaacacggcccttccaaccccttgactttatcacagtgaaactgatgtcagacttctggcctccagaactgcaggagaataaatctggattgttttaagccactaagtttgtgataattggttacaccagccaaagaaaaccaaggcagtccttcattc

SEQ ID NO: 36197 - DNA, 495 bp, Homo sapiens
ccataacgtgaaagaaggattttagatattctgtatatttgtacaatgtaatgaatgcctattagaatggataatggaaactgggcctatatttctgtttttcacatggtgcctgccatgttattgtttataaacaattgcagtttatcagttaccaaagcatctcagatagctagggggtggggtgggagaacatggcaggaaatgtacactcagtaatgaattctgaagcattttcgttcttttattggagcaagtcaccaaatgagaaatggacatggaatttgaaataacactgcatttgaatccgttttcagtatttattcaactacagaggcactttctaagattatttttcctcgagatctatagactccaaactacagacttagctgaaagcaaaagttagcctcagaaaagtctttatcatcataagctctggttatcaaattttaattgatgcctgaaaatttaatactataaatgccaaagaag

SEQ ID NO: 36198 - DNA, 346 bp, Homo sapiens
aaatgggctctcactatgttgctcaggctggtctcaatctcctgggctcaggtgatcctcccatctaagcctcctgagtagctaggactacgtgtgtgtgacaccacagccggccaattaaaattttattttttattttatttttttagagatagggtctcactatgtgacccaggctggctgaaatgttaattttaaaagagcatcccaaattagcagagtaggctaccttctcaagttgccatcaagaactggtactcagctggcttttgtaaaggtaacctagcagtgtaaagctaagactgccagagggatgtaaagctaagactgccagagggatgtaaag

SEQ ID NO: 36199 - DNA, 441 bp, Homo sapiens
aaggcccccactattggaaggtcagtggctctatcataggccaacagtgacagaagtgggcagctcccaggaggcccgatgtcttctcatgccctgtggtcctaggaaggagcaggaagtggttggaaacaggggctgggctcagatcttatgacttcctgggtttcaggagatctggttatcaactgaaagccaggatctggatgagggtatgtgcctgtttaagtcatgatgaaatggcttcaggacagggatatatacaaagtttgtgcatttgtcctcccagggattttccaactcaattcttacccaattacagatcccaaaagtacagagactgtccccatttctctgaataactgctgagtctgtgcctctctgtcacctttcctaacacagggccacagtgtgggaggtttgaggtctgattcagggacacac

SEQ ID NO: 36200 - DNA, 459 bp, Homo sapiens
gaagatgacatgggatggataaggtgggaaaaactggagcacttaaaaaaaagggggaaatcatttccagagggccaacatgagcaaagacacagctggggcatagagaggttatgctgccagacctttgaaggagggtggctggagataagagtagaaagggagggctggaaagctgggtgcagtggttcatgcctgtaatcccagcactttgggaggccgaggtgggcagatcatgaggtcaggagatcaagaccatcttggccaacatggtgaaaccccatctctactaaaaatacaaaaattagctgggtgtggtggcgtgcacctgtagtcccaggtacttgggaggctgaggcagaattgcttgaacccaggaggtggaggctgtagtgagctgagatggtgccactgcactccagcctgggcaacagagcaagattccatctcaaaaaaaaa

SEQ ID NO: 36201 - DNA, 750 bp, Homo sapiens
aaaagaagcaaaaaacaaacggaaatattccttaacaactacaggaaaacttcaaaatgttgcaagaaaataaccatcaatctcaaatttttacccaccaatactgctttaagaaaataatgcaaaataataccattttcagacaaataaggcctgagagactttcactaaaggaacctgtagataatttacttctgaaagacaaaggaagaagtgtgagaaaagtatgctttattaaaggtgctaagttttctacaataatattctttcaactttttgtaagaaaaaaaaaggtctaaattatggggagttagaattaatgcaactggtactaatcaggcttttttccaaacaattctgtctatgccttgctggttcacagatggcattatcatttatagcacatgacagccaatcaattagtaacttgaaattactaataatttcattattggtatggtgttgagtgtgtgaaaccaaagtacacagcagttcatgaaattttactaaaaataataaaatcactatattcaaaagtacacagcataaaaatgcaaataaatacatttagaagttgtttgatttttaattttgatgttcagtatcttagcgagatatttactaaagtaataatgcttcactcaaggttataatgttgacaatatttcttccttcaaaaaatttgttctaatttccaggaaagagaaagagaaaagattacagaagctgtgttttttctagaaaaaaaaa

SEQ ID NO: 36202 - DNA, 440 bp, Homo sapiens
cctccccttgcctatcaagctagcagatagaaccagtgagctggtagcttcatcaacatctggcatctggtgttcacctttgagtccaaggtggtgattccagtcttcaccatttcaaagctagcaggaaaggagaaagaggacaaggagggcgagtagcttccttttgcagaacccagctgcacacgtcacctttactcacagccattttcaagaatatagtcgcacagccacacgcctcggggcatctgggaaatgcagtcactgccacagcaatcgagagtcctgttcacacttagcaagaaaagggtattattctgtttctaaaaggaaaaaggggaaaatgaaggaaggaacacttactaatctctgccagtagccttgggcaaatcgctcttttcaagtctatttataaaatataagctagtaaaatatttaca

SEQ ID NO: 36203 - DNA, 220 bp, Homo sapiens
tttatatttacagttacgggttcacaggcttaaagctggagagggtcttgaagatattctaacccagtcacctcatcgtttagaaaacagtagccaacactgtacattcattgcttttaggtctcctcatgacttgctaagttccataagggcggggactttatttgccgtgtttactgttagtgcctccaaatgaattcaggtttacaagcaaataaat

SEQ ID NO: 36204 - DNA, 455 bp, Homo sapiens
atttcagagttcccagagcacgttcacacacatcgtctaatttatctaattagatcctgtcaacctttttttatggatgaggatatataggttcagagcagtcaagcagcctgttcacaagtttttagtgacagttcagtcattaaactgaactaacctacagttcagtgcttttcaatgaatttttacctcttgtagtgaaattcttacttactaaaactgttgcctattttctaggtccccacttgcttttttttttccatatggtgctaatttgactttgttctgcagccgttgtctgtcagttggcccttgacaacagcataagcaaaagctaaatgccatagttcacagctcttagaaactttgaaaacctttgagtagtgaaaagatggctaagtgtcaccatcttgtagaacttcctcacataactgaaaggtaatgttcctaacaaa

SEQ ID NO: 36205 - DNA, 627 bp, Homo sapiens
tccaggtaattctgcaagtgtgtcatcctgtttctgcatattgccttgcacacctttgatactgaattcttttgtggaattcaaagagtcaggtacaggttttccagtaatagcattttcttgctggagagatgcttctgcccaatcacctgttgatttagtgatgggagtgctcccatcaatagaacatacaggagttttctgatgagtgctagttttaagatttacaactggaatttctgaattatattcactcatgtcaagtcctgtagtttttgtgatgcagtcagaagatttatcggtctgttgtttcacttggggaaccagatcccaagtcagtatttcgttagtaaagttatgcatatcattcacgcatctggacacctcttccagtgctgcatttgtgtgtgaaaactgcctactgagcaatgcagacattgggtaacgtcctgcctctttatttctcagtggaaaaagcttgtcattagtctctgaaatgtcttcggatgattctttatcagtgtgcacagaccagctaccaaaatcatctgtgctctccttatatgagtctttaaattctttgtcaaatgctgctttgtcaataattacttcaaatggtgattcagg

SEQ ID NO: 36206 - DNA, 317 bp, Homo sapiens
acaagaacttgacatgtagcattaaattcaaatatagcacaaaattggacgggtgcagtggttcacgcctgtaatcccagcatttcgggaggccaaggtgggcagaccacttgaggccaggagtctgagaccagcctggtcaatatgtcgaaaccctatctctactaaaaaaatataaaaattagccgggcgtggcggtggacacctgtaatcccagctacttgggcggctgaggcacgagaatcgcttggacctgggaagtagaagctgcagtgatccgagagcgtgccaccactcttcagcccgggcgacagagt

SEQ ID NO: 36207 - DNA, 414 bp, Homo sapiens
  misc_feature (1)..(1): n is a, c, g, or t
  misc_feature (40)..(40): n is a, c, g, or t
  misc_feature (61)..(61): n is a, c, g, or t
  misc_feature (78)..(78): n is a, c, g, or t
  misc_feature (253)..(253): n is a, c, g, or t
  misc_feature (294)..(294): n is a, c, g, or t
  misc_feature (312)..(312): n is a, c, g, or t
  misc_feature (379)..(379): n is a, c, g, or t
  misc_feature (407)..(407): n is a, c, g, or t
ntttgactttttctcggctctcctcctacaactctgttcncagctttccaaaattgtttcnctttactccttagatanctgggtttccttaggttctgtgctctccctcttgccttcctaagaccctcagcatgagaccacaaatgtctgtcccctgtccatcaccaactgaggacagtgggatttcaaggacagtatttgatggactgaagatgccgatgcaaaaatcttccagtgtctaggattccacttnggggctgaagggcaatgtgaagagtgactgcaagtcctggnattttctgtggtgtcagnaaacgcccctttattttaaatgattccagacatctgggcagcatagcttggccaccatcactcaggnttgatcctgcagttgagtagaattcagnttggact

SEQ ID NO: 36208 - DNA, 376 bp, Homo sapiens
tttttttttttttttgagacggagtctcgctgtcacccaggctgtagtacagtggcacgatctcattcactgcactccagcctgtaacttccagatctcactgcactccagcctgtaactccagctcactgtaacttccacctcctgggttcaagcaattctcctgcctcagcctcgcaagtagctgagaccacaggctgccgccctgcctggctaattttttgtattttagtagagacggggtttcaccatgttgcccaggctggtcttgaactcctgagctcaggcaatccgcctacctcagcctcctaaagtgctaggattacaggcatgagccactgtgcctggccaatcattttttataaacttttttctt

SEQ ID NO: 36209 - DNA, 728 bp, Homo sapiens
attgttttgtactcttaaaatgtgtacattttattatatgtaaactataattcaataaaattgataaaaacaactagaaagaatccaaatgttcaacaacagtacgatgaataagtgtggtatagttatacattgaaatagtccataacaatgaaaaacagtgtcacttctgctacacacaacacaggctttcacagacataagggtgaatgaaggaaatcttacacagagtacgtaacatagcactctgtttacgtgaagtccaagaaaaggcaagactgatctatggctagaggtccacagcggggtggaatctgtggtagaactgactgggagggcacaagggggtcctctgggtcttagcattgctttctagcccccgtctgggtggcggttacatgagtgtgtgatatgcaaaaattcttcctgctgtatacttgagattcgcacaccgtttggtacataagttatacctcaataagaaagttaaaaaaaaaaaaaaaaaaaaacctcgtgcccaattcttggtcttgagggcaaattccctatgcgagttgtttaaattcggaaccatgtcatacttgttcctgggggaaaaagtaatcccttacaattccccaacactttccgacccggaggcctaaagggaaaagccggggtggcctaggggggagctacctcccttaaatggggtgggcttaatggccgctttccagcgggaaacgggg

SEQ ID NO: 36210 - DNA, 494 bp, Homo sapiens
ggcggacaacatcacatgccaaaaagagcagtcaccgggcgattgtgagtaagctcttagcctgaggctcagtgcacggtgggcgttcaggaagtggtggccactgtcagggttgtgaccaggtggttctctgctcagagcatctgctctctgtcctggcaggtctgcatgtcatgtgctgtgggctgtgcaccatgacacataccttccgtgtgccaggctcagaagcaccatgttcagcaagtcccttccctgcccttgagagcctgctgggagcagggaagccacactcaaccacaccctctcgctgagctttactgctggaagagtggagagcccggggcctccatgtgccttgctaaggagtgtgggctgctcccggagccacaggagccatgggaatccgcacaggagccacggagcggcccacacctcccaaccagctttggatcagggcaagggagcctcccctggtcacctcaggtggtacagtc

SEQ ID NO: 36211 - DNA, 2219 bp, Homo sapiens
  misc_feature (664)..(664): n is a, c, g, or t
  misc_feature (1685)..(1685): n is a, c, g, or t
  misc_feature (1721)..(1721): n is a, c, g, or t
gttttgtatgtgcctaccactttatattcattgtatattcaccccgtatttatgtattccttgcatctgccctgagaggcagagtcatggatggaaaaccaaggcctggcttaagaccctgcccaggtatagctggtaacgtgagagtcattctcaagactgcctgcctccagtgcccataccctttccgccacaccacaccttggggcttgctgttgtagcctgtgtggtcactaggcatgtctgggctaaggacgggcaagtcccacaagtggctgtttcgtgtctcctgcagtctcctggctgatacttctctgtataagctggtgattcttgggctctttcctcatctccaaaaccgttgttgggatggctgggtggatggatgggtgggtaggtagatggaattcccaaagtaacacaaggggcattgggccatttgaggaagctgcagacagagcactggccaccaccaaagccactggagcttgggagtcaggcggccctggggggtccttgctgttgctgcgtctcccacaccttaatcagagcatcgccaatgcaataaagttaatggagccagtcatcctatgaaggagccaattccgtgcaaagatgatacatctttgaagttgatgaggcctattaattgagcttatgcccnttaaaatgaattagattcttgaaatctaccacacagcagtacatccatttagtgtttctgtcaccgaggaatgaggagccaccagcacagagctataggaactgtcttcctgctgacatctagcatggcctacggctccttgggagctccacagatgtcatgcctggccagccattcttgttcttagcaaattccccaaatcggcataaatagctccaggaagaaagtgataccgatgatccatgggcctctggaagcgcatccagccagccctcagccattagcccctacctcaggatcagttagcagagatgcacaagaatacagctagactgccagcacttcaaaaatggccactgcacaggtggaactggtgcagggtggtccccgggctccagtagggtaagcagacatggtttccaggaggtgtgtagacctggaactgactgagcagagtgagtgcagtcagtgagctcagtcagtgactgagcagatctgactgcagcctgaacgggaatcatcacgcggcatcccctggacccccaaagatgcaccgaagctctgctcagtctcagactcctcccagttaccaccactcgcagttgcttaagagcacaaagtggcacttgttttgcccacagaacatctgctgaagacaaaacttgtgtttatagctcttcacttcaaaagactggccgtgttataaaaagaaagggaccatctgtccctcttctggaccccagcgcctcttggaagagatttctgtgcaagaaggcagtgagaagtcagcgtcgacttcagggaactattttggggccggaaaagaatagtgcctacccgccaaggggaccgtcgccggcagatgaaagccagctttgaggaggccatgcgatgggagatgctggcccggaggaggtgggctgtgcgccaatgatgctgcccagatattccagcagagcagagaccccagagcagagaaccaactggcaggaccgagggatgtgagggaaggcgaaggggnagggctgtgaggcactgcagctcccaggagcaggcntgagaaatgtcagcaacagcttgctgccacgcagagtcagatatcatgtttgcatcacccatgtgcgttccttcacccgacttctggggccattcttatctgcaaggccccttagggcagttctgcctcttgggaacaccttaggctgagtgatcgccttcccgtggctgagagctgagaagttcttccagactgcacaggtgtccggtctgtctgtgatgcccgcttaagactcatctgccttaagcccctgggcaccaatatagaaaagtcatgtgagtccaggagaagctgggcggaggtgaggtggagccaggattagcacggggtggggcctgcagaggggaggaatttcccaggcttcctggccggcatctcccaggctgagcatcttccagactgaaactccctaagaagggcttggccctccccgcctgcacggtgtttcatcggtttggaacagtcctgtttccttcccctcccctcgtccccaacagg

SEQ ID NO: 36212 - DNA, 412 bp, Homo sapiens
ggtcgacctggctggatggcactcacaggtgcagccagtgcaggctctcagagtcctgcagagaggctcctgcaagcagccacagtcatggccttggtggggctcagtgccaatgaggcttcagatacttgactgcgcaaccctcaccttgaagcaagaatacacactcctggctggcactgactgcttctgctggaccccgccaggaagggcgacaccattgcccgtggcagtgctatacataagaaagatcttgctatcagacctcctcggctaccaagaaagctccatgggaaggaacgccattccccgccctgggaatcttggaaggtgcactcgctggcctgacctcggtaccccaaggtgtccaaacccagcatttcaaagactcaggactgaatggacatgacag

SEQ ID NO: 36213 - DNA, 402 bp, Homo sapiens
actgctctccagcctgggcaacagagtaagactccatctcaaaaaataaaataaaataaaataaagaaaagagaagtcttctgtaaccattatataattattaatttttcagattggtttggcagattatcattagtttgacagattagtggcagattattttctgccactaactacaaaatttgaaaaaattaagtcagaaaatcatgccctaggttctgaaagacattaacacgggatatttctgagttgactgtttatgattgttgatctggaaatcaacttcttaaaacactgagacttgaaatacaaaggctatgagcattctgtgacacttgtgtagtaaaatttgctacatattgaaaatttattcttcataataaatagttttcagaagcttct

SEQ ID NO: 36214 - DNA, 431 bp, Homo sapiens
tgctttatcttcaaattcactgattttcttctgcctgctcaagtctgcggttaaacttctctagtgaatttttcatttcagtttttgtacttttcctaaaatttctggcttcaaataggaagcagggaggggctctgtgcctttaaattttccagttgatgccactagtggaagccattgcatcccaaggaatgtctaaaccaagacaggcatctgctgggacccaccagatcaaagggcacaaccccaaatttttggaggacaaggtcccactgcctaccctggccagctagctactccaggaatgtgagctgctatccccatagcttcaggggagctgaagagagggggatagtagctgggtcacacacacagttcccttagcaaagatcagcagcctctccctttaccaatcagtctcccgattgtta

SEQ ID NO: 36215 - DNA, 634 bp, Homo sapiens
gcatcgcttctcggccttttggctaagatcaagtgtagtatctgttcttatcagtttaatatctgatacgtcctctatccgaggacaatatattaaatggatttttggagcagggagatggaataggagcttgctccgtccactccacgcatcgacctggtattgcagtacctccaggaacggtgcaccccctccggggatacaacgtgtttcctaaaagtagagggaggtgagagacggtagcacctgcggggcggcttgcacgccgagtgcctgtgacgcgccggcttgacttaactgcttccctgaagtaccgtgaggttcctgatgtgcgggcggtagacggtaggcttatgcggcacgctttcgtttccaccgtggctactgcgctttgggaaggccacgacctcctcctttggggaggtccttaggatctcagcttggcagtcgagtgggtggcgaccttttaaaggaatgggacccacccggagttcttctttctcctgtctctctctctctctctctctctctctctctctctctctctgtctgtctctcgtctctctgtgtctgtctctgtctctctgtctctctctctgtctctctctctctctctctgtctctcactctctct

SEQ ID NO: 36216 - DNA, 698 bp, Homo sapiens
ttgggccaacgaaccgtgttgggccaacgcaccgtgttgggccaacgcaccgggttgggccaacgcaccgtgttgggccaacgcaccgtgttgggccaacgcaccgtgttgggccaacgcaccgtgttgggccaacgcaccgtcgaggacaatatattaaatggatttttggagcagggagatggaataggagcttgctccgtccactccacgcatcgacctggtattgcagtacctccaggaacggtgcaccccctccggggatacaacgtgtttcctaaaagtagagggaggtgagagacggtagcacctgcggggcggcttgcacgccgagtgcctgtgacgcgccggcttgacttaactgcttccctgaagtaccgtgaggttcctgatgtgcgggcggtagacggtaggcttatgcggcacgctttcgtttccaccgtggctactgcgctttgggaaggccacgacctcctcctttggggaggtccttaggatctcagcttggcagtcgagtgggtggcgaccttttaaaggaatgggacccacccggagttcttctttctcctgtctctctctctctctctctctctctctctctctctctctctgtctgtctctcgtctctctgtgtctgtctctgtctctctgtctctctctctgtctctctctctctctctctgtctctcactctctct

SEQ ID NO: 36217 - DNA, 178 bp, Homo sapiens
gcatcgcttctcggccttttggctaagatcaagtgtagtatctgttcttatcagtttaatatctgatacgtcctctatccgaggacaatatattaaatggatttttggagcagggagatggaataggagcttgctccgtccactccacgcaccgttcccgacgcggcccggtcgcgac

SEQ ID NO: 36218 - DNA, 1138 bp, Homo sapiens
ggaaatgatatatcagtataggatgagtttagacaggacaaacgaaattcaatttagattattttatagttcttatatttttgaaaatattatcccctcaattttctttcttcttttgtaaaataacgtgtttttgaaataatgaataactcccttttggattttaagggtctgctttttctgatgtatgtacggtcagcctatttatttgttccgtcccctttgcagtttggcagaaccttatgaagaagcttcccaaactgaaccacagtgctttcactctattagcaaattgtactaaagatgccagcgtaatgatgagtgccaaggttatagacatcctgcattttttaaatgttgctaaaatgagataaaagccttatgcagaagcaaccgcaggcaccccgcaggtaatgctatcgatttccctaataagtgggaaacgcttggggaaccttagatttgctgttggttctgttgaaatggtggaagtgatgtgaaaagtgttgctagacaacttcattattttccatagacctatctcttatttatttatttccctttaaaataggacagaggtttgctaaacagtttggccattgtagttttaacctaatattttaccttatggaaataatggagtaatttgtgtttttatgttcatattaatttttttaagtactgttaaagaatgaatagttatttttgagcacatatttgttcaactactgagtctccagagtaacacagggcactaaaatgcttttgagaaagaagtgttttattggtctgaatttacctgtttatattaattatatgtacggggaaatgtcttcttcaccagtcacagtggcttaaatgtacccacttatttcatgtgttttcatgctgttgcctagagaatagttttatattttctcaaatgttaataaagatattttgaagaagctgctactctttttatccccatatctcactgtaaagacaaacacttcatttgtttttaattattttcagccaattatttctttttgtctttcaaggtgatagttatttcctttgtttgaactggagatcctgggattcctttaaaaaaattactaataaggaaatgtcatgcaacctttatcatggaatt

SEQ ID NO: 36219 - DNA, 243 bp, Homo sapiens
atcccctttcatcttattttgtattattctaagctcaatgtgaccatgaccctcctgacactgccttcatacggcataatgatagtgttagaaatgctcctgtatttcatttgaataaagtcttcaaaactggagtgatttttagagctcccttagtagcccttacaatcttttttatttgcatattctttttttataatattttttagtcgtatgcattaatattttttaaatgctagaaaa

SEQ ID NO: 36220 - DNA, 440 bp, Homo sapiens
caagccccagggacctgcgatgggagggaggagagggggattggcctcacgagcgtgggcaggggcaagcatttccagcctttggggagtggcgaggctcccattccaggggcccgagaagaaggagaggggtctgcccttggaagttgccacggatgaaagaaccaaagaaaagctcttggagaatcacaatttattattttatttaacacgcccttttatagcactgatggagtctcaggcactctgctaaaccgttttgaaatgtttgttcatgtaatcctcactgcgacactatgtaagcatgattatcctccccgttttacagagcaggagactgaggcacagaagggtttcctgtcatttagtaagatcacgaattggtaagtggcagaactggggctggaagcagtcaggtgggagcgggatggtggtttcct

SEQ ID NO: 36221 - DNA, 164 bp, Homo sapiens
ccacacaagaagtcagcaccatcctcaccctccttccacagacgggaaaactggggctgagaaaagtaaagcatttgctcacgtgacttgaagatgcccgtaaagtcccttcaccatgagaaaactttcatgcaactggaacttcaaatttcctactgcacgta

SEQ ID NO: 36222 - DNA, 735 bp, Homo sapiens
ggctggaacccaacacggtgtctgtggcgagattctggctggagtcgtaagaaagagttctaagaacctttcaacaggttcaggcaaattttctttagagaacaaactaaagcatcgtcctagagtgacacgaagctgacaaatttgcatctcaatcagccggacactgctcaggctttcacaagtctaattcaataaattcaaaaatggcctatctgcttctctgcaattcagccatgcaccaagtttgaaaatgttagactgaagcagaaaccttcaccctaacttcgccaggcactcccagacgagccaaatgcggggatttctggcctgaaagaaaactggtgatgcagactccaagaatcaaggagcagtgtgaccagagagataagctgtgtggaatcagcagccttcccgcccagaacgtgggctcagcatgtttgccagataataagaaaaaccaaaattggaggcaggagcaaaagttcgggataagaagttgatgttcaacccacaatcctgacccttcaccttcactttggtttagtggagttacctgtcaagtctgcccagggcttaaaacaccaactcagcactgcgctggcacaatctctgggactcctcccacttagacagaggaggaagctgaggttgaggcaggaatgaaaggaccagacccaattctgccaaaaccatacaatcaattaaatccgtggacattctattaaaaaaaaa

SEQ ID NO: 36223 - DNA, 532 bp, Homo sapiens
gaataaacaaccacaaggtcaggaaactgggttagtcaaaagaaaccactttcctcatttgaaccagccccctaaaatccaacagcgtgttttactgcaaaccaaaaaagaaatgccaagttttaaaaagaaagtacccctctcttggaatacagaaacgttacctaaacagtaatttgagcctttctttaagaatgaagagtgaggaaataaagatcattcctccatattgaatgtctgattttagacattcaattgtttcttaggagattaaaatcatctaagctctctccttccctcagaagatcagagtaaaactttcctttttccttcaactcttttctttattcagtatacctatgttgagtcattactctgtatgaaaccctggactagtctaatagtgtaaggatgaatgacaccattgtacaacagaggcaataagccacataatcaaggaaggaacagaatgctttgtgaatgctgaggaatgtgcaattaattttgtctgagggggactttacagagcaac

SEQ ID NO: 36224 - DNA, 336 bp, Homo sapiens
tggttgaaaatgaactgttttttgtgcctgctgtgatttgaaataacatttacaggaaatggaaaagcttccatgtgttaccctgtttatgaatttaaatgtcaacccccaacacaatacatgaaattccagatcttcttttctgtatataacctttgttcaagttgccagttttaaaatttcacattagagagaacttgggagatctttatccaaatgtaataaccaaaagaaaaacactgtatcctttgaaatctaaaaggtgcttactttttttcttgctctctctctccctccttccggccctcccaggtttgtagagcacacgtaagggca

SEQ ID NO: 36225 - DNA, 521 bp, Homo sapiens
aacattaaaataaaatgatggttcttgtgtggggcatggataggtacaacaaaggaggcatgaagaccagttaaagggctgttgcattgtttcagcagtaggtgatgtaatgcttggattagcgtgataataagatgtggtttcatcacattttttaagtaattcattgctatgttttttaagtttcataagctcagtattaattttcttaagagtttgtggaggctgggtgcagtggctcacaactataatcccagcactttagaaggctgaggcaggaggatttcttgaggccaggagtttgagaccagcctgggaaacatagtgagaccccccctcccaccatctcaacaaaaaaataaaaagtaaaaattagctatgtgtcgtggtacacggctgtggtcctggctacttgggatgctgaggtgggaggatcacttgaacccaggagtcccaggtaacagtgagctatgattgtatcactgccctccagtctgggtggcagagcaagacccagtctt

SEQ ID NO: 36226 - DNA, 447 bp, Homo sapiens
ccatgtgtgatcctggagtggactctggactggatttttttctttgtctattttatcttattttcactatacaggacattattgggacaattaacaaaatttgaataaagtctgtagatcagaaaataatattttattagtgttcatttcctgttttaataaattatactgtggttattttaagagaatgtcgttgttcttaggaaatacatactgaagtatttaggaataagagggaatcatgtcttcaatctactctcaaatattatataaaagtatcacatgcacacagaagaataaagcaaatgtggcaaaatgttaaccgttgtggaatctggatgaagggaatagagaacaaccgctgtacaaagaactctttgtattattcttgcaactttctgcatgtctgaattatttcaaaataaataaatgtttaaaacgtaaaaa

SEQ ID NO: 36227 - DNA, 218 bp, Homo sapiens
gggctcatagctgatcttatggtgaaaagatgcgttagtgaacattacattcatgacatattttaaaatagtataaaaacaaaaacaacaataaccaaaatacatttgttttctgtcatcaaactgtggttggaccatcaaaccattgatggtcatctaaccccatctcctgttgggtcttttttttttttttttaagacagagtttccctcttgttg

SEQ ID NO: 36228 - DNA, 680 bp, Homo sapiens
aattacggagtttagttaagaatgtatcactactggctccttaactgtggcaaatgtactattctagtataagatgttcatattggggggaaactggctgcagtatttctataaatataaaactgttctaaatgataaagtctttaaatttttgttatatagtatttaatacaagcaaaagaacatttgtaattaatatgtagattaaaaacaagaaaaccccataaactgttccctctactaatgattaaaacattagcaataagtgccattgaagctatcctaatctatcatagccttttcccagccctgactggggattttaacatttcccttctttaaaaaaaaatttttgtaaattgtttatgtggtatgagtaatatgttcatgatatgaggtaagaatccacttccttttctgttatgaatatttcggaaaatatttcaaataaatgaaaagttccaagtccaatagaaaaaatttttttcctaaaccatgttgccacatgatgtcccatcactactgaattgaatatctgtttcctacaaagtattctccacaggtcgggtgcagtggctcacacctgtattcccagcactttgggagttcaagaccaggagaatacctgagtccagaagttaagatcagctggggcgacatagtgagaccccatcgctaca

SEQ ID NO: 36229 - DNA, 3536 bp, Homo sapiens
  misc_feature (833)..(833): n is a, c, g, or t
  misc_feature (2021)..(2021): n is a, c, g, or t
  misc_feature (2091)..(2091): n is a, c, g, or t
  misc_feature (2152)..(2152): n is a, c, g, or t
  misc_feature (2909)..(2909): n is a, c, g, or t
ggcattgatgctgtgtgcgcgtgcgtgtgtgtgtgtgtgtgtgtgtgtgtgtgtgtgtgtgtgtgtgtgtgtctggagtcatggcagggtccctttctgtctgtctccttgctctgccccagactggggggctgcagaggtgagggtatctggcctcaacagctgcttattcccgatgggatggcctgggctgggcccctgaggccaggctgacttggacatggcaagaggggtcccaggctcttgtgggcaaagcaggggaggcgccaatgtggaggaacagagtctcctggctggctgctgctctctggagcgggtggagtcagggaagagctgagctggggagtcaccctgggcctggggtcaccgtaggccccatgtagcaccctggttcccctgcctgtaggtgacaggagccagcccagccaggtgtgctccctccccaggccctaggcaggcgggtacaggggccagcagctgcgcccgccccaccttccttcccacccacatgccgaagggtggccaggcaggcaggtggacgagtccaggcagcggctgagtcagtgtgtgtggaatgttctggccgctcccagctgcaccctgcccctacctgccaccacctcaccttcatcctcaggcgctgcggccctgagcccctgccaggaatgcacctttagcccaggcctgctcagtgagctccgccgacagccagccctgctcctcccgccatgaccctgcagacccctctgggcttccaagttcctgggggctgcagtgaacatgctccacctgcatggctggcaaaccatggtgggccccagctgtggtgcgtnctggggtagaggcaaggaagtgatgggaccgcagagatgagacccccagggatgagatgggacccccaggcagggcccagggtccagggcccaggagagagaagcagggagggagagagcttcctggtggaggacgcatcctacagtgggggcaagggtgctctgaggtccggtgaaggcagggactaggctgcccaggccctgcctgcttggctggggctgggggctgctgggaggtggctgggaggctgggcctgggcagctaagctggagctttggccagggtccagagcctccctcccttcagcttcctgctgcacagaaccctcgcccctggccaccccgtgctgcctccttgccctggcagacccagcactggctgctgctagtcagatggggtagcgggcaggggccggaggggccaccctcccagctgacccagcctcctgggccgcttcttccaaaccagcagggtagaaagatggggcacccaccagtctctcccagtgccccggccccagctggcaccacagctatacctgggcttattccagaccttgtcgccgggaccccctgtgagttgtgggattcccaagaggggtgtggggataacccagccaagtgggggctgcagctgtccacagatgcactcagcctggcctctaccccagggccccgctgggctctcattgccggcgcccttgccgcgggcgtcctcctcgtctcctgcctcctctgtgctgcctgctgctgctgccgccgccacaggaagaagcccagggacaaggagtccgtgggtctgggcagtgcccgcggcaccaccaccacccacctggtgaggagcggctccttgctcactcagtccagagagggcttgaaatccaggctccagagcccagggcagcgaggcgagttcagccccagggatggtttaacccccacagaggcagggcgttgaggaccttcctggcagggaaagtgggtgaacagaggtgagaaggaggccatgcaacaggggctgccccatgggcccgagggagccacagcgggttcttgaggaaggcagggggtaccccagatgccacgttttgggtgggtttggccggtctcacagagcgaagccgacgatttgtgcctgttgggtggcctggcctggaggcggggggtcttgacccatgtcatgcaagngctgcccgggagcccagggctctgatgaggcatgatgtcagcaccacctgccccttgtcccaactcactncaggtgcaacctgatgtggatggcctggagtccagcccgggggatgctcagcaatgggggngcctgcagctctccctggagttcgactttggaagccaggaggtgaagggccccgctgcgcaggaccagcggttctgcgagtttccggaaagggtgacgggggaagggcagaccccatgccctgggtggtggggagctgacagggcaggggcccttggctgagcccaccccgctggctcccagatcagggtgggcctgaggcaggcagccgacctgaggcctgggggcaccgtggacccctatgcccgggtcagcgtctccacccaggccggacacagacatgagacaaaagtgcaccgaggcacgctctgccccgtgtttgacgagacctgctgcttccacgtgagtcagggatggtcggctgggtgggcctggacggctggatgggcctgggctgggtgggcctgggcagctgggtgggcctgggcagctgggtgggcctgagctagggcagcagggcctggctcacgccgctgcctcagatcccgcaggcggagctgccaggggccaccctgcaggtgcagcttttcaacttcaagcgcttctcggggcatgagcccctgggtgagctccgtctgccactgggcaccgtggatctgcagcatgttctggagcactggtacctgctgggcccgccggctgccactcaggtgaggtgctggtcaccaggccacagcccaaggcagagctggcagggaccctgccctatgggccatcggaaagacaggcctgatgggcagcattttcgggggtctganccccaactcggccagaatcaccctcccgggctgaagcccctcttgctgcccacagcccgagcaggtcggggagctgtgcttctctctccggtacgtgcccagctcaggccggctgaccgtggtggtgctggaggctcgaggcctgcgtccaggacttgcagagccctacgtgaaggtccagctcatgctgaaccagaggaagtggaagaagagaaagacagccaccaaaaagggcacggcggccccctacttcaatgaggccttcaccttcctggtgcccttcagccaggtccagaatgtggacctggtgctggctgtctgggaccgcagcctgccgctccgaactgagcccgtaggcaaggtgcacctgggtgcccgggcctcggggcagcccctgcagcactgggcagacatgctggcccacgcccggcggcccattgcccagcggcaccccctgcggccagccagggaggtggaccgcatgctggccctgcagccccgccttcgcctgcgcctgcccttgccccactcctgaatgcaccacatgcctctgtctccccgctgagcccaggcacttgcccaggccgccctgcaggaccactgcaataaacgccttctcctgccact

SEQ ID NO: 36230 - DNA, 3233 bp, Homo sapiens
  misc_feature (833)..(833): n is a, c, g, or t
  misc_feature (2021)..(2021): n is a, c, g, or t
  misc_feature (2091)..(2091): n is a, c, g, or t
  misc_feature (2152)..(2152): n is a, c, g, or t
ggcattgatgctgtgtgcgcgtgcgtgtgtgtgtgtgtgtgtgtgtgtgtgtgtgtgtgtgtgtgtgtgtgtctggagtcatggcagggtccctttctgtctgtctccttgctctgccccagactggggggctgcagaggtgagggtatctggcctcaacagctgcttattcccgatgggatggcctgggctgggcccctgaggccaggctgacttggacatggcaagaggggtcccaggctcttgtgggcaaagcaggggaggcgccaatgtggaggaacagagtctcctggctggctgctgctctctggagcgggtggagtcagggaagagctgagctggggagtcaccctgggcctggggtcaccgtaggccccatgtagcaccctggttcccctgcctgtaggtgacaggagccagcccagccaggtgtgctccctccccaggccctaggcaggcgggtacaggggccagcagctgcgcccgccccaccttccttcccacccacatgccgaagggtggccaggcaggcaggtggacgagtccaggcagcggctgagtcagtgtgtgtggaatgttctggccgctcccagctgcaccctgcccctacctgccaccacctcaccttcatcctcaggcgctgcggccctgagcccctgccaggaatgcacctttagcccaggcctgctcagtgagctccgccgacagccagccctgctcctcccgccatgaccctgcagacccctctgggcttccaagttcctgggggctgcagtgaacatgctccacctgcatggctggcaaaccatggtgggccccagctgtggtgcgtnctggggtagaggcaaggaagtgatgggaccgcagagatgagacccccagggatgagatgggacccccaggcagggcccagggtccagggcccaggagagagaagcagggagggagagagcttcctggtggaggacgcatcctacagtgggggcaagggtgctctgaggtccggtgaaggcagggactaggctgcccaggccctgcctgcttggctggggctgggggctgctgggaggtggctgggaggctgggcctgggcagctaagctggagctttggccagggtccagagcctccctcccttcagcttcctgctgcacagaaccctcgcccctggccaccccgtgctgcctccttgccctggcagacccagcactggctgctgctagtcagatggggtagcgggcaggggccggaggggccaccctcccagctgacccagcctcctgggccgcttcttccaaaccagcagggtagaaagatggggcacccaccagtctctcccagtgccccggccccagctggcaccacagctatacctgggcttattccagaccttgtcgccgggaccccctgtgagttgtgggattcccaagaggggtgtggggataacccagccaagtgggggctgcagctgtccacagatgcactcagcctggcctctaccccagggccccgctgggctctcattgccggcgcccttgccgcgggcgtcctcctcgtctcctgcctcctctgtgctgcctgctgctgctgccgccgccacaggaagaagcccagggacaaggagtccgtgggtctgggcagtgcccgcggcaccaccaccacccacctggtgaggagcggctccttgctcactcagtccagagagggcttgaaatccaggctccagagcccagggcagcgaggcgagttcagccccagggatggtttaacccccacagaggcagggcgttgaggaccttcctggcagggaaagtgggtgaacagaggtgagaaggaggccatgcaacaggggctgccccatgggcccgagggagccacagcgggttcttgaggaaggcagggggtaccccagatgccacgttttgggtgggtttggccggtctcacagagcgaagccgacgatttgtgcctgttgggtggcctggcctggaggcggggggtcttgacccatgtcatgcaagngctgcccgggagcccagggctctgatgaggcatgatgtcagcaccacctgccccttgtcccaactcactncaggtgcaacctgatgtggatggcctggagtccagcccgggggatgctcagcaatgggggngcctgcagctctccctggagttcgactttggaagccaggaggtgaagggccccgctgcgcaggaccagcggttctgcgagtttccggaaagggtgacgggggaagggcagaccccatgccctgggtggtggggagctgacagggcaggggcccttggctgagcccaccccgctggctcccagatcagggtgggcctgaggcaggcagccgacctgaggcctgggggcaccgtggacccctatgcccgggtcagcgtctccacccaggccggacacagacatgagacaaaagtgcaccgaggcacgctctgccccgtgtttgacgagacctgctgcttccacatcccgcaggcggagctgccaggggccaccctgcaggtgcagcttttcaacttcaagcgcttctcggggcatgagcccctgggtgagctccgtctgccactgggcaccgtggatctgcagcatgttctggagcactggtacctgctgggcccgccggctgccactcagcccgagcaggtcggggagctgtgcttctctctccggtacgtgcccagctcaggccggctgaccgtggtggtgctggaggctcgaggcctgcgtccaggacttgcagagccctacgtgaaggtccagctcatgctgaaccagaggaagtggaagaagagaaagacagccaccaaaaagggcacggcggccccctacttcaatgaggccttcaccttcctggtgcccttcagccaggtccagaatgtggacctggtgctggctgtctgggaccgcagcctgccgctccgaactgagcccgtaggcaaggtgcacctgggtgcccgggcctcggggcagcccctgcagcactgggcagacatgctggcccacgcccggcggcccattgcccagcggcaccccctgcggccagccagggaggtggaccgcatgctggccctgcagccccgccttcgcctgcgcctgcccttgccccactcctgaatgcaccacatgcctctgtctccccgctgagcccaggcacttgcccaggccgccctgcaggaccactgcaataaacgccttctcctgccact

SEQ ID NO: 36231 - DNA, 380 bp, Homo sapiens
tgatgaggtgaggatgactctagatgatgtatgtccaatgttcaggacccacatatcatccatttagggtaggtattcaaaagaaatggagctgctcagagttttctatcagagtcggtaaattcgagtttctacagggtcaactggttttcgcagcttcaatttccatgtttcttaggaaacaagataaagtttctcacggtgattccattttttgtaaacaattatttccaaaacaagaataatgaaaacaaataatgtcaggaaattatgatttttgttcttttagcatagagaacatcaccataaacagagaaacaaaaccttggaaaggttctataagagtgctatatgctcccttatagcctgaaatagggata

SEQ ID NO: 36232 - DNA, 290 bp, Homo sapiens
cccactttagggtttgaaccttggctccttttagatctgtcaactactaaactagccattgcttgtgctaacattgtagaacaatgaaattcagttcctgcattctgacaagctttaaggtaattccccaagctttgtgtggatctcacaggagccattgcacacttgcaatctgcatttacattttcataggttagaattatggtaagcatttctgcagcaggggcattagggatctgatgccacactgcctcttgcagccatgtgatatattgtgcataaggctctca

SEQ ID NO: 36233 - DNA, 336 bp, Homo sapiens
tccactttgccaatctgttttttaattggtgtatttagaccattacagttatggcaattattaatatgttatggttttcctgccattttattgttttctctttgtttcttctgtgtcttattcctctgtttctgttttcttccatttctgtgggttacttgaatatttttaggatttcctgttgatttatttatagcaccagtccccaccctttttttggcaccagggaccagttttgtggacaacaatttttccacagacaggggaagggcggatggtttcaggatgaaactgtttcaccttagatcatcaggcattagattatcataaagagca

SEQ ID NO: 36234 - DNA, 472 bp, Homo sapiens
tggggatgggaaggtgggttaatcccagtaggagcaatccaatccaatctgggaaggagggagggaggaacatcgcaagaaccagcccttgttcctgttacaggaacagttacaggtgggtggtggatgtggtgtggggaatatgaggtatcctcgaccaaacctcggtgtcctgagcacaggggagagaagggcgtgccaccaagtgcgttgtagggtccaggccagtccctggggtgcccttgcaggtccgcggttcatcttccattcctgtgagcggccattgcatccctgccttggatcctgagtagatttgctcaggtcatccctgcctggcaatcttcctctgccccaggggaagccaggcctggcgtgggaggttacgggcctgcacaaacctaccagcagggcctccttgggcagcgtggacctggagcttctcttggggccaccagtgtgttggggcagggga

SEQ ID NO: 36235 - DNA, 264 bp, Homo sapiens
gaaataaaaggctgaaatcactaaatcttcaacaacatagaataaagtgtgatgaggcccagcgtggtggttcatgcctgtaatcccagcactttgggaggctgaggagacggatcacttgaggtcaggagttcgaggccagcctgaccataatggtgaagccccgcctccataaaaaacacaaaaattagctaggcatggtggcgggcgcctgtaggcccaactatttgggaggctgagtcaggagaatcgcttgaaccccgc

SEQ ID NO: 36236 - DNA, 652 bp, Homo sapiens
tatccttctctactcagtcttgctgacctaactctgtaggagatttgtgccccaggcagatgataattcaggtcctgactctccaggtcctcaaatgctcatgacagatagttcagttgatggcatagcctccgagaaacagaagggcactctgaatctactttctgtaaaatatcagttcaaaaccatcagctcagggcttgtatatgcaggctgcttgtctggtattctactaaacacctatcttttctgcaaagttgaccagctttgctttgtgggcaaaaggtattcatttcaaagagctaagacacaaattgatgccatctaaagtgaattccttagagaaatccagtagtgatagcagctcccattccaggcatctagggtgatggtaagtagctcaatccacaggaaacactaagcattattaaaaactggtgatcagagacttctttccagagtattatttcagtctgctgttgttccaaaattgtcctgctactaaaatcctcaactgcccctttctttgtcatgaccaatatttaaacacatctgtactgtacaagataaaattgtgcagacaccttgcttaggaaaaaagaccctagaagtaggtgaagtcaagaccgactccctgtctccccctgagact

SEQ ID NO: 36237 - DNA, 605 bp, Homo sapiens
attttagtagagacggggtttcaccatgttgcccaggctggtctcgaactcttgagctcaggcaatccgcccgcctctgcctcccaaagtgctacgactacaggcatgagccaccgcgcctggccaataaatcattctttagtttgtagatgagaaatctaaggttatgagagacttatatttcctcaaatcattccacacagtcactgcagcaaaagatcccaaaatcagatgttctaactctccattcttggatacttgttatgacatcatattgcattccagttttagaattactaagttacgtattttggttcattgaaggactttaatgctacaattctcctgaattaaaacagaaagaaaaaccatgaatcttttagctattttccctcaaaacttcatttcatattttgatttaaatgattcttaagtcttgttaataaatttcagaaagattgatctagaaaattattaaacctgattttgttcttcaatgaataaaatggccttcaagagagctatagtatgatttgcaaactgtactttatgttttgacaaaagaaactttaatattcctgtatttttccactgcaggtgaattt

SEQ ID NO: 36238 - DNA, 630 bp, Homo sapiens
ccacgcgtcgcccacgcgtccgcgtcgggattaggtgaaagtacgtagttgtctttcgtaagttaaaatgataattgggccgaaacttactgccttacctaaaaggcagcgcagtcaggatattggtaggtcgggggcggctttggaaacccttaagtttacaagcatgcgcggacttgagtgctcattaggtcgccgggcgtccacgtgcagccctggaccctgaaccccggcgtgcgtgggccgtgggccctcgggggaaaggttccgtgcactcggggactccggtgaagcctgttcagccgtctgtgtcatgtggccatcttgagtctactctgtcgctcttgtgccctagcaccccgagaaccgtcagtttgagccagatgggaagctgagctgaacacattacgatggatgatggaaacataagactatcaagaaatccaagtggtaatgggcgaagtttattcagcatccggcaatggacttatcgtagttggggaaacgggtgttccgaataatatcctggaagttatcaggacacctattttaaatataggcctgaattttgtaaagtaatatttaaggtggtccgtgataattaaataaaatgcttaattcatgtggcta

SEQ ID NO: 36239 - DNA, 794 bp, Homo sapiens
ccacgcgtcgcccacgcgtccgcgtcgggattaggtgaaagtacgtagttgtctttcgtaagttaaaatgataattgggccgaaacttactgccttacctaaaaggcagcgcagtcaggatattggtaggtcgggggcggctttggaaacccttaagtttacaagcatgcgcggacttgagtgctcattaggtcgccgggcgtccacgtgcagccctggaccctgaaccccggcgtgcgtgggccgtgggccctcgggggaaaggttccgtgcactcggggactccggtgaagcctgttcagccgtctgtgtcatgtggccatcttgagtctactctgtcgctcttgtgccctagcaccccgagaaccgtcagtttgagccagatgggaagctgagctgaacacattacgatggatgatggaaacataagactatcaagaaatccaagtggtaatgggcgaagtttattcagcatccggcaatggacttatcgtagttggggaaacgggtgttccgaataatatcctggaagttatcaggacacctattttaaatataggcctgaattttgtaaagtaatatttaaggtggtccgtgataattaaataaaatgcttaattcatgtggctaaaaaaaaaaaaaaaaaaaaaaaattttcggcgcggcccgcgcccagaaaatttaacaccctgtgggggccggggccagggttacgaccggccacgtgccggacccgccgagaaggtggtcccaaaaagcgggccggtttgaccagggcgggccggcaccaggcg

SEQ ID NO: 36240 - DNA, 508 bp, Homo sapiens
cgtttattacataaacaaaataacattacagaaatgataacccagctagctttaaaaagagaacaccctaagatcaggaattcctattatataacacataactatgctaccccctacctctacccccaaaactagattaatcaaggctccagatgaggctgagacccaagagctggatattaatgtagccactgttagtcaggcaccatgggatgatgaaactccaggaccttcacattcgggaagcgtcgggattaggtgaaaggaagctgagctgaacacattacgatggatgatggaaacataagactatcaagaaatccaagtggtaatgggcgaagtttattcagcatccggcaatggacttatcgtagttggggaaacgggtgttccgaataatatcctggaagttatcaggacacctattttaaatataggcctgaattttgtaaagtaatatttaaggtggtccgtgataattaaataaaatgcttaattcatgtggcta

SEQ ID NO: 36241 - DNA, 298 bp, Homo sapiens
gcggccgctactactactaaattaacaacccgtcgacgtcgggattaggtgaaaggaagctgagctgaacacattacgatggatgatggaaacataagactatcaagaaatccaagtggtaatgggcgaagtttattcagcatccggcaatggacttatcgtagttggggaaacgggtgttccgaataatatcctggaagttatcaggacacctattttaaatataggcctgaattttgtaaagtaatatttaaggtggtccgtgataattaaataaaatgcttaattcatgtggcta

SEQ ID NO: 36242 - DNA, 641 bp, Homo sapiens
tgccgaaggcctcggcctttcacattcgggaagcgtcgggattaggtgaaagtacgtagttgtctttcgtaagttaaaatgataattgggccgaaacttactgccttacctaaaaggcagcgcagtcaggatattggtaggtcgggggcggctttggaaacccttaagtttacaagcatgcgcggacttgagtgctcattaggtcgccgggcgtccacgtgcagccctggaccctgaaccccggcgtgcgtgggccgtgggccctcgggggaaaggttccgtgcactcggggactccggtgaagcctgttcagccgtctgtgtcatgtggccatcttgagtctactctgtcgctcttgtgccctagcaccccgagaaccgtcagtttgagccagatgggaagctgagctgaacacattacgatggatgatggaaacataagactatcaagaaatccaagtggtaatgggcgaagtttattcagcatccggcaatggacttatcgtagttggggaaacgggtgttccgaataatatcctggaagttatcaggacacctattttaaatataggcctgaattttgtaaagtaatatttaaggtggtccgtgataattaaataaaatgcttaattcatgtggcta

SEQ ID NO: 36243 - DNA, 663 bp, Homo sapiens
ccacgcgtcgcccacgcgtccgcgtcgggattaggtgaaagtacgtagttgtctttcgtaagttaaaatgataattgggccgaaacttactgccttacctaaaaggcagcgcagtcaggatattggtaggtcgggggcggctttggaaacccttaagtttacaagcatgcgcggacttgagtgctcattaggtcgccgggcgtccacgtgcagccctggaccctgaaccccggcgtgcgtgggccgtgggccctcgggggaaaggttccgtgcactcggggactccggtgaagcctgttcagccgtctgtgtcatgtggccatcttgagtctactctgtcgctcttgtgccctagcaccccgagaaccgtcagtttgagccagatgggaagctgagctgaacacattacgatggatgatggaaacataagactatcaagaaatccaagtggtaatgggcgaagtttattcagcatccggcaatggacttatcgtagttggggaaacgggtgttccgaataatatcctggaagttatcaggacacctattttaaatataggcctgaattttgtaaagtaatatttaaggtggtccgtgataattaaataaaatgcttaattcatgtggctaaaaaacaataatagctttaaagaaaaaactcta

SEQ ID NO: 36244 - DNA, 892 bp, Homo sapiens
tgccgaaggcctcggcctttcacattcgggaagcgtcgggattaggtgaaagtacgtagttgtctttcgtaagttaaaatgataattgggccgaaacttactgccttacctaaaaggcagcgcagtcaggatattggtaggtcgggggcggctttggaaacccttaagtttacaagcatgcgcggacttgagtgctcattaggtcgccgggcgtccacgtgcagccctggaccctgaaccccggcgtgcgtgggccgtgggccctcgggggaaaggttccgtgcactcggggactccggtgaagcctgttcagccgtctgtgtcatgtggccatcttgagtctactctgtcgctcttgtgccctagcaccccgagaaccgtcagtttgagccagatggtgagtaataacctgtagcagtttggttgctggttaattctggattgtgaatctccatgtatctttgggacctgtcagccgtggcagtctcccttcctagccatggaagagcatatccttgtttattggcaaagctgtcaccatttaattggtatcagattctgacttgcacaagtaacattcactgttaaaaacctagagggtgccgggttattgggcaaaatttctaaaccgttgttcaatgtttctagggaagctgagctgaacacattacgatggatgatggaaacataagactatcaagaaatccaagtggtaatgggcgaagtttattcagcatccggcaatggacttatcgtagttggggaaacgggtgttccgaataatatcctggaagttatcaggacacctattttaaatataggcctgaattttgtaaagtaatatttaaggtggtccgtgataattaaataaaatgcttaattcatgtggcta

SEQ ID NO: 36245 - DNA, 1084 bp, Homo sapiens
tgccgaaggcctcggcctttcacattcgggaagcgtcgggattaggtgaaagtacgtagttgtctttcgtaagttaaaatgataattgggccgaaacttactgccttacctaaaaggcagcgcagtcaggatattggtaggtcgggggcggctttggaaacccttaagtttacaagcatgcgcggacttgagtgctcattaggtcgccgggcgtccacgtgcagccctggaccctgaaccccggcgtgcgtgggccgtgggccctcgggggaaaggttccgtgcactcggggactccggtgaagcctgttcagccgtctgtgtcatgtggccatcttgagtctactctgtcgctcttgtgccctagcaccccgagaaccgtcagtttgagccagatggtgagtaataacctgtagcagtttggttgctggttaattctggattgtgaatctccatgtatctttgggacctgtcagccgtggcagtctcccttcctagccatggaagagcatatccttgtttattggcaaagctgtcaccatttaattggtatcagattctgacttgcacaagtaacattcactgttaaaaacctagagggtgccgggttattgggcaaaatttctaaaccgttgttcaatgtttctagggaagctgagctgaacacattacgatggatgatggaaacataaggtacattccttttttgatatttctgagttaatctgaaacgccttagcggcaggacgttggaaagctaaagttggcccgttttgctggcttttgtagtttgagttaacaaccaactgaattagctgataagatctcaaaacagtgaggtaagtacacagctcggagttttataatgctttttttctcttgcagactatcaagaaatccaagtggtaatgggcgaagtttattcagcatccggcaatggacttatcgtagttggggaaacgggtgttccgaataatatcctggaagttatcaggacacctattttaaatataggcctgaattttgtaaagtaatatttaaggtggtccgtgataattaaataaaatgcttaattcatgtggcta

SEQ ID NO: 36246 - DNA, 586 bp, Homo sapiens
ccacgcgtcgcccacgcgtccgcgtcgggattaggtgaaagtacgtagttgtctttcgtaagttaaaatgataattgggccgaaacttactgccttacctaaaaggcagcgcagtcaggatattggtaggtcgggggcggctttggaaacccttaagtttacaagcatgcgcggacttgagtgctcattaggtcgccgggcgtccacgtgcagccctggaccctgaaccccggcgtgcgtgggccgtgggccctcgggggaaaggttccgtgcactcggggactccggtgaagcctgttcagccgtctgtgtcatgtggccatcttgagtctactctgtcgctcttgtgccctagcaccccgagaaccgtcagtttgagccagatgactatcaagaaatccaagtggtaatgggcgaagtttattcagcatccggcaatggacttatcgtagttggggaaacgggtgttccgaataatatcctggaagttatcaggacacctattttaaatataggcctgaattttgtaaagtaatatttaaggtggtccgtgataattaaataaaatgcttaattcatgtggcta

SEQ ID NO: 36247 - DNA, 822 bp, Homo sapiens
atttatcctggattagagacatttgagaaatcatgaaattatagaattgaagtctttggagagctgagccttggccacacattgcaaccatctggagggatttcagaaatacggtgcccaggcccatcctggaaacgctgagtgaattgatctggagcgggatctgaccaatagccagtcattcctcacgaggtctgagtaaatcaagacaactccttaaactgaggcatgcaatgtcctgatcaggtggtagaagtgccttttcacagagacgtgcaatgctatgtcatgggactttcttttctccgaaatctgtagatcacagcgggcgatgggcgtggctgcccagtgcagaagtaggagacggtcatgtgcccttccactgctgtctgccatagtctcacagagctggcattttctaatacaaactgtcttaggcttttaatccacactaaatcttggcaatcactgcctctgtcaaagaaaagtacttgcttgagacactgttaagagtctcgtcttacagcctgtgtgcacgttgaggcatctgtgcaggtgccatgcacaggaggtgctcagcgggaagttggagcacctgggttctcatctgcctctgctcctggctgctccttgactttgcacgaatgaacggaacatctctgcatctgcaccagggtcgggaagtaaaagcaccaaactagatgtctctgagatcaccctcatctctgaaatcatgtggcctaactaaatgattatgtatcaacagaaatcaacattggaatttacaaaggatttgattaagagaaatgcaaaaaaaaaaaa

SEQ ID NO: 36248 - DNA, 411 bp, Homo sapiens
tttttttttccaagacagggtcttaccccgtcaacatagctggactgctgtggcgcgatcacagctcattgcagcctcggcctccccccgagctcaggcaatcttctcacctcagccttcagagtagctggaactacaggcatgcaccactgcacctggcttttattttttgtagaaacagggtctcaccatattgccagggctgaacataacttttatatgcactgaaaaaccaaaaaatttgtgtgactcgttttattgagatgacttctttattgtagtgctgcagtctgggaccaagcccgtagtccctgtgaggtatgcctctatttcctaccacaaccagcagtaactttcaagtcaccatttagataatcagaactctaactcatcctgtagatggatgctttg

SEQ ID NO: 36249 - DNA, 271 bp, Homo sapiens
cattggggaaaatgtttagaatgtatggaaaacatgttatggatattatatatctaccataaaccaagaaaagagtctggcagagggaaattctatgttgattaggaaaagtcaccacgatcctggtctttatggctttattttttttctaaacaattgctttattctttttttcagaatataaaagaaaggctaagaaaaagaaaaaccaatcatgtctttcaaagatagcattcttaacatcttggtcctgtgcttttttaaaaaaaaa

SEQ ID NO: 36250 - DNA, 416 bp, Homo sapiens
aaagatgcagtatccccttttggaaacttcctttttccacaaataaaatcccctggttttgtttcctagagaaattctgttccaccaatgattgaccttattacccaaagggtggacaggaagagaaagtggatacatggctgtgcactgtcctccattacatttcatccaatgatgttgaatactgcataggtcagaagtccaaagagcatccaatagtccctccttgagtgaagcttttttattcaccatttaatgccacatgggtttggccatctctcctgggataagggaagtggattgtggtagtaagtcccctggtccttgtcaaactcttctgagcttgtgtagcacacacatactatgcttggaacttgagcttaaccatcagtttctctgcagaagactgcaacctg

SEQ ID NO: 36251 - DNA, 806 bp, Homo sapiens
ttgacacagactttatacttttcacaaaaactacctcagagtgaattgtagcctttaatgttaagcacaaaaatgtaaaactcctagaagataataaaggagaaaatctggtgaccttaggtttggtgataactttttagacaaaacaccaaaagcatactccatgaaagaaagacgttgttaagttggacttcgttaaaataaaatatgtacgttttgtgaaagttactgtttagggactaaagagataagtcacagactgggagaaaatctttggaaaatacatacctgaaaaagaactggcatccaaaaatattcagagaacccttataactcaataataaatgaacaacacaattaaatggacaaaaaaatctgaacctccttggagaagatatacagatggcaagcaagcatttcaaaagatgtttccacatatcattagagaacatgcaaatttaaaccacagtgagatactatacacctattagagtgatgaaaattccagacactgacaataccacatgctggtgagtatgtggagtaatgggaattctcattcattgctggtgggaatgcaaaataataaccttcaaaagacacttgggcagtttctttaaaagctaaacatattcttaccatatgatccagcagtcatgttccttggtgtttatccaaatgaactgaaaactttaagtccacataaaaatctgccgatacatgtttgtagcaactttatttgtaattgcccaaacttggaagcaaccaagatgtccttcagtaggttaatggataaacaaactgtg

SEQ ID NO: 36252 - DNA, 261 bp, Homo sapiens
cctcctcctcttccacttgttttccctctacaattctcttcacttctttccctctttctcccccagttcttcttctgtttccaattcctcttcttctcaaagttctttgaatgttctcacttcttctaattctcctccatttccttccaattctcctaattcttctccttctcctccttcttcttcttccttctctccctttaagcctcagcttccatgtatagtttactcatttgctagtttagaaatggaatctgctat

SEQ ID NO: 36253 - DNA, 338 bp, Homo sapiens
gggcaaaaagcacgaaactccatctccaaaaaaaaagcctgtagctgacatttagtagatgcttattaaaagtaataagcatctctgggaggctgtctcacagcaggatgatcaggtcagttttctggacaactttatgggttaggtccgaagttcagatagttctctgggtctctggggctgaaagaacagaactgtgtcttgctttaagagtctctatctggccaggtgcagtggctcacgcctgtaatcccagtactttggggggtgggaggatcgcttgagcccagtagtttgagaccagcctaggcaacatgttgagaccctgtctcaaccat

SEQ ID NO: 36254 - DNA, 449 bp, Homo sapiens
atggccaggctggtctcaagctcctgacctcaagtgatccgcccacctcaacctcccaaagtgctgggattacaggcatgagcaacagtgcctggccctatctttttttgtttgttttgttttgtttgtattttagatacctttgacttctaatgtgaaaatactctatatgatctcagagcggtgtatgaactttggaatactttatgacagaacctctagctcataaagcagcccattaacttagcctctagtctatttattgtactaaaatgaagttacataaagctgtatggtttttacaacagattaacatacttaaacagttttgttttgttttgttttgttttgttttgtggcagggtctcactctgttgcccaggctggagtgcagtggcgcgatcacgggtcactgcaacctccacctcccaggctcaaatcatcctccc

SEQ ID NO: 36255 - DNA, 867 bp, Homo sapiens
gtggcagaaatttttaggtatgaggaggattggataagaggaagatatcttttcatcagattgaattggaattagaaacatattttgttgcaaacttctatcaataagtagcacctcggatagaacataaaatatagacaaaatttttaacaagttgataataaactaattttcacttcagtcagtacatatacggagacaatattacatgctaatcagtgcacctagacatttaggatatacaggtcaaatgtattccagctcccgtccttaggtttcatataaggacacaaaatacataatcatattctatattgcactgtcagattaatctccttaagcaatgatttagataatgagaagaatttcactggccacctatcctattaagatattcagactccttgggaaagagtatggtttcgaaaaaagtaggtcaggctttcattataggatagacctgggtggagcccctatatatatcactcagccagcttggtttgctcatatataaaattctagctagtgatacctaattcaatcctaatgctgtaagaaataaatgagataataatctacctggatagcatgtaacctgtatctggtatctaatttctttctcctatctgatgttctgggccttccagaaaatagttcttacctccttttcccttgatgtaaatattttatccccacccaactcctacctggccttctaagcagcatttcttgaatatttcatgtgtagtcctatttctgtctttgttcaaatcagttcaaatcatatctcctacctgaaatgcctcctccttttttccccagctttactgaggtataattgacaaataaaaaaatgtatatatgttt

SEQ ID NO: 36256 - DNA, 318 bp, Homo sapiens
agtgatttatgaagctattatagattcttgtttttctgttcattcaatggaatgcaaaaaccttgaagaaatatgtggtcagatttatttcactgcagctgtttcttaccagaataaaatgtttatccttttgaaacccaaactttaacatgcacacaaatccatcactcattatataatggtaacattaatactgacacaatgtttttaggcaccagatacctgtgtctttacacattcttttgtagtattacctaatgaccctaaaaaaatctctgatgggatggtatataataacagccaaaatgcttatagcag

SEQ ID NO: 36257 - DNA, 893 bp, Homo sapiens
gaaggaatctgaggtcacttgttcaaattccctgatttacagatgaggaaacagaggctcagacagctcaaatgacttctctccaatacccaacattcgacaagtagcagctctgggactagtacccaaagcacctagctctccaatcactgcgcaagccacacaattctgtctgcttgtcagtggcttttctgattcaaaaaaagcttaggaatttccccaggaggcagcacgatgtagtgggaagggctctggatgtctctccaaggcttctggaattcatgcccacctccaccaagaagccactttcctgccagctacaggtgctcacctgaaaagcaagccagaccatattaaccctgggcattgctggtacctgggaagactttctgattcaatgctttccacctcctcctacccctcaccacccccgtggcatgaaatcctgggggctgctttagaaattgttttctttggctgctggtgggggtgctgctggtgggggtttgcacagctggcacactgcaccagtctggtgggggtttgcacagctggcacactgcaccagtctcctgcctgctgccaacaaggccatttcccaagcactggctttggagaagttggggctctgaagtgggaacacaaggctgccttttgcaggccaggtgtaaattctccccctgccactttcagcctagcgtgaaacagatggagtgtgcattcccacttccctttatggtaccctggaatgatggagctgcccagggcatcgccacgttactctctagacagtctctttgtcttcctgcaatggcagcgccgaggttgtatatttctaggtgcaggtatatgattgccatataataaaaatctgaaaacatcccaaaaaaggc

SEQ ID NO: 36258 - DNA, 118 bp, Homo sapiens
cttgaccaggcttttatcatctgtttctaagaccactgtaatagtctccttacttctctgcctctactcttgattcctttatgtaatccattcacttcacaagagccaggaggccttt

SEQ ID NO: 36259 - DNA, 299 bp, Homo sapiens
tgagccgagatcgccactgcactccagcctgggtgacaaagcgagactctgtctcgacaaaaaaaaagggggtacattagttaagaaaaactacaagtgtgtcttttgcttgagggaaaggctaacattagtagaatgatgaaaattattaatggtgttgctgtacagtagcatagtatgcagtcttcaagttgcatttgaaggttatataatagtagggaaatgtccccagtgtaataaatggtgtaaaaaaacaaaagacaatgtatatgtgaaatatgattccaattttatacata

SEQ ID NO: 36260 - DNA, 224 bp, Homo sapiens
tgccctgtaggactgtcatgtaaattagatcatataggaaaagcattttaataaattcctttcctatcttatcttacaattatattgctgggataatggatcatcaaggaccaaagctaagatactagacccctgggtttttgagtgggccagatgacttggacaagttgtttaacctctctgtgttttgttttctttttgttatgtttcttctaatccaaaat

SEQ ID NO: 36261 - DNA, 434 bp, Homo sapiens
aaatgtcaaaagtcacaggtgtcactgttggggtagataggatttgaccatagtggtgtgatctggcctacctcctttatatttctcttaaattgaaaagtagagtgatacagtgtgaatatagtttccaagctatttagtagcagagtagcctcaaggactttctcatgtaattctatgattaaagaaaaaggtcgagggttaagcaaggtcgaggtaagttaaacaatgcatcagaagaagaaatgtcaggaaaaaaagcattgtatttatttctgaatgatgtatttggaaatttaaatgttcagcagaaaaataaaatttgataattaggttctaaagaaactggatatatgaggatgtgtatgtgtgtgtatttacctatgtagtttgggaagataaactgaagtaaaacataacactaaaatgaagct

SEQ ID NO: 36262 - DNA, 662 bp, Homo sapiens
  misc_feature (4)..(4): n is a, c, g, or t
  misc_feature (20)..(20): n is a, c, g, or t
  misc_feature (31)..(31): n is a, c, g, or t
  misc_feature (54)..(54): n is a, c, g, or t
  misc_feature (70)..(70): n is a, c, g, or t
tacncacaaggaacaagtgngtccaccgtgngcgttaaatagtgatcccgggtncagaatcgcagagcangtcgtccccctgccggcttctccgccgccgccgccttccgcaggccgtttccaccgaggaaaaggaatcgtatcgtatgtccgctatccagaacctccactctttcgacccctttgctgatgcaagtaagggtgatgacctgcttcctgctggcactgaggattatatccatataagaattcaacagagaaacggcaggaagacccttactactgtccaagggatcgctgatgattacgataaaaagaaactagtgaaggcgtttaagaaaaagtttgcctgcaatggtactgtaattgagcatccggaatatggagaagtaattcagctacagggtgaccaacgcaagaacatatgccagttcctcgtagagattggactggctaaggacgatcagctgaaggttcatgggttttaagtgcttgtggctcactgaagcttaagtgaggatttccttgcaatgagtagaatttcccttctctcccttgtcacaggtttaaaaacctcacagcttgtataatgtaaccatttggggtccgcttttaacttggactagtgtaactccttcatgcaataaactgaaaagagccat

SEQ ID NO: 36263 - DNA, 1152 bp, Homo sapiens
  misc_feature (80)..(80): n is a, c, g, or t
aggactcagcagcctcccccttgggccccgtcgcttccctactttccgtaccctctgcccgccttctcccgccaccgccnccgccgccttccgcaggccgtttccaccgaggaaaaggaatcgtatcgtatgtccgctatccagaacctccactctttcgaaaaaagtttgcctgcaatggtactgtaattgagcatccggaatatggagaagtaattcagctacagggtgaccaacgcaagaacatatgccagttcctcgtagagattggactggctaaggacgatcagctgaaggttcatgggttttaagtgcttgtggctcactgaagcttaagtgaggatttccttgcaatgagtagaatttcccttctctcccttgtcacaggtttaaaaacctcacagcttgtataatgtaaccatttggggtccgcttttaacttggactagtgtaactccttcatgcaataaactgaaaagagccatgctgtctagtcttgaagtccctcatttaaacagaggtcaagcaataggcgcctggcagtgtcaagcctgaaaccaagcaataccgtcatgtttcagccaagcccagagccctaagattacaaacaactatggccggaacctcctcagctctccctctgcagagttccctaccctaagagaatgttaccacctgaacagtcctcggtgaatctgagaggagaggatggggtaaggcagaagcaccagctgtactactagaagggagcttttggtggtagatcccctggtgtctccaacctgactaggtggacagagctcaaagaggccctcttaccgctagcgaggtgataggacatctggcttgccacaaaggtctgttcgaccagacatatcctagctaagggatgtccaaacatcagaatgtgaggccaaccttctatcagagttaactttgacaagggaccaatctcaaactgatcatcagtatgttgtaagggtgagtgggattaagagaggccatgctggaagacaatggtttgggtgttccctagtttggtttgttggttaactttataatgttggaaataaacaaaaaacaagggggggattaggggagcgtgaaggatgataaaaggcgaggatggtggtcaatatttttattaggggc

SEQ ID NO: 36264 - DNA, 758 bp, Homo sapiens
  misc_feature (50)..(50): n is a, c, g, or t
ggcacgatcggcacgagtggcagcccggactcccccgacatgtgatcggnttcccagggagggcgggaggcccgggcgttccccgagcctggggaagctggccgtcccggactgacctgctcggggagagccagcaaaggacacattcggcctggcccaagccctgacgatttcagtgttgttttctgcacgcgcaaaacacctggggaccgaggggatggcagtggcatcctatctttgacagctctgaacgagcttaaccttttttttcagacccctttgctgatgcaagtaagggtgatgacctgcttcctgctggcactgaggattatatccatataagaattcaacagagaaacggcaggaagacccttactactgtccaagggatcgctgatgattacgataaaaagaaactagtgaaggcgtttaagaaaaagtttgcctgcaatggtactgtaattgagcatccggaatatggagaagtaattcagctacagggtgaccaacgcaagaacatatgccagttcctcgtagagattggactggctaaggacgatcagctgaaggttcatgggttttaagtgcttgtggctcactgaagcttaagtgaggatttccttgcaatgagtagaatttcccttctctcccttgtcacaggtttaaaaacctcacagcttgtataatgtaaccatttggggtccgcttttaacttggactagtgtaactccttcatgcaataaactgaaaagagccat

SEQ ID NO: 36265 - DNA, 433 bp, Homo sapiens
tactactaaattcgcggccgcgtcgacgagaaacggcaggaagacccttactactgtccaagggatcgctgatgattacgataaaaagaaactagtgaaggcgtttaagaaaaagtttgcctgcaatggtactgtaattgagcatccggaatatggagaagtaattcagctacagggtgaccaacgcaagaacatatgccagttcctcgtagagattggactggctaaggacgatcagctgaaggttcatgggttttaagtgcttgtggctcactgaagcttaagtgaggatttccttgcaatgagtagaatttcccttctctcccttgtcacaggtttaaaaacctcacagcttgtataatgtaaccatttggggtccgcttttaacttggactagtgtaactccttcatgcaataaactgaaaagagccat

SEQ ID NO: 36266 - DNA, 1107 bp, Homo sapiens
  misc_feature (50)..(50): n is a, c, g, or t
ggcacgatcggcacgagtggcagcccggactcccccgacatgtgatcggnttcccagggagggcgggaggcccgggcgttccccgagcctggggaagctggccgtcccggactgacctgctcggggagagccagcaaaggacacattcggcctggcccaagccctgacgatttcagtgttgttttctgcacgcgcaaaacacctggggaccgaggggatggcagtggcatcctatctttgacagctctgaacgagcttaaccttttttttcagacccctttgctgatgcaagtaagggtgatgacctgcttcctgctggcactgaggattatatccatataagaattcaacagagaaacggcaggaagacccttactactgtccaagggatcgctgatgattacgataaaaagaaactagtgaaggcgtttaagaaaaagtttgcctgcaatggtactgtaattgagcatccggaatatggagaagtaattcagctacagggtgaccaacgcaagaacatatgccagttcctcgtagagattggactggctaaggacgatcagctgaaggttcatgggttttaagtgcttgtggctcactgaagcttaagtgaggatttccttgcaatgagtagaatttcccttctctcccttgtcacaggtttaaaaacctcacagcttgtataatgtaaccatttggggtccgcttttaacttggactagtgtaactccttcatgcaataaactgaaaagagccatgctgtctagtcttgaagtccctcatttaaacagaggtcaagcaataggcgcctggcagtgtcaagcctgaaaccaagcaataccgtcatgtttcagccaagcccagagccctaagattacaaacaactatggccggaacctcctcagctctccctctgcagagttccctaccctagaaatgtacacatgacagactcgggatcgaacgcaagagggcagcaaacacacggcaccaaagggcctgggtaaacacagggtcacagatgtggaaaacaaagcctacgggagcaatgggccaggtgcccaccacagggacacagagcccacactgggcacgacagaggcccgg

SEQ ID NO: 36267 - DNA, 236 bp, Homo sapiens
cccgggctgccggaattcggcacctggctaaggacgatcagctgaaggttcatgggttttaagtgcttgtggctcactgaagcttaagtgaggatttccttgcaatgagtagaatttcccttctctcccttgtcacaggtttaaaaacctcacagcttgtataatgtaaccatttggggtccgcttttaacttggactagtgtaactccttcatgcaataaactgaaaagagccat

SEQ ID NO: 36268 - DNA, 1323 bp, Homo sapiens
  misc_feature (4)..(4): n is a, c, g, or t
  misc_feature (20)..(20): n is a, c, g, or t
  misc_feature (31)..(31): n is a, c, g, or t
  misc_feature (54)..(54): n is a, c, g, or t
  misc_feature (70)..(70): n is a, c, g, or t
  misc_feature (1291)..(1291): n is a, c, g, or t
  misc_feature (1302)..(1303): n is a, c, g, or t
  misc_feature (1311)..(1311): n is a, c, g, or t
tacncacaaggaacaagtgngtccaccgtgngcgttaaatagtgatcccgggtncagaatcgcagagcangtcgtccccctgccggcttctccgccgccgccgccttccgcaggccgtttccaccgaggaaaaggaatcgtatcgtatgtccgctatccagaacctccactctttcgacccctttgctgatgcaagtaagggtgatgacctgcttcctgctggcactgaggattatatccatataagaattcaacagagaaacggcaggaagacccttactactgtccaagggatcgctgatgattacgataaaaagaaactagtgaaggcgtttaagaaaaagtttgcctgcaatggtactgtaattgagcatccggaatatggagaagtaattcagctacagggtgaccaacgcaagaacatatgccagttcctcgtagagattggactggctaaggacgatcagctgaaggttcatgggttttaagtgcttgtggctcactgaagcttaagtgaggatttccttgcaatgagtagaatttcccttctctcccttgtcacaggtttaaaaacctcacagcttgtataatgtaaccatttggggtccgcttttaacttggactagtgtaactccttcatgcaataaactgaaaagagccatgctgtctagtcttgaagtccctcatttaaacagaggtcaagcaataggcgcctggcagtgtcaagcctgaaaccaagcaataccgtcatgtttcagccaagcccagagccctaagattacaaacaactatggccggaacctcctcagctctccctctgcagagttccctaccctaagagaatgttaccacctgaacagtcctcggtgaatctgagaggagaggatggggtaaggcagaagcaccagctgtactactagaagggagcttttggtggtagatcccctggtgtctccaacctgactaggtggacagagctcaaagaggccctcttaccgctagcgaggtgataggacatctggcttgccacaaaggtctgttcgaccagacatatcctagctaagggatgtccaaacatcagaatgtgaggccaaccttctatcagagttaactttgacaagggaacaaatctcaaactgatccatcagtcatgtagctagctgtagagcttgcaacttaatagcagcagctgcccaatgccatgtgaagtaacaaactggttttaggtttttttttccccttcagttttaatgtcatgtgtaatgtatttaaacccttatttacataaacntgtttcagaannagaaaaancacaccaacaag

SEQ ID NO: 36269 - DNA, 1509 bp, Homo sapiens
  misc_feature (4)..(4): n is a, c, g, or t
  misc_feature (20)..(20): n is a, c, g, or t
  misc_feature (31)..(31): n is a, c, g, or t
  misc_feature (54)..(54): n is a, c, g, or t
  misc_feature (70)..(70): n is a, c, g, or t
tacncacaaggaacaagtgngtccaccgtgngcgttaaatagtgatcccgggtncagaatcgcagagcangtcgtccccctgccggcttctccgccgccgccgccttccgcaggccgtttccaccgaggaaaaggaatcgtatcgtatgtccgctatccagaacctccactctttcgacccctttgctgatgcaagtaagggtgatgacctgcttcctgctggcactgaggattatatccatataagaattcaacagagaaacggcaggaagacccttactactgtccaagggatcgctgatgattacgataaaaagaaactagtgaaggcgtttaagaaaaagtttgcctgcaatggtactgtaattgagcatccggaatatggagaagtaattcagctacagggtgaccaacgcaagaacatatgccagttcctcgtagagattggactggctaaggacgatcagctgaaggttcatgggttttaagtgcttgtggctcactgaagcttaagtgaggatttccttgcaatgagtagaatttcccttctctcccttgtcacaggtttaaaaacctcacagcttgtataatgtaaccatttggggtccgcttttaacttggactagtgtaactccttcatgcaataaactgaaaagagccatgctgtctagtcttgaagtccctcatttaaacagaggtcaagcaataggcgcctggcagtgtcaagcctgaaaccaagcaataccgtcatgtttcagccaagcccagagccctaagattacaaacaactatggccggaacctcctcagctctccctctgcagagttccctaccctaagagaatgttaccacctgaacagtcctcggtgaatctgagaggagaggatggggtaaggcagaagcaccagctgtactactagaagggagcttttggtggtagatcccctggtgtctccaacctgactaggtggacagagctcaaagaggccctcttaccgctagcgaggtgataggacatctggcttgccacaaaggtctgttcgaccagacatatcctagctaagggatgtccaaacatcagaatgtgaggccaaccttctatcagagttaactttgacaagggaacaaatctcaaactgatccatcagtcatgtagctagctgtagagcttgcaacttaatagcagcagctgcccaatgccatgtgaagtaacaactggcttaggataaatatccccttcatttacagttatgtgtaaggatcgaaccgctcattaataaactgtttccgacattacacacaacacaggcgcgcgcaaatatccctccgggccattcagatcgcttttgtaaatcggcccctatgacgcataacggtacgggcgctacacgtgggacacgagtgagctgagaccactcggagaatgacacactaacccaacaaatgatgcacaactctgcatcagatcacatcgataacatctaaaaactgcgacaactaacatatctc

SEQ ID NO: 36270 - DNA, 1329 bp, Homo sapiens
  misc_feature (4)..(4): n is a, c, g, or t
  misc_feature (20)..(20): n is a, c, g, or t
  misc_feature (31)..(31): n is a, c, g, or t
  misc_feature (54)..(54): n is a, c, g, or t
  misc_feature (70)..(70): n is a, c, g, or t
tacncacaaggaacaagtgngtccaccgtgngcgttaaatagtgatcccgggtncagaatcgcagagcangtcgtccccctgccggcttctccgccgccgccgccttccgcaggccgtttccaccgaggaaaaggaatcgtatcgtatgtccgctatccagaacctccactctttcgacccctttgctgatgcaagtaagggtgatgacctgcttcctgctggcactgaggattatatccatataagaattcaacagagaaacggcaggaagacccttactactgtccaagggatcgctgatgattacgataaaaagaaactagtgaaggcgtttaagaaaaagtttgcctgcaatggtactgtaattgagcatccggaatatggagaagtaattcagctacagggtgaccaacgcaagaacatatgccagttcctcgtagagattggactggctaaggacgatcagctgaaggttcatgggttttaagtgcttgtggctcactgaagcttaagtgaggatttccttgcaatgagtagaatttcccttctctcccttgtcacaggtttaaaaacctcacagcttgtataatgtaaccatttggggtccgcttttaacttggactagtgtaactccttcatgcaataaactgaaaagagccatgctgtctagtcttgaagtccctcatttaaacagaggtcaagcaataggcgcctggcagtgtcaagcctgaaaccaagcaataccgtcatgtttcagccaagcccagagccctaagattacaaacaactatggccggaacctcctcagctctccctctgcagagttccctaccctaagagaatgttaccacctgaacagtcctcggtgaatctgagaggagaggatggggtaaggcagaagcaccagctgtactactagaagggagcttttggtggtagatcccctggtgtctccaacctgactaggtggacagagctcaaagaggccctcttaccgctagcgaggtgataggacatctggcttgccacaaaggtctgttcgaccagacatatcctagctaagggatgtccaaacatcagaatgtgaggccaaccttctatcagagttaactttgacaagggaccaatctcaaactgatcatcagtatgttgtaagggtgagtgggattaagagaggccatgctggaagacaatggtttgggtgttccctagtttggtttgttggttaactttataatgttggaaataaacaaaaaacaagggggggattaggggagcgtgaaggatgataaaaggcgaggatggtggtcaatatttttattaggggc

SEQ ID NO: 36271 - DNA, 1043 bp, Homo sapiens
  misc_feature (11)..(11): n is a, c, g, or t
  misc_feature (14)..(14): n is a, c, g, or t
  misc_feature (1011)..(1011): n is a, c, g, or t
  misc_feature (1022)..(1023): n is a, c, g, or t
  misc_feature (1031)..(1031): n is a, c, g, or t
tcagtctgtcnccncgggttttggatatgtcgaccacgcctcgaggcgtataagagacaaaaagtttgcctgcaatggtactgtaattgagcatccggaatatggagaagtaattcagctacagggtgaccaacgcaagaacatatgccagttcctcgtagagattggactggctaaggacgatcagctgaaggttcatgggttttaagtgcttgtggctcactgaagcttaagtgaggatttccttgcaatgagtagaatttcccttctctcccttgtcacaggtttaaaaacctcacagcttgtataatgtaaccatttggggtccgcttttaacttggactagtgtaactccttcatgcaataaactgaaaagagccatgctgtctagtcttgaagtccctcatttaaacagaggtcaagcaataggcgcctggcagtgtcaagcctgaaaccaagcaataccgtcatgtttcagccaagcccagagccctaagattacaaacaactatggccggaacctcctcagctctccctctgcagagttccctaccctaagagaatgttaccacctgaacagtcctcggtgaatctgagaggagaggatggggtaaggcagaagcaccagctgtactactagaagggagcttttggtggtagatcccctggtgtctccaacctgactaggtggacagagctcaaagaggccctcttaccgctagcgaggtgataggacatctggcttgccacaaaggtctgttcgaccagacatatcctagctaagggatgtccaaacatcagaatgtgaggccaaccttctatcagagttaactttgacaagggaacaaatctcaaactgatccatcagtcatgtagctagctgtagagcttgcaacttaatagcagcagctgcccaatgccatgtgaagtaacaaactggttttaggtttttttttccccttcagttttaatgtcatgtgtaatgtatttaaacccttatttacataaacntgtttcagaannagaaaaancacaccaacaag

SEQ ID NO: 36272 - DNA, 1152 bp, Homo sapiens
  misc_feature (86)..(86): n is a, c, g, or t
  misc_feature (1120)..(1120): n is a, c, g, or t
  misc_feature (1131)..(1132): n is a, c, g, or t
  misc_feature (1140)..(1140): n is a, c, g, or t
gactagttctagctcgcgatctagaactagcccacgcgtccgccgacgttccgttcccccctgcccgccttctcccgccaccgccnccgccgccttccgcaggccgtttccaccgaggaaaaggaatcgtatcgtatgtccgctatccagaacctccactctttcgaaaaaagtttgcctgcaatggtactgtaattgagcatccggaatatggagaagtaattcagctacagggtgaccaacgcaagaacatatgccagttcctcgtagagattggactggctaaggacgatcagctgaaggttcatgggttttaagtgcttgtggctcactgaagcttaagtgaggatttccttgcaatgagtagaatttcccttctctcccttgtcacaggtttaaaaacctcacagcttgtataatgtaaccatttggggtccgcttttaacttggactagtgtaactccttcatgcaataaactgaaaagagccatgctgtctagtcttgaagtccctcatttaaacagaggtcaagcaataggcgcctggcagtgtcaagcctgaaaccaagcaataccgtcatgtttcagccaagcccagagccctaagattacaaacaactatggccggaacctcctcagctctccctctgcagagttccctaccctaagagaatgttaccacctgaacagtcctcggtgaatctgagaggagaggatggggtaaggcagaagcaccagctgtactactagaagggagcttttggtggtagatcccctggtgtctccaacctgactaggtggacagagctcaaagaggccctcttaccgctagcgaggtgataggacatctggcttgccacaaaggtctgttcgaccagacatatcctagctaagggatgtccaaacatcagaatgtgaggccaaccttctatcagagttaactttgacaagggaacaaatctcaaactgatccatcagtcatgtagctagctgtagagcttgcaacttaatagcagcagctgcccaatgccatgtgaagtaacaaactggttttaggtttttttttccccttcagttttaatgtcatgtgtaatgtatttaaacccttatttacataaacntgtttcagaannagaaaaancacaccaacaag

SEQ ID NO: 36273 - DNA, 946 bp, Homo sapiens
  misc_feature (914)..(914): n is a, c, g, or t
  misc_feature (925)..(926): n is a, c, g, or t
  misc_feature (934)..(934): n is a, c, g, or t
tactctagaggatctcgggtcggcaaagggtgccaacgcaagaacatatgccagttcctcgtagagattggactggctaaggacgatcagctgaaggttcatgggttttaagtgcttgtggctcactgaagcttaagtgaggatttccttgcaatgagtagaatttcccttctctcccttgtcacaggtttaaaaacctcacagcttgtataatgtaaccatttggggtccgcttttaacttggactagtgtaactccttcatgcaataaactgaaaagagccatgctgtctagtcttgaagtccctcatttaaacagaggtcaagcaataggcgcctggcagtgtcaagcctgaaaccaagcaataccgtcatgtttcagccaagcccagagccctaagattacaaacaactatggccggaacctcctcagctctccctctgcagagttccctaccctaagagaatgttaccacctgaacagtcctcggtgaatctgagaggagaggatggggtaaggcagaagcaccagctgtactactagaagggagcttttggtggtagatcccctggtgtctccaacctgactaggtggacagagctcaaagaggccctcttaccgctagcgaggtgataggacatctggcttgccacaaaggtctgttcgaccagacatatcctagctaagggatgtccaaacatcagaatgtgaggccaaccttctatcagagttaactttgacaagggaacaaatctcaaactgatccatcagtcatgtagctagctgtagagcttgcaacttaatagcagcagctgcccaatgccatgtgaagtaacaaactggttttaggtttttttttccccttcagttttaatgtcatgtgtaatgtatttaaacccttatttacataaacntgtttcagaannagaaaaancacaccaacaag

SEQ ID NO: 36274 - DNA, 940 bp, Homo sapiens
  misc_feature (908)..(908): n is a, c, g, or t
  misc_feature (919)..(920): n is a, c, g, or t
  misc_feature (928)..(928): n is a, c, g, or t
gccattagaaatggaggctttaactctccctgtcccccatttaaaactttgcccttttgtcttttcctggctaaggacgatcagctgaaggttcatgggttttaagtgcttgtggctcactgaagcttaagtgaggatttccttgcaatgagtagaatttcccttctctcccttgtcacaggtttaaaaacctcacagcttgtataatgtaaccatttggggtccgcttttaacttggactagtgtaactccttcatgcaataaactgaaaagagccatgctgtctagtcttgaagtccctcatttaaacagaggtcaagcaataggcgcctggcagtgtcaagcctgaaaccaagcaataccgtcatgtttcagccaagcccagagccctaagattacaaacaactatggccggaacctcctcagctctccctctgcagagttccctaccctaagagaatgttaccacctgaacagtcctcggtgaatctgagaggagaggatggggtaaggcagaagcaccagctgtactactagaagggagcttttggtggtagatcccctggtgtctccaacctgactaggtggacagagctcaaagaggccctcttaccgctagcgaggtgataggacatctggcttgccacaaaggtctgttcgaccagacatatcctagctaagggatgtccaaacatcagaatgtgaggccaaccttctatcagagttaactttgacaagggaacaaatctcaaactgatccatcagtcatgtagctagctgtagagcttgcaacttaatagcagcagctgcccaatgccatgtgaagtaacaaactggttttaggtttttttttccccttcagttttaatgtcatgtgtaatgtatttaaacccttatttacataaacntgtttcagaannagaaaaancacaccaacaag

SEQ ID NO: 36275 - DNA, 870 bp, Homo sapiens
  misc_feature (838)..(838): n is a, c, g, or t
  misc_feature (849)..(850): n is a, c, g, or t
  misc_feature (858)..(858): n is a, c, g, or t
cggtccgtgtgtagacgtggcttgtgggttgaccgtgggttgtggctcactgaagcttaagtgaggatttccttgcaatgagtagaatttcccttctctcccttgtcacaggtttaaaaacctcacagcttgtataatgtaaccatttggggtccgcttttaacttggactagtgtaactccttcatgcaataaactgaaaagagccatgctgtctagtcttgaagtccctcatttaaacagaggtcaagcaataggcgcctggcagtgtcaagcctgaaaccaagcaataccgtcatgtttcagccaagcccagagccctaagattacaaacaactatggccggaacctcctcagctctccctctgcagagttccctaccctaagagaatgttaccacctgaacagtcctcggtgaatctgagaggagaggatggggtaaggcagaagcaccagctgtactactagaagggagcttttggtggtagatcccctggtgtctccaacctgactaggtggacagagctcaaagaggccctcttaccgctagcgaggtgataggacatctggcttgccacaaaggtctgttcgaccagacatatcctagctaagggatgtccaaacatcagaatgtgaggccaaccttctatcagagttaactttgacaagggaacaaatctcaaactgatccatcagtcatgtagctagctgtagagcttgcaacttaatagcagcagctgcccaatgccatgtgaagtaacaaactggttttaggtttttttttccccttcagttttaatgtcatgtgtaatgtatttaaacccttatttacataaacntgtttcagaannagaaaaancacaccaacaag

SEQ ID NO: 36276 - DNA, 977 bp, Homo sapiens
  misc_feature (4)..(4): n is a, c, g, or t
  misc_feature (20)..(20): n is a, c, g, or t
  misc_feature (31)..(31): n is a, c, g, or t
  misc_feature (54)..(54): n is a, c, g, or t
  misc_feature (70)..(70): n is a, c, g, or t
tacncacaaggaacaagtgngtccaccgtgngcgttaaatagtgatcccgggtncagaatcgcagagcangtcgtccccctgccggcttctccgccgccgccgccttccgcaggccgtttccaccgaggaaaaggaatcgtatcgtatgtccgctatccagaacctccactctttcgacccctttgctgatgcaagtaagggtgatgacctgcttcctgctggcactgaggattatatccatataagaattcaacagagaaacggcaggaagacccttactactgtccaagggatcgctgatgattacgataaaaagaaactagtgaaggcgtttaagaaaaagtttgcctgcaatggtactgtaattgagcatccggaatatggagaagtaattcagctacagggtgaccaacgcaagaacatatgccagttcctcgtagagattggactggctaaggacgatcagctgaaggttcatgggttttaagtgcttgtggctcactgaagcttaagtgaggatttccttgcaatgagtagaatttcccttctctcccttgtcacaggtttaaaaacctcacagcttgtataatgtaaccatttggggtccgcttttaacttggactagtgtaactccttcatgcaataaactgaaaagagccatgctgtctagtcttgaagtccctcatttaaacagaggtcaagcaataggcgcctggcagtgtcaagcctgaaaccaagcaatgacaaggtttcagccaagccaagaaccccaagatcacaggaggctatgtctgaccagaggctccttggggctccctggacagagtcccctgccctaggagagtgtcaccactttgaacagaatgggtaacactgccccagctatgtcactagagggagtctctggccctggtatctgaccagggtagaattcagaaaggggctaccttttccagaggaagtcaatgggacattt

SEQ ID NO: 36277 - DNA, 938 bp, Homo sapiens
  misc_feature (4)..(4): n is a, c, g, or t
  misc_feature (20)..(20): n is a, c, g, or t
  misc_feature (31)..(31): n is a, c, g, or t
  misc_feature (54)..(54): n is a, c, g, or t
  misc_feature (70)..(70): n is a, c, g, or t
tacncacaaggaacaagtgngtccaccgtgngcgttaaatagtgatcccgggtncagaatcgcagagcangtcgtccccctgccggcttctccgccgccgccgccttccgcaggccgtttccaccgaggaaaaggaatcgtatcgtatgtccgctatccagaacctccactctttcgacccctttgctgatgcaagtaagggtgatgacctgcttcctgctggcactgaggattatatccatataagaattcaacagagaaacggcaggaagacccttactactgtccaagggatcgctgatgattacgataaaaagaaactagtgaaggcgtttaagaaaaagtttgcctgcaatggtactgtaattgagcatccggaatatggagaagtaattcagctacagggtgaccaacgcaagaacatatgccagttcctcgtagagattggactggctaaggacgatcagctgaaggttcatgggttttaagtgcttgtggctcactgaagcttaagtgaggatttccttgcaatgagtagaatttcccttctctcccttgtcacaggtttaaaaacctcacagcttgtataatgtaaccatttggggtccgcttttaacttggactagtgtaactccttcatgcaataaactgaaaagagccatgctgtctagtcttgaagtccctcatttaaacagaggtcaagcaataggcgccgggcagtggtcaagcctggaaaccaaggcaaaacggcctgggtcaggcaggccagaggctaagattccaacactatggcggaacctctcagtctcctctgcgagatcctaactagagacggtcccccggcccggggaacggagggcggcggggagggaaacccggggacccagggcacgggggacaccgggtgcacaccagggcggagcacccccccgacagcg

SEQ ID NO: 36278 - DNA, 1272 bp, Homo sapiens
  misc_feature (4)..(4): n is a, c, g, or t
  misc_feature (20)..(20): n is a, c, g, or t
  misc_feature (31)..(31): n is a, c, g, or t
  misc_feature (54)..(54): n is a, c, g, or t
  misc_feature (70)..(70): n is a, c, g, or t
  misc_feature (1240)..(1240): n is a, c, g, or t
  misc_feature (1251)..(1252): n is a, c, g, or t
  misc_feature (1260)..(1260): n is a, c, g, or t
tacncacaaggaacaagtgngtccaccgtgngcgttaaatagtgatcccgggtncagaatcgcagagcangtcgtccccctgccggcttctccgccgccgccgccttccgcaggccgtttccaccgaggaaaaggaatcgtatcgtatgtccgctatccagaacctccactctttcgacccctttgctgatgcaagtaagggtgatgacctgcttcctgctggcactgaggattatatccatataagaattcaacagagaaacggcaggaagacccttactactgtccaagggatcgctgatgattacgataaaaagaaactagtgaaggcgtttaagaaaaagtttgcctgcaatggtactgtaattgagcatccggaatatggagaagtaattcagctacagggtgaccaacgcaagaacatatgccagttcctcgtagagattggactggctaaggacgatcagctgaaggttcatgggttttaagtgcttgtggctcactgaagcttaagtgaggatttccttgcaatgagtagaatttcccttctctcccttgtcacaggtttaaaaacctcacagcttgtataatgtaaccatttggggtccgcttttaacttggactagtgtaactccttcatgcaataaactgaaaagagccatctggcagtgtcaagcctgaaaccaagcaataccgtcatgtttcagccaagcccagagccctaagattacaaacaactatggccggaacctcctcagctctccctctgcagagttccctaccctaagagaatgttaccacctgaacagtcctcggtgaatctgagaggagaggatggggtaaggcagaagcaccagctgtactactagaagggagcttttggtggtagatcccctggtgtctccaacctgactaggtggacagagctcaaagaggccctcttaccgctagcgaggtgataggacatctggcttgccacaaaggtctgttcgaccagacatatcctagctaagggatgtccaaacatcagaatgtgaggccaaccttctatcagagttaactttgacaagggaacaaatctcaaactgatccatcagtcatgtagctagctgtagagcttgcaacttaatagcagcagctgcccaatgccatgtgaagtaacaaactggttttaggtttttttttccccttcagttttaatgtcatgtgtaatgtatttaaacccttatttacataaacntgtttcagaannagaaaaancacaccaacaag

SEQ ID NO: 36279 - DNA, 723 bp, Homo sapiens
  misc_feature (4)..(4): n is a, c, g, or t
  misc_feature (20)..(20): n is a, c, g, or t
  misc_feature (31)..(31): n is a, c, g, or t
  misc_feature (54)..(54): n is a, c, g, or t
  misc_feature (70)..(70): n is a, c, g, or t
tacncacaaggaacaagtgngtccaccgtgngcgttaaatagtgatcccgggtncagaatcgcagagcangtcgtccccctgccggcttctccgccgccgccgccttccgcaggccgtttccaccgaggaaaaggaatcgtatcgtatgtccgctatccagaacctccactctttcgacccctttgctgatgcaagtaagggtgatgacctgcttcctgctggcactgaggattatatccatataagaattcaacagagaaacggcaggaagacccttactactgtccaagggatcgctgatgattacgataaaaagaaactagtgaaggcgtttaagaaaaagtttgcctgcaatggtactgtaattgagcatccggaatatggagaagtaattcagctacagggtgaccaacgcaagaacatatgccagttcctcgtagagattggactggctaaggacgatcagctgaaggttcatgggttttaagtgcttgtggctcactgaagcttaagtgaggatttccttgcaatgagtagaatttcccttctctcccttgtcacaggtttaaaaacctcacagcttgtataatgtaaccatttggggtccgcttttaacttggactagtgtaactccttcatgcaataaactgaaaagagccatgctggatgcggccggaaccccgcctcagctctaactacgtcatccgtccaaaacaaacatt

SEQ ID NO: 36280 - DNA, 1419 bp, Homo sapiens
  misc_feature (50)..(50): n is a, c, g, or t
  misc_feature (1387)..(1387): n is a, c, g, or t
  misc_feature (1398)..(1399): n is a, c, g, or t
  misc_feature (1407)..(1407): n is a, c, g, or t
ggcacgatcggcacgagtggcagcccggactcccccgacatgtgatcggnttcccagggagggcgggaggcccgggcgttccccgagcctggggaagctggccgtcccggactgacctgctcggggagagccagcaaaggacacattcggcctggcccaagccctgacgatttcagtgttgttttctgcacgcgcaaaacacctggggaccgaggggatggcagtggcatcctatctttgacagctctgaacgagcttaaccttttttttcagacccctttgctgatgcaagtaagggtgatgacctgcttcctgctggcactgaggattatatccatataagaattcaacagagaaacggcaggaagacccttactactgtccaagggatcgctgatgattacgataaaaagaaactagtgaaggcgtttaagaaaaagtttgcctgcaatggtactgtaattgagcatccggaatatggagaagtaattcagctacagggtgaccaacgcaagaacatatgccagttcctcgtagagattggactggctaaggacgatcagctgaaggttcatgggttttaagtgcttgtggctcactgaagcttaagtgaggatttccttgcaatgagtagaatttcccttctctcccttgtcacaggtttaaaaacctcacagcttgtataatgtaaccatttggggtccgcttttaacttggactagtgtaactccttcatgcaataaactgaaaagagccatgctgtctagtcttgaagtccctcatttaaacagaggtcaagcaataggcgcctggcagtgtcaagcctgaaaccaagcaataccgtcatgtttcagccaagcccagagccctaagattacaaacaactatggccggaacctcctcagctctccctctgcagagttccctaccctaagagaatgttaccacctgaacagtcctcggtgaatctgagaggagaggatggggtaaggcagaagcaccagctgtactactagaagggagcttttggtggtagatcccctggtgtctccaacctgactaggtggacagagctcaaagaggccctcttaccgctagcgaggtgataggacatctggcttgccacaaaggtctgttcgaccagacatatcctagctaagggatgtccaaacatcagaatgtgaggccaaccttctatcagagttaactttgacaagggaacaaatctcaaactgatccatcagtcatgtagctagctgtagagcttgcaacttaatagcagcagctgcccaatgccatgtgaagtaacaaactggttttaggtttttttttccccttcagttttaatgtcatgtgtaatgtatttaaacccttatttacataaacntgtttcagaannagaaaaancacaccaacaag

SEQ ID NO: 36281 - DNA, 1269 bp, Homo sapiens
  misc_feature (4)..(4): n is a, c, g, or t
  misc_feature (20)..(20): n is a, c, g, or t
  misc_feature (31)..(31): n is a, c, g, or t
  misc_feature (54)..(54): n is a, c, g, or t
  misc_feature (70)..(70): n is a, c, g, or t
  misc_feature (1237)..(1237): n is a, c, g, or t
  misc_feature (1248)..(1249): n is a, c, g, or t
  misc_feature (1257)..(1257): n is a, c, g, or t
tacncacaaggaacaagtgngtccaccgtgngcgttaaatagtgatcccgggtncagaatcgcagagcangtcgtccccctgccggcttctccgccgccgccgccttccgcaggccgtttccaccgaggaaaaggaatcgtatcgtatgtccgctatccagaacctccactctttcgacccctttgctgatgcaagtaagggtgatgacctgcttcctgctggcactgaggattatatccatataagaattcaacagagaaacggcaggaagacccttactactgtccaagggatcgctgatgattacgataaaaagaaactagtgaaggcgtttaagaaaaagtttgcctgcaatggtactgtaattgagcatccggaatatggagaagtaattcagctacagggtgaccaacgcaagaacatatgccagttcctcgtagagattggactggctaaggacgatcagctgaaggttcatgggttttaagtgcttgtggctcactgaagcttaagtgaggatttccttgcaatgagtagaatttcccttctctcccttgtcacaggtttaaaaacctcacagcttgtataatgtaaccatttggggtccgcttttaacttggactagtgtaactccttcatgcaataaactgaaaagagccatgctgtctagtcttgaagtccctcatttaaacagaggtcaagcaataggcgcctggcagtgtcaagcctgaaaccaagcaataccgtcatgtttcagccaagcccagagccctaagattacaaacaactatggccggaacctcctcagctctccctctgcagagttccctaccctaagagaatgttaccacctgaacagtcctcggtgaatctgagaggagaggatggggtaaggctctccaacctgactaggtggacagagctcaaagaggccctcttaccgctagcgaggtgataggacatctggcttgccacaaaggtctgttcgaccagacatatcctagctaagggatgtccaaacatcagaatgtgaggccaaccttctatcagagttaactttgacaagggaacaaatctcaaactgatccatcagtcatgtagctagctgtagagcttgcaacttaatagcagcagctgcccaatgccatgtgaagtaacaaactggttttaggtttttttttccccttcagttttaatgtcatgtgtaatgtatttaaacccttatttacataaacntgtttcagaannagaaaaancacaccaacaag

SEQ ID NO: 36282 - DNA, 502 bp, Homo sapiens
  misc_feature (4)..(4): n is a, c, g, or t
  misc_feature (20)..(20): n is a, c, g, or t
  misc_feature (31)..(31): n is a, c, g, or t
  misc_feature (54)..(54): n is a, c, g, or t
  misc_feature (70)..(70): n is a, c, g, or t
tacncacaaggaacaagtgngtccaccgtgngcgttaaatagtgatcccgggtncagaatcgcagagcangtcgtccccctgccggcttctccgccgccgccgccttccgcaggccgtttccaccgaggaaaaggaatcgtatcgtatgtccgctatccagaacctccactctttcgaaaaaagtttgcctgcaatggtactgtaattgagcatccggaatatggagaagtaattcagctacagggtgaccaacgcaagaacatatgccagttcctcgtagagattggactggctaaggacgatcagctgaaggttcatgggttttaagtgcttgtggctcactgaagcttaagtgaggatttccttgcaatgagtagaatttcccttctctcccttgtcacaggtttaaaaacctcacagcttgtataatgtaaccatttggggtccgcttttaacttggactagtgtaactccttcatgcaataaactgaaaagagccat

SEQ ID NO: 36283 - DNA, 968 bp, Homo sapiens
  misc_feature (4)..(4): n is a, c, g, or t
  misc_feature (20)..(20): n is a, c, g, or t
  misc_feature (31)..(31): n is a, c, g, or t
  misc_feature (54)..(54): n is a, c, g, or t
  misc_feature (70)..(70): n is a, c, g, or t
tacncacaaggaacaagtgngtccaccgtgngcgttaaatagtgatcccgggtncagaatcgcagagcangtcgtccccctgccggcttctccgccgccgccgccttccgcaggccgtttccaccgaggaaaaggaatcgtatcgtatgtccgctatccagaacctccactctttcgacccctttgctgatgcaagtaagggtgatgacctgcttcctgctggcactgaggattatatccatataagaattcaacagagaaacggcaggaagacccttactactgtccaagggatcgctgatgattacgataaaaagaaactagtgaaggcgtttaagaaaaagtttgcctgcaatggtactgtaattgagcatccggaatatggagaagtaattcagctacagggtgaccaacgcaagaacatatgccagttcctcgtagagattggactggctaaggacgatcagctgaaggttcatgggttttaagtgcttgtggctcactgaagcttaagtgaggatttccttgcaatgagtagaatttcccttctctcccttgtcacaggtttaaaaacctcacagcttgtataatgtaaccatttggggtccgcttttaacttggactagtgtaactccttcatgcaataaactgaaaagagccataaaaaaaaaaaaaaaaaaaaaaacaccggggggacctatatagcgggggcgcgggggaaacacaggggcacgagaaggggccaggggcaaaaggggaaccgggacccaacttccgggacaaagggggaaaactcggcgggcccccaataaagaagtcgataaaatcaaaaaacccgggatacccggggaaaggaaccccgagaaaaaacacccgaccgcacccccacccacccccacccagcacacccaccccacccacccgcaccagagccaacacacaagcaacaaccacacccccaccaacac

SEQ ID NO: 36284 - DNA, 444 bp, Homo sapiens
gcggccgccttcggagcgccgccctcctcccgaaaccggccggggcgagtggctgcaagaagctgcggtttggcccgcgggagaggggggcttccccgctggggttgtctgacgcgaacgccttcctggccccagccaggcgccctgagatgatgaaggtttaagaagcagcatcatcagcgaactgtgttttgaagatttgagggaagggctgacctcaggattttatactagttgctgacctccataacagcagacaaaattggaagcaagagtgattttggaggagtcacacttagatgtttcccttacctatttctgttctggaaatttaaaaatcttacttctcgtgacagtcctacatgaaaaattaaaaatcacaaggattcatggatggaaaactgagactcagagaatgatcacattcacatcgtaataaatcag

SEQ ID NO: 36285 - DNA, 530 bp, Homo sapiens
acaaagtggagaaggaaacgctgggaaatctggaagtcagacatgagagctaatgctggcagctgttgggatgtcctcttccaggaatggtgatgagtttccctggatccagccctggcttggctgagggattattttcagacctcatgaagctgctggcttatagaacaggagtctttctgttggcagccaggagagatacaagagggggaggacagattctgcagctccatttcgtccttggaacaggagaaagggttggaaaacaaagatcacttttctctggccaaatggaatcacccaacaaagtaccttcctgatgggccagctatttcagatgatgaaggtttaagaagcagcatcatcagcgaactgtgttttgaagatttgagggaagggctgacctcaggattttatactaggtttgtgtaaacacacaggattctttttctctctgtcccaaatttaatcatcgcactcattcaaatgaaatatgaagtcataagtattaaaatatgcatgagattttg

SEQ ID NO: 36286 - DNA, 609 bp, Homo sapiens
gcggccgccttcggagcgccgccctcctcccgaaaccggccggggcgagtggctgcaagaagctgcggtttggcccgcgggagaggggggcttccccgctggggttgtctgacgcgaacgccttcctggccccagccaggcgccctgagagagctaatgctggcagctgttgggatgtcctcttccaggaatggtgatgagtttccctggatccagccctggcttggctgagatgatgaaggtttaagaagcagcatcatcagcgaactgtgttttgaagatttgagggaagggctgacctcaggattttatactaggtatttgatgcaatgcagactggaatcctccccacaaggatgccctggcctgagtggcacagagatcaatgcagcagtcatttcctgggcggggaaagcccatccacagtggccctggaatgatgctggtcttaccttctattcctaggaaggccctatctcaagtggctctggtccatgcaaacagatggaaacgggtgtggggaagcacaggcctcctactcatgttaagagagctgctcagaggcaggaatccagaaccaggaatgtccccagtggctgcccaaggtac

SEQ ID NO: 36287 - DNA, 5000 bp, Homo sapiens
  misc_feature (1124)..(1124): n is a, c, g, or t
agaagaaggggagaggaggttgtgtgggacaaggtgctcctgacagaaggatgccacagctgagcctgtcctcgctgggcctttggccaatggcagcatccccgtggctgctcctgctgctggttggggcctcctggctcctggcccgcatcctggcctggacctataccttctatgacaactgctgccgcctccggtgtttcccgcaacccccgaaacggaattggttcttgggtcacctgggcctgattcacagctcggaggaaggtctcctatacacacaaagcctggcatgcaccttcggtgatatgtgctgctggtgggtggggccctggcacgcaatcgtccgcatcttccaccccacctacatcaagcctgtgctctttgctccagctgccattgtaccaaaggacaaggtcttctacagcttcctgaagccctggctgggggatgggctcctgctgagtgctggtgaaaagtggagccgccaccgtcggatgctgacgcctgccttccatttcaacatcctgaagccctatatgaagattttcaatgagagtgtgaacatcatgcatgccaagtggcagctcctggcctcagagggtagtgcccgtctggacatgtttgagcacatcagcctcatgaccttggacagtctgcagaaatgtgtcttcagctttgacagccattgccaggagaagcccagtgaatatattgccgccatcttggagctcagtgcccttgtgacaaaaagacaccagcagatcctcctgtacatagacttcctgtattatctcacccctgatgggcagcgtttccgcagggcctgccgcctggtgcacgacttcacagatgccgtcatccaggagcggcgccgcaccctccctagccagggtgttgatgacttcctccaagccaaggccaaatccaagactttggacttcattgatgtactcctgctgagcaaggatgaagatgggaagaagttgtccgatgaggacataagagcagaagctgacacctttatgtttgagggccatgacaccacagccagtggtctctcctgggtcctgtaccaccttgcaaagcacccggaataccaggagcgctgtcggcaggaggtncaagagcttctgaaggaccgtgagcctaaagagattgaatgggacgacctggcccagctgcccttcctgaccatgtgcattaaggagagcctgaggctgcatcccccagtccctgccgtctctcgctgctgcacccaagacattgtgctcccagacggccgggtcatccccaaaggcattatctgcctcatcagtgtttttggaacccatcacaacccagccgtgtggccggaccctgaggtctatgacccctttcgctttgacccaaagaacatcaaggagaggtcacctctggcttttattcccttctcagcagggcccaggaactgcatcgggcaggcgttcgcgatggcggagatgaaggtggtcctggggctcacgctgctggccttccgcgtcctgcctgaccacaccgagccccgcaggaagccggagctggtcctgcgcgcagagggcggactttggctgcgggtggagcccctgagctgagttctgcagagacccactctgaccccactaaaatgacccctgattcatcaaaagtgaggcctagaattaccctaagaccctgttccacagtcctgtattccatcctagatatctactcaaaataattgagacaagtgttcaaacagaaagacgcttgtgcggaatgttcatggcagccctattcacagtagcccaaacgatgaaaacaccccaagctatatattaccagataaaaggataaacacaatatggtccatccatacactggagtattacacagccataaaaaggaatgaagcagtgatccccactacactgtggatgaaccttgaatgcatgatactgaatgaaagacatcagatgcaaaaggtcacatagtgtactgtccttttatatgaaatttccagaacaggccaatctgaagagatgtatagtggattggtggctttcagcagctgtggggaggtgggactgaggagcgactgctaatcaggatggggtttcctcctgggatggtgaaaatgttccggacctagatagtgatgaaggtagcacgacactgtgagtgcactaaatgctattgaattagacactttagaatggttgaaatagtgatttttatgtgaattctacctaaacatgctattacagctcatatatactttttccatctggattcttcacaaaagaatatgttgtgagcatctttccatgatattaaatcatcttaggaaacattattttgtgttcttcaaaatgtgcatgttaagtattcaaatcagtcttaaatttttaaaaatatgtaattttagaaaataatttaaaaggttttgtttcagtttgtaagatttcttttctggcactttaatggcttgaggtatcattatcagttacaaattgagttattcttcatcaaatgacttttggagtagagattttatttttatagcaatagatgcacagatattcctgtaagatacaggtgtggttagacacttttctagaacaggcatgccctgcaaactccacagacactgactgtttttgtcctatgaacaagcagaccactgagaagggagaaggtgacattttagctttcccaggtaaaagtggttttcatcctcacaccaattttatggactggacgttaactctcttgctcaaggtcactctgtgagtggaagagtggggataaatctggttcgtttggcatcagaggccatgacttttcctaccacagaagtaattttcaaagtaagtctctgccctaggcacatcagatcacctggggaccactccagagtgagtagacaagactttgacaggggtgcctaatttttttttttttttgagatggagtctcgctctgttgcccaggctggagtgcggtggcatgatctcggttcattgcaacctccgcctcctgcgttcgggtgattgacctgtctcggcctcccgggtggctgggattgcaggcacccaccaccacgtccagctaattgttgtatttttgatagaggcggggtttcgccatgttacactggctggtgttgaactcctaacctcaggtgatccacctgcctcggcctcccaaagtgctgggattacaggcctggcccagtttgatagtttgttatcatgttatacgtacacttagaataatgatccagccatctcattctaacagcaatgagaacttaggctcccctctctactaaaatacaaaagttagctggtcatggtggtgcgggcctgtggtcccagctgctcgggaggttgatgcaggagaatcacttgaaacccacaggcggaggttgcagtgggctggggtggtgccactgcgctccagcctgggggagggggacatagcgagactcggtctcaaaaacaaaacaaaacaaaacaaaacaaaaacaaaacaaaacaaaacaaaacactgccaaactgtttccaaagcatctgcatcgtgtttaatttccataagtaacgtatgagaattctaggtcctccaaataattagcagtccttcgtagtgtcagtttttgtttcagccttccttatgggtatgctgtggcatatccctgagattttaattcgcattttccagtgactaagggtgttgaaccactcgtgccttcctgtgcctatttgacactcctatattttctttggtgaagtgtctgttcaatcatctgctcattaaattttccttcggttgtttgccttcttattgttggattttgagagttctatgtacaagtcctttgtcagtcgtgtgatttgcaagtcttcttcctagtctctgaagtttctttctttcatagagcaaacgttttaaatttttatgaagtaagacttctcagttttatttttggtgaattatgtttatactgccatatataggaactctttgcttaactggaggtcatggagattttctcctacattttcttttaaaagttttatagtttcagagtttacatgtaattccataatctccatttagttaaattttgtatggggtgtgaactgtggtttgactgttttcttgtatatggatatccaattgtttcacacaatttttttgaaaagaatatccttggcagggcacggtagctcacacctgtaatcccagcactttaggaggtcaaggtgggcagatcatgaggtcaggagtttgagaccagcctggccaatatggtgaaaccacgtctctattaaaaataggcaggagaatcgcttgaacccaggagtcagaggtttcagtgagccgagattgtgccactgcactccagcctgggtgaaagagctagattctctctctcaaaaaaaaaaaaaaaaaggaaagaaagaaagaaaagaaaagaaaatcctttttgctttaacttgccttgcaggtttgtagaaaactcaattgttgaaatttgggtggatatatttctggattttctattctattccatgttggaccaataccacactgccctagtcactgttgcattatagtatatctttaaaggagtaatgggaatccttcaactacatttttttccccaataatttttggctattctgcttcttttgtgtttctatgtaaattttatcatcagtgtgtctatttctacaaatagtcctgatagggtttgaattgggatttctgtgaatctatagatcaatctgaggagacttaataatgatattgattctcccaattcatgaatatagtatacccctgtatttatttgttttcttgaatttcttttatcattgttttgtagttttcaccatgacagtcttgcacatattttgttaaatgtacagctgagaatttaattttttctggtgtacaatgctaataaaatggtgctttaaaagatgtgttcttca

SEQ ID NO: 36288 - DNA, 4628 bp, Homo sapiens
  misc_feature (1124)..(1124): n is a, c, g, or t
agaagaaggggagaggaggttgtgtgggacaaggtgctcctgacagaaggatgccacagctgagcctgtcctcgctgggcctttggccaatggcagcatccccgtggctgctcctgctgctggttggggcctcctggctcctggcccgcatcctggcctggacctataccttctatgacaactgctgccgcctccggtgtttcccgcaacccccgaaacggaattggttcttgggtcacctgggcctgattcacagctcggaggaaggtctcctatacacacaaagcctggcatgcaccttcggtgatatgtgctgctggtgggtggggccctggcacgcaatcgtccgcatcttccaccccacctacatcaagcctgtgctctttgctccagctgccattgtaccaaaggacaaggtcttctacagcttcctgaagccctggctgggggatgggctcctgctgagtgctggtgaaaagtggagccgccaccgtcggatgctgacgcctgccttccatttcaacatcctgaagccctatatgaagattttcaatgagagtgtgaacatcatgcatgccaagtggcagctcctggcctcagagggtagtgcccgtctggacatgtttgagcacatcagcctcatgaccttggacagtctgcagaaatgtgtcttcagctttgacagccattgccaggagaagcccagtgaatatattgccgccatcttggagctcagtgcccttgtgacaaaaagacaccagcagatcctcctgtacatagacttcctgtattatctcacccctgatgggcagcgtttccgcagggcctgccgcctggtgcacgacttcacagatgccgtcatccaggagcggcgccgcaccctccctagccagggtgttgatgacttcctccaagccaaggccaaatccaagactttggacttcattgatgtactcctgctgagcaaggatgaagatgggaagaagttgtccgatgaggacataagagcagaagctgacacctttatgtttgagggccatgacaccacagccagtggtctctcctgggtcctgtaccaccttgcaaagcacccggaataccaggagcgctgtcggcaggaggtncaagagcttctgaaggaccgtgagcctaaagagattgaatgggacgacctggcccagctgcccttcctgaccatgtgcattaaggagagcctgaggctgcatcccccagtccctgccgtctctcgctgctgcacccaagacattgtgctcccagacggccgggtcatccccaaaggcattatctgcctcatcagtgtttttggaacccatcacaacccagccgtgtggccggaccctgaggtctatgacccctttcgctttgacccaaagaacatcaaggagaggtcacctctggcttttattcccttctcagcagggcccaggaactgcatcgggcaggcgttcgcgatggcggagatgaaggtggtcctggggctcacgctgctggccttccgcgtcctgcctgaccacaccgagccccgcaggaagccggagctggtcctgcgcgcagagggcggactttggctgcgggtggagcccctgagctgagttctgcagagacccactctgaccccactaaaatgacccctgattcatcaaaagtgaggcctagaattaccctaagaccctgttccacagtcctgtattccatcctagatatctactcaaaataattgagacaagtgttcaaacagaaagacgcttgtgcggaatgttcatggcagccctattcacagtagcccaaacgatgaaaacaccccaagctatatattaccagataaaaggataaacacaatatggtccatccatacactggagtattacacagccataaaaaggaatgaagcagtgatccccactacactgtggatgaaccttgaatgcatgatactgaatgaaagacatcagatgcaaaaggtcacatagtgtactgtccttttatatgaaatttccagaacaggccaatctgaagagatgtatagtggattggtggctttcagcagctgtggggaggtgggactgaggagcgactgctaatcaggatggggtttcctcctgggatggtgaaaatgttccggacctagatagtgatgaaggtagcacgacactgtgagtgcactaaatgctattgaattagacactttagaatggttgaaatagtgatttttatgtgaattctacctaaacatgctattacagctcatatatactttttccatctggattcttcacaaaagaatatgttgtgagcatctttccatgatattaaatcatcttaggaaacattattttgtgttcttcaaaatgtgcatgttaagtattcaaatcagtcttaaatttttaaaaatatgtaattttagaaaataatttaaaaggttttgtttcagtttgtaagatttcttttctggcactttaatggcttgaggtatcattatcagttacaaattgagttattcttcatcaaatgacttttggagtagagattttatttttatagcaatagatgcacagatattcctgtaagatacaggtgtggttagacacttttctagaacaggcatgccctgcaaactccacagacactgactgtttttgtcctatgaacaagcagaccactgagaagggagaaggtgacattttagctttcccaggtaaaagtggttttcatcctcacaccaattttatggactggacgttaactctcttgctcaaggtcactctgtgagtggaagagtggggataaatctggttcgtttggcatcagaggccatgacttttcctaccacagaagtaattttcaaagtaagtctctgccctaggcacatcagatcacctggggaccactccagagtgagtagacaagactttgacaggggtgcctaatttttttttttttttgagatggagtctcgctctgttgcccaggctggagttgcagtgggctggggtggtgccactgcgctccagcctgggggagggggacatagcgagactcggtctcaaaaacaaaacaaaacaaaacaaaacaaaaacaaaacaaaacaaaacaaaacactgccaaactgtttccaaagcatctgcatcgtgtttaatttccataagtaacgtatgagaattctaggtcctccaaataattagcagtccttcgtagtgtcagtttttgtttcagccttccttatgggtatgctgtggcatatccctgagattttaattcgcattttccagtgactaagggtgttgaaccactcgtgccttcctgtgcctatttgacactcctatattttctttggtgaagtgtctgttcaatcatctgctcattaaattttccttcggttgtttgccttcttattgttggattttgagagttctatgtacaagtcctttgtcagtcgtgtgatttgcaagtcttcttcctagtctctgaagtttctttctttcatagagcaaacgttttaaatttttatgaagtaagacttctcagttttatttttggtgaattatgtttatactgccatatataggaactctttgcttaactggaggtcatggagattttctcctacattttcttttaaaagttttatagtttcagagtttacatgtaattccataatctccatttagttaaattttgtatggggtgtgaactgtggtttgactgttttcttgtatatggatatccaattgtttcacacaatttttttgaaaagaatatccttggcagggcacggtagctcacacctgtaatcccagcactttaggaggtcaaggtgggcagatcatgaggtcaggagtttgagaccagcctggccaatatggtgaaaccacgtctctattaaaaatagaaaaattagccaggcgtggtggtgtgtgcctgtattcacagctgcttggatggctgaggcaggagaatcgcttgaacccaggagtcagaggtttcagtgagccgagattgtgccactgcactccagcctgggtgaaagagctagattctctctctcaaaaaaaaaaaaaaaaaggaaagaaagaaagaaaagaaaagaaaatcctttttgctttaacttgccttgcaggtttgtagaaaactcaattgttgaaatttgggtggatatatttctggattttctattctattccatgttggaccaataccacactgccctagtcactgttgcattatagtatatctttaaaggagtaatgggaatccttcaactacatttttttccccaataatttttggctattctgcttcttttgtgtttctatgtaaattttatcatcagtgtgtctatttctacaaatagtcctgatagggtttgaattgggatttctgtgaatctatagatcaatctgaggagacttaataatgatattgattctcccaattcatgaatatagtatacccctgtatttatttgttttcttgaatttcttttatcattgttttgtagttttcaccatgacagtcttgcacatattttgttaaatgtacagctgagaatttaattttttctggtgtacaatgctaataaaatggtgctttaaaagatgtgttcttca

SEQ ID NO: 36289 - DNA, 3751 bp, Homo sapiens
  misc_feature (1124)..(1124): n is a, c, g, or t
agaagaaggggagaggaggttgtgtgggacaaggtgctcctgacagaaggatgccacagctgagcctgtcctcgctgggcctttggccaatggcagcatccccgtggctgctcctgctgctggttggggcctcctggctcctggcccgcatcctggcctggacctataccttctatgacaactgctgccgcctccggtgtttcccgcaacccccgaaacggaattggttcttgggtcacctgggcctgattcacagctcggaggaaggtctcctatacacacaaagcctggcatgcaccttcggtgatatgtgctgctggtgggtggggccctggcacgcaatcgtccgcatcttccaccccacctacatcaagcctgtgctctttgctccagctgccattgtaccaaaggacaaggtcttctacagcttcctgaagccctggctgggggatgggctcctgctgagtgctggtgaaaagtggagccgccaccgtcggatgctgacgcctgccttccatttcaacatcctgaagccctatatgaagattttcaatgagagtgtgaacatcatgcatgccaagtggcagctcctggcctcagagggtagtgcccgtctggacatgtttgagcacatcagcctcatgaccttggacagtctgcagaaatgtgtcttcagctttgacagccattgccaggagaagcccagtgaatatattgccgccatcttggagctcagtgcccttgtgacaaaaagacaccagcagatcctcctgtacatagacttcctgtattatctcacccctgatgggcagcgtttccgcagggcctgccgcctggtgcacgacttcacagatgccgtcatccaggagcggcgccgcaccctccctagccagggtgttgatgacttcctccaagccaaggccaaatccaagactttggacttcattgatgtactcctgctgagcaaggatgaagatgggaagaagttgtccgatgaggacataagagcagaagctgacacctttatgtttgagggccatgacaccacagccagtggtctctcctgggtcctgtaccaccttgcaaagcacccggaataccaggagcgctgtcggcaggaggtncaagagcttctgaaggaccgtgagcctaaagagattgaatgggacgacctggcccagctgcccttcctgaccatgtgcattaaggagagcctgaggctgcatcccccagtccctgccgtctctcgctgctgcacccaagacattgtgctcccagacggccgggtcatccccaaaggcattatctgcctcatcagtgtttttggaacccatcacaacccagccgtgtggccggaccctgaggtctatgacccctttcgctttgacccaaagaacatcaaggagaggtcacctctggcttttattcccttctcagcagggcccaggaactgcatcgggcaggcgttcgcgatggcggagatgaaggtggtcctggggctcacgctgctggccttccgcgtcctgcctgaccacaccgagccccgcaggaagccggagctggtcctgcgcgcagagggcggactttggctgcgggtggagcccctgagctgagttctgcagagacccactctgaccccactaaaatgacccctgattcatcaaaagtgaggcctagaattaccctaagaccctgttccacagtcctgtattccatcctagatatctactcaaaataattgagacaagtgttcaaacagaaagacgcttgtgcggaatgttcatggcagccctattcacagtagcccaaacgatgaaaacaccccaagctatatattaccagataaaaggataaacacaatatggtccatccatacactggagtattacacagccataaaaaggaatgaagcagtgatccccactacactgtggatgaaccttgaatgcatgatactgaatgaaagacatcagatgcaaaaggtcacatagtgtactgtccttttatatgaaatttccagaacaggccaatctgaagagatgtatagtggattggtggctttcagcagctgtggggaggtgggactgaggagcgactgctaatcaggatggggtttcctcctgggatggtgaaaatgttccggacctagatagtgatgaaggtagcacgacactgtgagtgcactaaatgctattgaattagacactttagaatggttgaaatagtgatttttatgtgaattctacctaaacatgctattacagctcatatatactttttccatctggattcttcacaaaagaatatgttgtgagcatctttccatgatattaaatcatcttaggaaacattattttgtgttcttcaaaatgtgcatgttaagtattcaaatcagtcttaaatttttaaaaatatgtaattttagaaaataatttaaaaggttttgtttcagtttgtaagatttcttttctggcactttaatggcttgaggtatcattatcagttacaaattgagttattcttcatcaaatgacttttggagtagagattttatttttatagcaatagatgcacagatattcctgtaagatacaggtgtggttagacacttttctagaacaggcatgccctgcaaactccacagacactgactgtttttgtcctatgaacaagcagaccactgagaagggagaaggtgacattttagctttcccaggtaaaagtggttttcatcctcacaccaattttatggactggacgttaactctcttgctcaaggtcactctgtgagtggaagagtggggataaatctggttcgtttggcatcagaggccatgacttttcctaccacagaagtaattttcaaagtaagtctctgccctaggcacatcagatcacctggggaccactccagagtgagtagacaagactttgacaggggtgcctaatttttttttttttttgagatggagtctcgctctgttgcccaggctggagtgcggtggcatgatctcggttcattgcaacctccgcctcctgcgttcgggtgattgacctgtctcggcctcccgggtggctgggattgcaggcacccaccaccacgtccagctaattgttgtatttttgatagaggcggggtttcgccatgttacactggctggtgttgaactcctaacctcaggtgatccacctgcctcggcctcccaaagtgctgggattacaggcctggcccagtttgatagtttgttatcatgttatacgtacacttagaataatgatccagccatctcattctaacagcaatgagaacttaggctcccctctctactaaaatacaaaagttagctggtcatggtggtgcgggcctgtggtcccagctgctcgggaggttgatgcaggagaatcacttgaaacccacaggcggaggttgcagtgggctggggtggtgccactgcgctccagcctgggggagggggacatagcgagactcggtctcaaaaacaaaacaaaacaaaacaaaacaaaaacaaaacaaaacaaaacaaaacactgccaaactgtttccaaagcatctgcatcgtgtttaatttccataagtaacgtatgagaattctaggtcctccaaataattagcagtccttcgtagtgtcagtttttgtttcagccttccttatgggtatgctgtggcatatccctgagattttaattcgcattttccagtgacgttcctcatcaccgggatcctctaagt

SEQ ID NO: 36290 - DNA, 1442 bp, Homo sapiens
agaagaaggggagaggaggttgtgtgggacaaggtgctcctgacagaaggatgccacagctgagcctgtcctcgctgggcctttggccaatggcagcatccccgtggctgctcctgctgctggttggggcctcctggctcctggcccgcatcctggcctggacctataccttctatgacaactgctgccgcctccggtgtttcccgcaacccccgaaacggaattggttcttgggtcacctgggcctgattcacagctcggaggaaggtctcctatacacacaaagcctggcatgcaccttcggtgatatgtgctgctggtgggtggggccctggcacgcaatcgtccgcatcttccaccccacctacatcaagcctgtgctctttgctccagctgccattgtaccaaaggacaaggtcttctacagcttcctgaagccctggctgggggatgggctcctgctgagtgctggtgaaaagtggagccgccaccgtcggatgctgacgcctgccttccatttcaacatcctgaagccctatatgaagattttcaatgagagtgtgaacatcatgcatgccaagtggcagctcctggcctcagagggtagtgcccgtctggacatgtttgagcacatcagcctcatgaccttggacagtctgcagaaatgtgtcttcagctttgacagccattgccaggagaagcccagtgaatatattgccgccatcttggagctcagtgcccttgtgacaaaaagacaccagcagatcctcctgtacatagacttcctgtattatctcacccctgatgggcagcgtttccgcagggcctgccgcctggtgcacgacttcacagatgccgtcatccaggagcggcgccgcaccctccctagccagggtgttgatgacttcctccaagccaaggccaaatccaagactttggacttcattgatgtactcctgctgagcaaggtgggcctctctgggatctgaattcaagaagtagaagggagcttcatgtgaaatgtcagatgaaagaatttgaacttgacccagagggcactggggagccatggaagtggagagagaagggagggacaggtcagagataggttttggagatagctctgtggactagcacctaccaggggactgctaaatgaaattgtgatgagtctgagatttactctatttataagttaataagctaattggccaccttttaatctatatatctacatctatacctatgtctgggtctatgtttatgtttttgcctatgtctttctgtatctttgtctctgagtttgtgtctctctctatgactatgactatgtctatgtctttgtctttttcattggccatatctgtatgtctttgtctgcatctgtgtcttcatctttgtttatgtttatgcctttctctctccactccctccctgccttc

SEQ ID NO: 36291 - DNA, 5058 bp, Homo sapiens
  misc_feature (1124)..(1124): n is a, c, g, or t
agaagaaggggagaggaggttgtgtgggacaaggtgctcctgacagaaggatgccacagctgagcctgtcctcgctgggcctttggccaatggcagcatccccgtggctgctcctgctgctggttggggcctcctggctcctggcccgcatcctggcctggacctataccttctatgacaactgctgccgcctccggtgtttcccgcaacccccgaaacggaattggttcttgggtcacctgggcctgattcacagctcggaggaaggtctcctatacacacaaagcctggcatgcaccttcggtgatatgtgctgctggtgggtggggccctggcacgcaatcgtccgcatcttccaccccacctacatcaagcctgtgctctttgctccagctgccattgtaccaaaggacaaggtcttctacagcttcctgaagccctggctgggggatgggctcctgctgagtgctggtgaaaagtggagccgccaccgtcggatgctgacgcctgccttccatttcaacatcctgaagccctatatgaagattttcaatgagagtgtgaacatcatgcatgccaagtggcagctcctggcctcagagggtagtgcccgtctggacatgtttgagcacatcagcctcatgaccttggacagtctgcagaaatgtgtcttcagctttgacagccattgccaggagaagcccagtgaatatattgccgccatcttggagctcagtgcccttgtgacaaaaagacaccagcagatcctcctgtacatagacttcctgtattatctcacccctgatgggcagcgtttccgcagggcctgccgcctggtgcacgacttcacagatgccgtcatccaggagcggcgccgcaccctccctagccagggtgttgatgacttcctccaagccaaggccaaatccaagactttggacttcattgatgtactcctgctgagcaaggatgaagatgggaagaagttgtccgatgaggacataagagcagaagctgacacctttatgtttgagggccatgacaccacagccagtggtctctcctgggtcctgtaccaccttgcaaagcacccggaataccaggagcgctgtcggcaggaggtncaagagcttctgaaggaccgtgagcctaaagagattgaatgggacgacctggcccagctgcccttcctgaccatgtgcattaaggagagcctgaggctgcatcccccagtccctgccgtctctcgctgctgcacccaagacattgtgctcccagacggccgggtcatccccaaaggcattatctgcctcatcagtgtttttggaacccatcacaacccagccgtgtggccggaccctgaggtctatgacccctttcgctttgacccaaagaacatcaaggagaggtcacctctggcttttattcccttctcagcagggcccaggaactgcatcgggcaggcgttcgcgatggcggagatgaaggtggtcctggggctcacgctgctggccttccgcgtcctgcctgaccacaccgagccccgcaggaagccggagctggtcctgcgcgcagagggcggactttggctgcgggtggagcccctgagctgagttctgcagagacccactctgaccccactaaaatgacccctgattcatcaaaagtgaggcctagaattaccctaagaccctgttccacagtcctgtattccatcctagatatctactcaaaataattgagacaagtgttcaaacagaaagacgcttgtgcggaatgttcatggcagccctattcacagtagcccaaacgatgaaaacaccccaagctatatattaccagataaaaggataaacacaatatggtccatccatacactggagtattacacagccataaaaaggaatgaagcagtgatccccactacactgtggatgaaccttgaatgcatgatactgaatgaaagacatcagatgcaaaaggtcacatagtgtactgtccttttatatgaaatttccagaacaggccaatctgaagagatgtatagtggattggtggctttcagcagctgtggggaggtgggactgaggagcgactgctaatcaggatggggtttcctcctgggatggtgaaaatgttccggacctagatagtgatgaaggtagcacgacactgtgagtgcactaaatgctattgaattagacactttagaatggttgaaatagtgatttttatgtgaattctacctaaacatgctattacagctcatatatactttttccatctggattcttcacaaaagaatatgttgtgagcatctttccatgatattaaatcatcttaggaaacattattttgtgttcttcaaaatgtgcatgttaagtattcaaatcagtcttaaatttttaaaaatatgtaattttagaaaataatttaaaaggttttgtttcagtttgtaagatttcttttctggcactttaatggcttgaggtatcattatcagttacaaattgagttattcttcatcaaatgacttttggagtagagattttatttttatagcaatagatgcacagatattcctgtaagatacaggtgtggttagacacttttctagaacaggcatgccctgcaaactccacagacactgactgtttttgtcctatgaacaagcagaccactgagaagggagaaggtgacattttagctttcccaggtaaaagtggttttcatcctcacaccaattttatggactggacgttaactctcttgctcaaggtcactctgtgagtggaagagtggggataaatctggttcgtttggcatcagaggccatgacttttcctaccacagaagtaattttcaaagtaagtctctgccctaggcacatcagatcacctggggaccactccagagtgagtagacaagactttgacaggggtgcctaatttttttttttttttgagatggagtctcgctctgttgcccaggctggagtgcggtggcatgatctcggttcattgcaacctccgcctcctgcgttcgggtgattgacctgtctcggcctcccgggtggctgggattgcaggcacccaccaccacgtccagctaattgttgtatttttgatagaggcggggtttcgccatgttacactggctggtgttgaactcctaacctcaggtgatccacctgcctcggcctcccaaagtgctgggattacaggcctggcccagtttgatagtttgttatcatgttatacgtacacttagaataatgatccagccatctcattctaacagcaatgagaacttaggctcccctctctactaaaatacaaaagttagctggtcatggtggtgcgggcctgtggtcccagctgctcgggaggttgatgcaggagaatcacttgaaacccacaggcggaggttgcagtgggctggggtggtgccactgcgctccagcctgggggagggggacatagcgagactcggtctcaaaaacaaaacaaaacaaaacaaaacaaaaacaaaacaaaacaaaacaaaacactgccaaactgtttccaaagcatctgcatcgtgtttaatttccataagtaacgtatgagaattctaggtcctccaaataattagcagtccttcgtagtgtcagtttttgtttcagccttccttatgggtatgctgtggcatatccctgagattttaattcgcattttccagtgactaagggtgttgaaccactcgtgccttcctgtgcctatttgacactcctatattttctttggtgaagtgtctgttcaatcatctgctcattaaattttccttcggttgtttgccttcttattgttggattttgagagttctatgtacaagtcctttgtcagtcgtgtgatttgcaagtcttcttcctagtctctgaagtttctttctttcatagagcaaacgttttaaatttttatgaagtaagacttctcagttttatttttggtgaattatgtttatactgccatatataggaactctttgcttaactggaggtcatggagattttctcctacattttcttttaaaagttttatagtttcagagtttacatgtaattccataatctccatttagttaaattttgtatggggtgtgaactgtggtttgactgttttcttgtatatggatatccaattgtttcacacaatttttttgaaaagaatatccttggcagggcacggtagctcacacctgtaatcccagcactttaggaggtcaaggtgggcagatcatgaggtcaggagtttgagaccagcctggccaatatggtgaaaccacgtctctattaaaaatagaaaaattagccaggcgtggtggtgtgtgcctgtattcacagctgcttggatggctgaggcaggagaatcgcttgaacccaggagtcagaggtttcagtgagccgagattgtgccactgcactccagcctgggtgaaagagctagattctctctctcaaaaaaaaaaaaaaaaaggaaagaaagaaagaaaagaaaagaaaatcctttttgctttaacttgccttgcaggtttgtagaaaactcaattgttgaaatttgggtggatatatttctggattttctattctattccatgttggaccaataccacactgccctagtcactgttgcattatagtatatctttaaaggagtaatgggaatccttcaactacatttttttccccaataatttttggctattctgcttcttttgtgtttctatgtaaattttatcatcagtgtgtctatttctacaaatagtcctgatagggtttgaattgggatttctgtgaatctatagatcaatctgaggagacttaataatgatattgattctcccaattcatgaatatagtatacccctgtatttatttgttttcttgaatttcttttatcattgttttgtagttttcaccatgacagtcttgcacatattttgttaaatgtacagctgagaatttaattttttctggtgtacaatgctaataaaatggtgctttaaaagatgtgttcttca

SEQ ID NO: 36292 - DNA, 5038 bp, Homo sapiens
  misc_feature (1104)..(1104): n is a, c, g, or t
acctcactcaccacccatctgccctgcaggatgccacagctgagcctgtcctcgctgggcctttggccaatggcagcatccccgtggctgctcctgctgctggttggggcctcctggctcctggcccgcatcctggcctggacctataccttctatgacaactgctgccgcctccggtgtttcccgcaacccccgaaacggaattggttcttgggtcacctgggcctggtcacccccacggagcagggcatgagggtcctgactcagctggtggccacctacccccagggctttaaggtctggatgggccccatcttccccgtcatccgtttttgccaccccaacatcatccggtctgtcatcaacgcctcagctgccattgtaccaaaggacaaggtcttctacagcttcctgaagccctggctgggggatgggctcctgctgagtgctggtgaaaagtggagccgccaccgtcggatgctgacgcctgccttccatttcaacatcctgaagccctatatgaagattttcaatgagagtgtgaacatcatgcatgccaagtggcagctcctggcctcagagggtagtgcccgtctggacatgtttgagcacatcagcctcatgaccttggacagtctgcagaaatgtgtcttcagctttgacagccattgccaggagaagcccagtgaatatattgccgccatcttggagctcagtgcccttgtgacaaaaagacaccagcagatcctcctgtacatagacttcctgtattatctcacccctgatgggcagcgtttccgcagggcctgccgcctggtgcacgacttcacagatgccgtcatccaggagcggcgccgcaccctccctagccagggtgttgatgacttcctccaagccaaggccaaatccaagactttggacttcattgatgtactcctgctgagcaaggatgaagatgggaagaagttgtccgatgaggacataagagcagaagctgacacctttatgtttgagggccatgacaccacagccagtggtctctcctgggtcctgtaccaccttgcaaagcacccggaataccaggagcgctgtcggcaggaggtncaagagcttctgaaggaccgtgagcctaaagagattgaatgggacgacctggcccagctgcccttcctgaccatgtgcattaaggagagcctgaggctgcatcccccagtccctgccgtctctcgctgctgcacccaagacattgtgctcccagacggccgggtcatccccaaaggcattatctgcctcatcagtgtttttggaacccatcacaacccagccgtgtggccggaccctgaggtctatgacccctttcgctttgacccaaagaacatcaaggagaggtcacctctggcttttattcccttctcagcagggcccaggaactgcatcgggcaggcgttcgcgatggcggagatgaaggtggtcctggggctcacgctgctggccttccgcgtcctgcctgaccacaccgagccccgcaggaagccggagctggtcctgcgcgcagagggcggactttggctgcgggtggagcccctgagctgagttctgcagagacccactctgaccccactaaaatgacccctgattcatcaaaagtgaggcctagaattaccctaagaccctgttccacagtcctgtattccatcctagatatctactcaaaataattgagacaagtgttcaaacagaaagacgcttgtgcggaatgttcatggcagccctattcacagtagcccaaacgatgaaaacaccccaagctatatattaccagataaaaggataaacacaatatggtccatccatacactggagtattacacagccataaaaaggaatgaagcagtgatccccactacactgtggatgaaccttgaatgcatgatactgaatgaaagacatcagatgcaaaaggtcacatagtgtactgtccttttatatgaaatttccagaacaggccaatctgaagagatgtatagtggattggtggctttcagcagctgtggggaggtgggactgaggagcgactgctaatcaggatggggtttcctcctgggatggtgaaaatgttccggacctagatagtgatgaaggtagcacgacactgtgagtgcactaaatgctattgaattagacactttagaatggttgaaatagtgatttttatgtgaattctacctaaacatgctattacagctcatatatactttttccatctggattcttcacaaaagaatatgttgtgagcatctttccatgatattaaatcatcttaggaaacattattttgtgttcttcaaaatgtgcatgttaagtattcaaatcagtcttaaatttttaaaaatatgtaattttagaaaataatttaaaaggttttgtttcagtttgtaagatttcttttctggcactttaatggcttgaggtatcattatcagttacaaattgagttattcttcatcaaatgacttttggagtagagattttatttttatagcaatagatgcacagatattcctgtaagatacaggtgtggttagacacttttctagaacaggcatgccctgcaaactccacagacactgactgtttttgtcctatgaacaagcagaccactgagaagggagaaggtgacattttagctttcccaggtaaaagtggttttcatcctcacaccaattttatggactggacgttaactctcttgctcaaggtcactctgtgagtggaagagtggggataaatctggttcgtttggcatcagaggccatgacttttcctaccacagaagtaattttcaaagtaagtctctgccctaggcacatcagatcacctggggaccactccagagtgagtagacaagactttgacaggggtgcctaatttttttttttttttgagatggagtctcgctctgttgcccaggctggagtgcggtggcatgatctcggttcattgcaacctccgcctcctgcgttcgggtgattgacctgtctcggcctcccgggtggctgggattgcaggcacccaccaccacgtccagctaattgttgtatttttgatagaggcggggtttcgccatgttacactggctggtgttgaactcctaacctcaggtgatccacctgcctcggcctcccaaagtgctgggattacaggcctggcccagtttgatagtttgttatcatgttatacgtacacttagaataatgatccagccatctcattctaacagcaatgagaacttaggctcccctctctactaaaatacaaaagttagctggtcatggtggtgcgggcctgtggtcccagctgctcgggaggttgatgcaggagaatcacttgaaacccacaggcggaggttgcagtgggctggggtggtgccactgcgctccagcctgggggagggggacatagcgagactcggtctcaaaaacaaaacaaaacaaaacaaaacaaaaacaaaacaaaacaaaacaaaacactgccaaactgtttccaaagcatctgcatcgtgtttaatttccataagtaacgtatgagaattctaggtcctccaaataattagcagtccttcgtagtgtcagtttttgtttcagccttccttatgggtatgctgtggcatatccctgagattttaattcgcattttccagtgactaagggtgttgaaccactcgtgccttcctgtgcctatttgacactcctatattttctttggtgaagtgtctgttcaatcatctgctcattaaattttccttcggttgtttgccttcttattgttggattttgagagttctatgtacaagtcctttgtcagtcgtgtgatttgcaagtcttcttcctagtctctgaagtttctttctttcatagagcaaacgttttaaatttttatgaagtaagacttctcagttttatttttggtgaattatgtttatactgccatatataggaactctttgcttaactggaggtcatggagattttctcctacattttcttttaaaagttttatagtttcagagtttacatgtaattccataatctccatttagttaaattttgtatggggtgtgaactgtggtttgactgttttcttgtatatggatatccaattgtttcacacaatttttttgaaaagaatatccttggcagggcacggtagctcacacctgtaatcccagcactttaggaggtcaaggtgggcagatcatgaggtcaggagtttgagaccagcctggccaatatggtgaaaccacgtctctattaaaaatagaaaaattagccaggcgtggtggtgtgtgcctgtattcacagctgcttggatggctgaggcaggagaatcgcttgaacccaggagtcagaggtttcagtgagccgagattgtgccactgcactccagcctgggtgaaagagctagattctctctctcaaaaaaaaaaaaaaaaaggaaagaaagaaagaaaagaaaagaaaatcctttttgctttaacttgccttgcaggtttgtagaaaactcaattgttgaaatttgggtggatatatttctggattttctattctattccatgttggaccaataccacactgccctagtcactgttgcattatagtatatctttaaaggagtaatgggaatccttcaactacatttttttccccaataatttttggctattctgcttcttttgtgtttctatgtaaattttatcatcagtgtgtctatttctacaaatagtcctgatagggtttgaattgggatttctgtgaatctatagatcaatctgaggagacttaataatgatattgattctcccaattcatgaatatagtatacccctgtatttatttgttttcttgaatttcttttatcattgttttgtagttttcaccatgacagtcttgcacatattttgttaaatgtacagctgagaatttaattttttctggtgtacaatgctaataaaatggtgctttaaaagatgtgttcttca

SEQ ID NO: 36293 - DNA, 4554 bp, Homo sapiens
  misc_feature (620)..(620): n is a, c, g, or t
gattgttggggttggagagctgctcaagggagcaagggacctgccccagctctgtccccttctctggctaggccaagtggcagctcctggcctcagagggtagtgcccgtctggacatgtttgagcacatcagcctcatgaccttggacagtctgcagaaatgtgtcttcagctttgacagccattgccaggagaagcccagtgaatatattgccgccatcttggagctcagtgcccttgtgacaaaaagacaccagcagatcctcctgtacatagacttcctgtattatctcacccctgatgggcagcgtttccgcagggcctgccgcctggtgcacgacttcacagatgccgtcatccaggagcggcgccgcaccctccctagccagggtgttgatgacttcctccaagccaaggccaaatccaagactttggacttcattgatgtactcctgctgagcaaggatgaagatgggaagaagttgtccgatgaggacataagagcagaagctgacacctttatgtttgagggccatgacaccacagccagtggtctctcctgggtcctgtaccaccttgcaaagcacccggaataccaggagcgctgtcggcaggaggtncaagagcttctgaaggaccgtgagcctaaagagattgaatgggacgacctggcccagctgcccttcctgaccatgtgcattaaggagagcctgaggctgcatcccccagtccctgccgtctctcgctgctgcacccaagacattgtgctcccagacggccgggtcatccccaaaggcattatctgcctcatcagtgtttttggaacccatcacaacccagccgtgtggccggaccctgaggtctatgacccctttcgctttgacccaaagaacatcaaggagaggtcacctctggcttttattcccttctcagcagggcccaggaactgcatcgggcaggcgttcgcgatggcggagatgaaggtggtcctggggctcacgctgctggccttccgcgtcctgcctgaccacaccgagccccgcaggaagccggagctggtcctgcgcgcagagggcggactttggctgcgggtggagcccctgagctgagttctgcagagacccactctgaccccactaaaatgacccctgattcatcaaaagtgaggcctagaattaccctaagaccctgttccacagtcctgtattccatcctagatatctactcaaaataattgagacaagtgttcaaacagaaagacgcttgtgcggaatgttcatggcagccctattcacagtagcccaaacgatgaaaacaccccaagctatatattaccagataaaaggataaacacaatatggtccatccatacactggagtattacacagccataaaaaggaatgaagcagtgatccccactacactgtggatgaaccttgaatgcatgatactgaatgaaagacatcagatgcaaaaggtcacatagtgtactgtccttttatatgaaatttccagaacaggccaatctgaagagatgtatagtggattggtggctttcagcagctgtggggaggtgggactgaggagcgactgctaatcaggatggggtttcctcctgggatggtgaaaatgttccggacctagatagtgatgaaggtagcacgacactgtgagtgcactaaatgctattgaattagacactttagaatggttgaaatagtgatttttatgtgaattctacctaaacatgctattacagctcatatatactttttccatctggattcttcacaaaagaatatgttgtgagcatctttccatgatattaaatcatcttaggaaacattattttgtgttcttcaaaatgtgcatgttaagtattcaaatcagtcttaaatttttaaaaatatgtaattttagaaaataatttaaaaggttttgtttcagtttgtaagatttcttttctggcactttaatggcttgaggtatcattatcagttacaaattgagttattcttcatcaaatgacttttggagtagagattttatttttatagcaatagatgcacagatattcctgtaagatacaggtgtggttagacacttttctagaacaggcatgccctgcaaactccacagacactgactgtttttgtcctatgaacaagcagaccactgagaagggagaaggtgacattttagctttcccaggtaaaagtggttttcatcctcacaccaattttatggactggacgttaactctcttgctcaaggtcactctgtgagtggaagagtggggataaatctggttcgtttggcatcagaggccatgacttttcctaccacagaagtaattttcaaagtaagtctctgccctaggcacatcagatcacctggggaccactccagagtgagtagacaagactttgacaggggtgcctaatttttttttttttttgagatggagtctcgctctgttgcccaggctggagtgcggtggcatgatctcggttcattgcaacctccgcctcctgcgttcgggtgattgacctgtctcggcctcccgggtggctgggattgcaggcacccaccaccacgtccagctaattgttgtatttttgatagaggcggggtttcgccatgttacactggctggtgttgaactcctaacctcaggtgatccacctgcctcggcctcccaaagtgctgggattacaggcctggcccagtttgatagtttgttatcatgttatacgtacacttagaataatgatccagccatctcattctaacagcaatgagaacttaggctcccctctctactaaaatacaaaagttagctggtcatggtggtgcgggcctgtggtcccagctgctcgggaggttgatgcaggagaatcacttgaaacccacaggcggaggttgcagtgggctggggtggtgccactgcgctccagcctgggggagggggacatagcgagactcggtctcaaaaacaaaacaaaacaaaacaaaacaaaaacaaaacaaaacaaaacaaaacactgccaaactgtttccaaagcatctgcatcgtgtttaatttccataagtaacgtatgagaattctaggtcctccaaataattagcagtccttcgtagtgtcagtttttgtttcagccttccttatgggtatgctgtggcatatccctgagattttaattcgcattttccagtgactaagggtgttgaaccactcgtgccttcctgtgcctatttgacactcctatattttctttggtgaagtgtctgttcaatcatctgctcattaaattttccttcggttgtttgccttcttattgttggattttgagagttctatgtacaagtcctttgtcagtcgtgtgatttgcaagtcttcttcctagtctctgaagtttctttctttcatagagcaaacgttttaaatttttatgaagtaagacttctcagttttatttttggtgaattatgtttatactgccatatataggaactctttgcttaactggaggtcatggagattttctcctacattttcttttaaaagttttatagtttcagagtttacatgtaattccataatctccatttagttaaattttgtatggggtgtgaactgtggtttgactgttttcttgtatatggatatccaattgtttcacacaatttttttgaaaagaatatccttggcagggcacggtagctcacacctgtaatcccagcactttaggaggtcaaggtgggcagatcatgaggtcaggagtttgagaccagcctggccaatatggtgaaaccacgtctctattaaaaatagaaaaattagccaggcgtggtggtgtgtgcctgtattcacagctgcttggatggctgaggcaggagaatcgcttgaacccaggagtcagaggtttcagtgagccgagattgtgccactgcactccagcctgggtgaaagagctagattctctctctcaaaaaaaaaaaaaaaaaggaaagaaagaaagaaaagaaaagaaaatcctttttgctttaacttgccttgcaggtttgtagaaaactcaattgttgaaatttgggtggatatatttctggattttctattctattccatgttggaccaataccacactgccctagtcactgttgcattatagtatatctttaaaggagtaatgggaatccttcaactacatttttttccccaataatttttggctattctgcttcttttgtgtttctatgtaaattttatcatcagtgtgtctatttctacaaatagtcctgatagggtttgaattgggatttctgtgaatctatagatcaatctgaggagacttaataatgatattgattctcccaattcatgaatatagtatacccctgtatttatttgttttcttgaatttcttttatcattgttttgtagttttcaccatgacagtcttgcacatattttgttaaatgtacagctgagaatttaattttttctggtgtacaatgctaataaaatggtgctttaaaagatgtgttcttca

SEQ ID NO: 36294 - DNA, 1227 bp, Homo sapiens
agaagaaggggagaggaggttgtgtgggacaaggtgctcctgacagaaggatgccacagctgagcctgtcctcgctgggcctttggccaatggcagcatccccgtggctgctcctgctgctggttggggcctcctggctcctggcccgcatcctggcctggacctataccttctatgacaactgctgccgcctccggtgtttcccgcaacccccgaaacggaattggttcttgggtcacctgggcctgattcacagctcggaggaaggtctcctatacacacaaagcctggcatgcaccttcggtgatatgtgctgctggtgggtggggccctggcacgcaatcgtccgcatcttccaccccacctacatcaagcctgtgctctttgctccagctgccattgtaccaaaggacaaggtcttctacagcttcctgaagccctggctgggggatgggctcctgctgagtgctggtgaaaagtggagccgccaccgtcggatgctgacgcctgccttccatttcaacatcctgaagccctatatgaagattttcaatgagagtgtgaacatcatgcatgccaagtggcagctcctggcctcagagggtagtgcccgtctggacatgtttgagcacatcagcctcatgaccttggacagtctgcagaaatgtgtcttcagctttgacagccattgccaggagaagcccagtgaatatattgccgccatcttggagctcagtgcccttgtgacaaaaagacaccagcagatcctcctgtacatagacttcctgtattatctcacccctgatgggcagcgtttccgcagggcctgccgcctggtgcacgacttcacagatgccgtcatccaggagcggcgccgcaccctccctagccagggtgttgatgacttcctccaagccaaggccaaatccaagactttggacttcattgatgtactcctgctgagcaaggtgggcctctctgggatctgaattcaagaagtagaagggagcttcatgtgaaatgtcagatgaaagaatttgaacttgacccagagggcactggggagccatggaagtggagagagaagggagggacaggtcagagataggttttggagatagctctgtggactagcacctaccaggggactgctaaatgaaattgtgatgagtctgagatttactctatttataagttaataagcacagcccatagtccggcccaggt

SEQ ID NO: 36295 - DNA, 408 bp, Homo sapiens
agtatcataatcgtcgacagcattcagaggttcaattaagtactttaacaagcataagaaactgcataagttaatcagcttaattgtattccttttgcccattgcatgttagtctttgaagctttgcttttattaacacgggtttgtgcagcaaacatgcctattctgtaatacacatgcaacccacccttcaacaatgtccattgagtgccaagagactcatttctactttaggtgaaaataaacctttactatgtttaggaaacatgactaataacatagaaagtattcaggtttttttgctttttcagttctaaataggacttgctaagcaagaaggttctagggaggagaacttgtgaagagaaagctggaggtcagaagggcaacttgggaatctgtattaca

SEQ ID NO: 36296 - DNA, 560 bp, Homo sapiens
aaagtagagagctactgttgattctcaagagaactagaacatgaagacaatagtatttagagattattctggcaattaagccagctagcatagcattttggaagagaacatactgcactctagttcctcttatggcatatacgtatatgcttccaaaatgctacttccttcaacatgaaaaactaaaagtggtagagacagctcactcttgcaagtacaaaagtataagatgatgggatcttgtccaaagcagctgtacatttaagaagacttttgccggccaggtggggtggctgatgcctgtaatcccagccctttgggaggccaaggtgggtggatcctgaggtcaggagttcaagaccagcctgacttgaacatggtgaaaccctgtctttactaaaaatataaaaattagctgggtgtggtggcatgcctctgtaatcccagctactcaggaggctgaggcaggagaatcacttgaacctggggagtagagggtgcagtgagccgagatcacgccattgcacttcagcctgggtgacagagtaagactccatctc

SEQ ID NO: 36297 - DNA, 322 bp, Homo sapiens
tccatctagaatctgtgaatgtgaacttatttggaaaaagtgtctttgcagttgtaattaagttaaggatcttgagataaaatcatctttgattagggtgaccctaaatccaagtgtcctcagaagattaggtagaagactcaaaagagaggtgatgtagagatgaaaacatatcagagtgatgcatctacaaggcaaggaacactaaggatttccaacagctaccagaagctaggagataggcagctatcggattctcctcagggcctctagaaggaaccaaccctgtcaacaccttgattttggacttctggcctccaca

SEQ ID NO: 36298 - DNA, 409 bp, Homo sapiens
tttggcaggaatgcgtcgacttttttttttacatctggtagaattcagctctgaatccatctggtcctgagctttttttggttgatagtctttatatgatgattcagttttggaactcattattagtctgttctgggattcaatttcttcctggttcagtcttggaaggttataggagtccaggaatttattaatttcttctagattttctagtttgcgtgcatagagatgttcatagtagtctctagggagtatttgtctttctatgggatcagtggtaacatcccctttgtcatttctacttatgtttatttggatcttctctattttttctccattggcattgatgctatctttctggcattttgttggaattagaagtcgacgtgtattttaaatttttattgta

SEQ ID NO: 36299 - DNA, 519 bp, Homo sapiens
atttctgtgaagacgtcgacctgtcctcagtggcatactgggatgctttgtctcacctagaagatgcagcttgtgtcacaaagccaagtcacatgttcctgggattgtcagtgtatttcccaagaaaaaacaagagtagtgatctcttggaatgaaaacaagatagatgattaaggaaattaggaatgtgttcaaaagtaaggattttgaggaattctactaattgctcattttaaagactaaattggccttcatcctaccagaaagattcttaaggttgggcacagtggctcatacctgaggcaggtggatcgctagagttcaggagttggagaccagcctgggcaatatggcgaaaccccatctctagggcatggtggcatgtgctgtggtcccagctacctgggaggctgaaatgggaggatcgcttgagcctaagaggtagaggtttgggctgagatcatgccactgcactctagcctgggcaacagagtgagatctggtctcaaaaaaaaaaaa

SEQ ID NO: 36300 - DNA, 266 bp, Homo sapiens
ttccccagccatgctgaactgtagtcaatttaacctctttcctttataaattacccagttttgggtagttctttatagcagtgtgaaaacgaactaatacagccctatactctgatatcatttcaataattttattctctgccctaagtaaccaattggtttctcctgcctataattaagtactttaataatatattaagtgttacaagatatgcttaaaaataaataaatataacattgaatatatttgttatctatgctactgc

SEQ ID NO: 36301 - DNA, 238 bp, Homo sapiens
aaacctaaacaacctaggaaaagaaaggaactgtctcaataaggacaaagagcacctacaaaaagcctactaacattatacttaatgatgatagactaaatgctttctcatcatcaggaacaagacattccagtacattcacattgtactggaagttctgtccagtacaatcaggcaagaaaaataacactcatccaaattggacatgaagcaaaaatgcatgtgttcacagacacgt

SEQ ID NO: 36302 - DNA, 289 bp, Homo sapiens
ctaatgggctattgtggttaggttccagaaccttcagactttctctagggataattcactgatgaaaacaagcactgccagccccaagcttaccctaacctttgcagggacgtggggcagaagtacaaagggatgcccacataccatctgtataaatatttaaaagttattcctcaagctaacaaaccattaaatagcatgtcctcgctaaatacaacttcatcctgacacagagagcaggttccaactgagaattccctgtcccatctgcagcctgccccccaactcc

SEQ ID NO: 36303 - DNA, 542 bp, Homo sapiens
gtatatagttagttgaattcaataagcacatttttgtttcaatattattaataacaggctatttcagttttgtattaaactttaaatttagttatttcttcaagattttggcaagttggatactacaggtaaggactaactagttgaccaagaaatggaaaatcatttggaaattgtattatgacccttgaaacataacttataatctgtaataatatgaatgccaatttaagatttttaaaagttttttgttttggaaatcctttttcaagttgtaaacagaggctatttatataagaatatgaattgtgtccttaataaacaatatttctgagatgcatattatattttggaccaacacttaatttctcaatagcttgataacatttctttacagaaaatgaagcacttaaaaataaataggctgggcatggtggctcatgcctgtataaccccagtaccttgggaggctgaggcaggcagatcacctgaggttgggagtcgagaccaagcctgggcaacatggtgaaacccgtctctac

SEQ ID NO: 36304 - DNA, 283 bp, Homo sapiens
cccacagcccgagtggctgccacgtgatggctgatagagcagaggacttcagaaaagcagatggccctttggtcctacctttagggtagaagaactgatgtgccatttgcgggagcgagtgaggttggtggctggagaaccggtgcctggcacaccgtggcagagttgactggttgctctttgagccagcttggccttgctcggcctgcacaagcctcagtgcaacaactgtgctatgaatggagccacagagaggaaacaagcagcaagatcaggagcaggg

SEQ ID NO: 36305 - DNA, 454 bp, Homo sapiens
cattttcatgctgataagactgagataaagcaaaatggatggcttatgcaatcccagttgcatattgccactttttgaattaccaagagacatttgattaaatagcatcacacagtcacagtggtcattcttacaacagcagctgtactcacatctgggtgtagtggcattctcaaaaggcattctgaccttggtatcatgtctgacctctcctttgagacttctctgctagcccctgtggatctcccctcttgtgctgctttcaggcatgcccagaatagagctgaaatggagtcctgccataaatcaaaatctgtgaatggatactataaaattcctaatttatatgctatgtggtgtgtgttcctttgagatacttaaagatatgcaaatagagtaaccagaaaggactgatgtaaaagtactattttgctaagaaaagaagcaacagaaa

SEQ ID NO: 36306 - DNA, 362 bp, Homo sapiens
cacttaattagctacaacccgggactgttgccatttgaacaagttgttaagaaaatctgccatgttttgctcttttttaaaaggaatgactttaataaccatagcaacacttactcagttttgtgatccactccaagattatgggagcaagaacagatactcctgaaagcaaccctcacctcctcccccgccccctgccctcagcaagtcctggcctgtgtgaactgaagggtttggaagctctggtttctaggagtgcccagaagctagaaagactagggtgtactagttattgaggggcagttgtcagtggcagtgtgggggcaccccagttgttattcgaggcactgcattgctttttt

SEQ ID NO: 36307 - DNA, 564 bp, Homo sapiens
cagatgtacagaatgaggactggcagggattttagaccttccagttcagcccctactgatgaagtcactgaggtccagagagtgggaggagtttgtcccaggccatggggtgggtgtcaggtcacagcttgagcccagatgtcctgactcctgggctctgagctcttgttcttattttgtccagaatgtctctctggccccctcttttcctccagatgtcattctgttctctcagatttctctcgtcatactctttgactgggtcattttctgcatctccttttgcccgtttctcttctccttcctctcctcacgcccctgccatgtgtgaatgcctactgtgtggaacagaggcacacagctgaggatgtggtggggctgaaatccattgtgtttgcccggaggggtgccttttcctaatgcacccagagaagtggccctcagagcagaagcctggccctcaatgactcagagcactcagattgcagctctccctggggtgggataaggtcaagggaagggagagaaaatggtgtcagcttgaaactagtataggaaatgtta

SEQ ID NO: 36308 - DNA, 3224 bp, Homo sapiens
  misc_feature (1910)..(1910): n is a, c, g, or t
  misc_feature (2010)..(2010): n is a, c, g, or t
aaatccttattttcctgaaaggagtaaagccaaaggaaactttttttacatttaaaaaaaaaggtttttttcaaatgtaaaatttgaaaaaattgtggccgtaaaatacagccacaggcacgtatctcgttttctgagtgactgcatcccacctttcaactgcttaagctttattatcattactagttttggaaaatttaaatttgcttgtaatgtaactgctacagttacctgttagtttatttctcatcttatattctaaacatacagtatgtctcatactgcaaaacaaaggaatctgaagaagaggaaaactaaaaagctcagaaactgttatgaagttttgctgccacgttgtatgaggaatttgatttgcaagtttttaaactaacacacttaaaagctctttattcttcacatatatatacataggtttccatagttggaatctcatatataagttattatgtatccattttttatatataacataagcattttttgagtcactgagtaacgcagttgtccttctgctaactcctggctgaagttactaatgggctgggattttcatttattcttctagtaattcaacaaatacttgttcagagcctgtcgagtgtcaagcattgtttcagtcactgttcatgtgcaaagagtagagcaggggacaagtcaggccaactcccagctctcatggaggtataatagagactgagggaagatgttaaacaagtaaacataagcaagaaaatttcaggtagcaacaagtgctgtggagataacacatggatatggatcaacaggtactcttacatactactggtgacatataaattattaagtaaaatgaaaagcaaatatatcctatgaccctgaagttttaccctatttcatgtacatataagccagatgcacctaaaagaacattcatagcagtgttattttcaatagttcaaaactggaaacaacaaaatgtccatcaacagtagaatggctcaatactttgtagtatagtcatacaatacagcaacaaaagccagtgtactacactcaatgtgaatgactcgtaaaaacatattgttgagggaaggaaagcagacacagaagaataccttctatgtatgtaaaatccaaaactaaggtatgtagtttaggactatgtgcgtagtaaaattacttttaaaaaacaaaaaacaggccaggcacagtggcttatgcctgtaatcccagcactttgggaggccaaggtgggtggatcacctgaggttgggagttcgagaccagcctgaccaacgtggagaaaccaaatctctactaaaacattagccaggcatggtggcgcatgcctgtaatcccagctacttgagaggctaagggaggagaatcacttgaacccaggaggcggaggttgcaatgagccgagatgatgccattgcgccctagcctgggcaacaagagcaagaaaaaaaaaaagacaaagaagcaactaccataaaatcagaataggactccctgtgggggcgagagggaggaagttgtgattagaaagggaagtatgggggaggtgcttctggagttctggtaattttttatttcttgaccttcatggtggttatgtaggtatttataataattcactaaactgcacatttatgttttagacactttcatttgtgttttatatttcaaacaaaagcagtgtgatgatagcattaagtatagttttagtgcatgtgcgcgcacatgagtgtatgtgtatattttacagctttattgaggtatgattgacatacaataaactatgcatttaaagtactcagcttggccgggcatggtggctcatgcctgtaatcccagcattttgggaggccaaggtgggtggatctcctcaggtcaggagtttgagnccagcctgaccaatatagtgaaaccgcatctctactaaaaatacaaaattagctaggtgtggtggcgcatgcctgtaatcccagctacttgggaggctgnagcaggagaatcgcttgaacccaggaggcagaggttgcagtgagctgagattgcaccattgcactccagcctgggcaacaagagtgaaactcctttctaaataaataaataaataaaataaagtattcaacttgaacacttatggcatatgtattaacccatgaagccatcaccacaatcaagacagtgaatgtgtccaccacccctaagtttcctcaatgtccctttttcatctttccctcctgcctgctccttcttatcccctcacccccgggcaaccactgatctgttttctgtcactacagctgtacatagattagcttgtatattctagaatttaatagaaatagaatcacataatgtatattcttaattttgtctggtttctttcactcagcataacttttcgagattcatccatggtgatgcttgtatctgtgattcattcctttttattgctgagttgttgtctcttgtgtgcatttgccacaatttgtttatccattcacctgttgatgaatattttggtagttttcagtttctggctattacaaataaagttgctgtaaatattcacatacaaatccatttataaacatatgatttcttttctcttggttgaatacttgggaataaaatggctggatcatatgatagatacatgtttaactactttaaaaatataagtatagttttgtaaccctgtatcttcagttaatatgaaaatattttcaagtcaataaatacattcctataaaattattttttaactgttatagtagtccatcaattaaacatgccataatgtatttaaccaattctttgttgatggacatttagattacttccagttttttcactattataaacagcattaccatgaatatccttgaaactaaatctttgaacatgttcttaattatttctttaagataaattactagaaatgagattgcctggccaaagttttattacagatttccctccagacatatgacagattaaatcatcaatcagatttttttatttgagtactagatttagatacagttagccaaaataccccttttttccagactgggcaacatggcgaaatcccacatctacaaaaaatacaaaaaatacgccaggcatgttggcattgagactgcagtggccatagtcacatcactgcactctagcctgggtggcagagggagaccccatctcgaaaa

SEQ ID NO: 36309 - DNA, 3269 bp, Homo sapiens
  misc_feature (1910)..(1910): n is a, c, g, or t
  misc_feature (2010)..(2010): n is a, c, g, or t
aaatccttattttcctgaaaggagtaaagccaaaggaaactttttttacatttaaaaaaaaaggtttttttcaaatgtaaaatttgaaaaaattgtggccgtaaaatacagccacaggcacgtatctcgttttctgagtgactgcatcccacctttcaactgcttaagctttattatcattactagttttggaaaatttaaatttgcttgtaatgtaactgctacagttacctgttagtttatttctcatcttatattctaaacatacagtatgtctcatactgcaaaacaaaggaatctgaagaagaggaaaactaaaaagctcagaaactgttatgaagttttgctgccacgttgtatgaggaatttgatttgcaagtttttaaactaacacacttaaaagctctttattcttcacatatatatacataggtttccatagttggaatctcatatataagttattatgtatccattttttatatataacataagcattttttgagtcactgagtaacgcagttgtccttctgctaactcctggctgaagttactaatgggctgggattttcatttattcttctagtaattcaacaaatacttgttcagagcctgtcgagtgtcaagcattgtttcagtcactgttcatgtgcaaagagtagagcaggggacaagtcaggccaactcccagctctcatggaggtataatagagactgagggaagatgttaaacaagtaaacataagcaagaaaatttcaggtagcaacaagtgctgtggagataacacatggatatggatcaacaggtactcttacatactactggtgacatataaattattaagtaaaatgaaaagcaaatatatcctatgaccctgaagttttaccctatttcatgtacatataagccagatgcacctaaaagaacattcatagcagtgttattttcaatagttcaaaactggaaacaacaaaatgtccatcaacagtagaatggctcaatactttgtagtatagtcatacaatacagcaacaaaagccagtgtactacactcaatgtgaatgactcgtaaaaacatattgttgagggaaggaaagcagacacagaagaataccttctatgtatgtaaaatccaaaactaaggtatgtagtttaggactatgtgcgtagtaaaattacttttaaaaaacaaaaaacaggccaggcacagtggcttatgcctgtaatcccagcactttgggaggccaaggtgggtggatcacctgaggttgggagttcgagaccagcctgaccaacgtggagaaaccaaatctctactaaaacattagccaggcatggtggcgcatgcctgtaatcccagctacttgagaggctaagggaggagaatcacttgaacccaggaggcggaggttgcaatgagccgagatgatgccattgcgccctagcctgggcaacaagagcaagaaaaaaaaaaagacaaagaagcaactaccataaaatcagaataggactccctgtgggggcgagagggaggaagttgtgattagaaagggaagtatgggggaggtgcttctggagttctggtaattttttatttcttgaccttcatggtggttatgtaggtatttataataattcactaaactgcacatttatgttttagacactttcatttgtgttttatatttcaaacaaaagcagtgtgatgatagcattaagtatagttttagtgcatgtgcgcgcacatgagtgtatgtgtatattttacagctttattgaggtatgattgacatacaataaactatgcatttaaagtactcagcttggccgggcatggtggctcatgcctgtaatcccagcattttgggaggccaaggtgggtggatctcctcaggtcaggagtttgagnccagcctgaccaatatagtgaaaccgcatctctactaaaaatacaaaattagctaggtgtggtggcgcatgcctgtaatcccagctacttgggaggctgnagcaggagaatcgcttgaacccaggaggcagaggttgcagtgagctgagattgcaccattgcactccagcctgggcaacaagagtgaaactcctttctaaataaataaataaataaaataaagtattcaacttgaacacttatggcatatgtattaacccatgaagccatcaccacaatcaagacagtgaatgtgtccaccacccctaagtttcctcaatgtccctttttcatctttccctcctgcctgctccttcttatcccctcacccccgggcaaccactgatctgttttctgtcactacagctgtacatagattagcttgtatattctagaatttaatagaaatagaatcacataatgtatattcttaattttgtctggtttctttcactcagcataacttttcgagattcatccatggtgatgcttgtatctgtgattcattcctttttattgctgagttgttgtctcttgtgtgcatttgccacaatttgtttatccattcacctgttgatgaatattttggtagttttcagtttctggctattacaaataaagttgctgtaaatattcacatacaaatccatttataaacatatgatttcttttctcttggttgaatacttgggaataaaatggctggatcatatgatagatacatgtttaactactttaaaaatataagtatagttttgtaaccctgtatcttcagttaatatgaaaatattttcaagtcaataaatacattcctataaaattattttttaactgttatagtagtccatcaattaaacatgccataatgtatttaaccaattctttgttgatggacatttagattacttccagttttttcactattataaacagcattaccatgaatatccttgaaactaaatctttgaacatgttcttaattatttctttaagataaattactagaaatgagattgcctggccaaagttttattacagatttcctccagcctgggtgacagtgcgagactctgtctcaaaaaaaaagaaaaagaaaaacctccttttttgtcatgaagatggtttttttactttttttctatttatagatgaaaataagtctgcagtctcaaaaatggagtattccatttttatcatatagtaaatgaaatttctctttctaaatcaaatgcagctggaaaaagaattacccttggaattagggaatctgtaatgttaaaaaataagttgtttaaggatgagcttgcagtcaaaaaaaga

SEQ ID NO: 36310 - DNA, 369 bp, Homo sapiens
tcaccttggctgcctatttccagattcctctttgcataaggcccataaactcattaatgatttaagccactattgtgttttgtattacttgcagccaaacgtgcaaaattactttgcttgctgtaatattcactagttgtgcatcctgggcatgtggcaactgttgggcctcactttacacatctacaaaatggtaaggtaggccgagcatggtggcttccgcctgtaatcacagcactttgggaggccaaggcgggaggatcacttgagcacaggtgtttgaggctgcagcgagctaggatcatgccactgcactccagcctgggtgagagagcaagaccctgtctccaaaaaaaaaaaaaagacaaa

SEQ ID NO: 36311 - DNA, 477 bp, Homo sapiens
gtgcctgcagagggcagggaaagagtggagggctcacaggtagcagctgggtatgtgccttcacagccacagttccttaacctttctctcaacagcaaactgttaccttccttcctaaggtggctttgagggttacaaaaagattaagtccccttgaaagcctatgtttctaaatggaaaaaatatatagcttacaatacagtggatccctgcccccctagccatagtttgtaacccatggtcaactgagaccccaaaatacgtgagtacagtataagatattctgaggtgacagaagcccccattcgtacgttttcttaatgaaatcagcaataagcccttccagtacaaaaactgggcggactaaacttccagtcatggagccttccttgttctttatcgcaactcttccctcttcccagttgtcccaacagtaactcaaaggatagaacagcaaggtcttttaaaaaaaaaaaa

SEQ ID NO: 36312 - DNA, 394 bp, Homo sapiens
agtatctaaaaattttagtttgttaatatcatctgtttatgaactattttctttttaaataatgacaaaatccaagctaaacttgaagactgttctccatatggatagagatgtgctcaaggagtacaaataatataatttttatcacaaaggagattaatgtattgctgctgaaaacattaatgccagaatccagtggcatttagcttacctgctaatttgaaatatttgttacttctttgcccctgcctaaaatttgtatgcctatattaaagttttgtcttttgaaaattgaatgttaagaattttggcttggcgtgctggctcatgcttttaatctcagcatttctggaggccaaggtgggaggactgcctgagcccaggagttcaagac

SEQ ID NO: 36313 - DNA, 3258 bp, Homo sapiens
agctccgcgccccctgctcgtcccctttcacttccaggcgccttcggcttggggtgcccagaagggcaagtccagcagacgccagggctgcaggttcaagatgctccgcctcctcctgccacttagagccacaaacgctagcgggaacctttccactcagtcttagatctgcggtcactgctgaggttttcagaactttccaggcaaaggccagccaggtcctttgcctccaacccactccgcgcctacctcccgcctggggacacccctaggcccaggagatcctactctcccccgagcaccgacgttccaactcgtctgcgcccccgactgctgtccggctcctgtgccaaggggcgcgcgcatcttcccggggccagcaacgctcccaacttctcgactcgccctcctcctccccagagcgagagtggggcgggctgagcccggatccggggtgcactcgagcgttcccagcgctcggcattcaccccgcctcagagccgactttcgaagggggattgagcctcggaggtccaggcgtcttactccaaagctcaagtcggcccccgtcttttctttccacacccctgtgcccgtcgcatgctggccgggtgagcggccgggccgaggattcgggtgcccggggccgcgtcgccccgtcgggtactgagctgagcgcaccatggccggctgctgctgcctgtccgcggaggagaaggagtcgcagcgcatcagcgcggagatcgagcgacagcttcgtcgggacaagaaggacgcgcgccgtgagcttaagctgctgctgctgggaactggtgaaagtgggaaaagcacctttatcaagcagatgagaattatccatgggtctggttacagcgacgaagacagaaaggggttcacgaagctggtttaccaaaacatattcaccgccatgcaagccatgatcagagcgatggacacgctaaggatacagtatgtgtgtgaacagaataaggaaaatgcccagataatcagagaagtggaagtggacaaggtctccatgctctccagggagcaggtggaggccatcaagcagctctggcaagatccaggcatccaggagtgttacgacaggaggagggagtaccagctgtcggactctgccaaatattacctgactgacattgaccgcatcgccacaccatcattcgtgcctacccaacaagatgtgcttcgcgtccgagtgcccaccaccggcatcattgagtatccatttgacttggaaaacatcatctttcggatggtggatgttggtggccaacgatcggaaagacggaagtggattcactgctttgagagtgtcacctccattattttcttggttgctctgagtgaatatgaccaggtcctggctgagtgtgacaacgagaatcgcatggaagagagcaaagccttatttaaaaccatcatcacctacccctggtttctgaattcgtctgtgattttattcttgaacaagaaggatcttttggaagagaaaatcatgtactctcatctaattagctatttcccagaatacacaggaccgaaacaggatgtcagagctgccagagactttatcctgaagctttaccaagatcagaatcctgacaaagagaaagtcatctactctcacttcacatgtgctacagatacagacaatattcgctttgtgtttgctgctgtcaaagacacaattctacagctaaacctaagggaattcaaccttgtctaaaagctgctgcccactcctcccctataacagaagatgtgatttgcaaactccttgttttatttgcaagtgcttctgacatcaccagagccagtcccatgccaggaactaaggatgtcatgtagatcgtggggacagagatgggtgatggaacttggaagatatttgagtttaccaacatactttaaaagtccttacatcccaaattgtgtttataattattttcttgacttttggctataagattttgtgtaatttttgaatttggtgttttctagaatttttaaaagccactttgatttagttttaaatatgtttaaaaatagcgattaaaattatgtaagcaaggagcctgttagtttatagatcatgccttcaaacctctagagttaatttgggtgacttttttaaaaataagaatgttaatgggtttgaagctttttattaaaccttgtaatttagagacatttttaattgtgtttctcacctcatgctgaagggtgactcctttaacatgccaccaaagattttttttaaacacttggttctttttgtgtgttaactttctaagccaaattaatggatatataagtatatctaatttagctttgccacagtttgatcaccaagaagccaaagctgacatagagtaaatgggctctagatagcatatatgttttattggtgaaaaatgtgtgtgtgtgcgcgtgtgtgtgtgtgtacatttttacccccaatgtatatgaccagatcttaaaaatgtatgaaatggctagaagtccacattgtttgacaaatgttacgtaaccctgccaaagttctgatggccaccacagatttgctgtttgaattatgtatgctgtgcctttctgaggaggctaagaatataccattctgctattagcactgggttatgttgtgtttcttagagctcatggttgactgatggttctgctcctaaacagaaaaatgctgtggccttaatagtaactcggaaactttcctaagattcctcctttcaaggcaagtctgcgcatcatcgtgtcatgctgcagttccctcagtagctggctgggtcaagcagaaggagaatcctctgggaattaagagtgctccacactaaaggccaagatggttttgtgcatgtgtgcacacatgtgtgtgcacacacacatacaccatttggggacgtaaggtatgaaatatctgtctcaaatcagtctataaaatgcacctcggttggctacatatgttatggaaccatgtgtccccattctgtgggaacaattccaattgctgaaaaagactgaaattattctgatatgcagcaattctacaatagcaacatctagctttaaaaatatgaatcctcactcaagagataaatgcaatagcaacagcttttgtggaagttcacaaattgatgttaaaatttatctagaacagtaaagtccagaaatagccgagacagttttgcgtgagaacagagagaggggaatggagctctttag

SEQ ID NO: 36314 - DNA, 2351 bp, Homo sapiens
ggagtgctctgcagatgtcccagaaggcgcatggaagtccttctgacccatattgtcttcaaaacagtcgtaggaaggatggagaagcctggcctggcactggctctcaggaaagtcattgatggaattcgtgtgtctgtgtggggctcactgtgagtggggggtgacttcctttgagtaggatggacatttccccctgctctaaaaggagagtcagttcctcgttctctaatatacagttacctgactgacattgaccgcatcgccacaccatcattcgtgcctacccaacaagatgtgcttcgcgtccgagtgcccaccaccggcatcattgagtatccatttgacttggaaaacatcatctttcggatggtggatgttggtggccaacgatcggaaagacggaagtggattcactgctttgagagtgtcacctccattattttcttggttgctctgagtgaatatgaccaggtcctggctgagtgtgacaacgagaatcgcatggaagagagcaaagccttatttaaaaccatcatcacctacccctggtttctgaattcgtctgtgattttattcttgaacaagaaggatcttttggaagagaaaatcatgtactctcatctaattagctatttcccagaatacacaggaccgaaacaggatgtcagagctgccagagactttatcctgaagctttaccaagatcagaatcctgacaaagagaaagtcatctactctcacttcacatgtgctacagatacagacaatattcgctttgtgtttgctgctgtcaaagacacaattctacagctaaacctaagggaattcaaccttgtctaaaagctgctgcccactcctcccctataacagaagatgtgatttgcaaactccttgttttatttgcaagtgcttctgacatcaccagagccagtcccatgccaggaactaaggatgtcatgtagatcgtggggacagagatgggtgatggaacttggaagatatttgagtttaccaacatactttaaaagtccttacatcccaaattgtgtttataattattttcttgacttttggctataagattttgtgtaatttttgaatttggtgttttctagaatttttaaaagccactttgatttagttttaaatatgtttaaaaatagcgattaaaattatgtaagcaaggagcctgttagtttatagatcatgccttcaaacctctagagttaatttgggtgacttttttaaaaataagaatgttaatgggtttgaagctttttattaaaccttgtaatttagagacatttttaattgtgtttctcacctcatgctgaagggtgactcctttaacatgccaccaaagattttttttaaacacttggttctttttgtgtgttaactttctaagccaaattaatggatatataagtatatctaatttagctttgccacagtttgatcaccaagaagccaaagctgacatagagtaaatgggctctagatagcatatatgttttattggtgaaaaatgtgtgtgtgtgcgcgtgtgtgtgtgtgtacatttttacccccaatgtatatgaccagatcttaaaaatgtatgaaatggctagaagtccacattgtttgacaaatgttacgtaaccctgccaaagttctgatggccaccacagatttgctgtttgaattatgtatgctgtgcctttctgaggaggctaagaatataccattctgctattagcactgggttatgttgtgtttcttagagctcatggttgactgatggttctgctcctaaacagaaaaatgctgtggccttaatagtaactcggaaactttcctaagattcctcctttcaaggcaagtctgcgcatcatcgtgtcatgctgcagttccctcagtagctggctgggtcaagcagaaggagaatcctctgggaattaagagtgctccacactaaaggccaagatggttttgtgcatgtgtgcacacatgtgtgtgcacacacacatacaccatttggggacgtaaggtatgaaatatctgtctcaaatcagtctataaaatgcacctcggttggctacatatgttatggaaccatgtgtccccattctgtgggaacaattccaattgctgaaaaagactgaaattattctgatatgcagcaattctacaatagcaacatctagctttaaaaatatgaatcctcactcaagagataaatgcaatagcaacagcttttgtggaagttcacaaattgatgttaaaatttatctagaacagtaaagtccagaaatagccgagacagttttgcgtgagaacagagagaggggaatggagctctttag

SEQ ID NO: 36315 - DNA, 299 bp, Homo sapiens
ggcaaacagaagcaggaggcctgtagcctggggccccacatgctcaccagcttcagcagacagtggcccagagactgcggcggggcaagggaagagatggatggactggcaatgcgccatgttgtttccaaaatatttcctttctacttcatcccaagtcccttgtttttcacttagaatcgcatggaagagagcaaagccttatttaaaaccatcatcacctacccctggtttctgaattcgtctgtgattttattcttgaacaagaaggatcttttggaagagaaaatcatgtactc

SEQ ID NO: 36316 - DNA, 229 bp, Homo sapiens
gaggaatgagggcaagcagggcttcctctggcccttcccacagtagttggcagcagttaggctaggatgtgtgggctcctcagagccttttgtttggtttctatggctctaacctcaattagctgctctgcatggagaggagggacaatgcagcttttaacccaagtccaacggcttcaacataggtctctttttcctctccctctatccatggctggatttaggcctg

SEQ ID NO: 36317 - DNA, 451 bp, Homo sapiens
aattctctggattaccaggcagagactgttgttctctgttcatcctttccctcacacaaatggagtctctctctctgtctctgttatgaattacttggactggggggtggaatgacacaagcacccctgtgtccaccttcactagtactgcactgagtcacacctgaagccagcatagcactgggttttgcttaaggcctgttgtaaccactccctggctactgcctatgtttgttttaaggccctgggtctctacaatcagccagtagtgaagccagccaggcctgtgtctttcctttcagggctagaagttctcccaggcggctccagcagtgctttgcaagagccaggggctagaataaaaaatcttagcagtctacctagtcttctattgtactatggctaagctgacactcaaataaaaggttaatttttaagtttggtacttaaa

SEQ ID NO: 36318 - DNA, 187 bp, Homo sapiens
taagctagctttatttttttctgattccagaattcattaaccaaagagtcaatgataattcaatgtatatcaaaagatgaaacactgactggttaataaagataatttggaaacacattattaatatagtttaatatgtatttgaatatttgtattatatttgaatagtttaatgtgaattgaatat

SEQ ID NO: 36319 - DNA, 879 bp, Homo sapiens
tttcaatttgatgattagatatatgtatatgttgtgagatgatttctgcacccaagttagttaccattctgtcacctcactcagttaacatatttttgtgtgtgtggtatgaacatttaaggactactttcttagcacatttcaagggtacagtacaatattgttaagtatagtcaccatactgtacatttgatctccagaatttattcatcttatatctaaaagtgtgtgccctttgaccgacatctcccaatttccctcacacccagcccctagtaatcaccgttctacactgtttctctgagttccattattttagattccaaatataagtgagatcatacctcatttgtctttccctgtctgacatctctcaccttgcataatgccctcgagactcatccatgttgtcacaaatggcaggatttcattcttgtttatggctgattaatatcccattttgtatatatagccaaaacatggaaacaatctaaatgtctgttgacagatgaatggataagtaattgtaacaattactgtcaacagacacaggttgtttccttgtcttggctattgtgaataatgctgcaataaacatgggaatgcagatatccctttgagctactgattttgtccaataaatatatacccagaagtgggattgctggataatatggtggttctattttcattttttttaggaagctccgtactgttttccttaatggttgtgccagtttatgttccaatcaaccatgcacaagaattccattttattcagattttgccaaaaatagttatatcttgtctttttaataaaaaccatcctgacaggtgtgaggcaatagctcattatggttttgatttgcattttcctga

SEQ ID NO: 36320 - DNA, 496 bp, Homo sapiens
caccaaaatgctcattcgatgagatggaaatttcttcttaaatgtctatttctcattttgcagcaaaggcatgattatacttctataaatttttgccttacatagtcagatagaagcatgcaaagtaggcagagcctaggcatctacctgaaagaaatgccctcctgcattttcttgaacatattaactcttcctgagctccagtggcactatctctggagtccttttccggcagataattttaaagcaggcgtcacttgttattttctctctcaaattgccgtgttctttgtcttcacagtacttttgaaaatacttaaatatacatgtgtttcttatgaaactcgtttgcctcactggactttaagatctgtgaggccaattccatgcctgttttattttctactttattgcccctgttccccaggcacaaagcaataagtgcctgacatacatttggctctcaataaatacttgtcatatttgagtgcttgtt

SEQ ID NO: 36321 - DNA, 701 bp, Homo sapiens
gggagtagatctccaaggcttttaaagcatgccacggaggtagacattacctgtagaccaacacttcttaaattttaatgctcatatgactcatttggggaccatgttaaaatatagatgctagctgggcacagtcgcttgcacctgtagtcccagctactcaggaggctggtcgctccctctgcctagatctgctggggcaggtgaagcttggcttttaaattgagagttgaacgataaataagagttcaaaagggcaggtaaagagaattaattctaggctaagaaccacctgtgcaaaggcactagggtagcgagtacagtgccttcaggtgttagatactttactatcattgggtcggaaagaggcagttaccaaagatgaggctggaaaaataggtagggagtagatctccaaggccttttaaagcatgccacggaggtagacattacctgtagaccaacacttcttaaattttaatgctcatatgactcatttggggaccatgttaaaatatagatgctagctgggcacagtcgcttgcacctgtagtcccagctactcaggaggctgaggcaggaggagtgcttgagcccaggagttcaaggctgtattacactatgatcatgcctgtgaatagccactgcactccagcctgggcagcatagataggtctcaggtggggcctgagcgtcagctt

SEQ ID NO: 36322 - DNA, 689 bp, Homo sapiens
taaaaaatgggtaaatcaaagatactgacaccaagagctcagagactgcttgggaaaatagagaataaacagaattatggtacaatgtggtaagtaccataataaaggcacatagtcagaactaggaagcaagaggaaggaaggctttataataggctggtcgctccctctgcctagatctgctggggcaggtgaagcttggcttttaaattgagagttgaacgataaataagagttcaaaagggcaggtaaagagaattaattctaggctaagaaccacctgtgcaaaggcactagggtagcgagtacagtgccttcaggtgttagatactttactatcattgggtcggaaagaggcagttaccaaagatgaggctggaaaaataggtagggagtagatctccaaggccttttaaagcatgccacggaggtagacattacctgtagaccaacacttcttaaattttaatgctcatatgactcatttggggaccatgttaaaatatagatgctagctgggcacagtcgcttgcacctgtagtcccagctactcaggaggctgaggcaggaggagtgcttgagcccaggagttcaaggctgtattacactatgatcatgcctgtgaatagccactgcactccagcctgggcagcatagataggtctcaggtggggcctgagcgtcagctt
